United States Patent 7,214,786 (NUCLEIC ACID MOLECULES AND OTHER MOLECULES ASSOCIATED WITH PLANTS AND USES THEREOF FOR PLANT IMPROVEMENT) - sequence listing, part 3

SEQ ID NO: 5775 - DNA, 432 bp, Triticum aestivum
  unsure (1)..(432): unsure at all n locations
  Clone ID: PAT_TA_5775
ttttttttttttacaataaaantggggtttgtannacatattgcacccaatccaattggaacggnttnccagtgatttcagtattagtgcttgcanctagntagagatttcctcaactgantgntactcattattcacccaccaaagtttgtgcaatgnccacatgcatgcatgcttgtgtatatgtacgtattatatggacaaaaaatagtagagaaaccgtaactcaaaatgcggcgagctcgatcagctgccgccgccgctccggccggccggcgaggccagttagactagtcacgttcgtgtccacggagacccgccgtcgcgtggtgctctactcccacttcctggggtcggtgatgttgatcttccagtgctcgtcggcgtagccgatctcctgggcgacgtgcctgtcccacgcgatctcgacct

SEQ ID NO: 5776 - DNA, 797 bp, Triticum aestivum
  Clone ID: PAT_TA_5776
taggccaggcccgttttcagggagcaacgcttcccgcagccatgtgccctgcgctctgtagttgtcgggacgagaggacggcacacgcaaacaggtgcaaggtgtgctcacctggagggaactggccccgagtgagcggcccactaaaagtggcgcgatgggctctctcttgttgcgaaaaacgatgaccatgtgccctttagcaactcgaagctcacgtacctcttgcagccttgccttggtggggactcgaagacgctcatgttcgtcaacgtctcgcccgaggcgtcctcacccggggagagtctctgctccctgaggttcgcgtcgagggtgaacgcgtgcgagatcggggtggcgagacggcagacacagtccaagtcctcctcggataacggtagcaggctgggctacgggtgaccgctgtcatgcctgttaacggccatcgtggcctggatgttgatgtgatactgctgcataacgagctgctaggctaggcagctccgtgggccaacttggccacgagcgtgctggcgacgcggcgcggctggcctctggtattagcaacatgtacagtcgcgacgcggcgcggctgggcctccgctgtgggcttcagggcaggagagaacctctgcttccagccatgatgattcgtcttctggtgggcgggagagaacctctgcttcctgccacgatgattcgtcttctgtttgtagtcgctgattgatttgagatttattgagtaatgttaactggcgctatattctttctgtgtacttcaagaataatccatgtgc

SEQ ID NO: 5777 - DNA, 446 bp, Triticum aestivum
  unsure (1)..(446): unsure at all n locations
  Clone ID: PAT_TA_5777
ttttttttttttggcaaatagnaaccagngccttgaattgaacaggaatcgggtacattaggcttntacattggagngctaggaaaggtgttagngaataatcggatttcttaaggactttgttatttgtaccagacggaggttaacttaggtctctgtccgttcatggcgcgtcgctgcttcccctaccccccggcccatgttttgaagcttccttccgctggtcacgcctcacactcactccttttgcacatacaccatggccaaattcagtttgtttgacagtcgcatggccaagctcagtttaggattcccgcagccatgtaggactcgacgctgtccttgagcgtctcctccagcgtcctgaacttccaccccagcctccgcagcttctcggagctgaacaccttctgatctcccacctgaacgtacttctttgggtagtt

SEQ ID NO: 5778 - DNA, 800 bp, Triticum aestivum
  unsure (1)..(800): unsure at all n locations
  Clone ID: PAT_TA_5778
acaactacaacggccaacccattccatctgcggccctcaaggcgatcgtcaagcacctagatctggctcctgaagccgtcgaagaagccgccatcgattcgggccgtctcaccggcctcgtcttcgtctctgaaaggcaaacaccacctccaagactcctcagatanggcctgcgcttcgaatgatggcgacgaagtccgggtcctcaacctttgggggacatccaatgggcggcgactttttcagttggtgcccgtctggaggacagcggctgcatcgcaggaggctacgaggtggatggtcacacagctgaccattacctcgtcttcgtgtccacgaaggagcccgtgcaagaacgccgtagcccctggaatgtcgtctacaaaactaatctcagaacaggcgaaactgagcgcctaactccaccagggacgtccgatttaagcccctctgtgtcaccatctgggaagagaatagcagtggcttcgttccaaggaaagaaatgggatggtgaagttaaagacttgctgacaagcatttacgtgatggacctagagagcacatatctggagcgcgagcgggtgatcgagaacgctggctggccatcatggggaagcgaaacagtactgttttcccataaaatggttggggataactggggtgtatttccggtacacttttacaccggtgaaacctccgtnttaccccgggagnatcccatcatnactccagcagcaccgattaagcaaattggntgttggaacanccgccanatnctgtttnaacngantcgtactgaa

SEQ ID NO: 5779 - DNA, 468 bp, Triticum aestivum
  unsure (1)..(468): unsure at all n locations
  Clone ID: PAT_TA_5779
cccccccgtcctccgcttgagcggggccggggcggcctcgccgccccagccgctctgccggccccgcgcctcttgggctggcggccgccccgccaccaacgccgtgctgtacggaggcgcgatgccatgcagctcaccatgtgcatcccatcccagtattgttgctgtttagaataatttccaatgtttttcagaaaaactgatgtaatttgggtgcagtgcagttcagaagcttccattgggtatattttgcagtgcgttgatgcagtccattgggggtgagccctcacagtattcggcatgtgtcgtgcagtgcggtgcngcgcggtcgtgcagtccggtggcggtgcccatgtaagaagtgctgtgagcatttcgtcgcaaatcaacccctcctaatccgttcaagcgccgacggggaccctatctccagctcactgaagtttgttttgcagctagcttgcttgt

SEQ ID NO: 5780 - DNA, 1367 bp, Triticum aestivum
  Clone ID: PAT_TA_5780
gcgcgtctccggctgcgtttcgtcggtgagctgcgagtgctcccgtcatgccgtgggtgtcctcagggccccgggtgggggtatctgggctcaacccatctgggctcgcgctccctggccttccttcggatgctcggtcatgcactagtacttcaagtgaccattcagtaacagatacaggaatatactattcctcaaatgaagatgaatatctcatgcctgaactgtcttggcagaagcatggttctgtgaatgaatttggtgcatttagtcagccagtcaaatataccaccatcggagatgatgatgatctttgtgttgcagtcccttgactccttatcaacagtgagagagaaagatgctggacaacagagacgctaccctgctactgctaattcaaagatcccttgattatcatttacggcccgatcggtttacaatatgtacgattcatgtcctgacgatcgcgtcgatgaatttcgacgcaagatgatctttggtgcactccccatgctggatgatgagagtggattgaatattttgtcgattcttattggaagcaaactacccgtgtcagcgtctatgagaccggaattggttgacattgatggagtatcatatcggttgcagcgagagattcagctactcaaggccttcaatctcgtacgatgtagaaattgcctggctctcatagctagacggagtgacatggtgataccgtctagtgttgaccaatgtggtcctcaggtcatgccgttgttgtacaaaggtgcgcaggaggtgataacagtgcacaacacgtctgggctcgcactccatggcaatccttctgatgctcatagctggttcccaggatatacgtggacgattgcgctgtgtgctgcctgcgagtccaacatcggctggctgttcagggctgacaaaaggaaccttcttccgaaatccttctggggtgtccgcatttcccaaactaaagatggcacacaatcggccaaggaccgatcgtccgtatgaggttgtggtcgtggttctcagcatgattctccttatctttcagctgacccagtaacctatcttcgcccgtgtaaggccgtggtcagcgcgattatcctcatatttcagcagacccagtaacctatcttcgccttcccggaactgcgcaacaaagggtcccttgtgcaatatcaatgtctgctcgtttgagaccacgctggatgtggcctgcgattttgtctagaattcttgctcaagatcagactttgttcagtacacatgctgaatgtggttcgatttcatctagaattcaaatttccaggtcgactttgttcaaaaaaaaaaaaaaaaaaaaaaaaaaaaaaaaaaaaaaa

SEQ ID NO: 5781 - DNA, 1475 bp, Triticum aestivum
  unsure (1)..(1475): unsure at all n locations
  Clone ID: PAT_TA_5781
nnnntnnnnanntannnnganntnncnnanaattnanntnntnnannnannnnnannanntngnnnnaaanntnnnnntaanngnnnggnnnnanggncnnnntantntaaaagnatgntttnnnanncaaatgaaanntngtgntngnaaaaanagnattnccatngatnnaagatnatncggccanttcgggcaattntccntngggngggaaatnntggcacggtggcatcaatctcaataggggggtcttggtggcaacttgatanccgctgccaccaacttgtcaggatctagcggccttgtgaataacaatactggctcctcaggatcccttttaaatacccagccattctgctgaggcctcctttttagcaccggtagccccggctcacgctttatacgcaatgtagggattgccgactgcttgttatcagggtaccgatgatggagaacaggttgccgaaaatatggctcttcagttgcggtgtcatctgaatccgcataatcatcatcacttgacccaaacctgctagaagcttgctggaaccctgacagtgtagtcccatcgtcaacaagctgggcctcatgcttatattgcatctgaacgcgctgaaggttgccctcacattccctggcctcccgctttgtctcttccctcttaatcagagcccccattaatgcctttgcttggtccaaattgcgccgtaccaggcggagtttttcaaacgactggatattattttctcgtctttgcatccttcttgtatgaagacgatgggccttttctcttggtctgaatacattatatgggtttgtatcattcaccggcggaggaggctgcaaacgccgcagaataggcttttgccaccgttccctcttagctctccaatagttatatacagcttggaaaacagcataccgaacagacaaatactgcaaagcctccatagcaacatcgagctgcaagagaactggaacaggtcctatgaaagttggtgttatggctcctgctctttctcgagctttgtggtccaaaatttccaacttgaataagaggacctccaacttttcagggttaagatttttccgctcattgttgtagtcgtcaagccagtcttcatcttcgttatccaagtcatactcaacaaattcaccgatctcagctctggctcctcttcctcgtatataacatgatggttgtgcaaaggtgcgagtgtaatccctatcataggtctccacatcatcaaactgtggtgttggtatttcttgagcattcttcttactgggagttgaatttccctcgccgtcagtcgcagcagcagcggcagtgaggtccgagccggagtgccgcagcagaacccctacccttgccgcggcgaacgctgccaccgtggggtcatcgtcctcgaagtcccgcgccgacttgaggattgggagctttttgtggatgtcgagcggccgcggccggaac

SEQ ID NO: 5782 - DNA, 1065 bp, Triticum aestivum
  Clone ID: PAT_TA_5782
agcgtggtcgcggccgaggtctttgatgcatggcagttcataccaaaggaagcttgccattttaaagggtggagcaactaaattgcttgataaaccaaaacgccgaacaccagcagtttcaggaagaggtgcagcacacggtaaagctcagcgctcaagtaagcatgtccaccagcccggagtgccaccgcgttcgaggcagatctccggcctttgcagcattaacttctgcctttgagaaacctagtaccaggaatctttccacccctccccctgctgttaaaaagcttttccctaaatcaaccggacctgatacgtcgaaagaggcagctatcagtgagctcaccagttctttggagggtcccttgaaaagaacaataccgaagtcagtaaaagcgagccaagaggcagggaaggcaatacaggaggaagatggcgcaggcgacgacgagccagaggatgacgaggggcgtacagtcttcccgtacgaacgcctggtaaccacatccgaggatcctgcgctcgacatcgacatcacccagcgagagatctacttatcgacggccgagttccgcgagaagttgggcatgaaaaggacagcgttctacaagctccccaagtggaagcagaacaagctgaaatctgcagtgcagctcttttagccccgtcgaatgccgaccaattttgcggggttcttctcttcgcctagctcgagtcaattgttttcctaggctctgcttcttcttccagtaaatataggtctttgaggggtgtttttctctactgaatcagagctcaggcaggttctttctgttgtggggctcagcgtttttgtattctttttatttttttataaggttggtcgtttgtgtgcctgccgggcagcagagataagcagggttgaaaatgagttgtagcctggtgcctcagcggttctggtgcgaaacaagggcgcccaaccatatgtacagcagactgttgaacctgctcagtcgccaaattcgttttgtttattgcatcaataaagatttagggcgtgggtagctgccattaatcatcaaaaaa

SEQ ID NO: 5783 - DNA, 748 bp, Triticum aestivum
  Clone ID: PAT_TA_5783
gttctccatggagtagcccaattcaaatccaagaacagcgaattccgaaagtgaactgttgctaacagtaaacagctcctcattttgattcatcacaacatgatcgagcgggcagtatttcgccccagtttcctggtcatgcacaactgaatgccggtggctaaaagttcccctttccacatcctgtccactcagcctaacatggttgccttcaactatgagtgctgcaaaggcaagggcttcggcaacagcccaatcaataccttcaccactctcgatcattgcagcacgctgctcaaaaatcttcttcactgctctgtggggcttgaagctttcaggcagagtagtaattgcttgcccaacacgtttcagtacctccggcttaaccccggtgttgcgaacacgtgaaatttgctcaggtgacttaaagccagtccagtaagccgagagccaatccctcttgttgggaacataatctttgcttttagcgaactcttcattcaggattcggttcactttgtcgtggatcctctgaacatcttctttagtgacttcacctgtttcaagcagtttctgttcataaagcttcaatgaactgggatggttcttaatgacctgatacatctttggctgtgtgaaggatggctcatcaatttcattgtgtccaaaacgacggtagcagatcaggtcgaccaccacatcagaatggaaagtctggcgccactcagccgcaagtgcgcagacacgt

SEQ ID NO: 5784 - DNA, 1167 bp, Triticum aestivum
  Clone ID: PAT_TA_5784
ttttttgttcgttcctggggatctcgtcatcattgcattataataaacttgagcatagattagtttagatacatcactcaactggagggagatttcggcatcatcgaattgataaaactttatcaagggattacatacatgactggacttgaccgagaaaaagaatgaagggccatctggccttttaccccccaatctatctctacttcctagactacacttggcacattgttaacgaacgggattaacactagccgccgggcggttaattaaatacgtgagctgctagcctgctaccaccaccgaaggacgaacgtacctcaacacacaaagcagcaccagccagaggaggcgcctttgcccccctacagcgctgcgacgaccaatcagtagtgattgaacttcctcctgtgccgactgtagtccgagacgtacctgaacgtctgcccgcagtctgcaaccgagcactcgtacgggcgctctcccgtgtggactcttatgtgctcggtctgcgcccacagccacttgaaggtcatcccgcagccctcccaggggcacttgaacggcctctcgtcccggtggacgcactggtggcgcttcaggtacttgtgcgactggaagcgcttgccgcacgactcgtcggtgcagatgttgcgctcgtgggcgcggaggtccgctctgctctcgaatgtcatgtcgcagaagtcaatctcccactgaaataactccaccaccttagacctcttgcccttggtggcggcagcggacggttttgcggtttcaatctgctctgccggctcttcgattactgcacgtttcgtcctgggcctcagcctctcgcacggggcgcgggcaaagctcccaacactttgtgattccctctttcttttttgcttgcgcttgcgtctgacatagcatatgatgctcgttctttttgagcttccaatgcttctagacaatatgtctggttgataagtatttggtgtgcctgaacttttgcctgtctcagataaactgtttgctgaactgtcaagtattcctctgctgttcttcaaaccctggcagttccaggcaccaacttcttcagcgttttcttgtttattttgtatttcagcgttctgaatcctaagcgatccatcagatgccaaattggacaaagtccgtccc

SEQ ID NO: 5785 - DNA, 678 bp, Triticum aestivum
  unsure (1)..(678): unsure at all n locations
  Clone ID: PAT_TA_5785
cccactccgagtgacctgcaccgtgatcttcttcttctccttgtcaaggtccttgaanngnaggattgccggtagtcgcttgtcgcagtgacaaacacaaccagaagaatactagcgacgatgccgaggccatcatgcgcgcccttgggccacccctcggtggcaatgccgacgacgggcgagaagaaggcacatgcagcaaggatcatgagtgtcatgtcgtggagcgcctcccagacaaagacccagaagctgcgggcctccgtctcggcgaatttgttgatgccaaagatctcctgccgggatgcaagcttgtccttggatgtgctgacgccatccgactctgaggtagacacctttgataggaggccctcggtgccgccatgtgctttcagcttcttgatgtcgtggctctcgacaacagagctcagttcctcagcacagatgccgtagcctgctgccttgacggcggcagggactgtgtactcgctctggggagcaagaccatggatgaactgaagtgcagcctttgaaacaagcacggcaacacgcagcttctcctggttggtccgcttcatggcggcggcctcggatcgcttgccgaggttggcggtgaagcggaagcggcgcttggggttcttgacgacgccgacgaccttgcgcggacgcgtgggtcga

SEQ ID NO: 5786 - DNA, 420 bp, Triticum aestivum
  unsure (1)..(420): unsure at all n locations
  Clone ID: PAT_TA_5786
tcgtgtatcgacaagtttcgccgcggcttcttctggcgcggcggggaggaagccgaagtggggcactacctcgttgcctggaacgttgcctgctttccgcatgcatcggggcgcctcggcattcacaacccacggctgctcaataaggctcttgcatcagatgccgctggctcgagaaagtagtccgcgacaagccatagcaagggatgtcaatctccattccccgcgaacaggagngacctgttccttgtccctaggccacagatccaggctatgtttctggcatgattggtggatcagcaggcgtacatctcccaggcggcttctcccccatccaccttgctgccagctctctgaccaagcgccggaggacctgagccacatcttgctgcagcgctccttctcgagggagggtttggt

SEQ ID NO: 5787 - DNA, 476 bp, Triticum aestivum
  unsure (1)..(476): unsure at all n locations
  Clone ID: PAT_TA_5787
cgggcaggtacggtaacaaggaggggggaaagaaccggcggggagctggccggcgacgatgtcgggggatganctcgcaatgggcgtcttggagcagcacaaaatgtngccagancnagatgncaggggggaaggagttgaggatgcatcatgacttcaggntggtcaagagttatgnangntgacagacagacaccttttatagggtcgatcgactatncagaactgctcacactccatcagatagaggctcactgcttacttttattgtccggaccaacaaccaacttctgaattcaccgttggctgcaaattgtttttgagttggctagtnaaacatcaccacatatatacagtctctaaaacctgcacaaggtggttntcttcttttatgtatttgccgtctcttgngcccaagtatcaccacagataaattctctcctcccaaatcggtacctcatgaacacacaagcaga

SEQ ID NO: 5788 - DNA, 673 bp, Triticum aestivum
  Clone ID: PAT_TA_5788
attccgtcggctgcctgccctcgcctgcccctataatcccatttagtaaactcgagaacaatgaacaccttccgcaaaatcagtggaggagccatgctagctaacaaaaaaaaaagaatatacgtcgttcgtgcatggcgccgcctgcatcggatgttctggtagttcatccagcagctaccatctatgtctagacagagcaggaacaggcatggcatagcataaacatccatctacaagaagcggcaaccagcgatcgtcagatgacttgttcctcctaattaacaagcctgaattatcagtcagctaagatgactagacccttgggctgccgccctccttcagcttcacgagcccggccacggcactgatattttcacggctgctcattggggtgctgcccccctcctccctgaccgtgatctgacaattgttaggcaagaaccggttaaactggcggatcagctcggggtgtccttctaatgccttctccgtggcactggccgaataacgaattctacaggtcctgaaaatgcgcaaggaaggtgacaaactccttgtgcttgtcaggttggtctgccaagctgtcgttcacaagcctgacgtacttgccccagtggccggtaccctccagacaacgctggccattgacaatacgcagctttcgtgagcg

SEQ ID NO: 5789 - DNA, 614 bp, Triticum aestivum
  unsure (1)..(614): unsure at all n locations
  Clone ID: PAT_TA_5789
cccaatccgccgacccgtggtcacctccgatccaccaccaacacggctcgagctcttggcggaggaggaggtgtcggcagcttcgtcgtcgcggtcgccaggcagacgcaggcgcgggaagagaggcggagatgagacggccgctcggcgcatgcggcagcagatccagcccggccgctgctttcctcctggccgccgccgcgatctgcgcccagttcgccacaggactagctgatgatgcatctaaagatgagtcaaaaggtcacactggccaaacagttttgtttgtcctgctaggaattggtgcagccggtctgttgtcattcttccttttcaagtattggcagaagaagaaaagagaggagcaacatgcacggctgctgaagttatttgaagaggatgatgacattgaggtcgagcttggccttagagattgataatcttctctgtacagcaaaagtatcttggctgacaaggttttgctggcagatcatcacatcatctttgtgttaatgtaaagaatttgttgtatttaaactcagacagcctaccgaggaaggtctgctgtaccttagttttatatatggtgaatatcttgacattcacgatccana

SEQ ID NO: 5790 - DNA, 1629 bp, Triticum aestivum
  Clone ID: PAT_TA_5790
gttttagactggcaaaaatctagtttagactggcaaaaatctagttgaagataaaaggccaaaacaggtgcttgcctaatgatgatatatggtgtttgggccttggggtacctatgatgtacacaatcattttagtagtttagctacacaaacttcttatgctgactatacaagacattagttaaatattgaaaagttagacattgctcgtagcctcgtattatcatattactcgccaaaacttttggcagatgcaaatattacatgttcaaactaaataattttgtactcgcaaaaaagaactaaataattttgtgattcattgacaacctcctttgattccaagcaacattccttctcgtgtacttgcatgcacgcatgtgaccaataaaatcgatgaggatatttactgtacctgaaatagtggacacctgcttttctgtcatccatctaaaggcataaccggtttgattatcctaaataatggtacatgatgccacacaatttagtcaaaatgtgtgaacttgtcttgcgtttggatcaaacaagcttttacaaccaatatgtcttgaatttagtaacaccaaatctgcagcatgagacatcttttttactcttttttaatactaaagcaaaaacaccggaccgaaggcgaacggcacccaggcctccgacctcacctccgatccaccaccaacacggctcgagctcttggcggaggaggaggtgtcggcagcttcgtcgtcgcggtcgccaggcagacgcaggcgcgggaagagaggcggagatgagacggccgctcggcgcatgcggcagcagatcaccaccaacacgacacgagctcttggcggaggaggagaaggtgtcggcagcttcgtcgtcgcggtcgccaggtagacgcaggcgcggggagagaggcggagatgagacggccgctcggcgcatgcggcagcagatccagcccggccgctgctttcctcctggtcgccgccgcgatctgcgcccagttcgccacaggactagctgatgatgcatctaaagacgagtcaaaaggtcacactggccaaacagttttgtttgtcctgctaggaattggtgcagccggtctgttgtcattcttccttttcaagtattggcagaagaagaaaagagaggaacaacatgcacggctgctgaagttatttgaagaggatgatgacattgaggtcgagcttggtcttagagattgataatcttctctgtacagcaaaagtatcttggctgacaaggttttgctggcatatcatcacatcacctttgtgttaatgtaaagaatttgttgtatttaaactcagacagcctcccgaggaaggtttactgtactttagttttatatatggtgaatatcttgacattcacgatccatgaaaatagctctacaaagtgtcaaggttttcgaaaacattcttttgttgcaaaaaaggttctgatatatatatacacccctctagtaaaaggcataacccagccagtgattcttctactgtagcatgcttcctggctgtattgcatatagcacatgggtgggctctgggttctgtttatgttctgtatgcaacctttcttctgcccaaaactttctggtgtcat

SEQ ID NO: 5791 - DNA, 645 bp, Triticum aestivum
  unsure (1)..(645): unsure at all n locations
  Clone ID: PAT_TA_5791
ctgataggaagactgaaggatatgaacaacctattttgtcgaaaattatttcatccagtcaattccccatgaaggataataggaggaaatgattttttttcccatgcaaagatatagccaatgctgatggcaaggggattatggatggctgccctcctacgaataaccaccgcaaggcggctgcgtcactgctactgtggccgcacatcggctaccagctcgcacgcnaaagctctgtagaagttgaacagttggcaatacatggacattgagcccgtggcaaatctctttctgttcatcatttgttgaccacaaattgcagtcctggatgcatcccagcgaattggcaacacaaaagtntagggttttgcgagctccgcagctagagaaacaagaagagcatcaagatgaccttacttccgaagctgtgcctcaaaaatattgtcgtgatttgatatctctcatgttcttctcacgcgattattccttatattatggtttggtggatagcccaacgccacaacacacctttgaaggaaccatcaggattcagggccatttttgtaagctccgaatcctgantgttcccctaccctgccacactaggtcatgtggtgcccgcttgctcgcatacnctgctctctg

SEQ ID NO: 5792 - DNA, 532 bp, Triticum aestivum
  unsure (1)..(532): unsure at all n locations
  Clone ID: PAT_TA_5792
aatttcagcgactgtcgatgcctttattattggtaantcaantcttcccccaaaggtagtatatgcggcaaatggacagaaaaatccganttgttgaagtgaagtgcatcatgttcccgttgttganccccctccattcggaattagttgtcgcagaaatgaatgtatctagatgtattttagttctaaatacatccatttctgagacaagtaattcagaacgaagggagtacatgtaagcctccaaaattccgcccgggtgtcaggatatagcaaagcaaaaagaatcagcgaagacgaggcaggtgaatcaccggcccccgtccaggcactctctcccgaactgaacattgtagcaatctactcctaggcatgaccagctatctttcgcctctgctggtgctcggcgaccttgtaatctacaacctcgcggaacaggcccggggtcagctcgcactccgtgctcccgtacacagcggcctgcacgctcgccatcanttcgctatctctcttccggagaagccgtcggtct

SEQ ID NO: 5793 - DNA, 1152 bp, Triticum aestivum
  Clone ID: PAT_TA_5793
aagactctgcgcaccgctgtccatgcgatcgttcctataggaaacatgtgtttcgcgaagtacttgatcaataattataccggtctgcaggcggcatagtagtttaattaaaggctctgcccacggtttgcaatccactggaccctcgatcatccatgtgtgagagcgacgttgtcgctcccatcgttcctagtgtacccctgtatatctcaccgttcttgtgctaccataatacctttctcgttacgccgtcgctcaataattacatacatcttcgtgttcctggttatgttattgggggttcctgcctcacttttgtcttatcattacttacgacggcattcgcattcggtccttgtttagttgtcggcgttttccttctgattacgcgtgtacgtgctttttgttcctttttttttgcagtactattgggttccctttttttttttgtttcttttcttccggatttctgtcttgttctttgtcttcttgtacgaactagtactttatttatttgcattacgcctacactttatagtccttggactataaatcctccttcagtagtagatccaggggatgttgttggtcagccggagaacacttgtcagttactcgatgccactacgattgtagtcgtccttatcatgtttttgttccttcgtcatggcttaacttgagtcgagcttgtaattatacttctatgccgtaccggtttataattattcgaataaaaaccaatcgattctagtaaatttccggtatttgcgcagacagtagcggctccggtctgaattagtaggggctcctagtagactggaacccctttgaataggctttcctggccgtattggatcatctcgtttttgggtattcatgaatagccgcataccacaatttatcttacgtatttggtttcctcaggatatcatgacccggataccggactatatttgagcataatatcggccatataataaagaggagaaggctatatcaaccttttggctctggattcctttttgctttttatgttgggtatgggtggttggttgggtgtatctaggtataatgggtttagtccatgtgcccgtaaaaatgttgggcaaaggttcgggcaggtggctaactgtactttccccccggacgcaa

SEQ ID NO: 5794 - DNA, 662 bp, Triticum aestivum
  Clone ID: PAT_TA_5794
cagacgacaagctgctgctgtactgagagaagccagagtcaccgaatcgctcggtttcttctgcctctggacccttggcaagacgatggccctcactgctcgctgaaccagatcgagtctcagcttcctcggcctgctcctgctcatccggtgcattggcacttgtggcaacctgagcttgcttcttcctcatggagagggcggctatgccggctgaaagaatgaccacgacaatggcaacacctgctgcggcggcgggctttgagattctgtccaagtagcttggcgacaggctggagtccgactcaagaccaagatgcggcggctccttgccctcctccttgccactgccgtggttctcctcgggctcttcactctcaacatcctgctcgcgcagctcagcaggttcagacggggtgcccaaatcctgactgatctcttcgccgttgctgctacctggagctgcttctgatgccccctcatctactgccttggagtagtctgatgcatcagattcttcttctaccactgcagcaacaccctctgattctgcaatcaagcgggcgcgtcgtgcttcagaaactgcatcctggatcttcaactgctcctccaggacatcatagctgctacctggagcttcttctgacattcccacatcaagc

SEQ ID NO: 5795 - DNA, 704 bp, Triticum aestivum
  unsure (1)..(704): unsure at all n locations
  Clone ID: PAT_TA_5795
gccggccgggcttcgacccaccgggcaatctccagtcaagcaatcctcgcacatctctccacctcccgaatcctctctcccccaccagcgcggcagctcgccatggacgcctcagccaccgtagccgccgggaaggcgaagaagggcgcggccgggcgcaaggccggaggccccaggaagaagtccgtggcgcggtccgtcaaggccgggctccagttccccgtcggccgcatcgggcgcttcctcaagaagggccgctacgcccagcgcgtcggctccggcgctcccgtctacctcgcggccgtcctcgagtacctcgccgccgagctgctggagctcgcgggcaacgccgccaaggacaacaagaagagccgcatcatcccccgccacctgctgctcgccgtcaggaacgaccaggagctcggcaggctgctcgccggcgtcaccatcgcccacggcggcgtgatccccaacatcaacccggtgctgctgcccaagaagaccgccgagaagtcccccaaggagcccaagtcgcccaagaagaccgccaagtcccccaagaaggcgtaggcacccattgcctagataggtcggagtagccgggatggatggtatggngtgtgcnttccgctcgaagcacactgttcttgtcgtgtcgttgtatcttctgatctgtgattcaatggaacgatgagttgctttga

SEQ ID NO: 5796 - DNA, 2156 bp, Triticum aestivum
  Clone ID: PAT_TA_5796
gcggacctcgcaacctaaaccgcaaaacccttttccctcctccccccttcccctctcggcctcttccttctcgcgccgcccagatctctcgcctcactccaaaccctagctccgcctccgcgcagccatcagccatgtcgtcgatgatgcaaccgcagatcatcctgctcaaggaggggacggacacgtcccagggccgcgcacaggtggtcagcaacatcagcgcgtgcacggcggtggccgacacggtgcggaccaccctggggccccgcgggatggacaagctcatccacgacgacaagggcaccaccatctccaacgacggcgccaccatcatgcgcctcctcgacatcgtgcaccccgccgccaagatcctcgtcgacatcgccaagtctcaggactccgaggttggtgatggcacaactacagtggtgcttcttgctgcagaattcatgaaggaagctaaaccttacgtggaggatggagtacattgtcataatataatccgtagttataggagcgctggcaatatggcgattgaaagggttaaagagctggcagtcagcatagaaggaaaaagcctggaagaaaagaaatcattgttagcaaagtgtgctgctacaacactctcgtcgaaattgataagcggagagaaagagttctttgcttctatggttgtggatgctgtccttgctattggtcatgatgacagacttaaccttattggaattaagaaggttcctggaggtaccatgagagattccttccttgtcaatggtgttgctttcaagaagacattttcctatgctggatttgagcaacaaccaaagaaattcctgaatccaaagattcttttgttgaacattgagctagagttgaagtctgagaaagaaaacgcagagatcagattatcagaccctctgcagtaccaatcaattgttgatgctgaatggaacattatttatgacaagctggacaagtgtgttcaaagtggcgcaaaaatagttctgtcgcggctagctatcggtgatcttgcaacacagtatttcgcggatagagacattttctgtgctggtcgggtcacagaagaggatttacaacgcctgagctcagctacaggtggaactgttcaaacctctgtcaacaatgtcattgatgaggtccttggcacatgtgagatttttgaggaaaagcaagtaggcaatgaaaggtttaacatatttagtggctgcccttctggtcagacagcaactattgttcttcgtggtggtgctgaccagttcatagaggaagctgaaagaagtctccatgatgccatcatgattgtgaggagagctgttaggaattcaacagtcgtgcctggtggtggtgccattgatatggagataagcaagcatctccgcctgcatgcacggagcatagctggaaagtctcaggtttttgtaaactcatttgctaaagcccttgaggttattcctaggcaactttgtgataatgctggatttgacgcaactgatgtgctcaataagctcagacagaagcatgcagctgatggtggtgctaattatggtgttgacatcaacactggtggaattgcggattcctttgctaactttgtgtgggaacctgcagtcgtgaagatcaatgcaattaatgcagcgaccgaagctgcctgccttattctgagtgttgacgaaacagtgaaaaacccaaagtcggagagtgcgcaaggtgacgctgctgcgatgggtggccgtggtggagggggaatgcgtggtcgaggcggcaggggaatgcgcaggcggtaaattctagtcagctccgccctgtaaccttatgctgccctggcggggtcagattttgagttccctctgttcgggctgttggtcctggcattacccgcatccaggttttgcggaatttgtatgtctgatgtgagagtttctagtgttaagaatgtgctagccttttgtttgagaacatggaagacatggcaggcgtgtgtttatctagcggttaccggttgtggtattatagcacgaactatgttcttgttttggtgattcgtcttgcctattggtctatattatgttcgcgagatcttgattgcctcgctggttgagaactaactttgctaactttaactctctgatgtt

SEQ ID NO: 5797 - DNA, 661 bp, Triticum aestivum
  unsure (1)..(661): unsure at all n locations
  Clone ID: PAT_TA_5797
actagccgttgtcttttaaccggagcccgtatcatcgctgggcacctacatcaacaagaccgtgtgttgcttcttctttggacgcctaattccaaacccaagttcccaggaatacatgttgtgatagtcatatgcttctccaagcgaatcaaagttgtttccgactgtaggaactacgacagtgtcagtcttcttctatgcacaacctgtcaatgttttctccagggcacttattctgccatcaaagtggacgttcaacaggtgtatgcctcactcggacctcttcgtccagcccggtgcctgaggaccatccttcccgattgactcctctgagttgggcgccgacaaactcagcccctcacaagtgatgttcaaatctaactgtagtgtgaccaccgcggcgcccacatcaccaattctggactgggcggttgtgcgaaccagagtttgggtggcttcagcgtcaagtatgggactcgccgccgccaagatccggcaggggaaacctgtcgaccggatctgaccagaactagaatcaatcgcctccggcctccgccctccgccatcgccatggatccgaaggattagttttttttttcaaaagggattttttccatgtaggcgatntgcctcgtgcggcggctgatgggatagatttttt

SEQ ID NO: 5798 - DNA, 1048 bp, Triticum aestivum
  Clone ID: PAT_TA_5798
gcggacactaccctgtccagcaaacgcacttgtttcggcggcggcggcgcgaagacagagccggtcggacgagggtttaagccatggcggccgaggaccagatcccgcgagcgcaagccaaccccgagaagaccaagaagcggaagaagcccaagaaggacaagtggggccagcccatcgccgccgcggccgacgagccggccgtcgagcaggtgcaggagcaagaggcacctgaggagcctgccgcaacggcggcggcgggggcggagggggtcggggagggcgcggagagctatgagcgcggcaaggtggtggcgagcggcatgccgtacacgaccaccgaggaagagatccgggagctgttcgaccagttcggccccatccgctccctccagctctcccgcttcccggactccggcaacttccgcggcctcgccttcgtcaccttcgagtcagatgaagttgccatgaaatctctggagcttgatggatccaaaatcggtaacaggtttatgagggtcgaaagatgcagggtaactgctagctcgaagaggcaaaagaagacagagttccaatccgatcctgagaagcctgatggctgcctctcagcttatgtcggcaatctctcatggaacatcaccgagaaggacttgagggatttcttcaaatcatcaaggattgcatcaataagatttgccatcgacaatcgaaccggagattctcgtggtttctgccatgttgatttcgaggacgatgaatcgctcgagaaagctgttgggatgaatcaatctgaactgcggggaagacctgtgaagatagcgtatgctatcatcaacagggcttgaaggctggctagctggtgctcaacatttcgcattattgagctagtgagattcagttgtaaggtcttgcccccttcactgtttccattatgtttctatagaccaaacatgccatatattggccagaagtaatgatcgtgtaacaaatacttttgggctgcatcttatcaatctatcttaaaaatcatgctgctcgttgttctgtc

SEQ ID NO: 5799 - DNA, 356 bp, Triticum aestivum
  Clone ID: PAT_TA_5799
cgggtcgaccggtacgacgacgaggaagagtagattggtgggtgtctcaagatatctgcacttccagatgtgctccctttaaagcagtatctgttgtcttcccaatattgttgactagaaagtaagtagggcaacaagtaggagaatttaacttggctgtgttttcaaaagaagctggcgcacctgaaagctgattttgcatgtttttccccatgcatgtatgtaagcttccaataaggaaccaacccatgatcttattggtgatagcattatcatcactaggtaaggtttatgatgtggtgctcatttgctttgtcagaatgaatccattgtgaaagagatttgcaaaacaaaaa

SEQ ID NO: 5800 - DNA, 421 bp, Triticum aestivum
  Clone ID: PAT_TA_5800
ccgctcgagcggcgggcgggagtcgggttctgcagtcggtcgaagagagcggcggcgcggcggcggcgtggtgggagaagagccagcgagcgcgaggtacaggttcgccgagggagaggggaagaggagctccgggcaagatgccgctgtacgactgcatgctcatggtgaagccgctggtgaccaaggaggccatcgcggagctcgtggcgcgggtggcggcgcgcgcctaccagcgcaacggcgtcgtcaccgagctcaaatcctttggtaaagtgcacctcggctacggcatcaggaagctcgacggccgccactttcagggtcaacttttgcaaatgaccatgatggtttcacctttctttactcaagaactgcactatctaaacaaggaggaccgtctgcttcgctggttggtggt

SEQ ID NO: 5801 - DNA, 1058 bp, Triticum aestivum
  Clone ID: PAT_TA_5801
tcggcgccgcgtctgcctgctgcgggtccccgagattgtcgaagagagcggcggcgcggcggcggcgtggtgggagaagagccagcgagcgcgaagaacggcggcgcggcgggagcgtgggagggggacgaggcagcaagcggcaggtacaggctcgccgagggagagggaaagaggagctccgggcaagatgccgctgtacgactgcatgctcatggtcaagccgctggtgaccaaggaggccatcgcggagctcgtggcgcgggtggcggcgcgcagcctaccagcgcaacggggtcgtcaccgagctcaaatccttcggcaaagtgcacctctggctacggcatcaatgaagcttcgacggccgccacttccagaggtccaacttttcgaaaaatggaccatgatcgttccaccttcctgtttgtcaagcacggagtggcactatcttaactcgaaggacggacacgcgggcttcgctggttggtggtgaagcacagagatgcggtgtatggtctggagttcatcaacgaggatgacgggaggtaagagatggacggtttccgtcgtgaaagtaatagtactcaagatgacgaggatgttgatgaatatgacgacgactacgacgatgacgagtacgatgactaggaagagtagattggtgtctcaagatctctcacaaactctatgtgttgtttgcacgatactgtcgactataaagtagggcaaaaattagagccattggactttgctgtttctcgaaagaacctagcgcacttgaaatctgactttgcatgtttttcccatgtaagcttccaataaggaacccatgatctgattggtacgctatcatcgcttggtcgatcatgcttgtcattagatgtttcaggcgtgctctgcttcttggttggaagcatggtgtataacgtcgttctacggctgctgacagtcactaccaggttctacagcagtttgaatgtttgatccattcatagtattatcatcactaggtaaggtttatgatgtggtgcttaaaaaaaaagaagaatttacaacac

SEQ ID NO: 5802 - DNA, 688 bp, Triticum aestivum
  unsure (1)..(688): unsure at all n locations
  Clone ID: PAT_TA_5802
cggcgatgatgtcgataaactgccgaatggatccaaagattcctcgctcggaggtgctgatggtggaggcgactgacggtgccggccgtgaagaggaagctgcggtggaaccagagcatgatggtgccagacatgaagatgaagaggcagagtatgagtatgaggaggttgtggaatcagatgatcatggtgaagatgatgatggtgtcacctatgaatatgaagagatggaaacagaggacaatggtcaggacgatgaggctgctgctgttgctggcttgaatgatgctgatgctgatgctgccgaaataaatgccagccaccaactgtccatggtggatgttcatccatcacagcctgatgaggaaccggggcacacgcagccccagctcagcgacgtcgaggaggacacggaggcgggcgttgcgcgtgtggatgcatgcctgattgaaccagtggctgacaacagtggttgttctgaagttagaggtgaaacggaggctccgcaaagtcaacctgaaactggacttcaagttagaggtgaaagggaggctctgcagagtgaacttggaactgaacttcaagttagaaatgaaatggcggttctgcagagtgaacctgaaactgaaattcaagttgcagctgaaatagtgntccgcagagtgaacttgaaactgaactncaaggt

SEQ ID NO: 5803 - DNA, 726 bp, Triticum aestivum
  unsure (1)..(726): unsure at all n locations
  Clone ID: PAT_TA_5803
tctctccttgtgagcaccgagaacgaagcctttgctgccaccttcacctttgacacggtaaaaagttcatggaaacaacttggcaagtgggtgctgcctttcgagggtcgtggtcacttcgaccctctcctgggcgcatttgttgggctctcgaaagacccagacaccctcggccaactcatttgctgctacatgcacacctccgacactggccacacccttgagttgaagctcagcaaggagaagctgttcagcgaggacccagccttgaggcacataggcgccacccttgtgtacatggaaagccagagcaaattctgcctcgtagaatgtgtctccattgttgacgacagtgctgatcaggagctcaaggaagaggaagacctgccccaatctggctgctgtctttgttgtttgactacattctatctctgtcatgacatgaatggagacccgacgaccggcaggagctgtatggtgcagtactacgaagtgcctagagcaacctctatgttgttcctccaagatcctgttgcattttggatgtaaaatgctaaaatcatgttatgatgaccgagttcctatgtttatttttcactcagttgtgactgctgcatttctatgttttaataatgtgtttactcgtctgtgattcagctaatgtatcaccacctctgtaacttcatttgttttatgtctanagtaagcaacaagaaagattctatg

SEQ ID NO: 5804 - DNA, 1581 bp, Triticum aestivum
  Clone ID: PAT_TA_5804
gccgcctgcagcgccccccccgacccccgtacgagtaacggcacccctccaaccgccaaccctgatccccatcgcggcgtcggcgccgccggcggcgccgccagagatagcgacccagatcgagcttcccatcgtagacctcaccgacgccgcggaggatgacgctgcaccagaccgcgccgcgcccgcgcccgcgcacctagaggtggcagaagcggtaggcgacgccgaaggggaccacgaggggacggacgaggcggacgaggccagcgcggcgggcaacgacgccgaggagagccccacgccaccccgcgtcggaggcaacgtcccagatgccgaccagatgggtaagcccaccgagatgcccgacgggccaggcgcggcaatggccgagggcgaggcagatgcggtcgtggctcctcctggcgagccgcaggcacagtcagcgaggaggccatacgcagcaccgtccatcacagccggcatacggcgatcaggtcagctcaagaggacgccagctatagtcgacagggagaacgagttggtccaaaaccaaggtcgtgcctatcaaaagtaaggacagaattaccccccgagacctggtaatcatgactgtggtcacgcaacacaagccacaggctacagatactctcacaataaacaatcttcgcccccacagaactgtagcccagaatagggagattctacgtgcagtgctcccgctccagccgagtagtactatgggcagccaccagccggtccgcagcaaggttaccctcaacagccagatccttatgctagacctccttatggtggacctggacaatggccaacaagaggcagtgcacctgcatatggtgcttacctggcaccaccccctgcatcttatgctccgccagcccagcaacctcctgcttatggtcaaacatacccaactggacctgatgggtatgctcagcagggttactcacagcagggtgggcaagggccagcagcatatggtcagagtgctccggcaggaccagggtacagtcagcagggcggctatgcgcagtatcctgcgtcgcagccagcatacggtgatcagtcagctcaaaacaacgcaaactatggctatcagggagccccagctgatcccagctatggaaatgcctacccacagtcaggatatgctgctgcaccgacaactggtcagcctggatatggtcaggcaggatacacccagccaccagctacaaacccaccaagttatgatcagtctgcgccaccggcagctcaaagtggctatgctgcacctgctgcaaacccacagcctgcggttgcaaagggcgtgtcgcctcagcctgctactgctgctggatacggcgggcagtggactgcatgacttctgttctgaagccccgctgaaagcaagatatatttgagagctatatgttttgtcgcctgctgttttaaatctttgggatgaggcttgccgtctaaaagtttatactctctgtagtactagtagattgttatgttaactttgaacttttgagttgaaaagagaacctggttagcttaaaaaaaaaaaaaaaaaaa

SEQ ID NO: 5805 - DNA, 380 bp, Triticum aestivum
  Clone ID: PAT_TA_5805
acaagacttatgcttaatcatacggagcccgttgccgttgccgctttctttgccgctatcgccgccactttctttgccagacaacacttacaacccactgaatacaacaattgactcgccaactggacctgattgtctatccatcaaacagttgttcatgtcttcatagaagttggtgatgcaaaatctaccagaaccaaaactggtaatgttgctggaaccataggatgacgggtgccattcctccggcagatctggatccctccaaacatagcgctgcttcggctcatgccctctaaggacaggggagagatcagccgcacacgggagctcaggattaccagcagagaggccaaaccagaggttgagctcagggatgt

SEQ ID NO: 5806 - DNA, 606 bp, Triticum aestivum
  unsure (1)..(606): unsure at all n locations
  Clone ID: PAT_TA_5806
ccaangtgttccaccccaacatcaacagcaacggcaacttctgcctcgacatcctcaaggaccagtggagccccgccctcaccatttccaaggttctgctgtcgatatgctcgctgctgacggaccccaacccggacgacccgctggtgccggagatcgcgcacatgtgcaaggccgaccggaccaggtacgagtccacggccaggggctggacgcacaagtacgccatgggatagataatgaagagcttcagctcgatcgagcttgaagatgtggaaaccatgtaccgatgaataataatcaatcaaccttttgcttcaaattatactagctgatgctgagtatgaacttaatcaccgtcagtcctctcccgtgcgaagggttgttcgcacaagtgacacgcagagagcatacactcacccctataaatttagaaaaatacgagcaccagtgtcaagtctaggacattaactctgttggcctagggatacaattgtcattctaaccatccaaccacatgatggtttgcgttccacatgtactgattgcaataaaaattaattattgctcaaaaaaaaaaaaaaaaaaaaaaaaaaaaaaaaaaaa

SEQ ID NO: 5807 - DNA, 1783 bp, Triticum aestivum
  unsure (1)..(1783): unsure at all n locations
  Clone ID: PAT_TA_5807
ccgccttcccgcgcccgccccactcctttcgccccaaaccccctccacccgccgcattcccatggctaccaccgccgcggctgccgccgccgccgccgccaccgcctccacccgggcaaacagcctctcccgcatcttctcctcctcctcgccaatcgtacaaccacccaagcgcaatcccaagaccaagagcgcgccgaagccgaagccgacgccgaaaccgcccgccgccgatgccgtctccatcgcggacgagaagcccccgaagcccctcggcgcacagcccgccgccaaaggtgattccgacgggaagcacaagctcccgaagccccttgggctgcccgcccgcgcccgcggccggcaccgcgtccccgacgtagcggtcagccgcctcacttcccttggccgccaagacggcatcaaggccatcatcgaagcgcagatgcccttcctcgaggcctcagacgaggggttcgccacgcgcctcatccgcctctacgtgccgtgcctccatgccatcccacgctgccgcaaccttccatgaacttcccacgcagcataaatccaccatgacattcaacgcccttcttgcagcgtatgcagaagccggggatttcgacgggctcactgctgcattccaggagatcccagccacccacccctcggttgttcccagcgtatactcttacaacatactcatccgctcattgtgccagaagcctgacctctcagctgctcttgatgttgttcttctcatggagaagcacggtgtttcagctgacattattactttcaacactctgttgaatgggttttgtaacaatggccccacggatgaagcagagacagtatgggagatgatgaaggagaggaatttggagccagatgcaaagtgctacaatgccaagctgcggggtttggttgcagaagggaggactgatgatgcagctgccgtgcttgagaggttggagaaggacgggccaaaacccgatacagtatcctacaatgagttgattcgaggatatttgaaagcagggaggttacaggaggccaagaagctgtatgatgatttgggaaaaaatcactgtgccgcaaataagggaacatatgagactctcgtgccacaccttgtgcaggctggagacctggattgtgcactgaggtactgctatgaaatgtttagtagtaaaaggagcagtagagtggagtgtggtgtgctgcaggatgtagtgaatgcattggtagatgcatcgagggtggaggaggctgccaagcttgttgatatcgggcggaagaagtactactactcacgaaagggtttgaggatgccaggtagtgcaaaaggcagtgaattaagagctgaaactgatgaggaagaagcaatatcagaagaaaaggagtgtgaagtggaagacgagactgaaaagtaaaattcataggtcaggctttgactgatgcatgccaaatttcaccatgacttgttttactcagtttctctgtttgcatgatagaacaagaagtgcaagttaaagtagtggtttaactagttcaataaggtattggtttagcttgccctgtgctgtgatgcttgttgaaaatctttctatccgttttagaagagatccacaggaagtctttattcttatctgccatgacttgcttgtgctgattttcctcgttgcatccatttatttgtatggatctaatatttgtgtctggaaacatcctccaaaagtattgtactttatggatactttatttttctggacattgcnattcaact

SEQ ID NO: 5808 - DNA, 1140 bp, Triticum aestivum
  Clone ID: PAT_TA_5808
cggacatcccccctcgcccccgccccgacgtcacgccgccctgacaccccacccgaaccctcggcactccctctctcgccgccgctgacccctccgccgatctccccgccgccgacgaggatgtctcgccgctacgacagccgcaccacgatcttctcgccggagggccgggctgtaccaggtggagtacgcgatggaggcgatcgggaacgccgggtcggcgctcgggatcctggcggtcggacggcgtcgtcctcgtcggcgagaagaaggtcacctccaagctgctccagtcctcccgatccgcggagaagatgtacaagatcgactcccacctcgcctgcgccgtcgccgggatcatgtccgacgccaacatcctcatcaacaccgcccgcctccacgcccagcgctacgcgctctcctaccaggagcccatccccgtcgagcagctcgtccagtccctctgcgacaccaagcagggctacacccagttcgggggcctccgccccttcggcgtctccttcctcttcgcggggtgggacaagaaccacggcttccagctctacatgagcgacccctcgggcaactacggcggctggaaggccgccgccgtcggggccaacagccaggccgcccagtccatgctcaagcaggactacaaggacggcatgacccgcgaggaggccgtcgcccttgccctcaaggtcctcagcaagaccatggattccactagtttgactgccgataagctggagctggccgaggtcttcgtgcagcccggcactggggaggtgcagtaccaggtgtgctctcctgatgccatggggaagctgcttgccaaggctgggcttacgcagcctgcgcctgaggcctgatgtgctggtttgctgtggcttgcgatgcctactactcttagaccgcttaatcagttatgtttctgttgttttaagccaaactatttgacaattatgcattttaattttatgtcgaacatgcttcaaattttctttatctgttggtttatcgtatgtaaggtgaaaattgtgatccttattccccatgcttgattgttattgtgactaatgcgcttatagaaaactgcagcgaaacctatgtgtttgaccatgttctcatcaagtg

SEQ ID NO: 5809 - DNA, 740 bp, Triticum aestivum
  Clone ID: PAT_TA_5809
ggcaccccaccgatgcgcctccttgctttccaagtaccggccagtcaaggtacctcgccactatctcaagaattacagcaggcctctcaggccctggacccagcttaatacaacgctgttacagaaattgtcacatatagactagtttaagaatttattataggaaaaaaaatgtacatcatgtttcgacccgaaaaaggcatggaatctctgaggggggaggccagccaaacaggccagcagagtatgcacactcatggctgtcaccttgtttcctcctgacctctctgccgggccgccgccggcccgacaggccagcagagtatgaacactcatggctgcgatatttttttttgacctttataccagtccaccgcccgctgggctgcggggcctgcgtccccgcccggccggtcgcccccagctaaccatgcccctttcatcagcttctaagccaacagagtcgggttttgagggtgggtgggctcgcctcggcttctatctctacggtagctggctggtctttgcggcgcttgctgccgcgtgtccgccccccgcgcgccccccccgctgctcccgtctccccggttcctcccgcgtcctggccgggccccccacctcgcggtcgcccccctcgcgctcgcctggttaaactcgactcccatcatccaccagatgcctgctggaagtcccgcttctgccgtcgcttcctttgcggtcctctttttggctggacagca

SEQ ID NO: 5810 - DNA, 658 bp, Triticum aestivum
  Clone ID: PAT_TA_5810
tcgaccacgcgtgcgcggacgcgtgggcaaaatgtgcctgagagctcgaatgcaaaatcatggtggcgagtatctgtggcttcacctaaactacgggatcgaacactgttgagcccgaagagggggatcttttattgtgtcctgtatttacaccctggtgattatcatcgagtacactctcctgttgattggagtattttcaaacgtcgacatttctcaggcaatctttttttaacaaatgaacgtgccgtgcggactatcagaaacttatatgtcgagaatgaaagggtggtacttgagggtcaatggaaagaaggttttgttgcaattgcttagtgttgccactaacgttggctccattaaactgctcatcgaaccggctgatgacaaacggtccagggtcaatgatactttactcccagccttacgacgagcgattactgaatgcactggcatgatggtttaaaagggaagaggtagcaattccatggggtcgaagggtttgttgcaattgcagccgttggtgctactaatgttggctccatcaaactgctcattgtaccggatctgatgacaaacaatccatggtgcatggcactttactcccagtcttacgatgagcgcgtctataacctgagagcaccgcatgatggttaaa

SEQ ID NO: 5811 - DNA, 840 bp, Triticum aestivum
  unsure (1)..(840): unsure at all n locations
  Clone ID: PAT_TA_5811
cggacgcgtgggcggacgcgtgggggcctatcgatccagatccaaattgcctggtgagtcctgtcgatgggaaagttttgcggcttggacagctcaggggtccaggaaccatgattgagcaagtcaaaggcttttcttatcctgtttcttctcttcttggtgctagttcatcgcttcatgatgccacagaagaagatatttctggagagccaacagaacaaaatgtgcctgagagctcgaatgcaaaatcatggtggcgagtatctgtggcttcacctaaacttcgggatcgaacactgctgagcccgaagagggggatcttttattgtgtcctgtctttacaccctgttgattatcattgaggaaacggcaagcatcatagaaaccttcggttgtagggatgttttgcccaccttttgggaatttggccttcctgagtgttgcaactaccatgcctgttagaaccctttcacgactgcactttatatcctgaatgtatttgctgccctgttaattggatgctccaaagtgcatatatgaatccatgtttgatttacgtcatgcacttatttccagtataccnttcacttgaaattgcttagtacatcatgggcccgttctgtgggaatgccaagacatcgtgttttgtcagaaatcggctcantgtcattcanatccacaacaaaacttttccgcattgtcaatttttttaaactattccctttggacttttgcctcagtagtgtacgtaagccnccaaagtacgattgccattacaangntactcanccgtaaccaagggntttatggccgtancggtaacataaccccgtntggatt

SEQ ID NO: 5812 - DNA, 984 bp, Triticum aestivum
  Clone ID: PAT_TA_5812
ggtgcagaccagcatgccctctgatggacggcacttgcatgccacaccaaatgtctcgctccaccacttggacgtggccttggccaccggaggccgctgcagtagggacgcttccaggttgacttcgcctttttcacagacgccgcgccccgccccgcttggatatccacggaacggggggactgcgggaagaacttcagtgtatttgttagctgccgctggaggctgtcttccccacccgctgtattccagccctgacccgcacacctgcgtcgggccgatgatgtgttggcatcttgttggcagaagtcacagtcacggtgaactgggcacctcgctggaagcgaaacgcaaagccagccttcaggattgcatcgatctaacttgtagccgatcccgtaggagtaacgcaacacatggctgctggctttgctttctacgattgtacgcaccaggaattgagatttgctctgcaccgggcacctctcatggcaccacccaacatgtcttatggtccaggatggtgtaggctgagctaaatcacacaacaaacgaacctctgatgggacagctcctagcattggtacacttttaagacagagctcatgcaccctcacacgttcctttgggacaccagagagaccctggagaagaacctccagagcttcaacatgctgggtctcgatgatgccctgcaccacgcactccatcagccaggggcggatctagacggcgtgccgaaattgtgaaggtcagtgggatttcactactagctggatggagacaacctcagatgtcaatcccaatggtcaaagactgggacgggttggagacagcaggaacgcgatgtcgcggcgaggaagaacggagatggcggtggggggcgggaggcggaggtgttggtcgtggggacgggggcgggagcgcggcgtcgccggccgctgttagggcacgacggggttgactcggaagggagaagccgag

SEQ ID NO: 5813 - DNA, 759 bp, Triticum aestivum
  unsure (1)..(759): unsure at all n locations
  Clone ID: PAT_TA_5813
acatcctangaccgccaatncatcgcaagcatccngttaaagccaaanaaaatccatggcccaagcttcaagcagggcgttanangtgcattgaaatcatgcactaaatttcanccatccagatcattttgtatgangcnaccactggaaatgggtacccaccctatgtcgcgtctaaggacatgaaagaacatcatttgagaggccaccaccacctccttgccggcgggggcggcgtgaggatgtcgatcatcgtctccttctcccttggagtcaggggaacccctcggacgaggttcagagccatgatgtgaacgttggtcctttgcctgtgcttttggtaagcccacacaccagctgctacgccgcccacaatgaccggtgataaccatatggcagcagtttgaagatcaaatttaggggcatatagaactgtttctccaaagtcttcttctagttttttgtatatctccttatcactctttccagattttatttcatcacgaattaaccttctaaggagaactgcaacatctgcttgcgaatcttcaatggactggctgccacactcagtgcaccgtacattgtggctaatatttcttgcacggtcttcaacaacctgccgctgcttcacatcctccgcactagccatggtacaagataatgttatctgtattaaccagtacaggttgttcatagagcaaagaacaaataactgtggcgcaccagaatgatggttgtgacctcacctctctgctc

SEQ ID NO: 5814 - DNA, 665 bp, Triticum aestivum
  unsure (1)..(665): unsure at all n locations
  Clone ID: PAT_TA_5814
cacagggaactnntgcgggacattgnnacgcgccnatntggagatnncctgtgggtttgtgacactgaantgtngatcgccgggacgcccggccgccgaggtctggaaggagctgtggccgacggacaggcggcggcagagggaattcttctgcttcggcatggacgtcctgctcaagttgcacctccaaggtacacgacggttcttcaacgcattcttcgacctcgagccgcactactggcacggcttcctctcgtcgaggctgttcctgcctgagctcttgatgtttgggctctcgctgttcgcgcacgcttccaacacgtccaagctggagatcatggccaagggcaccgtgcctcttgccaagatggtcggcaacttgatacaggacaaggataggtgatgacttagagggtatgtatgtacctgcatttctcatctcaagatcttcatggggtctttgattttggcatagctttttctcaaatgtatctatgattggcaaagaggatttaaatagcactgctagcaacagcagcttaggacctccagagagatgtaacaattcttgctgctgctacgttattgagatgtatagttcatatactgaggtatcgatccatgtattatatgtcaacatggtggacaaaaaaaaaaaaaaaaaa

SEQ ID NO: 5815 - DNA, 1036 bp, Triticum aestivum
  Clone ID: PAT_TA_5815
gttctttcctcctccacacttccctcattttttcgcgacaccttgtgacgattataatgtgccctaaacagtgatgagacaataaacagataactcttgttacaactgttgccgcacatttgtaacaaaaataataaggcctgttaatatattaagtaggactcgaattgtgaagcgtcttcataacatgtgaggccatacattaatttgcaggcgcacctcctgttgcctctgatccttgttcagatagtacttcagcctcaactgcagttcgttgcttccacgctcggcctctgctccccgccccctcgtcgccgttctccttctccccgccttgcactggggttcccccccccccacgggccctactcctctccggcacttcgcccaccttcagggcctcaagcttctctgcggtatccctcctccctgcccccctacccgcaagcacttcctcccgtgggcgggctgccccaaacggattccaagatctgacttttggttgaatcaccagcttctcctcttcctgtccatacacctccttcgtcaagttctccacctttgcggcaagcacttcctcacgtgggcgtgcagccccaaatggattgcaagaccagcttttgggctgaaactctcctttctcttcctctacaccctcatccttctccccatcagttgcaacggcaatcggtaaagttcgcttctgcaaaacaacccccgcacccgcacccctccccccgccacctccgccggcctccgctctcgtccgcgcccgcgaatcagcacccggacggccatccctattgaaaccccaaactgacccaccccttcgcccatccgaaggtgggggcgggggagcagagtagctcttgttggaaacccagctcgtggaatcgtcagcgcgtccctgcgactcgctaccaaacgcgctgctacgctccctccgctccatgggtagagaaggcgccgtcttcttggtggacacccagtcgttgacgtcatcagcacgcgacgaaatcgcctcgtgccgaattcc

SEQ ID NO: 5816 - DNA, 710 bp, Triticum aestivum
  Clone ID: PAT_TA_5816
agaaataagcacattcatgcttccatggtggcgtccatgcgtccatcgagctgctgcttctgccgctgtacccaccatggtgtcctctttctgctgctgctgtacccaccaaggaaccttgctgctgcatggcgtcgtcctggccgctggcctcctgcctcattcgaacatccatggcggctcggtccccatgctagggtttggagcgtctccatccatggttgtagacgggttagaccccactccatggttgacctcgaggacagtggcggctcaggtcgacgacggcgcgtcgatgccgccgtagatctaggcgctgcctcacctcatccctcgatcctcaatatgggccattcccttccctcccctcccctcccttgggatataaggtgaggggcgccggagagggtggagcagcagcgctggagggagaggaggccgccggacttggggttgaggcggcacagtagcgggcgagcgagccgatccggtcgccggagggacgccgtcggttccggcgctcctcccgttgacggggatgctctaggtccatcggtcgctctctcccgatgacgggaacggcgagctcgccgcccttcatggccgtgagaggctagcacaagggagggcaggccgtgtggtggaggagggaggcggagaggaacggcggctgctcgtgtgcgagcgatgcggccgcgtgccgaattcct

SEQ ID NO: 5817 - DNA, 1009 bp, Triticum aestivum
  unsure (1)..(1009): unsure at all n locations
  Clone ID: PAT_TA_5817
agagctcgccgcagttggagcggcacttgtcctggcggtacgtcccggcgtagctgcaccggccgcagccgccggagggggccttgtacgaccagtaccggccgacgtggtggccgttcacccacatctgccccttccccatgctccccatgtccagcgccaccgggtcgctccccaccggcgcggtgaacaaggccttgtgccaggtcagtggctgcttgttaccaggaccgccccactccacggaggagcttccggcgacggtgtggagccccagcgactcgcctttcaggccaacctgatatgtccatttctgatggctcaggtctctcttccccgaatttagcccggagacggtcaccggcccgaggacgccgacattccacctctcgaaatggttcccgtcattaggaaggccaactgctgaactcaggatggagatcttgttgctcccttgccacatcttcacatgcccgtcatacgtcagcttcgggttgttgtaaccgccataaacagaaccgtatgattttccgttgacgaagacttgcatcgagtgcccagcggagtagatggtgagctgaggccactggccgttctttgcgagctcattggcaccaatgttgacgtatgtggtgtaccacaggtagtctgacttgtcccatgtcatgctcagctgctcaaccaggccattcttcgtgaaggcgctgccgtcgagtgagtttgtggccncgctatacgactgcnaagcgaaccacaccaccggatgcatttttggcagcagttttggctccttcaccgtcgcggtgttgaaaaccgctgttttgcagtccggcagaatgctgatggaccaagcagggaggtcatagtgtctcccattgaacctgactttcactgcagcattcatgtggtaatttgacaggaacgcggcgcaacnccattcttcgacttgaagacgtatgccttctcgtagttccctagcgactggacagtcggatcaccagagaccagt

SEQ ID NO: 5818 - DNA, 366 bp, Triticum aestivum
  Clone ID: PAT_TA_5818
accaaatgtgtgtgctatgataattaaggttactaagatgaatggggtttctatagggccggacatatttcttatcgtcataaatcagtgatgcacagattatcttagctatattgtgaatcttgataaccccacgatgaacaaattttgcggcctgtatttgggtttattcaaattgttgcgaaatatgttcttccaggaaaagtcactacatcatatgtcctagataaatatttattgaacatttagttttccttatacatgcttatcgtgtggtataatgttattttgtgagcttaattctaccctgaatatacaaataattaggttgtttattttttttgctgtcataaaaagaccccgcaa

SEQ ID NO: 5819 - DNA, 913 bp, Triticum aestivum
  unsure (1)..(913): unsure at all n locations
  Clone ID: PAT_TA_5819
ctccagggcctccgcctcgaggacttcgccggctccctgctcgtcgaggtggaggaaggcaggatgggggtggagcgcgtcctcagggagcacctcgacatccgcaagcagctcaaggtcatcagccaccgcttccgcaggttcatcgtcgccgcgctgctcatcggcaccgccagccagttcgcctccgtgctcctcaccgcacgaggcgactccatcgacgacctcctccacaccggcgagctcgcgctatgttcagtggtgctcatgtccgggctcatcataatcctgagcagcgccgccaagatcactcaccaagcgcaggccctcacgggccagaccaccaagtggcacgcctgctgcacaatcgagccggtcccggacgacgagataaatccgggatccaaccagaactccatgctggaagagtaccccgaggacgagagcgactgcgagtccagcgaggagaccggtgatgaggacatgctggagaacaccaagttcctccagcctcacacgcacgtgatctccttccagaagaggcaggcactagtgacgtaccttgagaacaacaaggccggcatcaccgtgttcgggttcacgctggaccggtcgtacctccacaccatattcatgctcgagtggacgctcttcctgtggctgctggggaaaactgtcggcttctcatgaacgccgaggaatgtcatcgtccttcccagccaggtggttcgattccgttccatatttttttgctgtcgccggtttgatccttgtgaaaagagaaggaatgggttttttttgtgtgtncgcgcgggtngcacgtgagtgtgtgcacttgtatgcnagcagcgattttgtgtgatggtcgtgtaaattattatgggttgattgcccgtgcatgtaaggtgtatgt

SEQ ID NO: 5820 - DNA, 598 bp, Triticum aestivum
  Clone ID: PAT_TA_5820
gggccgggcgccaccactcccaccacagctcaatccccaccggcagagaccggctcccagcagcagagacgacggagaagcggagcagcggcgggggagatgtccgggaggggaagggccgggcaagggctgggcaaagggggcgccaagcgcccccggagggtactccgaggcaacctccagggcggcacgcaggcggcggtcgcgcggcgggcgcgtcggggcgcatctaagcgcatatcggggctgagctccgaggagtcccgcggcgtgctcaagagcttccccgacaccgtcacccgccacgccgtcagcaagaccgaccccgcccggcgcaagaccttcacggccatggacctcgtctgcgccctcaacggccacggccgaaccccctccggcttcggccgctagccgaccggccgccgggatcatcaagcaaacaaggcgattagcagttttcgtttattgtacgtggtttctgtgttgttttttgctctttcttcttgctctgtttgaggtttcgggtcctaatgaactagtacgaatgaataaagaatatggaatttagaaaggaaaaaaaaaaaaaaaaaaaaaaaaa

SEQ ID NO: 5821 - DNA, 749 bp, Triticum aestivum
  Clone ID: PAT_TA_5821
acctcacgacgctcgggatgctcgtgtctctcctcatggggctcaacatgtcctggaccgccatcaccgccgccctcgtcctcctggcgctcgatttcaccgctgcacaagcatgcctagagaaggtatcctactcgctgttcatcctcccgcccgggcaggtgcgaacctgatcgtgtgtgagcaggcgcggcgggcgcagttccatggctacaacctcaccttctggagccaccttcgtttcggcgtgccgtcgaccatcatcgtcaccgctattggcctcattatcgtcgttagctactgaactggacggggaggaacaactcctactcctacgttgcagcagtagtgcaacacgtaagcagacagacagcttccataagcaaggaagcagccgtgaaaatggggcaatttacctgattatcgtcttctacattcgtgtaaacttctcgcccgaaattaggcgcgggacgtcgtcgtcgcccatctgctaaagcaaataatgggcgtgtcttgtacgtgtgttgtactctacgtagatataagattacccggtcgacgcaagtagtcggtgcccgtccgttgtattcgaaagccaagctttgcttcgataggatggatggaaggacggggaatgcagtgacaatgttatttcaaaaaaaaaaaaaaacccaagactatttcttaccgcggccgcggccacggtgctgtctatgtgaatccaaaaaaaaaaaactcgagaaaaaaaa

SEQ ID NO: 5822 - DNA, 718 bp, Triticum aestivum
  unsure (1)..(718): unsure at all n locations
  Clone ID: PAT_TA_5822
gcacgaggatcccctcacgcagatcctgcgacggtcgacgcggctgctagggaaaggaatggcggcgctggaggcttgggtcggagtggagacacgcgcatcatcgtcgcactccatggacgatgacgatgcagacagaatggacgatgacgagtgtaccgccgtttggtcattttcaacatgtttctcacccacccgcctgcgccagattgcgaatagtcagtctacagctaagaagcacgttattaccaaaagcagctttggatccctcctaaacatcagttcattctctgtgccggctgatatgcttgattggatagttatgaaaattgacacacaaaaggcactgtttagtcacaagaagaagtctattgttcacgaaagacatggtgtgcaaattttttaatgttccttctgggtcaaggccagtggagttgttgaggaggaatgagcctcatgcgctccgtgaagcctatcgagtagggtcaagggctccaatgaagcatgctatccaagtgctgaagggggcagacgatcgtgatgtagtttccatcaacaggacttgggtgtttttatgcattgctctcgtgctatctcctgggactggcaacatggtccccatggagtatgttgcgagcntngttgacatggacaagatcaatgagttttgcgtgggatgagcattttctggctgctgcnttgaaggaggtgaagaagt

SEQ ID NO: 5823 - DNA, 347 bp, Triticum aestivum
  unsure (1)..(347): unsure at all n locations
  Clone ID: PAT_TA_5823
acatcgtcgtcgtccgtcgtcgattgccgccgctccggtccacctccggcctccccggccatgcccccgagttcgcaattccgacactgccggcgacccccagttcgactacggtgttgacgatccctccttcttaccagagcaaccagatgctggagtccaggagtcaggcgtcatcgtcgacgacaaatcctactacaccggaggtncntnactactacgtgcaggccgccgccgacgaccaggagtagtttagtaggatcccagacaagaggcttgcgcatattttgatttgcattccagtttgtgctagccatcttatggcaacttgtttaacttatgtctgt

SEQ ID NO: 5824 - DNA, 989 bp, Triticum aestivum
  unsure (1)..(989): unsure at all n locations
  Clone ID: PAT_TA_5824
gnnnnntnnnnncnnnnnnnttttgntctcttaagctcgaaattaaccctcactaaagggaacaaaagctggagctccaccgcggtggcggccgctctagaactagtggatcccccgggctgcaggaattcggcaccagcggccccgcgccacctgcaccccgccccaaacggcgccgtcggcctcgcgccgcccgtacctcccccaaccggcgccactcgatccccgccccaaccgagcccgtcgccgacggctgcctcgcaccctcgatgctggaggacaccatgcgcctccgtcggccctgccactacctcctcctcccggtgatactcctgcatcgccagcgcgcttggatccggtgacgccaccaaccaccggagctaggtgacgcccccgccccagccccgctcacaccccggtcacctctgtcgccggtaccccacgcgcgagacgctgcagcgcgcaagccattcaccttcatcgcccatgtccgtccaagtactggtcaccatgcgctcctagccgaacttcatggggtgcccgtggcggccttcattgcgtgcgtccgcttcgatcttcatccccagagacggtgcctcaaccccgggtggctccttccccatcagattgctcggggatccagctcgtggaccccgtctccattgtctcaactggtgagaagtccaaagacagcaacgcgtgcagggaatcgcttcaccgacaattcaatccggggcacaccgtcgtagtggtaactcactgctgggccaacagcagcctagtgcaccgcctgctgctgcgccaacagccgcccatgaaccagggcctcaccccctgcaacanctcactgacctatganacaaagtgatggtgtcgctttcatccaattggttttttcagtcgactaagttttggtccattagtctnattagttcttaaactattggatgaaagcnacaccatcactttgtatcaaaggtcagttanan

SEQ ID NO: 5825 - DNA, 1611 bp, Triticum aestivum
  Clone ID: PAT_TA_5825
ttttttttttttttttttttggagtgacaaattcttcctgaaggtgtaacaaaataatgactatcacattcacactggttacaaaatgaatcaaactcagctcaaagaaaaaaagaatgaaactgcactttcaacccaacaacttcgagacaaacagcaaatgccaaagaaggtaagttcacagcaaaatgtaacacaaccccttacagtgattcgatgctgtcatcactttcttcacacaagggtgcagattggattataacccgtgctccagaagcaagcctttcttcgatcttgatcattttgtccttctcctcatggaatgactctccccttgatgaagataatttacctagtgggtcagtcatcctattgcttgcacctcttgatgaaccaagtggtgaggatgcagtactacgttcttgttgactagagctgtacctgacatcagagttgggggagaatgctgttccacttctggattgcttacatgatatcattttgatagtctgtgggagacatctgaaactacccgactcggcccaagctttccatatcccttctagagtctggcgctctatacactctatcctcgtcgtaagatgatgagcgtttgagtgtgggtatttctcctctcccctgactcttcctgcttactctcctcgaccaagctttcactacttaaatgctctgactcagaaactcttattccaattgttcttgcgctacaaggaacattgtcaaggtgccgcaatgccataggagtagagaacattggagaagggaattcaacttgagtaaaccgtggtctgtatgttgggatgaggccaaagccacggtgatctttcacagagatggacccacaggtgatgagctgcatgagcaaattggctggcttcagcttcacacccattgggccatagagatgttcttcctctagtaccttattatagctactcctcctactggcccctgcccttatcagggactccaatgtctcaactctgccaccgggagaagcatcagatgaacacacctgtggtgattctcgaacaagtagagggacctttggcgatgcttgcgtgcttctttcatgacactcttgaatttcagcatctgatgtacaatcctctgtacggattcctgcagcgcaagtacgtttagaaggaacatccctctcactgtcatcagtttgtgtggacgcatcctgtgctccgatgggtttgcaaactctgtactcggaaggtccaggggagcttgcctctgataatggaacattagttcctactggttcaggggacaggttccccgatgagccagaatgtgtagtcctgcattgctcgtcctcgcgattggtggaagcagatgatcatggcacaaatgtggagtgcgccagctgttgtggttgctgggtaggagttggaggtgaggcctctttgataacagcagacggggatggggatgacgatgacgagcacccttcttgcgatcctcgcgactgaggagactcttgttgagggtgcttgggactctcggccttggtgttgctaaggccattctgctggcgatcaggcggcgatcggtccaggagctcggagcccttgaggatgt

SEQ ID NO: 5826 - DNA, 962 bp, Triticum aestivum
  Clone ID: PAT_TA_5826
cgtccgagatttttgcctctcgtgatacctctcctccttgaatcagacacaccacaaggcaggcagcaggaaagagaggcagcagaaggctctcctccttgtagcaggcatcggttctatcagcaagcaattcagagccaagaagatcggagacgggcatgcgccgggttcgagtctcgtcccaccactctccggtccagaagctgggcgattcgcacatgaagctgacgcccaagttccggctcaccgccgccacgacctcatcaccgtcctcctccgaactggagcaacctcaacctccatgggagacgcccctcatcccgggcctcccggacgacgcggcgctcaactgcctcctccggctgcccgtggaggcccacggcgcctgcaggctcgtgtgccgccgctggcgccacctgctggccgacaaggcgcgcttcttcacgcaccgcaaggccatgggcctccgctcgccctggctcttcacgctcgccttccaccgctgcacgggcaagatacagtggaaggtgctggacctcgactccctcgcctggcacgccatccccggcatgccctgccgggaccgggcctgcccccgcggcttcggctgcatcgccgtccccggcgaggacggcgcccacctgctcgtctgcggcgggctcgtctccgacatggactgcccgctgcacctggtgctcaggtacgacgtttgcaagaaccgctgggccgtcgtgccccggatgctctcggcgcgctccttcttcgccggcggcgtcatcgacggccgggtgtacgtcgccgggggctacagcacggaccagttcgaacttaactcagccgaggttctcgacccggtgaacggtgtctggcagccaatcgccagcatgggcgccaacatggcctcctcggactccgccgtgatcggcggcaggctctacgtcaccgaaagctgcgcgtggccc

SEQ ID NO: 5827 - DNA, 844 bp, Triticum aestivum
  Clone ID: PAT_TA_5827
gctggccttctatccctggtgggactcgactgcatcttcaacatgggagcaatgctgttcttccttatggccgacgcatgtgggcgtccagagaacaattcattcgacctgacaaggcagatcccaacttcttacagattgtggaatctggtagccagtatactaggcttcgttgctcctctggccctgcttttcgcgtctcatcgaggagctctgcagccgcatctaccgttcattccgttcttggtgctgcttgggccatacctgttactcctttcggtgcagatgctgactgagacgcttacatggcactggagatcgccggtctggttggtggcccccgtcgtttatgagggctaccgggtgctacagctgatgaggggcctgcagctggccagcgagatcgctgcgccggggtggatggtgcagagccttcgtggcttggtgacctggtgggtgctggtccttgggattcagttgatgcgcgttgcctggtttgctggggtcagttccgcgagcgatccgagctacggatcgagcgatgatgtgaacaggtaggtttcttcaagctgctgtgcttctgctgctcactgcacgatagaatgggtgacatgttagttctggtgcatctgtatttgccagacgtagtggacgtagaataaaaaagggttttgactgatagaaactttgaatcgtgcaactgctttggtatacagataaagtgaaaattgtacattgccgtgatgctgaacttggtatgagtgtgtaagaaatactttacttgaatatagaagatatatatacaagcaaaaaaaaaaaaaaactcgagacctgcccgggcggg

SEQ ID NO: 5828 - DNA, 583 bp, Triticum aestivum
  Clone ID: PAT_TA_5828
cgtccgcccacgcgtccggacagcgagagagagagacagagaaatccccaatccaccaaaccctgacccacacccactaggagagatcggcgatggccgtcgagaaaatgcagtttgccatgccgatggccaccggcttcgagggatttccctacatcccgttccaggcggagaaggagcaggcgcaggcgttcggcagggccatggcggagccggagccggaggaggtggcgctcgtcatggtcaggacgaagccagaggcggcgatccgcaaggccaagtccaaggtggacaaggagaaggcgtccctgaaggccaaggccaaggcagagaaggaggcggaggaggaagcggcgatcctcaaggccaaggcggaggcagagaaggaggaagcgatcaaggccaaggcgaaagcggcgaaggaggagaggatcatcaaggccaactgctgctgcggctcggacgaggacgatgtgccgtacgacaagctgtgccacgactccgacccggatataatcatgtccaggattgtagagcggtgggacctctttatcgaggaggaaaggttcgcttccctggcctc

SEQ ID NO: 5829 - DNA, 1018 bp, Triticum aestivum
  Clone ID: PAT_TA_5829
agcgagtccgagtaccagagaaagcgggaaatccccaatccccaatcccctaaccccacacccactaccagaaggcggcaagggggatggacgcggtggccgtggagaatgccctgtttgccgccccgggcgccaccggcttcgagggattcccctacctcgcgttccaggcggaggaggagcaggcgggcgcgttcgtgggggaccgggcggcggcggaggaggaggcggccctcgtcagggcgaagacggaggcagcggccggcaaccccaaggccaaggtcaaggcggcccaggcggccaaggccaccgaagccaaggcagaggaggaggcggaggacgaagcggcgaagctcacggccaaggcggaggcagagacggaggcagcgatcaaggccacgacgaaggcggcgaaggaggagaggatgatcgagacgatcagcaaggccgactccggcggcggctcggacgcggacgacgtgccgtacgacaagccgtgccacgactccgactcggaggaagacccggatatgatcaggtccaggattgtagggcgctgggacctccttatcgaggaggagaaggttcgcttccctcgcctcaagttcgggggctcctgcctaccggaatgcaccggggactcatacccaggggaatacaccggcgatgatcaggaagattcagatgacgagcagtactacccccgtttgctggatgagggtattctggtttgagattattgctcttgtaattcgactgggatgaaggcggttcaccattgctatcaatctatctatatatatagtagtagtagtagtcaattgatctggaggacatctatgttagtgatccacctatgtgtgtgatcttagtattttaagttaagagacgccaatgaaccaagggcaatggcatgtatgtatctactatcaacaccatcattatattagctaaattatgctgttctggtcttgtctgccatacataattgtctctctatgcctgcggtttattacat

SEQ ID NO: 5830 - DNA, 457 bp, Triticum aestivum
  unsure (1)..(457): unsure at all n locations
  Clone ID: PAT_TA_5830
gcggtgcgagcgcaccaaggcggcctgggcgctcccgctccgcccctacggcttctggaccttcgaccgcttcaactcccagctctcctgggacccccagatcagccaggccgccggccgccgcgacccctacgacgacctcctcgcccgccacgccggccccgccccgccctcctcctcctgagaaccgaatccggcatcaaccgcgaggaagtgtggttgcaccggatctacgcgggcagcaataaggaactcatttccctcaaaatgactgtgattgcattcccttctggttcatttttatccttgaactgccccagttggttcatctgctgagtggttactttgacaaacttcctgttcggcaagatacctgaaatgctttgtatctgttgattttcagtctttgtaccatgaaagctttcaatanaaaaaaaaaaaactaatacaaaataac

SEQ ID NO: 5831 - DNA, 602 bp, Triticum aestivum
  unsure (1)..(602): unsure at all n locations
  Clone ID: PAT_TA_5831
cgttctggcgacagcananagcgagcggcagcctgcgggcgccatgggcattcatcatggagttcgcggagaacctggtcctgcggctgatggaggacccggagcagcgcgacgaggcgcagcgggcgcacgtctaccggatgaaggagcggtgcgagcgcaccaaggccgcctgggcgctcccgctccgcccctacggcttctggaccttcgaccgcttcaactcccagctctcctgggacccccagatcagccaggccgccggccgccgcgacccctacgacgacctcctcgcccgccacgccggccccgccacgccctcctcctcctcctgaagaccgaatccggcatcatccgtgaggaagtgtggttgcaccggatctacgcgcgcagcaataaggaactcatttccctcatcaaaatgactctgattgcattcccttctgtttcatttttatccttgaactgccccagttggttcatcggcaagatacctgaaatgctttgtatctgttgattttcagtctttgtaacatgatgaatgctttcaataatctcatgcgcacatgtttttcctttcggtatttgaaaatcttctgatg

SEQ ID NO: 5832 - DNA, 751 bp, Triticum aestivum
  Clone ID: PAT_TA_5832
gacttttcctcagatcgaccgccctggcggagagagaaagagcgagcgagaggagcctcggccgccatggaattcatcatggagttcgcggagaacctggtcctgcggctgatggaggacccggcgcagcgcgacgaggcgcagcgggcgcacgtctaccggatgaaggagcggtgcgagcgcaccaaggccgcctgggcgctcccgctccgcccctacggcttctggaccttcgaccgcttcaactcccagctctcctggggacccccagatcaggccaggccgccggcccgccgcgacccctacgaccgacctcctcgcccgccacgccggccccgccacgccctcctcctcctcctgaaggaccggatacccggcatcactcccgtgagggaagtgtggttgcaccggatcctacgcgcgcagcaataaggaactcatttccctcatcaaaaatgactctgattgcattcccttctgtttcatttttatccttgaactgccccagttggcttcaatctgctgaatggattactttgcacaaacttcctgttcggcaagatacctgaaactgctttgtatctgattgattttacagtctttgtttgcaagatgaatgttttcagtaatataactgagaagatttttatctgtttatttttagtaatttgtaccatgaaagctttcaataatctaactgtgcacatgtttttccttgtaataaaataaaaaaaaaaaaaaaaaaaaaaaa

SEQ ID NO: 5833 - DNA, 1068 bp, Triticum aestivum
  unsure (1)..(1068): unsure at all n locations
  Clone ID: PAT_TA_5833
tnntnccaatttgccccaaaantcagnaaacactccctccggccnggtaaacaccaaacnncccagnttgattgcatgccaggcttgcataggntgccccgggttgataaatcaggagtctctagganagcttggtgccttcttgcnacgggatgttggaggattcgaataaggagccttagtgtnatcttnattggtgtgcttattaggtcccagttgttgcagcagactccacactagcatcatcggccaagccttgttgctcatcactttttgtttngcccagcgtctgggtccctgaaccccctaagcccaaaggcccccctttgagaaagagatagaagaactcttgagaattaaactgttgtaagaagggaattgggctgctgggttggaaattgcttctggttgatgcccgttatatgagaagcgctaagaaggttgccctgctgctgctgtacttgttgcaatctttgcaagtacttctccctttggtcggtgacctcaggtcttccacgaaattgaccagtttcactttgattttggaaaccagcaggagcttgaggcctccactgagccccaggaacaaccggaggagaaaatacccttcctccaataaccgcactttcactggtgttactggaatcagagctaactgcgtcgttagtcttcacaaccggctgtggttgaactttactaccaagaggtgaaaccaactgctgaggaagaccgccactgttaaccctctcatcggtattcattatgtttcgtttggacaggtcatttattggaggaattgcagtaatggacccatttcctggagctgggcctacacttatgggagcagctaatgcctgactagttaagccacgggcaatacccctgccaagaccaatttcagtaactgcgggagacggtctacgtggaggaaagctcatgctttcatcatccttcacggcagtagataagtttgcaggagttgaagcaacagcaggcatgctctctggagcatttcgaacagcagcaggagcagctattgtgcgcgcgccggcaggaataactggtcgt

SEQ ID NO: 5834 - DNA, 1241 bp, Triticum aestivum
  unsure (1)..(1241): unsure at all n locations
  Clone ID: PAT_TA_5834
gattgaattggcattgcagcactgcaggctatctacagggnacagagctgaatacagtttcgacagagaagcaacgatttcatggtccaccagatgcttacatcaaattttggtaagagttcctgactaataactgatctaattcaacctgcattcaacacctaaatacctcactcaaacgagggtgagaagaaaagaaaagaagaaacacgactatttcctactcccatgcatgataagcgatgacgtcacgcctgtatttatagcgcttgaatctccccaccgtagccgtaacgtttcaaaagccgttcatcttgccgccagttttccttcaccttcacatctatctcaagataaaccttcttttgaaggaaatcttcgatgtcaagcctggatgctgttgccaacgtctttatagctttcccatccttcccaagtataatgcttctttgtgattccctctcaacaagtatctcaacttgaataaaatccttggcactaggcctgcttttgtaacttgtaacattaacctggcatgcgtatggaatttcctgcctatattgaagaaaaatcttttccctcactatctcccccacaaaaaatctctcggggtgttcactagctatgtccttgggggtagtaagcaggacccagtggaagctttgacaatatccactccttgatatcaaccactccatgaccaaatttagcacttataggtataacatcgtcaacatcaagtgaatttttggtaccactcaagtttctttgcgatttctccgggttttatcatatctttcttgttgagcaccaacacaacagggaccttggtatctttgtttcccacgcccgcttccagcatatcatctatcttttcgggcagtttggaagcatcagcgacgacaatcacacagtccgcgttgccgatagcgctctggacattcttcatcatcatcgagtctagcttgtgcatttccttcttgatgacgcctggcgtgtcataaagtattatctggtattctggttccgaacatataccaagaatgcggtgacgtgtggtctgtggcttgtccgttacgatcgaaagcttctgacccacgatttggtttatcagggtgctcttgccgacattcggcttccccaacacagcaacataaccgctgcggtggttggcgcagagcgccgcccccagctcctccgactcgtactcgtccagcagcgccaggcnccggtccggcctc

SEQ ID NO: 5835 - DNA, 626 bp, Triticum aestivum
  unsure (1)..(626): unsure at all n locations
  Clone ID: PAT_TA_5835
gatcggcgaggcgaggcagatggccgacgggaagaacctggagnaggcgcggtacaagctggcggacgcgcagaacgcgctggaggacatcgtgctgaacgacggggagaagctggtgggcatgctccgggcggagctgcagcagctgctggacctgatggagacgcaggagctgtacgaggcggaggggcggccgtacgcgctggcctccgagacgtcgcacggccggcagcggtacgcggcgaggggcggcgacatggacgccgtgcggctgttcgccaccccgcgcatggacacgtacctggagcaggccaagaagttcgaggaggacccgacggcgccgctgccgtccgccgacgacgacgccaaggaggagatggccgccaacccgctggccgccatctcggcgcccatcgccttctacatcaaggtggccatccaggcgctgcaggagatcgagaagctcgtcgccccgcccaccaaataaaaaattcaactctccatttactactactccactacgtttgtttcatcactccatttactactacgttcccatttttatcttcatgttgcttaatttacttcatcgtgagctgaaatgaataaaggagcatctcatcatc

SEQ ID NO: 5836 - DNA, 1864 bp, Triticum aestivum
  Clone ID: PAT_TA_5836
gcacgcggcacgagcgctaaagctgctagctgcttggtgtgtgagctgagctctgctctgctagctcattggaaacaatggcgttcaacgacgacgagaagcctcctgcttctaatgtcggcagcaccaagggcctggtgacgatcagcacgccgacgtacagcaaggatgcggcggccctgacggccgacgcggtgacggcggtggtggagctgaacgccacctcgtcgacggccgtccgggaagggctggacctggtggcggtgctggacgtggagcggcagcatgcagggcgacaagctccagagcatgaagagggcgatgcagttcgtcatcatgaagctcacccccgtcgaccgcctctccgtcatctccttcgccagctcggccaacaggcactgcccgctccgctccgtcacgcagcaagcgcagaccgacctcaagtccatcgtcgacggcctcgtcgccaacggcgggaccaacatcaaggccgggctggacaccgccctggccgtcatcgccggccgcgccaccaccaaagcccgcacgcccaacatcttcctcatgtccgacggccagcagagcgacggcgatgccagacaagtcgatcccgggaacgtggcggtctacacgttcggcttcggcaaggacgccgaccacgccctgctcagcgacgtcgccaagaagtcccccggcggcacgttcaactcggtgcccgacggcgggaacgtgagcgcgcccttctcgcagctcctcggcgggctcctcaccatcgtcgcgcaggacgtgcagctgacgctgacgcccaaggcggaagatcccagcgccccggacctggataccatgacggtggcgccagggaccgactacacgcagaccaccgacggcgacacgggcgtcatcaccatcaagttcggcaccctcttcagcggcgagacccgcaaggtggccatcaacctcaagctcctggagagcaccttgacgacggcgtacgacgggttggtggcggaggcccagcacagctacaccgtgcagggcagcccgcagggccagaccccgcaggacgtcgtgataccccgctccccggacgcgcccgccgacccgcccaccagcggcaaggcgcaggcggtgctggcggagatggcgcgtcggcagcacgccggcgcgatcggcgaggcgaggcagatggccgacgggaagaacctggaggaggcgcggtacaagctggcggacgcgcagaacgcgctggaggacatcgtgctgaacgacggcgagaagctggtgggcatgctccgggccgagctgcagcagctgctggacctgatggagacgcaggagctgtacgaggcggagggccgaccgtacgcgctggcctcggagacgtctcacggccggcagcggtacgcggccaggggcggcgacatggacgccgtgcggctgttcgccaccccgcgcatggacacgtacctggagcaggccaagaagttcgaggaggatccgacggcgccgctgccgtccgccgacgacgacgccaaggaggagatggccgccaacccgctggccgccatctcggcgcctatcgccttctacatcaaggtggccatccaggccctgcaggagatcgagaagctcgtcgccccgccgacgaaatagaaaacaagctactccatttcatcactcgatctactgctatgtttgtttcatcaatccatttactgctacgttttccgttcattttatcttcatggttgtagcctggcgcttaatttacttcatcgtgagctgaaatgaataaaggggcatctcatcatccaaaaaaaaaaaaaaaaaaggcccctacccaattcgccctatagtgagtcgt

SEQ ID NO: 5837 - DNA, 899 bp, Triticum aestivum
  unsure (1)..(899): unsure at all n locations
  Clone ID: PAT_TA_5837
aagttgaacaacaacagataaggtaaagcctcacatgaaaataaacatagaggactaacagaaggcatagctatccagcctacccggcaaccatcatcattctcgccacattcgcaattggttccagtgtgcagatttcaccaattccactggttctttccttccactgtccaaatttcagccaaacttctccaccttcgacacaacagtgattcccaaaattgactacgcgcatcccaaacatgatgctcctactctttcatagagacaaggacactagcaacacagtagcggctttttcccgggtgttggagaaagcatacatgatccttccattttacagtagcaaggacaattgtacaacaagacgatccactagggcaggttccttgaatcctcaacatgacagaaacaaccatctactttgaagcctccacttttgatcagattcaaatcatcaccctttccagcagcagcagcagtagcaactaggtcctagaatcacattagtctggcattttctccttggtgggtctgcttgggggacagggtttgggggcgctggtgtgggtttactacctggggntggntggggggacggtngctggctactcctgtanntnnnccatggnctggnggcaagaaggggctnggaacctnggncatggtcaccntagacggcctggcttcatgatgggggcgggnnagcggctgccaccccnggcntgnggnagggcttaggggccttaaacaccacngaatccctgggggacttnncctttaagntcgnctcctcctcngcantanagnactccacggaccngnactgnacctcgggcggaaccacantaancnaattcccngnggcggcatngngggggagcatncaactncnggcg

SEQ ID NO: 5838 - DNA, 419 bp, Triticum aestivum
  Clone ID: PAT_TA_5838
ttttttttttttttttttttttattttttttttttttttttttttgagctaggaatagttcgcttcaatatattccattcaatgcgacagggtacggaactgcaaaaaacttaaacgagattcattacaacacagtacgatagatcgaagctagcccacgaagacaccaacgtacacaaccaaaccatgaactcaaacgaaacaaccaaatcataacgcacatcaaaacgcacacgtccgtccggcctaaacgcatgcatgcagacatgccacaaatataggtagccagctagctaaagccctctccatggcgatccggtcgatctacgccttcctcccctcgttggctttcttgaacgaggccgcctgcgccgccgcggcgctgtctacgccgccggccgcggccgccgcgaacgcgt

SEQ ID NO: 5839 - DNA, 358 bp, Triticum aestivum
  Clone ID: PAT_TA_5839
cggacgcgtggggaaaaggataatacatggccaaatttatacagggaatagcatgtccttgaggcattgataatgacatgttatcaagtgagcatccagttgtgaaacatcaacctgaaaatgcattgtcaatgattttctgccagtggttaagcgcttttctacagaagatcgaatgtgcattgttttttattgttccatgtcaaaggcatgattagtgaataactgaatacattctttgttttaaaatgtgtttttagatgataacatactttcttttcacaaaataatatgcacattttgggttttatgtattcccattatatcatatattttttattaccacaggttataggga

SEQ ID NO: 5840 - DNA, 1635 bp, Triticum aestivum
  Clone ID: PAT_TA_5840
tttttttttttttttttttttttttttttttttttttttttgcagccatgactatctttcattcatgtcatatatagttttacatatatgtctattgtgaatgttcggcgcaaaactgtactgaagacagttttagtgttatcatgcaggttgttcacaatataatactgtaagctactcacgcgctcggtgataaacactagccaacaacccagcagagcacatcaaaagacatcagataggatgataaaactaacaatatagattaagattgctatcagctaaatctttaaatagctcagtttaccaccgttcccgttgtctgccgtcaggaaatacaggaacagacgagtcgtcgttggcatcattggctgcattactctttgcttttggtgcctcgacttcttgtggacttgagtcatcaccatctccaaagtccggtggcgagccatcactctcgccaacccagccatcaccccagcggtagccgctgttgtcagatttgccaccaagttccccaatcaaatcttccatgtctgaaaaatcatcgtcttcgacatcttccatgtcgcttccttcattatacccttgcgcagcccatttgggtccctctgtctcctcaccagtcctaggcccaccacgccgagggaagcgtggaaccgcaacaagagccctcatcttctccttaagcaacaccagatggctcttctcgatcagctgcgagttcttgtacgcctcacggaggaacacggagtccctatctcccttgagtgacacatagaacatgtcagggtggcgaatgagcattccccgcagagactgcgagaaccggaactcctcccggaaatgagtcaggtggtcaaccagcgtgcgcttctcaagtgtcaggcttagaatctcatgaaccaccccacaggcatgcttctccttctcaggggaccccgacggcaggtgcgagaagtcggcgtacggcgaaatgtacggcatttctctgaatttctcgatcctccgcgcctctccccgcgacaccttcagccccttgggcagcttcacccggttgaacctgagcggccggtcgatgataagattcctctcctcggcctccctggcccgattctcctcctctgccatctcggcggcggacacggccagctcggggtcccattccgtgagctccaccgcgggccctctgtccatcctgacgacgcggaagtactgcgggtacctgaggcagatgctgtcgtggaagttggagggcaggccgaggtcgttctttgaggtgcgcgatccgcttcgatgaggatgcggcggtcgagcgacatcatgagcagcttgcggagcttggcaacggcgaggccctcggactcgttgcggaggtagagctcgtcgaggtagaggcgctcggcggcgggggtgaggcggaaccgcagcgagtagacgccctcctccacgatctcgaagacgcccgggaagcgcttgaggagcgcgatgaggcggcgcttgcgggtgagcccgaggtcgcggcggaagcggccaaggtcccgcaggctcatgacgcggtccgggtgggagacgaggatgttgcgcagcttgaggaccagcttcagcttcttgtcccgctggatcacgttgtcg

SEQ ID NO: 5841 - DNA, 1096 bp, Triticum aestivum
  unsure (1)..(1096): unsure at all n locations
  Clone ID: PAT_TA_5841
cctcttttgggcggtggggccgatcgtccattctccccgcccccctctgggcccgggggaattttgtttcagtgtgttccccccgaggtctagtctcgagttgttttttttttttttttggaaaaaaatcattgaattcatgcgtacgagtatggcaacagctaaatatctccgtatatcgctacactattacattgatcatcatgatcggtgcaaacttcgtcatgacaacgggaaacaatggcatggtgtggtggtctacctttacattctccaaatggatatcggttacatggttacatatcctatagacactcctgatcatgatcatctacccctagagttggtcctagcgccgtcgctcctcggcgagttcccccggccacgcggcatcgacgggctgtctcgcctggcctccctcgacttggacttgctcttcatcgcctcgatctgctacctgccagggcggccgccaggctcctccggtctgactgcagcggcttcgcccagttcaccaggttgagcttctcgctggggcggctcgggtcaagcgccctcaggccgcagagcatctcgagcagcacgacgccgaagccgtacacgtcgctcttcacatacaggtggccggtagaaacgtactccggagcggcatacccatacgtgcccatgacccgtgtcgtcacatgagactccccgtcatctgggccatgcttggccaatccaaaatccgagagcttcgcgttgaagtgtgaatctagtaggatgttggacgccttgaagtcccggtagataatctgcctttcggacgaatgaaggaaggcgaggccacgggctgcaccgatgagaatcttcagcctgaggctccaaggcagtggctcatagatggcccctcttctgaagaggtggttctccaagctccccttcgccatgaactcgtacacgantantagctcgttgtcctccatgcantancccaacagtttnacgaggtttggggtgcgaaatcctcccnaagaaattcacttcagacttccattnctccatcccctncaccctctcggggttgagcttcttnacggcgacgaccatggcggtg

SEQ ID NO: 5842 - DNA, 716 bp, Triticum aestivum
  unsure (1)..(716): unsure at all n locations
  Clone ID: PAT_TA_5842
accggctgatgctctggcgccggctcgccacgtggctgcaggggtgcaacgcagttcggggcaggaagaaacagcggcgcctcaaggttgcgctttccacgcaagtnttcgttgtctttgagaagcgtcctctccttctctttcaggttagctatctgctgttcgagcagctgggtcttctttcctctgatgacgcggagactcttctcaatttttccttccagaaaatgcagttcttcagtagagcatcctcctaaattttcgcccaagatctttcgcttcgtatcttcaagagcttcaagtttctttgccaagcttagagcatcagctttgacttgctgtatatctggctgtactgtcttgttattaacagtatcctttgtataagccttatagcggtcaatcgatttctgcaagctggtggcgctggcgaactcgtagagcctgccgcgaggggagaagacgacgagcgcgacctcggcgtcgcagagcacggagagctcgaaggctttcttgagcagcccattcctgcgcttggagaaggtcacctgccggctcgtcgcgttctctatccgcttcatctgcgtcttgccccgcaccatctttcctgccgctggcggagctcgatcgatcccctctcctccgccgaaaacgggccaatcaccaacagaaatggctaagcgaggagagagggagaggagcggggagggacggcg

SEQ ID NO: 5843 - DNA, 921 bp, Triticum aestivum
  Clone ID: PAT_TA_5843
gaggaattcggcacgagggccggcgctccggtggctcgacccgcagggggtcgttgccaggctgaagaaactgcaccgccggttcgacgacatgatgaacgggatcatcgccgagagaagggccggagctggcacggccggcgaggagaagggaggtaaggacctgctcggcttgctgctcgcaatggtgcaggaagacaagtccctcaccggcggcgaggaggacaggatcacggacacggacgtcaaggcgctcatactgaacttgttcgtggcgggcacggagacgacgtcgacgatagtggagtgggcggtggcggagctgatccggcacccggacatgctgaagcgggcgcaggaggagatggacgccgtcgtgggccgggacaggctcgtctcggagtccgacctgccgcgcctcacgttcctgaacgcggtcatcaaggagacgttccggctgcacccgtcgacgccgctctcgctgccgcggatggcctccgaggagtgcgaggtcgccggctaccgcatccccaagggcacggagctgctggtcaacgtgcgggtggtcaccgtgacggcggccacgctggtgcactcgttcgactgggagctgccgacgggccagacgcccgacaagctcaacatggaggaggccttctctctgctgctgcagcgggccgtgccgctgatggtccacccggtgcccaggctgctcccgtcggcatacgaaattgcataaaaacagagggaagcgcgccactgatttgtcgtgatgatctaatggaggagaaagtccagttgtgctatgtattgttgtcgatggggtgttcctcaccgtattcaactaaaatagttccacctgttacttgtgtactgttttcagataacatggaaaataacatattatgtatcaaggaaata

SEQ ID NO: 5844 - DNA, 676 bp, Triticum aestivum
  Clone ID: PAT_TA_5844
ttttttttttaaaggctctacagcattggctgatacagatacatgttgccagtttgtcagagtccaaattccgcatgcccacaagtcacaataagtagattaatacagcaatgctctagactccaatctgtttccagtgattcagtactttcatccatgtcaaggcagcgctaggacatgccgcgctcaaaaagcaagctacatctctccgcactcgcttatcacgcaggcaagcttcggccggttgttcggtccagtcgcgacgttctcaatcttccgcagcacgagcagaccatctcccagcaccctcccaaaaaccacgtgcttgttgtccagccactcacactttgcacaagttaaaaagaactgagatccattagagttagctccactgttcgccatggagagcaggccagggccagtatgcttcgcaatgaaattttcatcatcaaatttgggtgccatagattggatatgcatccactgccatcaccctttacgaagtcacctccctggaatcatgaaatctttgatcacccgatggaactgacaacccttaataccccctgtggaatagctgacttcctgtactcgccggtgcagaactgcctgaaagttctcggcgggcctggggacgatgtcggcgaagagctctctccctcgtgccgattcctgc

SEQ ID NO: 5845 - DNA, 593 bp, Triticum aestivum
  Clone ID: PAT_TA_5845
gccattgcctaccaccacccccccccgtgagcagtgacagttgttttcgtttctagcaatagcaatggagtcctcctgccgctccagcacgccgagccctctcctcgccttcctctgcttcgtcgtcgtcctcctcctcctggtccttcccctgcacccggcgtccgccgcgcccacgtcaaggagcatgcgcctgaggagccagcagcgcccgccgtctctgaagctttcttctctgcaggagatgacgacggcggcggccgggaagccgcggggccgggcggcggcgaggatggacgtggaggtgaacgactaccccgggtccggccccaacaaccgccatgaccctcccaagggccccggaagagggtgaaccaagctcaacgccaccggcaccagctggcctggcctgctgctgctggtgccgctctgtccgtagctatagccattactactgttactcctgtgcttcaacaccatgcatgcataaactaagggaaaaagatcaagtgatgttttgctcggccgggtctctcctctcctctcccccgtgtactgtatctgtcaattgtcatgactccatcgtgttccag

SEQ ID NO: 5846 - DNA, 746 bp, Triticum aestivum
  unsure (1)..(746): unsure at all n locations
  Clone ID: PAT_TA_5846
actcaatggtnaggtcctcaagttttggcctgtnccgcagcaagttccnatcacacgacgagggatggcactttctaatccacagtctcctaagaagtgacgccgatttggaagatgatggcccgaacaccctaccaactgataacatctcactggtgttggatagtgacaaatctgcgattcgccgccgcggcgtcgtcttggtctcatctttggacatccacttgcagtgacagttttaaggactggaaacatgaatacctgttgttgactttcttcgctgtcccctgccaatgaggttggccagacctccagatcaggcatgtcttcaaaatggagttccttgagtgactggtacaatgtgttcttctgtcccttggcaagtatttcaggtccaatgctatggacaccgctaatgcagcggagctcaagggaatggaggttgggaatatgaccaagaggtgggaggcatatacagttagggatgttgcctaaacttaggaaggtaacatttggaagccaggattccatgctctccatcatccagctgggaaatttagtgcccatgtagccatttatttcaaggacctcaaggttttcaggtggcaagagaacttcaagaaatgtttgacgttcttcagctcatcagaagagcatgaactggtccatgacacagtcaagttgcttagtttcctcttattcctcaagtttgctctcttggcatcgtttgtcagtcgacgcggccg

SEQ ID NO: 5847 - DNA, 610 bp, Triticum aestivum
  Clone ID: PAT_TA_5847
aaagtatcctctccctactcatgatgtagttgtacgtggtggtgctccaaatgctttctcgcaaagcattgttgcatatgatgagacgcaaagaccgactttgaagaaagctctccttcttggtgatgccatttcagatttgcccaaggtagacaactgtcagcctcatgaggtaattgaatatggtggtcaacccaagactgacttccagcgctacattcgacttagtcgtaaagatatgttggactattcctttggtgatgccacttgtcctgaagaaggaaagctcttggaccaccagcctttgaggctaaaccaagatgactatgaccgtgtccagcagattccgataaagaagggagcgaatttccgtgacttgccaggagtcaaggtcggagcgaataacattgtggagtgggatccagaagttgagcgtgtctacctcaagtccggcaaacctttggttcctgactatgcaatgtccttcatcaagggcagatcaccaaagccgtttggtcggttgtggtgggatgagacagtttccacggtcgtgaccagagcagagccgcataaccagatcatactgcacccgaatcaaggacgcgttttg

SEQ ID NO: 5848 - DNA, 1287 bp, Triticum aestivum
  Clone ID: PAT_TA_5848
ttgagcgtgtctacctcaagtccggcaagcctttcgtcccggtcctcccaatgccctcccgcaaggcctggtcgcctatgccgtgtcgccgggtccggccgggtgggacgctcccctccgtggtgaccccagctcagccccgcccccggttcacaccgctccccctcctggggcgtgtgttgacggtccgcgaccccgcacggccgcccggcgcccctgacgacttccgcgtgtagggtccctggacggtgcagttcgtcctggtcggtaatgcggtggctgtcccggttgcacgggctctcggctactccttggcccgagcataccagggcgaggtggacgcggggtatgatgcgctgtttgttcttcctgacagcttcaccaacatcggacagaccggtgcgagggcaagggcctcctccgagaagttgagcgtgtctacctcaagtccggcaaacctttggttcctgactatgcaatgtccttcatcaagggcagatcaccaaagccgtttggtcggttgtggtgggatgagacagttcccacggtcgtgaccagagcagagccgcataaccagatcatactgcacccgaatcagggacgcgttttgactgtccgtgagaacgcaaggcttcagggtttccccgattactaccggatgtacggtcccatgaaggagaagtacatccaagtgggaaacgcggtggctgtccctgttgcgcgggcactgggctactctttgggccgagcgtaccagggcgaggtggatgcggggtatgatgcgctgtttgttcttcctgacagcttcaccaacatcggacagaccggtgcgagggcaagggcctcctccgttggcacccctgcaggcgaggttgtcgagcagtagaacagagcctatctgttgtgttatgtggggtgggggttcgagtctagtccatttgtcgcgggaactaaattgctgcagcatgtaaggattgctcgagttgttaccgtttgtcgctggttgaacttgtgatcgttgagatccttggtcttagatgaagaaactagtagtatgttgttccattaaaaaaaaccaatgacaattattaatgtctgttgctccatcactggaattggtctggtgtatgtgagatttgttctatttgccccaaaaacaccggcagttaaagttatgtgaagctcaaattgtagatttgggcatggaaggatagttgataagcacaaaaaaaaaaaaaaaaaaaaaaaaaaaccccctaaaaaaaaaaaaaaaaagaagtaaaaggc

SEQ ID NO: 5849 - DNA, 2328 bp, Triticum aestivum
  Clone ID: PAT_TA_5849
cggacgcgtgggggggcggtgtcgcaggtggtaactgacatacgcagaggcgaagctgaagacagagactcgagaggcttcgggaggacaggatcgcagtcgcagcggcgacgaagcaaagatgtcgtattcgaggtacaggagtcgttcaaggagtgtggactcgagtgatgttgagaaccctgggaacaatctcttcgtgactggtttatcatctcgtctaactgatcgagatctggagaagcatttctctacagagggagaggtgattgatgcaagtatagtacttgatccatggacaagggaatcacggggattttggtttgttaccatggctactcttaaggaggcagaacactgcatcaaatatctcgaccgttcagtgctggaaggtcgtgtcattactgttgagaaggtattgccgaaagactgttaactctctgatatttgtccattctccttctccttctatatggagtggaattattatgtacagattagccttccaagctaaatatttgaatgttcttctgttgtgaagattttgttgacagcagcaggttgatgcccgcagctgtttggcatcaaattcaaaagatacacaacctaagatcgaaacaatgctacctcacccaaagggttgtacgcccaccattattgttttttcatactatttgtgttcttcagcgccgggggtaactgaaggaggccggggggaagatgcagagggagaccagagaggctgcggagggcagcagcggggtcggagcggcagaggcgcggcgaaggcgtagaaccagcgaagacgtcgtattctatggctggagcatgcgcgtgaggagagttgactggagtgagtcgtggtggcgcctggattatcttggcttgtatctcgtcgatgttggttgaccaagttgtccaccattgggggatggtttgttgcaaagagagttagtggatgaacggaaggagtatgacgtaatagggggataatcgactcgggtaggtttgggtctgtaccctgctacaagcaaaacgccgcatgaggagtgacgcaccatcgcaactcttctgtagagccgaactttatgatagaggtttgcctcccggcaacgctcgaactctccttcccctactcttgtgaagagaagtaataccgacgaattaacgttctaatctcagaatttgatagctgtgcatgttagcagttagtgttgacagtatgttcttgaacccggcgactgttaggaaactcttctccggatccgactactagcacgtacgaaaacgaacctatcctacttatcctacaggaccaccatagtcttctcgttttacgcccaacacagttcatcttcccctcccataggctccttctgatccccaataatgtatttagtcttgcttttgacataaaacaccagtactgattttgagccccttctccaccaccaccgatcacgagctccaataccccaacaccaggaaggtatctgggcaccgtgtggaagcaggtattcccgaagcaggtcacctgttaggagagaccgttacagctcacgctactcgcctgagcgagaacgctcttattctcctaatcgcggagtacgatcataccctcgtcctgacgtccgaagattctacgaccctgttgccgcgaggaggtaccgccctccccatggcagcacgcggcaagtctctcctgctgacgcgtcccagtctcccctctgctcgcggccgtcctactcaccctatgacaggccccactcaccccgccatggtcatcgccaccgttcaagatccccataccgttacagaaggcggaggtcgctctcccatgaccgttctgtttcagcatactacagcaggcgctattctccaaggagcagaagacggagctactctcgcagcatatcgccacgcaggagctactcccgcagctgctccccggcttcagaagaatcaaggagctgttctccgcggaaaggacgcgccggaagcaaggcatcacgcagcaggtcacctgggaagaggcgttccagagaaagctatgctcacagccgcagttcatgctccaggtccgtctccagggagcgctcaacctcagcaagcacctgatgttttacgaagcgccaggccaccgtatttccgttgtaatgttggaattttagtaacttggatgtttgtaaacagtgtggatggtatgatcgtgcacctagtgaagcagctgtatttcgtcatggttctggacttgcatgccatatgcatgctaaacgctgtactttatacttctgtgtctgttttcagtatggttggcagtgttgatag

SEQ ID NO: 5850 - DNA, 1095 bp, Triticum aestivum
  Clone ID: PAT_TA_5850
ttttttttttttttttttgtagaactgaaaatgaagtcttccacaattgttaatttccatgagatggtagtgtgtatcgtggtatgaacatcaccatttcaacattttccttggtcagaatgacgcactcatcagcattgttcatttcaatggaaggggtcaagctctttcatttacaagcaggcaatcaaaattatcctttacttttgggaacataccagtctctctttgtttgatcgtacgagagagtcgagcagctgccgttgcggtaatcccatgacagcaccttcttcatcaagccgcgcagcctctcagcgcctggaccaggctctaaaacagagtcttcctgtctagacaaacaagggtcagcccctccttcaaagctcccattacaccatgccccaggagtgaaccggccttcagagcggtgcagaagctcacggtcgatcctgtccaagaccttgtctgtcttcctttggaaacttccgtgcaaagggcgcgccactcttgaccatgctgttgaagtccttcatggagagggtcagcggatgctgttttgcagggtagtcccaggcaatgtagtgcaggtcatgaccaactgcagtgccctgaaactcatcagagttgcagatcacagtatggaaataaccttctggtgaggagatgaagttgacatagtacatcaggagggtgcgtgggagattatcccaaccccatatgcagtactcccaggaaggatttcgtgagcattatcccaagcagaacccagtatataatttgaaagatgttggcaattctcgccgctcaggtgtcgtagaaaggtcaaacttttttgagagataaagccctgggtccagaactatgggttttgctctttggatccttttccatccagatatttgcatgtgctctataaaattaagatttcttggcaaagacgagaacacatgaagtatatcatcttgcgtcatgaggggataatccgaggcgctgaggttgatgaaccagtcccactccaagccttctttgaggaggatcgccacggcgtggagcgtgcaggcgaccatcgtcggccccttgtacgtgaccaggttg

SEQ ID NO: 5851 - DNA, 873 bp, Triticum aestivum
  unsure (1)..(873): unsure at all n locations
  Clone ID: PAT_TA_5851
ccacgcgtccgggagtcccttcacccaattggggaaccccactctctccccccaccttccgctccactccccacctcatccgatggccaccgccgccgtcgacccgggagaatcgacgccggccaccgccgcgacgccgcgcgccggccccgctcggccggatcccgcgcgccgccctcccgtcaccccgcgcgagctagggtttacgccgttccgcgacccccctccccctcctcctcaagaagaagagggggcgctgccgaactcgccggaggggaaaattcaggcgcctgagtgcaaacctcttgccggatctcaagctgttgcacaaaccgagggcgtgaggacacctgcaagtttggttaagagcacccatgaagctttggggcaagaagcattcactgatgaacagcatgagcagttggatgcacagatactagtcaatgcagatcttagccagggaaagccactagcaaaggccgccgtacgccccgcacgcgactctccttctntcggacgcgtggggccaaattcaccagaggaggttcagacccctgagtgcaaaccttatgccagatctcaagctcttccagaaactgtggtaacccctcccctcccatctctgtatgcatgcacagatcatgtgcatccagctgtgtttactcatgcttcacttccctcccacatggtctggctccctccctaccgaagaactgtttttattttttggaatgtatttttaatattgacatggtttgtcataattgttgtggttaggtgtaatatattgacatgtttatcataattgttagcatgtgaggacacctgtaagttgggttaagagcacccgtgaagctttgacgcataaagcat

SEQ ID NO: 5852 - DNA, 1839 bp, Triticum aestivum
  unsure (1)..(1839): unsure at all n locations
  Clone ID: PAT_TA_5852
gaagagcttccagaagcggttcgggcagtcgccggtgttcatcgcctccacgctcgtcgaggacggaggactgccgcagggcgccgccgcagaccccgccggactcatcaaggaagccatccacgtcatcagctgtgggtacgaggagaagaccgagtggggcaaacgagattgggtggatctacgggtcagtcacagaggacatcctgacggggttcaagatgcactgccgcgggtggaggtcggtctactgcacgcccacgcgcgcggcgttcaaggggtcggcgcccatcaacctgtcggacaggctcaaccaggtgctccggtgggcgctggggtccgtggagatcttcttgagtcggcactgcccgctgccctggtgcgcctagggcggcaccctcaagtggctcgagcgcttcgcctacaccaacaccaccttctaccccttcacctccattcccctgctcgcctcccccccccgccccgccggctccccccgctcccgcagggcccccccgccgcccccgcccgcctccgccagtctcttcttcatctccctcttcatctccatcttcgcgacgggcatcctggagctgcggtgggagcgagggtgagcatcgaggagtggtggaggaacgagcagttctgggtcatcggcggcgtgtcggcgcacctgttcgctgtcatccagggcctgctcaaggtcctggccgggatcgacaccaacttcaccgtcacctccaaggccacgggagacgaggacgacgagttcgccgagctctacgccttcaagtggaccaccctcctcatcccgccgacgacgctgctggtgatcaacatcatcggcgtcgtcgcgggcatctccgacgccatcaacaacgggtaccagtcgtggggcccgctcttcggcaagctcttcttcgccttctgggtgatcgtgcatctctacccgttcctcaagggcctcatggggaggcagaacaggacgcccaccatcgtcatcatctggtccgtgctgctcgcctccatcttctccctgctctgggtcaggatcgaccccttcaccgtcaaggccaaggggcctgacgtgaagcagtgcggcatcaactgctgatcgcattaagagctctggacattgtgcatagggagaagaacaatttggacgcaagttttgtattgtggatgtttttgttcatgctatgttttgtgtaatattttggtggccagaaatggtttaaacaagaattgaacagggggccagactttggatgtcatccgaagcaagcaacaacagcaaccagtcctggggcccgctctttgggaagctcttcttctccttctgggtcatcgtccacctctacccgttcctcaaggggctcatggggaggcagaaccggacacccaccatcgttgtgctctggtctgtcctgctcgcctccatcttctcccttgtgtgggtcaggatcgaccccttcattgccaagcccaaggggcccatccttaagccgtgtggagtacagtgctgattggccttagttgtcaatggctcgcacacattgcacttttggggcggttcatatttgacttgcttattttgtacaagttttgcaagcgagataaagtgttgattcaaggggtttcaatgtttgtaagaatttggtcaggcacactaatggtcccaacgggttcgccactggggcggcccggtaccaatccncctataggagcctatacgcgcgncacgggcgtccgtttacaagtcctgacgggaaaacctggcgtaccaattaacgcttgcaacaatccctttcgcaactggntatacgaaangcccacgat

SEQ ID NO: 5853 - DNA, 576 bp, Triticum aestivum
  unsure (1)..(576): unsure at all n locations
  Clone ID: PAT_TA_5853
tcccatcgccaaacccctcaatcgtctcaattcgggccgcggaaccctagatttccgccggagatccgtccatcaggccagccactgatcccctcttcgatcagcgagcacccaatccgcccctttttggacgggaggcgctgctagatcctctgctcccgatccacaaattccagcggagcattcctgatcttcgtcaacctcgggccacagtctcggtgaagaagctaggtccggcaggcaccatggggaggcctctgatctacgagatactggagaagccggcgagcagcggcgtgatagccctctgctccctcatctggttcctcatccagaagaggggcatcgggtacgcggacgtggggctgagctacnaggcggccgtggagggcgggcagcactggcggctcatcaccgccgccttctcgcacgtcagcgtggtgcatctggtgttcaacatgagcgcgctgtggagcctcggcgccgtggagcaggcagccgggctcggcgtccagtactacctgcactacacccttgtcctcgtggtgctgtccgggctgctggttctcgggatct

SEQ ID NO: 5854 - DNA, 627 bp, Triticum aestivum
  unsure (1)..(627): unsure at all n locations
  Clone ID: PAT_TA_5854
actcggagagcggggtgatgttgacgaccccaacggggaccttagaagcactgaacacttcgccgataacccgcatcaggcccttgctagtgcctggtccccagtaaganaaatctttgattgggggagtttggttgtagcagtttccatcagacttgtcgccccaatctttgctctgggtatgagtaggtgacatagtgacaaaaaacgcccttgaactttttgggtccatgttgttctcgacccatttcgccacggcattcaggaccatcccatatgcatcctctgtttccatttctttgatgtccttgttcttatcttcaaaggaattttgcagaattttcatcttttgtccgggcatccaccacagggagggattgaataccacaacgtcagctcctttccaaaacttggcgtgcttttcaatggctgtnccccttactattctatccgtgacacggtgaacaacagcatcgtcggaatttgattcggctagaaagggggcccaatagaactcaatcgtggcattgtagtcctttgctctgaaaactgttagcgagtcaaatgtttccatggacttggcactctcaggaatggcccggtgcaggaggcagaccaacgacacgt

SEQ ID NO: 5855 - DNA, 894 bp, Triticum aestivum
  Clone ID: PAT_TA_5855
cggacgcgtggggacctagatcccctccttccctcccactctcactcccctccggctcctccgatggcggccacgcctcacccggtgaccaccctcgacgacgtggaggagctgctgcggtcctctaaggagaagggggaggaggtcccctgctgccaactcgaggcggacgcggccatcaacgccgccgtcaagctcaaggccatggtcgactccggcgccgtccgcctcgtcaaccaggtgatgctggccaacaagctgcaggccaaggccaccgtggaagaagggttcaaggagatcatcgaccggacgctgttctcgccccgggagatgcaggcgctggacgagagcatcgccgtgctcaagaacaggctccagatcccctacgcggtcgcttacccggagtccatggaggaagaagcaataatctctgaggtgcagtctcaacgggtggcgtgggctatgggtctcatggggctggaggttgagaaggaggtgctggaagagcaggcaccgaaggaactggaggagttccatagcatgcttgctgatgcgctgcagacgccttcattcatgggctcggggagcacagaccacaagttcctcacccattctgggcagctcgagctagatgacatggagtaaaaccattgagttaccactgactagctaccatatgctttgctcgaatgtctggtagactctgcttccattttggctgccaaaccatctatctatcttggggcaggaattagttttatattatgtaggttgggtgatgagagtatgtctcccgtctaattggtcaccatttgcagaaagaacggccgtagttaaccggtttagaagtcgtgagaacctttaaggatatgctttcggtgcagaatcgaacat

SEQ ID NO: 5856 - DNA, 678 bp, Triticum aestivum
  Clone ID: PAT_TA_5856
gcaggacttacactcttaaggtgaagagttcaaataagatcgaggatgtcgaggctaaaatgcatgatcaccatctagatgtgcagggtcttatctttgctggcaagaagctggtgtatggccgcaccctggcagattacaacattaagaatctgagcaccctacagcttgtccttcacctgcgtatttctgtcaagacgctgactggcaaaatcattgatcttgcggttaagagttcagataccatcaagcacgtcaaggcgatgattcagagtcaggagaacattccttgggataagcagggtctcatctttgccggcaagcggctggaggatggccccaccctggcagattacaacattgagactttgtgcacctttgagcttgtccctttcctgcatgtgacagtcaagatgctgaacggcgagagcattgatcttgcggttttgagttcagatacaatcgaggatatcaaggtgatggtttatgatcaggagggcattcctcagcgcttcatctttgccggcaagctgctcgaggattaccgtaccctggcggactacaacattcataagttgtgggagtgcgcgcttcaccttgtgacgtgcatcggaaggaatagtgcgattcacatcaagatgctgactggcaagaccatttttcctgcggttggcatta

SEQ ID NO: 5857 - DNA, 431 bp, Triticum aestivum
  Clone ID: PAT_TA_5857
gtgcttctcccctccattccgtacgcacgcctcgccgcgctcccctcggcatggcctcctcgtcgccgcccccgagctccaccgcctcccgcgacgacgacgacgacacgccgccaagatgcgatgtgggagaggcggacgcacgcgaggatcctggtctcggacgccgacgcgggctgcatcatcggcaaggccggctccgacatccacgccatggaggcccgctccggggcccacatcaagctctccgggcgaggccggcccctccccggcacggaccgcagggtcgtcctcgtctccggcctcttccgcaccgtcatggacgccgcagagctcgtcctcgagaagctcttctacctgggcgaccaggtgattgacgctgaggccaccgtggtgctcgtggtgcccgacgcctgctgcggcgcgctcat

SEQ ID NO: 5858 - DNA, 1015 bp, Triticum aestivum
  Clone ID: PAT_TA_5858
gtggaatggttagagaacttctcctttcctttcatagatcaactggacagaaaccccaaaggatcatattctatagggatggtgttagcgaaggacagttctatcaggttctgttgtatgagcttgatgcgattagaaaggcgtgcgcatccttggagtccaattatcagccacccgttacctttgtggtggtccagaagcgccgcccgacacggctatttgctaataaccacaacgatcagcgaagtgttgatccaaaaagtggaaacatactgcctggtaccgtggttgattcaaagatatgccatcctaccgagtttgatttctacctttgtagccatgctggtattcagggaacaagccgccctgcgcattaccatgtcctttgggatgagaacaattttaccgcggatggtttgcagactctcacgaacaacttgtgctacacctacgcaaggtgcacccgttctgtatcgattgtgcctccggcatactatgctcacctcgccgcttttcgagctcggttctacatggaaccggatacctccgacggtggctcggtcccgagcggcgccacgacaagccgtgcccctgctggtgcacgcggcggtagtagagctgcagggaatgtcgctgttaagcctctgcccgacctcaaggaaaacgtgaagcgtgtcatgttttactgctgataagtttaggatcccaactgaattacatgctgatttgccaatcctttctttgcggcacataagcaatcctcattcatcacatgagtgtatatgtgtaccagtgctgccatgtttcctgtgcaacctgaacatctcaattcctcttcgccccctacagattttcaaatgacattgccctgtttgtcttgaacacattattggcctgcacattcaaacatccgtccaaattggaaactgtaaagcttccggggcatcctccggccctgaccctttccaaattttccccacatttatttttgcgagggggcatgtccccctcccaa

SEQ ID NO: 5859 - DNA, 648 bp, Triticum aestivum
  Clone ID: PAT_TA_5859
ctttctctctccacccaaaactgaatccccaaagcgccagcgacagaatcacgcgacgacgcgaatcttcgtcccgtaaaccctagcgcggtctaccctcctcagcccggagccgtctccgtcgcctcgcccaccggattccccgacgagggttttgggagggtggtgcgccgcccctgccgtccggggatagcctgcgcgtctcgatctcgggggagctagggttttgtgatctgaggcctcgaggcgtccggcgtcgccctggttctgatgagaattggcagtctaatgctcagattggccgccggcgacgacgagaggagcagcttcgttggcagcggcggcggaggcctcaggttcaccgctcccaaggtccgtacacgggacaagggcgcccctatatccctctaattccagagggttgctggtgttgagacgtggagccttcgctgaagaaactggggaatgacgaggatcttcgtgcagcgtgggcccggtggctcctcgtccaactcggctcgctcaggctcacaggcactgcagcagcaacagcagcagcagcagaaccagccagcagctgctgcccgggaggaggagcttacggtgcagccgcagccactggagctcttgtctttaggtgatacaact

SEQ ID NO: 5860 - DNA, 806 bp, Triticum aestivum
  Clone ID: PAT_TA_5860
cacggtaaccattataattcagttgttgatcctcgtcggctgacagttggggcaggccttggatttagctcccttagagggaccaacagtgttgacagagaccaagtgaaggctgcaataaaagctcagcaagatcagcagattgagaacgcacttttggctgaagggcgactctactctgatctggagttaactgagaaggaaatagagcggatggtgatggaggcctctcgggcagagtatctgaaccagcagcaagttaacttcagagagtcatcaaggtcaggggcagagccatcttcctccgccgcaattagtggatcatctggttcggcagcggatagaggcagtgagaattgtttcgtactcccagacacggtgctgactcgcagcatgcagttgcttctggcaatgggctttagttacatgcaagtgatggaagcctacagtatattcggagaggacatggactcgatgatctgctacctggtggagatgggaggcaccggagcctccgcaggcggcagcaaccgccggaaagggaaggctgctgagtgatgtgtgcacctttctagaggcgactgaggatcgaagttatcaggcgtaactttcaggactacatacaaaataacgatagcctctgtgagttaagaagacatcgatgttgtgctgccatgttggggaatatataataaataatgaataaaaggtactctcaagagactttctattcgatctggtgtttgaatggtgtctgttgtagtacgtacttttgatctgttgagtcaagctgctcccttgtgacc

SEQ ID NO: 5861 - DNA, 1068 bp, Triticum aestivum
  Clone ID: PAT_TA_5861
gtgctttttgactccaacaaagctactgctttcttgcctatagacccacgcttccttctcgatattgacaatatagaggaggcaggcatccggccgggtttagtggagcagttcatgataattgatgagaacccaaatgatgaaactttgattctgagcttacaatcaattcagcaagaccttgcttgggaaaggtgcaggcagcttcaggcagaggatgttgttatcacgggtaaagtaattggtggtaacaaaggaggtgtggtggctcttgtggagggccttaaggcatttgttccattttcacaagtgtcatcgaaaacaactgctgaagagctgcttgacaaagagctacctctgaagtttgtggaggtcgatgaggaacaaggcaggcttgtcctcagtaatcgcaaggcaatggccgacagccaagcccagcttggtattggttcagttgttttgggaactgttgaaagcctaaaaccttatggtgcctttatcgatatcggtggaatcaatggacttctgcatgtcagccaaattagtcatgaccgtgttgcagatatctcgacagttcttcaaccaggagataccctcaaggttatgatactaagccacgaccgtgaaaggggccgggttagcctttctacaaagaagcttgagccaacacctggtgacatgattcgtaacccgaagctggtttttgaaaaggctgatgagatggcgcagatattcaggcagagaatagctcaagcagaggcaatggctcgtgccgacatgttaagattccagccggagagtggattgtctctcagttcagagggtatcttaggtccattgtcatcagacacagcagaggaggaagggctacccacggacgaataggtgcaatagcaagaatgcatctgattccagagatgcctggtagttcatctttttgtgaatgcacgatgagaccgtatcatattcagataatttcccctcgtcaacttgcgcttgtatcattgtgtatgaagtataaggtgctgaaaaacggcggaaaagaaattcaagttgtacccctttggc

SEQ ID NO: 5862 - DNA, 3045 bp, Triticum aestivum
  Clone ID: PAT_TA_5862
agttaggttaagttaccatcccggtaaccattataattcagttgttgatcctcgtcggctgacagttggggcaggcctcctcccccgcctgcccgttcctcattcccagcagaggcagaagagaatggcgtccttggtccagcacgtcgcggggctcgcgtgcccaccgctctccggcgcgtcgcgccgccccggggcgcctatgcggccgtccgcgctggtctgcgggacgtacgtgctgagcaaggatgagaaggagcgggagcggatgcgcacgctgttcgacgaggcctccgagcgctgccgcactgcgcccatggagggcatcaccttctcccccgaggacctcgaatccgccgtcggagaccaccggacatcgacactgacattggctcactcattaaagggacagtattcatgaccacttcaaatggtgcatttatttgacatccaatcaaaggctactgctttcttgcctatagatgaggcatgccttctcgatattgacaatatagaggaggcaggcatccggccgggtttagtggagcagttcactgataattgatgagaacccaaatgatgaaactttgattctgagcttacaatcaattcaggcaagaccttgcttgggaaaggtgcaggcagcttcaggcagaaggttgatgttcctcacggagtaaaggaattggtggtcagaacaggagggtgtggtagggtcttgtggagcgccttaaggcatgtgttccatattgacaagtgacagagtaaatgactgcaagagcaatgcttgcatcagagataaggctctacctgggtagttgccctttgtaggtaatggagaatgaaggcagtatcgtccagtattcaggataatttcccctcgtcaatttggcaatgtgtcattgtgtaagaactatagggtgctgaaaagcggcggaaaggatcatcaagctttacccaatcagcaaactcaggcatgcactcgtcaatggaaagtagagggggctgcatcgcacgcctcatctcctgccactcgatccccacaacgatcataatatggggcgagttagtaaaacgtgctggactatggaagcgaaaagccagaacttattagctcgtggagaaagggttcttatatgctagctggggttcttaagggattttaggaggggagtagcccttctgccgggaactgactttttaagggtgtatggctcgatccgacagattaagatggctcccattcaattgagtgtctcagagctcttgaagtcgagcatatccatggacatcaggcacagcgcggaagaatggctgccataagaacaaaggctttcaatgggaagacgccggctaatgccattgatgttcgagtgtccggttgttctcaaattcacgataaagtccatgcggtgaaatatagaacttaagatgcggtctgcaacttattcttgtatcattgtgtgggaaatttaaagtcctaactaacggcagaagaaaacggtaagtagcggtcgatgaggaatgttggcaggcacatggcgtgcagtaaagtgtgtgagtgtacatgtagtcagatgcaagaggccgtgtcagccagtcatattttggggtttggatgtagtaaaaccaactaaaaatgcctgatgcagagcaagtggaacttaattagtatgtgtgttgtcagtctctcactgtgtggggcgtccggagttttagctcccttagagggaccaacagtgttgacagagaccaagtgaaggctgcaataaaagctcagcaagatcagcagattgagaacgcacttttggctgaagggcgactctactctgatctggagttaactgagaaggaaatagagcggatggtgatggaggcctctcgggcagagtatctgaaccagcagcaagttaacttcagagagtcatcaaggtcaggggcagagccatcttcctccgccgcaattagtggatcgtctggttcggcagcggatagaggcagtgagaattgtttcgtactcccagacacggtgctgactcgcagcatgcagttgcttctggcaatgggctttagctacatgcaagtgatggaagcctacagtatattcggagaggacatggactcgatgatctgctacctggtggagatgggaggcaccggagcctccgcaggcggcagcaaccgccggaaaggaaaggctgctgagtgatgtgtgcacctttctagaggcgaccgaggatcgaagttatcaggcgtaactttcaggagtacaaaataacgatagcctcgagttaagaagacatcggtgttgtgctgccttgttggggaatatataataaataataataaaaggtactctcaagacaatggccgacagccaagccagcttggtattggttcagttgttttgggaactgttgaaagcctaaaaccttatggtgcctttatcgatatcggtggaatcaatggacttctgcatgtcagccaaattagtcatgaccgtgttgcagatatctcgacagttcttcaaccaccacgtgtccgcaaggttatgatactaagccatgaccgtgaaaggggccgggttagcctttctaccaagaagcttgagccaacgcctggtgacatgattcgtaacccaaagctggttttcgaaaaggctgatgaaatggcgcagatattcaggcagagaatagctcaagcagaggcaatggctcgtgccgacatgttaagattccagccagagagtggactgtctctcagttcagagggtatcttaggtccattgtcatcagacacagcacaggaggaaggcctacctacggacgaataggtgcaatagcaagaatgcatctgattccagagatgcccggtagtccatctttttgtgaatgcacgatgaagacaataccgtatcatattcagataatttcccctcgtcaacttgcgcttgtatcattgtgtatgaagtgtaaggtgctgaaaaacggcggaaaagaaattcaagttgtaccccttttgtaaagccatcaatccatttcgtgc

SEQ ID NO: 5863 - DNA, 373 bp, Triticum aestivum
  Clone ID: PAT_TA_5863
acagtaggaagtgcccagcttgatctccttcagcccggtcagcacgtcgagtttcgtcaggttcagggaggagaagccgttgatctggcagcagtatctgagcgcgactatatcgagccagccacaacgcctgggccgacctgttgtggtcccgaactccattcccgatgcgcggagcaaatcgcccgtcttgcccagcagctccgttgggaatgggccagatccaaccctggttgtataagcttttaccactccgatgatatcgccgagggttcttggagcaatgccgaggccagtacagatccccccagctgaaggacttgaggaggtaacaaaatggatatgtaccaaagtcaatgtctaacatggtagc

SEQ ID NO: 5864 - DNA, 1213 bp, Triticum aestivum
  Clone ID: PAT_TA_5864
cttcggccgcggccccgccgccccgcccccctcccccgcctgccgccccccccccctccccccccgccccccccccccctcccccgccgccgccacccccctgcctccccgcccccccccgcccccccccgccctccccccccctccgtttctcccccccccccggcccgggcccgcttcgcccctccccggcttcgccggtgccctccccgccgggggagtccccccccgcgcccggccccgccgccctgccgcggcccgcatcgcgccgctcccgcgcgtcagccccgtcctccgcccctgcctgccccccggcgtcggcgcctccatggccctcgccctggcccctagccgcccccccgccgccccccgccgtgagctccggccgccgccctcccgggcgcgtccccgccctcccgcggccccgccgccgcctcccgctccgccccgttcttcctcctccccccctccctccctcgccccgccagcgcgtcccgggtcaacagccaccgcgttgccattcgcctgcctagcctctctctggctctccaccgtcaacgggtgggcgacaaaaaaattgcaggcgcgcaggctgcatctgacggccgtcgatggtcacatgtcggacgagcccaaccgtgcaatacgccagagcaggttgtgcagtactttttgaaaatttctgtagtttatttgttatagatgcgcgattcacttcttcagccacctctttcttgctgttcacttgtcaggatagagaagtacgatggtgtgaactacttcgatgggagcagcaggggagtcgaggtggtgtttctgcctctggatgtcgtagtcgtgcggttcggctgtgccccattgcggcttggtattttccctttcttgctgataggtgcttcagtgcagttggcttgatcgaagatgaggttcggctggtttgtgtatgctggtcagggtctcttgtacatgcagctcacagcgtgatgttcgcgcagctcaccatcgtcaggctcgcagcttcatttgttgctggcagggtcgacgcaactggacccaggacatacggctttgatttatttttcattttgttttgagtgggttttatgtaaatttatagggatgtgtttggtaagttttaaaaactactattcgagttctcctttgttgctcgggaaaaaaagaactttacttcagggtacgcacggggcagaga

SEQ ID NO: 5865 - DNA, 1029 bp, Triticum aestivum
  unsure (1)..(1029): unsure at all n locations
  Clone ID: PAT_TA_5865
gatcttctctattcctcctgcgagtttcgcgacatagctgcttagcacgtcggagtccattgccgccgccttcttgacgctgctgagctcgttcccgaggccagccaccacttggaggccgagctttttgcactcaagctcgtctcggagagggttcgcaagagttcttggcgttgattggttgctggcagagagacgggaaccctctgtccggatgatctcctgcacgacgaaatgcagaagggttgtcttgccatcggtgcctttgacatcagccaatttgagcagagtgtcaagcttgaatgcatgcgcatcgccgcgatttgtgccaacattcatcctgttgccagtcttgagaatggcctccagtagcttcagaaatagtctgctgttcctaagctcatcgcaagcagcctcaaggatctcaaagttgttcttcaagtacttgacctctgattcaaagttagcaatataaagcattgcgtctactcttttgaaagcaaaaggcacatcaagaaccgccttaaggaacttttcggaagggccaagcttaataggagatgtctcttctttgaattctctcagcttgatctcctcttccttggtaggagccatctttagcaaggtctccagtaaatctgcgccgaagttctgcgtgttaccttcgcagagggcctcgcagacctcctccttggttacattcagagcgcgcagcaagatggcgatgttctgtgccttctttggatccagcagcaccttgttctccgccttgggcgtcggcagcgctggcctctttgtcgcctccttcggcgccgcattcgccggattgcagatgaacagcgtctcgatcatctcctcattcacctggaatgagctggatttgagctgatcccacaccatggctcggtcggagctggcccggaccttgtcccagtgcaggggcttcagcttcggccgcggcgtggtctcctcggacttgtcgacgtggtccgcattgtcctgcagccgtnccggggcctcgtgccgaat

SEQ ID NO: 5866 - DNA, 386 bp, Triticum aestivum
  unsure (1)..(386): unsure at all n locations
  Clone ID: PAT_TA_5866
cccacgcgtccggtccatgtccatgtccatgcttcctcttcctgcgccctcactctcccgtcagatcccctctccccacttcttcctcgcccaaattccctctccccgaccaagcttcagctctgctctagccccagcaatgccgcctagctcgtagccgacgcgcccgtccgtccgtcgcaactcgcaatggcgcccgcggcggcgctgctgctggcgtgcgccgtcgccgcgctggcatgcctggcactcgcggacccgccggcgagcgagcagacggcgctgctggccttcctcgcggccgtgccgcacgagcgcaagctcgggtggagcgcctccacgccggcctgcgcctgggtcggggtcacctgcnacgcngncaactc

SEQ ID NO: 5867 - DNA, 590 bp, Triticum aestivum
  unsure (1)..(590): unsure at all n locations
  Clone ID: PAT_TA_5867
cacaatttngaactttttttgcccaagtccaaatgnnttcccaaaaagcacgtgttttggcagttgacgattacnagcatgaatnttaggagtntactaagtttttgcccaagacatgtctnnacacagngtattatcaccaagcaagttgtcaagtagtcagcagaaagccagcaagcagaaagagtaggttgtttttgtacccaacacaaagcacacaaccgaccaccccctccatgcctccatgtagcatgcagtctgaacctcagctggctcgaatctgacgacgtggagaaacagcggcgcccgccacccagattgtggagaaccagcgtccaagtaatggtcggcggaggcgaaatcctgttcttccgccgtttcccagtctcccgtccgtggactccgacggcagctcctgtggacggtggacgagtggattcgagcggctataggaggcggcgtgggctgtggactagagcggccggtggaggtatggaatcgagcggatgcaacgctgggtgtgtactcgagcggcggcggcacggcctccctgttgccacgatgcggccagcggccagcgctcgggtcgc

SEQ ID NO: 5868 - DNA, 1730 bp, Triticum aestivum
  Clone ID: PAT_TA_5868
cgtccgaccggtggcacggctggaaaccacggtggaggcgcagaaagccgacttcgaccggctcaagaagatgctcgccagcatgtgcttccggctgtacaacaagaagggcgacatcgcggtgtggcagaagtccctcgacgccggctgctacgacaagctgacgccggtgaccaccccggccaagtgcgacgacagcgtcgacgccgacgccgcgtggtacgtgcccatgcgctcctgcgtgaccgcgcccagccccaagtcccgcggcaaggcgctgcccaagtggccccagaggctgagcgtcgcgccggagcgcgtctccgttgtccccggcggcagcggcagcgccatgaagcacgacgacggcaagtggaaggcggccacgaagcactacaaggcgctgctgcccgcgctggggagcgacaaggtgcggaacgtcatggacatgagcaccgtctacggagggttcgcggcgagcctcgtcaaggaccccgtgtgggtcatgaacgtcgtctcctcctacgggcccaactccctcggcgtcgtctacgacagaggactcatcggcaccaaccacgactggtgcgaggccttctccacgtacccacggacgtacgatctgctgcacgccgacggcctgttcaccgcagaatcacacagatgcgagatgaaatttgtgcttgttgagatggaccgcatccttcgtccgaccggctacgccatcatccgggacaacccctacttcctcgactccgtggcctccatcgccaaggggatgagatggacctgcgacaggcacgacaccgagaacaaggagaatgagaaggagaagctcctcatctgccacaagcagctctggtcggcaaagaaggcatagctgcgaaccagcagtctcagtgacaggaattgaccatgatcccacggaaaggcgagggcgattcatagtcgacactttgatagaacaagggggggttcatagtcatcaaaataaactacatgagtaatataaatatagttttatcatattcatatataggaggatccaatagttagctattgatcacacaacagttgattctttttctttgcggaaaaaccaggggaggtaaagtttggtgagtcacctgtaagttgttatccgaatactgtatgcatgtcctatagctagtcggtactgtgattgtaatcgagcaatcaagcggggtggctataaatattatttattcaaatgtggcctccatcgcgaagggcatgagatggacctgcgacaggcatgacaccgagaacaaggagaatgagaaggagaagctcctcatctgccacaagcagctctggtcggcaaagaaggcatagtcacgaaccagcagccccagtgacaggaattgaccatgatcccagtggaaaggcgagggtgattcatagtcgacactttgatagaacaaggaggggttcatagtcatcaaaataaattaaacaagcaatatatatagtttatcttgtcatattcatataggaggatccaatagttagctattgatcacacaacagttgattctttttctttggggaaagataaggggaggtaaagtttgatgagtcacctgtaagttgttatccgaatactgtatgcatgtctatagctaatcggcactgcgattgtaatcgagcaatcaagcggggtggctataattattatttattcaaatatttatggagcacgaagtgat

SEQ ID NO: 5869 - DNA, 481 bp, Triticum aestivum
  unsure (1)..(481): unsure at all n locations
  Clone ID: PAT_TA_5869
cgagtttttttttttttttttttcgaaaaggaggaatacccccggcctctgcatctggtcgatgcatacggccactttattaattattagcacaaaaccttacagagtcgtacaacagtaagaccaaagccaccatcttcgcaacctctgtcgctactcctatctaactgatgaaggggcgctgatggtctgggcctaataccaagcagacctcgcagccaaacctaacatctgagacctgaggtcccaacctggacgcctgccgggtatgggcgcccaccagtccggcgtgctcctcaaccaggccccctgccgggccgccgcccgcccctgccacgtacccatcttcaganctgtactgttgtaactgccttgctcggtctcgctgccgccgangcaacacgattcananaggtcgncctctgcgcctgtcgtcncacaatctgacgccaagcncncngctcatgcngccaanaccccc

SEQ ID NO: 5870 - DNA, 817 bp, Triticum aestivum
  Clone ID: PAT_TA_5870
gatgtttgccctctgtgaaagaagagtcgggtgagaacatcaacaacaagctgcatctggtgatgaggagcgggatgaccccgctcggatacaataccgacctcatgtacgctgcgtctgattctagggtcctggatctatttgtcttaggtgattaattcagacgagtggatgatctgctagatccttggtctggtggacccggtatggagcactgtgcttacgctacgagacactctattccgccgatgcgagagtagcgtctgtcaaatgacgtgagtgatggctcatgggtaccatgtcgacattatcggtgtactcataatagggagctggaccctggttggactagtccctgatacagatactggctatcaactacgggtgctctcctatttgtaaacaaaaccgccaccactactggagaactgcagaagcagcgagtatagcatggagatgagagcaacgcgaagcttctttgcttgagatagattgtgcttacacgtgaagaaaatgaactgcaagtcttctatctctctcttatttgctgcactgatcccctacatgttcctggtatttgatgcaagtcaagctgcagttccaacggatacccttcttcctggccaatctatctcgggcagcgaaattttggtctccgagaatggtgtatttgagttggggttcttctccccgtccccaggtgccatgaagcactacttgggcatacagtacaagaacctgataggcagccaccgagctatgttctggctggggaacagaatccctatcaccagctttctcaacacaaccttgtacc

SEQ ID NO: 5871 - DNA, 704 bp, Triticum aestivum
  unsure (1)..(704): unsure at all n locations
  Clone ID: PAT_TA_5871
gggaggcacgcgtccgacccccgctcccccactcgtgcccaccacccgcacttcctcccactttcgtcttcccatctccttcctctccgaaccacctcccaccccaacgcctccaccgcacaacctccctccccgcgccgccccttcacgcctcgcaccagaccaaccccaatcctcatcaccttctaccgccatcgccggcagccaccagcgccgcgccgcgccggccgggcaccctccaccgaccggccttccacccacacctacccccaccgacgggactcatccttctcctccgcagagccccacctccttcccaccgcgccgcccctctctggctaccaacctgctgccccgcgccagatcgaggaggcgccgctcagcaacggtgctggaagctacgcgcccgagatctggaacgcgcccggtcctccccgttggcatcttcctccggcgcccccttccctcctgaccggcaccgccctacctctggtcgcaccancgccgctgtgctggatggccggcggctcacctaccaccgcttggagatctgatcccgggctgggagtgggcggcggtcccgcgtgttcccaaggaggctggatccccacgcgtcttcctgtccctgtgtgggtgcgggcggccatcacctacccttccgtgagcaccatggcgaccacgcgcgtcgaccacctggactgcat

SEQ ID NO: 5872 - DNA, 419 bp, Triticum aestivum
  Clone ID: PAT_TA_5872
ttcggcggcgatttttactataatatcttcaccatgggcgcgtgcaactcgtgcgaggcgaccgccgtggcggcggtcacgggggcctccgcggtgggcgaggccacggcggcaagggtcgtgctcgcggacggccagctgcagcggttccccgggggcacccgggcgtcgcagggccatgaaggccgcggcggcggcggctcccgcgggcgcgtgcggcctgtgcagcgccgacgggctcgagctcggcggcgcggtggccgcggtggcgggcgaccaggagctgcagcccgggcagctctacttcgtgctgcccggcgcgatgcggcggcgggccctgcaggcggaggagatggccgcgctcgcgatccgcgccagcgccgcgctggccggcgaccacgacggcccgctcgtgttcc

SEQ ID NO: 5873 - DNA, 703 bp, Triticum aestivum
  unsure (1)..(703): unsure at all n locations
  Clone ID: PAT_TA_5873
gggcggcgttccggcccgcactcctggcgctgtgtgggggccgtgctgcaggtggctggtgctaccgttgggggtggcggccatgcgctcgttgaggggggggtgtggccgcgccaggctgctgccgttcgctgtgacacgtgagtgcctcgggggcgtaccggctggttcgaagctcggccagctgccccggggacgggttgggcgttgtctgcgggcccccccagaggctccagggcctactggttggtgtaggcgtcctggtctgggctggtttgggcagggtcgaccgatccctcgcttggtcgggtccgttcggaggcttctgtgcgtcccagacgtctccagcgtgctggccatggccaggggggtcgggtggccaaacttaaagtgagaggagtccgttaagagagatctgaaggaatggaatgtcaccaaagaactagccatggacaggggtgtgtggaagttagctatgcacgtgcgagaaccatgagttggttttgagatcttatgggtttcaactctagcctaccccaatttgtttgggacaaaaaggctttgttgttgttgtacagtacttgctgaaatagtttgacgggaagacaattatttcattatgtatcaaaattaatgaaattctgatgaaaagtacaaagtgaaaaccatgctcaagagnagcgtaaattattgtcatcaccac

SEQ ID NO: 5874 - DNA, 620 bp, Triticum aestivum
  unsure (1)..(620): unsure at all n locations
  Clone ID: PAT_TA_5874
cggcgagcgagccataatataccaaacccaaaccaagcacacggcataaccagcaaccagcatcgcatcaccatcgcgtcgcgtcgcccgcctcccaggagtcgcgcgctccttgtcctcctccctcgtgtctacgaccacctcctcctcctccctctcttgcaacagctagaaagcctagaactatccctctacaggcctcgccggagatggcgaccacgccgttgctgtcgggaaaacaggtggaggaggacacgatgccgccgttgcatggcgttgtcgtgatcgccctcccggaccacgccgccgacgggggccgggactcgccgtccaaggagcgagccggcggccttgagacgggcatggaggctgctgcggctggccacggcgccgctcgtggtgctggcggcgttcgcggtggcggcgcactgctacggcctctactccttctccttctccgggggggatgactggaaatgggcgaagggccgcctcctccttcctgctgccgctgcanccaaaccaaaacccgccgggtcaaagnggaggatcaacanggcctnctgccgagaggatactnacttcaaaaacatgggaanctgaaggcctanttctnaaat

SEQ ID NO: 5875 - DNA, 926 bp, Triticum aestivum
  unsure (1)..(926): unsure at all n locations
  Clone ID: PAT_TA_5875
ggtaccactaagtaagatcgacgacatgggattcatgtgctgttcctcacacccactacgggcagcctcgttgctgctgctttgcttctgcgtggtgctatccagagtgcacgcaggaggatctcgttctcgcgagctttacatcgcttacctaggcgacgtgaagcacgagcacccggacgatgtcgtcgcctctcaccatgaaatgctcggcactcttctccaaagggagggttcctcagcctccatggtctaccactacaagcatggtttctcgggcttcgccgccatgctcaccgcggaccaagcaacaaggcttgcagaatttccgggagtcatcagcgttcaaccgagcaagacgtacaggagcaccaccacgcggagctgggattttcttgggctccattatccgtcctcccatatgccggccagtgagttactgcacgcaagcaactacggagaggatataatcattggcgtgattgacaccgggatatggccggagtctagaagcttcagtgaccaagggtacgggccggtgccatcaaggtggaaaggaaagtgccaggttgggcccgattggggcaacaacaattgcagccgcaagatcatcggcgcaaggttctataccgttgggatcgccgacaaatacttaaaggcggactctctctcgccccgggatcacaacggccatggcacgcacacggcttccactgctgcgggctctaccgtggaggaggaggtagccagcttccacggccttgctgcgggggtggcacgcggaggcgcgccacgcgctcncatcgcaatgtacaaatcactctggagcgtggatgaaactggctccacggcgtctgtgctagccgccatcgacgacgcgatccatgacggggtggacgtattgtcaatgtccctcgcgtcccgcg

SEQ ID NO: 5876 - DNA, 1522 bp, Triticum aestivum
  Clone ID: PAT_TA_5876
cggtggggtgtgctagcagtcctcttccttgacacgccccctttgcaatgcacacacaactggtactgacattctatgggctggcttgccaatgataacacttcctctagagaaaatggcaaccagaggtagctggctccctttgtttagcgactgggcttggggctgtgatgtgtctgccctgccctctggtgtacgaagaccgagcagttgaactggcgacaaacccggcaaaactccaggcactgaccaataagcttaaagaagttcgtttaacctgtcctttatttgaccctgctcgctgggttcggacatggggtatcccagggacgacaggtgcttcttacatagactactggggcacagatgagttggtttatccaactcgctatgcacatatatactctgaaaaccttggtcatctcccaaattgcgatttcgtcaatgactacaagcggagaaattgtgatctcttatgtccctggtttgcccgcaccaaacttcacagtatgggttagcccaaggttaaattcagctttgcatgctttgaacacctctacaaagtaggtcccagaattatttgtttcatggggtaatattgtcaagcgtgttccaaacagtgtatgatggctcttatggtggtcacccgctggtggtaccagtgcaaccccacatgctgctgcaaggggagtgagccctgatcggatcattttcacagatgttgcgatgaaacatgagcatatccgaagaagtgaattagcagacctcttccttgacacgcccctttgcaatgcacacacaactggtaccgacattctatgggctggcttgccaatgataacacttcctctagagaaaatggcaaccagagtagctggctccctttgtttagcgactgggcttggggatgagatgattgttagcagcacaaaggagtacgaagaccgagcagttgaattggcgacaaacccggcaaaactccaagcactgaccaataagcttaaagaagttcgtttaacctgtcctttatttgacactgctcgatgggttcggaaccttgatagggcgtacttcaagatgtggaacatttattgctctgggcgtcatccggagccgtttaaggtaaaagaagacgacagtgagttcccatatgacagatgaggagcatgaaatcccggctgtgtagataaaaagcagagttgtagcgtagtacaatcatgtaactcgtttggctgcgccctgtcctgtaccatatagtagacctttgcgtgtggagtcccgacttatgtacccaagagagaagaatgtaggaggtttagtcctgtgatgagatcggattagcctatttatgtgtgccaacagaagattatagttttgttggttcctgattgttgtgccattcaaccccagctttgtgctgctatcataatgttgaaacttagccgcaaagatacaatatccaatatttatttgaaatataatatggcatctgttcccccccaaaaaaaaaaccccaaaaaat

SEQ ID NO: 5877 - DNA, 739 bp, Triticum aestivum
  unsure (1)..(739): unsure at all n locations
  Clone ID: PAT_TA_5877
cggcgtttctgttcctgccggtcggtcgctcaggcagggcccatcgtcgtgctatctcctgccccagcttaaacgtttggccctccttgttgccacgaaggattatgatctactggatttacagaaccagttaatggcatgatgctggcagtagtaatggagggttgtgatttctggatggtaaattcgtatgtcgccctggcgtgttctaaggtattctgtctgtgcgacgactttcttgtttgttgttctcctcttccctggaacgtctgccgcatcaagtctgcttccctttggtttgctggggtgcctggcttcggaccgtctcgcggcctcttctcacgacccgcactgccacacctggtctggtgtcggtcgggcagtggtcatggtagtgatatctactgccagaacataaacgtttggccctcctttttgccacgaaggattatgatcaactggacttgcagaaccagttaatggcatgatgctggcagtagtaatggagggctgtgatttctggatggtaaattctgaattggaaatgatattttctaatgtattcatacagttagataatatcatattagattttcttctcttacctgggaacgtctgccatgtaaagcatgcttccctttgatttgccgtggtgctgggcataggttggattggcgtcctcttctcacgaaacacactaacataaagtttctggtttctnacgtacaaggattattta

SEQ ID NO: 5878 - DNA, 1657 bp, Triticum aestivum
  Clone ID: PAT_TA_5878
ctcgacgcacgcgccccccccccatatccctcaaacccaaagaaacaagagagcaagaaagaacaacatagtgtctgcggtgctgagcgctcgtcctgcctggccgtcggagccggatacatccgcagccacacccggccgccgccgctcctgcaccgcttccgcgtcctcgtcctcgacagcctcgacaacgcctccgagtaggccatccgccgcgtccgaccacgggccaacgcgccgctatacagcctcgacctccgcaacgtggacatgcgtgacaagggggccctcgacagaaactcctcgtcccaacggctcctccctggcttccacgtcctcgtcgtcgacacgcttcgaggacgcctccgaggaagcccctcccttcctaccacaacatcgtcatcgccacccacaaccatcctccgacttacgcaaggtggaattgaggcaacaaaggcgtggcttctaactaatcttcccaatcccgaagcggcgagggctgtgaggcactgtgcccggctgccgaccgtcgggcccagcgcgcggacgacccaacccctctcggccaaaaaccgcttggcattcatgacatctcccctggcctccggcgctcggaccctgactggaagatcatactgctgaggtacttcaacccagtcggcgctcacccgagcggctacatcggggaagacccccttggagtccccaacaacctgcatgccctatgtccagcaagtcgctggtcgggaggcggcctgcgctgacggtttatgcgaccggctgctcctgctgctaaggtacttcaacccggtcggcgcgcacccgagtggctacatcggggaagaccccctcggagtccccaacaacctgatgccctatgtccagcaagtcgctgtcgggaggcggcctgcgctcacggtttacgggaccgactacaacaccaagggatggaacaggggtacgtgactacatccatgttgttgacctggctgacggccacatcgccgccctgaggaagctctacgaagattctgacagaatagggtgcgaggtgtacaatctgggcactggaaaggggacgtccgtgctggaaatggttgctgcattcgagaaggcttgcggaaagaaaatccctctggtttatgctggaagaagagctggagatgccgagactgtgtacgctgccaccgccaaagctgagaaggagctcaagtggaaggccaagtatggggtggaggagatgtgcagagacctgtggaactgggccagcaagaacccctacggctacggatccaccgacaacggccactgattaatagaccccagagccagtagcagtagcatatatacaccaccatccatctatatatttatccaccacagagagcagagagaagaagaggaagactactactgatgtgtatagggagtgagtgagtgagtcggatccatcagtagcttataattaattatattgttcgtgttagaaagctaatcatatccatctcccttatggagtaagtagaagaaataaggttggttcccttgccttgtagaaatatatatatagatatcttgtcggtcatggaataacttactttacctactgatataaatatatatatgcttggttctgggtgctgtcaaaaaaaaaaaa

SEQ ID NO: 5879 - DNA, 615 bp, Triticum aestivum
  Clone ID: PAT_TA_5879
tccggcccgccgtcgcggccgccgtggcccctcgcggccggcccctcgcccccgctgcccctcgtcggccgcgccgccgccctggcccgcccccgctccgctccctcggtccccccgcccccccctccgccccacgcccgcggctgctgccgcgaggcttccgcccgcgctcccgggcgccgaggttgtcggggtcgcgttctcctgtcgcctctgggcggcgtcggggggatcgggcgtcggtgctgcctggcgactagcgggctgggcttccccggccttgccagctgtctggtgctgagccgccgggttgcgccggtggtcggctccctcggcctgcctgcttcgtcctccgggtcacctcggcgtctgcttcttccacctatcaggcgttggcgctgggccgggcttcggtccgtcatgcgattttgtcctgtcttcgcccgcgcgcctggaggcgacgccgtgcggccgcgcgcctgttcatcatgcaattatgtgctatcttcgttcttgctgctgagggtaactccatgcatgcgcaagctatatgtactcttaagctgttagtcttctctaacttattgcatattcctgtatgataccactttttcc

SEQ ID NO: 5880 - DNA, 1052 bp, Triticum aestivum
  unsure (1)..(1052): unsure at all n locations
  Clone ID: PAT_TA_5880
gagggcgtgcagtgggtggtgatgggccgccccggcccgcagaagcacgcccacgccgcgcgcctcgccgaggtcctcgccgtgccgtacatctccatgggcacgctcgtcaggcaggagctcagccacacatcctcgctctacaagaagattgctaattcggtgaatgaagggaagcttgtgccagaggatatcatatttgggttgctgactaagcgtctcgaggagggatactgcaagggtgaaactggatttatccttgacggaatcccacgtacccgtatgcaagctgagattcttgatgagatcgttgacatcgacttggttctgaacttcaaatgtgctgataactgtttcatgaagaagcgatcaggaggtgacatatgttcccactgtgggcagcattttggtgtcagcagtctggtgtctagggagcgtaatctctcccttggaagctctacatggcctgctcaggcacaacatgcttctgttataggcctggaaaacccaaggatggagaagctgcgtgcttatgctgagcagaccaagcagctggaagattactacaagaagcacaggaaacttgtggagttgaagacatccgctcgccctggtgaaacctggcaggggctcgtagctgcccttcacctccagcatctagacccatccccaacaccacacaaactcaccgtgtaattatcatccactgagtctaaggatctacattgtgatcctcacctgcgacatacgtagtatgtttctatgttttgtgagttctggctgaggagtcagtcggctgtggtgctttggtctttatttgttataggtataatgtaaggctctggtctttattgttatagataaaatgtaagcgattttgtagacccgcttgcttctatgtttgtaacggagagctttgaacttgcaagtgcaagtgtgcggtgtgccaagctccgctgtgctgttgttttgagtaccagttttgatcaatatataagttaccgtgaatgttgggcgcccggcaaaggctacaactataaaatggaacctna

SEQ ID NO: 5881 - DNA, 659 bp, Triticum aestivum
  unsure (1)..(659): unsure at all n locations
  Clone ID: PAT_TA_5881
gcacgagtcaccgnggtgttcgggctgcttgccatgccggccggagcgcccatacatgtgttcaagaacctccagtgtgcggcgattgccacgccgcaatcaagatggtcgccaaggcgtacgacagagagacgacacggccatgccatgaaggttggagaggacaattgatgcacttgttgccggagttggcgtccttattttctcaagcaagcgtaggttcagtggaatgggagcattgtttttgaagggccaaggctgcatagtttgtacgcacatcaaagagaaacttggaatgtttttgtgcttggatctcgttcggaagtactacatcatgcaatacccaatggcgtcacctgatgagctccacgcgcagaggaggcgtctccatgggttccccgaggaacaacaagacatttgaattggttgccgatgacttatcagttctttgaaatagactacgatccatggtggctgtttgacaaatcttcactttggaacttgagataagatgtaaaaccttcggatctaagtatagtccatagagatgtccctcctgaaactgttgatgcaatgaaaaggactgtttcaggcatattgggtctgcttccgtctgataagtgagagggcgacccctggctcggtaccttgatcaactt

SEQ ID NO: 5882 - DNA, 669 bp, Triticum aestivum
  Clone ID: PAT_TA_5882
gtgttcccctgcctggccatcttcctggtgctggcgctctactaccagaccttcgcgccgctggcccggcgcatcaccggccacccgcacggcgcgtcgcagctgcagcgggtcggcctgggcctcgtcttctccatcctctccgtggcctgggccggcgcctttgagcggtaccggcggcggtacgcggtggagcacgggtacctgggcctgttcctgtcgccgatgccggggctgagcgcctactggctgctcatccagtactgcctcatcgggatcgccgaggtgttctgcctcgtgggcctcatcgagttcctctaccaggaggcgcccgacgccatgcgcagcgtggggtcggcgtacgcggccgtcgccggcgggatgggctgcttcatggccacggcgctcaacaacgccgtcgacgcggccaccggcgacatccggagcgggaggccgtcgtgggtggcgcagaacatcaacgtggggaggttcgactacctctactggctgctggccgtgctcagcacggtcaacttcgccgtcttcctctacttcgccagcatctacaagtacagaacgccgccgccgaccaccaccgccggctccaacagcagcaaggtggaggtctcggtggtttccggccacaagtgaagtgaatgaatgaaatac

SEQ ID NO: 5883 - DNA, 537 bp, Triticum aestivum
  Clone ID: PAT_TA_5883
ctccctcctggccgctggtctctccggctccaccatggccagcttcgccgtcaagaaccctctgctcgccgcggccgcgcgcttccggacgctgccgtcccgtgccggccggcctctcccgttctccccgttcacgcggacggcgcgcaggcgcgggcaagagaccgtcacgtgcttcgtcccgcaggagggccaggcgcccggcccggctcccgagcccgtgccttcgctggaggaagaggcggcgtccgcggcggcgcgccgcgtggcggagaggaaggcgcggaagcagtccgagaggcgcacgtacctggtggccgccgtcatgtccagcctcggggtcacctccatggccatcgcctccgtgtactaccgcttcgcctggcaaatggagggcggcgaggtgccgatgaccgagatgctgggcacgttcgcgctctccgtcggcgcagcggtcgggatggagttctgggcgcagtgggcgcacaaggcgctgtggcacgcctccctgtggcgcatgcacgagtcgcaccaccg

SEQ ID NO: 5884 - DNA, 1134 bp, Triticum aestivum
  Clone ID: PAT_TA_5884
cctcctcactccccatctcctcccgctgaacgcctctcgccgccggcgatcggagcagcgccagcgcgtccttccggcgcccgcgggggccttctgcggacatggggacgcgccacctcatcaccggccagaacaactgcgccccggacggggcgtcctcctccaacccattcggcgccctcgccaacaccctcctcggccagtccaacaaagcggagtcactaaggggacttcctggagcctcagttaatgttccaactacgtctgattatagcggagctccactgtctactctccctggctctgagaatgagttcaagcaagatcaacgaccatttgcatggggtgccgacttcagtcgtgggggtcctgctaatgattgggttgaatcttttcgccctccggggcattctgcatttggagggccagaagcaaactttgcagagtttgagcaaatttataacaatgcaggccctaccttgggaccggccttggatggtccaccacaaagggtcttatctggtgttctgcattcttttattctaagtggccgagctggtgtgccatttcaagctgtcccagtaccagctcttggtttgtccgaagccgacaagcaatgtatacgtgatcgcagcttcataatggcacaccatattttggccgatcaacctgaagaatatatacaagcacaggtgaatacactgctgcattctcttgatattgacaatagtcatcgaatggaggacgcgtgggatgggccgtacccagagatggaggagtactggaatcagtcccaaagtgctttgagatctggcccaatgcacaatgctgcaaataattggattagtgagttcggcaagcaaaacaataaccctgagggttggatcactgagtttggcaagcagaataataaccctgagggttgggcgcactcttttgagcagcaatatggtcccaatggatgggcctctgagtttgaacagcatcagtctcagatggccatggatcagatgggaggagcgaacatggcgaatctcgcagctatgcagcaatcccgtatgcttgcagaaacattatcaagtaacaatgacccaaagttccagaattctaaattcttccagtttgtttcaaaga

SEQ ID NO: 5885 - DNA, 681 bp, Triticum aestivum
  unsure (1)..(681): unsure at all n locations
  Clone ID: PAT_TA_5885
gggagccactcgacgcgtcggtttgcgttgacagaaaatgtgatgggctcgtggctaggggtacttattatgtcaatgtcaacaagcttggacatggagctcactggcggaggacacaaggacaaaaagtttattcaccctttcttcttggtttcgctcatgaggatgagagcagttggaaatcctacagtgttgtgaaagcgagcatgatgaatgcaaattacagtcttcctgataatgtggcaatcatcaccttgcagagtctcgatgatggtaccgcacttctccgcttggcacatttgtttcaggctgcagaggacccacagtactcagtgatggcaaaagttgaactgaaaaaattgtttggaaagagaaccatcaaggaattgactgaaactaacctgtccgccaaccaaaagaagtcagcgatgaggaagctcaagtggagggttgttggagacactgaaagtagtcctgccccaattaccggtagaccggttgacaatcaagcccttgttgtcgagctggggcccatggagatacgcacattcttgctgaaactgtgagctgcaaaaaaaagagatacctttatgtaattccatacatgttctaggagatcattgtgcctttcatttctgtgagcaagtacctccnatagttatgtccttgtacagcaataaa

SEQ ID NO: 5886 - DNA, 592 bp, Triticum aestivum
  unsure (1)..(592): unsure at all n locations
  Clone ID: PAT_TA_5886
ctccgctggtcgtgttgtccccatccccctcaagtgtttggccccgccggcccccgcggctccgtcaggtcggggctgcctctgccccttccggtgtcagtgctctaccgccgttgcgagctcccttggtctcccacttctcgttcctgccctcgctgctgctcgggctcgttcggcgccggcccttcccgccccttttatgccgccccctgccccttgcggggcgctgcctcccccctctatccaccgggcttcccctcttctcgttccggccgtgggctcggccttccctggccctcttcttgctctcctccggtgggggtgatttgccggaccccctctagaggcggggcttgctgcccggggagcctccgtctgctcccgcgcggccgtcgcgggcccgtcccctccaagttcttctgacgccccccccaagcgccgggctcgccaccttcggaatcccgcgtgccttgcctctactccctcggggcgtgcctacaccatccccgcccggcgaggatttcaanccgagacatgactacantttagggatcagtggactctacagcttccctgcnnaaatgtagtactt

SEQ ID NO: 5887 - DNA, 1003 bp, Triticum aestivum
  Clone ID: PAT_TA_5887
gcccccccccccccccctcccccccccgggccctccctcctctccccccaccccccgacccctcccccctccccccccccccccccggggcccccccggtcccccccttgccccggccgccagcttcagggtgaagcttgaatctacaagtggttttgtcacgaacgagaggtgacgttaggcgcaagtgctcgatggcaaatcattatgctcctctcagggttattcttctactgttgttggtcttcccttgtttcgcctctgaagctgatatccagtgcttgaaatctgttcagcagtcagtgactgaccccaacggtgtactcaagtcctcatggaattttgcgaaccgcactgctggttacacaggccgatttaccggcgtggattgttggcacccggatgaggaccgagttctttctgcgcgcctaacctacctcggtctcctgcgttcattcccggtcggccgtctggctgcaagctgtctggccgggctgggtctgtcaaccaactacttttcaggacctatccctcaagacatctcccgggaaataccatacctaacatcattggacctctcctacaatggtttttctggcaccatcccaccaaatatatcaaacatgacttacctgaacgtcctcaatctccaacataaccagtttagtggcgaaattccaccgcagttcagtcttctgactcggttaactgcattcaatgtcgcagagaaccgactatcagggtttattccatattcattaggaaaaaaatttacggcatcgaattttgccggtaatcaagggctatgtggggttccattagatgaatgccaagcttcagcaaagagcaagaacaacgcggccatcgttggagctattgttggcgtcgtagttgtgatcataattgttgcaatagttgtgtttgtttgtctgcggaaattaccagccaagaaagcaaaaaaggatgaggatgaaaataagtgggcaaagagtatcaaaggaac

SEQ ID NO: 5888 - DNA, 445 bp, Triticum aestivum
  Clone ID: PAT_TA_5888
agatgccgagaaccgagctgctccctccagcgtgccccctccatggctcgttgtcgctctatgaccacatccagctccagctgttgcagaaggacgtcaacctccttaatccgatggctgagctagagaagcactcacaagaagaagcatctcgtgcagtccatcaactcatcatgtacgtgcgcatcagatcatgtatggtccagaggaaatattcctttctctttcaattgatttgtctcctggccccttttgtctttgttttatatgtccgtaggatgtcatgtgccagaaccgcttcaacatgtgagcatgatcctttccaagctttagtaatgtgttgctagcgaaacacaataacattaataccatatattttgtattattgacttggggaattgatttaaattgctattggtgggttataataaaaaaaaaggggggg

SEQ ID NO: 5889 - DNA, 825 bp, Triticum aestivum
  Clone ID: PAT_TA_5889
ttctgggctggagcacttagtggcatctattgcgccccgcattcgtcctgtccttgacacggttaccactgttagctatgagctggatgatgccgaatacggggaaaatgaggtgaatgacccatgggtgcagaagcttctccttgcagttgacactaacgttacatggctccagccaatgatgacatcgaacaactacgattcctttgtccacctggtcatcgacttcattgtcaagaggcttgaggttatcatgatgcagaagaggttcagccagctcggtggcctgcagctcgacaaggaggttcgctccctgatcaaccatttctcggagatgtcacagaggccagtgcgagacaagttctcgaggctttcccagatgtcgaccatcctgaacttcgagcgcgtgtctgagatactggacttctggggtgacaatgctgggcatctgacatggctgttgacacctgcggaggtgaggagggtcttagggcttaggatcgacttcaggcctgaagcaatttctgctttgagactctaacttgtgcatttaaaatacacacttgtcactatagttcttttgtatgtgattatatcatgaaatatttcctggtttttatccacttgctatcatggataatcccacttctttaatccttgttgaaatggtgattatatatgttggtaaatttgtcgcgtgaactttgggagatgtgcgtgtatgaattcgtagttatatgccaagcctatgtgcatggtaatgctggttgtaacatttttttaatataatgtaataattagttaatttttgaggtaaaaaaaaaa

SEQ ID NO: 5890 - DNA, 660 bp, Triticum aestivum
  Clone ID: PAT_TA_5890
aggccctgcgggaactgtcctcagcttcccctcgtggtacaccgtttgcaactacaaccctcagggtaactttggtggtcgttacggcgacaacgtcctcaagcccgagggtgccaagcgtgttactgtctaggagcacagtcctcctcactgatcggaaaaggcgcacttctacatccatcttacagaacagccctgtgattctttcttgggcaagaacgtggatctagtgaggtggcagaaggcgtagcctcccaaccacgtctacagcaactgttttctttttctcttcatttcgattcttcaatgtacgttatgcatcatcgtacttaacgatcttcttcgttcaacattgggccacacggccaactttcttatcatggtcttaactttacatgcctggcgtctatgaaaaaaatgaaattaaaatagggatggcgcgtaaggaacgagggtgaatgatgagtgccgcctgtgctggctttttctttactacaaggtcgcatcttcttttgcctgactctgggttgcgaatggtttgactgagtctcggctgacttggggtttgccaaaacatgtttgattgctttttcagtgctcatagaagcatgttgatagacacgaatagcatattgatttcgccaaaaaaaaaaaaaaaaa

SEQ ID NO: 5891 - DNA, 731 bp, Triticum aestivum
  unsure (1)..(731): unsure at all n locations
  Clone ID: PAT_TA_5891
gggaaaattngttgacagtgaatagtggattcagtaaagaggttttgttgcagggcacaagccattcattgaaggaaaaggcaaggcagggtgataacccacgcgtccggcatgaagcagttgttgagaattggtcaaacaaagatttcacattttcctacagtgtttactctggtgacttgtcaggtggtatccatgtgcagccttcaacatcacaggattatgacgatagagatacgttcagcattttcattttacctggaagtgggaatagaaaggtcttcaagaaagcagtcgtatttgttgttgatacaagtggaagcatgaaagggaaacctcttgagaatgtgaagaatgcagtgtctacagctctttctgaacttgtgcaaggagattacttcaacattataacatttaatgaggagctccattcattctcatcatgtttagagaaagtaaatgaaaaggcaatagcaagtgcgaatgattggatgaacgccaactttgttgctgagggtggcacagatattatgcatcctttaaatgaggcgatggcattattgtcaagtgcccatgatgcgctcccacaaatttttcttatgactgatggatcggttgatgatgagcatgacatctgccaaactgtgaaaaatgagctcctcagcagaggatctaaatctccccgaatttctacgttcggactaggtttatattgcaaccattatttcttg

SEQ ID NO: 5892 - DNA, 1007 bp, Triticum aestivum
  unsure (1)..(1007): unsure at all n locations
  Clone ID: PAT_TA_5892
ccatgatatgtttggatgttccagtgattatccactgggatgaatgtcaagggaaataaaatgctatgtgtgcaaccagaatggtcacctgtgttgtaccgacttctctgatagttgttcaaaagaagttacttgttataactgtgctcaatctggtcatactggtttgggatgtgccaagcaacgtagggagacgagtgctgcgacaactccgaccttatgctacaaatgtggcgaagatggtcacttcgcacgtggctgcacaaatagtgctaagcccggccggttcaaaggcgagttgtcgtcgcatagtcgtagaaaggacaaatggaaaaatgactctggccctagatcagctcctcatggttctcacaaaagaaaaagccccctattcgaggatagatgggagacaccccgtggtaaatccagagccaggggtggttggattcctgaggaccatgatgatctgccatccaagaagtacaaaggcaatgggtgggactcccaatctactcctaagaagccctacaacaatcaccaccatcgctcctctggcggtgactattcatctcctcaagggcaggatttttcatggcacaactcgcaatattcaccaagtgcgaggaaacatggctcttcttcgtcaagattcgccagcaacacccatcaccgctttgaaagaagttaggccggagcttacttttggttttgttgttcgtttgatagtaggtctcttagggatgtactctgcctgtaataccggttccctgaaagagctgttttctgtatcttcagagttgtatacgttgtgtccattcctggtctgggcatgttttgtgttgcacttccaatgcctgcctaccgcgaacacgagcgtgtcactctgcaccccgcgccgccatccagcgtccagcttctgccgctctatctcgtcagcgctgcagtgttctataaactcgagcaactaccatggtactgcgtacaatgcgnagngaaatataagacgt

SEQ ID NO: 5893 - DNA, 830 bp, Triticum aestivum
  Clone ID: PAT_TA_5893
cgcccgcgccctctctgctcaacctgtgatgctctttctctgtcgttctcgttcctgttccgtcgcccagccatcccccttcctctctctttctcatctgtgcgtagttcccgcggtggtggtcgtcggcgaccacgctccccttcagccgtggccaggagaccgggtgcagccccaccctccctcggctcctgcgaccgaagcgccggcccgagcgctcgtcctcttccactccgacagccaaatcacccggatcccgcgtcctcttccactccggcgaccggatcccctcgagtttgcggaacaccggatctgtccagggcgaggtccttgtccacggatccggccgggagaaatcattttcttcattgtttccgtcgatttgtcttaggttcagttcaactaagaatgcaagatgacaaaatgcgacaaatggttgaaaaaatgtgcagttctgcccccagagaaaaagatgccatccaacaatatgcatagttgggttccttggaaacatcatccttgaactttctgtcagcttggaacagatgcttccacacctaacctccctacttcgattctttcattttgcctatgttgttttagtgcttccaagaatatgtgtactgtagtcatgcctggcagtgggagcaagcacgtggcccatcacaaaaattgcaaaaatgcaatatctttaagcaaatatgaaactgcaaacttccgattgcgtgttgctttatcactgagacaaataagcatctggatcaatcttgatataactagtttcctcatcaggtgaggaatcttcagctttctagtttcctcatcaggaa

SEQ ID NO: 5894 - DNA, 1085 bp, Triticum aestivum
  unsure (1)..(1085): unsure at all n locations
  Clone ID: PAT_TA_5894
gccggccggngttacttcacactccacgccctcggaggagtttctctgctcagctcagctacagcctacagagtacagacccaacccaactctgggagataacacaccagagcacggcgagaatgctgctgaacccggcctcggaggcgctggtgctcgacagcatcaggcagcacctcatggaggacacggcggcgccggcgccggaggcgaggaggcagcggccggcctactgccgcagcgccagcttcgggagcctggtggccgaccagtggagcgagtcgctcccgttccgcgccgacgactccgacgacatggtcgtctacggcgcgctccgcgacgccttctcctgcggctggctccccgacggctccttcgccgccgtcaagccgcagcccctcctgccttccccggactcctgctacatcctcttcctcccgcctaccgcatccccctcaacttcccgctccgcatcgagatcgccgccgccgccgcagccgcgggccagaagcgtcgtctccccagccggcgagccccgactcatctccctcctgcagcgcgcccgggtcgtcgaagaggagaaagagaggcgaggccgcggcagcgtccatggccatggctctggtgccgcccccgccggcgcaggctccggtccagctgaccctcccagcccagccgtggctggccgccggcgccgtccagcagctggtgagctgaagcggcgaagcgaccagtgatcgttctcacttctcacgagcgattagttgcttgatgtgttgagcgacgtgaggaacagagcatcaagatgagatgaatggcgcgtaatgcgtcgctcgaagaaaccttcgatcagttggaagcgattacgcgccacgccattgtgaaatttgtgtggttataagtctgaaacttgtcgctagggttagtggcgttggcacagtaaaaagtgtgagcagtggaatccggaagctggttcgtgacaggtggtgagggtgcaggtgcaaaatttgcacagacgttctcttctccaacggagaatcttctttgttcagccgttgtttggtaatactaatagtactactatc

SEQ ID NO: 5895 - DNA, 1313 bp, Triticum aestivum
  Clone ID: PAT_TA_5895
cggccgctcgagcgggccggcgccgggggaatccccagagccaatccagacgctcggcgaatcccaagagcgaactgagatcatcctaggaccaggcgcgaccacacaggacaagatgctgctgcttaatccggcgtccgaggcggcggcggcggcgctggacagcatccggcagcagctcctggaggagccaatggcgccggcgcggccggcgtactgccggagcgcgagcttcggcagcctggtggcggaccagtggagcgagtctctcccgttccggcccaacgacgccgacgacatggtcgtctacggtgccctccgcgacgccttctcctgcggctggctccccgacggctccttcgcggccgtcaagcccgagcccctgccctcccccgactcctacgacggctgctgcctcggcagcttcctcgcgtcgccgcccgggctggacgcgccgtgggcggaggaggccgaggtcgcggcgacggcgtcaagggggaagcacttcagaggcgtgaggcagcggccgtggggcaagttcgcggcggagatccgggacccggccaagaacggcgcgcgcgtgtggctcggcaccttcgacagcgccgaggacgccgctgtggcgtacgaccgcgccgcctaccgcatgcgcggctcccgcgcgctcctcaacttcccgctccgcatcggctcggagatcgccgcgcagccgcgggtcagaagcgtccgtctccccagccagcgagccccgactctcctcctccctcctccagcgcacccgggtcgtcgaagcggagaaagagaggcgaggccgcagcagagtccatgtccatggctctggtgccgcccccgccggtgcaggctccggtccagctgaccctcccagtccagccgtggctcgccaccggcgccgtccagcagctagtgagctgaagcggcgaaagcaacaagtgatcgttctcatgaccgatggccattagttcttccttcatggcttcatgtgttgagcccatggaggaacagagcatcaagatggcgtcaatggcgtaatgcgtcgctcgaagaaaccttgatcagttggaggcaattacgcgccacgccattgtgaaatttgtgtggctccgtgtgaaacttgtcgctagggttagtggcgttggcacagtagcaagtgggtgcagtggaatcccgaagctggtttgtaagaggtggtgagggtgcaggtgcaaaagttgcacagaccttctcctctccaatggagaatcttctttgttaaactgttgtttggtaccactgtcagtgagtgattcctttcg

SEQ ID NO: 5896 - DNA, 1629 bp, Triticum aestivum
  Clone ID: PAT_TA_5896
cggccgcaccacacaagcaagagaagtaaaacacagcagcactagtggatttcacgactgagaaggtcggctcaagatggaccaccaagcacacggcgccggcgagaagaagggcatcatggagaagatcaaggagaagctccccggcggccacggtgaccacaaggagaccgctggcgcccacgggcacgccggcacggtgacgcatggcgccccggccactggtggtgcctacgggcaggagggtcacaccggaaccaccggcacggggttgcatggcgcccacgccggcgagaagaagggcgtcatggagaacatcaaggacaagctccccggtggccatgctgaccaccagcagactggtggcacctatgggcagcagggacataccggtacggcgacgcatggcacccttgcgactggtggcacctatgggcagcaggggcataccggcacggcgatgcatggcaccccggcgaccaatggcacctatggggagcacggacataccggcacggcgaccggtggcagctacggggagcaaagacataccggagtgaccggcacggggacgcacgacatcggcgagaagaagagcctcatggagaacatcaaggagaagctccctggcggccatggtgacaaccaacagaccgctggcacctacgggcagcagggacacgtcgccacggggacgcatggcaccccggcgaccggtggcacctatggggagcagggacacgctggagtgaccggcacggggacgcacggcaccggcgagaagaagggcctcatggagaacatcaaggacaagctccctggtggccacggtgaccaccagcagaccggtggcacctacgggcagcagggacacaccggcgcggcgacacatggcaccccggctggcggcggcacctatgagcagcacggacacactgggatgaccggcacggggacacacggtaccggcgggaagaagggcgtcatggagaacatcaaggacaagctccctggtggccacagtgacaaccagcagaccggtggagcctacgagcagcagggacacaccggcgcggcgacgcatggcaccccggccagcggcggcacctatgagcagcacggacacaccgggatgaccggcacggggacacacggcactggcgagaagaaggccgtcatggagaacatcaaggacaagctccctggtggccacggtgaccaccagcagaccggtggagcctacgggcagcagggacacaccggcacggcgacgcatggcaccccggccggcggcggcacctatgagcagcacggtaacactggaatgaccggcacggagacgcatggcaccacggccaccggcggcacccatgggcagcacggacacacgggaactactggcactgggacacacggcaccgacggggtcggcgagaagaagagcctcatggacaagatcaaggacaagctacctggacagcactgagcccggtctgcccgcggccgctacccttgcagaataataaccccaccgtgtataagttgattgagtctagttcacctagctcacttggtcgttggaggagagaatgtattatgtatcttgtttaaagttttcacggacgcggc

SEQ ID NO: 5897 - DNA, 1682 bp, Triticum aestivum
  Clone ID: PAT_TA_5897
gcaccagcaagacaaggcaacagcagcaatagacagcttcacgagtggattgcacgactgaggagctcggcccaagatggagaaccaggcacacagcgccggcgagaagaagggcatcatggagaagatcaaggagaagctccccggcggccacggggaccacaaggagaccgctgggccccacgggcacgccggcacggcgacgcatggcgccccggccactggtggcgcctacgggcaggagggtcacgccggaaccaccggcacggggtttgcatggcgccgacgccggcgagaagaggggcgtcatggagaacatcaaggacaagctcccgggtggccatcagcaccaccagccgacgggtggcacctatgcgcagcagggacacaccggaacggcgacgcatggcaccctggcgaccggtggcacctatgggcagcaggggcataccggcacagcgatgaagttttcacggacaacagtgtgttcacagttttcgtctatttacactccgtcatgcaaatttcctttttgttccttttcttttgtccatcttattatccgacaggcttttgtaacttaacgcatggcaccccggcgaccggtggcacctatggggagcagggacacaccggagtgactggcacggggacgcacggcaccggcgagaagaagggcgtcatggagaacatcaaggagaagctccctggtggccacggtgaccaccagcagaccggtggtacctacgggcagcagggacacaccggcacggcgacgcatggcaccccggccgggggcggcacctatgagcagcacggacacaccgggatgaccggcacagggacacacggcactggcgagaagaaaggcgtcatggagaacatcaaggacaagctccctggtggccacggagatcaccagcagaccggtggcacctacgggcagcagggacacaccggcacggcgacacagggcaccccggccggcggcggcacctatgagcagcatggacacaccgggatgaccggcgcggggacacacagcactggcgagaagaagggcgtcatggagaacatcaaggaaaagctccctggtggccacggtgaccaccagcagaccggtggagcctacgggcagcaggggacacaccggcacgccgacacatggcaccccggccggcggccgcacctacgggcagcacggacacgctggaatgatcggcacggagacgcatggcaccacggccaccggcggcacccatgggcagcacggacacaccggaacgactggcactgggacacacggctccgacgggatcggcgagaagaagagcctcatggacaagatcaaggataagctgcctggacagcactgagcccggtctgcccgcggccgctacccttgcagaataataaccccaccgtgtataagttaattgagtctagttcacctagctcacttggtcgttggaggagagaatgtattatgtatcttggtttaagttttcacggacaacagtgtgttcacagttttcttctgtttacactctgtagtgcaaattcgtttaagttttcacggacaacagtgtgttcacagttttcttctgtttacactctgtagtgcaaatttcgtttttgttctttttttttttgtccatcttatccaagagacagacgcagcg

SEQ ID NO: 5898 - DNA, 1007 bp, Triticum aestivum
  Clone ID: PAT_TA_5898
tccggcagcaccacagcagtactagtcggcggtacttgcggctgcagcagagtcgagagagaaaccaagaaaccaagatgagacgactcgccggcggcgccgcgctggtgctcctcctcctcctcctggccatcaccgccaggcctgccgccgccgacttcttctcccctctcagccccctcctcgcccccgtcatggggtcgctatgcaaggcggtggcctgcgggaaggggaactgcacggtgaccacgggcctcccggggtacaggtgcgactgcgagcccgggtggaagcagatgcacgtcggcgacagcctcaggttcctgccctgcgtcatccccaactgtaccattgatcgctcatgctctaacgacaattcagccccaacaccggcgccttcacccaaaaatgtcttcgtctcgacagttccgcccgaactcccttactgtcattcggggggcacatgcacgaaggccaccctgctcacctaccactgcgagggcccgggggcactcagcaatgttctgaacatgactacaatgccttgttttcaagactgttcttacggagcggattgcgcagccatcgggatcctaccatccacaaactccaattctacagcaccaccagctggctctgcaagtgtctcaaacaattgcaatgcacctgttccaggatctgttttgcggcaaattctacttcctctgctgatattggcctcactggccatgggtcaggcgacatgaacagaggatggtttataccacggtataacactagagggagtatttgttcacggacagggtagagcttttagcccgttagagatgtactttgttgggtgtatgtcgctgctgcagtatttgttttgcacttgttgattcttctacggtgcgagaattgatgatttagtgtgaaaatggaataaactgtctctgtgaataattttataatattaaataaaccgatttactgccccgtgaaaaatttataatattaaataaccg

SEQ ID NO: 5899 - DNA, 766 bp, Triticum aestivum
  unsure (1)..(766): unsure at all n locations
  Clone ID: PAT_TA_5899
cttcctctatctcccctcctctcccccttttgccacctccaacctaatccttctcttctcgcctgtctgcctgacggattccaaagggctcgctcattcgggggaaaagctgttcgcagtgactcccaatctcatccatttcttgtctgttccaggcaatccagggtctggtcctgagctgtcggggctccatgtctaagtgggaacctgtcacatttgaggaatctcttagctttgttaagagggttaaggctcgtgactacttgttatacctgtcgctgctcaatgtgctcacccggagtgatcagatccctctggaagcttacaacgagcttttacttcttttccgggatcacggagatctgctagaggagctagggaagttcagacccctcccctctttcccaagcactgtgtacagctacaacacaatctggatgttcatattcctgatgccctttctgctcctgagccttctcctcgcgtttgagaagccgttggatagcttccttctccgataacctgttgcgagctaaagatcagcactacgatgaaaatgaccagacacggaatgcgtgcacggactgctgtcttgtgatatcccctcagagcccattgccttatcggtgcttttgtgatcatgttcatccttttgtgatccgnccgcataacggtgcgcggaataggtatctctgaatccccttggaaggacaggctaaatcgattgttttggcttgttcaangacaaacttcagtgttccattga

SEQ ID NO: 5900 - DNA, 1246 bp, Triticum aestivum
  Clone ID: PAT_TA_5900
ccgccgccgccgccgccgccgcaagggatgtcgctctgctgctgcagcgccgggagccgccgccttctcctcccgcgtctcttcctcggccagcgccgccaggcccggcgccccctcctccaccttcgcaccaccgtgaccgccgccgcctcgtcctccgctacatctctctcgacgcagcagcagcgccaggtctccctctacgtggacgccctcctcgactggaaccagaggatgaaccttaccgccgtcaccgacgagtccgaggtcatgacgcgccacgtggttgactcgctcgccgtgcttcctccactcgagcgcgcatacacctcccgcggcggcgacatttctggcatccgcctcgtcgatgtcggctccggcgccgggcttcctggtcttatccttgctgttgcgcggccaagctggaagtttacgctgttggagtcgatgcggaagcggtgcacgttcttggagcacgcagttgaggtcatggagctgtcaaatgtggatgtggtgtgtgaccgagctgagaatgctggccaaagtcatgatttcagagagtcatttgatgtagcagctgcaagagctgtcgcagaacttaaaattttagctgagtactgcctcccgttggttcgtgttggtggtttatttatagctgctaaagggcacgatcctcatgaagaaataagaagtgcaaaagctgcagttggtaaattgggtgcctccatgctagatttgtgcaatgtcgaatcgatgggacctcatggtcaacgaacggcagttgtgtacctcaaggaacgcactactccaaaaaaagtaccctcggcaaccaggtaccccttctaagacaccattatgaggagcacgctgactttatggtagacacacaatgatcaaaagctgatccgcggatgctctccctccaaatggacatcccctggaagacgacgattgttctggaagcacggaaggattaatctaccaccctgacagcaggtatttgttgtctgcaaggaagctggtgcttcactccatgtatcttgtaacaaaaggtcgcagatgttccactagagaatactacgtacatgctgctgccctgtttatggtattctcgtcggcatttcttatgtagaacagagaagcagaggttgtctctgaacagacacaggatgtcgcctgggcaaatgtataatactgcaagattgagctaaagtcttcaactgctgaaaaaaaaaaaaaaaaaaaa

SEQ ID NO: 5901 - DNA, 960 bp, Triticum aestivum
  unsure (1)..(960): unsure at all n locations
  Clone ID: PAT_TA_5901
ggcacgaggtcgaatcgatatactctccactctcatctccctcccgtgccccgcgccgtccccgcctcggcctctccttcctccgaaccctaaccccagccatgccccccggcgcggcggccgccgccaaatccgatgacgaggacgactacgaggagtacatccccgtctccaagcgcagggccatggaggccgaccgcctccgccaccagcgcctctccaagcccgccgccgccgcctccgcgggctccctcccaccgcctccgcccccgccggcggccaaccccgccgccgcccccgatgacgccgcccccgccgccaagcccagcctcctcgtcacgtccacgcagctcaagcgcgcggccccggaggtcaccgccaccgagcagatcatcctgcaggagaaggagatgatcgacaacctctccaacaagaacacgctcatgtccgtgcgggagctcgccaagggcatcacctacaccgagccgctccgaccggctggaacccggccgctgcgcctccgccccgtgccgccccccaaggccggcgcgctccgcccctccgcccacattctggtcgaangagacgagatcccgccgccccgccccggacttncgngaanttccgntttcccgangcccggtccttttggattgctccgcngagaaagggncattgtggcaanncccacgccccattncaagggnggcaggggggctttcccgggggggggnctttttcccgggggnggggnaaaatgaaanncgggaattnggccttttnacccgggggtcccgggaaaanaactnttgggggggttngggggctngccccttnaaaaaatgggggggntttttgcaaanaagggaaaangntngaaggccctanttnngnccccgggggagggggccccncttgggncanngaaaaaattttgcccatnancgggggnggggnggg

SEQ ID NO: 5902 - DNA, 1248 bp, Triticum aestivum
  Clone ID: PAT_TA_5902
gttaccgctcgcacttgccactcaagtaccgcccccattctctctcatggcggactcctgctgcccagccaaaccctaatgtcggaccggcggcgccgccacgccccccgcgccgtagcctcgccgccacgagctctcttcgaagattggaagctctcggcctggcgaggaaactaggagaagcaacgcctcagggagggaggcgcgatgggcgatctgaaggagatgaagtacaggcggaggattgggctccaggagcgcgcgcaatgcagcgaccagagggccgtcgactggggcgtgctcaagcaggaccccgtggagctgctgcgcaagctggacgagctgagggaccaaatcacgcggtcctgccaggtcgccgagcagccacgggagcaccgtcgggtgggccgccgaccgccctccttgctccccgaccttcccgagccggtacctctacccggttatcaccgcccacgctatggtgcccggtatgggcatggcttgccgctgagcccatgtgagccgcagcactctgatcatggggagaggtacgcgaggcagtcaagtgggcggtatcgccagtacccagggaggcagtgggacaacggtgggattggacatgggaattaccatcagtatgcgtgtgctagtccgcattatctgcatggacagaggcctgcgccacaagaagagcacataccgatggccagatacttcgctgggcagcatgaatgctaccgatttgaaaggtcaccatctatttcatcagattatgaccaaaggtctgtggcatcatcgctttactcgcatcgctcggtatcaaagaaaagggctgagtattttaggaagaaggcagaacatctctgccggccaatgcatggcgctgcgccatttgttgtttgcagtgcttgttataatctcttgcagctgcccatggaaaaatgcatggggtggaaacaaaacaggctacagtgtgggtcttgctctgagataatcagtgtgaagcgcgtgaaaggaaaggctattccctacacatcctcaccgcccttcagcttgtccaatactgagcaaagctcacatgatcgttgtgaggcgagattttgagcatcagcatcatgatgatgtcacttctgcgtggaataatttgcctgagcacagcagcatgcaaatcaacatagattttggtgatgataattcagtttcttccaccattagtcatgaaaggactgacagagaatgtggctcaaa

SEQ ID NO: 5903 - DNA, 606 bp, Triticum aestivum
  Clone ID: PAT_TA_5903
aggcttcgctgggtggattatgtgtactctccctcctgctcgcttgcttctcctccgctctcacttatcgatcttgcctcgtccgctctgtgcctgccatgaagttcatgatgaagtgatctgagcacacagatcgtccccgtttcttgatggtgtggttgctggtgctttgaattgctttcgccgcccttcagtgttcagtgaagttgctgctatgagcgtctttgtttttcattgctaattggctttctggagtacctcgtgttttcaatgcagtgggtgccgctggcaaggcgccaagacgttgagctgctgcaccgcgctctcgcccgtcttcgacaggtctacactctggcgagagctcccacgccacctccgtagggtctgggtggtccttttggcttcattgatgcgagccttcctgctctggtcatgccgcctccggcatgtaatcctgaacttctgcccccgcttcgctagagcttttgtgggctttgacgtgttgtaagacttgactcttgtgtacgctgcctgttgttggctttattaatttaaagccagacgcgtcgagcatcttcgttctaaaaaaaaaaaaaaaaaaaaaaa

SEQ ID NO: 5904 - DNA, 839 bp, Triticum aestivum
  Clone ID: PAT_TA_5904
gcctcgtctgcatcaccgccggcgcagggctggtgcacacgtgggcggcggtgctgatgggcatctgcgccggcagcgtgccgtggttcaccatgatggtcctccacaagcgctccttcctcctccagaaggtggacgacaccctcgccgtgttccacacccacgccgtcgccgggctcctcggcggcgtcctcacggggctcgctcgccaccccggagctcaccaccctgcacacccacgtccctggcacgcgcggcgccttctatggcggcggcatccagcaggtgggcaagcagctggccgcagcgctcttcgtcgtcgcgtggaacgtcgcggtcaccaccggcatcatcctcgccgtgggcctcgtcatcccgctgcggatgcccgacgagcagctcaggatcggcgacgacgcggcgcacggcgaggaggcctacgcgctctggggagacggcgagcggttcgatgtgtcccggcgtgcggcagcgagggccaccgaggtcggggaccagtcggtcgaccagcgtctggcagccatgggagctagaggcatcaccgttcagttgtagtagtagatatagcaagaggcgcccctcgttctttcgccagatgaactcgacggtatctacgtacaagccacagaagggatattcgtagctcaatctttttgttaagagacaaatgcaccatagctttagcctttacatgtgctttgctcttcgctctgtcaatttaagctctcgcccttctttttagattaaattcagttcctgcttgacatgtttgttttgaaaaaaaaaaaaaaaaaaaaaaaaaaaaaaaaaaaaaaaaaaaa

SEQ ID NO: 5905 - DNA, 780 bp, Triticum aestivum
  unsure (1)..(780): unsure at all n locations
  Clone ID: PAT_TA_5905
cccacgcgtccgcccacgcgtccgcggacgcgtgggcttccacatgatatagatttgttatggtaaatatttatattcttttctataaacttgctcaaactttagaaagtttgacttcagtcaactctaatatgcggagtaaataaaaacggagggagtattcaagcaagtctatttaaggttgtaaacatgctgatacacgcgggcatctcttctgcctatgctgtggaacagctacccttcctcaggcgatttcttgttccttggtcgcctggagcggtctgactcttgcaggaaagatagttcttaagcatccagatgtgcagaaagtactatacggtggcccctttctactaaaacaagaatgttcctcttccgatggacagaagggcccgactgctgaagattccccgcctcctgtcaaagaagaggaagaaccagtttctccagagacaaagaaatcttctgatgccagcgttcacagagacgagtctgacaagacatcgaccaaagacggttaaatttggtataatcccgacttatatcgcagtatgtccacttgctgtgacgacaatctcctaacgaactgccgtncttgtgctttgtatnctgagtctgatagctatgctgccatccaggattagagtggctggctgctactgcagatgagtaggtagcacactgacgtgatttagcttatcgtatccttagtttgttagctcgaacatgatggctgaaaagaaattgggagcagaagcttcatttttcttaanaaaaaaa

SEQ ID NO: 5906 - DNA, 545 bp, Triticum aestivum
  Clone ID: PAT_TA_5906
agggtggagatcatcaaaggatgggtcgggatgctgaggtcaggggcggagggcgtcgtcggcgagctggacgacttctttgatgagattgtggaaggcaggaagatgctgtcggacctgtgcagccatcgctgatccaagctcacaatctgtacttctgcagcagctagctgaaagcctgaaacaaacggggcatggtagatagtacaacaaggctaacagattagaacaaaaaaaaatgtgggtgttcttctctcttgtggttgggtaatctaatctagctgctctctctagtctagctatcatagcagctagtgtgtctatacatatgtcctgcactggaatatcatcatgcttgtattcttcctaagcagagcagagcagcaagtggtagtggcaggcagttggtgcttaggcctatctatttgtcagaatcagaatcagaatatatgtccagtaatttttaggggatcgatcttagaggatgaattggtgatataatagttgatggtgaaaggaagaatctaaaaaaaaaaaaaaaaaaa

SEQ ID NO: 5907 - DNA, 890 bp, Triticum aestivum
  Clone ID: PAT_TA_5907
ctcctcctccctcttcgatccagaggagtggagatcctcctcgctctcccgaagcccctgcctcctctctcgtcctccaggaatagtgccgccccactccttcctgtgcttcctctcctctcgcccgtccctgacctctctcttccccttcgcaggtgctccgttcgccatggccccgagctccgccacgccaagtccgtccccgcgtcgtccctgcaccggcgccatccaagcatgttctccggcctccctcgtttttcccgcgtcaccggagatcacgccaagtacagcaccgcctcgtccctgtgttgcagcgagccgccgcctgcgttgacccgctgctgctcgtcttcatcgagccggccaagccccaggaacgccatggccactcctcttctcctcacggctcctggacccctgcgccccgtcaccggcgttcggcgccgccatggattcgcgccaaggattcctcacctccgcccggttcctctcgcgccgtcacgcacctactcccgctgcttcaaggacgaggacgaccaatgaccagcgcccgagtcgactcccctgcatcacctgttgccgcgccgagacccgctgccgcctcgccgttgaccttctgtgtcgcgttctgtctctgttgagcagaggacgaaggagtggttcctcgttatcgcattgactgaggcccagtaacgatcttcgttccccaggccggcccttcttcctcaatcgggccaaggcccatggtgaggcaaaccccctagtgcctctcttttttcccttcctttggcccagctagtttcggctcgttatttttttccagcgcctgggttttgctaattatcagagactgtaggttttgcagaaaaaaaaaaaaaaaaaaaaaaaaa

SEQ ID NO: 5908 - DNA, 1129 bp, Triticum aestivum
  Clone ID: PAT_TA_5908
gctcggcacgaggaagagacgaaaagcaagccgacgagcgcccccgccgtcctcgcgtcacgcaggccacgccacgcacccacgcgcgcctgatccgtacgggagccacattggggcttccgccgcccggccatgacgagcgcctccgagctcttcaccgcccgccgcgcccgctgcgccccgcctctccgacccgggggaccccggcccggaaccgctcgccgacgcgccgcagtgacccgcacggcctcgccgcccgcccccgccgacgggggctgccgcgcgccccgccagctcgacgccgccggggacgtgcgccagcacctccacaccggccctccgcccccgcgccggcccggctcctccaccggctgcaaccaatccagcgtgtcctgatgaagagaacttggcggagacacatccatcagtcaactacttcccaacaggccacctgggactgagcaggtccgccttgccgttcggctagctcatggacgtctccaggcgaaagaaagaggtgactcgatgggcccccctgccccccggctcgccatcactttggatgaatcgtcagccacggagggctttagaatcatcgacttcggaagcagagaaaccccatatgaggctaattggcccagctcatccatctgtccagccaagcagcgggtcggatgaagagagcttggagaacacatccatcagttcaactacttccaacaggtcacctggactgagcaagtctgcctttcttcggctacagatagagatctttgaggctaagaaagatgacaacagggaggcatcgccggaatgctcgatttgtctcgatggtttctacgacagagacgagctgataaggctgcgctgcggacacaggttccactcgacttgcttggagccatgggtgcggaaatgcgcagattgcccatactgtcgaacaaacataaggtcccggccccgatgacagaccctcggtccagaactgcaacattgagtagggggtatgaccttatgacttcatagtaagatgtgttgttgtaatccactgttttgtgcatatctgttgcaccggtcctgctacggcatcatctcttagattcagtttatgtatctgaatatctttgtg

SEQ ID NO: 5909 - DNA, 387 bp, Triticum aestivum
  Clone ID: PAT_TA_5909
tttttgtattcaataagaaggacaatgatgattctttgccagtctgccttgaagccaagccagtagaacgttctgcaggtgatatgattggactgggtggttccttttcaacaaaagaaaccgagattagatgtacaaaaggaacagaaactctttggtcagatcgcatctccggaaaagttactgtcttggctggtaatgcaaacttctgggcagttggctgtgaagatggctgcctgcaggtttacacaaaatgtgggatgcgagcaatgccagcgatgatgatgggctcctcggctgtttttatagattgtgatgactgctggaaattgttacttgtaacaaggagaggtttaatgtacatatgggatctcaataacaggacct

SEQ ID NO: 5910 - DNA, 984 bp, Triticum aestivum
  unsure (1)..(984): unsure at all n locations
  Clone ID: PAT_TA_5910
gttaaatcatgggctcaaaaccgcctctggtctcaaaagcagcagtttgatattcaacagcaagctttgaagcttaccgcaaacagtatgtatggttgcttgggattttcgactgcctggttttttcctcagccgcttgccgagcggttcacccttctgcgttgacggggcttgcaaatattcaactcacattgtgaaccttagagtgatgggggattctgagagaggaaccatctgcccgaactatccacaatgcaacggccgtctagtaagacagtacacagaggcagatctatacaggcaattgtcctacttttgctatgtacttgatgcaacccggtgtcttgataagttggaccagaagatgcggcttcctttcgagaaagagtttgcagtattaaaccaaacaataagctcggcatttctggagattcagaaaatccgagacagatgtgctttcggatgggttcaattgacagatctagcagtgtcaatctgatgagctactgtttgccgtaatctcaagcagtgctgatctgagcatgggccgtgggatattgtgttgttgaaactagatctgttgttgaaggtgaaaggaactggaaaccagatgatggccttggccactagccgctgacgggtttcctggcctgcaaaggatggagttgcccacatcatgttgcatttaaatacaaatgttctaaccagttgtttcagagaccctccttggtgccatccctaattttcgaagtgtatattgtactactactgttgtaaatatgttgcatccatcaatcccatggttttgtagcgacatactttgaatactaaatttgtcagcagtccagttcttatcatctgaaatttatcacaatccagttgcttgcttactgattctcatctgtaacattttttttatagtcatatgtaacaaggtttatgtatcagaaactaaaagaaanaaggtatttgtgtatcagatag

SEQ ID NO: 5911 - DNA, 2059 bp, Triticum aestivum
  Clone ID: PAT_TA_5911
ccacccccccgcccacgccgccggccccggccccggcccccccgccctccgccgggccgccaccgccgccgtcgccccgggcccgccgcggactccccgggcgcggggttatcctcgctcctcccccggctggttgtggcgggctccggcgtcttgtctgcttgggagggccttgctctggtggcgggggtctgcgtcttgctttacgcctctcgggactcgccggaccgggcacacgctgttggtgcgcccttgcgcttctcagaggactgtgtcgtcacttccctgcgccatgtgctagtggcctatgcgtcagctccagagcccttgtggtccgcctggcctagcttgccggggcacgtctccgaccgcagtcttgctccgccatcgccccgtcatctccggagcgacccccgcagctagaggtgttgtgcgaaaagctttacaactctagagactcggctgagagagcacatgcagaaagtacgctcaagtgcttctcagagaacagagactacatttcgcagtgccaatatatattggacaatgcgtcaactccatatgccttgatgttggccagtacaagcttggtgaagcaagtgtcagatcgcagtctttctctacaattgcgccttgatatccggaattatgtcatgaactaccttgcggccagcggccctcaattgcagaactttgtgactatttccctaattcagcttgcatgtcggataacaaaatttggatggtttgatgacgacagattcagagagatttttaaagaagcaacagatttcttagctctggcatctcaggatcactatttaataggattgaagatactaaattttctcgtaatggaaatgaaccaggcaaactctgcaatgcctttgacacttcacacccacgcggccgcttcattcaaggaccagtttcttctgcagattttccaaatttctcttacctcattacaccaactgaaaagtgaagtaccggatgagctaaggcgtgttcctatttcgcttgcattgaggtgcttgtcatttgactttgttggttctccagtggatgagtagctctgaagaatttggaacagtgcagcttcctgcatcctggaggcctctccttcaagatccttccactgttcagatcttttttgactactacaaagtcaatgatacatctgtttcaaaagaggctttggaatgtcttgtcagacttgcttctgtcaggcgaagtctttttgtggaagaccctgccaggtcccagtttctctcacatctgatgtcaggcaccagggaggtactccaaacaggccaaggtctcgctgatcatggaaattaccatgagttctgccgtcttctgggacgttttaaagtgaattaccagttatcagagcttctgaatgttgagttctatggtgaatggcttggtctcgtagcagaatttacaactaaatcattgctatcatggcagtgggccagtaatagcgtctactatcttttaagtctctggtcaaggctggtgacatctgtgccttacttgaaaggcgatacaccaagtctgcttgatgaaactgtacccaaaattacggagggttttatcacttctagaattaattctgtccaggccagctttgcggacaactcaccagacccagataatccgttagaaaatgcggaaagtctccaggatcagctggagagtcttccttatctttgtagattcaagtatgaaagctgtagcctcttcatcattaatatcatggagcctcttctacaagcttatacggcaaggtcaagattaccagcttctggagatgcagctgagctgtctgtcattgaagggcaaattgcatggatggtccacataattgcagctattctcaagattaggcagactgttggttgcagccaagattcacaggagttattcgatgcagaacttgcggctcgtgtgttacagttgataaatattactgacacaggggtgcatgcacagagatatcaagaaataagtaagcaaaggcttgatcgagctattcttatctttgttcaaaatt

SEQ ID NO: 5912 - DNA, 582 bp, Triticum aestivum
  Clone ID: PAT_TA_5912
ctccgccacccatcgccgccaccgctcccgccgcccccctccccctcccgctcccaaaccctaacgcctccgcctctcatcgccgccaccgcggctctccccttcctcgtcgcgacatcccgtccccgccctctccaccgcgtccacaatcttcctccattagatttcgaggggtctcggaaggatggcgttcctgcagaaggtcgggaatgccctcaagcggtccgcgggctccggctcggcgatgctccaggcggtccggtccatgtcctcctccaaggtcttcgtcggaggcatctcgtacggcaccgatgaccagagcctcgcggaggccttggccgtctgcggccgtgtcctgcactccggcgggggcggcgggcgtgaatctggcaggtcaagggggtttggtttcgtgacctacacttcggcggaggaggctggagctgccatcaccggaatggatgggaaggatctgcagggtcggatagtgagggtgagctatgctcatgaccgtggtagtcgtccaagttttggtggtgggggtggctatggcggcggcggcggtggcgactatggcggcgg

SEQ ID NO: 5913 - DNA, 516 bp, Triticum aestivum
  Clone ID: PAT_TA_5913
aggaggacgcccattgacctaatgccgttccttggccctgaggagaccagtcagagtgagccactcgagtccacattcatatttgaggacagggaattttcagagctggagaatttagccatgaacattcaggggatcaggaagggcatggagcatgacagaggtggtcggaatcagggatgcggtgaggccgagatgactgacgacttctgggaggagctgctgagtgaaggaatgagggatgaagctgagattttagagctggaaaggaggagatctagatatgtcgacgcgtagcgcaaaagctgggtcatctaagtaagagcgatccaaaatttactagaattcataaccatttaatatatataccattgtcattgatagctatattgtatattgtagtgcaaatttatagtcatagacttgattgtattgcggttccaacaccggattatgtggtttatatcgtagtggtataaatactgtccctgcactctaaaaaaaaaaaaaaaaaaa

SEQ ID NO: 5914 - DNA, 775 bp, Triticum aestivum
  unsure (1)..(775): unsure at all n locations
  Clone ID: PAT_TA_5914
gcctgttgtgcacgaggagggcgtgcggcatcggccaactgcagcgcagcggcgccggcggatcttctctccccgcgccgtcccggagtgctccgtccgtgccagtaagcaaaacctacaggattagaagaagccacaatggaaggaagcatcagcggtccgtcagagaaaagggttgccgtggtgaccggagggaaccgggggatggggctggagatatgccggcagcttgcggggcacgggctcgccgtcgtcttgacggcgagggacgacaagaggggcgctgaggccgcccgcacgcgccgccgaggagcgccgggcggacggcccgtcgcacctcccggtgctccgcgcgcccgcccggcccgcccgcctggccccctccgctggctgcttgctcggcgggcttgtctggctggcctgccatgccggtgtgctcggggtgaccacggacggcggcgacccggcgacccttcaggaaacgcttgcaggcaaggatggggatggagggtgccgaatggctgagccaacggcccacacagaccacccaggatgcagaggactgcctgaggatcaactaccacggcaacaagaccgtcacggaagccctcctcccgctcctccgatcagccccccccggccgcctccccaccgggacctccgcctgcgggccccccagcttgggcgccgcccaggtatttcanccggcgacgaactccggtggggaggctggancacgtcgacaacctcaccacgccagcaanctcgacgagat

SEQ ID NO: 5915 - DNA, 1062 bp, Triticum aestivum
  Clone ID: PAT_TA_5915
cagaactcgagattttattattctcttcatagctcccgtatgagaagacctggaaggccacttgtataacgttccctccactaagaaaactcatttttcgcttttctatctgtatgtatgtatacacctgagggtttcttttccttacaagaatatgtcgggcagggtaaacacacacacacacacacacacacacacacacaagggaactaaagaattgagcggagagccggagcggacaagagtggaaaaacagatgctactacaaatgggtgtggcgagagatttcactccagccggggcaggcgctctctggggatccactctcatgcaggcgtacaaacgaacaaggccgtcgtcgttagtcgagtaagcacgcatcagccaaacccaaatcgcattcgcacggaactcgaagaccgctaacagcaaaccaggccgcatctcccacctatttacacacaaaaatcaccacccccccctacagggcgggctgctgctactatactctgacgggaaacccaaaattctggagtatcctgatctgacccccgctgcctgccgtggcgatggccatgccccaggccgaccggctcggggcctgcccggcgccgtcaccgtcggggagactggtgctggaccgcgggctctgtttcgtcggcgtcatgagctcctcgggccaggtcgcagacgctctgtcgccgccgctgtggttcgaaccgttgcttaggtcattgcggctctgctgctgctggaaatcagaggaatctccgtctcctgcgtgcggcagaggatactcggacacacaatccagctcctggtgcttcctcctggagttggtccgggacgtcgccgctgaccccgccgtggatggcaaggcggcggccaccgtcacgtcccggcagtagaagtactcgtaggagtttgcgacagacacgacgcccttgctgctgctgctgctttgctcagggctgtcgtcgtttctccacacgtacacatgggagttctcgcttgctgagatcacgtatctgcctcttgcagcgtagcaagctaagatttgac

SEQ ID NO: 5916 - DNA, 858 bp, Triticum aestivum
  unsure (1)..(858): unsure at all n locations
  Clone ID: PAT_TA_5916
aggaattcggcacgaggctagccaggcaaaaccggataacngggcgtggacgcgtggctcggcagggcggcgctgggtagctcgttccggcggtggtcgccggcgtcgaggtggcaaggtgagaccggggtcgggcgttggctctcccgatccagatgggatcgaggcagggcgtggcggctcgggcacatcgcgcgtcgaggcttgccgggagggggggtcgtctgtccgatctggatactgcttctccatcacttctggttcgtaaaggtcgacggccctgccgacgctagggatctcggatctccttcgccctttgggagctgcctctcctccctgccttcttcccgtggtgccagggaccaaaggccggacgccagcacgacggagctactgtgctgctgtgtgtcctcatgtcatccacgcgcgtcctcggttccagccacccatcatcaatattcggcgtcctctgtcctttttccgattgatgtgagtaagcctccactacccgcttccaattctgtaaaatttgcagttgtagttggcatgagacaggccaggccgctaccccattgccccctggccagtagagttgtccatgaccagggccccctagctaagtaaggagtaacatgctgcagctgctgctcaccaccatccatgagacatggaaatctagaaatctgcaggtttgtgcgacactcatgctcgccatgtgttcgctgaaatgctcccttgtagatatctataaattgatgtttatatattataagcatttgtaaaatgttncatgtacaatgtcagtatgcaacaataaatctattctcccaaaaaaaaaaaaaaaaaaaaaaaaaaaaa

SEQ ID NO: 5917 - DNA, 790 bp, Triticum aestivum
  unsure (1)..(790): unsure at all n locations
  Clone ID: PAT_TA_5917
atcaacgggaggactacacattatgaacaggatgtaagagagaagcttcgtgtacttgactgggcacctattgtttactgttctgcgataaatgggaacagcgttgagaagtaaaaccctaatcttagttttagaatcttagtcttttgatacttcgttattttttcagatattagctgtatataccctgccacagtacatttcacccttttgggtgatacctcggcaatgattaatttacgtgcgctgcctgaagtggccaaccatttccatttttcttcttctagaacatgatttccatattttgtcacatacttcaaagtccctaaaacaagaatcttatggagtagtagatctgtaatgccaagggctggtgtagtgggtcactaggtttcctgtaactgacatatgaaacatgtgtttcctctatgaacttatgtttgcctaagttttctgtgcttactggacatgcaaaatttgctggattcccacttttcccccttgatgagtcgtctatccctgtattagtatcctcctgttccctcggttctagacgccgccaccgcgtgtctatcaatgggccaataaggttcatattattcaaatgaaaaaggttttgtttttcttcttagtcctcgactactgccaaagctgaagtatggtcactctacccgaccggcccgccgcccgaacaatggtanagaacgtacatcaaagcacacacaacaagagcggaaaagagcgtgttatacaaacaaggcgcgtcgcacaaattgtcctcgcatgacca

SEQ ID NO: 5918 - DNA, 748 bp, Triticum aestivum
  Clone ID: PAT_TA_5918
aactcacgaggcgcagcggacgccgcaagcaacgcacggcggacactcgccatggctcctcgccgctttctcctcctcctcccagtcctcctcgtcctcctcggcgccgatggcttcggccgtggcgccgggcagaacaccgaccagttcgcctacaacggcttcgcgagcgccaacctcacgctcgacggcctggccgccgtggcgcccaacggcctgctggcgctcagcaacggcaccagccaggcggccggccacgcgttccacccgacgccgctccgcatgcgcaacggcgccgtgcagtccttctccgtcgccttcgtcttcgccatcgtctccaacttcaccgtgctcagcgacaacggcatggcgttcgtggtcgcgcccagcaccaggctctccaccttcaacgccggccagtacctcggcatcctcaacgtcaccgacaacggcaagcccgacaacggcgtcttcgccgtcgagctcgacaccatgctcaacccggagttccaggacatgaacagcaaccacgtcggcgtcgacctcaacagcctgcgctccgtgcagaaccactccgccgggtggtacgacgatgccacgggcgtgttcaacaacctcagcctcatcagccgccagcccatgcaggtctgggtggactacgacggcgccaccacccggctcgacgtcaccatggcgcccctcgacgtgcccaggcccaagaagccccttattttcgcgcccgtcaacc

SEQ ID NO: 5919 - DNA, 673 bp, Triticum aestivum
  Clone ID: PAT_TA_5919
acacagagcacgggtgaagctgaaggctctaggcgacgacacacaagcatgggtggtggatcgaggaggggcgcaaagtcctgacaatcacttggaaggactgaatacattggctttgcagaatttcagaagtcaatgttgtgcattttgtcatcttggatggacgtattttttggtccaacagtgtacctatgtaattgagacagttgtcgtttaagttagggagcagtggcacttggggcatcctgcaaccacaagtcggtttggtgctcccttttcaagaggttggctagaaagtctacagccctgttttgattacgcttaagcttggtgggtataagttcccggtctccatgggtcatgtgcttcacttcgctgttgatgtgcgccatcagtgagcggtcaacctgtggatcttccagggcagcaagtagtttggcgcggtaccaagggtaaggttagggcagtatacctgtagcgccaattgcataccttctgtggctgcatactactccctcatacttcctccgttttaaatagatgactcatctttgtactaagtttatgttaaagttagtataaagttgagtcatttatcttggaacggagggagtacatttaagcttacttatggtctgccagttaaaaaactaaaaaaaaaaaaaaaaaaaaa

SEQ ID NO: 5920 - DNA, 877 bp, Triticum aestivum
  unsure (1)..(877): unsure at all n locations
  Clone ID: PAT_TA_5920
gcaggaattcggcacgagggtagagtaattggtagaagcaggagctgtagatcactaacagggtctactttacttgatgagatggagatggaggattgcacaccagtaaacagaagtttggtaatcttcccaggacgacctgaagagtaccagagaagaggatctgcattgaactacgatgcagggagtgagactctttcaaggtgcaggatctgaaattagcgcctccaggggagctagcaagacaggtgatgcagaatttaccggtataggtgaatttgttgctgaacttaaggagatggctcaggttcattatcagaaacaggtaggtgaccagagtgcaaatgggaagagcatcggattagacccaatcatggatggtttgcaatcaccttcgcgatggccattggaattcgagaagaaacagcaggagatcattgagctttggcatgcttgcagcatttccttggtccgcaggacatactttttcctgctgttcaaaggagaatctgccgactcgatttacatggaagtggagcttcgaaggctatcgttcctcagagacacctactccaggggaagcacccccagcaatgtgaccgtaggcagcctcagctcttcccccgtcgcgagcgccaagaagctcagngcgagagtgagatncttgcnnggcanttncanaatcnnctgtccgtnnaggnnnagnnncctcatttnnccnaatnnagctntttnnntngantncnannnagnnnttgntncttggtnctnntnntnctnntntacnnannnnnnnnncnntnnattnnnttnntnnnannnnntncttntnnnnnncnntnntnnntnntntnnnctnnnnnttnnnnntntnnnn

SEQ ID NO: 5921 - DNA, 704 bp, Triticum aestivum
  Clone ID: PAT_TA_5921
gagcagctggtagagccttggcgtggctgcgcccttggccgggcgcccgcctgttcgcggggtggtggatgtggctcccgttgcgcagcctgtcgcctccgcctggattttgcccccgcggccttcttggtgtggccctggactggtgtgaaccatttgacacatatccaaggacttatgatctgctgcatgcattcgggctattctcaaaggagcagaaaaggtgtaacgcctcaattatcttgcttgagatggatcggatactcagacctggtggtagggcgtatatccgtgataaaaaggaaacgatagtggagatcaaggaaataacagacgcgatgggatggagatccaccatacgtgacactgctgaaggcgcgtatgctagcaggaaggttttgatgtgtgacaagccgatggtgcgctagccgatcaggcagagcattctccggcaagcaatgctgtggcgggtgcctgcggttttagttctccggcaccgttggaaccgactacaagaactgcagtggactggagattgacattgtgctccgtagataggttataggtggaggtcaaagctgtaacttaattcgattcatcatttgtttgtacaagtccgatctagctcggcgtgtttttgttgtaacatatatatacggtgatcgaaagaagacttggcaaaaaaaaagtcgacgcggccgcga

SEQ ID NO: 5922 - DNA, 699 bp, Triticum aestivum
  unsure (1)..(699): unsure at all n locations
  Clone ID: PAT_TA_5922
cgtccgggcttccagagtccagtccagtccaggcttggttgcacttgcagggagctcggcgaaatccggagcgtctcgcgtgtgtgcacctttgggaggcgaggacagccgccatggccgccaagagggtgctcctgctctgcggggactacatggaggactacgaggccatggtcccgttccagtcgctgcaggcgtacggcgtgaccgtcgacgccgtctgccccggcaagaaggccggcgacgcctgccccaccgccgtccacaagcccatcggccaccagacatatgcagagtcgaaaggtcataactttgcacttaatgcttcattcgatgagattgacgctgctgggtatgatggattggtgattcctggaggccgtgcaccagagtaccttgcgatggatgaaaaagtgcttgccttagttaggaagttctctgacgctaagaagcccatcgcatcagtttgccatggacagttgattctggcagcagcaggagtagtcagggaccgtacatgcaccgcgtatcctgctgttaggccagttntggttgctgctggggccaagtgggtagaagctgatactatgaagaaatgcgtcgtcgatggtaatctggtgacagcagcggcttacgacggtcaccctgaattcatcagcctgtttgtgaaagcacttggaggctccgtcgcaggcgcag

SEQ ID NO: 5923 - DNA, 1563 bp, Triticum aestivum
  Clone ID: PAT_TA_5923
cgtccgcggacgcgtgggggcttccagagtccattgtccactccgtccaggcttgttggttggcttggcaccttggagctcggcgaaatccggagcgtctcgcgtgcgcgttggggagtgtcagcagccatggccgccaggagggtgctcctgctctgcggggactacatggaggactacgaggccatggtcccgttgccggcgctgcaggcgtacggggtgtccgtctacgccgccagccccggcaagaaggccggcgacgcctgggccaccgccgcccacaagcccgtcggccaccagacatatgcacgagaggcaaaggccacaactttgcacttaatgcttcattcgatgagtttattgcctgcatggggtatgagtggatttggtgcaatgcgtggatggaccggtgcaacccgagggcaccttgctgcctggatgaaaaagtgctcgctgatgccggtgttcgtcaagttcggctgaccatgacgaacgccgcgttgcatcagtatgtcatgctcagccgggtcggacatggaggaaggacgggcccggatcccgtccgtgcatcgcgggtactggccagtcttgggtgctggtggggccaagggccggctcgccagggcagttcagtacgaagaaattggtcgtcctcggcaccatgcgtcgccttacgcggttaccgctggctcacaatgaatgcctgtcggggctcttgtgaacgcacttggaggcgactactgcacctttgcggggattacatggagtattatgaggtgatggtcccgttccattgccctgcaagcccttggctgccatgtcgatgcggtctgccccgacaagggccccgggggacaagtgcccaactgccatccatgactttgaaggggaccagacttacagcgagaagccgggtcacgatttcgctctgaacgcgtcgtttgacggcgtggacgcttcaagctacgacgcgcttgtgattcctggtgggcgtgcccctgagtaccttgcgctgaacgagaaggtgctcagcttggccaaggggttcatggataaaggaaagccggtcgcgtcgatctgccacgggcagcagatcctggctgccgctggggttcttcagggccggaagtgcacggcgtacccggcggtgaagctgaacgtggtgctgggcggggggacgtggctggagccggatccgatccagggccgcttcccccggtgcttcaccgacggcaacctggtgacgggcgcggcatggccggcgcacccggagttcgtcgcccagctcatggccctgctcggcatcaaggtctccttcgcgtgagcgctcgccatcgttcatcctcctcccatcacatgatgcacagatagaattttgtacaccttgccgtgtccggaactcggcctcgctctggccctgtctcgtgcctttgtttgtgtttgaggcaggtctgatgagaccgtccgtatgtacctgtacatgtgctgccgcggcaccgtcttgtggcgctgtttcatccatcaataatgaagttatctgtgtgggtgtgtcgattgttaact

SEQ ID NO: 5924 - DNA, 720 bp, Triticum aestivum
  Clone ID: PAT_TA_5924
cgtgtttagagcataggtcatctcactctcagcaaatagaacttcaaggtttgatgaacaacccccctgattaccagaaatagagagctcatacagctgcaacagacagttcctacaaggattgtgcagtcacaagcatacatcactactaacaggaactgaagagatgtatcatcatcaacaacagctccagagccacaaccagctcttagcttctaggcagactttcccttcagagaggcacttacttttgcaaggaggaattattccaggagagtcagggcttatactctcaactgatgctaaacccaggttaaaatggacccctgagctacatgatcgtttcgtggaggcagtaaatcaactcggcggaccagacaaagccaccccaaaaaccattatgaggctcatgggtgtccctggactaacattatatcatcttaagagccacctccagaaatacaggctaagcaaaaatctccatgttcaagccaatgtcggaaattcaagaactgccgcaggatgcaccatagcaacagagaaacaatctgaaggaaatggatcgccagtcggccaccaccttaatacgcagacaaacaaatcaatgcacatagggtgaagccctacagatgcaaattgaagtgcagcgacggctacatgaacaactggaggtgcaaagacacctgcaactccggattgaagcacaaggaagtacctaca

SEQ ID NO: 5925 - DNA, 863 bp, Triticum aestivum
  unsure (1)..(863): unsure at all n locations
  Clone ID: PAT_TA_5925
cggacgcgtgggggaggccaaggccgacgtcgccgccggcggcggcgacgacctctcgaccatgcgcgagcagtgccggagcatggaggaggccatctccttccgccgtgaggcgcagctaggcctcgtcggctccctccagcacctcgtcccggacctggtcccctccctcgaccgttccctccgcctcatcgccgacttcaacgaccgccccttcacccctaccccaaatcccaacgccggcgacccccagaaccccagcctgaagccccaccaccgccgcaccgtccccgacccgacccgctccacccgccgcaagacctctccggggtcctccccggcctccgccgccgtgggaggcgctgcccccggaggtctcgacgcggtacgcaccatggtggccgtatccctcctcgagcttatccccttcgccgagatcgacgccgccgtgctcgcacgccgtctacaggctgaatcctcctcagccagcgatgcggagcgggcggctcttgccgacctagcgacggagctcggcggctccgtgcccgccgctgtagctctcgccctccgacgcatagctgannacagcggcggcgtgcagatcgaggaggccatgattggaggcaagcagatgatgatggtctgggccatcgaccgtagcaagctcctcaaagagctaccagaatccgccacattgttgtcaccccaacctccacccataccacaggcgacctcgtccgagaccgacgctaacactgcaatcataccaagaccaccaccaccacatcagcagcaacagccggatatgtgggcacactcgatgccaccgatgttcccacggcccaggggcatgacaatggcgg

SEQ ID NO: 5926 - DNA, 707 bp, Triticum aestivum
  unsure (1)..(707): unsure at all n locations
  Clone ID: PAT_TA_5926
cgccccccgacactcgccgcgaccgccgccgcccactcctccccaaccactacgccccccaccacgtcgccccgctcctccccggcgctccccttcggcccgctgccagctcccccgattcatctgttctggttgtcacgccttgtctcgctgctccggcagctccagttgtcaccctgaatttccgtcctcaatcacttgatccaaggtccatcaacctagccgaacgcgatacagaatcctcggtccgcggttctagattttgtgccgcccaaaactcgccaagacgccgccgccgactcctccccaagactacgcgccgctcgacgtcggcgatctcctccggcgtactggacttctccccggtgcctgccgccccgattcttggggatccagttgtcatcgcctaattttcggttctcaagcaccaaaagaaggcacaataaacaagccgaatggataaatttctcccatgacaccaagagatggatacatttgtttgcattatctttgttgcaaaatgatgttgtggctgtgaagaactgtttggctgtgaaagattatgttgttatgataaattatgaatgctgggatttgggattcaaagccatgctgttatgataaattatgttgttgccgtgatcaatagtcctcgcggcccatgcaaattatgttgttgggaaaacgctggnaaattatgagaaaaa

SEQ ID NO: 5927 - DNA, 1152 bp, Triticum aestivum
  unsure (1)..(1152): unsure at all n locations
  Clone ID: PAT_TA_5927
agcggagccccgcctagccaccttccccgcggactccgcggccagctgtcggccaggatcaggccgcgcccctgctggcgcatcctgtgtgacgtgccgggcccggctgtgccctccctgtccaaccctttccctcgtcccccgtctgacgctcggctggtgttggaaagacagagcttgcaaaagctctagcggagcagctatttgacagccagaagatgctggttcgcttttacatgtctgaatttgttgacaggggatctgtgctgcgtctcatcggagcccctccaagctccaatggccatgaagacggtggacagctgacggagaaaatcaggagacgcccatacagtgttatcctttttgatgaggtggagaaggcagatccgtcggtgttgaaccttttcgtgcaacttctggatgatggtgtgttgacggatgggaaaggccggaccgtggatttcaagaataccatcatcatcatgacctcaaatctaggagcggagcatctaacagctggaatggctggaaacggcacgatggaagctgcacgggaccttgtgatgcatcaggtgcagaaacacttcaaacctgagctttgcaacaggatgagtgagattgtgatatttgagccgctttcgcgcgacaaactgaaggagattgtgaaaatccagatgaagaggattgtcgccagagtcgctagcaagggcatttgtctgtctgtgagcgatgccgcgttggaggtggttttgtcggaatcgtacaacccgatgtatggtgcgaggcctgtaaagaggtggttgctgaagaacgtgatgactgatctctctgagatgctggtcaatggacaagtcgtcgaaggctcctccgtctccattgatgctgccgatgacaggaggctcaagtttgaagtggtgaagaaggtgcattagaagcctgcagtaacagggctttgctgacaattgcatgcaggagcctgcgcccaatagctttctccaagatttagtttaatgactgcattttgtttttagcttggaaaattgtgtttgttgtggagtccctgattactactacttgctatcctgagcaactcaaacttggtcttcaaanactcagaaaacgaaatagacactagtttttnatacgcatttc

SEQ ID NO: 5928 - DNA, 563 bp, Triticum aestivum
  Clone ID: PAT_TA_5928
gcaggcatttccaaggtttaggtttagggttcttcgccgccgcccacctccgccgccgcccggcttggttgcagccatccacaccgaaatggccgccgcccccgcctccctccgccgtgtcgccgccgccgccgctccatgacggcccaggcgagtctcctgctggacatgcctccggagatccggcgggagatttcaagggtcaagatggccgacatctccgaccaccgccagctcgcccaggaggtgtcgcggctcagcggagtcatcatcaaccatgaggcggccgcgcgcctcaagccagtggaggctgcgatgcacgtcgggacgttgtcctggcgtgtctgcacctccgtgctcaccgtgagcatggctgcaacttttggcgtcgtccagatcgccatgcccgggtggaaatcgaggtatgaagacgccgcggtgaagcacgcttctaacatcattaagaagaaagcgcaacaactcgaagaatcactggccaaaaagctccggaacaaaaagacgttggtggagctgggaaagaactcaatcaccacgagggagga

SEQ ID NO: 5929 - DNA, 966 bp, Triticum aestivum
  Clone ID: PAT_TA_5929
cccccccctccgcccggtggcccccgtccgtccacccaactccctgagtttttcatcctgtcccccctgccttttgttcccccctcgcgcactcgcactcgcactcgcatcatcattcccgccgtcgctcgcccctgccgcggcgcgcggtccgcccgcggacggcgccgcccgcgcggcggggcccggcaggcggcggctgcgagtgttgggcgcgcatgggatgagacggcggtgtgagcgcgttgcctccagtggatggatcgcgggcggagcgcggggcccggcgccgtcggtagcgcgggcagcctcggcctccggatcggccaggccgcctgctcgtcggcggccctcatgttcatgtccgttggcgtcgagttcttcagctacaccgccttctgcttcctggttacgatcatgggcctgctggtcccctggagctgcacgctcgccatgatcgacatgtactccatcctcgtcgggtgcccgctccacgtgcccggtgtcatggccatcgtcgtcgtcggagactgggtgctgtcgatactgtcgctggccgccgcgagctcgagcgccgccgtcatcgacgtcctcctcgagttccacgggtcccactgcgccccgaggctgtgcgagaggtaccagctctccgccatgatggcgttcctgtcctggctcctcacggccgcgtcgtccctcttcaacctctggtacatcgcctccaggtgaggtgaggtgagggtgggtggtcgccgatgaggacgccagactctgactcgccgcagcacttctaaattccgtagtctgtaactctgtatagctggaaggaaggttttgtatgtgtatagctggaaggttttgtactcaaatttcatttcataaacctgcctctgactaatcagcattaaggattgtttgaagttaaaaaaaaaaaaaaaatcaaaaaaaaaaaaaaaaaaaaaaaaa

SEQ ID NO: 5930 - DNA, 683 bp, Triticum aestivum
  Clone ID: PAT_TA_5930
gttggtagatgttcctcttgatacagcacttatgacaggggaaatatttggcccatgctttccaattataacggtcgacaagattgaagaaagcatcgcacacatcaacgccggggcgaagccactcgcagcctacctcttcaccaaggacaagaaactgcaacaagatttcgtctcaaacgtctcggcaggaggcatgctcgtcaacgacgtcgccttacacctgacgaacccacatttgccgttcggtggcgtgggcgacagcggcacggggtcgtaccacggcaagttcagcttcgactgcttcacccacagaaaggcggtgctgatccgcgggttcggtggcgaggcgaatgcaaggtacccgccctacacagcagagaagcagaggatcttgaggggcctcatcaagggcagcttctttgcgctgatccttgcgctcctggggttcccgagggagaagcgttagctgagttgagctccctcccttctccagtacagcgtagcaggattgttcatgttcatgagggcgatgtggtgcacttctgcactgaagcgccagtgcgcgagtgtgtatgggactatcatcggatttctggatgtaatttaattttacataaataaacctggtttgctagttactctagcgtgaagcatgaagaggattatgccctgcttgcaag

SEQ ID NO: 5931 - DNA, 882 bp, Triticum aestivum
  Clone ID: PAT_TA_5931
atcataacgacaaaagcgttcgttacagagctggttgactctttgaaaagagtcttggaaaggttctacggggaggatccgttgcaatcggcggacctgtctcgtattgtgaatattagccatttcggacgattaacgaagttgatagacgacaaagaagttgccgccaagattcagctcggtggccagacagatcaggagcaactaaaaatagctcctacggtgttggtagatgttcctcttgatacagcacttatgacaggggaaatatttggcccattgcttccaattataacggtcgacaagattgaagaaagcatcgcacacatcaacgccggggcgaagccactcgcagcctacctcttcaccaaggacaagaaactgcaacaagatttcgtctcaaacgtctcggcaggaggcatgctcgtcaacgacgtcgccttacacctgacgaacccacatttgccgttcggtggcgtgggcgacagcggcacggggtcgtaccatggcaagttcagcttcgactgcttcacccacaggaaggcggtgctgatccgcgggttcggtggcgaggcgaatgcaaggtacccgccctacacggcagagaagcagaggatcttgaggggcctcatcaagggcagcttctttgcgctgatccttgcgctcctggggttcccaagggagaagcgttagctgagttgagctccctcccttctccagtagagcatagcaggattgttcatgttcatgagggcgatgtggtgcacttctgcactgtgaagcgccagtgcgcgagtgtgttcaacaggtgtaaaatatgggactatcatcggatttctggatgtaatttaattttacataaataaacctggtttgctagtt

SEQ ID NO: 5932 - DNA, 1890 bp, Triticum aestivum
  Clone ID: PAT_TA_5932
gcacgaggccccacctccgtccctgggttgggtgcacacttctctcccacccccatctctccctccctctcctgttcctcgccttatctccattgccgcctgctgccccagcttgggcttagctagccagggaacgaggaggagcgggttgttgtcatggcggcgtcggcggcggcggtgatggaggagctgcggggcaggcttcagggaggggcggacgcggccggccgagtggcggacggcgcagctcagggcgctcgtcaggatgatcgaggagaaggaggacgacatcaggcgacgcgctccacgccgacctcgccaagccgcgcatggaggcctacctccacgagatatcgctggcgaaaggggcgtgtatgtttgccctcaagggggctcaagaattggatgaagcccgacaaggtaccttctgccataactacattcccatccactgctcaaatcgtgccggagcccctgggtgtcgttctcgtcatatcagcctggaactatcctttcttgctatccatcgagacctgtcattggagcaattgctgctgggaatgctgttgtgctgaagccatcagaacttgcgccagcaacatcgtcattgttcgcgaagctgctaccagagtacgtcgatagctcgtgtataaaagttgtggagggaggtgtcactgaaacaggtgcactcttacaacaaaaatgggataagatcttctacacaagaaatggtaatgtagcccgcgtagtgttggcagcagctgcgaaacctctaacccctggtgctctggagctctggggaaaatgccgtgttattgttcactcaaatgtcgctctgtattttgctgataagaggattgctgttggtaaatggggctgttaacatggccaggcatgcattccactccattataacaacacgacaacgactttcgttaccgaattggatctattcgacgattagaggattggataggttaggtgggaaggataggatgcaatcggatctgctgtctagtcttggtttgtgttaattagttcgatcaaccaactaactagatagataaaaaggaagtaaccagcaacatacagctagctggtcagataagacagaagcaagaaaaaataacacctgcgccttcggtatttgtacctcttgatacagaacttatgacaagggaaatattagtacccatgcctatgcttccaattataacggtcgacagaagtaaagaaacacacacaccaacgccgggggggggcaaatggcggcctacctcttcaccaaggacaagaaactgcaacaagatttcgtctcaaacgtctcggcaggaggcatgctcgtcaacgacgtcgccctacacctgacgaacccacatttgccgttcggtggcgtgggcgacagcggcacggggtcgtaccatggcaagttcagcttcgactgcttcacccacagaaaggcagtgctgatccgcgggttcggtggcgaggcgaacgcaaggtacccaccctacacggcagagaaacagaggatcttgaggggcctcatcaagggcagcttctttgcgctgatccttgcgctcctggggttcccaagggagaagcgttagctgagttgagttccctcccttctccagtacagcatagcaggattgttcatgttcatgagggtgatgtgcaggactggtgatgtggtgcacttctgcactgtgaagcgccagtgcgcgagtgtgttcaacaggtgtaaaatatgggactatcatcggatttctggatgtaatttaattttacataaataaacctggtttgctacttactccagcgtgaaggatgaagaggattacgccctgcttaaaaaaaaaaaagaataatttaaaacctaataatcgg

SEQ ID NO: 5933 - DNA, 658 bp, Triticum aestivum
  unsure (1)..(658): unsure at all n locations
  Clone ID: PAT_TA_5933
ctcgctaccatccatggcgacaacctcgcccgcatggtcaactcctcccccgacgccgaggcccgcgcccgcggcgccgactcctggcccgtcctcgagcacctcgcgcaggaccgccacgccgcccgcgacggcttcgccgcggcctccttcgagctcccccaggagaccctctctgccggcgacgagttctccgcttccagcctcgcgcctgcggctgctgccgctactggggatgagccgccgcctgaggaggcgccccccattgagaaggacccctttgcggccagcgacatggtcgttagcaagccggaggaggccttggtcggtgcgttcaagaagaacaaggagaccgcccttgtggttgctgatcctgctgctgcgcttgctgggttggaggtcaccactctgccgccagctgaggccaccaaaccaacattcatcggtgtcgagggatttgagggcgactatggtggaattgagtttggtaacgaggaagcttcactggctgaggcattcgaaggcttcaatgcgccatttggtggtgggctagatgcttctgagtttgttaccacaaccaagaaggatcacaaggacaagaccccttactgggnccttgagattctanccatgantgggggggcaaggcaccgaangc

SEQ ID NO: 5934 - DNA, 464 bp, Triticum aestivum
  unsure (1)..(464): unsure at all n locations
  Clone ID: PAT_TA_5934
tggaggacgtgcccctttgtttgatgcccacggaggagggcccgacttgggntgcgacggagccttgggcgaacctttcctttacttgggagaaaaacttattgcaacatcttcattggagaagtgcgcgaagcgcctccatgcgttagcgctccttcttctcgtatgcttcgctactcatgcacaaggcagtggcacggagtccggtgacgccgaggcttttgcgtgctacaagcttgatgttttcccatcctgcaatccaaagacaagtcgatgctactgttgtacaatggatcagtgcaaaacccgctatggcacaatggatgagtgccaagctcactgtgtagcttcgcctttgggtgtaaatgagccagcggcaccctcctcctcctcctcctatgtacttccatgaaagtgaatggagtattatgtttgtttctttgagaaaaaaaaaaaaaaaaaaa

SEQ ID NO: 5935 - DNA, 1830 bp, Triticum aestivum
  Clone ID: PAT_TA_5935
gcccggggggcgccgccagcgggcgctcgtgccggccgcgctcccggcgcggcgccggccgccggtcctcgccggcctcccggggccggcccttcccgtggctcgcaatggagcacattgttcaggcgtacaggaggtcgaagacgcgcgccattctgctggactacgacggaacgctgatgccgcaggcgatcaacaagagccccactgcgaaatcggtccagatactcaatagcttgtgcccctgatcccctacgagtacgttgcctcccggcaaggcaacgacaagctggacagaatactgcgtgctgtgcaagccagaggagaagaagagcatgctggtggtgtccgagttcatcgggtgctccccgtcgctcagcggccccatacgggtgaacccgtggaacatcgaggccgtggccgaagccatggagtgcgcccttgtgctgcctgagaaggagaagaatctgcggcacgacaagcactacccctacctggagaagcaacgacgtcggctcctgggccgggtcatgccaggccaaggagctcgacgaccaccaagggagagtgcaaccgacgatccgggggaatcgaagagcaccgtgcactccgtcgaagctaaaccacagggcgtgagcaagggcttgcagtggagcacattgttgcaggcgtacaggaggtctaagacgcgcccggacttcgtgctctgcatcggggacgaccgctccgacgcggacatgttcaaccccaatgccaaatcggtccatatactcaacagcttgtgccaggaccagaggaatgcggtcctcctttgcagcgggttcaaacgctgcacgctcgacgagtggtaccctgccgagaaccttggcatggcggcggagcacggctacttcatgaggctgaagagggacggcggaatgggagacccccaccccacccgcagactgcagctggatgcagattgcaatgccggtgatgcagctctacaccgagacgacggacggttcgatcatcagaggagagggacacagtgctcgtctggtaactacgaggacgcggaccccgacttcgggtcatgccaggccaaggagctcgtcgaccacctcgagagcgtgctcaccaacgagccggtgtccgtgaagagcaccgtgcactccgtcgaagctaagccgcagggcgtgagcaagggcctggtggcgcggcgcatgctggcggcgctgcaggagaggggcatgtgcccggacttcgtcctctgcatcggggacgaccgctccgacgaggacatgttccagttcatcaccagtgcttcctgcgccgactcgttcgcgtccacggcggaggtgttcgcctgcaccgtcggccgcaagccgagcaaggccaagtactacctcgacgacacggcggaggtggtgaggctgatgcaggggctggcgtacgtctccgaggagctcgcgctgcagaaccccgcgctgggagaggaggaccccgaggacctgtggtgcgtcggcgagctgcagtagtagggagctggaatgaagcgcaggggcagcacagcaggaaggcattgtcgtgttggcaacagtctgagaggcttctgcagcgtagtttaggtgtacatgagctatgcttttcatggtatttgctgcactgccggtggtttgctattagtagtatgagacttgctttagagtgtcgtgagctccgtttgaaaacctggtagtactagttaccgcaacaataataatgtctctctgaatgccatggaaaaatgctactaatgtgtgctgttaaaacatatgaaaaaaaaaaaaaaaaccgagactagttctc

SEQ ID NO: 5936 - DNA, 782 bp, Triticum aestivum
  Clone ID: PAT_TA_5936
aggcaacaatcaaccaacacttaagtaagaactactgaatcccataacacggttgattagcagcggctgcagggttatacagctcatggtaagttcatacagacgagcagtacaagcattaagatcaggtgcttttgctttagcaatgttcaaaagagagagataactatactgggttgctggcctagacatttgcataggagagagaccacgaaaaaggttttgccaaaggtctacctcgcaagcgcaagaaacatccggtttgttaatactttcttcatcatcatcatcccacgagaatcaaagatgaaaagggggcactgtagattagtgttttagagcgacggaagggctgtctgtcacttgtgaacagacaactcgtgcagatgagcgatgtcggcgttggagaaatggcttgtgccgcagatcttctccagaggatctttgcagcacctctggagctccaggtacctgtccaggttgaacttctgcctctggatcaacttcctctgccgggactggaacatcctctccatgaagtcccggtacgtcggatcccttgatgtgatgaggaagtaggcgtacccgacaaccagacccgtcgcagttgtgaagaatgtgatgggctccatgacgtcccacgagaactcccagaaggtcagcctgaagaagagcccgacctgcgtgatcaggaaccctagcccagaccagaggatacgccggacttgcttgtgtgcgagcttgttgatttcttccaaatgtgtctggagttgcttgagctc

SEQ ID NO: 5937 - DNA, 564 bp, Triticum aestivum
  unsure (1)..(564): unsure at all n locations
  Clone ID: PAT_TA_5937
tttttccttaccctacttttctttgtttcagccaccttcttccagcccagtccaagcatgccccgatttatagtggtccatagccaagccaccctaccacacattactaccgaattacagtcagaagcatccatatatgctgctcttacatgctccatgggagcggcacctgccattcaaagtcgtctgctcccgtgcccctggggtgcggctcctgccattcatagtgtctgctccagagtccatggtttacgtatatatacacaaactagagccatggtgccattgcaaattcaacaactccatagtccatattaacaatatagagtactggccttatactaattctgcagattaggccggttcccctgctttcgccttgcatcagccccctctctgttaagtggcttcacttacagcccgtctacttggccgggacctgcacccgctgctgtcgacgtgcaacatattcctcatagtccgagtcactctcagactcggagatccatccgtagcaggggggccttttgcgcctagttcctgtagctaacggatnctggcgag

SEQ ID NO: 5938 - DNA, 513 bp, Triticum aestivum
  Clone ID: PAT_TA_5938
caccttattcatcgtttctctcgcctcagtggtgattctagcttcctttctgagccgcaaattagcaccaagttccaagagtaggcggcctcctggcccatggcgtctgcccttgatcggaaacctccaccagatcgtcggggcccagccgccggtcgtactccgggacctggccaagaagcacgggccggtgatgtaccttcggctgggccaggtcgacaccgtcgtggtctcctcgcggtccgccgcagaggagctgctgcgggagaaggacctctccttcgcgtctcggcccaaccttctggtcgcggagatcatcttctacggcaacatcgacatcgccatgaccccgtacggcccgtactggcggacgctgcgcaagatctgcaccgtcgagctcctcagcgagcgcaaggtgaggcacttctctccggtgagggacagcgagaccatgtccctcgttcggaacgtccgcgaggccgccgccgcctcgggtggcaacccattcaacct

SEQ ID NO: 5939 - DNA, 736 bp, Triticum aestivum
  Clone ID: PAT_TA_5939
cctagggggcctccccccgccccccgtggtccccccggcctcctcacgccccctccgccacatcccgttccgctcccatccccactaagctagctaggatggatccataccatgctcctatggcggggatttcgttaggttcgctggctccgccggacgtcgacgtcggcgccgccgccgacctcccccagagctgcattcttgacagcaagcctttctttggcgagaggataaacgacaccacggccacctacagcaccaccgacccggacgacgaacagcgccccatggtcatccagatcaccttgttcgtcgcccgcccgcctcgcgtctcctacgtgcttgcctgggccaccggcacccgcttcaccgaggagcctctcgtcctctcctcccacggcggcttcgtccttctctccatggccgggcgccccctctagtggccgcgctccgtatgctgcatcttccatcccgtccgaggccccggcggtgaggcccccccgccgctcctccagtgcccgctccccaacagcctccccttgctccgcgtctcctgcgccgtgggccccccttctcatgccccacgccggcaagaacttccaaccagccgaatcacaggtcagtccatggtggaaaatcggagcacggatcgatggtgatgctgctcggtcagaaaaacatgccttttatctcatcttacatgctagtacttacactagtacaatttcaaaaaaaa

SEQ ID NO: 5940 - DNA, 1957 bp, Triticum aestivum
  Clone ID: PAT_TA_5940
cccactcgtccgcccacgtgtctgtcagtacgtccctcttcttttcttgcatctgcttggttataaataagtaccagtatgtttattgcatcaacgtgctaaactatacagcaaacagcccacactccgtacaagctggcgatactggcaacgccatccaaatacaataggcaacaacaacggaaatgtatgccaggatgcaagataccatatactcataaagtcataatataggacacagcagcgtctgcagaagctagaacgtaaacgaacgcaggcatcatccaaattcaaatagcaaagcactgaactgtatggtgcttacgaacgaacggcacagatccgggggcttcttcagccgctgcgggtccagacgacgtggtcctgcggcaggaagtggcacaccggcgccccgccgggcttcaccttgagcacctggaacgccacgtgcctcgggttccagccggccgtgttggcgtggcacaccgccacggcctccaccgccgtgccgtccttgccgaccatcgacaccgtgtacgccctcgtcgcctgcgtcaggtggcacgcgaacacggcgtacgcgtacggctccgcgtggcaggccacgagctggtcggcccccgccgcgcgcctcacgccggccatggtgtactcctgctccggcgacccctccttcccgaccaccgtggagacggccctcacgtggctggtcccgaggctggacgtggcgaagtccaccatggactccagcgacgtggcgcacgacttcttctccccattggccgccgtcgcctcgcactcgcgcagcgtctgcttcatctccgccgcctcggcggagtccggcgccacggagaagcggctgaggatctcggggaccttctccgaggagaacgggatggcgtcggcctcgctccgcggcaggaacttctcgccggcgcccggggtggccatgaaatggacgttcatcttcttcccggcgtgcagatccttctccaggaagaagagcgcggcgctggggtcgtcgtgcagctgcgtctccgtcgcggcgtagttgtatatgaaaggcgagacgttgacgtggacaggcttaccccggggtttgccgcctggcttgccgtagccaggcttgacgttgacgccgacgccgcccttcccgacgccgaccgtggtgccgcctggcttaccgtagccgggcttgacgttgacgccgacgccacccttcccgacgccgacggtggtgccggtgccaccaggcttgccgtatgcaggcttcacgttcacgccggcgccacctttcccgacgccgaccgtggtgccgccgccaggcttcacgttcacgccgacgcctcccttccctactccaaccgtggtgccgccgggcttgccgtagccaggcttgacattgacgcccacgccgcctttgccaacgccgaccgtcgtgccgctgggcttgccgctgccaggtttgacgttgacgtcaacgccgcccttgccaacgcccacggttgtgcccccgggcttgccgtagccaggcttgacgttgacacccacgccgcccttgccgacgccgaccgtagtcccgccgggcttggcgctgccaggcttgacgttgacgccgacgccacccttgccaacatcgaccgtcgtgccgccgggcatcccatgacccgcgtcgacatggacaccgccccagccgacgttcaccgacgtgcctccggcttgattgtttaggagttgagagagggagcttggcataggggtgttgggaagagcagacttccagtattgctccggagcacgagctgcatgggcatggcttcctaccgacgcaatcagtagaaagccaaggatgccggcggcgacgagcctatccatggagggcaccaatgaggaaactgacgacagctcgcaatgtgaggatgatctgctcacttggaactgccacaaggggtcgacc

SEQ ID NO: 5941 - DNA, 846 bp, Triticum aestivum
  unsure (1)..(846): unsure at all n locations
  Clone ID: PAT_TA_5941
acgagcggggggcgcgctcgcgcgtggttttcttcaccctcccctccactcagctcaaaanaatcaatcctgccaccgcggttctgtaccaagtggctggcgaggagccgtgtgagtcgctgaaacaagtgcgaaccttggaagctagtaaaagttctgtggaccagcaggtctggtgttgggaagaaccttttgtgatcaggtaatttgaacaagccgaagagaatcctgccgccatagttctatttctatcgtccctcgcgtccgggagccacgtgggtcgctgaaacgggtgcgtgcactcggaagctggcaaaagtttagtaacgtgtggaaggaactttctgagaccagagaattagaaacaaagcatattaaggtagcggctgaagatattctgctcctgctactacacattgttttggtggtctggtggtcttgattgagctgtctgttagattcagttcatggtggctggatgagaagctgaaatgctactggctgtggagggaggaggttttttctcatcatccgcatcaggatacagccatggccttgcgcttttgctgctcggccggagaactgaagagcagcctgtgagggcatcgtcctggaatcactatcgactagtcgatcgggacgctgggcatggggggcagctgcctccaacaaaagacgatgttcctggtaaatgtgcttccttcacctgctttggntgcacacctgctangcttgagggcgcatctcctccgaaattgagctcaagtaacacgcggcagcaattatccagttccacaancaggaaaggaacaanccaatggttcctccanaaacggaagcgggagg

SEQ ID NO: 5942 - DNA, 1244 bp, Triticum aestivum
  Clone ID: PAT_TA_5942
cccccccctctgcatggggatttttttggtgagggcgatgaagcgcgtgagcttcacccagctgcgccgctccgagagcccctccacccggccgcactccctcctgcccgccaccgcctccgcgccgcccccccgcgccccctgcctcggcagcctaggcgcatgagatgggctgccctggtatgttggctccagaaatccccacccccccgggagcctgggccccccccctagcccgcgcccgcgccctgagcaccatcctttatgtggtgctggctcgggtctgtgtgtttcggggtgtggagtgttgggggtgttgctccccggctccagttcggagttcgtgcggtgcaatggccgcaggtacttctccaacccacagtactacttccatgtgaatgatcagtatgtcaggaacaagttgaaagtcatactgttcccgttccttcacagggggcactggacccggataagtgagcctgtgggtggccggctgtcgtacaaacctccaatgtacgacataaatgcgccagatctgtacatccctttcatggcgttcggcaccttcattattctagcaggcttcacactaggcttcatggggaagttcactccagaagccataaaccttcagttcacaagagggctgattggatggggcctacagatcgtgttcctaaaagggctgctctactcgatgggcggtggcgaggtgccgctgctcgacctggtggcctacagcgggtacctgttcgcggggctctccctggccatcgtcgcccggctcctatgggcctactcatactatgtgatgatgccgtggatgagcctgtgcatggggatcttcttggtgaggacgatgaagcgggtcatcttcacggagatgcggggcagcgagaggcactcgacgcggcagcactacttcctgctcttcatggccatcgtgcagttccccctcttcttctggctcggcagcataggcgcatgagatagtcttgtctgtaatcttggcactagaaaaagaaaaagcagcaacctgtgaagcttaggcgcattcagtatagcacatccagtagcttgtgcaggctctctgagcatcatcatacatgttttgttgacagggttttgtgtttggttttgtataaagttgtgaattttgcagttggtcaccattttgtagtatgtttgttggaatagtctcaagtatatttattatttattctttttgttacataaaaaaaaaa

SEQ ID NO: 5943 - DNA, 1382 bp, Triticum aestivum
  Clone ID: PAT_TA_5943
ctgccgggcccccccgccgtcccgcggggtgctgtgtgcacctccgccaaatgcgcgggccgggtagtgcgcgtgcgggaggttcgcccgtcggcgttcctgtgttggtgttgctgcggcccgacagtgccatcggccatcggatgccccccggtcctcgtgccgttggtgatggccggcgctggcaggccacggaactggcggtcagcgggctgtcgcggcgggtggttccgggccttgccccggaccaatttaaagctgaggtgcgaataatgaagcggttacgtcatcctaatgttgttcttttcatgggtgctatcactcgggtgcctaatctttccattgtcaccgaatttcttccaagaggtagcttgttccggttgattcatcgacctaacaacctgttggatgaaaagaggcggttaagaatggcacttgatgtggcacgaggtatgaattatctgcataattgcacaccagttatagtccatagagacctgaaatctccaaatctactggttgacaagaactgggttgtgaaggtttgtgattttggcctatcaagaatgaagaacaataccttcctatcatcaagatcaacagctggaacagcggagtggatggcacctgaagttttacgtaatgaaccatcagatgagaaatgcgatgtctttagttacggtgtcatactgtgggaactttgtacgctacagcagccttgggaaggtatgaacgcaatgcaagtcgttggagcagttgggtttcagagtcgccgccttgatattccagacaacgtcgaccccgccgtagcagagatcataacaagatgctggcagacggacccaagggcgcggccttcatttgcggagatcatggctgcattaaaaccattactgaagcccttgcccgcgaaccaagcaccaaggcagagagtacagcaggcagaggggtagagaaaaacgaagattagcagctgcccgacgtccatacctacaggaattgttttttgtacagttacaccaaatgcgtgtgcagagtaaagagcgtgcgtgatgttggtccgtttgctttcctgtaaagatgtaagttcgtcccaacagtggcatgagccgtattaagcccgcctgtcatcgatccattcacgaagacggacactgtcagaccatgtaacagttgaacaaggaactgacgtggcggttggaacagggggctttgctcataccatctctcctctcctcccctccatttccctcttgtgtttccaccaaatggtggctatatgtcatatgtgccaacacatgtaatgtaatgctgtcaggtgtcagtcagaaccaaaaggaagaaaaagatgaaaagcttgaaaaaaaaaaaaaaaaaaaaac

SEQ ID NO: 5944 - DNA, 603 bp, Triticum aestivum
  Clone ID: PAT_TA_5944
gatgagcattgtcaggtcaagaacaggaaggatggagacaaagtcgggctgatggacaagatccgcgtcgatttgctcaccaggggctacgtcgaggtccagaaagaatatgtggagttgggctctgatgatgaggaggactcggacgatgatgattgtccctatgaaccatatgatgagaacaaccctggaggtgtggtcctgctgatctgagattgaagcaatccaagtattctgcacaaagtggtagaattgcatccaagaagttcgtcaacatccaagtattctacacaaagtggtagaattgcatccaagcagttcgtcaacatccaagtatctacacaaagtggtagaactgcatccaagaagtttgtagactatctgatcagtttaagttgcaactctaatctagcagtgccctgtgtattttttacaatttcagtttggccgatgtctgcatcatgtgttgttgcttagcaaatgtagattcatgaaggtggcatatcagtccacagcttatgtagtcctaactcaagtcgatagaacaaagtttgaacatatgtttattatttttcactgattaataattttatcctctttcct

SEQ ID NO: 5945 - DNA, 853 bp, Triticum aestivum
  unsure (1)..(853): unsure at all n locations
  Clone ID: PAT_TA_5945
cggctccaacttccccgtccctgttgcttcatcgcgacgggcgcgctgcacgcctctgatgtggcctcctcctgatgcgccctctcctgcctcccggcgcctcccggccagatccatcctcgtcctggccggatccgccttgcccctcggtggacacggcaggccacacgcattcttcccccttccttcatctcaacccggcgccaccatcagagaaccggctcctcttcctaccttacgctcggccgtaaggagggcagcagcagccaggatcgagctcctcctccctcgacgcggggccgcgtcctggcgagcgccctttcctgcgacttgtctggacgacggtgcacgcgcaggcccacctccctggtactcctcattgtcctctcaggcggcggtgccatggcggagccctacagcggtcggctccactccggcagcgctcccgccttgacggtgagggtggtggccgctgcagtgcagttcaattgccctgtggtttgtagcccggaattccttctatgcctttaaattttgtttttatgcagctcggaggcaagatgttgcagtgcggttcgcgggataacgacacaattattgtatctgttgtggatgacacacccacttgcagtttggttggcgtgacagcgtanttctttgctctacgtgtggttttcgccgttcggaattgtaatttcattggtaatgcaattgggtttttgccgttcggnattgtaatttcaaccggnttcaaantaaaacnaacgggnccttggaantaaccaacnaanggggttancccattaccttgcggaggggtaanggcaaaggggtgccaancaaatncccttgc

SEQ ID NO: 5946 - DNA, 2250 bp, Triticum aestivum
  Clone ID: PAT_TA_5946
cgtccgcggacgcgtgggcttcagcagcagcagcgaggtcgagtctcagctcaactcactctcgccactgctctcctcctgctttcctcgccagcggcggcgggctcctccggcgacgaggctccaggagtctacggctaagccccgtccgtctgaatcctgcgcgcttcggtgcagccgcccgctcgcgccggccgcgtgatctggttgtgctgaaatggccggcggcatcacttgtggatccttgctgcagaaattacagcttgtatgggatgaagttggtgagagcgacgaggaccgtgacaaggtcctgtaccagctggaccaggagtgcctggatgtttacaagaggaaagttgaacaggccaccaactctagggatccccttatccaggcgctggaagactcaaagattgagcctgccaggcttgacggttgtaccggtgatagctctgttggacgagtactgtaaagctgatgggggaaagacaagaaacacataacggacagcgctccaacagttggctgcttgagcaccaacactaaagagaggaagaaggaatttgttagtgtacagtcaggaatttttcaaatgtgtggtcagatagctggcaccacagaggttggattgcaggcaccacaaaggtcggtcagcaggggggaacaccaccggtcaacgatgatgattttacgatctcagaggcatgaggatgtgagagagcaactccatgggttggagaaagatctgaggaatatgagggtggtgcatcatctgtatactatcttgggacatgatctttttaccgccgtgggcaaagattttcccagccccgtgacctctattgatgatagtttaaatgacaccagcgacgataacttatcaagacttggcgacgaagtattcacactacttgaagatacagtgttgagactaagcaaacttaaaaagtttgctgttcaactgcatcacccttttgcggctcatgggtgctccgttgcttgctcctggcatgttgggtcatgttacctgcgactgatcagcatctgtagtagtattcactgctccttgagatcttgcccttgatttaattgaacaggctgagacagaggttcaaaggctagaccagctaaaatacagcaagatgaaagaaatcgctttcaagaagcaaactgagttggaagacatctatgccggtgctcacacagtaatagacaccgcagctgcccatatgaaattgttggcactgattgaggcagggaacatagaaccaacagaactaattgcagatatggaagatcagatagcaaaagcaaaggaagaagcattgagcaggaaagatatattggataaagttgaaaaatggatgtctgcgtgtgaagaagaaagctggcttgaagattataacagagatgacaacagatataactccagccgaggtgcccatctgaatctcaaacgcgcggaaaaagctcgtattgcggtcagctaggttccagcgcttgtcgaatctctggtggccaagactagagcatgggaagagagccgtggtctgtcctttatgtatgacggtgtaccgcttctagctatgttggacgagtatgttatgctgagggaggaaagagaagaagacaagaaaagaatgaaggaacaaaagcgctacgtcgagcagaaactgaacactgaccatgaagggccgtttggatcgcgagtcagccccaacaggcctgctacggcgaagaagatacctggcccaaagtccaacggcacctccatgaacggcactcctccgagcagaagactatcaatcagtggccagcagaatggaaggtctggggggaaggacagcaagagagacagcatgacgaaggccgtgtcgtctccggggaacggagccgccgccgcagctgccaaggaagacgcatcctcccacatctccggcaccgacctggctccgaccacgccgtgatctttgacctaatatggtgtattagaagataagaaaaggacatttgctgatgttttttcccattgttttgtgctaatataatgtgctgtgtttgtagcgaggagagggagtatatgtgacgtccatcgacccctccgtagttcggctacctggccagggtttgtttgctcctggtgtaaagtggtgttccactcttgattagtttcaccgaggcgtactattttctactacctgtgatcagacgctgtagtatagactttgctggtctgtgttgttagtcgtc

SEQ ID NO: 5947 - DNA, 1210 bp, Triticum aestivum
  Clone ID: PAT_TA_5947
gcagctggccgcgtcctggggttcctcaactcgcggcaggtgagcctgagcttcgcccggaaggcggcgttcgaggtgcactggtacagcttctccaacggccaggagtgggcggcggggaaccccaacgaggtgtgcgcgcggatcgggcccagcgtctcccgccgcgcgctctacctgttcgaccagggctggccggtcttccttagtgagttccgcgcccccgcccccgccgcggccgcctccgcctgccgctccgccgggacggccggagcgtggtcaccagcccatgccggtgcctgagcgcggacaacagctgcgacccggagagccagtggttcaagctggcgagcaccacgaggagcgtcgccgccaatagcatgctcgcggagctgcctgtgaaactcgtgagctcgaagattcgctcgctttgatcggtaccggtaggaccgacatatataattggaggcggcgccgtacacggtgctgttccacccggcgacggggctgtgcgtgaagctgcggtagaactggagtaatatggagctgggcgcgtgcgccgacacggaggcctgggagtacgcgccgcagcaggggcggctggcactgcgggacagcccgctgatgtgcctccgcgcgcagggcgccggccggcccgtgcgcctcggcacgccgtgcgacgacgacatgtcccggtggcgcctcgtgtcggactccaagctgcacgtcgccgttaacacgtcgtcttcgtcgtcgtccggctccggtagcggcatgctctgcctggacgtcggcgcggacggccagagcgtggtcaccaacccgtgcagatgcctgagcgcggacaacagctgcgacccggagagccagtggttcaagctggtgagcagcacgaggagcgtcgccgccaatggcatgctcgcggagctgcctgtgaagctcgggagctcgaagattcgctcgctttgatcagcgccagtaggcccgacataattgtataggtgcacgaatccgttgtagctgcaaaggcgccgggatggacgagagaagctgctctagaactggagtaatatccttcagaattcagataactgaatgaatgttggggcactggagcctgatggccccaagcttgccaaatcgggcagttcattccaggaaataatctcacaaattgatctacataaatctataattttggttcgtgtcc

SEQ ID NO: 5948 - DNA, 1586 bp, Triticum aestivum
  Clone ID: PAT_TA_5948
ctctccctcacccctcgcgccgcgccctccttccctcgcgctggcaccggcggcgccctccttcctttctgtcaccggcggcgccctccttcctttctgtcaccggcggcgccctccttcctttctgtcaccggcggcgccctccttccctcgcgctgcacccgaacctcgctctcgctcccagctcttcttcctcctccgctgcagctagggttttgtctccccgatccccaatccccgaagctcggatccagcagcagcatcagcgatagcggccgcgagagatcctctccaaggtcaagcacgtccaggccaagcctgctggccgccctcgcgggtgactgcctccgcggtgacgacggcggcctcgtcgtccccggaggccgcggcgccccccgggcccgacctcccccgccggcccgcgccgccgtgctcgcccctccgcccgtgttccgggtgcacgcacgagttcgacctcgacaagccgccggtgctgcaggaggtggcggatttcttcagtggccacggaatcgaggacttcaccttcagcaggggcaggctgtcagaatggcggtgccgggcgaagctagcggtacgtggaacaccagagaagccgctgattggcctgtatcaagaagggacacatactgttcaagatattcccgattgcagagcccatcacccaagcattaactatgctattaagcttctgaagcaaggtatatctgagctcagtgtgcagccttttgatgaagatgctggtactggtgaactaagatacgtgcagatgaccgtgacgacatataacacgtctattcccgttgcgcaaagatacgagcaagcgagagttcaagtttcattcgtttggaattcaagagacgagcgctccaaaaattcagagaagttgagtttgttgcaagaattcttatggacaaatggtggaccaagaagtaatttgcatgtgattcactctatatgggccaatttccagacatcaaccagcaatataatttttgggcataaatggagacatatcggcggggaggcagatctgtgggagcgttttgggggagttgatatttgtcttgacccttatagctttgggcaggccaatactctgtcttttaactcgttactgcataagttgatcaaatatgtaccacggggcgcgacggcgcggccgtggtactctggtgccggtgttattgggttagccatcgcggcttctaggaaatgcaggtctgtgagatgtgttgagatcaacaaaatgtcgaaattgtcttttgagaagtcagcaagccgacttccaccaaacctgggttgcaccataacttggcacaataccgatgcttcagctgaacccattcactggcttgaagggtcaagtgttgctatcgtggatcctcccaggaaaggactgcacccttctgttatcaatgctctacagagagttgctttgtctgagcgcaaggcgttcaaggccaaaagttcacttacaaaggtcaaagatgagaagagaccatggatcctgcgagcaagggaaccagctgttcatgttgatagtacctgcccgggcggccgcagtg

SEQ ID NO: 5949 - DNA, 673 bp, Triticum aestivum
  unsure (1)..(673): unsure at all n locations
  Clone ID: PAT_TA_5949
aatttccttttgctttcctcttcgtgcggtctttctacagcatcccatactcttccttcgcgagaaaggggggacggggacgggctgaagggccaccgcccgcgccgccggtcagctgccaccaccgtcacctccgagcgaagtgtcgcgcgggcgcgctgtagccgcgcggcggacgggaagcgccgtctccgtcgagtttattagctggcgaggttaccgctggccgctgcagcttgccgccgccgccagccgtgcacctgcctgccgcgtgcgcccccggctgccgctggacacagctgggcacgcgccgcagcaaggtcaccgcggccgacagggcaattcccctctcaaggaggaaagcacatatcttgtgtcagaagacgatattgcttcctatgaggagacaagttctgaagatactgaggatgtgaaagtctgtgacgtatgtggaaatgttggtgaggagaagaagctcgctgtttgcagcagatgcaatgatggtgctgtgcatatttactgtatgttggtaatgcttaaagaggttccanagcgcgggtggttgtgtgatgagtgccaagctgaggtagaaattgaaattgaaaagaagaaacttgagaaatctcaagtaaattttgtcatggtttccatggagaataaagtggatgctgaa

SEQ ID NO: 5950 - DNA, 811 bp, Triticum aestivum
  unsure (1)..(811): unsure at all n locations
  Clone ID: PAT_TA_5950
ggctgattcagcgcattcggccgcccggcctcagtgattctcgtgaggcgggtggtgctgcaagcctcactgggagctgctcttgcatttggcagtgagatgtctggtgggatctcggatgttcatgttgatcaccttcatattcatggttcatccaaaggtatatccttcaggaccgcaccaggccgtggtggttatataagggatgcgatagtatcagatgtccaaatggaagacctccgtgttgcaatcgagttcaccggcgattggtcaagccatcctgatgaacattttgatttgtctgcactcccggagatcagtgggaatcaccttaaaagacatggttggaaaaaacattacgtttgcaggagtttcgtcggggaatggatggtgagcctttcaccaatatctgcctctccaataccaatttcagcatagctgatacagcgcattctccctcttgggcttgctccaacatttctggatactccgagtcagtattgcctgaggcttgttccgacctccacagtcaatcatcaaattcctccatctgctcatctacccttagcccccaatgcccttgcgacagcgtaccatgtacattgcgcccaatattccttctgtccatccttctgtccagcctcccatcttagcctgcgtcgcactcgctgccccctctacccccccttgccccccgtaccggctctcttccgtttataaggtgcatcaaaaggaaatcatccggggcctttcaaaacaagtcaaggcntttggagggntcaaaaaaaaaaaaaaaaantttggntggggg

SEQ ID NO: 5951 - DNA, 438 bp, Triticum aestivum
  Clone ID: PAT_TA_5951
gaaccgtttgaggaaacccgttcgtctcgtccgctcccgcgagcggcgaggcgaaccctagctcccgcctcctccagccccccgttccttccccccctcctcgccgccgccggctcgcgccgccgggcaaagcccggccagcgtcggcggcggcggggcttcttccccctcctcgcggcgggctggcgcggggcagatcctcggcttggaggtgggccgttctgcaggacggcgtggcgtggcggcggccaggactgcgcggcggcggcggcctgggttgacggcgcgggcggctgctcgtctatgtcagtgtgggggcgtgccagctcgggcggcggcggtgggcacctcggcccagatctggatcgggcaggtgctcgggcaggcgaccggtgggcgacgccggccgagatggcatgggccgcccggcggcgtgcg

SEQ ID NO: 5952 - DNA, 382 bp, Triticum aestivum
  Clone ID: PAT_TA_5952
gcagcaactaaggtaggagcatgtcggcgatatgggctagcggcaggaagacacggctggcacgtgcagttgatatgctgccacctgggccccttcatgcacgacttacaagaccagggcctttttccgagggatgcgctgggtttctctttattggtggtgtatgggatgtcctagatattcctttgctatatgatttgagatcattgtattgctcattcctaaagtgctacggataatctgattgagctgactaaaatagatggtcttttttttacttggcatctgcttgtgttcattgttctacaatccttgctttacagtgtgcacgctggtatgttctggtgccaggctcaaatcggtgagacccatgccaatacat

SEQ ID NO: 5953 - DNA, 468 bp, Triticum aestivum
  Clone ID: PAT_TA_5953
gcttgtccgcacaattgccgcgaccgcgcaaccttcgaatttaagctacccagatcaccttttgaagtgatgttctccacatgtgtgttttttatttactaggcgggacttacgaaggctgatgatcatggggctatggagcgaggtgcgaggatgctcacagagaatgttgtcagaatggtaacgatctgtgcggcagctcatgctaattctgcggcaagctaagatgtgagctctcatttaaaattatctccctatgattgttggttggtatcactcggtattcctcccatagtgtttagatgacgagcaccgatgggtttttcggtgatgcgttgaactcactttttcttttcaagcatccttaaattcttgctggcgtggaaagttgtattgttatgttgttattttcttcttctgtattttcgttattcggttaatgaaaaggggttatgcccgatttaaaga

SEQ ID NO: 5954 - DNA, 403 bp, Triticum aestivum
  Clone ID: PAT_TA_5954
gaccagcttaccacagagctagactggacagaaggcaaggagatcctactcatgagtggaaatgtgcgtgttaaacagcgcgaagccttgatggaagccttcaacgacatgaacagtgaggctaaggtgatgcttgcatcaaccaaggcctgctgtgaaggaataacactggtcggtgcatcgcgtgtggttctccttgatgtcgtctggaatccttctgttggacggcaggcgattggccgagcctatagaatcggccaggagaagattgtgtacacatacaacctgattgcagaaggaacaaaggagaaggtcaaatatgacagacaagctaccaaggatcacatgtccaaattactggtttcaaatgaaccgcaacctactgggagcaatctgtcaccgg

SEQ ID NO: 5955 - DNA, 671 bp, Triticum aestivum
  Clone ID: PAT_TA_5955
accaaagtattctgggatttcttcaaatcctgtgcatttggatccacgagttcttgcaacaaccaggagtcactggaattggagcacattggtaaagacattgttccaaagttgaagggttccccattagctgccaagactattggtcgcttgctgagaatggagctaagtacaacacattgggaaaaatataaaggaaagtgaactctggaaattaaaacaaacagatactgacattctgccagcccttcgactgagctatatgtatctaccgcagaaactgaagagatgcttctcaatctgtgcaatgtttcccaaggatcacaaatttgggaaggattttctagctgatatttggattgcacaaggatatgttggaggggccccaagaatcatcaatgtgcttcgatgcccttgcaaatcgttcattctttcagaaaccatcaccacagagtcttaagtatgcaattcatgatctgatgcatgacacagcacagctagtctcgaaggatgagtgcttcattataaagcatgctagtgacctggacaaagttccttcaaatgtccgtcatctgtcaatattcacaaacggaaatgttcagtgttctgaattgaagagcatatgcgacaagaaaaatttgaggtccctggtatgcgatgaatcgtatagc

SEQ ID NO: 5956 - DNA, 691 bp, Triticum aestivum
  Clone ID: PAT_TA_5956
ccacgcgtccgcccacgcgtccgggcagatgtggacaatgggcatgccagctcaagcaaagaatcttccaatggtttcgatgatctcgactgcaaagagacaccaccagagtgggaggatcatgcactgttcagtaagggagttgaagtgcaacagcagcaacaatctgcccagcaggaaaatgagcttagcttcaccgtccgcccacgcgagcgtaaggctctatcagtccagcaacttagttctgaattttatgccaatggagctgggactgaaggcattgatgcatatggttgtaaggacatgcaagaagttaaaggtatatttcttgaggggcactgtggtttgccggagaacttagataccgaagtcgatcagcttgcctgggagcattccagtttgctacttcaaggattggactatgaatcctattcagaagctaagttgatagatatggtcaaaggactgtccgaacgtatagagactatggagaagaagcagattatttccaacaaagaagtcaaatgcctacaaggagtgaatgacaggttgctgaaaagagttgttgagctaaagaacacagtgaagaatttgaattccaaaatagatcctttatctctagatgattcactaaatcagtttgttgaagaatgtttgggttcagaagatgtcatttatctcattgggggtt

SEQ ID NO: 5957 - DNA, 642 bp, Triticum aestivum
  unsure (1)..(642): unsure at all n locations
  Clone ID: PAT_TA_5957
tgnnnccnnnnnnnnnnnttntgattccgccaagctcgaaattaaccctcactagcgccttcgggcgccggcgcgcctccgccgggccgcccccccgtcgccgagcgcgccccccgggctcctggccttcggcacctccaacgggcacacgctcggcggggagcaagacgcgtacaccgtcagctgggacgacaagcgcgccgccaccaaagtcctcctctccaaggtatttctgcagaaccgggtggagagcctgcgcccgtacaaggcgcacgccgacaagtacatctgctccctcgtccccggcgccggcggcttccagtcccagtacacaccaggaggcctcctgttcacggaacgcgacagcaacatggagtacgtgacctccacggccttcctgctcctcacctacgccaagtacctcagctccaccggcggcgccgtctcctgcggctccaccgccgtcaccccctccaccctcgtctcgctcgccaagaagcaggtggactacatcctgggcgcgaacccggcggggatgtcgtacatggtggggttcggggcgcggtacccgaggcgcgtgcaccaccggggcgcctccatgccgtcagtgcacgaccacccggcccgcatcggctgcgacga

SEQ ID NO: 5958 - DNA, 386 bp, Triticum aestivum
  unsure (1)..(386): unsure at all n locations
  Clone ID: PAT_TA_5958
accggctccggcgactccggcggcggcgtacgggtgcgcggcgtgcggcgcggacctgaacctgtcggcctccaacctgtacccggcggggacctacttcgaggcggggaacaagggcacgctgtccttcagctgggtggacgagtcgcggctgcggttcgcggcggaggaccggatccggcccttcttcgaggcgctcgactactggggcatccagcggaagcgcacccgcgtcagctgcgacgcctgcggcaggctcctcggccacgtctacgacgacgggccgccgctcatggacggcaccggccagctcgggatgggccctanccaggtcgtcccccgccggcccaggtaccggttcaaggtcaaggccgtcaccgccgccg

SEQ ID NO: 5959 - DNA, 2105 bp, Triticum aestivum
  Clone ID: PAT_TA_5959
gttgaaagccagcaaacgcgcgccgtgccccacgcgcccgggcacttcacacctcacgcgcgtacgcttgtctagttcgtccccctcgccggcgacccacccatccattgatggcagcgacggcggtcgtgggcgccgcttctcgctcccctctcctcctccaccaccaccgactccctcaggttccagccggtgggggaggttcgctgagggtgggcgcgctcggggccggacgggattggagacgacgggtccgggttcgggtcggggttagggttttcgcgcgctactcctcccagccacaagacttctctagtcgactccaagatagagctggtgaattgccgaaattagtagaggatcttctccagacgtcgattagcacagggcctcgaggtgcctttaggatggcgcaagggatccaagctctccttggggttggtggggagtggctaaatgacttctcgaagacagctaacacgtcagaaggaattccagctcagatgcgtcttggtttgctttcccctctttacctcagaaggctttttgaacgcatgggtgcaacttatatcaagctaggtcagttcatagcgtctgcaccaacttcctttcctgcagaatatgttgaagaattccagaactgttttgaccgagcaccacctgttccttatagcgagatcgagtcgatattgcgtgaggagttgcagcggccattggatagtgtctatgagtacattgatcccgtgccaatagcatctgcttcaatagcacaggttcatggggctagattgaagagctctcagaaggatgtggtgattaaagtcctgaaacctggaattgaagatactttggttgccgatctgaattttatctatcttgttgcacgtgttttggagtttctaagccctgaattagagaggacatcactggtagctatcatcaaggacataaaggaatcaatgcttgaggaagttgattttagaaaggaagctgtaaatatggaggctttccagagatacatcgaagcaatgggatttgataggcaggccaaatctccatttgtgtatcagcactgtagcacaaagcgtgtcttaactatggaaagattgtatggtgtttcactcaccgatcttgattctataaggtctcttgttcctgatcctgagttgactttagtcactgccctcaatgtctggtttggaagccttgatctcatgtgaatccttccatgcggatgtgcatgcaggaaacctatggttgcttcgtgatggacgtgttggatttatcgattttggaattgttggtcgaatatccccaaggacttgggctgctatggagatctttttggcttctttcgcaactgaggattacaatgctatggcatcggccctttccgaaatgggtgctacagggaatgatctagatgttgactcctttgcaaaggacttgcaaaatatattctcatcgctacaggagttggatactgaaattatagtggcagctgcaagaagttctgatgctgcagctgtatctgctaatgttgttgtagacgagaggcagatgaatgcactgtttcttgatctggtaagggttagcgagtcatatgggctgaaatttcctagggaattcgctcttctcatgaagcaacttctttattttgatcggtacactagactgctggctcccagcatgaacatgctgcgagatgagaggattaacattacttccaacaagcacaccagaacgatgaattgattctatcttccatcatttgaggaattggtgcaagacatggacaagtgatattgtgagttgtgacaagcttatgcaaccattctagaactgtgtataatttaatacgaccagcatagaagtgaatcacgtgaggggaaacataacactggctcctgttgtggaacttaggcatcttggagcggaaattgcttttggatctcgggctacatgtagactggaatttgaaaattataaaatcataattttcaagttttaaaaagttctgaatatatatacacctacaatgggatgtatactactgctcagttcacttgtatacactgatataagacgtttttcacgcgtcaaaa

SEQ ID NO: 5960 - DNA, 609 bp, Triticum aestivum
  Clone ID: PAT_TA_5960
atactccatcgtatcattctctccatcatacacagtttcgtacaaactactcattgtttatgccgttctatgactacatatacaacaccatggacaagtcaactgacgagctgtatgagagaacactgattggaaaagaggaaacaccagatgttgttcacttgacgcatatgaccacccccgaatcgacttatcatctaagggttgggattgcctctgtagcctctcggccctcagataaccatgtatggtatatgtggatgatatggccaatggcatggctatcaatggtactagcatgggtttatggatcatctgcgtttgtcgtcgaaagtctcaagctgaagaagatcatgatgcaaacatggctgataccaagatacaacttccagtacagcctgattagggagagggaatccatcaataggttaattgagcaggcaatatcagatgcggatcaaagaggggtcaaagtgctcagtcttggacttttcaatcaggaaagacaactcaatggaagtggtgaattatttacacaaaaatatccaaaattgagagttcgacttgttgacggaagtggcttagcaacagcagttgttctcaagagca

SEQ ID NO: 5961 - DNA, 781 bp, Triticum aestivum
  Clone ID: PAT_TA_5961
tcgaccccgcgtccgtgcgactcaagagcttcacgcttcttggattcagaactcaagaaagataatgagcggttaaggaggctgtacactgaaactttattcaagttcaccaaccagattaaatatcacacagaagctcaaggtctgaaggaagaattaggaaaagcaaatagcagattgctatccatggaagaggagcataagagggagatcgaacaacttaagcatgacaatgaaatgaattgcaatgccctggagagcaaacgcagctgtgctcttgttcagcaagctgctgatgaggctgcaataaaacaactcaagttggacctgggtgctcataaagctcacatcgacatgctaggtagcaagttggagcaggtcactgctgaagtacatatgaagtataaaaacgatatccaggatttgcacgatgtaatcatggtggaacaagaggagaaagacgacacgcaaaggaagcttaaaactgcagaaaatgagctgaggattctcaagatgaagcatgcagagcagcaaagggactccgtctcggtccagcacgtggagtcgctgaagcagaaggtcatgaagctccggaaggaaaacgagtcgctgaagcggaggctggcgagctccgaactcgattgctcatgagagccggcaccgctcccgccgtcaggttccgaacccttcgtcgccatcaaactcaagtagcttccctccccaatccccatgtacagtcacatgcaccatatctcgccatcagtgattctctcgtgttgag

SEQ ID NO: 5962 - DNA, 961 bp, Triticum aestivum
  Clone ID: PAT_TA_5962
cgggactcgctcaagctgctcgaggccgacatccagcacgccaactcgattgcttctgaattccgaagggaatatgatggtgcctgtcttcagatgaggatgtcatactgtccggctgcacaccttttcctttttcttgtgcagtggacagactgcaaccttgctgtgtgctcttgggctgttgagaattctcatttacaaggtttatgctgatgggacgaccaccatgtccactcatgaaaggaaagcgagcattagggaattctatgctgtaatttacccttctctggcgcaattacatgaaggaattaatgaggtggaggacaggaaacaaaaagcgatttgtatagagaggtatagaagacgagaggaggatcacaaaagggtgatctcagagattgatgataatatagaggaagagtgtggcatatgtatggaaataaacaacaaagttgtccttccaacttgtagccatgctatgtgcattaaatgctaccgtgactggagatcaagatcccagtcctgtccgttctgccgcgccagcctcaggagcgtcgaccctgcggccctcggccttgacacggatacccgtttcctggtcgacatggcgacggtcagaagagagaacctgaggcgcctcttcatgtacatagataagttgcccacggtgatccccgaatctgttttcgaggtatacgattcccacgtaaagtgaccctgtgctcggctcggcgctgcgccaattgttcatcagttgggtactgctagtgctgtagacattaccaattgttcgtcagtggggtgctgctagtgctgtaggcattgccggttgttcatctgtgtgctgctgctaatgttgtagacatttctggagccccgggcgctggctgcctcgagcttatgaacgctccgagcagttcgccggggaagctctgtatgtatgtgacgtactcctatatat

SEQ ID NO: 5963 - DNA, 494 bp, Triticum aestivum
  Clone ID: PAT_TA_5963
agggttacatccaggtctgcacctaccgcggcgccggccgcgaggtgagcatcctcttggactccagggagatcggtgacaacgaactctgtgaccgcctcacgtggaccaaacgggagcgctgcaatgctgccgacttccacctcgccgtctgtgaccccctgtccagcagatacgtgctgcttccaaccatacccgaggacctcgccgcccagccgcaggagtgcctttgggatttccaggccgtgcttgctcccaacaccaccgacgacggcgaggaacagcccttcaaggtgatatgtgtagcaagatacacgacgaagcttgtcctctttgtgctcccgtccacaactatgcaatggtctatgctcgagcctcccattttcccttctttggaacacatgtcctgttttgactgcgtgcgtggctgcttctactggacacagcctgctggctggagtgaccatttgatggtgctggacacgctcaccatg

SEQ ID NO: 5964 - DNA, 275 bp, Triticum aestivum
  Clone ID: PAT_TA_5964
aggctcccattcccatcacagaacgtacacctctgcactgcaatccgaccgcgagagcgggagtgaagagtgggtcgacggctatggcgatgaggaaggagctgctcctggcggccatgatgctggcgctggtggtgggagctgagagctgagagctgagagtgcacgcatgttccctgttatgtggctccatccatcgatgagatgctggaataaaatgttgggtcatgatgcatgctggattatcactttttcccaaccttaaaaaaaaaaaa

SEQ ID NO: 5965 - DNA, 442 bp, Triticum aestivum
  Clone ID: PAT_TA_5965
aggctgatttcgctcgaccgccccagaagcgaaaagggctcgcgcgggacgaggtggagaagcggcggcacgcgggggcgcaggttgtttagctgaggcagattcaagacgggaggccgccatgtgcaccgtttcaatggtgttcctcctcgaggagcgcgtcactagcatgacgcgggcggggaagtggtggacgcgcagggttcacgcctacgtttggggtggccatcgcgctctacctcctggcctctgaactcaccagcatcggtcgccgcggcggcgttgtctctatcgtcttcatcgagatgctcctggtggtcctctataaagccccgagccctggacagggttgatcgtcgaggcggaagcggctgaggcccggagccccctcgaatcgccacgactcatggaggagcagaaaacaagccggcaatgtgcctga

SEQ ID NO: 5966 - DNA, 747 bp, Triticum aestivum
  unsure (1)..(747): unsure at all n locations
  Clone ID: PAT_TA_5966
ctgaattgcccgcccaatttgcaatccacaaattcttcaatccaagattcatcatttccttccagcttatctgcaagcattgtgacaagcttcctgatcaccatgtccacctctgcatctgaaccaacggtcaactccgatactctgcttccagatagaagctcaagaagcacaactccatagctatacgggtcgactttcgacgtgatagggcggccggaaatccactcgggagcaatgtagcctgtggttcctcgcacatgagatgtgttctggttggatccacctcggtttagtaactttgccaacccaaagtcagtgatcttaggctcaaagttttggtccaagagtatattctcgggtttcacatcgcaatggatgacccattctaggcactcatggtgaagataggccaaccctttcgcaacacctaatgcaatattgaaccgttgcttccagtccagcaagatgatgcttttatcaccgaacaaaatgctagcaagtgagccgttctcgacatattcacaaaccaacagcctgtgagatctccccgaacacaatacccatagtctcacggaattctacatctatatcccagctgacacactcgcctataaanctnantctaancaanggcttactcaaaaacttgancaaacgnntccttcagcaactnaanangtgctcaantccganngcttaanggggcaccntcctccggccanttgngnacccttaaaaaaanan

SEQ ID NO: 5967 - DNA, 536 bp, Triticum aestivum
  Clone ID: PAT_TA_5967
cccctctccggcggtgatgcgaccggcggcggcgctgagcctacctgccagacaccagagagcacgctaggcaagggcggcctagcgatgcctttggtcgccgccgccagactgaagcgggaggactgcccccgcaccaaacacgactccctcttctccccgtggaaggttcttgtcgggccgtcggactgggaggaccactccgccggcaaggagggggtccagaggtatcacacacgcaacctcccggacaacttccctggcctctacgagctgggcgttgcaaggccttcctatgatggtgtcagggctcgcagaaatcgatcagtcgtcgtcgtggtggtgtacctcgggcaggccgatagtgtcagggcgaggctccagcagtacggacggacagggtcacacctggacgccgggaatccgttggctgctgtcggtaaagctgaggtgaacgcgctcacggcaggacctggattgttcagggaagtcttctccagaggttactccgtgatgtttcgatgtgcgctgatggg

SEQ ID NO: 5968 - DNA, 1072 bp, Triticum aestivum
  unsure (1)..(1072): unsure at all n locations
  Clone ID: PAT_TA_5968
cctcgcctccgtgttgacacgctgcggcgctattctgtcaccccccgctccccccttgtcgcgccgtcgctctccactgcaagtcaaaagcttaatgaggcacccgtaccaaatgaggcaatgacgagtggagggctgcaagaccaaggggagggagtggggacagcgtcttgtcaaggggtaaaacagggcatgggtgatctacatgttatgagtcagcagaaacaagagacgggtcgacaaactattcaaatctatcaactgttggtacccaggatgcctgcattttgcaaatgtcagtggatcctgaagccagaaacaagcaagagctaacagctcatgttttatcacctcaacatgtagaggagaatttggcagcaacaactgatggacagattgatgagacaatacgtcttaaaactatcagaacccgcagtccagtagaggctgcgccggttaacagtgcaagtcaaaaggttaatgaggcaccgataccaaatgatgaaatgacgattggagtggtgcaagagcacaggaagggtgtgaagacagagtcttgtcaaggagtaaaacaaggcatgggtgatgtagatgttgtcacggaggaatcatcaccagtgagcacgctaaaattgggaaatgcaggcagcgcacctgccgagtttgatcatctgaacatagtgcagcagagagctgatgctctagagtcacttcttgagatatgtgcaaagctactggagcaggagaggcttgatgagctcgcaggtgttcttcgaccgtttggcgaaggagctgtctcatctagagagaccgcgatatggctgacgaaaagtctcatgactccaccaaagcttggagggtccccatgactgatctagtggatagaatttgagaatcttgtgtgtgagtgagtgttccctgtttggagagtgtatatagcttcactaaaattcatgattgtgctgactgaggcttgagtttatttatcttgatgtataggttttcagactgcgcacatttgtgtgcactaactattctgttatgagttatccattgtacancananaaaaaa

SEQ ID NO: 5969 - DNA, 891 bp, Triticum aestivum
  Clone ID: PAT_TA_5969
agtctcaagttttttttttttttttttttttttttttttttgacccaaaccaaaactggccgtgcagccatcagtaattgcaccatgccttcccctcccaagtacgcaattcttgctaactaattgctccagcgacgtacgcaagggaccaaaaaacttgggacatctcttgcaatctactaccaccccctgctccgcttctgctctgtgctctcactactaccgctctgctactccacttccttcacaggccgcctgtcgccaccgccgccaccctgctgccggcggcgacctttggtggcgtccgagacccgctgcatgatcatcgcctccgccgcatcgaccgcctcccgtgtcccgctgatcaccacctccctctcgttcgtcccaggtatgaactcccccttcacgattttgatctgcacgcccgtaacccgttcgatctcttgtatggtcctcccgccatagccgatgacggcgcccacgtactcgtccgcgacacccatggtgagggtcccttgcacatggctgtcgtagtcaggcgatctcacgggtgtgtcaggcctgctgtggtatctttcgacatgctcatcttgcccatcaccgccataccgaacacttgaacttggaaaactaaggcttgcaacggaggatgagtagcggacgtcgtcaagcaactcggacagtataagaaatattgcctgcagctgattgtccaagtgtccagtgatcgttaccagtctatcatggaaaccgtagcagatgtcgtagggcgagaccgtgattccagcatttgactcctcagctaaggacttgatgacctcccctcctttgccgatgagcgcgccgcagcaggcgtcgggcaccacgagcaccacggggcctcagcgc

SEQ ID NO: 5970 - DNA, 479 bp, Triticum aestivum
  unsure (1)..(479): unsure at all n locations
  Clone ID: PAT_TA_5970
agcgcggcgcgccccgcccgtcggcccactagctcgacggggccgcctcccacgccccgccgcggccgccctccggctggcaggccgccccgtccgtgccggccggccgcatccgtccctcgctccccctgtccctcgccggcgccgcccggccccccgccgcgggctgcgcggccgtgcgcgcgcccgcgggcccggaaggaccccgtagctccccccctcgtcccctgcagctcagcgggccccgtgtcgccgcgcccccgcggccggccaatgcccggcgcgccctgggctccctgccgggcggcccccaccaccacatcctgccgctgttctgagctcctcttcgccacccttctgcaagatcttgcagcatatatgacctggttgtatgcttcatctcagtaaaccccatcgatcggatgactcgtgactaaaaanttaaaaaaaaaaaaaaaaaaaaaaaaaaaaaactcgag

SEQ ID NO: 5971 - DNA, 1112 bp, Triticum aestivum
  Clone ID: PAT_TA_5971
ccacgcgtccgcccacgcgtccgcccacgcggccgcccacgcgtccgcggacgcgtgggtctaggagcaattgctctatgtttactttgtcatgcacttcatactgaaggtgttcgattacgttctactatccaagagttgaaggaggatggccaaaccaaaagaattcttacaagtttgaagtcaaactccattgaaatgacagcttttggagaagattcaagttcatggggtcaaccatattatgcggtgcaccaaacaacttctggaggtcctggcgacaattactacggcttacatgtcaccacggatgtgtatagccacaatctaaaacccggccaacagacttcgactgcaatttgggttaatcatgttggaaatggtgttaaatcaagcttaaatacaattagtattggctggcatatctatccagagcactatggtgactcacatccacacttgtatactgactggacgagagatggatatgctcaaactggatgcttaaacatggactgccctggcttcataagggcgaatggtgctgttatagcccctggcgatgttatacatccagtttctggtgtccctggtggacgtgtacagaatatcacactcagactgcttaaggacaaaacaagcggagattggtgggtatactacggcttgaacggcatccccacgggggtgggatacttcccaaggtcgttgttcacctatttagcagaaaaggcaaaccatgtggctttcggtgccttcgtggatgctgagaaggcgcttccaactcctccaatgggtagtggtgtcctcccaaatggtggcaagggtcatgcggcatctttcaccaaccttcaactcattgataaggatgggaacaacagccccataaaagcaaacctacccgagttaattaccaaggccaaatgccattctattacacatattgaccacagccaatgcctttatggtgggccaggaggttgcgtgtgataagatgtaacattatttgtttgagcttagtctctttcaaactctttgttacttaataaatcatatgggtgacataaattatgaagagaaaaaatgtccactacttttacccaaaaaaaaaa

SEQ ID NO: 5972 - DNA, 1317 bp, Triticum aestivum
  Clone ID: PAT_TA_5972
ccgggtcgacccacgcgtccgaaatagatgtgtcctgtggcaagacaccatgcaatattcaataatgataaatctggaagtgaagagaacagcgacggtgggctgcttttcagctgggcaatgcaccaagttagtaatcacctcaccactcttcaagttatgttgccaaatataacggaaggtgggtccctgtcaaacatgcttgaaaactgcatgtattgtgcgatgggtcttggcttggttggactggatttccgttgcctgcttccaccaatttttgaaaatgcggttttaaatttattctcgaagaatatgagtacagcggttgagaattttcaggttgtcttggattcacatcgttgggtgccgatgccatctattggctttgtcacaaatggagctgtggatgatacttctgatgatgtgacaccaccttctgttttgatggagcatccacctcgcgctgtctctgttggtgctgtggcggctgcttcggatgagctgacaccacctgctcctttgagcgtgcagcctccccttgctctggtggtggtgggtggttctccagcagtgtctgaccctctaccgtgtgcccctgccagccggatgcatcgtcctgctgagcctccccggtccctctcactttgccaagcatttattgaggtcgcatatccttattgtgctgcatgttttggacgatgctaccccaacggaggagcgctgatcacagagtgcccccagcttattggatgctgtcagccaactacctataagatccggttcggggatcagcagcattgatcgaaaaccgtcaggaggtatcgaaagaaggcagtctggaggcatcgaaagaaagcagtcaggaggcatcgagagaaggcagtcaggaggcattgaaagaaggcagtcgatcgagagtgctgggactgcggcctctgagaacggacttgtaaccaatggccccgagccagaggtgaccagcgacgcgggaaccactgctgcaccagctggtgccgacacgcagaccgaagcacccgcaaacgcatagcctgaaccgtgttgatggaatctgtcgaagttcttgttatgttgagccattgctgcaaggctatgttcatcgacagtttggttcattatttttggtcgtggtcttacagtgtacacaagagagcgttggatgttaatctgtacaatacacaattggaaatttagctgttcatgtctagcccatacgtagatgttatagaccggaaattgtttcggactgacagtaagttgataatatgaagcgagtgctctatgttgttgttgacggca

SEQ ID NO: 5973 - DNA, 664 bp, Triticum aestivum
  Clone ID: PAT_TA_5973
ttgttttcggcttcacaggcaacccatgtgttaactactgtgacaattgtgtatgcaatttcctctctcttttctcttcgccttccagatctctcatcgtacccaaatcttcccctctagacgccatgatctaccaacggagaggcacatgttttctcgtcatcaccgtcatgctcctcctcctacctctgatggcttcctatccatgtgtggccactgcacatgacccactgcgtcatgctccaggtggagacattggtgtgtggggtcgttcagatgggccacatcatgaaggggaaaaggtgtttgggatgggggctgcgaggcgcttggggcagaggaaaccgatgaagaaccctccctcgcctgtccccaatgaaaacatgggggtggtgttacccctgacaccgccaccaccgtcgttgatcaataaacaggtgttggaggtccgggatacgagcatgccatggtgactttcgtgcacctccttgtctgttgttgttgtggttgtggttgtgtttcgcgattaatttcactattgtgaaataagttggcatgcttcaaagtgttaaaatatattgttcgcttatgtataccaatttggacttttgagagaatggtggaaatataattttattatagtcggaaaaaaaaaaaaaaaaaa

SEQ ID NO: 5974 - DNA, 490 bp, Triticum aestivum
  Clone ID: PAT_TA_5974
gtcgacccacgcgtccgcggacgcgtgggcggcgacgacatcctgcaggaggtcttcatcctcctcccaacccccgccgacctcctccgcgccgcgctcgcctgccagcctttcctccgggtcgcacgcagcgcagctttcctccgccgcttccgccgccgccacccctcaacctgcccggtcgtcctcggatgcctcctctaccgccccagcaagcgccgcggggccagcgccccttaccttctgcccgccgacctcctcggcgccacgcgccgcactatcgagggaggtgacttcgccctctccttcctcccccgccgcggccggccggatggccccggcaccccgtggcggatcctggactgccgcaacggcagcctcctgttacgtgacggggcttccggagagctcgccgtcgccgacccgttaacccggcgctgggtttcactccccgcgctccccggtgggcgccgcgtagggtacgccctcg

SEQ ID NO: 5975 - DNA, 662 bp, Triticum aestivum
  unsure (1)..(662): unsure at all n locations
  Clone ID: PAT_TA_5975
ccagagtcggaggtggttgcgctgtctccggcgacgctgatggcgacgaaccggttcctgtgcgagatctgcggcaaggggttccagcgcgaccagaacctgcagctgcaccggcgcgggcacaacctgccatggaagctgaagcagcgcgggagcaaggaggtggtgcggaagaaggtgtatatctgcccggaggcgtcgtgcgtgcaccacgacccgtcgcgcgcgctgggcgacctcaccgggatcaagaagcacttcttccgcaagcacggcgagaagaagtggaagtgcgacaagtgctccaagaagtacgccgtgcagtccgactggaaggcgcactccaagatctgcggcacccgcgagtacaagtgcgactgcgggaccgtcttctccaggcgggacagcttcatcacgcaccgggccttctgcgacgcgctcaccgaggagagcaacaagggcatcagcgggggcggcctgcctccgccacccaccgcccaagcccagcaacacgccatgctctattcgcccgcaacgattctggatgcaagcaagcagcaagcaaccaaggagcctcgccgccgtttcaangaaccancaatcaaccaatcaaccaaaggtccatggcaacaagcaattgccaacnttcgacgttgaaagcc

SEQ ID NO: 5976 - DNA, 684 bp, Triticum aestivum
  unsure (1)..(684): unsure at all n locations
  Clone ID: PAT_TA_5976
ccacgcgtccgcctccctcttcccctctccgcatcgtcgccggccaccgcagcccgtcgcgttctcactccggcagcccaccgtgttcttcctcctgcagcccagcgcttgcttcctctccttcctttcccaccgcttgcttcctctccttcctttcccatcccgaggtcaaaagagtggttttttatgcgccggtgaagagcttctgggcggcggagctggtgtgggcgccgacgccggatccgcgtgcgcgtacgctagatctgggcgacggagcggcctggacagagtggagcggcgacggagtggagcagcggagtggccccggggaaggatgcctggccggctgcgggcgccctgggtggggctgcgcgtctatgcggcgacctcatcgagaccaagaagccggcgtcggtgatgctgctgcacatcgatgacctcctccctctcatgcgtccccgccgccgtgcaccgtggcagtcggggcggaccacccaancatgggattanaacaancannttaaggcaaangatggcatggtgaaattaggacatgccaacaacaacaccacaanactgctccgacgcatggcaacncacaacgaagnccttctcaaagcctcctcacaaccccgttcaattgattgtcccgaagcggnanaattccnctgctngcccattggn

SEQ ID NO: 5977 - DNA, 931 bp, Triticum aestivum
  Clone ID: PAT_TA_5977
tcatgactctcatcgaactgttgcccgactatgctcgcattgttgatgatggactctaccgagccatcgacatatacctaaaggcacacccatctctaatggaatccgagtgcaagaagctgtgcaagctgatcgactgccagaagctgtctcaggacgcgtcgagccacgcggcgcagaacgaccggctcccgatgcagatggtggtgcgcgtgctctacttcgagcagctccggctcaagtcgtccttctcgggcggccactcgggcggcggcggcgagtactgctccttctcccagcggatcaccatgcccatcagcgggagcggcgtgccgagctcgtgcgtgtcgccccgcgccgccggcgccgccgacagctacgcgtcgctgcggcgggagaaccgggagctgaagctggaggtgtcgcggatgcgggtgcggctgacggagctggagcgggagcaggggatgatgaagcaggggatgcgggacggccgccccggggagcacggccgcgccttcttcgcgtcgatatcgagggggatcgggcggatggccatgttcggcccggccggggagaggaggaagaagagctcgagggcgacggcgagctcgcagtgctcggaggggaagagccggaggaggaagaaaccatcggtgacgtatgcgtagctagctagctagaggctctcaagccacgtgcggggaaacaatgtagaatgtatgtactgtgctaggtagctcgcgtatacatgatgccggtggattgcaacaagtttcctttgcagttttatttcgtatccgatgtgacaccgagagatacggctaatctgagaacctctggtagtgtcgtcggcctctaaaatgcttttggaactgaaaaaaaaaaaaaaaaaaaaaaaaaaaaaaaaaaaaaaaaaaaaaaaaaaaaa

SEQ ID NO: 5978 - DNA, 855 bp, Triticum aestivum
  unsure (1)..(855): unsure at all n locations
  Clone ID: PAT_TA_5978
cactataataacatatatgacagatggagtgcttcttcgtgaaaccttgaaagagctgaccttgataaatatcgtgttatcgtcatggatgaagcacacgaaagatccctcaatactgatgttttgtttggcatattgaagaaggttgttgcacgtcggcgggattttaagctaattgtcacatctgcaaccctaaatgcagacaaattctcaaagttctttggaggtgtgcctgtatttaacattccaggcaggacatttccagttaatatcttgtttagcaaaacaccatgtgaagattatgtggaagcggcagtgaagcaggccatgacaattcacataacgagtggccctggtgacatcctcatcttcatgaccgggcaggaagagatcgaggctacttgctatgctcttgctgagcgcatggagcagctaatatcgtcatccacgaagaatgtacccaagctctccatcttgccgatttactcgcagttgcctgctgacttgcaggccaagatctttcagaaggcagaagagggcactcgcaaatgcattgttgctaccaatattgctgagacgtccctcacagtggatggcatcttctatgtcattgataccgggtatggaaagatgaaggtgtacaatccacggatgggcatggatgctcttcaggtttttccgtgtagtcgagcagctgcagaccancgtgcaggacgtgctggaagaaccggncctggcacatgctacaggntgttcacaaaatcaacttaccaaaacgagatgctccctaacccccntgccaagagattcaaaggactaaacctgggaaaaggtgggtctccttactggagtccc

SEQ ID NO: 5979 - DNA, 975 bp, Triticum aestivum
  unsure (1)..(975): unsure at all n locations
  Clone ID: PAT_TA_5979
ggcaagcgacgccggctgcctcatcacgtccctggcacgagcagtgaagctggccgcaaggtcaggatcgtcttcgaggctagggagcctagcctcgcctcgcctcacaacctccttcctcttttcatcctaaccatcccctctcgatcccaattgttgtggagcagcccggtggatttggagtcaactaaggtccagcaggtgaacagcggtgggagaaattcagactggcagtgtgtcatgcaaggtgattttgaatgaagttgtgaagaatttggaagggcgcctactatatatcagaccaaacacaggaatagcggtcattattgctatctgaatgcattcatccctggtacggtggtgctggacaacctgaaacaggggagctacagcgatggcccttttagttctgctaataagacaatgaggaggcagcggagaggttgattggttctctctgtagaaagcatattttcaaagttaatgatttgaactggatggattggaagctgttgtgttcgtgaaaggtataattgttgaagtgaactatgtcatgtgaagcaggataatggaactcttggagaaaagattcagctgctagagggcgtagcaccctggatgataattgactctgtatgatctgacctctgttgcttggccttctgcttttcatgcctatagctcagaaggcgctgatacatgtgtgcgcagagcaaaatgcaacatgctgctgtttaaagggatcgatatgtttgatcaggctgtttgtaggaatcattgttagcacgaagctgaaatactcgaatggctgtaaggctccatagcaagagaaggttgaggttatgtctgtatgtatatgttatgttctgtgaatgtgtataatctgcaagtgcctctttgcacggtctagcatctagagcagtaaatggtttcnggcaaggatacttgatcaagcaaaaaaaaaaaaaaaaaaaa

SEQ ID NO: 5980 - DNA, 1103 bp, Triticum aestivum
  Clone ID: PAT_TA_5980
gccccgacagcttagatctctcatggctcgtgccagcactcgtctcccaccttttctcttgctcctcgcagcaacttgtgccgcggtagcgaacgcgcagctgtcggagaactactacggttcttcttgccccgcggcgcttctcaccatcaggactaccgtggcgacggcggtgctgctcgaccgccgcatgggcgcctcccttctccggctttacttccacgactgctttgtgcaagggtgcgacgcgtccgtgctgctggacgacacgcccagcttcaccggcgaaaagggggcggggccgaacgcagggtcgctgcgcggcttcgaggtgattgacaggatcaagctgctgctggagctgatttgcccgcggaccgtctcctgcgccgacatcctcggcgtcgctgcccacgacgccgtcgtcgacctaggggggccatcatggacggttctacttgggaggagggacgccaccaccgcaagtgcgtccttggccaacagtgacctccccggccccaactccaaccttaatgatctcctcgccgctttctccaagaagggattaagcagcaccgacatggttgctctctcaggggggcacaccatcggccgggcgcaatgccagaattaccgaaaccggatctacgccgacaccgacatcgacgggaccttcacggcgtcgctgcgaggcgactgcccacagggtggtggcaacgacggcaacctcgcgcctctcgacgcgtcctcgcccgactacttcgacaacagctacttctccggcctcctcagccatcgggggctgctccactccgaccaggcgctgtacgacggcggctccacggacggtctggtcagcagctacgcgtccaacaatgatcagttcggcagcgacttcgcggccgccatggtgaagctgggcaatctcggtgtgctcacgggggcgtacggtgaaatcagggtcaactgccgggcagtaaactgaggatagatcctgggtatctatcttacaaaatgaactctatccgttacggaaacgggaagtgagactgcgtctttatgtacactatgtaccgagttaaatgcattggttcctttatttt

SEQ ID NO: 5981 - DNA, 1040 bp, Triticum aestivum
  Clone ID: PAT_TA_5981
ggtgcgcgagtcggagctggtgcagggtcacccttcccctcggcctcaagagctctgcggttgccgcggccaagggcgtccgtggagaagcgggagcaggtggcggcgatggaagagcaaggcggccaggcggcgctcgggtgggcggccagggacgactccggcgtcctctccccctacagcttctccagaagggttcctaaagacgacgatgagcactacgtggtccgcgtccccggcggcctggcgctggaccgcaccgcgccgctgctctgcgccggcgtcaccgtgtacagccccatgatgcgccacggcctcaacgagcccggcaagcacctcggcgtcgtcggcctcggcggcctcggccacggcgccgtcaagttcggcaaggcgttcgggatgaaggtcaccgtcatcagcacgtccgccagcaagcgccaggaggccatcgagagcctcggcgcggacgagttcctcatcagccgggacgaggaccagatgaaggcggcgacggggaccatggacggcatcatcgacacggtgtcggcgtggcacccgatcacgccgctgctggcgctgctgaagccgctggggcagatggtggtcgtgggcgcgccgagcaagccgctcgagctgccggcctacgccatcgtgccgggcgggaagggcgtggctgggaacaatgtcggcagcgtcagggactgccaggccatgctcgagttcgcggggaagcacggcatcggggccgaggtcgaggtcatcaagatggactacgtcaacacggccatggagcggctcgagaagaacgacgtccgctaccgcttcgtcatcgacgtcgccggcagcctcggctctgccgcctaggcatggctgcaaaggtttcaatcagagcccagccgcaataatttgttagctaccgaatgaatgatggtctacgcttgttgatgagttggtgctttgtcgtggttttgtggatgtaataattcgatgtacaaataaaaaaaggggagacaaggtgcttgttcccttggtttggtgac

SEQ ID NO: 5982 - DNA, 1004 bp, Triticum aestivum
  unsure (1)..(1004): unsure at all n locations
  Clone ID: PAT_TA_5982
ggtccggattcacgggtcgaccgttcattcttagaaaattgattattgaatcaccattccaatgttggccatgcaacccagcccatatttcgggtgcacctttcaaccattgttaaattgtgtatgttttcctcgagcatacatcaatatatcattttgatctgacaaatgttatatccttgttcacataattgtggaaatccatcctttggaaatcttgatgaattgtcgctgagttcatcagccacctccttgtcctctccttgggttaatgatgaactcttgttaacagaaatcacttcatagttcatttcccgagaatcttacagtgtcatcccgtcaaattgtgtcgcaccttttcttttcaggcatcctgagtctgaggtatcctaacaccgatcagatctgaatctcggtcagatatgatggttggaacactttcccaagagtcacaacactggtcttttatgacccggtaaggtgatgacaanccagcacacctgggttgggaggacctattgcaagacttattcctatgattgtccctgattggatccttttgtgttaccccaaanttttgacctttgccttngaaaacatgtccaatgctatcccgaactttgtccngtgggnatcccgatttttnaacnaagacatttttaaccccaatgctaatgtttccncgctccaatttncccaaacaccttttgttatgggaaataccagaattctcctcccccctaacctaagggttttcccaagttataccctgtccanngaacangctccgcttgncctttnggaaggtataccccccaaaangtgtttnaaaatttncttccatttgncggttaanccgagataanncttccttccatgggttgttaacctcctgggatcanagttaancattaaattccnctagtaaacncatgtnantcgtacagaccgttcatgtagaatcggacccntggcaaanttcaatgccccnntaaaaggaangg

SEQ ID NO: 5983 - DNA, 553 bp, Triticum aestivum
  Clone ID: PAT_TA_5983
aggatcgcccttggcaaacgttgaccgtgatcgaggtgtcgctccccacccccccaccaggcgcgttcatccgttgcttcacacgatcgtggagccaacagtggtgctcagacgcctcaaggcatgtcttccaatgtcgctcaccttgttgaagatggaatgacggccgatgagatccgaagactggaagaggaggagcgacagctggacgacgagatggagcgtgcggcgagacgatagtgcagcctcgcaaggtcagaagctatccctcggtcgaaacaactgagggatgctttagtttcatgcgtcaaggggttcggagtttttgggttatgacatgtctagtcctcatggccgcattgggctagccactcactaatgttatgtagactgtatcattcgcctacgatggagtgaacaggtagtaggtggctggtcgatcgtgtctatcgcgaaaataccagagccttttgtatttaaggggggccgaagaaggaaccaaaatctacgataatttgcttgcacttcttaaaaaaaaaaaaaaaaaaaaaaa

SEQ ID NO: 5984 - DNA, 1070 bp, Triticum aestivum
  Clone ID: PAT_TA_5984
ccgcacgtggccctgtcgctccgccccatccatccgcgcctccaaataaagtaagcgcggccacccgctcgccccgctcctcccccgcgcgcctccaaataaagtaagcgcggccacccccaccaccgaatcctcctccgcctcgcaatccgccctcgccctcccgccaccgccccccctccccccgaccatccatcccgttcctcctcgcggaggagagggagcacgccgcgcgcggccgccatggggttctgggaggccttcctcaactggctccgcagcctctttttcaagcaagaaatggagctttcattgattgggctccaaaatgctgggaaaacttcgcttgtgaatgttattgctacaggaggttttagcgaagatatgattcccacagtaggattcaatatgagaaaggtaaccaaaggaaatgtcacaataaaattgtgggatcttggaggccagccaagattccggagcatgtgggagagatactgccgtgctgtttctgcaattgtgtatgttgttgatgcagcagatcgggagaacatggctattgccaaaagtgagctccatgaccttctgagcaagccatctttgaccggtatcccattactagtcattggcaacaaaatcgacaagcctgaagctttccctaagcaaagtttcacagaattgatgggtctgaaggcaatgactgatcgagaagtggcctgcttcatgatatcatgcaagaactcgaccaacattgattccgtcattgactggctcgtgaagcactcaaagaagaagaactgatccaagatttgttgcctttgaagtgctgcagattctctctctgttttttgcatggtacttagcaattggggctgtaaattatgtgagaggtcttaatcaggaaggttatgtgttcataattgataattgtgtaacctgttttagcaatctgttggttgactgcatctggcatttggacgcgtgtgctctgttaggctgctacaaaaagcctacaacttacagaagcctttagatgttgcatacttgaaaaaaaaatttgaatctctgcatgg

SEQ ID NO: 5985 - DNA, 662 bp, Triticum aestivum
  Clone ID: PAT_TA_5985
ggctgcaggaattcggcacgaggacatatcataagtaccaaccacggccaagaaccatagcctcctcatcctccttgtggctgcctctgttgtggcctcttcagtcaccgccacctcgagcacctccccctcttcaacagcatatgagctgctggagaagtacggcttcccacggggaatcctcccggagggtgttcaagactatgccctacacccagacggatcctttgaggtctccctccccggcggctgtgagatcaacatcgggggattcactctccggtatgaaggaaatgtgcatggcaacatccagtccatgttgattaacgcgctaacaggggtgagcgtcaaggttgcattccaatgggttagcatcaatgcagttgaacggcatggtgaccagctcatcttcaatgcaactgtgatatcaaaatcgtttcctgttaacaacttctccaggagcccgcgctgcaaccgaatccccggaattccaaagtagattaatgggttagcaacaaaacaattgcttcttgattttgttagatcaacatgctcaattgttacttgattcttgtgggtttgtctattgtgactttttatgttattttgcttcaaaattgttatcaataaaatcacaaatcttaaaaaaaaaaaaaaaaaaa

SEQ ID NO: 5986 - DNA, 1348 bp, Triticum aestivum
  unsure (1)..(1348): unsure at all n locations
  Clone ID: PAT_TA_5986
cgcgcgcggctgcgcccccccccacccgcagtcccgtcttcccaagatttccagatcaagcagagagccatggcgaacctcctctcctcggccccgatccacgcgtcgctcccggactgcttcgtcttcccgcccgatcagcgcccgccggcctcctctcaggccgtctccctcccggtcatcgacctctctcgcggccgcgacgaggtccgccgcgccgtcctcgacgccggcaaggagctcgggttcttccaggtggtcaaccacggcgtctctgcggaggcgatacgggacatggaggcggtgtgcgcggagttcttccggctccctgcggaggagaaggcggccttctactcggaggacacggacaagcccaaccggctcttctccagcaccacctacgagctcggcgatgagaagtactggcgggactgcctccgcctcgcttgcggctcgcccgtcggcgacaccaagaacaactggcccgacaagcccaaaaagctccgcgaggtggtggagaagttcgtggagccgacgagaggcgtggggatggagctgctgcggctgctgtgcgagggcatggggctccgtccggactacttcgaaggggacctcaccggcggcaacgtgatcatcaacgttaaccactacccgccgtgccctgccccgggcctgacgctcggcctgccgccccactgcgaccggaacctcatcactctcctgctccagagcaccgtgcccggcctccaggtctcctacaagggcgactggatcaacgtcgagtccgtgcccaacgccttcgtcgtcaacttcggccacctgctcgagattgcgaccaacggggttttgaagagcatcgagcaccgggcgatgaccaacgccgcgctggcacggacgtcggtggcgacgttcatcatgccggccgcggacatccccatcggcccagcggaggagctcgtcggcgagggcaacccgccgcgctaccgcactgtcactttcgacgagttcatgcgcgtgtacaagaccgtcggcgcgcggagggagagcgtggagaaggccttcaagctttagacctcagctcacctgtatctgatttggagatcagttgcagagcagcaaagaaacttgattggtgatctagctactaggtcggagtaagataaatttaaaaacagcaactgggggatgtgaggtggaaatcacgtttctgctatatcgacgctccttgtttcgacaaggcgggttcactgcgtgtccccccgtctttgacacatgggtgcgtgggggccgcgcaaccgcccactcacatcccaccctcgggctaattaaatcgacgggaaacanttcg

SEQ ID NO: 5987 - DNA, 712 bp, Triticum aestivum
  unsure (1)..(712): unsure at all n locations
  Clone ID: PAT_TA_5987
ggnctgcaggnaattcggcacgaggcaccggnaaaatcccccaaactttggccggccgaaaccatggacggagatcgacggttgccgccggccgccgcgctcgcgtcggcggcggcggtgcttggcgacgacgacctcctgcgcgagatcctcctccgcctcggcttccccacctgcctcgtccgcgccgccctcgtctccaagcggtggctccaccacgcctccaacccggccttcctccgccgcttccgcgaccgcaacccgccccgcgtcctcggcgttttcgcctgctaccccgggacaccgtacaagttcctgccgcttccgcagcccccggagctcgccgccctctcacgccgtgcggcctcctcctgcgacggcgccttcgccgccagctcataccagcgcgtcgtgcactgccggaacagccgcctcatcaccgtgttcttgcacgagggaacatacaggcactccctcctcgagccgctgctcgctggggagtccgaagcggtcctcccacagaccccgctgccccgccatctcccgcaggccggctcacactcaaggggtattctctcagactttcctgacccgaggacgggggccgcgacggcaacggcatcaccttggtgagtctgtggatggtctggcgagaagtccgtgctgaagtgtgcgtgctgggatccgacggatggggcatccctaccacagc

SEQ ID NO: 5988 - DNA, 759 bp, Triticum aestivum
  Clone ID: PAT_TA_5988
aataattcctctgtgcttgcgtaccatggagatgggcagtgaactgtcaaaaaccgtcgctaccttcattgtccaaaagattctgctggatgatattggactgcgttacgtgtgtgccacccctgagcgtttctatgctgtgggcagcgttttaggaaatatggtaatttcacttgctgatcagccttccacaaggttgctcaagcacattatccgatgttacctcaggctgtcagataaccccagggcctgtgttgcactgcataattgcctccctgacatgctgaaagatgggacattcaacatctctcttacggatgaccccgcgacaaggcgctggctccagcaactgctgcataacgtgacagtgggcggcatgggaggacctggcatgggggggcctctcccagccaggcctggatcacatgatggggatatgacccagtttagttgctgcaattcacaacaataatagtgtctcttgtgaaatgcaggtaggggaagattatcttccctcagccgtctagaggtaggctgtgcggtgtcggtgtagtttcaaccttccggaaaaaggaaatgttgtttgtgtgtgtgtgtgtgtgggtgcgtctgtctgcggctctgtgtggaaacatcaacagcagctccaactggtttgcttatcctgtaatactgggaacacaagcaaagcaaagctgttttctggggggggtttttgcgaaaaaaaaaaaaaaaaaaaaactcgagactagttctctc

SEQ ID NO: 5989 - DNA, 1029 bp, Triticum aestivum
  unsure (1)..(1029): unsure at all n locations
  Clone ID: PAT_TA_5989
gaagatctgggattctcgaccggaaggcctatcgctgcgtacctcatctaccgctgcctggtccactggagatcatttgaagaggacagaaccactgtttttgaccgcattattcagaagataagtgctgcaattgaggcgcgggacagcaatgaaaaattagcatattggctatccaattcgtgcacactgctgctgcttctccaaaggacactgaaaaccagtggttcagctgcttcggcgcgtcagaggcgaagaccatcgtccctcaactcaccaaaggaaaaccaagctcctgggtcaccctgagcgttcagtttccgatgggcggttggtccggtgccctgactgacatttcccaagttggagccaagtatccagctcttgctttcaagcaacagctcacggcattgctggagaaggtctatggagtgatcaggcacgacctcaagaaggagctgtcgtctctgcttgggctgtgcattcaggcaccgagaacattcgtcgtcagccccagaggaacaggccctcaaggaacagacatggcccaacaagcctccatggcacattggcagagcattatcaagatcctgacgaattccctcaacgttttaaaatcaaattacgtgcctccattccctggatctgcaagttgttccccccaaagtatttcaattccatcaaatgtgcaactatttaacatctccctgctacggcgccgantgctgctcaatccagtaatgggggantatgtccaaagcaanggctgggatgagctggganattgggtgccattgggtaacnggaagatagcangtcaaccctgggatgaactgaacatattcggcaagcggcacctctttaataccnnaagagaacacanaatccctcaaaagantcactgacgattctgcccgggatcacatgaacaacttncggttaacacgattctnnacanaattggacttgggcanccacaaattcttcaaatnaccaaatnttggggtnaaanccacgtgaagagaanaa

SEQ ID NO: 5990 - DNA, 147 bp, Triticum aestivum
  Clone ID: PAT_TA_5990
aggcaaatgtatgatctaccagttgcgtgcatatattgttgacaaaacatgcaaccttgtaatcaactcagccaaacatgatcgaagtgtgtccaaattaatccaatgacgactacaattctcagtcacaaaaaaaaaaaaaaaaaa

SEQ ID NO: 5991 - DNA, 583 bp, Triticum aestivum
  Clone ID: PAT_TA_5991
atcatccgacaccatgcctgttcctgcttcacagtcgcgaactttatcgcccagagaccatcgaatttccagacgctcctcggaccgtttttcagaatcggaaacccgcagccctcgctcgcgacatagcaacgttccttctccatcatctgtgcacgataccactgccgatatctccatcaccagcataaggcgcgagaccatctctacaatgccacctccctccaagacaccacagcgaagatcgatgggtaatacccagtcatcacccgctccgaaccgtagcaccatgtctcgacgcgtcgcatcctccccacgagaacggccgtcgcctagaaggcaaccgtcagtggagcttggcgaggattccatcatcagcgggtacaatgataccaaccactctcccgccatgtcaaacagagccagtgcaaagaactcccctgcccagtctgttaggagcagacgatccagcgtcaagaactcccccgctacatccagcgccagaaagcatgcgactatgaagcccaactttacggcggtgaatgatggtccttcggagcgctcttctcccaggaatcaacct

SEQ ID NO: 5992 - DNA, 576 bp, Triticum aestivum
  Clone ID: PAT_TA_5992
gcccccccccccggtctcctcctcctctcgcccctcgtcgacctgccccccttgacccgacccgacgacgcgacttcaccgcacgcggccgccgccgtcgccgccactcagcggccgccgacttcgcgctcccccagtaacccagatccaccccccgtttttctccagtatttcagcatgattgaacttgcccccaacaacgatgtgctggagaagtgcattaaagacatcctctctcaaataaaaccggcagatgatgatctgaacaaaagactatctgcaattaaggagctggaagtttccatgcaaccagttgcagccttgaaaggtccacgtgtctgccactgtgtaactagtgacctatggcggcaatatgggatttgctaggttatgagctgctcaaatgacacacaatgatctttacccgaggataggttgatttcttgcctgagacctgtttggccagctttccggtgcggcggcgtttccggtcggatcctgtccatccctcctgcacgcgtccccgggcgtctgggcgtgagcaaccgctttggcatttcctgcgatttatccgtt

SEQ ID NO: 5993 - DNA, 768 bp, Triticum aestivum
  Clone ID: PAT_TA_5993
tcaaccccgccccttctgccgggacggcctcgagagataaacgccggcgacctacggacgctcaccgagcagccccacgtggtcgccgtggccggggtcccgaggcggaccagctcggccctgctctgctccggcgggagggtgcaactcggcgaccgcaacagcctcttctgggcgggggagtcccaggtgaaagaaggctgcggcgtcgtccgcgacgtgcacgccactgtggttctcgcccaggggcgtggaggcatgcctcctgcttgctatcgccctggcgtccgggtcctccaggggctgcgcctcggcctgggtggtggcgcaccagtcctacaggccgccccctggccgcttccccctccccgtgcggtggcccgactgcagcctccccggcgcccgcagattcctctgcagcctcacctactaggtctatgtggtcggcacaaccaccatgtccacccacgaaaggaaggccagcatcagggaattctacgctgtgatattcccctccctcatgcaactggagcacgggataagcgactccgacgaccggaggcagagggcggcgtgctcagagcgatacaggaggatgagacgagccagaggacagcaagaggccggtctccgagatcgacgccgagatagaggaggagtgcgggatctgcatggagctcaacagcagggtcgtgctgcccaactgcagccatgacatgtgcatcaagtgctaccgtcaatggcgctcgagatctcagtcatgcccct

SEQ ID NO: 5994 - DNA, 528 bp, Triticum aestivum
  Clone ID: PAT_TA_5994
ggtaccagtcaggaattcccgtcgacagataaagcatgagctcgctaacatctcagtcaaggtgaattggtccacaaattcagctttctaggctcatggcaatgttgattagtcacgttccatgcgaagatctatggttgctgttaacgtgggaaactttgatgctattgaagttctttcttttttgttggtagcttaccaagctggtcgcttggtgctgttgaagcgttaacgccccttgctaaagctatatggtcgtgctagtctgacagacaacatggagctagcttctgtcatggggaaagtgaaatgaaaagaagccaggtaaactacagtctggagctcgcttctatcctggggaagatgaccagttggtgatacttattttgcggagggagtaatgtagcactggacggatgtgccctttattacatagtgattttgtgctggaactaagagtattgtttaccttaacccccattctatttagctgttggaatgtctgcatgttctttaagtcatttttat

SEQ ID NO: 5995 - DNA, 1193 bp, Triticum aestivum
  unsure (1)..(1193): unsure at all n locations
  Clone ID: PAT_TA_5995
ggcccggcgagccccggcctgggcagggccgtgccctgcccgcagccgccggcggccctgtcgggccgggggcggtagttccggcgcaagctgctgcccggagggcgccggtagccccactggatctgctgtgccaggtggccgtggttgcgactcggtgcctggatcccgtctctagtaggccgcgcagggcatagccccctgcaactcgtcctggtgggcatggcctggaggctcccgcctttgcccttcgggcagcgagggcggttgacctggaatcatcttcaggctcgagatcttcagacggatcttctggcaagcgaatgcgggaggccgcgtcccccgcctccgctctccacctccaggtgccgggccccgcatcgggctcggaggcggctgatggccccgcttgccagccccctctcctcgtcggctcgcggtggactcccctcccacggggcgcccaggtctcgcccgcgtcggtcccggtcggcgacccccgccctcgccgagctctcaataactgcacggcctgtgcgggagatttcagccccttcaaccgcaggcatcactgccggaactgtggtgatattttctgtgataagtgcacccaaggaaggactcctctaacttcggatgctgattctcaaccagtccgagtttgccgccgtcgcctcgctcccgtttctcgctgtctaagcagtgcagtggaggcgccagttccacctgttgtgctctgccgtgaggttccggccagcggtctgctgccacccagggaattagataagaaatcatcttcaggctcaagatcttcagagggatcttctggcaagcgaatgcgagaggtcgcatgccccatctgcacagtgcacctccaggtacaagtcccagcatctggctctgagacgatagaatgcggtgtgtgccagcaccctttcctcgtcagctctcgttgaacaccgancgtcgctcagagctcttccactttgatccccctcgagatcatggcactcatcngngccgctgctccagccagtcatcatctgnatggngacctttantccgtgtctgtatncgagctaatttaagtacagttgtgttgagaagcaaggatgaatcgagatgactaacagatgttgnttgccantaacttcactgctatttcgtcgtctcnttntacttttgntacnaca

SEQ ID NO: 5996 - DNA, 1046 bp, Triticum aestivum
  unsure (1)..(1046): unsure at all n locations
  Clone ID: PAT_TA_5996
cgcctctccccccccttcgcctccctcgcgctcctcgcgtcccgcttcgtccccgacgtcctcgacctctccctccgccgcccgcccgccgccacgcgcgtggtccccgccgtcgacctgcgcgtcgccctccccctgttctccgtcacccccacccggctcggcggctccgcgcgccgcgtcgccctgcgcgtccgctccctcagcatcgccggccccttcgccccgtcctccccgtccccagcctccgtggtgctctcggagcccccgcgcgcccccccggcctcccgggtggtcacccgcctgctgccccccgcggcgctcgtccccgacctccccctggcgctgggcaggacctgggcctcccccgtctgcctccccgcggcccacccgcggcccgccgccccggcccgcccggaccccccggaggggctgggcgtcgtcctgcgccagttctccgtgaggtccacaggggtgggcgtgtcggcgcgccgcgacgccaagctcgtccgcaccaacagcaaggccttccacgtggactcatcatcgcaatcacaggccaccgttgagttgacttagcgcgcacacacacaaacacactagatatcatgcagcagctccccttgtaaatatgatgatgagcagcagcttgagcttggcaagaaacaagcttctgcctgttgtttgcctgctgcttctcaagagtgttgctaacctggtcaggtgtttagagatgagcgggtttcgccggtcgaattagggtttaactgtacatgatgaggattattgattttgtttgtagacagtagctacaaaagggaggaaggaatggactgatgaggacagtggatgtacattggagtggagtggagggatgtaagtgtaggagatggatgggtacttagcttgttcccctcattattatttggggataatttttcccttgttccttttgttcctttgttcctaagttaagaatatatatatccttctggggaataataatatgaataaagcctgtattntattttaaaaaaaaaaaaaaa

SEQ ID NO: 5997 - DNA, 778 bp, Triticum aestivum
  Clone ID: PAT_TA_5997
tatagctggactgactgtggggacagttggaacgattgttccgtggctttttcctagtctgtttaccaatgatctactggttgtacaacagatgcacaaagtgctgattccatatttcactgcattgttggtgacaccttcagtacacagccttgaaggaacattgctggctggaagggatctcaggtatttgagtcaatcaatgggtgcatgcttcagcattggtacctttctactactgcttgtccgcgacaagtttagtagcttgacactatgctggtgggtacttgtcttcttccagtggagtcggtttggaagcgctctacaacggcttgtttcgccaacgggcatgttgtataacaaaaatttcaaccagcctgagcatatcaaagtgaaggccacatgaggttgaaacggggcgacaacaaatacacgcatatttgcagccctggaaagatcattctgcattgtctgtttctaaccaccatgcttagagcaggggctgcacatgatatgattggaagcaaagttcaagacctgctcaatgtcttcagggctaggaaagtccatttggcactagggtagaattcggtctcttgtagtatctttttgtcctaggcaccttcatcgcatgctttactgctgcagagaaggttacattgtccaacacttgcgactgtaaaagtgcagttacgcaagcatgtaaagaattttgtctaagtttttgttacgaaatgaaaaaaatatggatgttgaaattaaaaaaaaaaaaaaaaaa

SEQ ID NO: 5998 - DNA, 637 bp, Triticum aestivum
  unsure (1)..(637): unsure at all n locations
  Clone ID: PAT_TA_5998
ggataacttgccactgaccaccatggccggggccgcggcgtcgtcgttggaaggaggcgggagggtggtggacacgtacaagaaggcgctgaccacggcggcgtcggtggccgcgtacgccatgctggtgcgcagcatggccagggagctcctccccgaggagctgcgcgccgcggtgcgctggggtgccgcgttcgtgcgcgcccgcctcggcgccggcgacaaggagcggcacaccatcgtcatccgccgccacttggacgccgggtacaacgangaaccacctcttcgaggcggcgcgcgcctacctggccaccaagatcgacccgaccgccatgcgccggctctgcctcgcgcgcacccggtacaaggagcccgacgggagcagcagctggagcacactcctgtgcatggacgatgggggctccaccaccgacaccttcgacggcgtcgagttcaaatggacgtcatcgagacggcgggacaagcaagaaggaaanggcatccgcccacangcaaactcagtacttnacccagaaagagggggtcaccgtactgcgtnacagtcacggggacaatnacggcggatnccgtaaatnnataacagtctangacgatacaataccggnagtnantc

SEQ ID NO: 5999 - DNA, 770 bp, Triticum aestivum
  unsure (1)..(770): unsure at all n locations
  Clone ID: PAT_TA_5999
ggccgtccgcccgcacccctccccccgtctcccccgtcctcaagccaagccggaaccaagtcgtgaagctcgatggaccacgcgggctccatggaggagaggatcgtggcggaccggatccggaagaagctggaggaggtgaacgtcgccgcccagaagcacctcgagggcgtgcaaggaccatgtcaacttcactctgcacgaaagagtacttcaacgtgtgcacatgactgcttttgatacggcgacggactcaagacgggatgcaccatgctgtgttagagaactggtggtgtgcccgctctttctgccaacaatgttgttggagaccgagatggccaagttcctaggaaacggttgaatccctcgttagcatggacctgaccaaggacaagtttgaagcagcagagcacctcgaaacatgcaagactgacacaaccaatagacctgcactcttgcgtggacacctccctcctgatgacaatatcaaggggcctgtccccagtctcggttgaagcacttacatgtcacaccatttacttccatgagaagtccagagaagagtttttggctgagagattaaggtttataaatggctacgcgatacctgaccagaggtctctagcatcactagtgtaacgtgagcagtttacctccaagagaaggtccagaggaggggtttttgctgagaaactattacccctccccggcgccgcgtcgcttcccaatgggcggtcgtgcgttgcaaacatccttnatttnatctcatg

SEQ ID NO: 6000 - DNA, 321 bp, Triticum aestivum
  Clone ID: PAT_TA_6000
aggcttatggattaatttatggttcacggtccatgtggagactacaaagtaaagtgtgcatgtatgaaagatggattgtgttccaaaagatttcccaaagattttaatgagaagacatcggttgatgatagaggctttcctatatatcatagacgtgatttgggttactatgtgaggaacaagggtactgttaagctggataatcgatgggtagttttcatataatagttttggtaatgtaattattaatgtatatttctgcttgcgaagcgtactggcatatgtttgctttcaataaaaaaaaaaaaaaaaaaaaaaaaa

SEQ ID NO: 6001 - DNA, 1357 bp, Triticum aestivum
  Clone ID: PAT_TA_6001
cccacccggacggagagccccccccccccgcccttccccgtcgttccaaatcccccccgcgttaaaaatccaacgcgcgccggtattctcgttccccccgcctccccccccccgccctccctcccccgcccccccccgccctcccccccgccccaccgccccactgccgcgctcccgcccgtccgccccgccatcgcgcatccgcgcctcggcgtcccgtgcacggaaccctagcgcgctataagagcgcctccgcacccatggcgccatcgcccgcgtccgcatcggcatcggcatcgctcgccgccaccccccaccgccccgcaccacgccctcgcgcccccgcgcgcctccgtctccggtcggccgccgccgggaggaacagcggcctgtccgtgtcggtcggcgtgcgctccgttccggggatttctgtggttaattcgcagcggaggaggatggtcgcggcggcggcggcgaccgagatggcgcccgcggcgaggggcgagggcgggggcaagccgttcgtggacgagatgagggccgtcgccatgcggctgcacaccaaggaccaggccagggagggggagaaggagccccaggcgccccccgtcgccaggtgggagcccaccgtcgagggctacctgcgcttcctcgtcgacagcaagctcgtcttccagacgctcgaggacatcgtcgaccgcgccgccgtcccctggtatgcggagtttaggaatactgggttggagagatccgagccactgaagaaagatctggaatggttcacggaacagggtcacaccattccagaaccaactgctgctggtactgcatatgcttcctatctggaagagttgtctgagaaggatccccaagcatttatctgccacttctataatgtgtactttgctcatactgctggaggccgaatgattggcaaaaaggttgccgagaagattctggacaagaaagagctggagttctacaagtgggaaggtaccctgtcccagctgctgcagaatgtccgcatcacactaaaccaagttgcttctagctggtctcgggaagagaaggaccactgcctggaggagaccgagaagtcgttcgcctactcaggagatctcctacgccagatattcacctgagccaagaacgatctccattatgttttacgataaacattgtaaatactaagccatgtctgtgcaccggggaggaacatgctccgtcaggtctgaactgccttgaaatcaaattgtcatatcatatactaataatccttccattgcaactgcctggtccttgccttttgctgatcccacttgggcgtttgctcaagggtctacgttctctaaggaga

SEQ ID NO: 6002 - DNA, 432 bp, Triticum aestivum
  Clone ID: PAT_TA_6002
tattcggtaaccaccgtacgtccgatcctgcctgtgcgcagccgggcctttggccttgtatacctctcccacttaccccttcgtggctaagactatatatactcctcccccacccctagctagagttagcaaatatgatagctcattggtatgtgagctttgctcctaccactctactcttgagagaaagcgagagagagactaccactcccatggagctcaagacctccatgtgagcatgtgagaagatcctatgggattcaagacccctcatgggaagacccgtcacagattcaagatctcctcttgaagatgaacttcacattgtatctttccctttgttgttcatgtaccttgtggatctatgtgtttattagtctagtggatgtgtgattggacttgttgaaaaaaacaaacatcttggaacattaa

SEQ ID NO: 6003 - DNA, 970 bp, Triticum aestivum
  Clone ID: PAT_TA_6003
ttgctggtggtgaactagagccatttccccagaggctcaatgcagtaccacctcggatagcccgtggttttgtacctgggttctcagttcaaacatatcaggaggacaataaactctggcagaaacatgttaatgcttacaagaaaaccaatgacttgcttgatactggaaggtaccgcaacataatggacatgaatgcaggtcttggtagctttgccgctgtactggagtctccaaagctgtgggtcatgaatgtcgttccgttcattgcagatacttctactttaggtgtaatctatgagcgaggattaataggaatgtatcaggactggtgtgaagggttttctacttacccaaggacatatgacctcatccatgctaacggtgtcttcagtttgtaccaaaacaagtgtaaatttgaagatatactactggaaatggaccggatcttacgcccagagggcgcagttataatccgtgacacagttgatgctcttgtaaaggtggagaaaatagccaatgccatgaggtgggagacaacactggccgaccatgagggcggccctcgtgtgcctgagaagatcctctttgcagttaagcaatactggactgccgacagcaagagccgccgctaacatgtctggattattgttctcgcttctcttcaggataacttttgtccctggcagcgttcgttgcaagtacacattagacggcgtgtagagaactgaagaaccaagccagtgacaaactagaggagagtaaaatatgtcttctatttatcgttggtgttgtatttttctttatttttgttcgtgctgtattcttgtttatttttgttcgtgttgtatcttagaaattcatgaagtggagagacattgctgtttcctgcagtactgaagctgaataacatactaggaacagttttgagtcttgttaaaggaaatgtgcattgttgttaaaaaaaaaa

SEQ ID NO: 6004 - DNA, 839 bp, Triticum aestivum
  unsure (1)..(839): unsure at all n locations
  Clone ID: PAT_TA_6004
gcacgagggcagtgtgaggagggcgagatgcctaggtctagccgccgccgccgccacccctgctcgacggcggtcgggccactgaacgacgacgacctgctccgcgagatcctcctccgcctgcccccgcagccctcctccctcccccgcgcctccgccgtctgcaggcgctggcgcctcctcctctccgacccaggattctcccgccgcttccgcatccaccaccgccgcaaccctcccctcctcggttttttcgtcagaaatgaaggtctgcccttcctaccttccctcgacgccccggatcgtgtctcccccggccgtttctcctgccgccgcggcgacggcgaccggttcatgtcccttggatgccgccatggcctcgtactcgtctccagcaaacctaagaaccagatcctggtgtgggaccccgtcaccggcgaccagcaccgccttgacgtccccccgggggttgcgatacatgcggagaagacaccgatcaacgggggcggtgcttncgtgcttctggagacgatgcccggcacttccaagtggcgttgacagtggcagacaacgatgacttgcaacacagacgagcccttgcctgcgtttactcgtcagagactggcgcatggggtgaactcgtctcaacacagcttccatctcgcgttccaatgagtaatgttggcaccttcgtttccacttacaagcctgctgtgctgattggggattccctttactggaggcttgctgggaattttgccggaattcttgagtttgatttggagaagcaaagcttagctgtcatacgggtgccagtgcatatccttgagaccttgaag

SEQ ID NO: 6005 - DNA, 594 bp, Triticum aestivum
  Clone ID: PAT_TA_6005
acgccatggccatcgtccgggagctcctctggagttggagacggcgtacacgcctgcgctgcgcacccagttgttcgccaagtccgaggacctcggcattgacgccaacgatcttgtcgaccacgacgccgacgacgactactactatcgcacgagccctaagaacttccaagaggaagacgggaccagagccgccggaagccccgccaccggcgccgcctactgggcgacgcaccgagcggagctggccagggtgtccgagctagtctcctcggaggtgccaaagtcgagactggacgccgccagcgtgcagccggagcgacgggacgtcggcgccgacatagagaacgccttgctcgatgctttggtgctggagctcgtcatggacctcggtggctgctaatcgatggcgcccaatccgccggtgtaggtgcaggacgaagaacagagcggcgacctctgcgttgctctgtttttgttgggtagttgctcataggccgggccctactactcagtgccaagtggaggctgtagacaaaataaatatattaattaattgatttgttcttttttgagaaaaaaaaaaaaaaaaaa

SEQ ID NO: 6006 - DNA, 800 bp, Triticum aestivum
  unsure (1)..(800): unsure at all n locations
  Clone ID: PAT_TA_6006
acttcaccatgacgggaccgctcaacaagaccggcgggttcgggttcgcgttccccaagggtcgccgtacgtgacggacctgtcgcaggccatcctaaagctcaccgaaagcgatgagatgaacatgatcgagcgcaagtggttcggcgaccccaacgacgatggtgccacgcaggacggcgggccgttcacgtccaacagcctcagcttcagcagcttctggggcctgttcctcatcaccggcgccacctcgctcctctgctgcgtcgtccacctcgccacctttgtcgcggccaaccgacgggagctcccgccgcacttgtcctggaaggactggctctcgagtttgttcaagctcttcgacgacaaggacccctcgtcgcacacattcagggtcaaggacgacggcggcgccgtgtctgtccggaacgacgcggttgcctcccctcctattgcgcacagcgagcttggcagcccgctcagcgcgccctacacgagcgagtggtcggggacggcaagcccggcgaccggtgagatcgagctggccgccggtggacaggagaggcatgaggtggctcccaaccctgacggctgtggagagaatggcagaggccagtagctgatcaactgccgttcgatcttcgacttatttctcttgcagcgaaccaatgattactgattgttcccagggaattgcgatggtgatgagtagattgattgtgtgagcagtggttgaataattaggcattttcctgtttagtttaatccagaaaaataaggataaaacanaaagcaatana

SEQ ID NO: 6007 - DNA, 832 bp, Triticum aestivum
  Clone ID: PAT_TA_6007
cggcacgaggatcaccatgtcctccctccacagaccacggtcttgctatcttcggtggccatcctctttctcgatctttcgccggcctcctacggcagcggctagctcgccgccgcaccccaatcatgcgaggcccctttctgtacccctgctgcacagtccagccggccacacggccgtcttttcatggatctagatgcgtactccactgcttcttggctctagatccatgaaaactctgctttgttgtacctctagagcgataaaaatggttaatgaagtggatgaggcataccgatgtcagtcaaattacaaccactggtgaggccgccgagtggagctactacaagagacgggcgcaacagctctctggacatgaacattgttctaggtcaattcgtcatcagtcaataagaggcacttacactgcttgaggaaccatgtctctttgaaaagctcatatggtttgaaatcaatgtttatatgtaaagagatttgtctcgggtgcaacttgcaatgctgtgcaacgggggctccctgcggctgatgataactatttgatttttttcttatctctcagacattattaattttcttacctgtacgattctgtactttatgacactatagcttcctattatcagtgtttttgtaggatggtatgaccatgtactggatggtatttcacaacctaaatggtctttatcttttctaaaaaattattggatttaatactttagttgactaagctttgtaaattttagcttaaaatataagaccttattgagcacatatcaaagttctttttttaaaaaaaaaaaaaaaaaaaaaa

SEQ ID NO: 6008 - DNA, 851 bp, Triticum aestivum
  unsure (1)..(851): unsure at all n locations
  Clone ID: PAT_TA_6008
cgccccggcgcccctcacaaccaggacaagcaagcagcagaaccagtgtcagatttcccgaggcacaagttgagcgcaagatggagcaccaggggcgcggcgcaggcgagaagaagggcgtcgtggagagcatcacggagaagctccccggtggccacggtgatcaccagcaggccaccggtggcacgtacggtcagcagggacacgccggagttaccggcgagaacatcaaggagaagctccccggtggccacggtgatcaccagcacaccactggaatgaccggctcggagacgcatgccaccacggccaccaccgatggcaactacgggaagtcgggacacaccggcactgacggcaccggtgagaacaagagcatcatggacaagatcaaggacaagctgcctggacagcactaagcccaaccggtctgcccgctacctttgcagaataatataataagatggccaacttccaccgtgtatacattaactgagtctagtttaactagctcacttggtcgtacatctgggtttaagctttcatggacaacagtgtgtcgccgggtttttgtttgtttacaatttgcacactttgatgtgcaaagacaaaaaaaaaaaaattttcgtttgtttacaatttgcctactttgatgtggaaatttcctcttggttcaaaccgtgtatggtatgctatggtatctataatatacatcanaaaaaaatantaaaaaacttccacgtacgcnttggttactaaaggttggcgccctactngctaggcttaaaccattgtnccaaggaggagnnatcnccggcggnnaacccgggcgaagtggccccgganaaant

SEQ ID NO: 6009 - DNA, 550 bp, Triticum aestivum
  unsure (1)..(550): unsure at all n locations
  Clone ID: PAT_TA_6009
cggccaccccctccttcggcccgccgggctgcgcctcgcgccgcccgacccgctgcagcccacgcggctgcaacgacgtcgactacggcttcggcgagcccacctacgtcttcacattgaacgacgacgtcaacattgtgccgtcggtggtgtacctcaagccgcccaagccgaagcagggcatccggctcgtgctccagtgcgtcgaggagccgcacgccgccgtcttcacccaggagctggagaagctcgcctaagagggcttgcgttcgtcatggttacctccatactttacagaattattacaggtgggatttggagttgctgttgttgttgtattcttcatcttgatgtgtgttgtatttgttgtattccacaccaggttttgcctcaaacaaacaaattaatcactgaggggttcttctttacttgcagctgcgtacttaccgttcttatctatgtgacatcgtaaaccgccggcgccatgtgatcacttcgtcgaatccccgaaactgttggtgtatcaatgcatctggtnaaaaaaaaaaaa

SEQ ID NO: 6010 - DNA, 705 bp, Triticum aestivum
  Clone ID: PAT_TA_6010
tgtcatggaggacaaaaagagggtgcattgcaatctatatttttcactactaaatgtgtgacacaatctgttgagaaacacatttaggtatgcgtagtatacttcagtatatgctcatttcatctggaggtacaatctcaacttcttgaagcaacatacagtaccggagggtgtaacttttggacatttacgtcaaaaccttggagatgatggatgctcggtgactagctctgcatgccttctatgggtgatcgacagaggctcttttggtccaatcagtgagagatcaaatagcttgagcttgccatacacaaagcaatatgatacacgcttccaactacagtgcagacgctccaaaaatcaggctacatgccagctgcaaacaaatataataaagttgtttgggtggatctgttgtggtgctgcttaggtggatctaatcaagacaactattgatcgtcttccatttcaacagcagcaatgtggggtgtcacatgtggagttgggggtcttagagtcgatcgagcaggcgtggatccgcgcgtttcattgggtgttgtgcgtggcgtatgggggtgttcgtcagtggctctcgtgcccctacctgtgagagatcatcgagctggcgcttgccttgcacaaagctatgtgtctggatttgtcttgaggtttctaccatttaaaaaaaaaaaaaaaaaaaaaaaa

SEQ ID NO: 6011 - DNA, 667 bp, Triticum aestivum
  unsure (1)..(667): unsure at all n locations
  Clone ID: PAT_TA_6011
tcagcatcagcgattgttgcagttctcttggccctgatcatcctttacatttacactcgtaaatgtgcatcaagaccatcaaggcgttctaacaggagaagggaagtgactgtttttgtggatattggtgctcctttgacatatgagaccgttgtacgcgctgctggcagttttaatgcaagcaattgcattggaagtggtggctttggagcaacatacaaagctgagattgcaccaggcattctggtggcaataaagaggctcgctatngganggntccaaggtattcagcagttccaagcagaggtnaaaacncttggaaggtgtcggcatgacaatcttgtaacactcatagggtaccacctcagtgattcagagatgtttctaatatacaattttctgcccggcggtaacttggaaaggttcatacaagaaagggcaaagagaccaattgattggagaatgcttcacaaaattgctctagatgttgcacgtgcacttgcataccttcatgataactgtgtcccacgttttctgcaccgggatgtgaagccaagcaacatcttgcttgacaatgagtacaccgcatacctttctgattttggattagcaagactacttgggaattcagaaactcatgcaaccaccggtgtcgcgggtacttttg

SEQ ID NO: 6012 - DNA, 906 bp, Triticum aestivum
  Clone ID: PAT_TA_6012
cgagagcgccccgtgagagtcgagagcgagcaaccgttcccggcccgatcccctatcttctccgatggcgtagccggccggagcagagaagggagaggtacacggagtagtcttgtatatagcgcgtctagttttaggtggtattctgcccatgtggcgtatggcggtatgccgatgtggatagcgccgccgccgtgggcgagtagcggccggtggcttacggcggtggtcttcatggtggtgctgactggaggtcagtcgctgccgtcgagcgcatcgtcggctactccaccaataagctcgcctggttccctgttctggaggtgctccgcttcctctcctgcttctatggtcgccgtggtggtggagttgaagcaggggaaagatggaggtccagatcgggtttgtgctcatccccgatggctgctggtgaatggctacggcgccggccatggcgcttggctgccggccgtttcttccatgccatcggatctgctggccgaagggcggccgtacttcttccttccggctatggagccaattgggaggcagtgcttcttcaacatggagtccgcggcgaggtgtcgtggaggctttgccacaccaagtggtgttgtccccggcggtggcaaggttgcattcgtgatgaaggtgcttgggacccgatcgcgtttttcatttggttgtgggggtcctctttgtaaaatgcagggaccagtgtgttatctaggtttagttcggggtccttttgcatactgctgtgtaccaccgctgttttattactaatgcagtctcggggtccttctggacccctctctcgttcaaaaaaaaaaagaacggcatcctgcaaaaaaaaaaaaaaaaaaatcctgcccgggcggccgctcgaaatcacatagtgaattc

SEQ ID NO: 6013 - DNA, 842 bp, Triticum aestivum
  Clone ID: PAT_TA_6013
tggtccaccatgcatggtgagtttttcttagcctctccgcacgggtacatgcatcatgaagttctcaacagcttcaaatgactttggatcctcatccttgtttgggatctcagcgcttattattttgtcgatttgcgatggttctaggtacttgtctttgtccttcaaaaatattagtatgtgggcatgcgggagtcctctcttctggaattctattgtgtagatgactgcagttgattaatagtttgtcagatttagctaaaattggaatgcatgttactaaagagctagaatctgacggagtataagatgatgcatgtttctaaagagcaagagtctgacggactataaaagatgatactaccggtagtaaagattccgggtcaatggatcttacttgcaatcgtttctccaaagtgtttcttcacaagatgtctctcatcaactcctttagttttatcatgaatactcgatcaacaatatctggccggtcggctggatttaagcctcctcctgcttcatctagcatgtattggatctcgggccactttgcattgcatgtgaatgttataaacaggtctggatatccagcccaacggcatattgcaaaagcgtcttgcaagttctgtgccttgtatcttctgcctcctgtaaaagatgaaggtacaattatcctctttccaacctgctctgttctggtgtcacctcgctcaatcgcgtcttgcagtccactataaagttcagttcgtaacttcccttgattattcctgatctagtttagtctgttttgctcaatgcatgtgtaaacatcttaccaaaattgcagcgatagatgtctagac

SEQ ID NO: 6014 - DNA, 1411 bp, Triticum aestivum
  unsure (1)..(1411): unsure at all n locations
  Clone ID: PAT_TA_6014
gcccctgccgccccccgccctcccgcccccgccccgcccgcccgcccctcccccccccggcctccaatcccacccaatgcggctctaaaaatatctcactcgctccgccaccgccgacccccagacctaccgccgcgccgtagcccggcgtcgccgcctccgcctctagcgctccccgccgccgcggccgccgtcgccgtccccgttctaccccgtcgcgtccctgctgcccacaccccgtccgcggcctcggccagtggttttcgaggaaagaaggcgggggcgcatggggcgggaggcatttttggctgccgctgctggtgctggtggggacgccgcaccgcggcgcgggcgcggcaacctgctccggcgcccggggccgccgccccgcgcccgcactgtgcctcctcttccgccgcgggacccgctgcccctcgccgtccgccacccgctccggcgtccccggctggttccccgcggcccccgcgcctgcgctggggaaggagttctgccatgccagggcgcccaagatgatgctagatctgcattccgacggcagccacatggtcgacggcaactggtaaggcgctcgggaagctgctgatctactgcaacggctgcacaaaggggggcttgttcggaaacatccatgtccccggacactttgtgttcaggacgcgcttctcaaggaccgcaggcaagagcttcctgcctctgcagtgtaggatggatgtcttgtatgtgtccgatccgtgcgaacatcttgaccagggggaagaaggcgacctgggttttttccgtggcatcttcaagtcgtttgccacttcaagggtcaagaagatcctgattgagaagcaggctaggttccatccaacggaggtttgcccctattgcaaggctaagctatggaacatgctgcatgctgatatgatgccggcgagtgcttccgccaggctgggtgcttacgatgattccgtggagtactttgtatgcctgaatggacatgttattggattgggtaccctgttacctctctcggattctgaggaggcaccggaggagtaatcatcaaggaacagtgatcaggtttgcaagatggagtcctggggagaaggcatgggcgcggcaaagctgcaaggcgacaaaaacgtgcagctagctttgcatctaaccgcatgtttccgtactggtgcatcagatgaaactgctgttcctctgtgcttctcctctgtttgttgatcgcctgtctgttgttctcgtcattgtaatgaccatgccgacctttcactttgtccttcatgtgcagagcatatgtagcaaggtgtgatgagaccgagttgtaaaattggtgcccatattggacctcatatattcatgtgctgttcctaaccgtaaaaaaaaaaaaaaaaan

SEQ ID NO: 6015 - DNA, 1076 bp, Triticum aestivum
  unsure (1)..(1076): unsure at all n locations
  Clone ID: PAT_TA_6015
ggccgccagcgcccccttcgtcctctccgtcggcttccccggcgagctaccaagacatggtgaggccgtttgaggatgactacctgtgtcctgcttggtttgcacctggaggggtcagggcaacacattccaaggatggatcgaccaaaaggtcatccaaggatagatcgtgctctcctttttatattccaggcctccgcacagccgatgttgctgttgtggaagagtatctccgttctgttaacatcatgcctgtgtttttagacatcaagatgccaaggaagtctgtgtttactctgcgtgaaaccttttacgttctttatgggggaacacctgtgaaggaactctctgagctcgtatgttatcgcttaaatctcgaggaaggtcgccccatgcagttcctcatgaatggtgatctactcgctgaggcgaccactgtgtctgcaatctatgagaaacatcttttgtctgataaccttgctaccttgcagtgttacattgacaagaagaagtttgttccaagaagcttcaatgtcgacaagtcagttaaagttcccatcgttgagccagtttatgtcaatgaagagtacatcccgtttcctcccttccgcatccgcaacatcagggatgcaaagaaggcagcggctgatgccaggagtggctcctacggcaatgccaccatctctcatggatcgtacagcgaggagggtcatctgcagttctattaggcgacttggcttaagggttggtatgaactatgatcggcgaattttgtcagattggctggagttttgcacccttgtggggtagtgttaggatcgaccggtgaatttggtctgttcttcagaccgacccttgcgcggcagctttgaattgctgaggccagtttgaattatgctaaaccttcatggatgatgttatgggcgttcaggcttactttcagggttgttttctgatttttgctgtggttgctcttcttgctttcactaactctgtcaagtgccaaacactgattaacctctactctaagaacatgnctcaaggcacgggncttattagnatnnaataactgccat

SEQ ID NO: 6016 - DNA, 524 bp, Triticum aestivum
  unsure (1)..(524): unsure at all n locations
  Clone ID: PAT_TA_6016
aggcgtcttcggcttcggcgccgtcatcctcgagatcgtctccggccgcccccgtgccggctgcggcgccgccgggtgcagccagctgctggaggccgtgtggcagctccacggcgccggggagggccgcatcctcgaggccgtcgaccggcggctcgcgcccggggagttcgacgagggcgacgcggagcggctgctgctgctgggcctcgcgtgcacccaccccaaccccggggagcggcccagggcgcgcgccatcgtgcagatcctggcgcgctccgcgccgccgccggacgtgccggcgtccaagccggccttcatgtggcccgcgctgccggtcgtgctcggggacgacgacggggagatggccgtgtccgggacaagcacggccttgacctcctcgtcgtcgtactacgcctcgtccgccgggtggacgacgcaaaactactggcttaccaagggaacacgacttggcggacaaggacatgnccacggcgtgagttgaccgccgggggaaccttgtg

SEQ ID NO: 6017 - DNA, 1288 bp, Triticum aestivum
  Clone ID: PAT_TA_6017
cgaccgccaaccccttccgtctaggcaagcaccccggcggcgcgaacaccaaggctccccggcggccgcagcaatgctcctaaccaagccccaccccgccctcaccctcccctccgcatccctcccaaatcctaacctaaacgccgcccgcgtcaggcccctcgcctcgtccgcgccccatggacgccgcgggctccgcgtctcggcctcctcctccccctggcgccagcgcaggccgcgtccgcggcgctgaaccgcgtggacgtcctgtcggaggcgctccccttcatccagcggttcaagggcaagacggtggtggtcaagtacggcggcgcggccatgaagtcgccggagctgcaggcgtcggtgatccgcgacctggtcctcctctcctgcgtcggcctgcgccccgtgctcgtgcacggcggcggcccggagatcaactcctggctgcagcgcgtcggcgtcgagccgcagttccgcaacggcctccgcgtcaccgacgcgctcaccatggaggtcgtcgagatggtgctggtcggcaaggtcaacaagcagctcgtctccctcatcagcctcgccggcgccaccgccgtcggcctctgcggcaaggacgcgcgcctcctcaccgcgcgcccctcccccgacgccgcggccctcgggttcgtcggcgaggtcacgcgcgtcgacccctccgtgctccgcccgatcatcgcctccggccacatcccggtcatcgccaccgtggccgcagacgagaccgggcaggcctacaacatcaacgccgacactgcggcgggggagatcgcggctgccattggcgccgagaagctgctgctgatcactgacgtgtccggcatactcgcggaccgggacgaccccgggagcctggtgaaggagattgacatcgccggcgtccggcggatggtggccgaggggaaggtgggtgggggcatgatacccaaggtggagtgctgcgtgcgcgcactggcgcagggcgtgcacacggccagcatcattgacggccgcgtcccgcactctctcctgctcgagatcctcaccgacgagggcaccggcaccatgatcaccggctgaaacttgtttgtttgttgtttctttccttttcttttttggttcattcagtgggttggatggttttgcatacctcatttgtggtaactgtgttttcgattcgaatcctgaacaaggaatggtgaaagattgcaactttaagcagaatatatacatttcgtggcagattttccaaaaaaaaaaaaaaaaaaaaaaa

SEQ ID NO: 6018 - DNA, 548 bp, Triticum aestivum
  unsure (1)..(548): unsure at all n locations
  Clone ID: PAT_TA_6018
aggggaagcggcggcgaggacgacagcgtcgcgcccgtcggccgtggcaatggtgcaggtgggcaagctggtggacaactacctggcagaggtcgcgtccgacgccaacctgaagccagccaaattctgcaagctcgcgctggcaatgccggaccacgcccgcatctacgacgatggcgtctaccgcgccgtcgacatctacctcaaggcgcatccgcggctgacggcggaggagcgggacagggtgtgcggcgtggtggactgccggaagctgacggtggaggcgtgcacgcacgcggcgcagaacgagcggctcccgctgcgcgcggtgctgcaggtgctcttcttcgagcagctgcagctccggcgcgccatcacgggcacgctgctggcgtccacggcttccccgccgagcgcggcatccgaatcctcagccgcagccgccggcggcggcgctgcgtcacgccgctgggcccgagcgaggcgtggcggaccacgacngtgcaggagagcaagacctgccggntgncatgaccgnaattaagacc

SEQ ID NO: 6019 - DNA, 618 bp, Triticum aestivum
  unsure (1)..(618): unsure at all n locations
  Clone ID: PAT_TA_6019
gcacgaggaagacaaccaccaccaagtctactccccgtccacgccaatcttcttcctcctcctcctccgccgcctacacctcgtcgccgccggcctccatgatgaaggacaagatgaaggatctcatgaagaaggtcacctcctcctccgccccgtccttcaagggcccctcccacgtcctcggctccggccctcccccctccgcctccacctcctcctcccgcccctcaaaccctaaccctaaccccaggcccgcccccaagcagcagcccccgcgcccggccggcccctccgaattcacccccttcacccccttcaccgccgtcatctcctcctcctcccgccgcccagatgccaacggcggcgacaccgtcgcgtgccccaactgcggcgacgccttctcctccgagcacgccgtctcggagcacctcgacggctgcctcgcgtcggccggcggcgcccgcgcccgcgcggccgcgtacctcgccggcaacccaccccccgcggccgtcgaggtcgtcaagaagcttctcggcaacctgctcaaggagcccggcaacgacaagtataggagggtcaggctcggtaaccctnnnatcaannnnnccgtggcggnnn

SEQ ID NO: 6020 - DNA, 688 bp, Triticum aestivum
  Clone ID: PAT_TA_6020
gcccgccgcctctcagctccagcaccgaggctcggctccctctacccagagccaaagaatcaaggctgtttgaagctcgagatcacgcgcgtttcattcagcccctctggtggtggtagccaggccgagacagtcaccgggcggaaggagcggaaggactgaagcctcagcgggccggcgatctactactatgaggaacggcagcaccgtgtgcgacgcggcggcggctgtggggctgggcgtggcgccgcggtacaggggggtgcggaagcggccgtggggcaggttcgcggcggagatccgggacccggccaagcgggcgcgggtctggctcggcacctacgactccgccgaggccgccgcgcgggcctacgacgtcgccgcgcgcaccctccgcggcccgctcgccaccaccaactttccccaggaccccgtctccttccccacgctccccacgctcccgcatccgtttcgaccggcttcccccggcccagcctgcagcgccaggctccaaccgttcgagtcctaccgcgcgcccccagccgccgccgcgccgcgccccctcccccccgccccgcccccggctcctcgccccgcggaccgctcccgcggcggcgcgcttccccgcggcgactgcccctcgtcgccctccgccgtgctccacggcggcgacgaggccgcctcggcc

SEQ ID NO: 6021 - DNA, 754 bp, Triticum aestivum
  unsure (1)..(754): unsure at all n locations
  Clone ID: PAT_TA_6021
aggatactctctagcatcacacaaggctcaagctacagcaacatagatatatgccctgcctaattcctgctacccacatacctagctagcttcttctctctcagctctctcgattgagatcttgtcaatctctttctcctccgtgtagctagctagagctagctcaattggtgcctgtaggcaacgacatccatcgtcaagatctctcatccatacccatagtacacatcgcaaattcacaatacaaattgtagagagagtccagctgagctgagcagggggagggtgcggggagtagttggtgcacagatagagnagaataagcatttccatggggctgcgggacatcgagatgacgctgccgccggggttccgcttctacccgagcgacgaggagctggtgtgccactacctgcacggcaaggtggccaaccggcgcctcgccggaggagccgccgggaccatggtgggaggtcgatctgcacgtccacgagccatgggagctgccagacgtggcgaagctgagcaccggcgagggccgcgtcttccgctgccccggcccctcgtacgcccccgcccgccgcgccgccatcgtcggcatgcgcaagaccctcgtcttctaccgcggccgcgcccccaacggcagcaagacctgctgggtcatgcacgagttccgcatcgagaaccctcactccccacccaaggaggactgggtgctgtgcagagttttccacaagaagaaggccgacacgga

SEQ ID NO: 6022 - DNA, 544 bp, Triticum aestivum
  Clone ID: PAT_TA_6022
aggcagctgcaggtggagatggtgccagggcggcgacgggagccatccgtgcggtggcgaaggtgcacctcgccctcggctgggcggcggcactttcgccctctgcgccgtcaccctccagccccagctgaagccgcagggaggtcagtgcgcggccaccgaggtggacgcagcgaccttgcgcgccaaggggctgctgttgctgctccccgccggcgcccaggcagcggcggccacggtggccgccttcgcgccggacgcctggagatggaggcggctgcacgtcggctggaccttcgcggccttcgcgcacgtcctcagcgtcttcacctacttccacctcgaggacgccttcactgctgcggccgccgtcgccttcagcggctgccccggccacatgtacgtggagacggccatgttcatcgcccacaacgtcctgctcttcgtgcccctctgcgtcttcttcattgtaggcaccgccgcactcgtcgccgccgtggtagccctttgattcctacaaacatatcgatgcatccatgcctag

SEQ ID NO: 6023 - DNA, 730 bp, Triticum aestivum
  unsure (1)..(730): unsure at all n locations
  Clone ID: PAT_TA_6023
agccaagaggaagaacatgtttgcacccggaaaaggaaacaaagcgaagtcaaaagcatgctagacggacccacaacttcacaacaccgaaagaaggctctctgtgagcttgggtcgacggggtcgcaggcttggttaaggaaggagatcaacgaactcgcgcttaaaagatatcttcattttccagcgcgcttcggattcctggagcgttgcaagatcacgctcaagtccgtggagaggaacaagtcttgggaggtggaaggtgtcaactaccatccaggcaccaacaggtcttataattgtcttacgagaggctggaaggccttctgtaaggagaacgagctcaaggcaggagacatctgcaccttcaaagtcatcaacagcacgctgtggcatgttgtcatcgaccgctgctagaaatacggttcatagatgatcttggctgatggcggacctgctggttttgcgaacctaagtagtatcatgatgaatattgtggtgacatgataatcaacctgctaggagtttgtgttccatgatatttacttggttcgtaacctgctagtgctaggtgttttcgttcatgacttgtgattaggtggctggctcctgtcaaggcatgatatttaacctgctaggtgttggttttatcgctgtaatgcagcagtgcactatatttattgttctccctgtgctactattagtctattactcatnacaaaagtctcct

SEQ ID NO: 6024 - DNA, 1235 bp, Triticum aestivum
  unsure (1)..(1235): unsure at all n locations
  Clone ID: PAT_TA_6024
cgtgggtgcagccgccggcgagaagctccgtaagtacatcgcgtcgtccaccccgcagaagccggccacgggcaccatcctgttccaaggcacccacctcggcgtgcacccagcgccggtggtggcggcgttctcggcgcgcggcccgaacccccaatctccagagacactgaagccggacctgatagcccccggcctgaacatcctcgccgcgtggcccatcggcgtgggcccggcaggcatcccctcggacggccggcgcacggaattcaacatcctctccggcacgtccatggcntgcccgcacgtctccggcctcgcggcgctgctcaaggcggcgcacccgacgtggagccccgcggccatcaagtcggcgctcatgaccacggcctacacaagggacaacagcaacggcacagggctcgacgagtccaccggcaaggtggcggacgtgttcgacttcggcgcggggcacgtggacccgatgcgcgccatggacccgggcctcgtctacgacatcgcgccggcggactacgtcagcttcctctgcaacctcaactacacggggcagaacatccgggcgatcacgcggcggcaggccgactgccggggcgcgcgccgcgccgggcacgccggcaacctcaactacccgtccctctccgtcacgttcgtggcggacggcgcgagggcgaagatgaggacccacttcatccggacggtgaccaacgtgggcggcggcaggtcggcctaccgcgcgaccgtgaggtcgccggaggggtgcaatgtcacggtgcggcccgaccggctggcgttccggcgcgacgggcagaagctgagcttcacggtgcacgtggaggccgcggcgcgggcgaggatggagcccggcagctccctggtgaggagcggggcgctgacgtggggcgacggcaggcacgccgtggtgagcccgatcgtggtgacactgcaagcgccagtgcagtaggcatgcaatgcaagctcgccatgagaagcttgatggatggatggagccaagttgacacgatctccggcatgtagagaatacgtaatctacttactactactagtggctatgatttggatcaagagcttgttcttagggaagattggacagagttgcgtgccatctcgtcttatacaacagtattactaacagctactagtatagtatagtgtactactataacatcgtataaatacatgggtaatccccctgc

SEQ ID NO: 6025 - DNA, 521 bp, Triticum aestivum
  unsure (1)..(521): unsure at all n locations
  Clone ID: PAT_TA_6025
gccaaacctatctgacttcatccctgaagttgcgtggctggccctgcagggcttgaggagacgcatcgagggcttgttcacgcggctgcatgccatgatcggcgagcggatcgagagtcagatgggagaccgcgccgctgccgcaggtgagccgaccaagaaaaacttcctggacgtgttgctccgactaccgcaacaccgacgatgaccagggcttccgagcgccagacgatcctctcattgatttccgacttgttcagcgctgggancggatacaagcttcagccaccgttagaatgggcgatggcggagctgctactgaatccatcatgcatgtcgagagcccgcgaagagctcgaccaagtgataggccctaaagcgcagctcgaggcctctgtcgctggtcagcccccgtcccccctagccatcgtcggccacccccgccccctccggcccccggcgcccttccggctcccgcctggggcacggccgacgacacaggtccaggggtacacggttcc

SEQ ID NO: 6026 - DNA, 639 bp, Triticum aestivum
  Clone ID: PAT_TA_6026
acgagggccttgcctcgccccgccggactcgatctcttcctccctttcccggcaccacgtgtccacgcccctagtgcattctccggagtccagcctactgtctccacttaatttcacgcgaggtgacggagtcggggcgccaacaagacctaggagcgacccgccgccggcgacaagtccgaataccttctgcgactgatccgcagacggcgaagacgacatccatctctcagggctaccccgccgcagcaggacgtcatgttcccacagccgaatgcctttggaccactgcggcctcctcagcctccgccatggcagtggcagtggcagcagcagcagcaccaccaccaccaccacccgcaccagcagctccctttccagcctgaggcggcggcactggcggcggccagttccttttggcagcgtgacaatgtgcgggagcatttgaagaagctgcaagagaccgtcgcgatttcaagcgctctgataaacgagctagaggagattgcacttgtgaggaattcatcggatgctagtgcacaagaaccagattcgtctgcagtagcatcgtcttcagggtctggcgtctcttctccaggcaggccttgccatttttcagagcttgcaagtgaaatcaag

SEQ ID NO: 6027 - DNA, 653 bp, Triticum aestivum
  unsure (1)..(653): unsure at all n locations
  Clone ID: PAT_TA_6027
ataattatcgaacgcggcgcggggcttctgccaaaaaggaagctaagnacgttcaggnaatgtagaaatacagagagaggtgcagccctggccctattgcacctatccaagcgacagatctggggatctagactccttgggttatccaaagccatcatcgactgttgtcagtgagggcttggttttggttaataccttcgaagagacttttggtgacgtatatgattctggtaaaggtgtctggagccaactcacaaatatgggttctcatagtttacctcgacgggttgtctcactcgcttcattcatcggagaaaggaggtttttcgtgtgcacaggcttatttattgactggaatggatgcacccccattctgacttcagcgagtttggttagggatcctaaagatggaaacaagattgctgaaaagttgaagattgaagttttgcttccaaacaaagagcgcaaagaagggaaattgcaacattatgatttatactataatgttgctctcatcgttgtcgaggattaccgttgtcttcgtccagctagaattcatgatgattggtggaatcattttacattggaagatcccaatgtagtagctgtggggtgctgtttcaaatctggcaggttaatggctacacatggaa

SEQ ID NO: 6028 - DNA, 645 bp, Triticum aestivum
  Clone ID: PAT_TA_6028
gatccccgggctgcaggtgctgtgctcgagggttcctcttcctccactgcgccgccgcgagcctcccgacccctccgtcgcgattctgcgaaatccggcgggttcctacgcgatccgaggccagatgggagaaggagatccggagggcagcgtcgtcggagcgaccgcggacgcgacctcgacctcgacctcggcggccggcggcggccgcccctgtgagggacatcaggcggtacaagtgcgagttctgcgacgtcgtgcgctcgaagaagcggctgatccgagaccacgtcctcgagcaccataaggacgaagtggatggtctggatgagtacaacgtaggtggtggtggcggcagtgcgccgccgggcaaggagatcggccatgattgcaaggagtgcggcgcgaggtttaagaagccggcgcatctgaagcagcatatgcagagccattcgcccgaggctgtttaattgtgtgaagcattggatcccaaagaactccaaaatgcgagagggccctgaatggactagtaccaggatggggagaccctcctgggaagctccttcaggaagcctctttcacgcccttcttcagatatgaatgtgtgaagcattggatcccaagaactccaaaatgccagaaggg

SEQ ID NO: 6029 - DNA, 932 bp, Triticum aestivum
  Clone ID: PAT_TA_6029
gtctgcttctctgcaccccaagctaaccccttagactctcaccgctactatatactggacctgtcaccggcctccactatcaattctccctttagggtcctcagctaccgctctaatagtttctcctccgaatcccatgtaaaatctaactacaccaattcattctactgggatactctcccagtaccaccatttctaggcgatgactatggaagaaccattgacatttgttcctccatgatgatcaatggctcgaccatatgcatatcctctgtcgaagaagggcgttggcacctacacctttgatataagtgacaaaagttatggactcaggctggcaattgggtgctgcccttctacggcaaagcagagtatgttcccgagctcaacctttcgttcgctctatctgctgacagcccccaccgcttgtgcgctttaacctgcacttcaatgcaccatgggggcccaccagcattgcagcatacttttgatgagctcgacctgccggagaattggtcgccatacaagtgccacctggttaacctgggctcaggcaacttttgcatcatttccttctgtaagaccatgaactgtgagtttgccgtcttcaccggcgtggaggtgaaaccctgcatcaatggcgacggtcctctccggacgatcaagcacctgtctaagagtttcagccttggatctcatagcatcaaaagtgtgctctgaaccatctaattgattgcctggatgccgatatggaacttagtctgtaatctgtgctattttgttttctgcctcttagctgttctaaagcccgctgctgtttatcggtcttgatatgctgcatttaatccgacagcgcatgactatgtaaagactatttgcttaaatgatttttaaacttgcttaagttcaaaaaaaaaaaaaaaaaaaaaaaa

SEQ ID NO: 6030 - DNA, 533 bp, Triticum aestivum
  Clone ID: PAT_TA_6030
aggatgggactatgtcacacagagatggaggggttcaatagaaatctgtaggggaccagttaactgcattaaatttattgctcgaaagcaatggtttgtggctgggtcctctgatggtctccatgtacaagaggaagctataaaaaagaagaaaatccagaggttcagagctcgtgttaactctgtcacatcactggccgttcatccaaccaagccgtatgtggtttcatcatcctatggcggactgataaagctttgggactgggacaagggatgggaatgcataacaacatttgaaggggaacactctgatgttgtatgtcaactcgcatttaatccaaatgacacgaacagtttcgctagtgtgtcgaacgatcgcacaataaaggtttggggtcttgattcacccaaatcccattacactctgtctggccattcagataatgtgaaatgcctggatttcttcacacgtgatgatgggcaatacttgattactggttctgttgataatactgccaagatatgggacttgc

SEQ ID NO: 6031 - DNA, 1417 bp, Triticum aestivum
  Clone ID: PAT_TA_6031
ccccgggctgcagggtgcagcgcctacttggcctgaagtaccccgatgcagcctagcgctttgatcgcttcctactcgagtcttatcttgaggacaatgactttgtgaagtggtgccccagcatcccacactgtggacgcgcaatccgtgtgggcactggtgatcgttactgcgaggtcaagtgcctctgtggtgtcaccttctgcttcaactgtatggagcagacacactcaccgtgcccgtgtaccatatggaggcactggaacaccaggatccatggcgagtcagagaacatcaaatggatcgttaaaaacaccaagagctgccccaagtgcttcaagccgattgagaagcgtgacggttgcaacctggtcaagtgcaagtgtggccagtatatgtgctggctatgtggtggacccacaggtagcgcgcacacatggacaaacattgagggccacagctgcaaccgctacaaggagagcaaggacaaggtggacacgggcaggcggcagctagagcgatacgcgcattactgcaaccggttcaagatccatgaggactcatacaaggagcaacacgaaaagctggggccggccatcaaagagaaagtgaaacagctggagtcgaaccacctgcgaccaaggctgatcagggacggcgactggctgaccgatgcacaccaagcgcctgctgtggtcacggcaggtggtgtcacgatcatacgcgtttgcctaccacatgttcggcggcgaactgcaggcgcaccggtcagagcggggcagcttggccccagcgcagaatctgtttgagagccagcaggagcagctggagcgccacgtggagcagctgtcgaaggtgctcgtgacggatatcctggcgctgcctgaccaaggagatagtgaaggtgaagcaggaggccgtcaacctccgacaagttctcccgagaggctcttgcggggagatgtacacctgcattccaggacgagctgctgcccgctgcccaacgggacccatggacatcgccgcttacaccccggacggccctgtgcgggccaaggtgtcccgggcctgacaggcttcttcacttggtgccccctcctccgggcgcacatactgggtgccaccgactgtggagcgctggcctccctgtcatgctgccgacgcaagggtggtcgtacaggagcccctcatgggggttcgtgcccgccgcgcactaggtggtgcccccccccctaccctagttggactaatggggatttctttttctccctccgtcccaatgtaagtcattttttgacattacactagtgtcaaaaaacgtcttacattgtgggacggagggagtagtttgcaagtgaagcatgtacgggttcatccagctatctgtggtgtctgtactaagcgttgttcatctttc

SEQ ID NO: 6032 - DNA, 991 bp, Triticum aestivum
  Clone ID: PAT_TA_6032
gtgcggcgctcaggcggcgggttccccaagaactccctctggccgctgctcttggacgcactcccgcacccccgttgccactctccgctcccctcctcccatctcctgctcgaggcacagccccttcttccgccggaactctccacagcgctctcctctgctccggccttctccagctcgccatggaggcgccgctgctggtggccgcgctgctgctcctgtcctcgaccctcgtcgtctccgatttctgcgtgtgcaggtcggagcagccgcaggcggcgctgcagaagaccatcgactacgcgtgcggggcgggggcggactgcaattcgatccacgagcaggggccgtgctacaaccccaacaacgtcgtcgcgcactgctcctgggcggccaacagctacttccagaagaagagggccatgggcgccacctgcgacttcggcggcaccgccctcatcatctccaccgacccaagttcttcaggctgctcctacccctcaagcgcaagtgctgctggaacatcaacgactccgaccgggactgggactgggatcggaggcacaacagggggaactggaggcaccttcacgcccggtgccggcactagcaccggcggcatgggaggaaccggcacggggacggacaccaccagtggggctacgggcaccgggtttggcggcctgggtccaacaggcacgagcaacatggacacggcagcagcgggcttgcacacaaggtcccgagccgtagagcctgccttcctcgccctgctcctcttcttcctggcattcgcatgaagctggatcgctcgctcacattcggccagggtagaagaaagaaaccgctttggtaagcttgtcgcagggctagtctgatccaaggacaaatgatgaaaaacctgatatattctgaaggtgtcatcctccccaaaagaagaagaagaagaaaaaccctgcttctttcttgtccggtgtcaaggcatgcacag

SEQ ID NO: 6033 - DNA, 1797 bp, Triticum aestivum
  Clone ID: PAT_TA_6033
tagcgcgggcgcggcccaggcgcccggagggacgcgggcttaagacgactccggggcttgccccgccgattgtgctctccgacaacgggtccgtcgaccgtctggcagcttctctcccgggagccgccgacggcgcggtcgcggtgggcccgcctgcgggcgctcggggctgtgggacctgccccgtttgcgtaagggtgatgaagcgaagacactgaacttgtggttttctcataggtaataactctctttgtacagcacatctggagactgaactactgaaacctggaggcacacaatccatggatacgacgattacaccgcgtcgtgcgagctgagatttgcagctcgcaaattgaaaccgggcaggccaatttgggtggattgggatttacggccgtgattgcaattcgcggtgggcatttacaaattgaagtaccaacatttcagaatcactgaaaagcattattggcagcgagatttgtgcgagtagtgggaccctgtatggctagattcttatttgctgcatcatctttcgcgcacgtgtgactgttggatactactaggaacgtagcctttgcacttcctcttgctgttgcaaggacatgcacacatgcagaaactagtgtgtgtataataattctggaccaaacggctgttctaaaataaaaagacaaaactccacacaaggctgtcatgatcatgtattccgggccaggaagaaacagtcgagtctgtcgacagattgcgacaagcttttcctgcggttcccgtgtatgttagggctcaagacatgtctcatttgttggatctaaggaaagcaggtgcgaccgatgttgttctagaaaatgccgagactagcttgcaactaggctcgatgcttatgaaagggctgggtgtcatgtctgatgatgtatctttcttgagtaagcttgtgagggactcgatggagttacaagctcaggaggcactcaacaacgtcgaggatcgtgaaactactaccatggagtcacttcaggttagagtatcggacttggttgagtccaatgggaacggttccggaatgattccccgggagcaatcgctaggtctaagcagtcgtccggaggtacgggtgatgaaaacgactccggataatcccatgcctaatttgaacaacaaaaacgaatctgaagacggtgtgaaatattgtctcctggaaaccgctgacggcgaggaaacggtggagcctccagcggaagcaaggagatgacggaccagaccagtttctgtaaaaccaaggcgcagtctgaagcgaaggcactgaacttgtggtttcctcataggtaatagctctcattgtacagcacatctggagactgaagcgccgaaacttggaggcacacaatctgtggacacgacgtttgcactgcgtcgtgcgagctgagatttgcagctcgcaaattgaaaccggaaatgtcaattcgggcatattgagatttacagccgtgattggaatttgcggcgggcatttagaaattgaagcatcaacatttcagaatccctgaaaagcattattggcagggtgatttgtgcaagcagaagtaacctgtatggctagataattatttgtatcacatttctctgatttgtgtctgttgtatacaactaggaccgtaggccaaatcccccctgtaaaaaaaatctcgtgccggcgcccatgcagaaactagtgagtgtataataatactggaccaaacggtttgtcctcgccgcgacaagttgaaaaaaaaaaaaaaaaaaaaaaaaaaaaaaaaa

SEQ ID NO: 6034 - DNA, 391 bp, Triticum aestivum
  Clone ID: PAT_TA_6034
ctcggccccggcgagtgtcgacctcaagagggtattcccagataaaaagatcggcaagataatcgaaacaagcctatcggcgaaccaagagcgcgctgccatggagaagaagaggctgaagtggaaggtggcagggcctcccccaaaagaaaatgtggtccgtggagggcccttggacccctccaagctcgtcgtcgagttggcacccatggagatccgcacattcgtcatcaacttcgaccaccgactcgccgcacatccgatgtaagcgccatggcgatgatcgccgacgttgttgttaggaataagcaacttgtattcccatgaggccataggccgatatatatacatgtataggtgtggaacatatgcaggaaaccccttatataac

SEQ ID NO: 6035 - DNA, 2567 bp, Triticum aestivum
  unsure (1)..(2567): unsure at all n locations
  Clone ID: PAT_TA_6035
tttggctcatcagctgatatttttgctggcatcttcccaaaaatttatgaaccaccacctggtgagttttattttgaagtcgatgatacttcccctgttgtccaggatgatccccttctttttgattacaatgttgaacaacgggtgaatgattttgttgctgcagcgctggcacaggcaaatgttacaaggacaaaccatatcatgtttactgtgggaacagacttccaatatcactacgcagaaagttggttcagactgatggacaaattaattcattatgtgaacaaggatggccgtgtgaatgctctgtactcccctcctccccttgcctctgctgcaaaggtcggtaccaatgggccatggcctcttaagacaaatgatttctttccatatgcagataaccccaatgcatactggacaggttactttacaagcagacccgccttaaaacgatatgtccgcatgatgagtggatattacttggcagctaggcagctggagttcttcattggaagaagcaagtcaggttccacaacagatagcttaggagatgccctacctcttgctcagcatcatgatgctgttacaggaacagagaagcaacacgttgcaaatgattatgcgaagagagtatcgattggctataagaaagcggaggaactggtttccacttctctcgcttgcttgagtgagtcaggctcaaattctcgttgttcgtccccaacgacaaagtttgggcagtgtcctctcctgaacattacttattgccccccttccgagaagaacttttctcaaggaaaaagcttggttgttcttgtgtacaactctcttggatgggaacgagaggatgtcctccgcataccagtcatgagtgactcaattgttgtccatgattccgaagggaaaagaaatcgaatcgcaacttctgccaatagctaatgcctcatccgtacctacgggacagacatgtcaaggtttacttgggcacatcgcctgccgcaagtcctaagttttgggttgcttttcctgcttcggtaccaccacttggttttagcacttactttatctcgagtggaaagagatcagcatctatctcttcgacatccactctaaactctccggcaaatgggagggggtttctcccagttgggcacgggcgtttgaaacttcactatgatgcagctggatcattatcccagtactccgatagtaagacgcaggtcgaagcaaatttcgagcagaagtacaagtattacctaggacaagatggaagcggagatgatcctcaggcttctggagcgtacatatttcgccctaagggcgttgttcctatcaaaactgatggtcaggttcctcccacgattctgcgtgggcccatattggatgaagtgcatcagcagattaatccatggatatatcagatcactagagtttacaagggaaaggactatgtggaaaccgagttcatagttggaccaataccagtcgacgatgaaaatggaaaagaactttcaactgaaatcattactagcatgcccgcggacaaaacattttacactgattccagtgggcgtgatttcatcaaaagggtacgggattatcgctcggagtggaagattgaagtaaaccaacctgttgctggaaactattatcctattaatcttggcatttatgtggaagatggcagcaaagagttgtctatacttgtagacaggtctgttggaggttcgagcataaaggatggacaaatagagctaatgctacacaggaggctactcaatgatgatggtcgtggtgttgcggaagcactagatgaaaaagtctgtttggatgatcaatgtgaaggactagttattgaaggaaaatactatctcaaaattgacccacaaggtgacggagctaggtggcgtcgtacatttggtcaggagctgtactcccctcttcttcttgcgttcgcagaaaaggatggaggcaactgggggaattcacatgtttcatcattctctgcaatggatccaacttacagccttcctgaaaatgtcgccgttgcttactcttgaggaactcgaagatggaagtgttctcccttcggttggctcacctatacgaggctggagagcataaggatctctcggccccggcgagtgtcgacctcaagagggtattcccagataaaaagatcggcaagataatccgaaacaangcctatccgccaaccacgagcgcgccgccccggccatggagaggctgaagcggttggtggctgggccgcccccaaaggcccaccccctccgtggagggcccttggtcccctccgggcgcggccccgtggggcccccccccgagaccccctcattcgtcatcaacttcgaccaccgactcgccgcacatccgatgtaagcgccatggcgatgatcgccgacgttgttgttaggaataagcaacttgtattcccatgaggccataggccgatatatatacatgtataggtgtggaacatatgcaggaaaccccttatataacgggataaatacaaaggggtacctgcccgggcggccgctcga

SEQ ID NO: 6036 - DNA, 772 bp, Triticum aestivum
  unsure (1)..(772): unsure at all n locations
  Clone ID: PAT_TA_6036
aggcgggtgcacaccgtcggtgtggctgtggtggatggaaaaatagaagaaagaagagcagaggaagaaagacgaagcctcccttgtctctttggttcgatcggacggccaaagtatgtcagatcggacggtcagcttttttttatcatccggctgatttgtagcagcagcctttccttaatggataggaaacctcgggagcacctcacctccggttacaaaacgcacgcaaagaaaccagacataccaattttcacaccacgtacgcatctgccttcgtcttccaaaacccctccagcaacgccgtaccacacagcgccaccgttccatggccacggaggccatggccggcgccgtgagggacctggccgccctctccatgcggttcctcctccacctcggcggcaaccaaaccaacctggccttctccccgctgtcgttccactatgtcctcgtccttctcgctgccggtgccacgggcgacaccctcaaccagatcgtctccttcctaggcccctccggcggcatggcgcacgcatccctcgcgtcccatgcagcctctgctttcctcgctcggggcaatggctcggagcccgacgtccggtgcggcgtaggcctttgggtggattcgtcgctccggcttaggcctgccttcgcagacatggtcgcctcccggtacaatgccacagctcaagccatgcctttccaagaaaaggtgatttatctatatgagcattgagcaatntgatttaaaaaaaaaaaaaaaaaaaaa

SEQ ID NO: 6037 - DNA, 683 bp, Triticum aestivum
  Clone ID: PAT_TA_6037
cgtccgcccacgcgtccgcccacgcgtccgcggacgcgtggggtcgcagcccgcatagcctagtccgccacaccacacctccctcatctctccccttcctctctcagtctcagtctttcttcgcttcttttcccgttaattaattcgtttcctcttgctctcctccgtttcttggctaaatccggcgcatacgcctccgtaagcccaatctggggagcgaattgtcgactcacctgccctcaagcacttgatttcctaggtggttgcggctcgcgcgccaactgctcgacgcaattccgctgcagaatcttctctgccatttgggggagcgcaggcggtgacggtgtttcttatggcgtgtgctccaaattatattgccattggcttttccaactatggtttatatacggggacaagggtactctcgccgagctacaagaacttcccacggaaatcctcctacaagtttctcaaggtccgtgctctgcagggaaatgatggccgtagaaggctgattgacataatccggatcatcccggagctgtcaaggaactatttcaaaacgggtccaagagctcttttcggcggacgcacactggggggttatgtttacgaaaaacctacatccgcgctggggcgtgatgctttgggcgttaacgatgttatcgcatgagttgtgtgtg

SEQ ID NO: 6038 - DNA, 1058 bp, Triticum aestivum
  Clone ID: PAT_TA_6038
attcggcacgaggctctatccactctctctcgtgggatcgtccgtggtcctccggcccgccgtcctcctcctccccttccccctccccctctccctaatccaatggctgctgctgcctcttcctcggcctcgccgcttctcctcccgtcagggccgcgtggcgctagctcgagggcctggcttcccagcggcggcggcggcggcggcagggcgttcatcagaggtggcaacagcagggcgccatgctgcaggagggctgccgctggcggaggaagcgcggcgcaatgcggaggagctgacgacgacaacggtggcgtggtcacccggaggggcgtggtcggggcggtggttctgggggtgtcgtcgtccgcgttatgcctgcaggccgcgctcgacgccttcgccggcgggctgccgccggaggagaagcccaagctctgcgacgccgcctgcgaggcagagctcgaaaatctgcctatggtgactacggagtccggtttgcagtacaaggacatcaaagtcgggcaagggccgagtccgcccgttggcttccaggttgctgcaaactgcatcgccatggtgccaaacggacagatattcgacagctcgctggagaaaggccagccctacatattccgtgttggcgcaggacaggtgataaagggacttgatgaagggatcttgtcgatgaaagttggaggattacgtcggttgtacatacccggtcaattagcattccctaagggccttacatcagctcccgggaggccaagagtggctccgagcagccccgtcgtatttgacgtcaacctattgttcgtacctggtcttgacgacgatgagtgaaagcatcatcttgcatctttacaggaggcaactgaagagaatgattttctgtttgtgaattaccatatatgtagagtgacaattgttttcggcagcaaaatatacaaaactatgatgatttgtattaagtgcatagcaacctttggttgtgaatggaataatgtagccttagtgatataaagatatgtgctaatccttctactcaaaaaaaa

SEQ ID NO: 6039 - DNA, 1455 bp, Triticum aestivum
  unsure (1)..(1455): unsure at all n locations
  Clone ID: PAT_TA_6039
ccgcgcccgccccccgccctggccccacctccgcacgcgtggacacgggccgcgtgcagccgtgcagtgcatgcccgctctcctctcctctccgcgaccatcattaccaggggcagcgccgtgcccgtgtcctgtcctcacctgagcgccatcgaagaatcatttatacgcgcccagccgccaccgccagcaacactgactgcgccacaagacgagcaagcaagaggaagaggtgaggaatccgatggagcagtacgaggtggtggagcagatcggccggggcgcctacggcaccgcctacctcgtccaccacaaggccgagaagaagaggtacgtgatgaagaagatccggctgaccaagcagaacgacaagttccagcggaccgcctaccaggagatgtccctcatggccagcctcagcaacccctacatcgtcgaggacaaggacggatgggtcgacgaggggacctccgtttgcatcgtcacaagttactgcgaaggaggtgacatggcgcagaggatcaagaaggcaagaggcgtcctcttctcggaagagagggtgtgccggtggttcacacagttgctcttggcccttgactacctgcactgcaaccgcgtgctccaccgtgacctcaagtgttccaatatcttgttaaccaaggataacaacatacgacttgctgatttcgggttagcaaaattactcatggaggatcttgcctcgtcggtagtaggaaccccaaactacatgtgcccagaaatactcgcggacataccttatggttacaaatctgatatatggtcgcttggttgctgtatgttcgagattttagcacaccgctctgcattcaaagctacagacatggcaacattagtcaacaaaataaacagatcgtcaatatccccaatgcccccaatatactcatcgtcactgaagcagatagttaagagtatgctgaggaaaaatccagaacatagaccaactgctgggggagtattggagacacccatatttccagcccgtatctgggctggaatcaaatccaactgctctccatctaccttccaagtaaaacccaaagaagagtaacctggggagacaagcagtccaagaaaccaaagtgggcggcaagaaagaganccngcaaagcaacggttccaagcgaancattacaagcagcagcaaganaaacaaggggaacaaagagacagtccgacaactatcngntctacnacgntgggaccaagntcctgcatttgcaangtcatggttctgaancaagaacaaggaagantaacancatgtttancactcaacagtnaggagattggnaacacaatgatggcagatgatggacatagtctaaactacagaccgatcataagntgcccggtaatgagtnaacttagngtcattcaanagatgcattgtggnangcagaggttagnatccnn

SEQ ID NO: 6040 - DNA, 734 bp, Triticum aestivum
  unsure (1)..(734): unsure at all n locations
  Clone ID: PAT_TA_6040
gctcggcgcgaggccctcgctcccgctccaatcttcctcacccccgctctccgtgtgggcggagcgaagcgagagccaagccagccgcccctctccccctccccttccccgcacccgctcccgttcgccccctgccccctcccgctccctttctcttcccctgcccccgccgccacccgcagccgacgccaacgagctctatgcgctatgagccggctgctcggcgaagtccgttcccaggctgccggcgtgttcaatcggctgactgcaccgggggccaagcctgcagcctcgttggtcccgcccgtcccccctgcctcagcggccgatgtgaagccaagtcgctggcaccccgttctagaccaccacgatccggagtgccgccgacagttcctgtacccatcacgcccgcgtcaacgaccgccaagttgctggcgccccgttcctgaccaccacgatctgggagcgccgcccccgggtcccgtccccatcacgcccgcgtcaacgaccgctgcggaaccctcctcggcctcctcctcaacgatacatggcaagaacccggacgaccccgtccccttccccgtctcctccactgcagcgccccgcgccgtccggtcgtccgttttccctatctgccngaatatgtgtgggttttgaccctttcgttgcctttccatcatgttngtatatcctttttggatcccgattccccatgcctggngcgaattcnccca

SEQ ID NO: 6041 - DNA, 723 bp, Triticum aestivum
  Clone ID: PAT_TA_6041
gtgcaggagagccagacgctgcgggtggacatggacggcatgaggagccgagtgcagggcctggagagggagtgctccagcatgcggagggcgatcaagaagatcgacggcggcgcgtcgcccggcagcgccggcccggacgcggacaccccggcgggctggcggtcgcggtaccggtgcaagttcagcacgcaggtgtgcgactcgcaggcgcgcgacgcggtcgtgtccagggcgtccaggatggggatgagcccatgaccgaccgaaccatgatggtgtacggtgcaacggtgcgcaggatgatcggcgccatctcccattccgttcgaacgcggcgtgtttttcacgatcagggaagagctcgacactcgagatgaaaatggctccgacttgagttgccacggctagccagacgagagagagtgaagacccgagatcgagcgcggcaaaaatgtctcaccccctgtcatctcgtcggcacgtttgacgcacccgattcgtgtgaccactgccaactgcgtgggcagcagcaacaggggttgttcatgtgcggtgtctgtacgatatgcttagcttgtgtgccccgtgattatggcctttgcaccttgtgatgtggtggcagtttatacggcattggtgtcctgttgtgcacgaagcgtgccttctgtcttggctggtattgtttcatcattagctgtttctaaaaaaaaaaaaaaaaaa

SEQ ID NO: 6042 - DNA, 1266 bp, Triticum aestivum
  Clone ID: PAT_TA_6042
tcgagcggccgcccgggcaggtacagaatcaaaagaaggagagagatggtggagagtccatgaagcttgcatcaagggtatactgttgttaagaaggcacaagatatagagccgttggaaccaactggttttgacctgtatgatgcaagggggcctcccagtagtggccgcaggggtcgtggaagaggaagtagaggaggtagcaggggaggaagaggtcgaagtcgaggtggaaggatcccaagaggtattagcagctcatctaggattgaatttatggatgaggatgctgcatatgagaaagccccaagaaagaacgcacgtcgaggacgtggccgtggccgtggccgtgggcgcggacgtcgaacagttaggcctcggcagccattatctgagggcagaggcagatcgattccaaaggctaatctgttgggaagcttcagcatgcttagcaatgtgaagccttctgctgttgaggagtccccacgaagctcaggtgcagaagagtggggcttggagagcagaagaccgtacatccaaggtgaaggtgatgagaacagctctggatccgaatcagatcaatcagaagacaacggggaaaacggccagcccatggacgaggagtatgaggaggagcaggttccagattactcgagagcctattctggtggattgagaccccttgcccatgtcatgatggatgatgagaccgaggatgatgatgaagatgctgaaggggacggagagggtgacgaggaagaatatgacgtgaaccatgcttccgccgatgttgatgatgagatggacgaggatgatgatataggtgatgatggggatgatggtggtgatggagttgaggtgaatgcagatgaagatgaaggcgcgacctcatactcgtcagagtacagtgaataagagcttctgtctccggtgaccatttatgcaggtagtgatactggtggacaataataagccttttgcccctttttgggggcatagtgggctagatgtggaacggggaagctgttgctcggtaggttggtatgtatgtagtacagcagtcaggtttgtattggttatctggtggcacatcatggtggctgcctcgacaatctgccagtgtaaaaagtgtgtgccttgttagtttactaattcgttggagcagtgcaattccctcatgtgtacaagtacaatgtgcccaaggcagagtataatttttatcagaagagctgcctctgttctccgttgcatgatataaaaaaaaaa

SEQ ID NO: 6043 - DNA, 870 bp, Triticum aestivum
  unsure (1)..(870): unsure at all n locations
  Clone ID: PAT_TA_6043
tnccnagtcacgagagttttaaaaangaccggcccagngaatttntaaaaaggacncacntttngggggggaatttggncccggaaggtnggaatgntccccggcccncccattggcngccggcggggantttggatnaggctagcgtggtcgcggccgaggtacatgttaactgatgttgggcctccacaacccactactggcatgactaaaagagccagtcttacatcttttgttagggaagctactatacatcttagacttgtggagtaatttacaagatgcacatacaaatctcttcggcacctgaacaaaatcactaattccaacacacctagtgtgctgccacacatggcatgagtcacaagatagcatcctctcaccatcatcatccttcgctccacatgaacaattaactgtccatttgtctacacccctctccattcgataaattgcaaccctgcgctcacctccaacacacttgccttggatgctgacagtcccttttgctccaaataagagcttgacttgagttgtgtcatctgcagttggacaatcaagaagctggtttgctacaaagctttgtagcatcaagtagatactttggaatgttctcgacctgcccgggcgcccgctcgaagccgctgcggtttgcccaagtgccccgcgtgccccccggtggctgggtccggcaccaacccgatcctcgggccccacttggccccagatgtgcagcacagattggttttgagtgatattgttgccttattagattgcaaatactgaacattggtgataaaaccaaccttgtctcaaacaattgaaccatcaggccacaacgccggcaggttttgcagctggccgttttgt

SEQ ID NO: 6044 - DNA, 617 bp, Triticum aestivum
  Clone ID: PAT_TA_6044
tcaccgcattacaagtccgcggcacccccaaattctttgctgattgggatcccgcacgggagctgcagggcgagcagctgcttcctttcccaaaactgcaggaactcgagacggatgaagtggcaggagtccttaccgcgcccggctgccgcctcctctcttcctccctcaccaaattatcttttgaacacaacaaagaggtggagtgcttcaccaaggagcaagaggaggccctttccctcctcaggtccctccaggacctccaattccagtggtgtcctaagctgcggcgcctcccagcagggctaaacaagctcaccaacctcaagaaattattgatctggagacctggagccatcctgtcgctgccaaagaatggcctccctggctcgctgcaagagttagttgtcgacgattgcatcaagctgcggtgtctcccagcagggctacacaagctcaccaacctcaagagattacagagcaggctgtgtccagccatcaggtcgctgcccgagaatggcctccccgactcgctgcaagagttagatgtcagatgtctcctcaacaaaaagctaacacaggaatgaaggcggttaatggggaccatcccattgatc

SEQ ID NO: 6045 - DNA, 1015 bp, Triticum aestivum
  Clone ID: PAT_TA_6045
aggcaaaggtgccccacgtggaggttctggagcgagtttcttctatcctcaaggagtatgggttttgcccaactggagaaatcgttgatgttaagaacctctgcccttacaactgctgcgtaatgtctgatgaagagttattccaccaagggcttatgaattcaaccaagggagttacaggaacagataatccgtgtgctacaatggaagaagtacatgctgcggaaaagtctctgcctaaaggatgggataacacattcacaaggagaaagttcttcccatattggagatcagtgctacaggcccgggcttttctgcgggtgtacccatcatatgcaacagcagatgccagtcgacctactgtgcctactccagttccaggccataagcttccctcgctgggaaaagctccacaactgttaagcaatcgtcaatccagaagactttttggtactggcgcatccgcggctaggtctgcacttggttatgaagagctccgccgctcccggggtagctcaatggacagcactccaagtcaaattcacaacctttcactgctggtaggagttgcacaagtaacaaatgatcatggtcaatctagaagactctttggtactgctgcgtccatcctcctgaaggtggcaactaaagtgtgagtggttgctggtgcgagcagtcattcagtgcatttttctcctagatgggaagatgaggctgctggtacactgtatggccgcctggtgatgccggactggcaattaagttactgcttgtattttgcagcttgtaagagcattgtgtatggccgcctagtgatgccggactggcaattaagttgctgcttgtattttgcagcttgtaagagcattgtatggccgcctggtgatgccggactggcaattatgttactgcttttatgatactccggatagactcggcgtattcatttcatctgaccaaatttgttactatttatgtttcatgaaaacgtaagtttagtttggaaaaaaaaaaa

SEQ ID NO: 6046 - DNA, 1188 bp, Triticum aestivum
  Clone ID: PAT_TA_6046
tcgcgccgccgcccccgcaccccctccccaaaaatgccagctgccccccctccgagcctgctccctcctcggctcgcggcataggcggccgccgccccccgtcctcaacagcggccgccgcatcttctcggcacccacccgcagcgccttctctcccctccgcgccgccactctgaagcccgccttctctccggcatggccccaacggccacctcctccccccccaccggcgagaccccagccatccaagttgatcctggggtcttcgtcagtggccaggaagaacatcctcaacgagatggggttcgagttccaagtcatgaccgcggacatcgacgagaggagcataagaagggaggatccggatgagctagtcatgcttcttgcggaggccaaggctgatgctatcatgtctagaatgaacatttccgattaccagaaggaaggcgaccaaccaacactcctgatcacctctgacatagtggttgtccatgaagggattattagagaaaagccaagcagcaaggaagaagcacgccaattcctgaaaggttattctggtgggcatgtgtcaactgtgggtggtgtggttgtaactaatcttacgactggcaagaagcttggcagtttagacaaagctgaggtgtacttccatgacataccagatgagataattgagaacctgatcgatgagggggtagtatttagggttgcgggtggcttgctgctagaacatccattggtgttgccgcttgtcgaagcagtggttggttctagtgacagtgtaatggggctatcaaaggatctggcaaacaaactcattcacgaggcattgttggcatagcctagcagtttgggtgtgatcgccatcgatcgaatccttactgcactgcatgaaggtaatgcgatggcgaaaacctgtcgagacatggtgattgttatcgtttgaattatatgaagaattccaggcaccatggcacgaagattcattgagtgtgcaagaacacttcagaactgatgcctgctattgtgatcactgatgagatgtcacctgacacatcctcctgtggaaacatcctgaatcttggttctcacataaggtgaatttgtatgatacgtgaaattgttattttctcttctggagtacattgttatgcagatgcaatgacaccgccttcttgtttgcaa

SEQ ID NO: 6047 - DNA, 635 bp, Triticum aestivum
  Clone ID: PAT_TA_6047
agggtgcaccacttctcttctgctgccgctcgcacagtctcgcagctccccatacctcaccgctttgctcgccacacgaaggcgagagacgaatccggccgagcctccgccgccgctcagctcttccgctcgggacctcgcctcgtcgaggcggagttcctcgcgccgtccgttctccattcccggcaccagttcaggcttcgtactccagctccagctgcagtgtgacccttaccaccgggacggtggcgcgcgcagggggcaaaatcgtattgccatggcggttcagtagaatggtgcattcggggggcgcaggctgccaccggtgtggtttgtggccaggtggatccgccccaattatcgttgtcaccgtctcgatgatgcgcccttcccgtttcagagcacatgcggtgcatttagattgtccccctagaactgaacagagaaatgttgacgatttagtggtgatgaggccttaccagcggcctcggtcaggggacgatttcgccaagcggaagaatgcgggtaatgtggtagtaatgcggccagaacgaagaatgcgggatggttcggtggatcgtgcagcccctggaaatgtcagagcagctggggatgtcgagagggccattttgtcc

SEQ ID NO: 6048 - DNA, 502 bp, Triticum aestivum
  Clone ID: PAT_TA_6048
ttttttttttttttttttttttttttttaaagatgattgggccaaatttgatttataatctccctaaaaaattacagtactcgcatcaattgttcgctgattctgaaatgccacctgctacaaatctacaatctgacaatcccaaagaaaacctaaataataatattatatgtaactcccctaattctgagtttcagaatatgccactccatgtgtcactgaaaagtgggcatgggccctgcatgtcagtgatcttgaaggggtcacatcatgaaatgcaacttaagaggagtgacattaaaaatcattcaaacaaagataaactattacactaggtagggaagacattatattccagctaattttcatgtgcgcgggcaacggcgcgatgaaccttagaagattcggcttctccttggaccatggggtgccattatcatgccactctccggtgttactcaggaactttgcgatgtttgggaacaccatctcccggcaatgc

SEQ ID NO: 6049 - DNA, 973 bp, Triticum aestivum
  Clone ID: PAT_TA_6049
aggctcctgtgccaaggctggaatcggaccatggaagctccggaatacttcgtgtgcaaccctgcaaccaaccgagaagatctggtcggtgctgcctgcaccagagcctgtgccgttgcctggagttcagacaagctacagtttctgtttgtgttccgaccctgccgccccctctcgcttcctcgtattcgtgttcgttcagagagactattacatgacattaagggtctactcatctgataccggagagtgggcgtccacggcgagcggtcgccgaatggtgccgtatggtggtgaaacagtatatgacttctttaatgatgctctgcatttcactgctgctcgtcttggagatgatacaccggggaaagtaataccatcggtatttacagtgagcacggacggggttacttggaggaggtttcgagtcccatctgaagttgaattttctttcattgggcagtctcaggggcgcttatacggtttggacatagagcatttcatgattgcttgctatcagtttgggtgctcgaagattatgctagtggacagtggaccttaaagcacactgcttccattatggaactgctaggaaggccttattgtgagctcggtgagcaattgatgttggttgcgcttcatccagaatgtaacctgattttccttgttggttggatgagatcgcaagagacacttatgtcgtatgatgtggatagtcagaaactgcacgttatcagcaccttgaagattaccagatgacaacattccgaccttacattccctgctttgcggaatggctgccgtcagatgctcactgaattccagagcagcttcacatttgctaagttggcatggctccttcatggaaacctgttgttgggtatggtccagatcttctagctttggtcagtggcttggacaagtcctacatctgctctaatttggcttcttatcagtgacgtccaagtgaatg

SEQ ID NO: 6050 - DNA, 1175 bp, Triticum aestivum
  Clone ID: PAT_TA_6050
cgttgctgtttcgattctattagatacctactagaaacttacaaatacaagacttccaatttaaatctacaatctatcttagtacagacatccatttcacacaacattaaggttacgcacacaccccaccaacacacacacacatcatatgccacacgtttacgcccccgcccccgtcgcctcaaccacgccgtctagataagccccatgtcatcgtcgtcgccgtcgtagccttgtcgaggtcgtgatgttgtcgtcatcatcgtcgccgcagccccatctcgacagcgtattcgtctccgccgtttcgtcgccgccgtgttttccttactatgggctccctaatcgtggtagcagccaacgcaccatcacaccttcatggacgtcatagcaacatgtcgcagtcttccaatatttatcagactgctggaacgccaagtctctttagctcatcgacccagccctatcattcttatagtagaattatgaactatcagcgacatgatcctgcattctcggtcacgaggggtaaaaggacccgaaccgactgctccatgctaagcacgacccgagcttatcattgacgccgactcgaagattctgaggacgctcgcagcatgcctagccgctgtaccaagaaggcggaaacgagcggctgctctcgcgcacgcaagcaataagccgtcagccagccccgagtattcccaacattgtaccctttactgtcaggtcactcccatttaactcttggttgcagatgtattattgttgtagtactagtaatcatcagcagtaacagacacttggtgtgtcaaccaataagcatcagaaccaacaatgatctctctagctacacaatcgttctagtattacggtctatttgactagcaggaaaacagagttgttcttaaaacagaacagaggggagtttgtaggtacctgggtttggccgtggacgccgaatccgggcccctcagatatccgtctactgcacttctccctcctcgtactttcctgccggctcacaggcccgggcgagggcaccctccatccggctcttccctcactgacagatcttttcctcttcccccggctgttcacccccctgctttcctccggtcagacgctcgctcccccccagccgctactcacctcctccatcagcctcgtgccga

SEQ ID NO: 6051 - DNA, 592 bp, Triticum aestivum
  Clone ID: PAT_TA_6051
aggccagccgcggcacaggaccctggcgtgcacggtgcaggaggtggaggacgtcaagatcgtgctcatggtgctccccatcttcctctccaccatcatgctcaactgctgcctggcccagctctcgaccttctccgtggagcaggcggccacgatgaacacccacgtcgggggcctgaaggtgccgccggcgtctctaccggtgttccccgtcacgttcatcatactcctggcgcccatctacgaccacatcatcgtcccgttcgcgcggcgggtaaccgggacggagatgggcatcacccacctccagcgcatcggcaccgggctggtcctctccatcgtggccatggcggtggccgccgtcgtcgaggtgaagcgcaagaacgtggccaccgacgccggcatgatggactccacggcgccgctgcccatcaccttcttctggatcgcgttccagtacctgttcctggggtccgcggacctgttcacgctggcgggcctgctggagttcttcttcagcgaggcgccgccgcggatgcggtcgctggcgacgtcgctgtcgtgggcgtcgctggcgctggggtactacctg

SEQ ID NO: 6052 - DNA, 885 bp, Triticum aestivum
  Clone ID: PAT_TA_6052
aggcgtgcatgcagatgaaccccactcatgctcgtgcgacacaagtgctatgatcattggagaccccggacgtgggaggcgacaggcaaattgtgcaaggatcattggaggttccggacgtgggaggcgacatgcaaacaatgcaaggatctttgggggcaccggacgtggaaggcgacatgcaaacagtgcaaggatcattggagacccccgacgtggtgggaggcggcatgcaaactgtgcaagggctagatgtggtgggaatgaggccacaggaggtggttgcttttgacaagctaaaatggttttgctctagcctggtcaagaagctagcaccaccacttctcaaggaagtgcaagcgtcgggccttcggccagaggcggagcatttacaccgcgacgcaccacgcgcgcaacgaagcgagcgccccagagcaagcaaggaaaggctactccagctgagaacgcccttatgcatgcgctcgggctgatgccccaagatctggaggtagacgaggcaatagtggatgagttgcagcagctctttgactcccctctgcgtactcagcatgtcagggtgatcgccgcgttatttgggaaggagttcccgactgggagtgagctgcacagcgagggcgggactgtcggtcgtcgcgcactaaacgtgcagctggtgctggatgtttgatcctgttatggatttgaacccgcatattttatgttggaatgtgaggggccttaattgccctgccaaaaaaaaggcagtccgggagtttgtgatttcggtgcaagttaacctagtgtgtttgcaagaaacgaaactagatgtaattgatcccttcataactatgcaatgtattgggccgtcccttgacggctttgttt

SEQ ID NO: 6053 - DNA, 650 bp, Triticum aestivum
  Clone ID: PAT_TA_6053
gacttgctgtagttggtactgctgctaccatcccattaccacgcgcccctttctctccccgccgagatcgatacacggatagatctcgcctcgccggcgaagcgggagaggagaaggacgccatggggaactgctgctctgacgagatgggcgccggccgccactccgttggccccgccgcctcctccgccgatgccgcttccgccgtggctgatcgcttcctccgctcccgcggcgccggcgcgtccacgcagatcgagttatctctctccgcatcaaatttgggcgatcaagaatatttcttcaagagcaatcccatagtcgttgtgtattcgagcaatgacggagcacttgaagaaattgggcgcactgaagttattgtaaattcatcgagcccgtcatggaatgcaaagatcattttgcaataccagtttgaagttcttcagccattggtgtttcatatttatgatattgatccgcagtttcatgaagttggtgaaaagatgcttaaactggaggagcaacagtttcttggagaagccatctgtaatttatccgacgttatcaccaaacagaatagattgttcaccctaaagcttggtgtttctgagcacaacttaccaaatcctagtaaatttggtgagttaact

SEQ ID NO: 6054 - DNA, 799 bp, Triticum aestivum
  Clone ID: PAT_TA_6054
ctcatgcacttttgtctggccagttgattctggaaatgaaattcatatgatctcatctacgcaagctccccagaagcatcagaagtatgtcgctaatgctcttggtcttccactatcaaaagttgtttgcaagactaagcgtattggtggcggatttggtggaaaagaaactagatcagcaatatttgctgccgcggcatctgtagcttcccacgcgcccggaaggccagtaaagattgttttggacagggacgttgacatgataacgactggacagaggcacagtttcctagggaaatataagcttggatttaccaatgacgggaagatacaggccttagatctcgaaatttacaacaacggtggtaactcactagatctgtcccttgcagtcttggagcgtgctgttttccattcggaaaatgtgtacgctataccaaatatcagagtcagtgggaaagtatgctttacaaatttcccaagcaatactgcttttagaggttttggtggtccacaaggcatgttgattgcagagaattggattcatcacatggctacagaactcaagcggagtccagaggagataaaagaacttaatttccaaagtgagggaactgagctttattatggccagttgctccagaattgtacaatgcattcggtttgggatgaactgaaggcatcttgtaatattttggaggctcgcaaagctgtaaatgtttttaacagtgaaaatcgttggaggaagcgaggcattgctatggttcccacaaaatttggcatatccttcactgcaaaa

SEQ ID NO: 6055 - DNA, 1309 bp, Triticum aestivum
  Clone ID: PAT_TA_6055
ccacgcgtccgcgcacgcggccgggcctttgaaagaaagctcaagaaggaagtcgatagagagatgaagggagagacaatggacgggagcaaagggccggtggtggtgactggagcgtcgggtttcgtagggtcgtggctcgtcatgaagctcctccaggccgggtacaccgtccgggccaccgtgcgcgacccggccaacgttgagaagaacaagccgttgctggagcttcccggagccaaggagcggctgtccatctggaaggccgacctgagcgacgaaggcagcttcgacgacgccatcgccggctgcaccggcgtcttccacgtcgccacgcccatggacttcgactccaaagatcccgagaacgaggtgatcaaacccacggtggaagggatgctgagcatcatgagggcctgcaaggaggctggcaccgtgaagcgcatcgtcttcacctcctccgccggcagcgtcaacatcgaggagcggcagcggccagcctacgaccaggacaactggagcgacatcgacttctgccgccgcgtcaagatgacaggatggatgtacttcgtgtccaagtccctcgcagagaaggccgccatggagtacgccagcgagaacggcctggacttcatcagcatcatccccacgctcgtagtcggcccgttcctcagcgccggcatgccgcccagcctcgtcaccgccctggcgctcatcacagggaatgaagcccactactcgatcctgaagcaggtgcagctggtgcacctggacgacctctgcgacgccatgaccttcctcttcgagcacccggaggccaacggccgctacatctgctcctcccacgacgccaccatccacggcctcgccaggatgctccgggacaggttccccgagtacagcatcccgcacaagttcgcaggcgtcgacgacgacctccagcccatccacttctcctccaagaagctcctcgaccacggcttcagcttccggtacaccgccgaggacatgttcgacgccgccatccgcacctgcagggagaagggcctcattccgctcggagacgccccggcgcctgcagctgccggcaagctgggagctcttgctgcgggcaaaggccaagccattggtgccgagacataataagccagcgctgctgcatgaatactattcttgtgttcggaatttgcatgggcagagccctgcaactagtgggatatcatggactatggagtgcatcattttttttccacctcggtagtagtatgaaataaaattgaaaattacgcataaactttaaaaaaaaaaa

SEQ ID NO: 6056 - DNA, 777 bp, Triticum aestivum
  Clone ID: PAT_TA_6056
gacgtgctctcactctcccttggcggtgacacgagtgccagcttcgatgacgaccccattgctatcggtgcattcagtgctgtgtccaagggcatcctcgtggtgtgcgccgccggcaatagcggtccgaggatgggctcgatcaccaacgaggcgccgtggttgctcacggtcgccgccggctccgtggatcggagctttgctgctggcctgcatctcggcaatggcaggagcatcgacggagaagcacttacccagaaagtgagtctgagttcaaagtcacaccctctcctctactccgaggaacgacggaactgcaattacaagagtgacagtggcatcaccggtaagatcttccccggcctgcgcgctaggtcgaagactcaacagtccaacatccacagaatagtgggtgctggtgcggctggtgtggtgctgttcaacgatgaaatcagcggctacgccaccatggttcaggatttcaactccagtgttgtacaggtgagcgcggccgacggtgatgtcctcatagcttatgccgcgtcatcagagagcagctccatggcctctctcatctacaacaacacactgtttggtgtccgtccggcccccgttgtgccctttttctcttcccgtggtccaagcgtcgtcgccctcggcatcctaaagccggatatattggtaccaggcctcaatatcctggccgcgtggccgccaagcacgagctctggaaggggccctctttacatcatatcatgaacatccatggcgaggccc

SEQ ID NO: 6057 - DNA, 379 bp, Triticum aestivum
  Clone ID: PAT_TA_6057
ctgcggagcctccgtgtaagtggaaattagtaatgggtctagctagtctagtctagatagcactgttggtggtgagtccaacgggttaaacatgtctctgctaactctcgagagaaaggacggagccattttaactactcctatattatatgcgtgtgcctctatggtctatgcccatgtttttcttttctttttctgattgagtatggccacgtgtgtctgtcaatttgcactcagtgacacgaaatgagcaggaccgagcgggcagaatccaaaaaaaaaaaaaaaaaaaaattaaatcaagctgccacttctaataggatccaaccctaacctatgcgttcaatgctacgttcaaagctcttcgatactgtcacct

SEQ ID NO: 6058 - DNA, 591 bp, Triticum aestivum
  Clone ID: PAT_TA_6058
aggattcccgccacgtggccaatcaggggaaaggcaagaaacggtcgatccacggtgccggcaatggcgtcccgtcgggccgtcctcgccttggtcgtcgctgtcgcggcgtcggcggcgtccgttgcagccgacgatccggactacagctacgtgtcggggaccaagctgggcccggagaactgggccaagctgagccccaagtacagcgcatgcaacggcggcgccgcggcgaggaagcagtcccccatcgacatcgtcaccaagagcgccgtccccaagcccgacctcgaccccctcacccgcacctacgtcgccaccgacgccaccctcatcaacaacggcaaagaaatctcgatgacgttcaacggcaagcctggcagcgtgtccatcggcggcaaggccttcagcctcaagaagctccggtggaagacgccctccgagcacaccatcaacggcaagaggcacccggtcgaggtccagctcgtccacgagagcgacgccggctccggcgagctcgccatcatcgccatcctctacaagctcggcgccccggactccttctactaccagctcaagcggaagctggcg

SEQ ID NO: 6059 - DNA, 789 bp, Triticum aestivum
  Clone ID: PAT_TA_6059
aggatctacctcaaggtctccgtcatcgcggcgcaggacctcatcgccgccgaaagggccggccgctcgcgcccaccatcgccaagatacagatgggcagccatatcaggcggacgcggccggggcagccgcaggggtcggcgaaccaggcgtggaacgaggagttcatgttcgtggccagcgagccgttcgaggacccgctggtggtcaccgtggaggagaaggtcgccgccggccgcgacgagcccatcggccgcatcatcatccccgtggcgtcgccgtacgtgccgcgcaacgacctggccaagtccataccatccaagtggttcaacctgtcgcgcggcatgacggtggacgaggcggcggcggaggccacgacggggaccaagcaccgggagcactccaagaccttcgccagcaagatccacctcaggatgagcctggagacggcgtaccacgtgctggacgagtccacgcactacagcagcgacctgcagccggcggcgaagaagctccgcaagagcgccatcggcgtgctggaggtgggcatcctcagcgcgcgcggcctcggcggcaacaagagcccctactgcgtcgccaagtacgggtccaagtgggtgcgcacgcgcacgctgctcggcaccgccgcgccggcgtggaacgagcagtacacctgggaggtgttcgacctcagcaccgtcatcaccgtcgccgtcttcgacaacaaccacctccaccacagcgacggaaaggaccagaggatcggcaaggtgcgcgtcaggctcgcca

SEQ ID NO: 6060 - DNA, 1265 bp, Triticum aestivum
  Clone ID: PAT_TA_6060
gacccctcctgccgctccccccccctatctcctcccacccctatcccctctgagccgaggccgatccgctgctctgctcctcctgaaaacagccctaacagaggtcttcacttaaaggggacttcaagttcatggcccttaaccctctgtagccagccgacagtgttgcaggttcaggccgttccagcttcagtccctccaactccaagtcttattgttatcagccaaaacctcactcaagagcgcaaagcaagcatcaccaccgagaatcgccttcagagttcaccagtcctgaaatgcagccgcgtcgacgaggttgtccagtcccatcaggatcatcagactactgagatccccatactcctgcaccaatcggtcgttttccccggccagacgctgcagctgcagacggttgagttcagataccgcatcatgatgcagacactactactccaggaaggccaaagctttggtatcatctactccagcaggaaagacagtaggatggccgatgttggatgcatggtcaattatcgttcagtgcgataagcttgtcgatgaccgcttcctcctgacatgcgtcggcggtgaccggttccgtgtcctggaggtcgtcagaacaaagccctatgtcatcgcaagagtccaggtactgaaagacagagactcgcctgattcaagtaacctggggtgcctgatgcagcaggtggaagggcacctgaaggatgtgacaatgctttcagacaagctcagctggaaactaatgggagacaaggctaggcagctcagcaggatgcattctccggagtctttctccttggtcgttgctcggttgtttgtcaaagatcgttcagagcagcaatggttgctcgggttagatgacacagcacagcgattggtgagagaaggaatgtatcttcaacagaggagcaagtacctggcagccgtagcagcgattagggacgcctttgggcaactgtcctgcaatgagaagcagtagcagacctggtgcgttggagctgccattctggtaataggagtatgttcttgctgcattgtagtttgatactttgcttctatcgtaatgtgtatatattgtatatccttgaatgttcgtctttgtggtgaaacttcactaatttctggatgaactctgttactcagtcatgtatatacacaccatcgtcaaggttttcataaattatgaagggtatacagctactgatccagaacacatcaaacaaaacaaaaaaaaaaaaaaaaaa

SEQ ID NO: 6061 - DNA, 800 bp, Triticum aestivum
  unsure (1)..(800): unsure at all n locations
  Clone ID: PAT_TA_6061
acttaaggaggcagccaaaggggaggaagtatagagcactcatacttaagttcatcaaggatcgcatggcaacattgcttttggtggatgtcgggattcaggtcacaaccgtggttgcagccgggaaagtgggagatgaagcgagtgtcgttgtggaaatggttcatccccgcgacgacatcttatcagttacggagattgcacaagacacggaggagtaaatgctcgcaatgggtaatggacgctcattgcctcgctccctgggacatggatattcatttttggtgcgcatgatggaggtgattcattaccttgggcacttaggcgaggatctccccttcaggatcatgctctcgagttcggtatcatgcctgggattatggaatagaacacgcgtatggccgccctgtgaacgttcgagcagggtacaatcatctaactgtctcgctaaccacttttgaggctgaggcagttctgatgaaagcacaggtttggtttggttgaatttccttggggtccttgggcgtttaggttcgggtgctgagttctgggagtcatatttttntggtatacctagctacacgcacatgatccagggttgcacgatctggcgcccccccttctttgtcactggtgccgttgtgctctccatgcgtactccgggtactcggcgcggttctccgggtacatgccgggccccgcccgatccccattccgccgctaccnnccacggcgtctttnantctacggaaaccnngtaccactanccctgaaaacccttccacnntatacaagccccc

SEQ ID NO: 6062 - DNA, 748 bp, Triticum aestivum
  Clone ID: PAT_TA_6062
cggcacgagggtccttctgggcgttcctgcgcaagtactcgcagtaccgcgagatggcgcgcacgctggggctggagtacctccccgccggcgggccccggcggttctcgtacgcggagctgaagacggcgaccaaggacttcacggacgtggtggggcgcggcgcgtacggcacggtgttccgcggcgagctccccgaccggcgcgcggtggcggtgaagcagctgcacggcgtgggcggcggcgaggcggagttctgggcggaggtaaccatcatcgcgcggatgcaccacctgaacctggtgcgcatgtgggggttctgcgcggacaaggaccagcgcatgctggtgtacgagtacgtgcccaacgcgtcgctggacaagtacctcttctccagctcctcgtcggcggcgccctcccgcggcgacgctcaaggcgacggcgaggagagctcgcagggtgagggccaggggcggcagccggtgatgctggacctgcacacccggtaccggatcgcgctgggcgtggcgcgggcgatcgcgtacctgcacgaggagtgcctggagtgggtgctgcactgcgacatcaagccggagaacatcctgctggaggacgacttctgccccaaggtgtcggacttcgggctgtccaagctgacgagcaagaaaggagaaggtgaccatgtcgcggatccggggcacgcgcggctacatggcgcccgagtgggtgatccaccgggagcccatca

SEQ ID NO: 6063 - DNA, 464 bp, Triticum aestivum
  unsure (1)..(464): unsure at all n locations
  Clone ID: PAT_TA_6063
cactggccagccagtagccagtagccactgcgaccactgagggagaggcacggatcacggatgtcaagcatggcatccagcaagaggcttcttgtgttcgctctcctgcttgctgctgctatcctcgtcgcctcgactgatgaacaccctgaggccaagaaggaagagaatgaggccggcgtggagaacttccactttggcggaggccaccacgggcacggaggcggcgggggaggctacggcggaggcggaggcggaggaggttacggcggcggcggagggtacggcggcgggggctacccaggcggcggaggaggctatggcgngcggtggcggctaccctggccacggtggggaaggcggtggaggttacggcggcggcggctacccacgccggccggacggacgctaccgccgcggtgtgcggctaccccggccccgcgggggaggaangcggttggagt

SEQ ID NO: 6064 - DNA, 811 bp, Triticum aestivum
  unsure (1)..(811): unsure at all n locations
  Clone ID: PAT_TA_6064
gtgtgatctttctgagctgcccgccgctcaacgaggagctgctcaaaaaaatcaaccagcactgcactcagcgagattgtgcggaccaacgaaacctgccgtctctactctgaagcatgtatatctgtatcgaaagagatggacatcaaggtggtcgatctttggaacgccatgcccatagcagacagaggactgggccacagcatgctttacggacgggttgcatttgtcggaagaggggagcaatatagttgtggaagagatcctgaggatcctcaaggaggcggaatgggatccatgcctacactggaaggcgatgccgaccgagttcggggaggactcgccctacgaccttgtcgcctccagcggcaaatcgaccatcaacccatccgagtggactttccacaggaaaagatcatgggaatgaacggatcgccaggacatgtgtgagatcgagcagctgcacgtgatattttgcgccggtgctcttcggtcgctttgtgttattcatctgatggaagaacgtgataagatgtttctgaattgcaagggtccatcgagtcgtagaattaataatggacatgtttgagttgaacaaacgttgagctgagttgggggtggatggatcgctgatgtataccggctcaaagatgtagtgttctacgtttcctagtatgaattgagcatgcatgatcatctancnacatttgggttaatgctggaattcgtggnaaggattgattgtatacccacagttgccnactgcatcaacnatcaaagntggagttacctcctatttaaaaaaaaaaaa

SEQ ID NO: 6065 - DNA, 630 bp, Triticum aestivum
  Clone ID: PAT_TA_6065
ctccactccagtccacagagagcacgcgctgcccaaaaccctcgtccccgccgcggcgcttccggcgacggccatggacacccgggtgccgcccgttcccatggatccggcgacggcggagaggctccggcgcgacggccatgacccggatgagatggaggccgtcttcgcccgcgtgctctcccggatccacttcgccctcccggaccagtccgtctccgtcgacgctcgcctcttcggtctcctcccccacgactcggtcgactgcgtcagccgcctccccgacgtgctcctccgcaacatcgtctcccgcctccccgtgaaggacggcgcgcgcaccgccgcgctctcccggcgttggcgcggggtctgggcgctcggccccgctcgtcctcgtcgactcccactccccccccgcgggcaccgcggccgcgcgcgctgacgctcgtcgcgtcacctccgccgtctcccgcatcctagacgcgcacccggggcccttccgctgcgtccacctcaccagcagccacatggaagacttccctggcctgctcgcgcgctggctccagatcctcgccgtcaagggcatccaggatctcgtcctcgtcaaccgcccttgggcgctcgacttcg

SEQ ID NO: 6066 - DNA, 541 bp, Triticum aestivum
  Clone ID: PAT_TA_6066
ccacgcgtccgccggagcggcccagctacgacgacgcgggcttcggccccgtgccggcgggctggaagggcaagtgcgagggcgggagcgacttcaactcctccgcgtgcaaccggaagctcatcggcgccaggtacttcctggcgggctacgaggcgtccaagggccccgtggacacgtccaaggagtcgcgctcgcccagggacaacgacggccacggcacgcacacctccagcacggcggcgggctccgccgtgcgcggcgccgacctgctgggctacgcttctggcacggccaagggcatggcgccgcgcgcgcgcgtggccacgtacaaggtgtgctgggtcggcggctgcttcagctccgacatcctcaagggcatggaggtggccgtcgccgacggcgtggacgtgctctccctgtccctcggcggcggcacgtctgactactaccgcgacagcatcgccgtgggcgcgtacagcgccatggaaaggggaatatttgtgccctgctcggcggggaatgccgggccgggcgcggc

SEQ ID NO: 6067 - DNA, 1172 bp, Triticum aestivum
  unsure (1)..(1172): unsure at all n locations
  Clone ID: PAT_TA_6067
agctccgctcaagaagtanaaaacgccctcaactcgcctgtcgcggaggctgtggcctgtgtcaggtgtcaggcgtgcaggagaagatgccgccgccggcgacccctgcccctagcgctaccgtgcacccatgcttgaggacgcacggaaaagaggtcgctaggctgcacctgttcgactggatcgtgctgctcctgcttgtcgccacgattggtttgctgggcctggtccagccgttccaccgcttcgtgtcccaggacatgatggcggacctccggtaccccatgaagcgcagcaccgtgcccgactgggccgtgccggttattgccgtcgttgtgccgatggttttcatcgttgggatatacatcaagaggaggaacgtctatgacctgcatcacgccatccttggcctcctgttttccgtccttataactgctatcggtgaccgttgcgatcaaggacgcggttggtcggccgcgcccggacttcttttggcgctgctttcctgatggagtgccgaagtacaacaacgtcaccggagatgtgatatgccacggtaaaccgggcgtaatcaaagaggggtacaagagcttcccgagtgggcatgcttcaggtgcttttgctgggcttggatttctgtcatggtacctggccggcaaactgaaggccttcgaccgaagaggccacgtcgccaagctctgcatcgttcttctgcctctcctttccgcgacgatggttgcggtatcgcgggtgacggactactggcaccactggcaggatgtgtttgctggtggagtccttggattgggcggttgcttcgttttgctaccttcagttctttccgccaccctacagtgaacatggagtttggcctcatgcgtacttggagcacattcgtcgtccggagggtgaaatgcaagcgcaatcaacaacaaactcgaatatgcaccataactcactgccccttgatctttctggatcaaatgagacgagaaccaccagccatgcactggattccatggaagaagggagcagagatcagtgacagatgaatgcaaggtttcctcttatttatttccttttcttttgtattacaggcagacttcataccgnggcactacgttaaaaaaaggtcaataggaccggccattaaccgccaatagcaaaattat

SEQ ID NO: 6068 - DNA, 713 bp, Triticum aestivum
  Clone ID: PAT_TA_6068
ccggcccgaggcgtcgtgcaggccacgcgccccccctgctcggcgaggtggttgctcacccgcggcctgccccaccgcggtccaggccttccccggcatgcggaggccccgcccgctcctccctgcccagccccaaaggcccaactcccggcagttcaagccaccagctccctgctctcgaagtgctcggtatacacccaccgcctgggcgcccccgtccgcggccccttccgcctccgcggccccggacggccggccacgaggcaccccagctccgccaactcgttcagcccacaagctccctgatcacgaaagagtctgttttcaacccacttcctgatccacccatcaggtcacaggcttaaccctgtaatcgaagagcctgcccggtgcaccctgcgacaaccccaaatacccaactcctgatcgtggttcatgtggcccatctgaaggtgcatctgggggacttgttggaacatcctctgcatcgggcgcctggtccacaacgtaagccctacccgacgagcctgcacccaggagcatcgaccctgctaacattgtctcgcattcccatgggagcgagcatccgggctggcgctcgctggcttctgcccgtcctgggctgcgtctcctgggctcgcagaattttctggccagcttccccgggcttctgcccgtgctgggctgtatgtaccgcggccgcgaccacgcta

SEQ ID NO: 6069 - DNA, 546 bp, Triticum aestivum
  unsure (1)..(546): unsure at all n locations
  Clone ID: PAT_TA_6069
aacttggtaacacccctaaaaaaaattagcaaaccctagccacgcctcatcccctcctcttcgccgccgacgcatccgccgccgccgatccaaggcaagcatggcaggcagccaaccaggcgaaagcaacggcggtgccacggattccatccttaccgttgccggacagatgaagccgtttcctgcatacgctattagcctgttccgcgactacgacctcgagggcatcgcggccgcattggccgaagttgtcaattgctcgtacgaggtacagatggaagccttcactaaggctctggaacagtccaagtattctggtgccattggagcattccccaacgaaggcaaggccaaggacgaggaagaggatgaagatgaggagggcgtggtggatgaagatgaggaggacgtggtggatgaagatgaagacgacgaggtggatgaagatgaggaggaccgtgaagatgaagatgatgagatactgacgtttcaagtcctttatgaaggcgaacgagagcccaggccgccacgactagnggntttggt

SEQ ID NO: 6070 - DNA, 639 bp, Triticum aestivum
  Clone ID: PAT_TA_6070
tcggcacgagggaatgatcaaaatatgtgctctcagagtcattgttcttaagtaccagcatgaatatgacagtgcggtgcaatacggtgctgatcgatggtggtcggcgaggcggcgggaggcgctgccgccgactgatacggtggcaggcagataaaatgtctataagtctacgaggagtttgatattcacgatgaaagacggtccctaaaaatgaatgtcttcagttgaagactttggttttcttgaagactttgaaagtgaggaaattggtgtgaccttgaagacttgatattcatgcgaggattatgaagcgtgaagacttttgttttcgtagtttcattttctctttctcgagtcataggaaacaccggactgttaaagcggtcgaggtaaaactaaggaaaagtttccaagtgatgctcatctcaaaatcgtacacctacccaatcctttcgagtgaagccaatggaaatctcgtacagtttagtcaatttcgtcagtgacagagacgaagatcttctgttctttgaggaatttgttctggctgaggagttaggaattcgctagtgcggattacctacaagtgaggaacatgataaccctaaggaatttgatactcaaattttcgatcgttgc

SEQ ID NO: 6071 - DNA, 632 bp, Triticum aestivum
  unsure (1)..(632): unsure at all n locations
  Clone ID: PAT_TA_6071
atgtgaagctctcttaatcggaaaggagaaaaactatctgtctgcatgagtgcccagcaacaagaggttggcacagggttgctcgagtcatctgagccagattctccaatagctgggataatcctgcagtcagacgatgaccagtgctactccaatttctgcaagctaccagtcctgaatccctatgacaagttcctcccatccgctggttgctaagaccgcctgccgcaggaaatgaacacagcaacccgcaaatctagggtcccacgacaccacgggaagctaccagtttccagcaaatggtggctctatggctctaaatccatgcatcaagcatgacgcatttgttacttgcaacagatcgaggggagtcaccggtatgcaagatgagatgagttcgtcccgtcataagaattgaatagtgccttgacagcactagtcggttgcctactccttgctcccggtcgaggtcatatgggggatgtaattaattctgcccaagaagaatcagctagtcgttttgtgcaatatgttagggttttatcttatcattcagttgttaaccagctatctcgcaactgtaattatgcaagctgggctcatcgtgctgtgccacatgttngtattcatgt

SEQ ID NO: 6072 - DNA, 2115 bp, Triticum aestivum
  Clone ID: PAT_TA_6072
cccagctctccgccctccggcttcgccgccgcctgggcctgggagctccaacttccccgcccccgtcgcctgcccctccccccggccgcccgcccggcctcttcctcagcctctgggtctccccccccgaggctggtattcgtctggcgcttcttcctccacgggggtggaattcccatgcttccttttcgcggacggtttggcggaaatgcttcctccccatgggcatcggttttggcagaaaagttactaccacatgggatatcagtatgcagttattgattacctgtgggtaccgaaggtatgtttgatggggcagagtagcacattcctatggggctttgacaacccttgatccgagggggtcgaaccgtttccttgacctccaaagatttccatcgtccaaatatgataaagggttcagtcaaattgccaataaggttcatgagatgggcttgaaattcggcatccatttaatggaaggaataagtacacaggctgttaatgcgaacacacccatcttggatattgagacgggaaaaccctatgtagagaacggtcggcaatgggcagctcgtgacattggcctgacccataaaacatgtgcatggatgccacatggatttatgagtgtaaatacggatattggagctggacgggccttcttaagatctctttaccgacagtatgcggattggggtgttgattttgtgaaggttgattgtatcttcggtactgattatagcccggaagaagtaataactatttcgcagctcctgcaagagctggaccgcccaatagtactgtccatatctataggataacaggagatgattgggacaactggaaagatgttagttcacattttactgtgtcaagtgccttcgctgctgcgaataagatcggggccactggattacgaggaaaatcttggccgtattttcgcatgttcccataaggctggggccatgatccgggtgtcaataagggccctcataggccgtatgcctttacatggcatgaacagaaagcccagatgacaccagggtcaatggcggccgtgcctctcatatattgatgagatctgagcacagtatgacactttggtcaatggctaagtcgcctctcatatatggaggagatctgagacatctcgacaatagtacattcagcattatgaccaatcctactctattgaagataaactactacagtaaaaataacatggagttccattatgtgtctggtgagacgacttctaataccagacattctggtcacttgagtcctcgatatactgtaaacccgacaaaacatgatggcatggtcgtgggtctcacttcctgcaccaatgaccaagctaatggatggtttgtatttccacaagatgggaagtcagatcatatatgcaggatctatgaaacagagaatggcaaaaatgtctcattttgcttggggaaaacaaaacctcttcttgcctcggatgatgatatcaatgaaaaggaagaagaccaaacaaagttccatctggcagttgcagacattaatgattcttgtttggatgcatctgctagtcggcggcggactgcctcagaggttaagcttctcatgttctccaggtgcaaatggcatgcaaggcagatgtgggagctgaatgacaagggtaaccttgtgagcagctattcaagattatgtgccacggtggaatccagcaaggaagcagtaggtattactggagctcgtgcatggattgcaactggaagtaaaggggaaatctacctcgcgttcttcaaccttgactcggtgagccggaagataaccgcgagaatatcggaccgggaaaaggttcttgggacagccttcgtacgaaaacactcgtgcagctgcagtgatgtttggagtgggaggaatcttggtctcgtcgaggaagagatctcagcggcggtgaatccacacggttgcgtggtgttcgaactcatgtgttgaggacttgaggtttgccagactagtcacggtgggaataattttgggagcctaccgcaatcccatgatatgatatgatgtaagcctaccctgaacagcgtgaaccttgaacaatattgggtaaaaaaaaaa

SEQ ID NO: 6073 - DNA, 397 bp, Triticum aestivum
  Clone ID: PAT_TA_6073
ctcgtggtccaacgaagaccccagaaggggaggtaaggagtggtacaagaaatagggtggctaaactgacaatgcccgtcttcactgccgtcttggtgatggccctgttgatcactgcatcatcttcaggagaagtttcaacgacagaacgtgatagggatgcctccaaagtgacaaagggtcacacttctctttaccatcttcagatgcagagccacagcaggatgaggattctgacggattttctggactacgactacggaggagccaactccaaacacgatccacacaggaggcccgggaatgggggacattaggcactagataatagctagctctcccaaccattcgacagagtccggtgttttggactggtgtcatgtgtgtgcgtattcac

SEQ ID NO: 6074 - DNA, 922 bp, Triticum aestivum
  Clone ID: PAT_TA_6074
gattcggacggggtcaactcccccccctcccccattcaactagcccattaagttctctcttttccccttcttgcatacaatcatctccatggctagtccattcggtgtcttggtttgtctactcatagtgctaccacaaatccttgctatttctagccccatccacgagattgcacctcttaagacatgtcagttcccttgtatgaccgaggttaacttgcacttgttcttgcaccaattcgtcgacgggccaaacaacccaaatcgcaatgaggaaaccttactccaagcaagttttccttttgggtttgggacgacgatagtccatgactggactcttaccgagacaacaaattccagagacacggttgttgcacgtgtacaaggtgtgcatgtccaggctggtttaaccaagcctaacagatggtacacgactcataacatagagtttcagcaaggaaggtttgcggggtccacccttcaagtgatgggtataaccgcaggtttggaaagtgggcagtggtctattgtcggtggaactggtcaattcattatggcacagggtataataagtttcacaaatcatccggcctctacttttgaagatggtattaaagaactcaatattccgtgtacgcttcacaagggatattacacaagccgcttgaggtgcatctcgtcccttgaaagcccgcccgcccagttcggtatttgatggggaaatgcgctttccctttcgctgtgatgggtcgttaatgtggtccgcttgtgtcacgagagtatgcattagcataccctctttctatctttcattcaaaataagatgtgggtttatagcatggtggatgtccagtccttaatccatgtcaacccatctgtttgttggtatctatgtaatgtcttggatatgctttgcaaaata

SEQ ID NO: 6075 - DNA, 465 bp, Triticum aestivum
  unsure (1)..(465): unsure at all n locations
  Clone ID: PAT_TA_6075
tnatacatgggnacaggagagttgatatgnnacanggcgtcaccacacntnatacatggagacagaagcagttgatatgaacatgacgtcccctcacatgatacacggtgacacgagagtggatatgaacatggtatccacttctcacgatgatgcgatgcacacttttgatttggtgaacgtcaacctggagagttctttgccaatggctgcggcgggggtcatgcaaatgcatccacacccaccagtttaccatcccaaacggctcctcaatatgagagatcaggtgatggactcaaacaagagatccaatgtggaaaccaatacttatttcatcggaggtggaatgcatgtggggtagtttaactgtctgctgctgtaacatctgtttagaaagggagacgaccttcttgtatgtcgatatgtatgttcttagttcaggcagtaccacaaatcaacagtttg

SEQ ID NO: 6076 - DNA, 1146 bp, Triticum aestivum
  Clone ID: PAT_TA_6076
tatcggccgcgggcggttgtgccgttcccacctgggcgcgcggactggcttctgcccgggggatgctctccgcctccttcggggcgcgtgcgggccacgggggcgcttggagctgcatctggccagccggccctcgcactgccggcctcttccttggctcctaggattgtaggccgcccctggtgctccttgacgccgagcctaccgccacactcccggggcttgggttggctatggagggtcctggtcgtccagtctgccccgtgaccccgtaggtgatggggactcatcgttaccctgccccacctcttgggtcatctggtatcttcgggttccaatgctgtttttccttaccccgactataccgcaaaactctctgattttggattggcaaaggatggccctgttggtgagaagagtcatgtgtccacaagggtaatgggaacacatggttatgcagctccagaatatctctcaacaggccatctcactgccaagagcgacatctatagctttggggtagtgcttctggagatgctgtcaggccgtcgcgccattgacaagaaccgtccccagggcgagcacaaccttgtcgaatgggcccggccatatctcacacacaagcgcaagattttccgtgtccttgataccaggctagaaggccagtactccctgaacggagcccagacaatcgctgcactggctgtcgagtgcctgtccttcgaagctaagatgaggccgtccatggacgccgtggtctctattctggaagggatacaagactccagcgacccagccagaagaccggcagatccaaccagaagaccggcggcagagaggcctcaagaccccaagagtggaagcaaaacggcgcccggcgcaagcaacagcggcaaaggtcgccgtaaaagctcgggagaccttctgaaggagcctggccgagacccaaagccgtcggcctactcgtcgtagcgacccccgagtctgagcctgttagctagctagggtggtagtgtgtaaatttggtgtgcatattcctgatcgtcgtcaggcttttgggctgctcaacttgagttaatggtggattgtgttcacattgaactattggaattagcccccgcactccggcttcatccaaaaataaaa

SEQ ID NO: 6077 - DNA, 780 bp, Triticum aestivum
  unsure (1)..(780): unsure at all n locations
  Clone ID: PAT_TA_6077
gnatcctgtacttgttcctggtgcaaaaaagaatataagctattacttcttgaaagagtttgacatgtgggtaggttttgatcaaaatcctctttatgctctcttacatgagtctatctactgtgagggatcttcatcgaaatggtcagccgataagattttcaatgaaaatggaagtttgtttgaccctgttaaggctacagaagaaggccgtcctgtgtatcttacaggagagatggtttttccctgttttttcgatgagatcaatgctctacgacccctaaaggaagctgcgcacttgctagctgagaaggaggactggcctccgttgtatgatatcagcgtgttgaacaacaacaaggtcccagtggccgccgcggtgtactacgaggacatgtacgtcaacttcaacattgccaaggagacggcgtcccagatcgccgggatccggctgtgggtgaccaacgagtacccgcactctggccttcgcgacggtggcccccacgtcttcgagcatctcatgggtctcttgaagggcaagaggcctctgttttagccttttagccaatccataactatgacaataaagccttcattttctcctagttgagaaatgaattacaatatacccctggttaaatgtttctgaatgtctgcacatacatcctggggcacaaattttggcgctccagtcatgcttgcacgcttagaattgcgctatgttatgcacatctcgttgggatccttctaattaatgctccactcaacccgaataaagaa

SEQ ID NO: 6078 - DNA, 582 bp, Triticum aestivum
  Clone ID: PAT_TA_6078
tcgggatcctcccagatcccctcccgatccaaaaatcctcccagatcccctcctcaccctttccacctacaggccatcgttccctgcctcgagccaggagctcgtcctcgaccccgatccacttctcccgccggcgaccgaagtcaccgaccaggccgccccatacccttcctgtttttcttcccatcttcttttattctctgatctctctcacgcgcaagcctctctttttccccttgcagcagagtcaaccatggacgaccccatcctgccatcgcttcatatggacgggaaccagcctccccaaccggcgccatgcccgcgcctcccaaggagttcgtcgtcgctccgttccctgctaggagcgttgccgcctgcctccgtcgccatcaacaaggagcaccaacgcggcgccgccttgaccgcgcttctcctcctcaagtttcgtcggcaaaccacgctggagacgagagcctccagtaggaccccgacgagcccgcgccaagtccctgtctcgccggagagagtcatcgtgccagtccgccaagtccctctacagctctgcccgtcgccgctgctgcc

SEQ ID NO: 6079 - DNA, 705 bp, Triticum aestivum
  unsure (1)..(705): unsure at all n locations
  Clone ID: PAT_TA_6079
cggctccgctccacctggactcgcacgatttctcctcggctcatccttaaccaaagttaagaagatagcatcggcatcccacggattagatagcgccaccggaaagttgctgctgctgctgctatatatctcttgcggcctccaggctccagcgtcgaggattaattgccgccagcttaaggaagcaagacctgaattggttgtctggccggccatccagggagctaggccagggatatacatacatggaggcgccggcggccagaggaggagcgcgaatgcggctccggctggtgtccctggtggtggtggtggcgatggcggcggcgacggcgcgggcgcagctgcaggtcgggtactacgacacgctgtgcccggcggcggagatcatcgtgcagcaggaggtcagcaagggggtgtccggcagccccggcaccgccgccggcctcctccggctccacttccacgactgcttcgtcaggggctgcgacgggtcggtgctgctggactcgacgccgggcaaccaggcggagaaggacgcgccgcaaactcgagcctccgcgggttcgaggtgatcgacgcggccaagacgcggctggagcaggctgctacggcgtcgtctcctgcgcgacgtgctcgcttcgcgcaagagangcctcgcctgtcggangnagtcgnacaagtgccggccggnnnaananaagg

SEQ ID NO: 6080 - DNA, 1117 bp, Triticum aestivum
  unsure (1)..(1117): unsure at all n locations
  Clone ID: PAT_TA_6080
ggtccccgtttcccttcgtcaactacgcaccacctgtccgtccaaacgcgccatgcacggcgccacgcacactcgttcctaaccccgccctcccatccccccttcccaacccaccgcatgctcgcgcgcccccgccggggccgcccctcttgaccccccgctccccccgcgcgccgtgacctcgccacggggccgccgaggccatggtgaagctggcgacggcgagggaggcgcggctgtacgggccggcgctggcggtgcggcggtgggagtacatcaacgccggcgcgtacatgttcgggaccctgctcctggccacggggctcgcggcgctgtgcgcgtccgagggcggcgccggcgccacggacgcgggactcgccgtggccgccgtggcgctggcggtggtggcggccgtgaacgcgcacgacctgggcgcgcacctcgccggcgtggactgccgcgtcgggctcgcccggttcgacccccagctcggcctcgtcgagctcctcgcgcccgcgctccacgccgccggctgcgtcctcgccatcgtcggcctcgcgctgcagctcttctcccaaggcgagaagctggagaggcgcgcggccgacgcgctgctggcgggcgcggtgctctggctgctgggctccgtgctcagctcatgtcaggtgtacgagcgccctgacggccgcgcgcagctgctgcagtccagcgtgcaggtgcccgtcctcctcggcagcctgctcttcctcgtcgccgccgccctccaccgccgccgtgagcccaccctggcaggcaagggcgaaagccagagcgagagcgaggggtggattagcctgtgcgggagcgtgctgtgggtggcgggtgcactgttcaacgtgctgaaagtgtttgtcatgcnaccaagagcgacgccccgcggctcgagaagcttccgcggcggcgccccggagcggctcgcccgggaccgcgagggccgcgtgccgctggtctgggaggtcngcggcgccgccgaccgagctgcgctgacagtatggtaattaaggaggctggtgcaccaaggaataccagcgtggccggcgccggaactatactccggttctgtttggtgtctctttct

SEQ ID NO: 6081 - DNA, 937 bp, Triticum aestivum
  unsure (1)..(937): unsure at all n locations
  Clone ID: PAT_TA_6081
ctcgtgccggtttcctccgccgcgagatcgcccgttttctctcgatacttccgacgaccggagcggaagacgaatacaaatcccgtcgaattcgcctgctcgtggctccatcttccgtctctctgctgcgtgtggtggtcttgattcgtcgtgttaatttcgattcaatcgcccgggcgccatgggattggggagcgacgcgagctcgtcgtcgtcgcggctggactcggcgccgctgctgccgcaccacagcgccgaagggggccacctttcgtcgcagcccaagaccttcgcgaacgtcttcatcgcggtggtcggcgcccgcgtgctgggcctgccctacacgttctcgcgcaccggctgggcggcgggctccatcctgctcctctccgtggcgctgctcaccttctactgcatgatgctgctcgtcgcctgccgccgccgcctcgccgacgaccacccgaagatgctctcctcgtttggggatctgggggacgccgtgttcggcgcgcccggccgcctcgccgtggacaccatgctggtgctcagccaggccagcttctgcgtcgggtacctcatcttcatctccaacaccatggcgcacctctaccccgtcttcgccccctcctcgaacgtcttcctctcccctaaggcgctcttcatctacgccatgctgccgttccagctcgggctcaactccatcaagacgctcacgctcctcgcgccgctcaagcatcttcgccgacgtcgtcgacctcggcgccatgggggtcgttgttgggcaaggacgtgtcgacttggctcgccggggcaaccaaccgtcgccgcgttcggcgcccccgccgcgctcctctacggtggcgggcgtgtccgtngtacgccttcnaaggggtctgtatgggcctggccgctggnaggcgganggcccgggcaagaa

SEQ ID NO: 6082 - DNA, 551 bp, Triticum aestivum
  Clone ID: PAT_TA_6082
gttggcatgacacggtacaacctacttacgactagggaagatggcgatggattgaatctggatgtaaggaccatgtttatattccaatttaatgtttgttttgcaattagacatgtttaacttctccttctcttcttcttttaactgcataggaggatctggctttatgtcacgtcttcccgctggaaggaaaagccaagggcacccggaaccggaatggcaaaagatcacgatcagggcatgaagtggatccacacgaacccattacccatgccggcgtggaagaattgcaccaaatgatggccgattccaaaaacaatccaattatcgacgcggacatggatgttcatctgctcttggctgatcaaccgccaaaacattgggcaaagcttcaccaagatacacaccaaaattcctaaacttatctacgcggcgtgcaaccactgcgacacgatgttgaagttaacatgtggtcacaaatgtggcaccggctccctcaagcatcatagtgactcctgtcgatgcaaacccaagcaggagcagctgcccgg

SEQ ID NO: 6083 - DNA, 472 bp, Triticum aestivum
  Clone ID: PAT_TA_6083
ccacgcgtccgctccaataatctatcttgggtgagaattcttcttaacaccacatctaagctaacatgaggattgctctagcgcttctcctgactcttaccgtcctcttactagcatcagatgtggaagctgattgtacgacatcaattatcaaccgtccaaataagtgtacaaacgctatttgcgagcagtcctgcgacgcaaggcgccagtccgtctgtggcgatcaatgtcgtcttcagaaagccagttgtgttggaaagttgtgcggatgtacctggtgcaattagttgtacttccctcgttaattgaggtcccagtaaagggaagtatgaccattagacaaaaataattgcaatgccacacttcacagtgcggcagcaagactttcactggaaagttaagtagaacaaaaatttaatactcaacttgagttatatgaagttatcagaataaagtgttctaaaaattt

SEQ ID NO: 6084 - DNA, 531 bp, Triticum aestivum
  Clone ID: PAT_TA_6084
tcgaggagagctacaaggcggccgggctgccggagaagatccccacgctggcgctcattcaccccaagaaccccgacgtggtctacttcttcctcaaggagcacctgtttggtgttgacgtgcgtggtcgcaaggtggtggagtgccaggtgtatggtcttgttgcgcccccgagcatctgcttggccagccgcttcgttcgggcttgggagctgccacgggcgctctcctcctcagggagtggtctaatggcatcagcttggctgagagcgctaatgcgcgtccataccagcgatcggcaggggattatcacttggtggggggctcacaggatagcatgcaaacgctgaattggaggtaggaacctgaagcagctagtagctgtttatatatggggctaagtcagtttgccatagcatttgtgcttgcggacacactctggactagtacttgagtttttatcatctctcccttggatggagcacttgtaccaggaagtgtgacttggggtggggcgatttgattgttaag

SEQ ID NO: 6085 - DNA, 1129 bp, Triticum aestivum
  Clone ID: PAT_TA_6085
ggctccagctcgccgccgccgtccagctcgccgccatggtatcttggagtgaaggatacagctcgtcgtccgacgactccccgggccacatcgacttctgctccgaggtctcctccgccgcgcgcctctccgactcggcgctcatcctcgtcgacgccgtcgagagcgtccacatccagacccacgccgcgttgcgccaggccttcctcgagcgcctccgcccctgcctcgtcctcaacaagctcgaccgcctcatcaccgagctccacctcacccacgccgaggccgatacgcgcctgcaccgcatcctcgccgacgtcaactccatctactccgcgctgcgctcgcactcctacttctccgtcctcgcgtccctcgaggaccaaccatcctccagctcgtcagcctcacaggacgatcccccggaagatgctgacgacgatgaggaggacgccttccagccccaaaagggcaatgtcgtcttcgcctgcgccctcgatggctggggcttccgcatccaccacttcgtagagttgtatgccaccaagcttggcgccagcgcctctgctttgctgaccggatgttgaatcaagtgatggtgtgataaccatggaagatggaaggcaaggtattcttgtgcgtggtagagcagatttttctgtgagagtggggtttgtgagtggatctgatgctgaagctaaccatactcctgacagcactaaatcatcagcagatactcctgaatcgttacatctagaatctgtggcactaaggaacagcattctttcaggatttcagtttgccacgaacgcagggcctttatgtgatgaaccaatgtggggtctggcatttatcattgagccttacatatctgctgacaactctgatgctgcccatcaatctgatcaatacaacatcttcagtggccaagtaataaccgcagttgtcgacgcggccccggcagccgttcttcagaacaacccaaggcttgtcgaaggcatgtatttctgtgaattgaccaccccaactcagcgactaggttcaacatatgcagttcttggtaggagacgagcgaagattttgaaagaagagatgcaagaagggacttcagtatttacagtgcacgctt

SEQ ID NO: 6086 - DNA, 654 bp, Triticum aestivum
  Clone ID: PAT_TA_6086
agcaactcgcagcgacatctcagcaggcagaggcgtttgctaaagctcatgaggattttagaacaactacagctcacttgggaatgacattcgttaagctggcaaagtttgaaaaggaccaatctacatgcagttctcacagaactcgagctattaatattaacaattttgcaaatgctgttgtcaaagtcagcaggtctcagacaaaactggatgctgaaattgtgaaacatctggacactatccataaatacctggagacgatgacttctgtccacaatgcatttactgatcgctctaatgctttgctccatatccaaagtctatcatctgacttatttgctttgcacaaccgggtggcgaaacttgaatctgtgtcatcaagaggaatagatcaggagaggacgaggtatcagaaggttgaagaactgaaagaaacaataagaacatcagaagacgcgaaaagtcatgcacgcaaagagtatgaacttatcaaggaaaacaacatgaatgaaattaagagatttaataaagagatacgccaggatttggtggagatgatgaaaggctttgtaacaagtcaggttgcacagtcagacaatattgctagtatatgggcaaagttagcagaagacacaaagggatacgcggaca

SEQ ID NO: 6087 - DNA, 653 bp, Triticum aestivum
  unsure (1)..(653): unsure at all n locations
  Clone ID: PAT_TA_6087
ctcgtcacgctccagctgccggccggccccccaccagcacgcgatctccactcgctccgtccggccggatccccttcctcccctccgcaggtacttccctcttgttcgactgatttgatcccaaagaaagaatcctcgtgagatctccactttccatctcatctcgccggccgggatctgaagcaagctcggatcttgccagccaacagccatgtcttcctcgtcggacaaccccaacacggtcaccgaccgcggcctcttcagcaagagcagcaaggacgagaagaagaagcaggaggagaagaaagaggaggaggagggcggcggcgggttcatcgacaaggtcaaggacttcatccacgacatcggggagaagatcgaggaggcggtggggttcggcaagcccagcgcgacgtggcccggatccacgtgccccacatcggcctccaccgcgccgacctcgtcgtggacgtgctcatcaagaaccccaacccggtgcccatcccgctcgtcgacatcgactacctcatcgacagcgacggccggaagctggtggcgggcctcatcccggacgccggcaccatccgcgcgcacggngaggagacggtcaaggtgcccatcacgctcgacttcgacgacatccggagcaccta

SEQ ID NO: 6088 - DNA, 1032 bp, Triticum aestivum
  unsure (1)..(1032): unsure at all n locations
  Clone ID: PAT_TA_6088
gggncgggnncgtccgtccctccngttggcggncggnccccactaccgngacacgctccgcgcgngatctccactcgctccgtccgtccggatccccttcctccctccccagccatgtcgtcgtcgtcggacaaccccaacacggtcaccgaccgcggcctcttcagcaagagcagcaaggacgacgccgccgacaagaagaagaagcaggaggagaagacagaggaggaggagggcggcggcgggttcatcgacaaggtcaaggacttcatccacgacatcggggagaagatcgaggaggcggtggggttcggcaagcccagcgccgacgtggcccggatccacgtgccccacatcggcctccaccgcgccgacctcgtcgtcgacgtgctcatcaagaaccccaacccggtgcccatcccgctcgtcgacatcgactacctcatcgacagcgacggccggaagctcgtcgcgggcctcatcccggacgccggcaccatccgcgcgcacggcgaggagacggtcaaggtgcccatcacgctcgacttcgacgacatccggagcacctacgcggatatcaagcccgggagcatcatcccctacctgctccgggtcatcttcctcgtcgacgtccccgtcttcggccgcatcaagatcccgctggacaagtccggcgagatccccatctcgtacaagcccgacgtggacgtggacaagatcaagttccaccacttctccttcgaggagacgacggccaccatccacctgagcctggagaacaagaacgacttcgacctgggcctcaacctgctgcagtacgagatgtggctcggcgacgacagcgtggtggaggcggagctcaccgactccaccaggatcgagaagcaggggatcaccaagatgcagatccccttcaccttcaggcccaaggacctgggctctgccgtctgggacatgatcaggggcaggggcactggctacagcatcaagggcaagatcgatgtcgacacaccctttggcaacatgaagctg

SEQ ID NO: 6089 - DNA, 1449 bp, Triticum aestivum
  Clone ID: PAT_TA_6089
ccgccccgcccccccgacccgcctgccccccatgctgcctccctcggtactctccagctgccggccgcgacacgctcctgccgcgatctccactcgcgccctccatccggatccccttcctcccgtccgcagcccaccagcgcgccaccatctccgtcctctgtcggaccaccccaacacggtcacccaccgaggacacggccgcaaaggccagcaaggacgaccgcgccaacgagacagacgacgccgtcggcgacgagagcggaaaggaagcagggaagaggcgggggaacaggaaagggcaagaggggcgtcgccggccccgggccgacgatggcggaggctccggggttccgcacggcccaccgcgcgacgtggccgggatccacgggctccacaacggccccgcacccgggccgcccccgcccccgaaccccctccaccgcaccgcccacgcggcggcgatgcgcgcctcgtcgccaaatccggagctcatcaaccgcgacggccggaaggcccacaagggctgcccgcccgccaccggcgaacgcggcgcgcaccgcggcgacggggcgcgggacccctccgcgcacgacgggcgcagacggtgaagcggcctcgagtgctgcaactcgacgaccaacaaagccaacctggggcccgggaaccatccagctgaacgctctactcttcctcagcgtatctttgttgatggcctcatccggaacgacgcccagcgctttcaagttccacttccccggtgatactaccagggtacacaaccagtgtgtacgtggagaccatggtacctccatcaaccggagcctgaccaaccaccacaacttcgacctcgggctcaacctgctacagtaccatatgtggctcggcgacgacgagcgtggtcgaggcggagctcaccgactccgaccaggatcgagaagcaggggatcaccaagatgcagatccccttcaccttcaggcccaaggacctgggatctgccgtctgggacatgatcaggggcaggggcaccggctacagcatcaagggcaagatcgatgtcgacaccccctttggcaacatgaagctgcccatcgacaaagtcggcggaaccactcgcctcaagaaggacgacgacgatgacgatgagtgaagtgctgttactgaacatacaagatagtcaagcagggagccagggaggatccagctgaactctttactctagcttatggtatctttgttgatggcatcatccgaacatcgtcagcgtttttatgtttcggtgctcagtgttctttgcgggaactcatccagtgtgtattctttctgtgttaactttgtcaagtggaaacagacctgaaaataaattccatcgcccctttcttgtttgtggggtatgatgttagccttcttcatccaaaaaaaaaaaaaaaactcaaaaaaaaaaaaaa

SEQ ID NO: 6090 - DNA, 161 bp, Triticum aestivum
  Clone ID: PAT_TA_6090
cctggtgttcatctccctcgttgccgccgtcgtcctgcttgtggccaccctcttgcagactgtgtataccgttttgccattttactctaacacttagtaccacctggatgtacactgtaatttttctaatattgattaacgcatacgctttgtcctaaaaa

SEQ ID NO: 6091 - DNA, 764 bp, Triticum aestivum
  Clone ID: PAT_TA_6091
agcggccgctcgcgtttttttgctagggaacaaacactctgatttatgtaactgtcaccacttagaagtaagctaaaacaatcactccgatacaagttcagaacacgacaagagtcgactaaaaaatacagccaaatcttctcacgctctgccggcgaacgcgcaaagtaacagcacaagaacgcacgcagataagttaggatcaagggggttggagaaaccatggtttctcaaccaaatcttccgagttagataatcaatcatcagcacgcgttctcgtcgagcctgccaaggcgcaccctgctccgctctctgttctgcgttttcgacgccgaattctggtccagcctgccgaggggcaccctcttctgcgacttggacgccgagttctcgtccagcctgccgaggggcgccctagttgttggctctctgttcttctgagcattgagcttctccttgagcttcagcctgagcctcctcaggctaagcgtgtccagtggcttcttcccttccttcacttcaaatattgggtggatggaaaattgatccactggcttcttctccaggtcttgtgccactgcagccttctccttgagctggaccctaagcttcctcaggctcaggctgcccaatgcttcagattcattgccttcctccttcatttccttctctttttccattgccacgggctcagtaacgttcttctcagcggcagcttcaggcaccgttgttgcctgccacggtgactcggtcgcgtgggtcga

SEQ ID NO: 6092 - DNA, 960 bp, Triticum aestivum
  unsure (1)..(960): unsure at all n locations
  Clone ID: PAT_TA_6092
aacaatttggtgaccgtgaggggattgaggatgccattgtgggcaagcggagattccaatatgaagatgaggtgaggaagaacccactcaattacgactcatggtgttgattacatcaggctggacgagagcgtccggaacaaggacaggatcacggatgtgtacgagaggagtatcgcaaatgttcctcctgcagaagagaagcggtactggcagaggtatatctacctttggataaactatgctttgtatgaggaacttgatgcacaggacatggaaaggacccgggaggtctatagggagtgtctgaaactcattccacacaagaaatttacttttgctaagctgtggctgatggccgcgcagtttgagataagacagaagaacataaaggctgcacggcagattctcggtaatgcaataggtatggcgcccaaggggaaaatattcaaaaagtacattgagatcgagctttatctgggcaactttgaccgctgtagaactctatatgaaaaatacatcgaatggtctccagcaaattgttatgcctggaggaagtatgccgaactggaaaaaaaccttagtgagactgatcgtgctcgatcaatatatgagcttgctatcgctcagccagcccttgatacgcctgaggttctatggaaggagtacttgcagtttgaaattgatgaagatgaatttgatagagcaagagaactctatgagagactgcttgatagaacaaagcatttgaaggtatggatcaactttgctgaattcgangcctcanctggcttgggagaaaacgctgaaatgaggagaataagaatgatgctggttacaaggaacaacaactcnaaccggtccggagttcnggcttccttgaaaggcatccactactnaagncaatgcgcaaactaaaggaaaaagacatcnccggaaaagggcaaaanaatnacttgg

SEQ ID NO: 6093 - DNA, 1374 bp, Triticum aestivum
  unsure (1)..(1374): unsure at all n locations
  Clone ID: PAT_TA_6093
ccgcccccgccccccccgggtcatcgcgtctgccctccgcgactcccctttgcggcggctccccccgcggcccccgcgccgcgctgcttcgccgtggcctgctggggccccagtgggggccccgccccgacgcgcggctcccttgcgcaatgaactgcgcaccgggccgcccccgactgcctggcctgtcgccggcgcctcgtcggcacggtcaacgccaccaactccgtgcgcgtgggaggacggatctccgtgctccgctgcaccatcagcttcgaggcgtttatgttctacgacggcaaaagcacgcggcggattccattttcatctccgtcatccatggctccggtgccggcgccggcccccacaggacatggaatcagaccttgggtaatagccttatcggtagctgctcctgtagcactggtggttgctctctgctgcttcatcgtttactgttgtcggcttagaaaaaggcacgcaaaaaaaggtaaagtgaccttacacgaaaaaagtactcaccagtttcaaggagatgaactagtttgggaaatggaagcggagttgtctgaattttcagtatatgagtttcatcagatattagaggctacaagtaacttttctgaggaaaacaaacttggcgaaggtggatttggcccagtttataagggctactttcctgagggaatagagatagcagttaagagacttgattccgattcagatcaaggtttcatagagttcaaaaatgaagttgagctcatagccaaacttcaacacagaaatttggttagactcatgggatgttgctctcaaggagaagagaaagtactggtctacgaatatttgccaaacaaaagcttggacttcttcatctttgatgaagatagaaaagttctactagattgggagaagcgctttgcaataattgtaggaatagcagaaggacttctttacctacataagcactctaggttgcgtgttatacatcgggatcttaaaccaagcaatattcttttggatagcacgatgaatgccaaaatttcagattttggactagcaaaaatatttagctcaaataacaatgaaggaaataaaacgagaaaggtggttggtacatatggctacatggcacccgagtatgcttcccatggcctcttctctgtcaaatcggatgtattcagctttggtgtttaagttctcgagatcactagcggngaaaaagaatccatgagtgtggagctttnannaacctccagtgganangcttgncanttanttccanaagaaagatgatccaactcgttcatncggcatnantcccacggcgattcttctcattgatgaggccatancattcattgttngnttaca

SEQ ID NO: 6094 - DNA, 691 bp, Triticum aestivum
  Clone ID: PAT_TA_6094
ttgtcatggcatgttaacaaattcaagttaagactttctacctacaacatatggttgcacgaaacaaatttccgtgctgcaccatctgtcaaattatgaacaaaaattctgatggcaggtgaaaaggatcttttctctaagcacccccccgtcttccagcttcaaataaggacattttttttagaaatacataagctagaagagttcacagctttatcatatcccttttgtgaacaagtgtggcctttcggcctttctcatgtgtggcttacatttcgggtatgcaaagtgatcagcagaatgaaatatcaatattgtttttgtccgcctccgccctctgcttcctcgcctcccgctcctttctcacttcatcaaatctgtatcctagtattcccgctcctgtcgcattgtacttgtacgtacacattaaggcaccagcgatgcagccaaacaacaggtccttccctttccagccagttttttcacaaaacgaggcgattgttctcttgatgtcatcagccatcgtgctcttggattcattcatgccatcaccagagtacatccgcttggtggtgcagctgcatccagggctgctgcggccgccgtggctggagaaacgaggggccggcgccttgcgccggagcgcgaatccggtggcagatcggagcatagccaacaccgcggttgtcgc

SEQ ID NO: 6095 - DNA, 761 bp, Triticum aestivum
  Clone ID: PAT_TA_6095
ccacgcgtccggcggccgcccttttttaactaacttttgcaactcaccgtaagaaaatgggccatgctcatgtccagttccatccatgtagtaccagtcacccagtttgactgacaattcttcaacagtgcaaacccgcgcctccgggctcgctccatccactcatggcgattggcttgccatccactgatcatttcgtgctcctcaccatcctcatctgcctcctcgtccatcattgcagtgcagtctatgacgtcgagtcaaccgctgagtcggggaagctgatgtcggcccagctaaagctcgtcggcgggtcggcagattttgggcctgatgtgaagagtctcaccctaaccgcaagtcttgagacagacagccggctacgcgtgcgcatcaccgatgctgaccatcggcgatgggaagtcccccaagacgtcatcccacgcccggcgccagggccgcagccaaaggacgtcttgctcgactcaccaggcaatccctccatgccgagcaatagcaccatgtcgagtgcgtcttcggacctgaccttcaccatccacgccagcccgttccgcttcacggtctcccgtcgctccaccggcgacaccctctttgacacttccgccaaccttgtcttcaaggaccggtacttggaggtgacatcggcgctgccggctgaccgagcatccctgtatgggctcggcgagcagaaaaaacagacgttccggctacaacacaatgacactttcacgctgtggaac

SEQ ID NO: 6096 - DNA, 1260 bp, Triticum aestivum
  unsure (1)..(1260): unsure at all n locations
  Clone ID: PAT_TA_6096
ccccggccgccccaccgccggttaagccgccgccagtcactcctaccccaaccccaactccggttaagccgccgccagtcactcctacccctaccccaactccggttaagccgcccccagtcactcctacccctacccctaccccaactccggttaagccgccgccagttactcctactcctacgccaagtccggtgaagccgccgcctgctggaactccaccatctcctgtcagcccgtcgccgccaccatcttcgcctgcggggacgtgcccgatggacacactgaagctgctggggtgcgtggatgccctcaacgggcttgtgcacgcggtgatcggcagcagcgccagcgataactgctgccctttgttgtccggcgtgaccggcctcgacgcagcgctctgcctatgcaccacaatcgagctcaaggcactcaacatcaacctcgtgctgccaatcgccatccaggtgctcgtcaaccaatgcggcaagacggtgcccagcgacttccagtgccctgcgccaacgcctgccactccgccgccgacaccagcagtgccgccatcacctgtccaaccagcgctgtctccaccaatccctgtcactccatcgccgacgccaccatccccagctccggtctcgccgccgtcccctgtggtcccgtccccagtcccagcgacaccaccgccatcgccgtcgacgggccagtgccccatcgatacgctgaaactgttggggtgcgtggacgggctcaacgggctggtgcacgcggtgatcggcagcagcgctagcgacagctgctgcccgctgttatccggcgtggctgacctcgacgccgcgctctgcctctgcaccaccatcaagctcaaggcgctcaacatcaacctcgtgctgcccatcgccatcgatctgctggtcaaccagtgcggcaagacggtgcccaaggacttccagtgccctagttaagctccaacgagtagaatatcaactatcagtaccacccgtatctgcatgcgatgcatggatcgcttaaattctcttgtgtggtcacgtatgtagtgatctttatgtacgagcatgtgcagccctgacgtactacctacttgtgatgtggagctgtagaacatgcttggattttgtgtaactgtgtatcaaataataaccgtgtagcgcgttgtggatttcaatcggtttgtagcgtcttcttaaaaacaattatgaatcgnnntgtgttgtaatttgaatgaagttgtcacat

SEQ ID NO: 6097 - DNA, 229 bp, Triticum aestivum
  Clone ID: PAT_TA_6097
caacaccctgaaaatttagttcaccgtttattatggagctgtagtagtgattacctatgaagaataaagagatggttttatctgttgtgtgaatgaggggttttgtctaccaccgcatttcgtataagtgactcagttccagttaccggtgtcacataggacgttagcataaactatgtagtgcacttgcatagtgccaggggggagtggtgcactcgcatctttgggt

SEQ ID NO: 6098 - DNA, 697 bp, Triticum aestivum
  Clone ID: PAT_TA_6098
cacggcatctgctctctcgcccctcgaaatatcccaagctccaaagcccaaagcatcgatcagagccgatcaaatatagtatttcttgagcactactagctagagagaagtattctcgtgttgctgttagcctgctttactggaaagatgagccccgaggagggagagaggctcttgttcccttccttcgtcttcccggacggtttcccggcggacgacgccacaccagccgtctccggtggagagcagaagaaggccggccggcagcggcggcggaggagggcgaggcaggcagcggcaggcgaaggcgcgggaggggacgatgcggcgaagaaacgccggctgagtgacgagcaggcgcagttcctggagatgagcttcaggaaggaacgtaaactggaaacgccccgcaaggtgcagctcgccgcggagctgggcctggacaccaagcaggtcgcggtgtggttccagaaccgccgcgcccgctacaagagcaagctcatcgaggaggagttctccaagctccgcgccgcccacgacgccgtcgtcgtccacaactgccacctcgaggccgagctgctgaggctcaaggagaggttggcggagacggaggaggagaagaacaaggccatggcggcggcggcggcggcgacaacgggcggcgggggtggcagcagcccgagctcttcgtcgttct

SEQ ID NO: 6099 - DNA, 606 bp, Triticum aestivum
  Clone ID: PAT_TA_6099
tatccgccccgcggcttccgatcccaacatcatccaatccagacctcccactccaccgccccgcgacccctccgccactcccctctcccgtccatgggcaagatgcgcgcgctcttctcccgcagccgcagcggcggccgcgccagccgctcctcctccaccaagtcgtcgtcgacgccgccgtcgcccgcgcggtcgccctctgtgcgggaggacgagatggagcgcgtgttccgcaagttcgacgccaacggcgacggcgggatctcgcgggccgagctggcggcgctgttcgagagcgtgggccacgcggtcacggacgacgaggtgtcgcgcatgatggaggaggccgacgccgacggcgacggctacatcagcctcgccgagttcgccgccatcaacgccgcgcccgacgccgccgtcgaggaggacctccggcacgccttccgcgtcttcgacgccgacggcaacggcgtcatctcccccgccgagctcgcgcgcgtgctgcgcggcctcggcgaggccgccaccgtcgcgcagtgccgccgcatgatcggcggcggcgaccgcctcgtcgcctgcctcgtctccttcctcatgatggcc

SEQ ID NO: 6100 - DNA, 955 bp, Triticum aestivum
  unsure (1)..(955): unsure at all n locations
  Clone ID: PAT_TA_6100
aatgacagaaccacaagttgcatcttcagatgcaacaaatatagaatgtgcaatatccaggcagggagatttctatgtgataaatggcaggaaatggtggaccagtggggctatggacccgaggtgtaaaatcctgatattaatgggaaaaacagatttctctgcacctagacataaacagcagtcgatgatcttagtggatatcaacactcccggagtgcagataaagagaccattgttagtctttgggttcgatgatgcaccgcatggacatgcagagattacttttgataacgtgcgtgttcctgtcacaaatatcctcctcggagaaggacgtggtttcgagattgctcaaaggaagactaggtcctggaagattacatcattgcatgcgactaataggagcagcggaacgtggcatgaatatgatggttgagagggccttaagtaggaccgcttttggaaagaagattgcacagcatggttcctttcagtcagacctggcaaagtgtcggatagaactggagcaaactaggcttctggtgcttgaagcagccgatcaactcgaccggcatgggaacaagaaggcccgtgggatccttgcaatggccaaggtggcggccccaaatatggcccggcaggtgcttgacatggcaatacaagtccacggcgctgctggggtctcatccgacacggtcctgtcccatctatgggcaaccgctaggacactgcggctcgccgacggccctgatgaagtccatctcggcacgatcgcgaagctggagctgcaaagggcgaggatgtaagatcaggcccatatatattgaataaaaagggggacggcaaacttctggagaaggtcagttaaggacatcatcagagtcacgggtagatagaatggtgaaataagtggcgttagattcctcctccatgcacctcggccgcgcccacnnna

SEQ ID NO: 6101 - DNA, 836 bp, Triticum aestivum
  unsure (1)..(836): unsure at all n locations
  Clone ID: PAT_TA_6101
cagctcggcacgtcaccgaacccaccgcgcaacttcccccaaccaaaagacagcaccgtgtgttcttgtgtgtatatgtctatggcctaatcgagaccatggacgttaccggggacgccggtggaggtcgccgccccaacttccccctgcagctcctcgagaagaaggaggagcatccgtgctccgtctccccggctgctgggctcgggacgaatgggtcggcgacgggggagctgcaggtgcggaaggcggcgccgcctaagcggaccacgagcaaggaccggcacacgaaggtggacggccgcggccgccgcatccggatgccggcgatctgcgcggcgcgggtgttccagctgacgcgggagctggggcacaagacggacggcgagaccatcgagtggctcctgcagcaggcggagcccgccgtgatcgcggccaccggcacaggcaccatcccggccaacttcacctctctcaacatctccctccgctcctccggctccatgctctccaccatacccgcccacctccgcgcccccccggcctgcccggtctctttttggaggtggcgcacgggctgacgccttgggacgctttcttcgctcgggttccgcggcggcttcgaaagcccggatcaacaacaattcttcttgttccccgctcttgctactttcatcctggaancttcgctccactttcccatcttcgngacggcgcggcaacacgactttcaagaacgngtttngacaagaatgcacacaggacacaacanaacaanaacacattcaacaacaaatgcngtacaccaaancaatcccggacgtttggattgtccn

SEQ ID NO: 6102 - DNA, 1010 bp, Triticum aestivum
  unsure (1)..(1010): unsure at all n locations
  Clone ID: PAT_TA_6102
gagcttcagcccccggcgccgatgcagccggaggcgccttccgagcagctctgctacgtgcactgccacttctgcgacaccgtcctcgtcgtgagcgtgccgagcagcagcctcttcaagacggtgacagtgcggtgcggccactgcagcagcctgctcaccgtcgacatgaggggcctcctcttcccgaccacgaccaccactgtcgccgccgagtcagccgcttctgctgtcaccaccacgacgtccccgccgccggccgccgctgctcaccacggccagttccactaccccagctcgctcaacctcgcgcccggcaaccctccccgccactccctcctggatgagatatccagcgccaacccgagcctgcagctactggaccagcacggcctcggcggcctgatcgcggctgcgggcggcaggaacgccgcggcacctgcgccgctgccgccacccccagtcgccggggggaaaggtgggaaggagccatcaccacggaccaatcccgtcgtcaacagacctccggagaagaggcagcgcgtgccgtcggcgtacaaccgcttcatcaaggacgaaatccaacgcatcaaggctggcaatcccgacatctcgcacagggaggccttcagcgcggctgccaagaactgggctcactttccgcatatccactttggcctcatgccggatcaccaggggctcaggaagaccagcctcctacctcaggatcatcagagaaaggatggccatgggcttctaaaggaggggctttacgcggccaacatggggattngctccgtactgatatcaagctagcatatccatgctattgccatcgcctccttgactagctcctatcgactattactatcaggctatctttaattagctagggctttctgccatggtaaacaatataattacctcagttcgtatgacctattagctataattaagtgatcaatatcgatctagtagcacactcttcctgccaaaaaaaaaaaaaaaaa

SEQ ID NO: 6103 - DNA, 706 bp, Triticum aestivum
  Clone ID: PAT_TA_6103
ggcacgagggcaagcacatcaatttcaagggattcatgatcgggaacgcggcgatcgacgaggcgtcggacgaccgcggcatggtggactacgcgtgggaccacgccgtcatctccgacgagctctacgacgccatcaacaagaactgcaggttcgaccaggccggcaacagcagtgacttctcctcgtcgggccacaaccccgccagcaaccccgcctgcgaccgcgccatgaacggcttctacggggcgttcgaccacatcgacctctacagcctctacacccccgcttgcaccgccaaccccgccggcacggcgggccagctgccgcgccgcctccaccggtcgtccagcaccgcgtccgacaacggcaggcccctgcggccgcgctacaacagctacgacccgtgcctggacagctacgccgccgagtacctgaaccgccgggacgtgcagcacgcgctgcacgccaacgccaccgggagcatcccctacgcgtgggccgcgtgcagcgactcgctgttccagcactggcaggactcgccggcgtcgacgctgccggtgatcaagaggatggtcgacgccggcctccgtcgtgtgggtgtacagcggcgacaccgacggccgcgtgcccgtgtcctccacccgccacgcggtgcgcaagctcggcctcaagaccctcaagcagtggaggggagtggttcacc

SEQ ID NO: 6104 - DNA, 1431 bp, Triticum aestivum
  Clone ID: PAT_TA_6104
ggggacccgtgcccagtactcaggaccattgatgcctcctggggtaaacatggaagagatccttaaagagcacgagcggcaaatccagcaagccgtgcgaagggctcgtctggacaagggaaagggcaagcacgccgagagagaccagtcagagtcgctgctgtacgctgcccataatggcaggtcatagcgccgcaaagctcggctcggcattcttgatggcttcggcaatggaaagtagtgtatgatccccttattttttacgcccccgtcgagcggagaggtttgttctgccggcagctcccacaccattgcgccagtggactggctagttcctggcagcaagaagaagaagaaggcctgctcttcactcatgtaagagatttccgccaagtttagcaagaaagatattcgctggcaaagtttgcttgcccacacagtcaccaattgtatatctcagagatgagtacccacccgcttgaggatcgatccttctgaccacctggtggttgggtaggtgcctacacgaattttatcatagtatacttcaagtcgttcatcctccactttgggtcgatcaagtggcacagatccaaacggccagagattctacacctctcagattgctgctgctgagatgtctaacccatctactgcaactgggcagcgaggcaatactggtaagctgtctaaccttggggacagcgccaggaaacagtatttaagagagcatcggtcgagttcaagatacagtcaactcgctgctgccgaccagtctgacaaacccaaatggtcgcaatcgcatcaattccaagaaaggccgtcatcttcccatcggaaggatgaagtggtggcagataaggagcctacgggggtgaatggcacaaggaagaaccgaatccagtactcaggaccattgatgcctcctggggtaaacatggaagagatccttaaagagcacgagcggcagatccagcaagccgtgcgaagggctcgtctggacaagggaaagggcaagcacgccgagagagaccagtcggagtcgctgctctacgctgcccataatggcaggtcatagcgccgcgaagctcggctggtgttgttgatggcttcggcaatggaaagtagtgtatgatccccttattttttacgccccgtcgagcggagaggtttgttctgccggcagctcccacaccattgcgccagtggactggtggttcctggcagcaagaagaagaagaaggcctgctcttgctcatgtagagattttcgccaagtttagcaagaaagatattcgctggaaaaatttgttgcccacacagtcaccaattgtatatctcagagatgagtacccaccctcttttgaggattgatgatccttacacctgtgttttggtaggtgccaaggagaaatttaaccagtttatactt

SEQ ID NO: 6105 - DNA, 425 bp, Triticum aestivum
  Clone ID: PAT_TA_6105
gctattcatgactcatgggagaaagttttccctgaggtcaacttcgaatggcttaaaccaaattggtgcatctgatcttccatccgatgattcagaggaggattatgaccctactttagctgaaggggacacggtagatgaagacaaatcatctgcagaggatggggacgaaggatcagattctgatgacctggattttattacatcatccgatgagtctgaaccttcaaagaagaaaaggtctgaatcaaagaacaaaaataccgtcaatgacctcgcgttgccttcggatgactcagaggatgatgactttgatccagaaggtccaaattccagtgaagaccaaaagaccaaaacagactcagacgagtggacttcacatctgattctgatgatttctgtgccgagatttctaaatcttctgg

SEQ ID NO: 6106 - DNA, 655 bp, Triticum aestivum
  Clone ID: PAT_TA_6106
ctcaaagctgagtagttctggtcatcagtgctatctgagcgggcagaatcctttcaaaaacagctcgcctctttgaccgcaacaaagaaagggcctccttcagaaagtgacgatgataacactccagcacccaaatgtgtaaacgaatcagaggtaatcacgctgttgttctactttccgtttgcattctgacaataccaaatgttgtctggccactgacatctaggatggcctgaacgacgccaccagctcgcttccaccaacagaagaagcatcatacaatgaaccggatcacgggcccagcaagaaaacaaagtctcagtcaaagactaaattgacaggtcaaatgatacataaacggagatcacgctggaattttgccctctgtctatgcctcaagtatcgatgatacctccctgcactataactaccatgtcctctttattctgtttattcagcaaatgatggattagacgaggatttattcagactcaatctgtacaacaatggagtattcatgcagtcttttatttaagctttcaaatgagtgcattggatgctggctttgagcatttggcttgcatgttttttcttgctgttatattatctatatacaacttttcctaaatgagtaccactctatatgaccttttct

SEQ ID NO: 6107 - DNA, 538 bp, Triticum aestivum
  Clone ID: PAT_TA_6107
gttgaagctgcattcaaggaagcaggacaaggacaagatgaggcatagaaggtagcagctgaaggaaagaaatttgtcagatagctttggaaaggtgtttgtcaaatcttaagtatctcaggtatgccccttcttggatgtttatgtgtacccgaatcaaatgatctcattcgataactaggaattgaaaatatttattgtaaaaatagctcagtctcttctttggcaactattatgagtcactctcattctgttgctagaagctgaagatgtgaaattgatttgctaccagagaaacaaaagaaattgatttatatggaggtatactgcataagtttccaggctccaaatagattggctaccagtgtccattgcatgagactacaagttatacagtataattaattcagacaagacattagtacatcttcacatagtataaagtatatactgaaatttgatataaagttcctgacttgcgcagcctttagccctttatttaatctgtcgtagacacccctagtcttgacacaagcga

SEQ ID NO: 6108 - DNA, 662 bp, Triticum aestivum
  Clone ID: PAT_TA_6108
agaagaagctgagtatcagcagcatcggaggaggcaacaagaaggagaatatgaaggggaatggacgaagcaatgaaggtggaagcagatggagttttggacgatggggttctacaaggacagcctcaacaaacacgttatcaaatctggtgagtcccatctctctattactctctaaattcacatgtttcttcacttcaactgtacatgtacatactttaccttgccatccactcgcctcgcttcccgacccccccttcgtctctgtctcctctctttgccttactcaggttacgcaccgtaaactgtaactggcaaagctgcattggacttgcttgggctttggctttaggcttgcttgagttagtccctgacggttggtgccgtcatcagccaaccgaccccccctgaaacgagacgagagcgagagagagagagaagaaaaaaaaaaaatatgcaatcacttgttgaagagagttttgttctggttgaatttgaactcaattatcagagagagcaatgagagagcaagcaattgaaacgacagcccaataaaacagcaactcggagaaaaggcgttatagtattacagtcctacgcaaacagaatgctctcttacatttcaaaaatggattaacaatctcaaaaaaaaaaaaaaaaaa

SEQ ID NO: 6109 - DNA, 643 bp, Triticum aestivum
  unsure (1)..(643): unsure at all n locations
  Clone ID: PAT_TA_6109
cgggcccatctacaggttctacatgggcaggcagccgctggtggtggtcgccgacccggagctgtgcagggaggccggcatcaagaagttcaagagcatcggcgacaggagcgtgccggtcaccatcgctagctcgcccatccactacaagagcctcctcttcaccaagggctcgacatggcaggcgatgcggaacgtgatcatctccatctaccagccatcgcacctggcgagcctcatcccggccatccagccctacatcgagcaggcgggcaacctgttctgccccggcgaggagatcaccttctctgacatctccatcaggctcttcaccgacgtcatcggccaggccgccttcggcgtcgacttcgggctcaccaaggacgccgccgacgacgccgagaagatcatccacgacgcgccccgcgacttcatccaagaagcacctgtacgccaccacgtccctcaagatggacctctcgggctcgctgtccatgctcgtcggcacgttcctgccggcgctccagaagccgctgcgggaagctgatgctgcgcgtgccgggctccatggaccgggcggatggacgaagaccaacgacggcgctcagcgggcgagctcgacaacnatcgtggcggagcgggn

SEQ ID NO: 6110 - DNA, 1538 bp, Triticum aestivum
  Clone ID: PAT_TA_6110
cgtccgcggacgcgtgggcggacatcgcaaggcacgcacgccgtatcagttcatactcacacgcgcaacggtagcatcgctcgtgatagcactgcaacttgggtggcgctttgtctttgatctcagtccggagggaagggattggtcgagccaccacttgccagcgatggagagctgcagcttggtcgacacggccgccgccgccctctgctcgacggcgggcgggcgccgccgcggcagcgccggaaacaccatgaggttcttcaactgctccagctcatccagagagcacggggtgagcgcgtcctactccatcggccggatgctgagcggggtgaggtcggcggcgcggaggaagctgttccggagcgagcccgagtggatgggcgtcaacttgcccgactccaccggccaccattggtggaccaccctggagaacaacttcgtgctggaggcctccgaggacgagtacggcggggtcgtcgtcgacgccgacaggctgccgtccgacgaggccgccttcgcccggtcgctcgcggcgtccctctcctactggcagtccgtgggaaagaaaggggtgtggctgaaactgcccgtggaccgatctgagtttgttcccatagcagtcaaggaaggattcaagtaccaccacgcggaggaggcctacttgatgctgacgtactggatccccgacgagccgtctctgctcccagcgaacgcttctcatcaggtcggcgtcgggggcttcgtgatcaatgatcaaatggaggtcctagtggtgcaagagaagtatcgcggctgggcgttggatggtgtctggaaactccccacggggttcattcaggagtcagaagaaatatacacgggagccatcagagaggtccaggaagaaacaggggttgacactgaattcgtggatgtggttgccttcaggcacgcgcacaacgtggcgtttcagaagtcggacctgttcttcatctgcatgctgaggcctctgtcgagcgcgatcaagatcgacgaaacagagattcaggcagcaaagtggatgccgctggaggagttcgtgaagcagcccttcatccaggaggaccacatgttccagaagatcatggacatctgcatccagcggctgaggaagtgctactgcggcctcacggcgcacaacgtcgtctccaagttcgacggcaggcagtccaccctctactacaacgtgggcgagcccgaggacgtcaactgcgacgccgcctgacgggtcgccggattctttttgctctgggacctctaccgtttaggaattccgcggtacaaagttctactagcatcaaggcaagcctctgtatatatgtgtagaagactgtaattagacatgggtgggacggattagctctgtcgtgtagcaataatgtactactcctattcttcagtggaccggcttgatgggtatgggtggtggcaattatctagtactagaagaaagtggcaatgatatagtataagaaatatttctttcaaaaaaaaaaaaaaaaaaaaaaaaaaaa

SEQ ID NO: 6111 - DNA, 624 bp, Triticum aestivum
  Clone ID: PAT_TA_6111
gcaggaattcggcacgagggcaagttgtggtgaacgagcaaaaggtcgataaattcctctatacaatgttgaagttgaactcgacgatactcaggtactccagaatggcagctgtggtgctagtgagcctccctccgccaccgctgaatcaccctgcatacttctacatggagtacatggatctgcttgtagagaacgtcccacggatgttgatagttaggggatacagaagagatgttgtcacgttttttacttgatcaaaaatacatacagtctgagctccattcagttgttgtgccattgtagcagaatggatacacagatgtgtgcatattccactgctgacgttggaagccctcaccttgacggctaccttagatgggatgcactgggtttgttattgccatattataggtacgtaaactatagtgtcttcattccttttctggacacaacagatgaatacttggtcattacaaattttgtagccccattctccaaatcaattgtagaaacttccaaaaaaatttaccgaaacagtagcaatagtgtccctgtttttggctattttccgtgatctgtatacggctgagaggctgcaaaaaaaaaaaaaaaaaaaaaaaa

SEQ ID NO: 6112 - DNA, 1076 bp, Triticum aestivum
  Clone ID: PAT_TA_6112
gctccccgcccctcctcccctgccctgcccctgccgcgcgcccccctcacccccccctgcctggccccggccgccggggcgcggcgcgcccgccgccgccggccgcgcgctgctcccccgtcgcgacccgcatcgccctcgcgcggcgtgccctccccccgccgccccgcggctccccctcctctgcccgcggcagcccccccatggcttggccgccccccgccccaccctgtcggcccggccagtcccagcaacatcgccaccaggaacgagcgccacggaggccaagcttctgacccggccaatccactgccgctccgccgcgtcgtcggctacggcgccggcccgccaccgcccgcttcaccggccccccggccccttccgtccccttcctccccccaacgcgcgccgctcccgcgtttcttttgctctctgcagcgccatcatcggagcttcatggccgcgggcaccttcatccgttgccacacgccacctgggcttgcccacgttccgatccagccggcaaacgtacggatccgtttcccccgtgtccgtcccaggcctttctacctcgttggagtcgtcaaggcgcaggcactctctaccaagtcaactgcatcgcgcccctgctccgtctcgggaggagcagcgagccagcgcccgcctctgcatcgagcactgctcgatccgaccacatcgcccaaggcccactccgccaccgccttgctccgccctcaccgtcctcccgccgggggtcgccaccgacatgaacgccgaagaggaggcatgcggtgagggggagatcgccggcgtggccctcgtcggtggcggtctccgggcgggaggcgcagaatcgggcggtcgggcgcggtcgtctcgggcgggtggcggcgtagaggggaaattagaggtggatcacctggcgaaccgttctttacgtggtggattgcgggttgaatacctgaaacagtaggggggtttctgtaaaaatgccgacgacgtacggcacaaacccaattctcttaattctctttattattattaggtagagattgtttaaaaaaaaaaaaaaaaaa

SEQ ID NO: 6113 - DNA, 715 bp, Triticum aestivum
  unsure (1)..(715): unsure at all n locations
  Clone ID: PAT_TA_6113
ggaattcggtncgaggacggacctgggtttcgccgccgccgcctccccgccattgaaaatcggcccctcgccgcctgtccaggctcgtccttccttcccgattcgcacgttgcgtgccccgcctcgtacgtccacgggctgtacaagatcccgccgttgaaccgaagtccgcgggacgagtagccaaggcaccaagctgacgctggccagcctcttgtcctgcccaaaggaaggaaggtctgctccagtcttcaaaaagatgcggaaagctaagaggagcggtgatcatctcactagaagctttcttaagagcagaagagcttccaaaaatgaatcattggtctcaggttgcttcattggggactctgatcaaggtgttcggtctgggctcagtgataggctaatatcatacatgtctaaaagcgtcgtctctattactttgtacaatgaaggcacaatcctattttcatgctcgggcatagctatggaacgcaaggggtgccaccttacaaggtttctgacttctgcaagtttggttagagctctgaatggtacaaatgaagaccatgatgacttgaagattgaagtgcgccatgaaggcaatgaagtgtatatgggggtgatggctgaatatgatttagatcgcaactttgctgttgtcaatgtcgatgcgttccttgatgttcaggttcaatctttccaacatgcaccgcga

SEQ ID NO: 6114 - DNA, 1235 bp, Triticum aestivum
  Clone ID: PAT_TA_6114
gtggcccgtggaatgaattatttgcacaattgtacccctgttgtagttcatcgagatttgaagtcaccgaatctacttgttgacaagaattgggttgtgaaggtttgtgattttggtttatcacgtataaagcacaataccttcctttcctcaagatccacggctggaacagcggaatggatggcaccagaagtgcttcgaaatgaaccgtcggatgagaaatgtgatgttttcagctatggggttatattatgggaactttgtaccttgttacagccatgggaaggtatgaatcccatgcaagtggttggagctgttggttttcaggaacgacgccttgatattccagccgaggtggatcctgccatagcagagataatagagagatgctggcagacagacccaaagacgcgtccatcattttcagagatcatggctgccttaaaacgagtattgaaaaaattgtctgccaaccaaccacgaagacagcgagcacaggaagcagatgactaagaaaaaccagagatcaacatcagctgatataacataaacaaaaggggtgcattggtttttcctgctgtccaccagctgtccgtctgtaactataccattctttgtatagctccaacaaatgcttgccaatgatggaaaaggtgagattttggtcgttttaacctccaaaggcagctgtaaattttccagtgacgctggcagaaatctgccgagcattactgcttcagtccatctattgggtggaagacaatccaaagaataaacacacccatcaagcaaaggaaaaagaaggaaaaggaagaaaaattccaggacagttagtccacaatagcgatgttgggcaatggcataacgaagttgagatttcagagtcagcgtgtcaggtagaatgggatcctcctttgtttagttatatgtcttttagttttccagccaaagttggatgattcatgtttattcaacagaaagatgctatcgatacgttcaccttgagcatcaagaggcaccgtggcccagggccttgtgtatatcacaccatggcaaatttgtctgaattggcagttagatttccaaagaaaatctctgctgtttgtgctaaaatcactattctttacagcagcagtgttgattcttctctctttttctttttgctgtaacaagtgtacaaaaatatcccatagaatagggtgctaattgatccaaaaaaaaaaaaaaaaactcga

SEQ ID NO: 6115 - DNA, 839 bp, Triticum aestivum
  unsure (1)..(839): unsure at all n locations
  Clone ID: PAT_TA_6115
ctgtggccatgccggtgccctagccccgcctgcgccactagcacggatttcacccgcctccatcacccttcggacgaaggcctccccagcagttagatccgcctctcccatggtcggatccgcctctcccaacggccagagccctctctcactggtagccgtcgcccctgcttctccaccgccggagaaggggagggcagcgggttaggccgagaagcagtcgaggagatgggaagagcagtgacggggaggcgacacttcttctccaaccagatcgagcagtggtttgaggtgccccaatgtgtcgtgcgtacctccccttgctcccccgttcgctcaccgccgccaagatccggcacctaccttcctctctcgagcttctctgcaggtgagcatggggagtgcctccctgtgagcaccggctccgtccgcgggatctcaactcccccctctctcaatggatccatggtgcggcagtccggcatgcgcacgcgtgcagcacggttgtggcgtcgaggcagctcgtgtcgttccttcagcttggtttgtgtgcgtagtgcagtttgttgctacggggtggctggcatcaacgtgcctccagaagcagctcactcctcaagtcgtcgcagttcccggcggtgggagagaagtgcaatgctctatggtgctctctttcacgggacagtggtcatctgctgcggtgcagctcaaaacatgtgcagcattcgtgcttggcaagcacacaatgttgcccggtcacgcaatgtgcctccntcgtcngtgataccactcatacntaatattcagtgaaganntcgaaccgcaagtgcatcaacaaa

SEQ ID NO: 6116 - DNA, 963 bp, Triticum aestivum
  unsure (1)..(963): unsure at all n locations
  Clone ID: PAT_TA_6116
gcggggtagagtcaatgttaattgacatttcaactttgcgagcggcaaccaaggattttgcggagaacaacaaacttggtgaaggcggatttggccccgtgttcaagggtactctcttgaacggcgatgagatcgctgtgaagagactctccaagagctcaacgcaaggggtggaggagctcaagaatgagctcgccttggttgcaaagctgaagcacaagaaccttgttagactggtcggcgtctgcttggagcaacaagagaggctgctcatctatgagtttgttcctaaccgaagcctcgacctgatccttttcgacgaagcgaatcgtcagcaactggattgggaaacgaggtgcaagatcataaacggagtcgctcgaggcctgcagtacctccatgaagactctcagctcaaagtagtccatcgtgacctcaaagcgagcaacgtcttgctggacatgaacatgaacccgaagatctcggattttggccttgccaagattttcgggagagaccagacccagggtgtgacgaaccgcgtcgtcggcacatatggatacatggcgccagagtacgtgatgcgtgggaactactcggtcaaatcagacgctttcagctttggcgttttggtcctggagatcctgacgggaacgaagaacagtgactgctacaactcccatcaatctcaggatctccttgaccacagtatgggagcattgggcggccggaacagtgttggaggtggtagacccgtccatgaacaagagcttcccggaggggcatccgctcaggtgctgccctgccgggctttccggcgtccggcccatcccggccgcccggccgttgctcgcggcggtggccatgccccgggcctccaacccggcctctccccctaccccggccaagnangaccggtcaaantcattcacatgaagccgtnnaaaaattcttatanacaat

SEQ ID NO: 6117 - DNA, 533 bp, Triticum aestivum
  unsure (1)..(533): unsure at all n locations
  Clone ID: PAT_TA_6117
ttgggaagaaaagcaaccttttattttgcatgcatcagcatgatgatacatcagtgttccacttacaccacacacacaaaagtatgatgaaacaacatgaaaaactcatgtgatcctgtgatgactcgaacaaataagaaaaaaatggactcctgtggtgacagcaaattgcatgcttgctatgctcttgtctattaccccgtcccaaattagttgtgtcaatttaagacaactaattcgggacggagggcgtatatttgaatatatgagatccttttggctactgatgacttgataagtttgccagctcctcctttgtcagtgccgacggggcgacttcaatctgctccaccacgaaaccagcctcctggcacgccgtcttcaggagctccacctgcgcatcaccgcctgggttattggattaancataagggaaacaaaaagaaaatggaaaacaaaaattgcgacatcaattgttcccaagaaataaacaaaccgcgctaaaaaatcagacagncaacacaagatctccn

SEQ ID NO: 6118 - DNA, 461 bp, Triticum aestivum
  Clone ID: PAT_TA_6118
atcaggatctactttgatcatgccagtgttggacaaccagctgaaatcacctagtccactattagtccctgcaagagatgccgtcacccctttgtccgagtcagaggcggtcgacctagttaaggatgtctttgcatctgcaactgagagggacatctacaccggggacaaggtggagattgtagtcatcaacaaagctggtacaaggcgcgagtacatcgagttgaggaaggactaagtttgcgccgcggttgccatttgcttccctagatatagggaattattatgcccagagctgctacttgatagaaacacccgtgcttgctttgcttccgtgatgatgtaccaggatcgacccagcttgccttgttaaactactttgttgtttcatgcatatgagatgctgagctatttgttggaaatgctaaaagtacgttcatagccattctattataacccag

SEQ ID NO: 6119 - DNA, 1876 bp, Triticum aestivum
  unsure (1)..(1876): unsure at all n locations
  Clone ID: PAT_TA_6119
ggccggctcgaggccnnggccgggcccgggaacgcagcctcaggccgccgggatcgagaaggtcacgaagaaatctgatcaaagggggaaggaagcgagacacagggcgccggctgcgccacgcactgctccccttcgccttctcctccaagccacgaactccggcgactccaccaccagcccccgagcagcccgccctctccgaccaccgccatgtcgaggcgcggcgactgggtctacgagaacaacggcgggacctgcgtggccatcgccgcgcgcggactactgcgtggtcgccgccgacacccgcctctccgtcggatacaacatcctcacgcgcgagcactccaagatctgcgagctggccgataaatgtgtaatagcatcttctggcttccaaggtgacatcaaagctctacagaagaacttagctgccagggaactgctataccaggcacaagcacaataaaatggatgagcctgcccagcaatggcacaatgctctccaacaccctgtaacaagagactctttcttcccatactatgcttttaaacgtgcttggtggggccttaaaaggaaggggaaaaggatgtgttactcatatgatgttctgttgggtcctatgaaaggactggttacagttccccgaggtatcaggttcaacctggatcatgccagtgtgctggacaaccagctaaaaatacctagtctcctattagtacttcctgcgagagatgccgtcaccccttggtccgaagccagaggcggtcgacctatttaaggaagtcttgtgcatcggaaacgcaagagggaacatctacaaccaggggcaaggatggagaattgttgtagtcatcaccaaagccggggaacaggcgcgcgagcaacatcgagatgaggaaggacttagtcttgcgccgcggcatctacttccttccctatgatgtagggaattgtcatgcccagagctgctacatgatcgcaagtcccttgcttggtttgctgccagtgtttactgtgccaggcccagatccatctttgctatgtataaacttctttgttcgtttgcattccttagatagatgctgcagcgcatgtttggctgccgtgatgatgtaccaggatcgacccagcttgccttgttaaactactttgttgtttcatgcatatgagatgctgagctatttgttggaaatgctaaaagttccctcttacccaggcgagtaaaacgaattgcaacttctgttggatgcggttcaggagggcttaccaaaacctaagtgaattactgatagcatcccggaatctggagttcttcaccaatggttaccgatatttaattcaaatcctgccagctgcagttgttgctccaatgttttttgcaggaaaaatcgagtttggagtaataaaccaatcggtgtctgctttcaatcacatcctcagtgatttttctctcattgttttccagtttcagtcaattagtgcattctcagctgtcattgatcgtttaggtgaatttgatgatctattgggtgaaaatgagtcttctctatcaccccaacgtgatagcattgatgggatcaacatttctttcaagagcggcagtccttctgttcttagttctaatggatcacaaatgcaatctgagccaggcatagttctagagatttgtgatttgacattgttaacacccaggggtggaaatattcttatcactgacttcagtatggaattaaaagacaaggaccacctactggtgatgggacccagcggctgcgggaagacctcattgctccgtgctttggctggcctttggactagtggcactgggaatatcatataccatgccagagattctaggcagcttcagacagc

SEQ ID NO: 6120 - DNA, 772 bp, Triticum aestivum
  unsure (1)..(772): unsure at all n locations
  Clone ID: PAT_TA_6120
ccctgccacctggggagagctcaatcgagctcgggagattgatctggcgacatgtcgaggtggggaagtggcttgctcccagccctgttgctcgcggccatgctgctatgtgcgtggccgctggtggtggtcggagaagacgcacctcaagcttacgcatacccagcacctaagccatgcaatccagggagcacagggccctcccccgccccctggcaaccttcctcctcgttctcgtcgccgccctggtccccgtccggcaccttgtccccttggctaaatttcgtttagcccctagattcttacgtccggtaaaatccagttatagctattcatctatattaatatccctctatatatatacttatatatataaattcatgtgagatttataatcatgtcaaagcaaacctatcatagcacttctagttgtcatagagatgttttttttttggcaagcacgtcaatccccgccccgccaaagatttacttgtcaaagcctgacaaaaagctatacacggcagattagccatgttttctaccaaaataggccatccccacaacgactcgcaatgattgacgctacaaggtttgggcagccatccacacgtctctggcgtctcgcttgttgccaggccccaaggtgcgatctcgcaccctctttctttcaactttgtactcggaatccgcatctttcgcatgatatatcttcnatggaatattagtccatatgaaacgatgactttttaaaaaaaaaaaaaaaaaaaaaaaa

SEQ ID NO: 6121 - DNA, 877 bp, Triticum aestivum
  Clone ID: PAT_TA_6121
aacgagcggtccttcggaccggctcgtagcccgctcggtccaggccggctcggtcctatcccgacgaaaaatacagccggtccgagctgcagattccgggccgaaaatttgtcggtccggtccgggctttcaccgagccagctcgcaggaccgacaaaccgatacatcggcatggcgggaacgtggcgggagcacggtgagcaccaagtggggcatggctggggcttggctggggcatggcggagctctggcgagggcgtggcggggctgtggcgggtgcatggcgacccaggcgtggtgggggcgcaagaaaactactgtcgtctacgtccgccaccgtggggctgtcgtccgcgcggccactggactctctggccccggtgaccttgtccattggatgcgccagagtctgattagtcgtctcagccaaagaaatcaacgtgggaggtcctacgtcgccgcatcgatcatcgtccctttcgtctcagttcactggccgtttgtcgccgttgggctgccattggtgatgttcttggttactctagcttcctttggttcttctgtagcttgcagacatcttgccgatgagctgcgcttcctctagccggagcagccgtcatcggagctcgagtgcgcgctctggcttgtgtactggccggtcctctcggtctggcccgggctttgccgccgccggtccggtccctagaaacaggaccgccagactggtcggtccggtccggctcggtccgccggcggccggtccaagtgacggctcggtcagggatcggatcggctcggaccgtgtccaccctgagttgtaagcattccattccaatcaagaaaggcatcaaaccactccaaaaaaaaaaaaaaaaaa

SEQ ID NO: 6122 - DNA, 654 bp, Triticum aestivum
  unsure (1)..(654): unsure at all n locations
  Clone ID: PAT_TA_6122
ttctgaagcttcgctgtgcttgctttcccccaacaagcagtaatccaatcacgggtgcatcagtgtgatttctttgcatcgtgtgctgtcttctttggcctcctcttctgctgcacctgtgcaccgacgaccacaatgggatggatcaagcagccaagactcagagtgtggtcgggcagcgccatggggcagatctgtgcggcgcaaggggcggcagatgcgaaactgaagcttccctgctaacttcggagcagtcaattgagcagatggacacgacgaagtgaggattgggtgctgccgcccctgggtaggagcccaatgtccctaatccgaaactactgtcatgggagagggcaatacgttggatttggcttcagatttttgggagaacaaacgcccattgtgccgaacgctccgcatacgattcctcaatctcttttgaggggaggcagatccgggtttcgatatcctgtatcctctgggttcaaggggtcgtggaatccctttgggtaatacgcgcttgcaacgttatgcccacncganaagtgcgcatctnacatcatgccggaccgtccaacatcacgacatgccaacacanacgtttnaagnattgagaaattngnancattaactcaaggaaacatggattcttgg

SEQ ID NO: 6123 - DNA, 798 bp, Triticum aestivum
  unsure (1)..(798): unsure at all n locations
  Clone ID: PAT_TA_6123
tcttttcaactgtgggaacagctgctatgctaatgctgttctacaatgcctcatgtgcacaaaacccctgatgatccacctgcttctgagattgcattctaaagactgtaatactaagcctagcgtggtcgcggccgaggtactgttgtctgcacagggtaaaagtaataatacagttgtctactcctgtctgtctcacactctttgttatcttcgtataggttgctcaaagaactggtgtcttatgtgcgaacttgagcaatatgcttcaactttacgtgaaagtggtggacctgtgtctccaagcagaatcctttcgaatctaaggaacattggatgtcgcttgggtggtggaagtcaggaagatgctcatgaatttttaaggcatcttgtgatgtctatgcaagcagcgtgcctggatggactgggtggtgagaagcaagtagaacaaagcttgcaggaaactacactgatacaacagatgtttggtggacgccttaaatcaaaggttaagtgcctcagatgccatcatgaatctgaaagatacgagaatataatggatcttactttggagattcatggttgggtggagtccttgcaagatgctttgacannnnnntcactgnctcctgaagatttagatggggataatatgtataaatgtggaaggtgttgtgcttatgttaaagctagaaaacagctaagcgtgcatgaagtgccaaacatattaacagtagttttaaaaagattccagacaggaaagtatggcaagattaacaaatgcgtcacttttcctgn

SEQ ID NO: 6124 - DNA, 980 bp, Triticum aestivum
  Clone ID: PAT_TA_6124
ttgtgcagtacgaaaactacttactggccctgttatttctcaggcaacaaactgaatcatcatgttggcatatcagaaaagcatgcaagggaagcaaactctgagttgggtcatgcatcattcactcctcaaatccacatcacgtctatgaactttcacatgatgcacaccatatgccatgaaaactcaaatatctctttgcattttcatggagatgtttacaccaagttaaagtaaaccaaacactgctttgaagttctccaaccgctggatggtttagttgcatggaagaatagatcaagaatgttaaacaggggacaactcctctcttcaagcacttccatgacaggaggtagcaggctcggaaaagtcagcttgagctttgttcactgctaaactagcaccagacttgaatgagaagaatggtacagcagacgtggcggaatccaggatgttgcacatttttgttgtgactactcctaagcatcttttcccaattcagcaacttcaatctgacagtaagattgatctgcaagaagataaccagagtcaaggcaagcagttgcatcaagcataaaaccactctggttttcatgaaaccactggttccgcccttgtatttttttgggggggctttttagatgagatggagctagcacacaccaactaatctgtgagataaaaaggtatagatatatgaatacgataccctatcaacactgttgggttcctagcataaaaggaataaagaagatgagcgatgatagagcgaagggtgcaaattgcagaaggttgtcaagaagagtcacaactgtaaactgcaaactggtgtccatgtttttttgtccattgtcaagaattttaaggttcctatagctcttactcttgtcatgcctttatgaacaacagtggtaagctacaaatgtcaagctcaaatcaaacactaggagtataggaattcaaaaaaaaaaaaaaaaaaa

SEQ ID NO: 6125 - DNA, 1447 bp, Triticum aestivum
  unsure (1)..(1447): unsure at all n locations
  Clone ID: PAT_TA_6125
cggncgcgtgggtggttgtgacattggtgttgctagcactaaggcatacacaagtcaaattgtagtcatggcaatgatggccttggctattggatctgaccaaatatccactcaagctagaagggaagctatcatcagtgggcttttcagtcttccaagcaatgccagtcaagttctgaaactcgactctgaaatgaaggaacttgcctcttcattgattgactcggaatcgctcctcgtgtttggaagaggttataactatgccactgccttagagggtgctctcaaagttaaggaggttgcgctgatgcatagtgaaggcatgtttgctggtgagatgaagcacgggccactagccctagtggatgaaaaccttcccatcatcgtcattgcaacacgcgacgcatgcttcagcaagcaacagtccgtgatccagcagctcctttctcgcaaggggcgtctgatcataatgtgctcaaagggagatgcctctgctgtcaatcccggcggatcttgtagagtgattgaagttccaaaggttgcggactgtctccagccagtgattaacataataccattacagttgctcgcataccatctcaccgttcttcgtggattcgatgttgaccaaccaaggaatctggcgaagagcgtgaccacccagtaagtagaggaaaaacatgcagagtcatagctcagaagtattcaggtatttcttctagaaaagaagaaagagtgctgtagccgtgaatatcgtgatagtgtatatttgaggaggttagcatcgtcggcagcctgttgatcagctcgttgtgaaaatgtatgaatgttatttgcgaaaaagaaagcaggttatctttcaagtatgctttgtcttgtcgtaaacctaagatgatgcattggctctgctggaactccacacgtcggaacttcaggagcacacagggtgtgttatttgcagtaactccctgcggatcttgtagagtgattgaagttccaaaggtcgcggactgtctccagccagtgattaacataataccgttacagttgctcgcataccatctcaccgttctntcgtggattcgacgttgaccaaccaaggaatctggcgaagagcgtgaccacccagtaagtagaggaaaaacatgcagagtcatagctcagaagtattcaggtatttcttctagaaaagaagaaagagtgctgtagccgtgaatatcgtgatagtgtatatttgaggaggttagcatcntcgncagtctgttgatcagctcgttgtgaaaatgtatgaatgttatttgcgaaaaagaaagcaggttatctttcatgtatgntttgcttgtcgtaacctaagatgatgcattggctcgctggaattnctcatgttgtaattactgaaagacctttgtttgttattaacaaaaaaaaaaaaaaaaaaaaaaaaaaa

SEQ ID NO: 6126 - DNA, 673 bp, Triticum aestivum
  Clone ID: PAT_TA_6126
atcgcgccgcatcgacgggagagacgagatgaaccgtatctgccgccgccgctccgcgttgccgccgccggcgaagacgaccccgacggacgatgaaaacctcctccccgaggtactcatccgtctccctccgcagccatcctgctgctgcccccgcgcctccctcgtctgcaagcagtggcgccacctcatcgccgatccccaattcctccgccgcttctgcgcccaccaccgggagccccccatcatcggcgtgttcctggacttctaccgcggagacctctccttcaggtcggtcctggatcgcccggacctcatcccgcccgagcgcttgtccgtgcggttcgacggcatcgaaggcggcggcgtcgagggaaacgacggcatctggtccttccgccgctgccgccacggtcgcgtgctcttcaccagaggggaccacctcggcaagggctgccgccacgtcctggtgtgggatcccgtcacaggcgaccgccgcttcataggcagtccgccgcagttggatcacgactggagcaagtcacatgtgcaagcggatgtgctctgtgttgccggcgacaaggaccacgtacacggcagctgccactcgagccccttcaatgtcgtcttggtgtgcgccgacaagctggccgcgcgagcctgcgtctactca

SEQ ID NO: 6127 - DNA, 651 bp, Triticum aestivum
  unsure (1)..(651): unsure at all n locations
  Clone ID: PAT_TA_6127
tcattccaacagtgccgcgtcttatgggctattgccatgtgngaaacaccagtttatcttaaatgtggagatctaacagatgcactggcgaaggaaattttagatgaagaccaaggtgatgagataggcgagtacacccctgacgtgcttgttagtgaatttatgaaaggagagacacagcttgtggaaaaactactccagacggagataaatctacttcgctcaatcagggatggctcggcccttatgcagcacatggaagacttttactacgtcacacttctagagactgtgagatcaaggtaccaattggttgatgatgcaagccaagaatagcaccaaattgaccgcgtggtcctattaaagttgtgtgctggaacttcccagacctgactcgcactggaaggaacaggatattaagggttactaagtgctcagcttcgttcaacagatacgtatattaatgggagcatttgcaaccaanggaaatctgatgtagaagacatcttgtcggcaattggttgcctgcctaatcaacatattctnggctgggtgagtgtaaccatttgggaggcctgctccgaaagacttgtatccccatttacanccacaagtgttgtttaaaacacnnctcnactaaccnggacactt

SEQ ID NO: 6128 - DNA, 919 bp, Triticum aestivum
  Clone ID: PAT_TA_6128
gtattctctctcagattaacgtggtcgcggccgaggtctagtctcgagtttttttttttttttttttttttttttttttttgtctcaacccgttgtcctcataacgagcagtcaggtagtgtctacaagatctcactcaattgtcaaagtaacagaagaaattctcgtaaatgattcggtccaagaagttaatgatggttgccatgctcggagaggtgtactacactgagcatgactcgaacccagtgcacttcgaggagaggcgcctgaatcgcaggcaaaccggccgccgttggcctgcgagtaccaccccatggacccccatgaccccgtcccacctccccgacgatccggacgacgacgtccggccgacctccccgtggcctccttgcccgttgacgtagaattgcgtgatttcacgtacccccgccggacaaggatgcccctcctcatcgattactcgaaagcgccggtggcctctcccctggctgccggccgacgagcttggtcaggcgcacgtcgggcgatcgtcagcacgtccgtccccgttggtgaagtggagggaccttggtgaagtgctcgtcctcgccccccccctcgatgcccgtgcgcggggaagcagtggatgtggcggccgcttggccagcgccggcgctgctgccggggagctgctgtctcggctggcgatgggtggaccggtctccggcggacggtcgcgcagggagatgcggccgaatgagggctggagaggttggggcgggggacctgacgagcctgcgacgctccgacggggcgatggcggcgccgagaccggcgaggcggcggcgagagctttcatcactgccggcatgatgcaattcgcttgctccggaagttgggcagttgggtgcggagcgagggttggtgtctagacgggccc

SEQ ID NO: 6129 - DNA, 614 bp, Triticum aestivum
  Clone ID: PAT_TA_6129
tcgcgctagaaggcgcgtcgtcgaccgggggcttcccgggatccttcccatggctggcaggcaccgccgggctcttggacttgtcccgcggctggaacttctggaaccaacttctcgcggaatccatcttgtgctcacaatggcatcatctctaagactagagagcctattatattgaccaatccagcagccgcccacaggccagaggagctctagctctgaagcggtcaataccctccaaatggatcagatgtccacaccggcacctcctccgtagaacccgatgctgggaatgatgcctatctcggcgcggagcggcggcgggggcgggcgcggggcggatctcggcggcgactggagcaaaagtgggagggaggagggagggactcacgccttttttttccttctctcttctcttcaccccggacgaatgtaccgagcaagaaactgaatgttgttcatctgagccttcatgttctgctcaggctaacatgcggtctttccattctaggcatactcgtgatgataacatagacatgaacatagaggacatgatggttatggaagcgatttggcgttcaattcaggatttcctatacttccttgctcctgaa

SEQ ID NO: 6130 - DNA, 2419 bp, Triticum aestivum
  Clone ID: PAT_TA_6130
ggggcgcgctggcctatcggtcgaaagactctgagctatataatttttttcaattggttcagaaaagcagaggtgaattcaattgtaatacacatgctcgtcagagctggtaacaagtatacacttatgctgtagccagtaatagccggggacccatcgccgagactgtcaaaccaacatacggcgaaccaaacaggcatcactgctaacatcaaacaccatactattttggagacaggggatggatgttgttttaacaaattcactaaaaagaaagcatcggttaggatttacaaaagctggacggggtaacaccaagaccaaaaggcaacagttttttttttcctctcttttacttttctgtggtttactttttaaaacctccatatcctatttacgtcgaggttggtattgttctggtggggcgcttgagtgagaagaaggttgtccctccttatggggcaacatatttaagaaactgccgtgcacaggttcatcttcatccatgctctcaaacaatgtcttgatggttggccgttttgatttggagctctttttcttcagctcggcaatcccggcaacttcatcgtcattcacaatttcaaagttcttgtacgtgtacccaacaaaatttgcatccttggatggaagcatctttctccatggacccgccttagatgaactctgaacttgtgctccagtctcctcaaatttctcaaagttctgagtatccaactcgccattaacttctggtatgaaagcagctttcatctgatacaacttttcccattggacacctctaaaccatgtatgtgcttttatttcatgggctccttttgttccaagtctctgctcaacattacagagaagtttgctaatgagatccttagtttcagaagaaagctttgcctcttcaggaaatttcaggtgacttctccagttcacaatctttctgcaggttgacattggatcctccgaataaaatgggggataaccaactagcatttcatacatgatagcaccaagggaccaccagtcacactccattccatatcctttcttcaatagaacctctggagcaatgtaatcaggagtaccaactgtagaatacgccaacatccgacggttcttttgccaatgtgacagctgctcctgctgcgtacgcttcggtgcagaagagttagttaatcgactggtgttatcgggtaaaggtttagcaccttttccaggtgtataatccggttcattcaaatttggaaaattactgctatccaaaggtttgcacaatccaaagtcagaaagcttcaagtgaccactgagatctaacaataaattatctggcttgatatccctgtgaatgtaattgtgcttgtgaatggactctattgctagtacagtttctgcgatgtaaaatttggcttcatcttctgtcagagtgtccttgcgcatgagcaaagtcatcatgtcaccaccaggaaggtactccatgatgagatacaagaactcatcatcttgaaaagaatagtaaagctttactatgtacgcactatcgacttctgcaaggaggtttctttcggctttgacgtgttccacctggcccctacgaagcatttcagatttcttaagctttttcattgcatatacacttttagaggtcttctctctacaaagacgcacctctccaaatgcacctcttccaataattgtcaaaagttcaaaatcttcaacccccatcttgtgtctttgcaaacgcatatattcagtctcctttttctccaaatgttttagaatgttgttctgctcttctgcaggaacttcagcatcctgtaatttcctctccagcatccagcgcctctctttcctatcttgcaaggacttcatctgagtcttgtagtggttctcaatgtactgttttgccgcagcgaccttctgcttggtcgcgctagaaggcgcgtcgtcgacggggggcttcccgggatccttcccatggctggcaggctccgccgggctcttggacttgtcccgcggctggaacttctggaaccaacttctcgcggaatccatcttgtgctcacaatggcatcatctccaagaccagagagcgtattatattgaccaatccagcagccgcccacaggccagaggagctctggctctgaagcggtcaatacccctccaaatggatcagatgtccaaaccggcgcctcctccgtagaacccgatgctgggaatgatgcctatgcctttttttttctccttctcctctcttctcttctcttcacccctgcctggctgcgtcgctccgggttggttgtccttttcgtgggcaaaggcaaagcgtgtgagggggagggaggagagagaaaagcccacccccgccgatgcgatgtgcacagaggaagggagcggacgcggggtc

SEQ ID NO: 6131 - DNA, 598 bp, Triticum aestivum
  unsure (1)..(598): unsure at all n locations
  Clone ID: PAT_TA_6131
gcacgaggctcgaatggccaccgccgtcgtcgtctcggcggcgggtctccccgccgcgccgtcgccgtcgccggtgcgttatacgccccgccgagcggcgctgcgcgacgtgcctcagctccacgcagctctgctcaagtccggtgagctcaccacttcgccagagtccttccactccttcctcgaggctaccgcgctcccgtcgccggccaccaccgcagcccacctcgcctacgcgatccgcctgctccgcctaggcccccacccgcccctctccgcgcggtcgtataacatccttatccgtgccttcttccgcgcgggccacccggaggatgccctccacctgttcgtcgaaatgctcggtgctgccattgctgccaacgtctgccccgaccagcacaccatcgctaacaccgtaaagtcctgcgccaggatgtatgccttggctacggggcgcagcgttcaggcgtacgctgtcaagcttgggttcatggccgatcagtttgtgctgaacagcttgatacatatgtacgcgagctgtggggatgtcgcggcggcaaaggtactgttcaacgcagttgnnnnnnnnnntgtggtt

SEQ ID NO: 6132 - DNA, 1565 bp, Triticum aestivum
  unsure (1)..(1565): unsure at all n locations
  Clone ID: PAT_TA_6132
ccgtttatccngacggangtncatgcatagntggnatttggaggcancgtgggcctttgtatnancagttgcgaagggattnntcaggcgttagtggtangccttttttttttttgacctttttgttttcccggcaccgaccgataactccaacagattcctgcacccgccccccttcgcgggctcatcagtgtcggtataaccagatttcggtgcaggtacagctatatcaactacacaggcaaaatcggcaggaggagctttacagggagacgcgctaacggtgtcgtggcacgctccgatccgatccgtggagcggacagggaagaggccagaggatgaatatcatcaggcatttccattcacttcttcaagatcttggattcgatttcctccaagctcagccctttggtctctggggcgttgaggatgacaaacaagagggcgagcagcgatatggctgcgaaaagaaggaagacgttggccggtccgaggtactcattcctcaggcctcacaacatctcctggagcagtcgggacgggcggaccgaaacatgtctaccaaacagcccccgtccccttgaagatttttaggtagacttctcttcacactgagcatttgtctcgtagatgcgacgggccttgttgtacattatgtaattcttgccatcggtggctgtgttgcgcacctcagggatctgctgcacaacgtgccagttcttcccaccctccaggcagctcctgagtaaagggagtgcacattgcagctcgaatcgacgcaggccgatttggcctgcaaagcggatcagcagctcctagccgaccgtggggaacgcgatgttcccagtaagaatgcccaactcctcggaaatagtatgtctccgtggatggggggaacacaagcctgagatgctgcagcgtgtcgaggcccgacacgtgcttcagcttcgcgcagtcgtcgatggtgagtgacttgagtgcgggtaggttggagatcctcagaagcgccctgttatctttcagatagagttcatcagatagttttggcaggtcctttatctctgtaaggcaatgtgcaccctcgacatgaaggtcacacagagcagcatcctttagaccttctggcagagctttgagtttagggcagaactgtatgtgcagtgacttgagacaaggcagcaatgtctggctctcttccacacttaaggaccagtcttccagattcttcatgtttcttagcttcaaaacctcaagcttggggaatgagatggctcgtgaaatcacaagtggtgcccgaaacccaaaaacctaccgcggccgcgacctcgcgtctgcattngagatttcaanggacttgaactgtttcangngggcaaanaacaaggcanagtgggtgcatgacatgccattgtcaaagatnaaggaaggcaagggnaggaaaggangtgctaancttgggaaccgccaancaatttggnaactttcaccttgggaattcctgatacaagcttccaaccctattgggtggcgtgagccatcaaatctttaccacttactgaancgnc

SEQ ID NO: 6133 - DNA, 927 bp, Triticum aestivum
  unsure (1)..(927): unsure at all n locations
  Clone ID: PAT_TA_6133
gacacttccaagtatttagttcctggagtagtggacccacagtttgcacaaaatttgcatgacttgctcctggagggtggtgctttgctaccatctggtttgttatcatgtcaaaatagtcataattctggcaatacaacagagatgggcaaaaactctaatcctgaagttaaagaaactcctggatggttgctagttgctcaaacaggtcaaaatacaccagaacgttctgtagctgaagattctttaccaaagattcccttgccaccttgtgaagatgtacaataccctgtagaaaatacagaagcaactatcggaagtttgggtactatttcgattgagggtgaaagggttgctgaacattctttggcaaacatgtcaggaagtagcagtgcgaatttgggcaagttgagctgttctagtatgaaaacaatcagctctgttatggatgatgttgctgaagatgaaatatcatgggaagatcttcatataggagagcgcattggtctaggtgcatatggggaagtttatcatgcagattggaatggcacggaggttgctgtaaagaaattccttgaccaggatttgtcaggtgttgcactgggagcaattcaaatgtgaagtgcaaacatgtcaaggctgagacaccccaatgtagtcctttccttgggataagttgacgcaacctccaaactcncctatattaaccgataccttccaagagggagcctattcccccaatggcatccggccaaatacaagttttatngaacacaanggtgaagatgaatttgatgtgcaaaaggataattcttcacactancatcctacatngaanccngattngaacccancttannggcaaatgggtttaagntcaaattgggattcaaggtgaacacaacttcttcncaagcgcggngaaan

SEQ ID NO: 6134 - DNA, 519 bp, Triticum aestivum
  unsure (1)..(519): unsure at all n locations
  Clone ID: PAT_TA_6134
ccagagcatcgcctcgccgcacctgttcacggtgccgatccacgagggcatggacacggggctgcagcggctggaggagggcatgttctcgcgctacaacatgacgcgccgcctcttcgccagggggctgctcttcggggtcaacgtcttcgtcaccgcgctcttccccttcatgggcgacttcgtcaacctcttcggctccttcgcgctcttcccgctcaccttcatgttccccaagcatgatcatcctcaagatcaaaggggagtgcgacgggagatggggcaggctctggcactggggcgtcatcgtcgtctcctcggccgtcggcctcgccacctccgccgccgccgtcagattgatcctgcacaacgccagcgtctaccgcttcttcgccgacacctangagcacgactatcccgccgcgcaggacggcaggatgatgatgcagtgcgtgcgcccaaccgtgacataacagtactactaatacacccccttgtcgtaccgtgtcaatcnngggg

SEQ ID NO: 6135 - DNA, 948 bp, Triticum aestivum
  Clone ID: PAT_TA_6135
gagcctcgttgctggcttcttcaaacatgagcatatgatggaacagtctgaaggttaattcaaatgtagtgaaagtttgaaggtcaatgggttttccatattaaactttcaaacaaaccattcatcgacgtcgtgggattcacctccgccaatgaccatcaccaccacgacgccgcctacgcgatgtcgcctgaggtgaatgagtagcagcccacgacgcatgcgcggtgggtggctcatccgagctgatgcgcccactgcagcgttcccagcagcaagaagtgtgccgcgtgcaagcttatgtagtactggaaagcctccacctatgattggttttatcataaaaactggttagatatcgccgctggcgtggtcacttttccccactaccgaaagctctgcgccgctaacagaacgccccaccagtctccacctccgttggcgccgtcgagagcctcgactatgaggagcaggtccttcaggttcggtgtggcaactttttcgtgataacattttgagatttctccaccaatcggcaaaatttggtgcttataaatagaaaatcaataccaaacggagtccaaatgccacgaaacttcatggagattttttatggaccagaagaccaatagtgggccaaataagcacctgggggtgccccgaggggggcacaactaatcgggagccagttccggcaccttgctggagggggaaatcatcactggtggtcatcttcattattccggcggccaccacgataaggagggagtagtccaccctcggtgttgagggtttgtaccagtagctatgtgtttaatctctctctcgtgttctatatcatgggctttgttaatatagatggattatatgatgtttctcccctctacttttgttgtgattaattgaatctttaccctttgaagttttgtcttgtcggattgaatattc

SEQ ID NO: 6136 - DNA, 697 bp, Triticum aestivum
  Clone ID: PAT_TA_6136
ggtcatatgggcactcctgcctcactctctctcgcggaactgctcgcggagtaactaactcgctgctgccgttctggagcgcgatgtccgcgagcgtcgcgtccatccggagctccgccaagtccggcggccttccaccaccgccacagaacgaggacgtgtccgggaacttgtctacagaactcccttcgacctcctctacgccgttcaaccattcgttgacgccggatgccatcttctccaactccggcggaactccgatctcgacagattaagagatgatagggttatggcctacactcaatgagccaagtggcgttgatggagccctaacttagcgacatgcatgttattttgctatattacgcgccagcattgagttgtgccaatgctttgatccagggatagcacaataagcacgaagatttggattctaccaaatctgagttgttacaactagccactgaagcgttaaagtgtgccggctctcatgtctatcttttcctcctcaaacgaatggacataataatggttcaatgggaatatatatataacaaatagacggaaaaaaaaaagccacgttccataccgcctcgcaaggtctgcggtctgcggtgcatgcggtgtcggtgttttacgtgagatgttatactcctgatgctatcactggatcagtacctcggccgcgaccacgcta

SEQ ID NO: 6137 - DNA, 751 bp, Triticum aestivum
  unsure (1)..(751): unsure at all n locations
  Clone ID: PAT_TA_6137
atgaaaatggagcagcaacgcctgccaaaactggagatggtgcgtcgacgggaatcaagaaaccgcgtgggaggccgagaaaagagagaccgccagaagaaatgtctccagaaactggagatgcaatgcctgctcctgaaactcgagatgcagcgcctgatgaaaatgaagcagcaacgcctgctgaagctggagatgctgcttcaactggattcaagaaaccgtgtgggaggccgagaaaggagagaccaccagcatcaatccctactgaaactgaagatgcaacccctgctgagactggtgatgcaaggcctgctgaaactggagcagcaacgcctgctgaagctggagcagcaacgcccgctgaagctggaaatgctgcatcgacagggatcaagagaccgcttggaaggcctagaaaggtgaagaagcttgggaggccaagaaaggagaagccagaagaagcagcaatatctggtgaaactggagatgatgctgcagcagctatatttgctgaatctggagcagcaacccggggaaaaactgcaggtgatgatcggcggcataaanaaggcccgggaggccaagaagganagcccgaaacagcantttgtnaaagggngacccaaacanaaccaaaccaaaaacccaantncagggccctgaatgngaaaaaaaaaggctngggggccaaaaggggaacggggggccaaaagganatcccttanccncgnttnacggaatangcccn

SEQ ID NO: 6138 - DNA, 612 bp, Triticum aestivum
  Clone ID: PAT_TA_6138
gttgttcgccgtctgggactttgatggacaagatgtgtacaagaaaattgttgatgccacagaaaatttcagtgacacccactgcattggaattggaggtaatggatcagtgtacagagctcagttgccaacaggggaaatatttgctgtaaaaaagattcaaatgatggaagatgctgagatatttaattgtgaagtagaagcgttgatgcatattcggcaccgcaacattgcgaagttatacggctattgttctgctcctcaggggagatttcttgtgtatgaatacatgcatagaggaagcttagcagcatctttgaagaacaacgaaactgcaattgaaatggtttgggtgaaagaggttaaatgtaattacggacgttgctcatgctttgtcttacatgcatcatgattgctttgcgccgatggtccacagagatataacaagcagcaacattttgcttgaccttgaattcagagcatgcatctctgattttggtattgccaaaatactagacatggatgcgccaagttgcacaaagcttgccgggacaaaaggatatctggccccagagcttgcatacacaacaagggtgacggagaagtgtgatg

SEQ ID NO: 6139 - DNA, 577 bp, Triticum aestivum
  Clone ID: PAT_TA_6139
caacaaggccacacaacccacaaccactctcgccctagcaccttcgccggcggcggcctatctctctcgtcccctgctctggcccttcgccggcagccggcggcctattttctcctccgccgaccggatacaagccgcacctgacagtaagctaacataaagacatggaccttcacaagaaactcactgctgttagtttaactgatgatctagtggttgatatcctctcccggctgacgtacaagtcattttgccgctgcaagtgtgcctataaggcctggtctgccttttcctctgacccagactaccgcgagaagctgcccaaaaaagtaaccactggacttctgtaccaaggtcacaataagtctgctatcccgcttgtaagcctgtgcccagatgatggggaaatagacggaattcttgctgatgtgccacactatgagcatttagaattcctcgactgctgcaatggtttagtcctttgtaagtataggagcagctatacttctacaaacgtttgccgcttcgttgtgtgcaacccagcaacacgagagtggaggatacttcctgatacaca

SEQ ID NO: 6140 - DNA, 984 bp, Triticum aestivum
  Clone ID: PAT_TA_6140
tggcggtccggggcgcgcccgtctcgtggttgagttttcttctgctgcttgtgaccggaggaggaatcatagtgtactacgacaaggaaaaagaagcgtcacattgaagagctgaagaacaatacgaactcagtaaagccagcacaagcagtaggaactgctgctattggtggtccattcagtcttctgttccatcatgggctcgccggccctgctggggacctctggggtggtggggcgcggcgctctgtgcggttcgcgcattccccaggacatctgtccagatgaactgcagaagatggctgctgctattaataaactcaaggaaaaggcaaaactagaaattgtgccagtgttcatctcagttgatcctgaaagagacactgttgagcaagtccatgactatgttaaagagttccatcaagatctcataggactaactggtacccctgatgaggtgagcaaaggttgctcgtgcttatcgagtctactatatgaagacagaggaggagggttctgactaccttgttgatcattcaatcgtcatgtacttgatgaacccgaaaatggagttcgtcaaattcttcggcaagaactatgatgtacacgcactggcttgagacttgttccaagaggtccgagagcacgagaggagctgagctgaaatcacacgcaccatttcgtctcgttgccaatttagaacttatattcttaaataaacaaaccccaattccgatgctgctgctgctgctgctgctagttcatgcgttttggaacggcaggacctttaggatatcactctcttttctaaattttgaaacctctttgttctagcagattttgctgcaccggcgttgttttgctatagtgcgtgggaagtgaaggccctactttgactcgtgttatttgtgagtgctctgtggagcgatgggatttgttggggaaatgatctctgctcccgtaaaaaaaaaaaaaaaaaaaaaa

SEQ ID NO: 6141 - DNA, 521 bp, Triticum aestivum
  Clone ID: PAT_TA_6141
ccacccactcctgcaccccacccacccccgattcacatccccttcacctcctctcctctcctctcctctgccgacgggatctctccctttctccgacccatgccgggatcctccgccgtgtggccgcacacgcgtgcaagccttcctccaccacccgaccgaccaggcccatcccggcggccaagcccgggctgctccccgccgcggcatgggggcagggcggcgcggcggccccgagggcgagcatagtggcggcgcgggcggtgcagaccaacaggcagcaggcgcgtgggaggagcagttgctgcccgaagccggcgctaggaacaagctgaaggaagccgccccgcttggaggagctggaggtgcagcggggatccaacggctccgcgcccttgtccccagatcagtcccctccaaatctccccccggccgccgccgtggtttggcttggtggtgcgggggggttgcggcttggtttgtgagctacagaccttatcaagcagcaaagtcatctcaca

SEQ ID NO: 6142 - DNA, 1242 bp, Triticum aestivum
  unsure (1)..(1242): unsure at all n locations
  Clone ID: PAT_TA_6142
ctactggaagcagttggcaagacaagcagtcaatggatctcaaagcgttgatcctgaaggaaggtaactactcaaagggttgcacatattcatgttggagcagttaagtttgcaggatctgctgttggagggcatggtatgtgctctcaagaagttctttattatccggtgacatcttttggcctattgaggaactggacatgatttatatagcgaagttaagcgtatggatgacaacttcctctcatacctcttttgacctattgaggaactagacatgatttatatagcgaagttaagtgtatggatgacaacttcctctcatacatgttatctgtatattttatatacatggcttttgtgttctgtcatgtgcgttcctgctgcagacttttgtaggaaattcaccatgggaatttaaataatggttccctgcccatcagtttactttcttgcattttataggccacacttttcctattttgttaaagaagtgaactcattcctaaacttccaccgtatatacattaacactgggatgctgtaccaacccagcaatactaaaaaactatgaattgtgtgtcagtgtagtactatatcccactgatgatgcttctctgtatcacgtttatctatttggttgcatgccttgaaggagcagtatattgagcaccctgagataatcatcaagaagtttggtggaattttaaatgatttattaagcgaccttttatgattgaccattgtacgagagcatgttttagtactacttgaccgagttagaatgtatatattttcaactaaaaccaattttttcaaaaggcaaaatattttctgcatgatcacatatcatgattatctccatgaagaatgctttagacagtacaataatgaaaataagcatttttgattttcgaaacatatactaatgttgggacatctgattggacctttctatgtggataatgagatgtagattttgtacagaaaccttccctatgtaagtcctacatgcatgatctatctcattatctaaaatcacattcctttatagttttctcactgttatatttgataatcttcgattgtctgctttctccattttccagttaatttaatcccgatagtaaattagntagtattttgttttatctctgaaatctcgagaagtacacaagttgttaggtgtcagaaaaagtacacaagttgttaacatttgaaattagattgtctctgaccgaa

SEQ ID NO: 6143 - DNA, 840 bp, Triticum aestivum
  Clone ID: PAT_TA_6143
tggcacacatactatagaagcgctcctggactgagaagcatcttggtcccaaaggcgagtcaattgattacagaggtgttcttcatcatgatggctctgttttgatgccagtttccttggatcaattggaggtggccgcgccggtcacggaccagaagaccataagcaggcattcgatgcttctcgctttgcctaatccagcagtagggcgtcactgacagggtggcgcacaactctgctttcacggactatccacgagtcggggacgactaattgagcatgcggctggttgaagcaaacgacaatctggcagcagaagcttgtggttgagccgagcattgtaaggatccaagtagaacgatgctccatctcttgttagagcagcctgggcttcccaaggccatttaccgtgtcagaggatacttgcagaacacgataagtaaccgttcttttcaacaccactgtccagaatagcgggagctgtccaacgcaattgttgattacttgtgtgttgctctccaaatgaggcaatggggggaagattctgccgcctttgaggcaattatgtacatggagaacgccacaaacattgtggcaaaggaactgaaaatacgaatggctgagcaaatgtaatgagaccttggttatctaaggctcggactcaattaggcatttgacatgatagacaaccttgctaaaggttatttatatgatgtgagatacatgtcctccttttcagattagattcatagtgtcatggcagatgcctttcctcctacttgtgcgatggataaatcaacaaagttgatggttattatattgaaaaaaaaaaaaaaaaaa

SEQ ID NO: 6144 - DNA, 576 bp, Triticum aestivum
  unsure (1)..(576): unsure at all n locations
  Clone ID: PAT_TA_6144
cgcnatctgccgccgccgccccactaccaccacccgcctacttcttggaacagtcagtcgtttcgccatccgccgccgccgcccccacaccaccacccgcctacttcatggaacagtcagtcgtttcgccatccgccgccgccgccgcccccacaccaccacccgcctacttcttggaacaatcagtcgtttcgccatccgccgccgccgcccccacaccaccacccgcctacgacttggaacggacactcgtttcgccatccgccgcctccgccgccccaccaccagccgccgcggccgctctgctcctccatccggcgcagcccagagcctccctactccaagccccacacgtgagaagtttcgatgtggaggttgatatgatggaagaagaactaaacaagtgagcgcgtgcctacatgtacgctgatatgatgtggagtaattgtctttgtccggaccgtctatgtactactagcattcgaaccgccagtcgaaataaggtgtgcccacataaaattgacttgagactcaaatcaatgtgatggtggaataaaaaaaaaaaaaaaaaaaaaa

SEQ ID NO: 6145 - DNA, 666 bp, Triticum aestivum
  unsure (1)..(666): unsure at all n locations
  Clone ID: PAT_TA_6145
gctgaacaggatgcaaatatatcgctgtgctaggtgttgactctcatgtcagaanatgtccgtgcaatacttgatcaagcaggatttactcaggttggtgtttatagaatgtccagcgagcaaattggttgttccttggcagatgctgcttcaagttctgcttatacacattttcttaagacggcatcaagatctcctccttctttacatgtcatttatatcaatacctcactggaaacaaaagctcgtactcatgaacttgttcctacgataacctgtacctcttccaatgttgttgcaactatactacaggcatttgctgaaataccagatcttaatgtccgggtatggtccctgattcctatatggggtgcgaacatagcagacctatttaagagaatgactatcatgtcangatgaagagattacagagatacatccagatcacaacaggacaactacaagttcattattacaacgtcttcattactatcagaatggtaacggtattgtgcatgatatgttgggcaagaattgnggngaaatnngggnggatacgngatnattcaacgcacacttgaatcaagagaagtccttgcnagggacaagacagggatggatatggtcaccgatactngttnanaatcattggcaatngatggagtt

SEQ ID NO: 6146 - DNA, 809 bp, Triticum aestivum
  Clone ID: PAT_TA_6146
ttcggcacgaggaccccaccagtgacacccaaaattccccaaaccacactaggtctcgccgccggctgccctcaccctcgccatggacggcgatggagatccccacgacgggcatcaccctcaaaatcctgccccttctgaccctcgacacccccagcttgaggaggaaggtaatcccctccctcatgaagcgcagaaggaaatggaagcagtgaggagagcgaataaggtagcgcggaagatacggcgtctgagggccaaagctctcgcgcgggggcagggaaagctacagaaggaggatctgccccaaatcacaccagcatcgtccgtagccctcgccatgggaacccatggctactctgaaactcctcctgacactcaacacagcggggagcaagctctgaagcccgggcaagtgcttcgtacgggagtgttggtggaagcgcctgacaaaatcccctcttccgccggcactgatgtgtcagcagcacccccaagaccacatattcgccagagcgttttgtactcagatcgcccaaggcgatccaggaaacctacatcagataagctaccgcccactggaactgctacttgtgtccggcaaagtgctttatatgcaggccgcctcagtcggttacgtggaagccaggaaccggaaataacgaataagctactggttgaggagaatgctaacaaggtgagtggcagtgtggatctacctgaatcgaagacactagcgctgaatgacacacgtcctaagcttgaattaactgatagggttgaggagaatgctggcaaggtgagcggca

SEQ ID NO: 6147 - DNA, 1074 bp, Triticum aestivum
  Clone ID: PAT_TA_6147
gaaccaaacacggccttcgcaatcactcgcaatcacatattaacgatagctaggcacggagaaaccaatgccaagtggcaaatgaccgccatccggtggcaagtgagctgatgcagacacataaccaacctaccacacgtcgacaccccaccagctgagtcaaactcagctagaaataatataggacaggccttggacagcaggaatgctgcttttattctccccgtacgcactagcagaacctcctcgtgcaaaaacaaggcggcgaaagcgaaaccaatcgcgcgatcacgcagcgtctccacaagacgaacgcaatccgatgggatcggtcactcacatacagtaattacacacagcagaggcaggagctagcctctgtcgatgatttactactggtcgtacctagagcgcggtcacggtggcctcggcctcgccggccggcgagcgtcgcggctcctgccgcttcgtcttgcacttgtcgacgaccgcgtacaggcggtagggcgacgcgtcggtggcgagccactgctcgacggtgaagagctgctgcgcgcacccgaggtggggccccgtgaccgtggcctcgaggtagttgcagtaccagccgtggtgcgcgccggtgccgtcggaggtgaggttcatggcgcagggcgcctggctcatgcaggggccccggccgctgaagatgtccaggttgccgcgctcgtagtagtcgtggccggcgcccatgaggccgccccaccccgccaggtcccggatccggatgcccgtgccgtcggggcccagcagcgtcacgccgatggtcgagtccgtgccgcccttccagatggaccccgtccgcacgtacaccgtgtacacgcactggttctccgggtccgactccaactccgactgcgacggggcgcccgcgcccctgacgacggccgccgcgcgcgacgccgacgccgacgccgcgtacgccgcggtggcaaagaaggcgaggaggagaaggcagggagagaggagcttcagcttcatggcacccccggagcgcggaatccttggctgctacgatctgtctgaatgctgatg

SEQ ID NO: 6148 - DNA, 679 bp, Triticum aestivum
  unsure (1)..(679): unsure at all n locations
  Clone ID: PAT_TA_6148
ggacaaagatccacacaaatggagattccatatcgacatcatcaacgtacaaaacagccaccgcaactaatcacaactctcactcatggcacacagtacaaatcaggtcccgatcgattatttcgccaccagcagcacgaactcatctagtagcagtacaatctccgtgccgcggcgcggtgcacgcggatcacggggccgacacgcacggccccgcaacttattgctaccaccacccgccaccaaccacaacacacgaggaggccggcgtactcgatcttacgcatcggcggcgccatcggctgggcagcggtcgacgacggcctccagcttgtagggcgcggcgtcggtggcgagccactgctcgacggtgaagagctgctgggcgcagccgcggtgcgggccggtgacggtgacctccacgtagttgcagtaccagccgtggtgcgcgccggtgccgtcggaggacaccctcatgcggcagggcgcgctggccatgcacggcccgcgcccgctgaagatgtcgaggttgccgcgctcgaaataggagtggccctgccacatgagcccgccccacgacggcaggtccgagatagccacgccgtcggcgttgcccgcggtgtagagctccagcgtgatgttggcgtccgtcccggcctccagatncgcccccgtccgc

SEQ ID NO: 6149 - DNA, 892 bp, Triticum aestivum
  Clone ID: PAT_TA_6149
gatgataaatagacgtatacaccgagagctaatgaactgacactgacaggctaacagacaactcgtcctcaatttgactccaaccagatcgttccagaacacaacgaacgctggctttatttccggcgtgtcaatgctaacaagaggccggcgaaaactaatcgtgcacatcgatcaaatcgtatcatgctttacaacaatatatcgcacggatgcagttcacgctatgccgcggcgcgtgcatatacttctcacagagcggtgctggccctggcctcctggcccttggcggcctgcttgtcgccgcagttgtcgacggcggcgtagaggcggtagggcgaggcgtcggtggcgagccactgctcgacggtgaagagctgctgcgcgcatcccatgtggggccccgtggccgtgacctcgacgtagttgcagtaccagccgtggtgcgcgccggcgccgtcggaggtgacgttcgcccagcacggcgcgcgctccatgcagggcccgcggccgctgaagatgtcgaggttgccgcgctcgtagtagtcgtggccggcgcccatcatcccgccccattgctccaggtcggcgatccggacgcccgtgccgtccgagcccagcagcgtcacgccgatcgccgagtccgtcccgcccttccagatcgagcccgtccgcacgtacaccgtgtacacgcactgctgctccgggtccgataacaggctgccgcggccgccggcgcccgcgaccgcgatcgctctctccgacgacgcgtacgccgcggcaaaaagggcggcgaggagaaggtaggagagcttcatggccggcgactttcgatccggaagtgagcgattggcaacgataaggcgtggcgctatatcccagcccggccggc

SEQ ID NO: 6150 - DNA, 896 bp, Triticum aestivum
  Clone ID: PAT_TA_6150
acccacgcgtccgactagttctagatcggcgagcgccgcccttttttttttttttttacaccgagagctaatgaactgacattgacaggtaacaaacaactcctcctcaatttgactccaaccagatcgttccagaaccagatcgttccagaacacaacgaacgctggctttatttccggcgtgtcaagaggccggccaaaactaatcgcgcgcatcgatcaatcgtatcatgctttacaacaatatatatatcgctcggggtgcagttcacgctatgccgcggcgcgtgcatagacttcacagagcgatgctggccctgacctcctggcccttggcggcctgcttgtcgccgcagttgtcgacggcggtgtagaggcggtagggggaggcgtcggtggcgagccactgctcgacggtgaagagctgctgcgcgcagcccatgtggggccccgtggccgtgacctcgacatagttgcagtaccagccgtggtgcgcgccggcgccgtcggaggtgacgttcgcccagcacggcgcgcgctccatgcagggcccgcggccgctgaagatgtcgagattgccgcgctcgtagtagtcgtggccggcgcccatcatcccgccccactgctccaggtcggcgatccggacgcccgtgccgtccgagcccagcagggtcacgccgattgccgagtccgtcccgcccttccagatcgaccccgtccgcacgtacaccgtgtacacgcactgttgctccgggtccgataagaggccgccggcgcccgcgaccgcgatcgctctctccgacgacgcgtacgccgcggcaaaaaaggagacgaggagaaggcagaagagcttcatggccggcgactttcgatccggaagtcccaacccggccggc

SEQ ID NO: 6151 - DNA, 1079 bp, Triticum aestivum
  Clone ID: PAT_TA_6151
tttgttctttttcgcttttgatctttaatcgtacacatagtgtttcttcttcgcctttctccaactaaacagaacctactggctataaacaaaggcagcaacaatagtcccaccatcaacgtacagaacagccaccgcaactaattacagctcccactattggctcaaagtataaatcggggaccctctttagtgtggaactgcatcgaaaacatggacaagatccacacaaatggagatgccatatcgacatcatcaacgtacaaaacagccaccgcaactaatcacaactctcactaatggcacacagtacaaatcaggtcccgattatttcgccaccaccagcagcacgaactcatctagtagtacatctccgcgtccggcgcggcgcacgcggatcacggggccggcacgaacggccccgcagcttattgctaccaaccacacacgatgacgaagaggccggcgtacagcttactcgatcttactcctcggcggcggtgccatcggcggggcagcggtcgacgacggcctcgagcttgtagggcgcggcgtcggtggcgagccactgctcgacggtgaagagctgctgggcgcagccgcggtgcgggccggtgacggtgacctccacgtagttgcagtaccagccgtggtgcgcgccggtgccgtcggaggacaccctcatgcggcagggcgcgccggccatgcacggcccgcgcccgctgaagatgtccaggttgccgcgctcgaagtaggagtggcccccccacatgagcccgccccacgacggcaggtccgcgatcgccacgccgtcggcgttgcccgccgtgtagagctccagcgtgatgttggcgtccgtcccggccttccagatcgaccccgtgcgcacgtacaccgtgtacacgcactcctggctgtcgccgcccaccgcgccaccgcccttggtcagcttgatctgggtcgggagatcgcggccatgcgccagcgcggcggcggagacggcgacggcgaaggcgaggaggagggcggcgagccgagccatggctgacgggtcggagcgcgatcgagcttggtgtctt

SEQ ID NO: 6152 - DNA, 722 bp, Triticum aestivum
  unsure (1)..(722): unsure at all n locations
  Clone ID: PAT_TA_6152
acaattccaggagatgttttagttgatgcgattggtgaggtatttcctccaaatggtgtaggatagcatggttggaggaattcctacatagactgctcctttgctgtcacttctgcttttaatttcgtgtctgtcatgttagtcttatgttgtgtggtaatcaatcctgtgtctatgggtagctggtaatctgttgtagcatctagatgagttctcccaaaagtctgtagactgtagaatatccccagattagtttggggattcatagtatttgtcgtccccgaagcaaagcaacttagggaacttatggtgaagcaaataaggcaccctgcatggatgaaagaaaatatctggactgccaaaccttttctctggggacatcagtggcgccttcaccccccttccaagaagccgattaaaaaccccacgctgcttggagtggggtctctcacgcttccgttgggcgcatgcccccctttggcttttccgtcgttctcccccctcccccatcccccagcctgattcgtgtccggatcatctgggcggtggctcttttcgtctcttggtcaccgcggtttattgcctggctcccagtgtcgcgctttatccctccgaatccgtagtcctgtcctttgcctgccgggagttgttgtgttccngtgaagcggcaactctcccaagtgtttccttccgttccctaaggaaaaagaatagtttcttng

SEQ ID NO: 6153 - DNA, 590 bp, Triticum aestivum
  unsure (1)..(590): unsure at all n locations
  Clone ID: PAT_TA_6153
gcgttaagtttgngtcgtcctcttgaaaccctccgccgtcgccgtaatcgngncgttgagaaccttcnnttgttcagctggttntgaacttgaacgggaggacgcnatccttgacgcgccggacgagcgnttgaaggcgacgagncggacggagcgatggatggagcgggtactcgtcgtcgggctcttggtgcgcgcacccggaccggagcgagcggccatccgtggcgcaggccatgcacgtcctgcagtccgacgaggcgaggctgccggcgctcccacggcacatgtacagggccgcacaggatcttgcgtcgtacgggtctttctccgttgacagcgcaggctccggttgtgttcgctcttcttcggtcagcaccggcaacaccactgtttcttccgagtcgtcctcgaccgcgctgctacgtcattccaaggatcaagctacgtagttgattcatccagatttgtaattcttgattaatttccttgttacgtccagtatgcattgtttcgctggaatgatgttcggtctatttggatgatgtttttgctccattaatttttttattgtatattggggggtttat

SEQ ID NO: 6154 - DNA, 446 bp, Triticum aestivum
  Clone ID: PAT_TA_6154
cccacgcgtccgcccacgcgtccggcagcaccagtcctcccgccgacgccggcctcctccttctcctcctcacgcccttaaccaccccggccttccttccctggagtcgatcggtgcgcaatcaatctcttgcacgttttgatcggtcggtatcggagggcgctccgatccgatccatgtccaggcggcggcaatggagcccgcggagctagccaagatcatcttctcccgggtgcaggaggtggagccggacaacgtgagcaagatcgtcggctgcatcctgctgcgggagcccgacgaggatgagctggtgcacctcgcctacgccaccgacgccgcgctgcgcaacaccatctacgaggccaagggcacgctcgccgtcatctacgcccgcttttccgccttcctcggtcaccactaccaccagcccaacggcgtcggctacc

SEQ ID NO: 6155 - DNA, 509 bp, Triticum aestivum
  Clone ID: PAT_TA_6155
gtgacattattgttacctacagcctacctgtgatgctgaatgctattggtctagcgggtgtctttggtatatatgcagtcgtttgctgcattgcctttgtgttcgtctacctaaaggtcccagagacaaagggcatgcccctcgaggtcatcaccgagttctttgcggttggggcgaagcaagcgcaggccaccattgcctgattcatcatggagctttgttttcagtttgcacactgcggtctgcgctgaaaattgcaaattggacgggtcctcgtgaggaacggaaaaacttttgagttgtaaatgagacagctacccaaagagctcatcacgaggaacgggaagctgtaaaagtaggaggatttcatgcccccatttcatcgtctattattgcttattagtactgtactgtaatcgtcattagttgctgtagggttgttcaacttgctaatctgattctgaactaccatgctgatgtccgaaataaagaaaaagcatgtttttttt

SEQ ID NO: 6156 - DNA, 1720 bp, Triticum aestivum
  Clone ID: PAT_TA_6156
tcgttttggtgcaacgagaaatgggttcatttcataccagacaacacaagagcggtgcagcaggtgtcagtggaacaagttacagaccacaaaaaaataatgggcaattgagcgagcaaattattgaggcactgttgcaattgtgtgctcgtcatgctggcattcagcactaaaaacttttcagaaacaaaattgtgaaacaagacaggtaatttcgacaagcatcagctaagagtatattataaggcgcgcctcgacatctaattcagaccttatagccggttaaggtgaatcctctgcctgcaatctcgcctacgcagaaccatgcataaagctcaaccccaaacagtgttgcaattccaaggtcctcaacgttgtgagcgagcagttattgaggaaatgttgcaatggtgtgctcgaatcgctggcattcagcattggaaacttttcagaaacaaaattgtgaaccaagacaggtaatttcgacaagcatcagctaagagtatattataaggcgcgcctcgatatctaatacagaccttatagccggttaaggtgcatcctcagcggtgcaagccgcgcccgacgcgagaaccccatcgcataccacgctcaaccccatggacaattgaccgagcacattattcaggcactgttgcaattgtgtgctcgtcttgctggcattcagcactgaaacttttcagaaacaaaattgtgaaacaagacaggtaatttcgacaagcatcagctaacagtatttataaggcgcgcctcggcatctaattcagaccttatagccggttaaggtgaatcctctgcctgcaatctcgcctatgcagaaccatgcataaagctcaaccccaaacagtgttgcaattccaaggtcctccaccctgagctccttcctattcttccaaagctgcttgacaccatcaacctccttccacaatgcttcatagcggcctggtagactagcgaggcgcgtgtagaagagctgcttggagagctcctggcacttctccacggagggaggctgcacgacgtactgcttgttcttctccatcgcctccttgtagtaggcgccgccgtgcttcgaggcgaattccgccgcctgcgccgccttggtccgcagctgcgcgagcctcgccgccatcgccgccggaaccttgacgaaacgtcggcaagaggcgaggaggaggtgaggtgggaggagatcgagagggaggggggcgtcgaccgaagggggcgggaggccaggggcatgcccctcgaggtcatcaccgagttctttgcggttggggcgaagcaagcgcaggccaccattgcctgattcatcatggagctttgttttcagtttgcacactgcggtctgcgctgaaaattgcaaattggacgggtcctcgtgaggaacggaaaaacttttgagttgtaaatgagacagctacccaaagagctcatcacgaggaacgggaagctgtaaaagtaggaggatttcatgcccccatttcatcgtctattattgcttattagtactgtactgtaatcgtcattagttgctgtagggttgttcaacttgctaatctgattctgaactaccatgctgatgtccgaaataaagaaaaagcatgttttttttttgtgtcaacttgcaaactttcttttaaacattgtgcaatgtattgtaaatttctttatcaacttccctcgattcagagagaag

SEQ ID NO: 6157 - DNA, 621 bp, Triticum aestivum
  unsure (1)..(621): unsure at all n locations
  Clone ID: PAT_TA_6157
gcgcgcgccccccccccgcccccccccccgtccccccgcccccccccccccccccgcccccctccctcccgccccgccgccccctccgcccccccgccccccctccccgccccccgcgcccgccgcccgcacggcctcgccgaccgcgccgcagaagccgcgcggcgggggccgggcgctcaagtgggaggcggagctggacgccccacacgcagcccagggccggccgccgggcgctcaaggcttcacgagcgagcgcgtcgcggcacgccggccccgtcgccctgcaggcgattggtggactgcccggctctattgactgggccgacggacattgatgcaacttgaccaaagccgtcacttacggcttcctaacacttcccagccatccctcccccccctaccatgccccccacctaatcgaagtttccctaggtcctaatgtatgccgagccacgtgctccaggcgaccggtgcgcgccgtgctcgcggtcccatgcgggccgctctcagccgccgccgcgccgtcttgtctgttccgagcgcgaggccgcctgccccctgcacgctttcgggcctggtttgcggcccagttcgcatgcactctccccacggtgctcn

SEQ ID NO: 6158 - DNA, 1095 bp, Triticum aestivum
  unsure (1)..(1095): unsure at all n locations
  Clone ID: PAT_TA_6158
aggaattcgtacgagggcttgttccctctaggtaggggagggacccgacccacctcggcggcggcggcggcggcgagtcggggaagatgaatcccctgacgcaggtgaagcggacgcaggtgataaaccagaaggaggcggcgctgggcctcagcgaggacgcctcctggcacgccaagttcaggggctccgcctacgtcttcgtcggcggcgtccccttcgacctcaccgagggcgacctcctcgccgtcttcgcccagtacggcgaggtggtcgacgtgaacctcgtgcgcgacaaggccaccggcaagtccaagggcctcgcgttcgtcgcctatgaggaccagaggtgcacggttcttgccgtcgataacttgaatggggctaaggttcttgggaggatcatcagggttgaccatgtgngagaagtacaagaagaaggaggaggaggacgaggaggagctgcagaagaagagggaggagcgcggcgtgtgctatgctttccagaaaggcgagtgcaaccgcggcgatgcgtgcaaatattcccatgatgaacagagaaatgcaaacactggttggggttctaaggaggatgacccaaaatgggagcatgacaggcaccgtggtccacaaaataagggggaatcccgtggtgtctgctatgctttccagaaaggcgaatgcagtcggggagatacctgcaggttttcgcatgatgagcaggtagctgtccagggacgtggcgtctgctatgctttccagaaaggcgagtgcagtcgcggagcttcctgcagattttcacatgatgagcagagaaatgcaaacactgatcgaggttctagggaggacagcaatgcaaggcggcagcatgaccatgatccaccaaagagccacaaaattttccctgacaggactaaagaagaggcgagatcaggggataggggatggtcaatcctcaagatcagagttgtacagggaccgagattctaggacaagatatggcgatagagacacaaaagatanggacaggaacatgcacgagaaatcccctgagagatccagaagcgacaggcagagaggcgatgacaggggaag

SEQ ID NO: 6159 - DNA, 424 bp, Triticum aestivum
  Clone ID: PAT_TA_6159
cccgcggcgacccacgcgtccggttagccacacggcagtcgtttggagattttttgtaaaccgtctaatcacgggcgtcttccacgcgcgcgccggcgagaatggcgcggcagggcacactcgtcctcgtcgccggcgccgccctgctcctcctcctgtgcggcgcggcgatgggggcgaagcgggcggcgatcccggacgacctccgcgacgtggtggacgacgaggaggacgacgactggcggcactggggcgccggctccgggacgcgggacgtccccaatcggccgccgccggacctgtcgcggatggaccccgccgtgctccgggcggagatcctccgcggccacggcgggccctcgcttcggtttgtgaagctccggtcccgtgtccggcggttccgggaggaggtggcggtgatcgc

SEQ ID NO: 6160 - DNA, 775 bp, Triticum aestivum
  unsure (1)..(775): unsure at all n locations
  Clone ID: PAT_TA_6160
ccacgcggccgccctcgcgtccgcccgccgccgcttcccgggcggcccgcccccacgcgtccgcccaatcccatcgatctatatatagcacttgtgggctctcagtacttggatttacggcgatggcgagggataatggcgacgggctggcggcgattgccgggcggatcggcgtgctcgggtccgtcgtgctgaacatcgtggcgctggcgatctacctccgtggccgcgccgccgccgagaagcaggccagcaagaaggtgaagaaggcggcggctgtggcgccgtcgtctggcaagcctcccgtcgcgtgtgactcggtcatcaatttggaccacggtgatccaacgatgtttgagacgttttggcgcggaccgattggcgaaagcgctacgctggtgattccagggtatcagacgatgagttacttctctgacgtcggcaacctctgctggttcctcgagccacgcttcgagcgtgaggtgcgccgtcagcgtcgtatcaactacccccttctactcgatgtcccccacgttgacggacttcctcaactcggggctctaccgatgggccggcgacgccaacgcattcgatggcaacgactacattgaggtcatatgctcaccgaacaaccccgacggcagcatccgcnnnnnngtcctcaagtccaaatnnggcaaggacatccacgacnnnnnntactactggccgcagtacactcccatcacccacatnnntcgccatgacatcatgctcttcaccgtgtcnanntgta

SEQ ID NO: 6161 - DNA, 626 bp, Triticum aestivum
  unsure (1)..(626): unsure at all n locations
  Clone ID: PAT_TA_6161
ccgcgccgcctctcacgccgccgccctcgctcaccccgcctccgccactccacctccccgccccgcctcgccgctccgccggcctccccgaccgcgccgtcggcccgccgccgccgttcttggttggtttccccaccctgcccgcggggacgagatgagcgacgacgtgatatggcactgcatccgccacaaccactgcagcttcatggccaagatcgagacggggatattctgccggaacccctacaacgccaccggcatatgcaaccggagctcgtgcccgctcgccaacagccgctacgccaccatccgggaccacgacggtgtattctacttatacatgaaaactgctgaaagagctcatctgccaaaaaaactatgggagagagtcaaactacccaggaactatgagaaggcaatggaaatcatcaacaagcatctcgaattttggcccaagctacttgtgcacaagatcaaacagcgtctgacaaaaatgactcagtatcggataagaatgaggagactccaacttaaagtgagagagaagataatgacagttcccaggaagaaaactcagcgcgatctccgaagattggacaaagctgaaaaggctgctcaactagntn

SEQ ID NO: 6162 - DNA, 984 bp, Triticum aestivum
  Clone ID: PAT_TA_6162
aggatcacactgccacaaacgccgctgcttccaccaccgtcgaggctgccacagagccaccggtcgtcgtcaccaccaccaccaccaccactgctgctgctgctgcaccggcgagggatctcgtcgacaccatcggggccaactggagcaagagccctaccgccgccccagctgcctgcttccggccatcgccggcgcccttcgcggtgccggtgccggtgcaggacgagatcacggacgccgccatgctgctgatgacgctgtcctgcgagcttgtccggagctgatcgatccatggaacactcgagagactctgatctatccaccacggtacccccgggcttttttgccttagtccgttagacagtcggtacgtactgtccgtgctgccgcgtttttggcttcttgttcttgttgctagtgtaaccctgcgctacttaaagtcttgtgattcgtttgtgtgtaagattaaggcggtgaggaagagagagatctagaggaagagaggtagaaacaaggagagatcagaggagagaagaggataaaaataaaaaaaacaacgtgagctagctagctataggatctgcaaacactgtgagatcgagcgtgagttcagtttggagtagctagctttttgttgcccccggctagttaccaagccaataggctaccatatagcatgtatgttttgttctttgttttgctcgaaccatttgtactgtgggctcgtaataatacccaaataccggaccatgaaaaagaacagtgcaaaaggagtcaaggacttcgttgctggcaagattgagccatccatcaagagcgagccgatcccagagaagcaggagggtgtccacgtcgtcgtggccaagaactaccaggaggtcgtcatcgacagcaagcaggatgttctcctcgagttctacgctccatggtgcggacactgcaagtcgcttgctcccaagtacctcggccgcgaccacgcta

SEQ ID NO: 6163 - DNA, 2237 bp, Triticum aestivum
  Clone ID: PAT_TA_6163
gggcaactttacgacgacccctcgtcatcgagcccgtctccgtttttccctgtggggcggaggttctttgcctggtgacacccaaacctgaagcgaacccacgctgttcgccgacccgtccactgctgctccggccagccatgagggtcctcgcgttcctcctcctactatggatctctgccgccgccactgcatcccctccgccgctcgagaccctcggcatccctccgcaagatgaggcgtactacaggggcggcgtgatcaagtgcagggacggatcgggcaagttcaccagggatcagctcaacgacgacttctgcgactgtcccgacggcaccgacgagccagggacatccgcgtgcccggaggcgaaattctactgcaagaataccggacattctccaatcaccatcttctcgtcgcgagtgaatgatggtatatgcgattgctgtgaggggagtgaggaatacggtagcaatagcacttgcaagaatacatgctgggaagctggcaaggcggcgagggagaagttaaagaagaaagtagctacatataaaagtggtgtcgttattcggaatcaggaagttgaaaaggccgaattggcaattgctaaagatgaagcagagttaacaaaactgaagggtgaagagaagatactccaggggcttgtcgacaagctcaaagagcaaaagagattaatagaaaaggcagaggaagaggagcgcctaataaaagagaaggaagaaaagagaattaaagaagaagttgaaaacaagcagctgaggaaaacaatagcacctgatgcctctcaggaagcagattctcaggacactaatgagaaggcacaagaagatgaaagcaaggtagttgaacatcatgatggagatatcacggaccatgacaatcactcaccagaaggcgagacatctgttgaagtgcctgacattaaagctgggactggagatgacgaaccaccggtggagacatctgcagtacctaccgaagagcaggaccctacttctgtcaactctgaaggtttgtcaaaggcggaattgggtcgtctggtagcttctcgctggactggagaaaatgtagatgatgttggtaaaagcgataaaaagggccatgaggatgagctggatcttccagaacctgcagaagaagcatttgaagatgagcatgatataccagaacccgtagaagaaaattatgctggctatcattcagaaattgaggatgataggcacaaatttgaagacgaagagttgtctaatgtatcagatgatgaatatgttgatgatcatgaagaacctgatgtgtcctataaatctgatgacgaccggaaaggtgatgaccattcagatttaactgcctcaggacaagcatcatggctggacaagattcagcaaactgtacagaatgttttacagaaattcaactttttcaagacccctgttgatttatcagaggctgctcatgttcggaaggagtatgatgatgctagctcaaagctgtccaaaattcaatctaggataacctctctgacagataagctaaagcaagactttggtaaggagaaggagttctattacttttatgaccagtgctttgagggcaaggagggcaagtatgtttacaaggtctgtccatacaagaaagcttcacaggttgaaggacacagttccactaacctggggcgctgggacaaatttgaagaatcctacaggatgatgcacttttcaagtggagacaaatgctggaatggccctgaccgaagcctaaaggtcaggcttagatgtgggctgagcaacgaacttaacggtgtcgatgagcccagcagatgcgagtacgtcgctgtgctgtcaactcctgcaatgtgtgttgaagagaagctgaaggagctgcaacagaaactcgacgctgcgtcttcaaacctgtccggccacgacgagctctaaactgtcactggaaacaatgactccactattacaaccataaccacaagaaagaaaggctaccgaggtacatgttggatagatagaaaagcctggagctgtgagtgccgccaaagtagcgttagtctggttagggaaaattttgagcaaaatggtcggatggttgaaattttcacaccatcctgattttagtagctgcaagtggatatctttttcttttgctttgacggacgtttcctcaaattgtttatctaggtcatctgaaagagactaagccttctg

SEQ ID NO: 6164 - DNA, 1155 bp, Triticum aestivum
  Clone ID: PAT_TA_6164
acgtatacatatatgtgtatataatgaacaatgtaacaaagattgatccctacgcttcatcacctgtgcagccactcaacacttttattgtccagtagtactgtttcgaaactgcttcgcgcgcactgccagtgccattttatctgcctgccatcctctcagtacgtgtctcctggcctctaacctagtagtagagtatatatcagtcaacgaatagaactgctttgctttagttggctttgcaattcttggtcagggaccaaagcccgtccctcccgtgtgcacctcgaagttaggcatcaaatgagcagaagcagcagcaagccgggccgccgccctgttgttaggaggagccacctggctgccgtacccgattagtgctgcggcagttgggctgtagaaatctaccattcctgcagcttccttcagcatgttgttgttgtggccatcctcgtggtgatgacggtgatgatcactagttgcacctgcaccgccgcccttgatgatattgcccgccgtgatggcggcgtccctgacggcggcagccgtcgaaccgccgcactgccgtggctgcgtctggtagaacaccttggagacgacgagctcaccatccttctcctcctcatcggagcctaggtggtattggtgcatcacccagttggtcttctccggcttgcgctgcttgccgtagttggtatagaggacgaggatctttttgtaccccttgagcttcccgtcggtgaatacggggcgggtcttgcccgttttgtgccacctcgtctcgccgccctgctcgtcggtgtgcaccttgcgccgcttcctagtccccgtcgtatacgcctttgatggacggtggaagaagtggcggatcaggccgtccttgccaactcctggaaccctctcagcgtcggtgtagcaaatgccgcacttgccgtggctgcgtctgatagaacaccttggagacgacgagctcgccatccttctcctcctcatcggagcctaggtggtattgatgcatcacccagttggtcttctctggcttgcgctgcttgccgtagttggtatagaggacaaggatctttttgtaccccttgagcttgccgtcagtaatacggggcgggtcttgcccgttttgtgccatctcgtctcgccgcc

SEQ ID NO: 6165 - DNA, 574 bp, Triticum aestivum
  unsure (1)..(574): unsure at all n locations
  Clone ID: PAT_TA_6165
ttacatgatggactgcacagcaaatgattgccatcatttactaaaatcagcagacaagnaggagctttatcctacggtgttgcttttcccggcagagaacaaaagcgcaatatcatatggaggaggaatgtctttgggtaatttaattgaatttctggagtcgcatgcgagcaattctcgccatatgtcggaatataaaggatttctgcgaaagaagaggatggtaatgcaacatgaagcaccgcagactgtccggtttcacatgaaggacaagagcggcagcaatgttggttccgatccgccaagtcaacctgaaaagcgcaaggtgcatatcgtcacggggtccatcctcgacgccaccgaaaagcttggtgccgcagttccattcgataatgctcgagtgctcatcgtatcggctgattctcacgagggatttcatggactaatcatcaacaaaaggttaagctgggacaccttaaagaacctggacagctccctggagcctatcaaacttgcccctctcttctacggcggacctgttgtggtgcagggttaccaccttgtgagtttgtcc

SEQ ID NO: 6166 - DNA, 1517 bp, Triticum aestivum
  Clone ID: PAT_TA_6166
ccacgcgtccgcgcggccgccccggtggcgctcgtccgttcccccccttcctcattcggcttctcagctcgaaaacgcgagcgccaaaaatcccccgcgccgccaaagcggcggttggggttccggcctccgcctcccccgcggccccggcccacggtagccccgccgtcgcctcgcagatccccgaggacccccagcctcgccgccggccgtgtcgtatcggcggactccctggtgttgaacgagttgttccttttgtagaggttgtattacaaggaccaaatgcctctcttcaagaggacacctttcttcttactggacccaccaaaggacttggatcccaaggagaaggtgttccaagttcgatttactaaggagatatttcgagattaccaggagtacctgaataggttgaacctttaccgtaaaagggtttggacatgtaaggtgtctggaaaatctaatttaacctatgaggaagctttggtctcagagcagcgggctgcagagaaggctcaacagttgccaagagagcttatgtctcctgttctccagatgatccaatacagtacacttaacttaactgaccttgtcaacaagatatatggcagtctgcaagagaatctgtttgaaggattagaattacatgctaaaagagatggttcggaggctgcttgcaagattctgaaggttataggttcaggtaaaaccacaagctatgaggtgggctggattggtcaagacaatgcaattaccagcacttcagttctcagagccgacgatctaattcgcaagaaagcaccttgtggtcgtaatatgctcaagatttttgtcagggaatcaacatcacaaaactctccatggatcgtacatatgaatcttgcaaagaaatatggcatacccactgagcctccaaaagacatgattaatggtgaaggattgtccaaagcaaggaaaagactagcgaatgggactgcagaagatgccagcaaaaggtcaaagaaagatgaagaggaacaagtagtaccagttaaatacccaatcgatgatcttttagtaaagccggtggcagatgaccctcttttgtcaaagagatgcccagcatccacagatttcaaagtccctataagttctgtgggagatctcctgatggtctgggatttctgcatgtcttttgggaggcttttatgcttgtcgccgttttccttgtcagatctggagaatgcaatttgccacaaagaaaccaatcttgttcttcttgtggaaatacacactgcacttctcaatttgcttattaatgatgaaggtgaatattatgagtttatccagaacaagaacagaaaatcaaaggtatctctagtcacctggaaggagtatctatgtgatttcatggaaatgacaagtatctccagtaacatatcaacagtacggaggggtcactatggtcttgttcccactagcctgaaacttgaaatcctacgggaattggtagatgaagccattgcaactattgctgt

SEQ ID NO: 6167 - DNA, 599 bp, Triticum aestivum
  unsure (1)..(599): unsure at all n locations
  Clone ID: PAT_TA_6167
ctccccccggccgtgtcggtgtgtctctccccttccccctccgacccgccgcaaaaaccctagctctaaaccccgctgatcgccggccccctcccggcgcccggcgccgcccggtttgaccccggccaggccaggaagccgaagggcccccctccccagccggcgccgccatggacatggacaccttcgaacgcctccaggccgagaccaggctccgcgatgcgctcatgcggctcgaggaggcggaggagaccgacgacgacgaggagaggggcgccgaggaggaggagctggagtgccccttctgcggggaggagttcgacggcgtcggcctgtgcttgcacatcgaggacgagcacgcggcggagaccaaggccggggtgtgccctatatgcacagatagagttgggatggacttggttgggcacatgacctcagagcatccaagtttcttaaagggcaggtggaggaaccccggcgtcttctcgtctcgtcccaatgtatccgaattgaaaaagatgcgnnaatanatacgctacgnggtctctcgtcaactcgctaataaatgccngtcncaancccncttgtggaactcattg

SEQ ID NO: 6168 - DNA, 759 bp, Triticum aestivum
  unsure (1)..(759): unsure at all n locations
  Clone ID: PAT_TA_6168
tnntcancccctatgggnccccganttaggtttcaatggggggtnttgttncttagaagtgacnagagggcaganccgggctccccacccgatggcgtggtggcgcgcgcggccgggcccgctgtggacgcccccgcccgcgaggggccgccgccgcgggccgcgcaggcgcccccgcaggccccgccttcatcagcgtcctcccttccaaaggagcagtcgcaggtggagttggagctgaggctgctccaggctctcgggttctaccctccctccaaactgaaaggcattcatcgccacttcattctatacggcctcatggaatacttgagaaaaagccttgacagacaattctccgcggatgaagttctgcaatgctggccgcttcttcaacctagaaatgctgaaaccagacgacgacgagaaggataacttcggtcagacggaagaattcgccttgccggacaattttttcaagaaggaagaatgatgtgcaagttagctgtttctttgtgttcttttccccctgtagtctttgccctagaagcctggaacagaacacccatatatatgctgaagagctgtgttggttgctggctggtgttcactgacttgacctgtgctgttgtacagcttctgttgtgctcggatacccgatgaactgttatgagtctgctcatttaggtttggaattatgtgtttcgcttcaataaaaaaaaaaaaaaaaaaaaaaaaaaaaaaaaactcgagactagtctc

SEQ ID NO: 6169 - DNA, 1123 bp, Triticum aestivum
  Clone ID: PAT_TA_6169
gctcgaccgttcgttctcttttcgtggctgcaggccggacgactgccgttccttgtacttatgggggatgattccgagctcgccccgagcacgctcatcttcaattgctttgtgttctgccaggtgttcaacgaggtgagccccagagagatggagaggataaatgtattcaaaggcattctagacaacaacgtgtttgtcgcggtgctcggcagcacggtcgtattccagatcatcatagtacagttccttgccgactttgcgaacaccacccctctgtcgctcagggagtggttctccttgtcattgtcatcggctttccataggacatgcccatcgccgcgaaatagtcgaagctcttcatcccgggtcgggttctctagtaaggcagtacgcctagctaattgcagactgaaggaaagatgttgtgagaacttaggactgacaagttcgaccgagtcttccaacgcctcatcttcaattgctttgtgttctgccaggtgttcaacgaggtgagctccagagagatggagaggataaatgtattcaaaggcattctaaacaacaacgtgttcgtcgcggtgctcggcagcacggtcttattccagatcatcatagtacagttccttggcgatttcgcgaacaccacccctctgtcactcagggagtggttctcctgcatcgtcatcggcttcataggcatgcctatcgccgcgatagtcaagctcttcccagtgggttctcagtaggagacgacaactaatttgcagtcaggaactgaagtgaggtagtaggactacaggctgatggtgatgccaacgcagtttgggcgctgtcgtgagcataagaaactcttctttctgctgttaatccgttttatttatctaggtgaattgaatctatggccttttgtcttttgcatttgatctttagaggatgagccaagactgtgggcttgattcttcaaaagtgtttaatagaccctttttagttatttttttcatgttattttccttggaatgttgaacttgaaattgtatatgcatcaacctaaagtacttgagacatctgttttgatttgacatgatgtttggattggcttgtgcaaaaaaaaaaaaaaaaa

SEQ ID NO: 6170 - DNA, 1412 bp, Triticum aestivum
  Clone ID: PAT_TA_6170
tgactcatgcactcggggatctttttatttatctatgtgcggaggggtttggttgtgtcgaagatgcagctgaagatgcttcagacggacagaaagatgcaacaggaactggaactcccacgcgtccgggtcaagagagtgcaagctctaaaattgatgatatatcacaacttgagggcaccaatgaaatggatgctcagtgtaagggagatcaaactcctaaggatgatgatcaagcaattgaaatggaaggagattttgctgctgaattagctgatgtttctgagaatgaaagcaatgactcaggcagcgagggtgaagacaacttggataatcagatgggtgacactggtgatgccagtgaaatggttgccaagaaatcttgggacaagaatgaagatgatgattctaagacgtctgacgagaagtatgagtcgggttcattagccaagggggcagatgaaaataatagggaattgcgtgctaaggacgaatgtcccatggagacagatcccgtggagacagatgataacgagcaaggcaagaataataatatggatgatgaaccaagtgcttgtgaggatgctgatgatgtaatgaacaaagctgatgcatatgatgatcgaacagggcctgaactctctgaactggacaatgatgatgaggatgtcaacatggatgatacagaacaaaccgatggcctgggtgctgacaatcctgacaacgaagatatgggcccagaagaggggcatcaagaagatgatagtgcagttgcgtcagaagatatggaggaagacgatgccacacatgatggtaacaatgtggttgataatgaaggggaacatgatgaagatggaaatgttgagccaaacaacatggagaagcaacagttggacaaaatggagtcacctgcacatccttcacaaggtatacaacccaaccaattggaaacagactccaacagagaatctgaagcaaacttggccaacagcatggacatgagcagtggagttgctccttctgtcgatttttcaagtaatgaagtgcctagtctggaaatctctatgcccaactctggtgaaggttcaagaaatttgtccaactccaagccagagttgcagcctgatgctccaccgtcacacatcaagcagacaaatcctttcaggagcattggggacgcattggaggactggaaagaacgagcaagagtctcagatgatacccaggatcatcaacccgaaactgaacaccatattgatgagagtgctactgaatttcgttatgtgcctgagggtgagcagagcacctctcaagcattaggtgatgcgacagctgatcaaatcaatgacgagctgcaagtcaggcaacctatgttagaagatgaaacccgtgccgaagttgaacaacccgat

SEQ ID NO: 6171 - DNA, 923 bp, Triticum aestivum
  Clone ID: PAT_TA_6171
attgtacgaatccggaagctatgatgtagaagagatcataccaaaacagaatacatagtgacacacgtgaaggctgaaaagcgagagaaatggttcaaatgccgctacgaggtcaatgtgtctgataatttggggtatttctcctgcatatgcggcctgttcgagcacatggggatggtttgctgtcactcgctgcaggtcatgaatgtgctccggcttaaggagattccacccagacacatcctgaagagatggagcatacacgggagagacaatctgccagatcatctaaaacattaccaacaggacatggggccgccggacgcacccacttatagacattctgctttgtacatcactgctctggaagtggttaaaatgggtgatagaaacctagaatcatacaaattcatgttggatggattggtggatctgagggagagaggagcagaaattagcgcaccaaatgatggcctaggcattgcggagcagcaggtttcgaacaccggagttgcgggtggttcgaacgggaaaactaaatcttgtaaggcggcgtgctctgtaaggagtgtagaagggaatcacttgtccgccggaggagcaacatcggtgtcggttcatccacctgcaagccagggtgagggggggacaaaatcccaagacatggcatcagaaggatcttgtcccaatgcaaatagctacaattcagactattctgaaactgcatcaaggctggatgtcaatgtgggcgatagtatgcttgcgccggaaagggagaagaaacgtggcaggccaacgacaagcagggacaaaggctccgttttgagaagggggagcaccaaaaagatcaaggtttttgttctattttgcagggggccaaaggaacacaagttcaaagccccctgccctgaacgttggtggac

SEQ ID NO: 6172 - DNA, 348 bp, Triticum aestivum
  Clone ID: PAT_TA_6172
ctattcttattggttggttttatgggccaatggcggacttccagtcgatcttctactacttggaattgatatctttttgccatataaagcgaatcaaaattgcaacttgtgtaaacatagagtccccccaggaacacaacaaattatttatcatctagtagagcttcaacgtgaaatattagcaagaatttaccgttagtaactcgtgctgccaatccaaaatcagctagtttcatcttgccagtcttggtgagcaaaatattctccggcttaatgtccctgtggatgacgcccatttcgtggcagtacttgacgaccgacattagatccttgatgacaagggcggcc

SEQ ID NO: 6173 - DNA, 460 bp, Triticum aestivum
  Clone ID: PAT_TA_6173
accatgacaatctgaccgagtagatcgatcaatcatgagttttatcatactttgagccaaatcttcacgcttttttcttttatttggttatactgtgtaaataggaatcaataataaaagtagatggtgcaaagttgtgctccctagcttctctggtgtagcaagttaatatatatcttcgtttatgtagcatctctggtgttccattatgttcagctatgtatgttcatttggtcccttagttactccctcggccctcttggctgccaccgaatggatttttatatttttgtatatcttcatggtcctatgctccatataggcttttctatatattaaaaaaaaatcagctgcatgaaagtgatacatatatgtgatgatctctgacttgacctgtgctgggtttactcctgcagcagtcggtatccagtatagcgggttttgggacgtggggtggagt

SEQ ID NO: 6174 - DNA, 1239 bp, Triticum aestivum
  Clone ID: PAT_TA_6174
aaaaacccccaaaaaagagagggagaagagagagttggccgcttgattagcagagtggtgtgatggagtcggcggctggggcggagacgccgaacctgtcggcaccggcgacgccggggacgccggcaccgctgttcgcgggggcgcgggtggactcgctgtcgtacgagcgcaagtcgatgccgcggtgcaggtgcctgccggtggatgcgtggatgtcgtccaacgcctgcgtcgtggagatccccgcgccggacgtctcgctcccccgcaagctcggcgcggagttcgtcgggacgttcatcctcatcttcttcgcgacggcggcgccgatcgtgaaccagaagtacggcggcgtgatctcgccgttcgggaacgcggcgtgcgcgggcctggctgtgacgaccatcatcctgtcgacgggccacatctcgggcgcgcacctgaacccgtccctgaccatcgccttcgcagcgttccgccacttcccctggctccaggtcccggcctacgtgacggcccaggtgctgggctccatctccgccgggttcgcgctcaagggcgtcttccacccgttcctctccggcggggtcaccgtccccgacgtcaccatctccaccgcccaggccctcttcaccgagttcatcatcaccttcaacctcctcttcgtcgtcaccgccgtcgccaccgacacccgcgcagtgggcgagctcgccgggatcgcggtgggagccgccgtgacgctcaacatcctcgtggccgggccgacgacgggagggtcgatgaacccggtgaggacgctggggccggcggtggccgcggggaactacaggcagctgtggatatacctggtggcgccgacgctgggcgcggtgtgcggcgccggcgtgtacaagctggtgaagctcagggacgtgaacggcgagactccgcgcccgcagcgcagcttccgacgctgatccatgtgcacgcaaactccggcccgtgcatgtacggttggttgctgatcagcaacaaccgggtgcgtacggacgccggtaaacatattactcctacgatttccatgttccagtgccgcggacacaccgtgactgctagcatatttgtgtcccgtgattgtaataaataattaacgccgttttgctacgtccagaaccgcgagtctcataaatgaattaacgcccttcctgctacttccaagaacggcgttggacttgtgccttaaaaaaaaaggggggg

SEQ ID NO: 6175 - DNA, 1005 bp, Triticum aestivum
  Clone ID: PAT_TA_6175
gatcttcctctctatgacattctaaatgagtttcagaaagtcacagccacatggctgtggttgttaaacgcactaaagaaggagcatctgttgaaaagaataacagttttacagcagattataaaatgaccaatggacatgctcatgctgatggtctgggtctgtcaccctcacatgtcaacactcccggaagtcgtcgaaataacaatgacaaatacagtaagaaaattgaaagaaaacgggacaacattcttgattttaacaccgatccacttcctcactattcaatggatgaggaagcggtgggaataattacaatggaagatgtcatggagcagctgctgcaggaagatatcttggatgagacagatgagtatgttgatgtgcataacaagatcaaaataaacatgttaccgccaggcaaatcattgtcgcctcttatatctcctagtggtggacctctgtctcaaggactaagaaagacccctatggcttctccgctgtcgccataccataatggcggctccatcttacgttcccctgctgcaaaccatgctcgatcccctgggactttaccgacagccttttctcctgggaggtcaccggcatctcaaacccccgtgcgcagttcgccgacttcaagttgggtctccgaggaattcgtaccgaaatccatagaaatggtggtgagagctgatgccaaagagctcagggggcaacaatcccagttgaggtcactcccaagatcaaattgaggcactgaagagtgtagggtcaaagaatgaagaccccacagctctctcctttgttgctggtccttgtttatttatgattttcttgtacatatatatatgtcccttagcatctgaactgagtatggatgagctctcaccacctactgtagacgccctttttgccacactcgtagcaaccggggcaaacgctgacaactcctcagtgaaacgacgtaaaagaaacgcattctgtaaaaaaaaaaaaaaaaaa

SEQ ID NO: 6176 - DNA, 563 bp, Triticum aestivum
  unsure (1)..(563): unsure at all n locations
  Clone ID: PAT_TA_6176
ggcagatcaccgaaatggcaagcatagcgctcgtgctcacagtttgcttcttgggcttttacgtgcccgccccttccctggcgtcgtcctccaacaacaacgacttcctccggtgcctctccactagcatccccggccagctcgtgctgacgccgagctcgccgtcgttcacgccgctcctcgtgtcatccatcaggaacgccaaggttggtggcaccggcgacggcgaatcctccgctctgcatcgtgacncccacaaacgcgtcgcacgttcaggccgccgtgcgctgcgggcgccgccacagcggtgcgcgtccgcgtgcgcagcggcgggcacgacaatgagggcctctcttaccgatcgggccacccccaacggcggaggcgttcgcggtgattcgacctcgccaagctccacgccgtccaacgtcaaacccgcatggtgccgccgccgccgtcggggcccgggcaccggccggcgagctccccggccgcatcgccactgcggcgccagggctgggcttcccggctagcgtgtgcccgaccgtgggcgtgggggccat

SEQ ID NO: 6177 - DNA, 475 bp, Triticum aestivum
  Clone ID: PAT_TA_6177
gtgttttttggtggccgcgttaacaatctcctctccgtatttcatttcactgatcaaagtattaatcccgatgtgcctcataatccggccacatttagaagggactgttgatctacaggactatacaagaacgcacttggagctatcaagtgcagaaataatggctatctatagctacacatacaccctactaggagtatgtccatgactagatagaggctctaacttgtcctcacgtaagcctgtgggaacatccttgggaagtaagtgcgcttcgccttgacaaccagccaatacgcagagaagcacgggacgtgagcgacggccatggcgaggtaccatagcggagccccgggcgatgcaaggtcgagaaacgggtaaggccaccaggataaagctccagaagcatgaatgacccactggagcggcgccccgggccatccccggtcgacgaacggggcgggcctcctgccga

SEQ ID NO: 6178 - DNA, 815 bp, Triticum aestivum
  unsure (1)..(815): unsure at all n locations
  Clone ID: PAT_TA_6178
cccacgcgtccgcccacgcgtccgcggacgcgtgggtccaattccaaaaccgagaggtaggtatccttggaggagggggagggggatcctcctcgccgctccggtttccatggcggccgcccccgcccccgccccttcgccgccggaagcgtccccgccgcccctcgacgcctctgcctccgcctccgacgacgagtgggatgcggatggatttgttattcctgatgtgactattcaagatgatgatgatgatgttactacacacagtgtccccaaagcaagggatcctgaacctcagcaggctaaagaggagaagatatacctgggacctcatggggcgccaccatcaggagcaaagcagcaacaacttaacacagttggccgtaagcagagtgtcagaaacaagctgaaggaagcagataggaaatccagtggcaatgctcaggagaacaaggtggaaagccctaagagagctcatggggggctgtgacaacagatnggtaggggcatggcgaagagttctcgtcgcgaatggcttgacccacacttgtcgcggagtcggagtttgataggaaaccgcgctagctaggtggctgccatatgatgtgtccttttgcgcaaaatctttaactgtatactgctgtgggctactggctatgccccaaaaacatgtctttgttatctgcaagtttttgggaaggaatagccaacggttttctttggtatgcagactctcatgaatcttgctgggaatgtatgtcttgacttgagatgaatctgtagcggtggcatgtggtattgtatgtggtnatgtc

SEQ ID NO: 6179 - DNA, 1612 bp, Triticum aestivum
  Clone ID: PAT_TA_6179
ggcacgagcggcctcgacagctcctcggccttctctcgtgacgcagacgctgcggggcctggcgagggacggcaggacagtgattgcgtccatccaccagcccagcagcgaggtcttcgagctgttcgacatgctcttcctgctctccgggggcaaaaacgtctacttcggacaggcagcgcaagcatgtgagttcttcgctgaagttgggttcccatgcccgcctttgagaaatccctcggatcatttcctgaggtgcgtcaactccgacttcgacaaggtcaaggccaccctgaaaggatcaatgaaagcaaggatcgaaaggtctgatgatcctctggataagataaccacatcagaggccatcaggaaactcgtctctgcctacaacaggtcacagtactactacgctgctagggagaaagttaatgacatcgcgcgaatcaaaggaacggtgatggattcaaggggcagccaggccagcttcttgatgcaggcgtgtacacttaccaggcgttcattcatcaacatgtcgcgcgactttgggtactactggctcaggctcttgatctacctccttgtgactgtatgcatcggcaccatctacctggatgtcggcaccaaatacacatccatcctggccagggcagcatgtgcagcattcgtctttggattcgtcaccttcatgtccattggaggattcccttcatttgtggaagaaatgaaggttttccagcgggaacgggtgaatgggcactacggtgttgcagcatttgtcattgccaacaccatctctgctctgccattcctggtcctgatatgcttcatgtcagggacagtatgctacttcatggtgcgccttcatcccggtttcacacactacatcttcttcgtcttgaacctctacgccagtgtcaccgtggttgagagtttgatgatggccattgcaagtgtcataccctatttcctcatgggcatcatcataggagctggaattcagggaatattcatgcttgtctccggatacttcaggcttccctatgacatcccgaaggttttctggagataccccatgcagtacatcagcttccattactgggcactacagggccaatgccagaatgacatggacggtctcctattcgacaaccaatacccggaccagccgaagatccccggggagttcatcctgaagtacatcttccagatcaacgtgcaccggtcgaagtggatcgacctgtcggtcatcttcagcatgatcttcatctaccgcctgctgttcttcatcatgatcaaggtgaacgaggacgtgatgccctggatccggggctacatcgcgaggaagaggcttcagaagaaggtgcctgccatcggcaagacgccttccctgagaggctatgttgtggatccggagcttggtcctaacgaaggctagaaagatataagctgggggttgctgggtagcacaaataggagggtttcctaccggttcttggcgtaatatgtatctatgatcagagaaactggtaatttttatacgttttggaagtgaagctcgtttgagtagaggtacatacatacatgtaatgtgttcaaaaaaaaaaaaaaaaaa

SEQ ID NO: 6180 - DNA, 647 bp, Triticum aestivum
  unsure (1)..(647): unsure at all n locations
  Clone ID: PAT_TA_6180
cgtgatattgctctgaagttccaagattagatgctgcgaatgttttcggttcagctctcaggatacaacagactgagaacagttttgcatttgggtcatgcataaaccgaagtaacattgagaatgaggatctcgcgccgttctccgcgcggggttttaattgggctgtatttgagaatgaactgaagtggtactggacagaggcggaacaagggaagataaattataaagactccgacgagttgcttaaattctgtcagaaacataacaaacaagttcgtggccactgcttattctgggaagtggaagattcagtgcagccatggcttcgatcactgcatggacaccacttgatggctgctgtacaaggtcgtttacagagcctactgtcaaggtacaaaggccagtttaaacatcatgatgttaacaacgagatgcttcatggatctttttaccaagataggcttgggacggatatcagagctcacatgttcaagggaagccataagcttgacccttcagaagnccnctttgtcaacgactacaacgtcnaagatgganccaattcgaaatcaaccccanaaaggtttgtggngcaaatggccgatntccanaacggggggggccccaaattggggggaatcggg

SEQ ID NO: 6181 - DNA, 696 bp, Triticum aestivum
  unsure (1)..(696): unsure at all n locations
  Clone ID: PAT_TA_6181
ncactttttgttatctacatgattcggttcaaacttaggtcaacttatatgctggacaaggacaactttgcattgtactatgtggtgataccttgtgctgtgttggcgctgctagttcatccttcaacgtctcacaacatcgcaaaccgatttagctgggcgttctgtgtttacctggaagccgtctcagtgctgccacaactgcgtttgatgcaaaataccaagattgtggaaccgttcacatctcactatgtgtttgcgctgggggttgcgaggtttcttagctgcgcccactgggttctccaggttctggacactcgtgggcgcctgttgactgctctgggctacgggttgtggccgtcgatggttctcctgtcagaaatcgtgcagaccttcatcctcgcagacttctgctactactatgtcaagagtctggtcggcgggcagctggtgctacggctaccctctggggtggtgtaggaggaggatctgcagcgggaggaacgacggctggttggttcgcccatgaggcgtgcccgagaccggagccgtcttagcccagatatattattcagttacagcttacaattggcactagtgagaaaatcgcagcagcagacataggcttgtcggtgtgtgtgactggtaacagcagcgtatgtatgacctaacctgagagtaactttagcttccggt

SEQ ID NO: 6182 - DNA, 811 bp, Triticum aestivum
  Clone ID: PAT_TA_6182
ggacctgcgccggactatcccttaagactcaggatttaactgcattgtttctagctgttagactatactgcagctttgtcatggaatatgacatccatactgtgttggatactgctacacttgtggctacactttttgttatctacatgattcggttcaaacttaggtcaacttatatggtggacaaggacaactttgcattgtactatgtggtgataccttgtgctgtgttggcactagttgttcatccttcaacgtctcacaacatcgcaaaccggtttagctgggcgttctgtgtttacctggaagctgtctcagtgctgccgcaactgcgtttgatgcaaaataccaagattgtggaaccgttcacagctcactatgtgtttgcgctgggggttgcgaggtttcttagctgtgcccactgggttctccaggttctggacacccgtgggcgtctgttgactgcgctgggctacgggctgtggccatccatggttctcctgtcagaaatcgtgcagaccttcatcctcgcagatttctgctactactatgtgaagagcctggtcggcgggcagctggtgctacggctaccctccggggtggtgtaggaggatatctgcagcgggagaaacgactcgtcgggtcacacccatcagaggaggatattttcagttacagcttacaagtgtcattagtgagaaaattgcagcagcagacataggcttgtcggtgtgtgtgttactggtaacagcagcgtatgtatgacctaacttgagggttaattttagcttccgtatgtttgtttgtcgcc

SEQ ID NO: 6183 - DNA, 1293 bp, Triticum aestivum
  unsure (1)..(1293): unsure at all n locations
  Clone ID: PAT_TA_6183
gaactccgcacgaggccagacccagaccagaccgctcacgccgcaccgcacgcgctgcacgggcacccaacacaagcccttctccgatcgtgctcgctcgccgccggtactagtctagtagagcagcggggaggagctccgagatgagggcgccgcggaggccgatggcggtggtgctgagctgggtgcggaggcagccgcccaaggtcaaggccttcctcgccgtcgtcgcgggcatgaccgcgctcgtcttcatccgcttcatcgtccacgaccacgacaacctcttcgtcgccgccgaggccgcgcacgcgctcggcatcgccgtgctcatctacaagctcaccaaggagaagacctgcgctggactttcactcaagtctcaggatttaacagcactgttcctggctggttaggttgtactgcagctttgttatggagtatgacatccatacaatactggattcagctacactagtagctactctttttgtcatttacatgattcggttcagactgaggtcaacttatatgctggacaaggacaattttgcattgtactacgtggttgtaccatgttgtgtgctggcatttattgctcatccttcaacctcacatgtcatgatcaataggatctgctgggccttctgtgtttacttggaagctgtttcagtgctgccccagttgcgcttgatgcaaaatacaaagattgttgaaccattcacagctcattatgtgtttgcattgggtgtggcaaggttccttagctgtgcacactgggtccttcaggtcttggatactcgtggcagattattgactgctctgggctatggcttttggccatcgatggtgctcctctctgaaatcgtccagacgttcatccttgcagatttctgctactactatgtgaagagtcttgctggcggacaactagtgctgcgacttccttctggggtggtgtaaaatctgcaatatgatgcacaactcatttgttcggtgctgtgtcttactgttgaacagtggctctgcttctggcgcccaaccttctctcttcccatgtgggatggattcaagagtcttgtttgccttttctttttccagttataaactgtttggtgaaaattgtaccggagactgttggtcgtgaagcttaggctgttgagaatactatctatagctgactatttatccagactattttacaacctaaatacgttggtccaatcaccaattccggattgggaggcagantctccattcaaggcangtcccttcattgggtgatcgggtgac

SEQ ID NO: 6184 - DNA, 1044 bp, Triticum aestivum
  unsure (1)..(1044): unsure at all n locations
  Clone ID: PAT_TA_6184
gctcttctcatgaagcagctcgtggatctcaggctctaccagcaaagctctaaccttgaagtccagagtttgattcagcgccttcaagtaatggaacagaaccagaagcagatgatggcacttctagcaatcgttgtccagaaccctagtcttctcaaccagcttgtgcagcagcagcagcagcagcgcaggaataactgcgtttatgaggatggaaacaagaaaaggaggttccctgctctagagcagggtccaagtaactgatcatgagacttctggctcaggggccgaaattattcagtatcggcctcctgtccctgaaacttctagccaagtaatagcagatgaagcatttttgtcggccaccgcacaaccaatctctagtgctgcacttaacatgcccatggacatcgacactcaaacgaccttgggcaacctcaacacacaaggttcatctggggacatttttgctgacatgcctgctctaccagactttgaagacatgcatctgtggtttagcgaagacggggaacctactttaactattcaagattatgatgaatttccccaatcagggcaggactgtcagatggaagcacagcataactacaataaccctcaacatgctgatgccataactgaagcataggtggtggtctaggagcacatcgggcagcaacattactttagcttccgggtgatcaaagtgtggaggcatggtgatgcgtgaggtgcgcgccattggcagtgaaagcggcagctgtgctcagagtcatcggagtctcgtatggcaaatgctcgaaagacattaactgtcgttgactatacaggattcttttgttgttttttcgggcacaggacagggactttttgcgcgaccctactctccttgtcctcacagtagaacagccaacaactgaagttcacccgctcggtgtatacgctgttgtgttttggtaaatgtcaacctgtcctgtacattcctgtgacttccagccgaaaatgttatgttccaatnacatttatgaagtgggtttctaaaaa

SEQ ID NO: 6185 - DNA, 602 bp, Triticum aestivum
  unsure (1)..(602): unsure at all n locations
  Clone ID: PAT_TA_6185
ccgcccgggcaggtaccacatattaatggagcaactcttggtcaaatccttgttgtcttgacgaaacctagtacgcctcgtattatgaaacggaggtgcgagggcactggagcgtgttttatgatttcgtgaccccttctgacatttttagtatgcaccancacaaatgctacaatctaaattgttaagtactctatcagcaattgtcacaaacttttctttttctactctggctttggacgctggctactctggctttctcatgtttactcatccaaagcatgccaagcaagatacccccgattgaccagatgacaagaaaagtggaaacctgtggcctgctaataccacttccttttcttctactacttgatggatacttcacttgattgcttaatgatgacaccccttgctactttgcttgactcgacttaatgtactgaatactcatggtagctaggtgtatggatgcgcgtgtaattcgctaaaaaggagctctagtataacttgtgaacgaaattgcttacaagctgcatttcttcccttgtgttagtcaagctttntgttacaanaaaacatanattaaacttaaaaaaaaaaca

SEQ ID NO: 6186 - DNA, 1031 bp, Triticum aestivum
  unsure (1)..(1031): unsure at all n locations
  Clone ID: PAT_TA_6186
ccaaaatattatgcatagggatatcaaaggagcaaatatgctaattgatggtaacggtgttgttaaattggctgactttggaacggctaagcatttaagtactgcagcccctaatctttcattgaagggaacaccatattggatggccccagagatgattcgggctacacttgttaaagacgtaggctatgatcttgctgttgatatctggagtcttggttgcaccattatcgagatgttcaatggaaaacctccttggagcggtcttgaagggcctactgcaatgttcaaggttttgaataaggacccaccacttcctgacaatttatcacatgaggcaaaggattttctgaaatgctgtttcaagaggaatccagcagcaaggccaagcgcaagggagttgttgacccatccgtttatcaggaattcaagtcattacagcaagcatgttcaagaagtcattattgcaggctgtgaggaagtcattcgagcaagctgtgacccatccttgacaaggaaaactacaactagtggaggaaatgatgccaggtcttccgaatcattagtttcacagttaactctgcaaccagtccaggtagtcacaccttatttcccccctagaaattcaggttttgtctccaatcccggttcttaagcatgccagcattgggatctacactctgcatcctaggatggttcccttgttacatttcagtaggatttcagtagacgtcaaatttcatacaaatcctctgagtcatcaacaaaatgtacatcccccccacccacccaccccccgcccacatagtttatggaaggagttcacgatgattctgctctacagttttgtttcagaattactgatgatgcatgcttgtaatgtatgtttaatatgtggctttgtttgcctgcctgctaggtgctagatgcttcagtcattccggacatatgcttgataagatttctcaatcattgctgattgcctgtcatattttgatgagatgtctcggttatctcaaaaatnnaagagg

SEQ ID NO: 6187 - DNA, 818 bp, Triticum aestivum
  Clone ID: PAT_TA_6187
gcctcgcgccctcctccgctcctggctcttctgtcccagttcatctctatctgcatcctcgccggcgcggcacacaactcccatcccccacttcaaaccattttatttcttaccgatgtgagagtcaccccggatttgtggtgtgccagccacggcggcgcccggcgttgactactccgagcggccagcacggccgcacaactttgcttcctcgcgctggagttagtgctgtgctgccaccgccggcgacgaggcggacaagctttttggtgctgcaatcagttgcgcccttcgacggcggagtttcatccgtgcgcgccgaagctggaaacggcgtttttgggagctgcaagcagtgcaggtcaggcggccgcgacgagccagagggtggcgacgtgatgggcggcgagctcgcacggcttggcggacgacgatggccatcgttttttaccgggaggacgcggcaccagcggggacgcgacctgtgccggggatagaacgagcgttgacaagatctgacggttgagggaagattaattcgacggctcgcgcttgaccggccgaactattgggcggcggggccggggccccgtgcaccgcactactggcccccttacgcaccctatcattttacattgggcctttaccgaactaccgcacttcatttttcttgaaatttttatagaacctatcactcaactttcaggtgcttgtgaattatgcatggtctccaaaagaggctgaagaagcctccggggaagtaagcaaacttactggcactggtttcccgtggagataatttggatcatcatttattt

SEQ ID NO: 6188 - DNA, 634 bp, Triticum aestivum
  Clone ID: PAT_TA_6188
gcacgagggaagagctaactcaaggagaagcataaaatctcagggtgtctcctttgttctcgtgagagttgtgtgaggcagcagcctaaaatcccagggagaagcataaaatcctgtgagaggaaggcatggagagcgcccataagaaggcactcggcatcgtgacgctactggtggttctgcagctgctcgtggcggccatggctcgctcaccaccagaggagatggaaacggaggcggcgagatcagaaaagatagcgattgagcgcctcgtcctgaaagcgccgcggggagacgcgaaatgcgccgacgaaacatgctatactggtttttgcttcgtcgtcgctggttgcagctgccagtatccctactgtacaaagtctcgcgtcccaacgccagttcatgcttgaaaagcttctccttccattcgttgacggacccctaaaacgctggggtttgctttctcgctgaagaaaaagcctctctatgtacggtgctcatttacgtgcgtaccaaggaaaaaaatagcgcgctacagcaaaatagcgttggcctcagaatacgctattagcgtgctatatcgcgctatagcgtgctattaacgagacgttgtacatttgatttatttaaaaaa

SEQ ID NO: 6189 - DNA, 578 bp, Triticum aestivum
  Clone ID: PAT_TA_6189
gtttgtcaattgcgccgctgtcctcttcgccttgaccgccggagtcgacgcgtacactgttcccgccctctccgctcgcgccaaagacagtggtcccaaggccgtcaacatcagcgtgcctgtcgatcatttccacaatgagaccatctatgagcctcactctgacaaaaagttcccattgcgatattggttcgacgcccagtactaccgaaagggcggtcctgtcatcattctcgcgtcaggtgaaacttcaggcgaggaccgaattcccttcctcgagcatggcattctccagatgctggccaacgccaccggcggtatcggcgtaattctcgagcaccgctactatggaaccagtttccctgtgccagacttgaagcctgagaacatgcgcttcttgtcaactgagcaagcccttgccgacacggcttactttgcgcagcatgtcgagtttcccggtatggaggagcacaatctcactgcttccaccaccccttacatcatctacggtggctcctacgctggtgctttcgctgctttcgcgcgaaagatctaccccgaccttttctggggtggca

SEQ ID NO: 6190 - DNA, 828 bp, Triticum aestivum
  Clone ID: PAT_TA_6190
gtcgtgttctttgagaaatgtccaccggtccgacacgatgcagcgattcgaccgccatggcgctgaaagccatgagactccaaatagcgcacaactccttctttcgcggtagatactgggcctcatactgttcgatctcttcgtctgtgataccacccatcttctcctgcatcacctctgtgtactgtttgtagtcagtgttggttgtgagtttctccactgctccgcggacataggacttgaacgttccatagcaactcttccgcaacgacccaatgataacaggattggtgctgatgtcgaagggactttcgctatcatcctgggcggatggtgcaatgtctgcatctcggggttccccttggctatctccatgccggatctttcttaccacgccccggtcaaggaagatcttttgcaacactgctctgtagaaatgccgggagaagaatcctgcgctctccttctcggtccagttttgcggcgcttggcaggccatcatacgagccgtgatattgagtcgcacaccgtctccttgatgcgttgagaacctttggctcatgggaaatccctgcgggtcatgcttatctgattcccgaacaagtcggccgttgacagcttgaagagtcggtcgcaagaaggcatgtttgtatgtaggtggaccaagtttctccgtcatcaggttgtagcagcatccaacgatggccacagcccggatatctgggttcagaaccagagagcggattccaaagtgcgatagatttccgcaagaatgaattgacatggccattaagttcaggtccttcttaaaaaaaaaaaaaaaaaaaa

SEQ ID NO: 6191 - DNA, 669 bp, Triticum aestivum
  Clone ID: PAT_TA_6191
gcccgcgccggcgccgcccccaagctcgcccgccccgggcctcgccggcgctggcccggactcaccctccacctccccccctccccccggtaccgcaacacctccgacaacgacctcgcttactggggcctcgactacccgcccctctccgcctaccagagccggctccacgcccgcctcatcaacgcctccctccccgacgccgtcgccctccgatcctctcgcgggtttgagtcccacgaatcgtacgggcccctctgcactaacctttagcacatcgtggtgcgcagaactccgtgtctgtttcaagtctctgtggtctgtttcctgcaggaagttgcttatgcggtggacagtactctcgtctgatctcatggtgttcttccccgcggcgctatggttcgtgtgggcgtacatcagggtcccgggtggcggtagtgcggaggcgcgggacgggtcgctcggccggccccccggggttcttccccgccccggtttggtaccgtgcggccgcgcacgaagcgatggggttggcggtagtggggagaggcctgagggggcgacggcgcggctcgccatggttcttctcaacccgtgtttagtattaatcgaccacggccattttcagtataactgcatcagtcttgggctgacactcggagcgattgc

SEQ ID NO: 6192 - DNA, 669 bp, Triticum aestivum
  Clone ID: PAT_TA_6192
acgaggcctcagggttggacaaaaagcgacgatggaaactggtgtgcagcttaatttgtctatatattcttgcagtggagaaggagatgaccaaacaagaggttgttgatgagatcactacttttggaggtgccaatcagcaaagtttatccgggcaccgtgcacaggtggtgcaaatggcatgtgctgaagaagatgaaggaaacattgggccctctgtacatgaagaagagtgagttccaggctgagttccatgaggttgtgaaccacatgctaactgacgagtttgagatggcatgggctacactgttagataactacaatatgagaaagcactcctacaagacccaaatatacgacatcagaaaggtgggcaaaaccatatttcaagggttttttctgtgccaagatgacgatcacacaaggcaatgagagcgtttccccatttttggcttgtgacagggacagactgagcatctgcggaagaagattgcttacgagatagtgacaatgaaagggaacaaaggagctatcccagagtttctgtacccatgtgatcgttgactgaagtggaacatagtatttagttgtatcttttggctgtacgtgtgctaggcagttggattaacacgactaagtagttgggtcaaaaaaaaaaaaaaaaaaaaa

SEQ ID NO: 6193 - DNA, 643 bp, Triticum aestivum
  unsure (1)..(643): unsure at all n locations
  Clone ID: PAT_TA_6193
catacatttcctggttacagagacacgaggagatcatgcaagatgtagaaacatgtgcaatggcgttccgccttttacgaatgaatggttatgatgtgtcgtcagatgacttgtcccatgttgctgaagcctccactttccattgctcacttgaaggatatttaaatcatacaaaatctttattggagttatacaaggcttcaaaagtatgtttgtccgaaaatgaattgatcctggagaacataagcaactggtcaggccacttattggcagagaaactgcgctgtgatgggacacaaagaatgccaatttttggagaggtagaatatactcttaaatttcccttttatgcaacagtagaacctctagaccataagaggaacattgaacattttgattctagggttactcagcagctaaagagaaaaaacatgccatgtcatgccaatcaagatcttctagattttgccgttgaagatttcagtttttctcaatctatataccaggatgaactctgccacctcgagagttgggagaaagaaaacaagctggaacaactcaaatttctacgcaaggggagtctgataaatngttatctctctgctgctgccaccctatccacgcatgaactctctgatgctcg

SEQ ID NO: 6194 - DNA, 607 bp, Triticum aestivum
  Clone ID: PAT_TA_6194
gaggggaaagagctggagcagtatgaggcggcctccatgggtgcgttgggcacaggaatgagggaggttgatccagatgatgagtatgatgatggcattgatgatcctgatgattctcagatgcattctgccggtaggaagcttggtgatggtattcatgagaacatagggaaggaagagaatgctgccttggagagacacatgaaagcagcaggtggaaggattagtgatgacagtgatgctgttaacacgaatcaaaagaaagcttcgggtactggtgataagaaacatgggtccaagaagaaaccaaagcagaaaaagtctggttcaacttgtgaaatgaagtttctgaactccactgctcaacttgtagagcctgcaaaaaatgaaaaatttgctagctttaagttggagtatgtagagattgaacaaaaaccagctggatcagaaaattgggagccaagatttgctggccaccagactctacaggaaagggaggagtcatacgtagctcatgatcaaccaattgacatgggcttttgttaaggggcctaatggatcaagcactgggttttgatatatctgagggtgacagggagttcatgag

SEQ ID NO: 6195 - DNA, 625 bp, Triticum aestivum
  Clone ID: PAT_TA_6195
gatcggccgagggtccagaagccatcggtctcgtcgattactcattcacacttcacctctaccacatagatcatggatcaccgtccgcaagcttggggccgtcccagagacgacgtttacggcgcttacgatgcctcattcatgagtgacaacggtcccaagcaaaacacccagcagcctatcgttactggtacttccgtcatcgccgtcaagttcaaggatggtgttgtcattgctgccgataacctggcttcatacggctctctcgctcgtttcacagatgtcaagcgactccgccccttcgccgactcgtcagttgtaggcttcagcggtgacatctccgacatgcagtatctcgaccgccacctcatcgagctttctctcgacgaggcctacacctcccccgatgctccccgtctcaacgccgcaaaccttcatcgctatctcgcaaagcttctctaccgccgccgttccaaattcgaccccctttggaaccatatccttgttgttggtctcgacgatgacgacaagcctttcctcgctgctgccgacctcctcggcagcacctacagtgctcccagtctggccaccggctttggtgccatgctggcccagcctatcatgc

SEQ ID NO: 6196 - DNA, 591 bp, Triticum aestivum
  Clone ID: PAT_TA_6196
tcttcggcttctgcacctctccggcaggagcttggccatggcgaatcaagagactcactatggcttcgacgaaggcggagacgacgaccagtccattgtgtcgacgcgcggactcgaggctttcagtcgaaaggttacaactacagctactcatttgatcggtcccaatgccgaagccacggctcatcactaccaagccgccatggccgaggttcacaagcaaatgaagcgaccgacggtgcagcgaagcatgttcgcgatggcaaggacaacccccacagacctcatgcgctccaggctatcaacccacgaaattcagcatcgcgccttgacgttcttgcccgatgaccttctcgccaatattcccgagcatgaaaacccgtattcgttatttcagggcttccaggccagttttccggaactgactgacgaaggcaagaaattccagcgacgggtttctcgtggtcgcaaaatgttggaagattcagaagggacaccaggaagccccaaaaagctgacgcagttgaaaaaagagaaagccgccatgatgcatgaatttgggctgctgggcactcgcaagagtatggcgag

SEQ ID NO: 6197 - DNA, 561 bp, Triticum aestivum
  Clone ID: PAT_TA_6197
gagggaggaagaagaaggcgcgaggagagggagatggataaggcgggccccctctgtcagctgctcaagccgggccacgccaccaccacgtcacttaggtggaagtgtcaactaggccgtacgttttccttaggtgaaagcgtattccggcattgcttcaggtcagagtatgttttcttttcagctcaggggcctgaatgcgttttccggttctgaaagtgtattgtctgtaatacgtttctgtttttcagctcaggggcctgtttgtggagaaatctttatagattagtccctgaacttcaacccctcatatctttttaaccacaactccaaatgaggtgaatccaaagcccacttcttcgtttcgtcgagcccgttctgttggtttcattttcactatggtttgacactgtgaaaatgacctttttttcccttgcacgtaaacagccctccgagagagaactgtttccggcaagtctttccgcggcttcaccgcgcttccccccgttgccttcttcatccccaggcaagccacaatacccacttgcatgataatcatgc

SEQ ID NO: 6198 - DNA, 760 bp, Triticum aestivum
  Clone ID: PAT_TA_6198
ccgcagaggccttaccgatgatgcagtcaaggggcattcttgttctggaagtacttgctactataagcagattggtgatgcttatatctgtgagaagactggtcgtgtacatgtctgcgatgatgcctgtcgtgaatttgtcttggaccaagctagcgggttacttgtctgtacgatatctgggcactgttttgagcgatttttatgtcctgatgacgagtgggacacttgtgatgctgatcagcagcaaggtggcgtgactgatgaagcagagccattcatgggatctggacgatttgcacgagcttatcagttgggttacagctgtgccgacgagaaggaacttgagcacgctttgcggttctgctgatattctcccggggatttgatccttcagaccttcactccttgctcgctacacgagagcaagtttttggttggcaagggaaataagctgcaggaagctctatactatacgctttacttgatctcgacctccggggatgtgcctatgaatgcaaaatcagcagaaatgctggtatgcttttcgatcagtcgagggagctaatatgctgttgtgtagtttcctaatttatgagcgatgtatcctaagtaataaaataaatgcttgaccacttgtccacttgtaatccccacaacagtgcctatttgtggcactgtaacctattcactgaagtggtcgagcgggcatgaggttgctgtttttttatttagcatacaaatcagcaagtttttcacc

SEQ ID NO: 6199 - DNA, 577 bp, Triticum aestivum
  Clone ID: PAT_TA_6199
cagaccgagatgttctccgactccgtcatacggtctgcgctcaaccaactcccttacgctatgcactgccgtaggacaaatgggcaagatttgatccgtgaactcatccgtgaacaccgtcttcttcttcgcggagctggcgctgctgtagtatggtctggtgcagtccaagccgtagattttttaatactctgaatcccagcataccaccccagcatactgcgtaccctgaatcatggttaattgctggtgtttatgcttgtttgggtctggtcaactgagaactctgaaaacctatcacaccgcttctgctcggcatcgtcgataaactgcaacacgtatattttcagcatctgaaaagccatctatttttcttcaacgctgtatatatagatcagcgcaaatgtcgtatgatacaaagtccagagtttgctccagattcagcatacagaaaacaccatacagagctgaatgtcctacctgttcaaaattaaaaaagatatcaggatcacaaacaaatacatgtctagctagattcttctacttgttgcctgattaatgcttctacttgtactga

SEQ ID NO: 6200 - DNA, 553 bp, Triticum aestivum
  Clone ID: PAT_TA_6200
gagggcttgcggcccagaccttgttgttgaccaaaggagtttgaaactgaaattttgaggcttaagcgtctcttggctgagaagagtgacacaaatgatcatacagctctagtgtctcctgagacaataaatgaagtcatacagaagcaaactccagtttcatctgcaaggacaccagcgtcaaacagaacgaatacagtccagtccagtgtgaaagccattgcccaccatggtagctttcaggatgaagctagcgaggactgctgtagaaggggtgtttgcagctcagggagtgggacagatgaaagttcccgttcttgtgtgtatcatatgctggttgaatctttagttggcatgaagttttcactgaaggatgaaacagaaggactctcactttcaatccatcatgaagctactggttatgatttcagccttacatggttggagcaagcggatggtggtgaatgggcctacaaatactcctcgctgggcaccctggaggagatggctttgaagtggatgaaagtgcaggacatacggttcagcatggaca

SEQ ID NO: 6201 - DNA, 1367 bp, Triticum aestivum
  Clone ID: PAT_TA_6201
agccacttcacgactctgtagttgaacttgaacatcaggccaaatcccatgatcccagcaaaatgatcactttaggtgtgccaacgatcgtgcaggcagtcatcctaatagttcttgctgtgctgatctgttggcgcctgagaaaggcaaagcaagatgatgagtgggagatcaagtgtgggctcgcggctttcacatacaaggatctggtgactgccactgaaggcttcagcgacaggatgctccttgggaaaggaggctttggaagagtgtacaaaggggtgctccctaccaccacacagcatgtggccatcaagcgggtatcgccagaatcgaagcaggggaagaaggagttcatggcggagatcgccatccttggccatgtccggcaccgaaacctggtccaactgctaggctattgcaggtacaagcaggagctgctcttggtctatgattacatggccaatggcagccttgataggtacttgtatgacaagactacgccgaccctggattgggctcagaggcttcgcatcatcaaaggcgtagcttccggcctctactacctgcacgaggattgggagcaagtcatcatccatcgggacatcaaggcgagcaacgttctcctcgacgacgacatgaatgggaggcttggtgactttggcctcgcaaggctgcatgaccatggagtcgatgcccacaccacacttgtagcaggcacctggggatacattgcccctgagctggcccggcttggcaaggcgaccaaggcgactgacgtgtttgcattcggagtgtttaccatagaggtggtctgcgggagaaaaccaatcggcccggccaacaccagtggcggccttcttgcgctggcggattgggtacgtggcacatggcagggtggctcgatcgtcgatgctgtggaccctgagctgaaagattacgacagggccgaggttgagcttgtgctgaagcttggattgctgtgctcccattcgctgcccaggtcgcggccatgtatgcgtctagtcatgctgtacttggaaggaggtgcaagacttccaaacttccacccagcttctctggtcgctgatggacatgaggatgaagagactgatcataaggcgttatctacatctgcagctacgactgtgaccattctttctggaaggtgaaatttctgctggggtggtcataccatcatacaagcttatcaccaatgtttatttgggtctctgcaatttctcacccaatgtttatttggatctctgcaatttctcgtgttgtagtccgtgatgtgtgcacaagtttgccaaatttaacattttgttggggaaaaccagaattacctcgaaaaaaaaaaaaaaaaa

SEQ ID NO: 6202 - DNA, 1260 bp, Triticum aestivum
  unsure (1)..(1260): unsure at all n locations
  Clone ID: PAT_TA_6202
ttaaaacctccctaaaaaaaagataccccacgcgtccggtcaaaataaaacacaagcacagtacccatcccctccgctcccccctcccccctccgcctccccgcgctcgaatcctctgcggttaacaatggacgcgcagtacaaccccaggacggtggaggaggtcttccgggactacaagggccgccgcaacggcctcgcccgcgcgctcaccaccgatgtggaggaattcttccggcaatgcgacccggaaaaagaaaatttgtgcctttatgggtttcccaatgagcattgggaagtaaacttacctgctgaagaagtgccacctgagctcccagagccagcattgggcatcaactttgcacgagatggaatgcaggaaaaagattggctatccatggttgcagtacacagcgacgcatggttactatctgttgcattctactttggtgctcgattcggatttgataaaagtgacaggaagcgcctgtttggtatgattaatgagcttcccacgatttttgatgttgttagtgggaagagtaaaaccaaggctccgaccaacaataaccacagcaatagcaaatccaagtccaacaataaaatgaaaacctcggagcctcgggcgaagcagcccaagccccagctgaaggaggaagatcacgaggacgaagccccggatgcgggcgaggatggtggaggcgccgccggtggtggtggtggcggggaagagcacggcgatacgctgtgcggcgcgtgtggggacaactacgggcaggacgagttctggatcggctgcgacatgtgcgagaagtggttccacggcaagtgtgtcaagatcacgccggccaaggcggagcacatcaagcagtacaagtgcccgtcgtgcatgggcgccaacggcggcggcagcggcagcaacaagcgggcgcgcccgtcctcctaaggccgccgccgtcatccggcgaggggcgaccgaccggcctcgccgcgtagtaggactgagctcttattgcagtcgctgtaacaaaagtttccaggcgtcaaggcgcgtgcccttaggagggcttgtaaaatgtaactttattaatctggcttcgagtagaggattcttcttattttagctgggacgaatgtggatttgatatctgttgtattatactattattaaattcatagttcgacgatgattgtttaaaaaaaaaaaacgaaaaaactcgagggggggcccggtacccanttcgccctctagtggctcta

SEQ ID NO: 6203 - DNA, 1249 bp, Triticum aestivum
  Clone ID: PAT_TA_6203
aacatgccaaacaaatagagactgattttgcagctcctcgagtgaagcctgagtttggtactcaatcagcaccaatttttgctgataatgtgcttgatccatctgtgaggctgcgcaagttgaattctccaatgttctcgagcccactacagtcaagtagaacaaattattcctacaaactcccgacaccagctgatgataaaatctgcacttcagcaggcaccaacagatcacctcattcagataaaccagagagttcacatgtggcagcaaatttgtggcattcctctccgctcgtgaaagattatatgccgagctccttgtatagcgggcctgttaagatgccatcaagtactgagaggagatcatcaccattagtttattcctactccacttcagattccaagaaaatgaagagggaatctttttctggcccaattcctagtaaagcagggttaagcaaacccttgttttcagctgctggtcacagagcatcagtaaattatcctcctcgtgttatgtcaacaaaatcacacggaccaggttctcttccatctgtggctccaaaagtccctaggataacttcactgccaacaacatcccccagaattagtgagcttcatgagctgcctaggcctcctgcacctttagacactctccggcctggtttggttccggcggcgggtcctttggtatcagggcggcaacttcctaacgtaccaacccgtgcctttccccaccgtcaaatacagcatcaccgcttccacggccacttgctgccatgactcgcagctattctataccttcaaacagccaaagaacacctattattactgtgaataagttgttggagtctaggcatagcagagagagcagcgaagtttcctcgcccccactaacacctatatctttggcagatgtctcccgcagatcaatagcagaaacaactatagacaccagaaggatgaaggaaacctcgtgagcactcacacatccaaacctgtctataattgtaggcaattttgtacgtatgtagttttcattcttggttttcttcaatagtctttggtgtattttgtgaaacaaaaaggtgaaataaagatagcaatattttaccttcattcacatatgaaagacttcctatccttggcttatttatttggcctacttattgtattatttttactccatggcttgcatatctgaagtatttattggatttaaaaaaaaaaaaaaaaaaaaaaaaact

SEQ ID NO: 6204 - DNA, 494 bp, Triticum aestivum
  Clone ID: PAT_TA_6204
cacgaggcacaatgtctcgctcattatctcaaaaaatatactccgacgtctttgcgcgctggccaaagcaggctcttcgtcccgatcaccaactccaagatgtcctaggcaaggccgttaccgagcgattccaaaactacaagccatcaatggagcgcgaagaacttctcaaggccagggcgctgcagttcctggcccaggaccgatacaacgaccgattcaagcttaagggccgattgctagaaccaaaaagtcaacccacatactttgcggatctaataagggaaattgacgaggcgcccaacagatcatggttggagaggttgggcaagaggttgtcaggcatgattcgattccagtaaagatgatgatgaaacgattaatgccggataagaatacggaaggatattcagctggcatctgacctgtatatgtaattgtacttgtacattgtatcaaaaagcgattcccccttaaaaaaaaaaaaaaaaaaa

SEQ ID NO: 6205 - DNA, 992 bp, Triticum aestivum
  unsure (1)..(992): unsure at all n locations
  Clone ID: PAT_TA_6205
gctttgcccgctggcccccctcctctcgagtcgcccccgccccctctccttcctctggccgttggcgccccggtggacggggtggggcctggggggggcggggttccttgggtcgatgggcctgccctagggcccgtacgtgatcgtcgtgatgccttctggtgggtcttctcggccgcacctgaccgcccgaggctcgaaacccctaaacgcgcaacccttgaagacgaagccgatgagaaagaggtgaccgtctgcaatcatgaaatacagattcatgaagatctgggccatgtatgccgtgtctgcggtatgattgtgagagaagggctgacacaatcattgattatcagtggagaaaggcatcaaggtcgagatcatatttctctgaaaagcgttcaaaggattctgatgagattgtcactgctgatgttagagtccctgaagaactcaatgctttaggcattgctattcatccaagacatgaaaagcaaatgagaccacatcagttggcaggtttccactttctggtgaagaatttagtatctgacaaaccaggaggttacattctagctcatgcccctggttcggggtaaacatttatgctgattagttttattcagagcttcttggcaaagtatccctctggaaggtctcctcgttgtactccctaaaggcatattaggtacatggaaacgggaatttcaacggtgacaagtggaggacatacaactgtatgacttgtgctctgtcaaggctgtgaccagagcagagcagttggaaatcctcaacccttggcaagccaacctgagcatcctattcgttggatacaaccagttctcttggatcattaacactgatggcggtggcaccgtcgcaaacacaggaccacacatgttgctgacgcctgagaaaaacaaacaatcacactgagaaaataacagctgatacatcaaaanagctggggcnccanaaangtacccanaaatttt

SEQ ID NO: 6206 - DNA, 595 bp, Triticum aestivum
  Clone ID: PAT_TA_6206
cgaggaccgcccgtcctcctcgagccccgccccgcgtccctcctcctcctccctgctcgctcacatcgcgggcggcgccacctcctcgctaggcccatctctgcccaccctctcttcctcgcgattcggagcagaaggacggatgcggccacccaggcgtcggcgccggcgccggcgcgggattatagaggagaggggacatcgatggccaggcaaggaaggacgagggggaatctggtggaggtgatgagggagctgctaaggtggggcaggagaggacggctcgccgacaagctcgagttggaggcggtgagatcttttccttcatgccttcccacctgctgagctcgttggtcctcctccctcccctgtgcggccgtcttcgtccttcatcgctcgatttacgatcaacccctggtacgcctccatccttcgtctcttgctccgtggcccggatgttgagagagggcgagaggcggtgtcgcggtgatatgcaggggtgagggagatggaggcggtgacccgcagctcctattgaaggggcggagaagagggggtactcgtgtgagcggagaagagggggtactcgtgtgga

SEQ ID NO: 6207 - DNA, 569 bp, Triticum aestivum
  Clone ID: PAT_TA_6207
gagggactagtctcgagtttttttcttttttttttgtttactgaacagaatctcattatgtattcccgcacattatgcattaccgcgtcttcatgcagacgctctaagtacaggtgtccagctgacactcatcatcgaccaagccctcagcttagttgggaaggttggcaggggcataagactgatcaggcttaacaacctttcctccctggacctgcttatcggtataagcaggccagacaatctgtccctcggaagaaacaacagacaaagtggtgaatccatttccggggccgaaccggccgcgccagccacaggtgacggtgtagtcgccgcacctgacggggccgccgttgcgctgagaggccttgctgcccttgacgacgaacttgcaggcggtggcagcgcccttgtgggtgtcgatcttgaagttccaggtgcaggagctgtcgtccttggcacagctgcgctgcatgctctcgatggtccactggggagcggcggccatcatgttgacggcttgctcggtgggggcggcggagacgctggtggctgagaggacagcggcg

SEQ ID NO: 6208 - DNA, 999 bp, Triticum aestivum
  Clone ID: PAT_TA_6208
gagggcggcaatggggcggaggaggaggttgggcctgctgctagcgacggggatgagcagctggacggcggggggtgcctggcggacgtgtagtgatgcggagcatcctatggacatcaccatgtcaagagtccgttcggcgagtgacacgggcggcatctacttcacatacccaaaggtgaatcatctcctttacacgtgttcacttgacaccttcgaggatggtatactacttgacactccactcatgtgtatgcataggtattgtcggaacactacggacgacgaggaggagtgcaagcgtcaaggaacaactacaccatccgtgagggaagcctggaagcggagacgaaataaacggagctgctggaagctacagtggccggatatctgggccagaggccggacatccggcgcatgcgccgaagagcttcagtagccggacatccggccgacccccggacatccggcgcctgtcaacaggccggacatccggtatcgccccggaaatccagacaacggctatccatagaagagcaaaacggcctgttctaggtcggacatccggccagtgccccggacatccggtgtctcacgaacggccggacatccggcccccagcccggacatccggcgcctacctgcgcgtagagttgggccagaggcccatgtatctctttcccacttaccccttcgtggcttagactatatatactacccctcctcctagttagggttagcgttggtttagctcatttgagagatagagctatgctcatccatatcggatctcctccgtgcgagagaccgtggcctcttcggggaagatccctttggattcaagccccctttctaagggaaggtccccccgtggattcaagacctcctcacggagaagaaccggctacctatgtatcgtccctagttgattgtggatcgtgtatcttactttattactcgaggatctagcacatgtgtgactaaaaaaaaaaaaaaaaa

SEQ ID NO: 6209 - DNA, 931 bp, Triticum aestivum
  unsure (1)..(931): unsure at all n locations
  Clone ID: PAT_TA_6209
gaggggctagcggtgccgcttctgagtgtgtcctcgtctcactcccttggcaccttcggccgatgatccttctgctttcctttttactaaatagacaagttggatccagtgtgtctccatgtgtccatgtgtgttttgggtgaatacgcaatgaaacgcgggaaagtggcctctatttgacattgtcgtgctgaaagattcattcacatgtctgtaactttgtatcttggttctgtttctattgttagttccaaaagatatatccacttcttggcgacttttaactctgtaacatgtctattcttagtgtagatatactttttattctagctgcattgctgtgagcaggcagatttcttatggggaatggcgatgattgcttgagctttcattttgatcccctttgtatcccaaacatagttttcgcacagtcgctgtatgtactggttccggatactccatgtagcggtttttgtttgtttttattcatataagtactagattctcgtacaaaaaaaaaaaaaaaaacactatatgtttactgatatgttgggcccaaataaaatgtcttcgtgcttcacttttggctactttgattctaatgcacatatgtgcattcctttttttgtcattcactttgttgttcatttgattgtccatttcttcatttttaatgacaaagcatgtttttcttttcttttcgaattagcttaaaatcacaatcaaagagttaactttttacttaatttcataaacaactgtctatatggcttaagaaaggtgaagagcaaggcaatcaggattanctatgggtggttcctgatccagatccttacaaggttactaaagcanttggtttaacgancgaggcagataaattataatactncaatatactccanagatattgcgnangtcaatgaatgcactt

SEQ ID NO: 6210 - DNA, 898 bp, Triticum aestivum
  unsure (1)..(898): unsure at all n locations
  Clone ID: PAT_TA_6210
gtcggcccggggagtccgcgttgccgtgggtgcgggttgtcttgcagatggccggcttgcctatcggatagggccgcctgatttggttagctggcagtgcaacggatgcttagcctacctgacggattggggttcctcccttcgtggtgccactgagcaaggaatgcttagagaacattcatggttggtgtaaaacccatcatggtgccagtggactgacagatcaagtactgcagagtgacatttctgagtgtgatgctcagaaacaggtgctagactttgttaggaggtatattggttcggcgactccattgattgctgggaattctatctatacagatttactatttttgaaggagtacatgccccggctccccggcggattccctcctggcaccgtggatgggggcagcccaccggccccgtggacgacctcggtcccagcggcaagggagctgccgccctgacagggggaacatcttcaaatcgcggcaatctaagcattagcctgttgggattcattagctctcttgattgttgggatgaaaacgttcccatggtgtatgatccttccatagatttgatgatgcttaaatggccaagtgcctttggggtaacgccaagattgtagtcacatagggcctgtgtggttggtgaccaactttgccatggcttgccacttgttttgtcacactggcaaaagtgctccctatcccactttactagttttagggaaatcactgtttcacagctaggagatcccctataattttagtccctaaaaaaattaaacacatttttaatacaaatcatttcacacctaggagataccctaaagttttagtccctaaaaaatttaaacacatttttaatacaaataattccaacccctattttn

SEQ ID NO: 6211 - DNA, 503 bp, Triticum aestivum
  Clone ID: PAT_TA_6211
ataactttgtaatttttaatctcctcctttcgttttctatcgttttagtaatattgaatctcctccgttcgttttctatcattttaataatataatatatttgattttggtagtaccgttgaatttggttgctgctgttcatttatgtatgtgaaggaattggataatgtgctctttttttgtttgcaaaatgaaggacgttgcatccaggtagtgggaatagttagtccttgctatcaatagtagtagcattattcactgtggagtgtgatggaatttgatgatcatctacttttgcctatcatctacttctgatgttttccctgaaagtgacacgtgatcttcctttgtttttctttagctgatagtatgataactgcttgcttggcagaagttatggttgtgatgtttcttagataaataaagaaactgagatttagttcgatttggagcgcctcttgttgtaccacagttccttctcttagagttgtatctgtactgca

SEQ ID NO: 6212 - DNA, 746 bp, Triticum aestivum
  Clone ID: PAT_TA_6212
gtccatcaatgataacagtgatacctgattgaagattaggtggtctacaatcctccagctctccaaaactatatctcaagcccatcaactccgaaaattaaagagacgggcgccacatgggcaattatgtatctatagctattatttttagaagaactacatctctacagtcattttcgctttaaggtcgccaccatgccgtctctctctctggccgcccttcacatcgtcttggtttgctggttgccactatgtctcctgccgtttcgcccgccgccatcgctggaagggttgtgtaggccgtcgcctatgccactactatgcagtgaccagtgagggccatggcatcgagacagaccaaaagggaaacaccaccggccacagcgccggtagaggcctccctgtctgcgccggtgactggataacatcgccgccgccactgtcgttgtctttgttgcttctcagcaggcatttgattaactcaaaggcaacaggaaggcacgacggtgatcaaggttatgtacgccgagtagtgtcttttgtctaccataccgtatgaaaatagatcaagatgagccaacttagtcacgtactatgtttctataaggggaacatatctggtctatatccgaatctatgaactattatatggatgatgtcgagttatgtctatatagtcatatgcttatataagctcaaatgtatcctttgtactgttcaaaaaaaaaaaaaaaaaaaaaaaaaaa

SEQ ID NO: 6213 - DNA, 452 bp, Triticum aestivum
  unsure (1)..(452): unsure at all n locations
  Clone ID: PAT_TA_6213
cccacgaacccccgcttcacgtcgcacactccccatccccgcctcgtcgcctcctacccccgcaccaccgccccgcctccttccccagcgccgcctcctaccctcgcgccgccatgacgcctccttgccccgcgccatctccactgggatccactccagcattctcctacgagcccgccaccatgatccatccatgggaaggaggggggtgaccacgctggatcaggccggctctaccgccaccgactgtcaccagaggtgcatcgggcacccatccgccccaagatccgccgaagatgccctggatccgttgacctcccccatcccccacctaagcctattctgagagcatgangtgggagagggatggcgctcggggccgcctccttggtcctcctcgtcgtcctctcccatggtggtggcatggcgtggctctctagtggccaactcca

SEQ ID NO: 6214 - DNA, 954 bp, Triticum aestivum
  Clone ID: PAT_TA_6214
ccgtcccgggatcctcccagatctgatctagccaaccatgcgcagcaaaccccccttcctcattttcagatccaccatccatcccttcgatccatcttcagtcaacgagcgccaacgctcaaatcccgcaggggccgatgccctctgcgcctcgatccatcctcacctgcaagatcagctccatccactccattcccgccacagatgagcatcacacatcccttttccttctcttgtcgtcctcgtctctcaactctctctcatctctctctcttatcttcaccaggagataaacaccaatcgaagatgcagcaccgccctgagctccgtccgtgacaccaagtccctttgccacgcctaccacctcctcttaatcctcatgcccctcccctttcttttccctgtatctctcacctcgcctccctgcaggaaccgtgcagcgccaccgcccatggaactccctccgccatggtcgccaggtaccatggtctccgctgcttccgcttcgatccggcaggaaacgagacccgaaggcttctcgcgcttggatccgaacgccaccgagctcccgcgccgacccctcctcatcctgccgctctccggattcctcagcgccgccatgcctgctgtttgcttcactgaaccggccgccaagtcccacatcgctgctgctctttttcccgttgagaataggaggacgccgcatcttccccgagtcattcgagcgagcgcgatgacctttccccgaccgaaccaagcaggtcggcccagcgcgcccctgccagcctctccctctccagcgaccgggccaaagcccaaggggtgagctgcttcccagcgcctctctgttggcccaaaaatagattcggcccaatgtattttttccttgtatgtgtttttagcaattaaacatgagactgcagttttgcaggaaaaaaaaaaaaaaaaaaaaaa

SEQ ID NO: 6215 - DNA, 1808 bp, Triticum aestivum
  Clone ID: PAT_TA_6215
ccgcgcgcccgactccaccctcatggctccccgccagtttctcgcctgtgctcgccgctcgtgagaaatttactcaaattccttttagaagctcacaaattgaattagtatcgggccttgatctgtgtggattcaggtgatggtgcaccgcttagaaattccggcatctccatgtcgacggtgttcatcgtcatcttgtaaagaaagttctcctctcccttattcatcgtcactgatttctcccctcggacgcccttttccccactcccactcgttgttcttctcttccccgcaatttcccgggccgacggcgacgggggcgggggcggggcgcataaagcaaagggcaactgcctactggccactggattagcgccgattaatttcctcttttgttggttcctctacttccgcgcgcaagatcgatctgaggcgcggcagctaatctcgtcggaaaatcgagggttcaactgaagccaatatgcccaacgtcaagtccgccggtggtgctggtgccagtgccatccctgccggcggcgacggcgaggtggaggccgggttcgccaagctgcagggtggggatctcgagtactacatgcagacctactccatcatgctgggccgcaacagcaagaaatccacggtggacgtggatctctccagccttggcggggggatgaacatctcgcgccaccacgcgcggatattctacgacttccagccgccgccgcttcgcgctcgacgtcatcggcaagaacggctgcctggttgagggtgtcctgcacctccctgggaaccctcctgtcaagcttgactcgcaggacctccttcagattggagacaagaagttttatttcctcttgcccacgaggtctatctttgcctcgttcgctgctcggcaagcccctgttattcctccacagatcccgccgccagcttatgcgcggccagggcaccctcgtgtgtccgatttccatgaccgcttctctgaaggtgattatggccgggacagtgatgacattgggaatggtgttggggaaggtggaatgaagggcaagctgaagagaaccaagaagtctcccggagatttggacatctatggtgggcacagaatcaatgttgaagcaataggaacattgggtgaagacaacagatcagaaataagatcaaggggtgacaaggatgtggacaaccagcaccttcaaacggaagagaaggaagtcgtgtcatctgttgcgactgtgttatctgacctctgtggccccggagaatggatgcctatgaaaacactccatacagagcttatggaccagtttggcaacgtgtggcaccacagcagggtgcggaaatacctgacggcggacgactggtcgccaattgaagccaaggggaggccgtggtacgggctgctggggctgctcaggaagtacccagagcacttcgtcatcaacacgaagtccaagggcagggcgatctcggagttcgtctcgctggtttccttgctctcctgaccagcgaggtgaggctgtctccaaagctttgcttgggttttgttctgcatccttgccgtcgccgtcagtcggtcggtttgttcgtgtctgtaaggtcgagtggcgtcctgatttgcccctgcagttttgcatcagttaaatgaactttgctgtaatgtactgtacacctggctggtttcttctgtgtttttacctatagcaatgtagtgtcgaaaatgttatgcggaaacaggacttataagtacgtagttttcagttcgtgtctcttcaggtttaaaaaaaaaaaaaaaaaaaaaa

SEQ ID NO: 6216 - DNA, 500 bp, Triticum aestivum
  Clone ID: PAT_TA_6216
acgaggatgccgcatccctcttcctcttcctccctcgtgctcgcactccccttcctccctcttcatctgctttttcctccagggatcccactccggcaaaagatcgccgccctggtggtcagtgcctcctcgtcggcgtcggcgtcgtttagggttccttcaaggtcggggtcgtctagggttccatcaagctccgtcaagttcgtcatcttcaagaagtattccatcggtacagcagagagaggacaaggggctcatcaaggcacgcggtgctaggaacttccattcgacggccccactgcttattcgacatcctatttcaaaacagtcgtggtgagctcttggtctgagctcatggtccatcgattttttttctatgtatatatctgtgcactgtaggccagtgttcgttttttaagtgatagtaggtgatgtgactatagtttttgatataggacgttaacctagtaatacaagatgaaacttgcaagatgtacaca

SEQ ID NO: 6217 - DNA, 493 bp, Triticum aestivum
  unsure (1)..(493): unsure at all n locations
  Clone ID: PAT_TA_6217
acgccgatatcgattgagtccattgtcagccttgcgcgccgtcccacgctccattttacaaaccgagtttacaagccgacgaagctcaattcagttcacaatgcctactcccgagtccgagcaattcaaggcccagaagcctactgtcgctcccacctttaacggcgtcgactacgatgataccaaggccttcaaggctgccgaggatgccctcatccgggaacaatgggtcggtgccatgatgacccgacttgtnggtgaggagctgaacaagtgctacgttcgtgagggtgtcaaccacctcgagaactgcggccacctccgagagcgatatcttcaattgctcaagtcaaacaagatcaagggcactaagttcttgcaacaaaactacatcgatcagaaggaacatgatcttgacctggcggccaaggtccacacaagcgacaagatcgccaagatgaaccgtgatcgattctcttcgtaagggatatga

SEQ ID NO: 6218 - DNA, 911 bp, Triticum aestivum
  Clone ID: PAT_TA_6218
agaggaaggagaatgcagtgtccgctctctacgagatatgtcgccgtggtggctcagcattggttcggagagtagcaaagattccggggttgaatacagtaatacagaacatcatgctcactggtacaaagcgcgccaagaagaaagcaagcttgatcgtcaagatgtgccaaagaagccaaatgccgtcagcaatgtcgctaggcactagcttgagggtggttgatcattctttggtaggtaacagctcattgaggcgtgctgcgagctttggcagtggagagttgtcgaatcccgtttcgatatcagtgcacgtgccctaggtaatcgccttccaattgggcagccccatatatgtctggccagttttgtccaaaagttctttcattgcatgctcaaaatgaaggtatacaacatttaaatctaaaggaactaatacttgcaatatactatcacatgtgcctgtgtctgtgtgtgggaaatgtggataactgaagtatataatcaatgtacatgtagaacttcagcttggtgtttcgtatgaagcttggaaggtgttctgtttttgttccatttttcaaaagactatgctacttgttgtaaactagccggataataatttgtagcttgtattgaggcaacaatggaagggattgtaatgtactccctgcgtaaagaaatataagagcgtttagatcactactttcgtgatctaaacactcttatatttgtttacagagcgagtactacgtaagttgtagtagttacagagacttgcacattggcaaggaaaaataacttgaatgtcaagtatagctttgtagaagaaatctgggtcgaactttttactccaaaaggagctttggaagattaggcatctttattcgctgtcatcaacctattattagaag

SEQ ID NO: 6219 - DNA, 1193 bp, Triticum aestivum
  Clone ID: PAT_TA_6219
gagggcgaagcctatacagttagtagtgcgcacgtggagcttggtgttccagtgttggactctcgccatgacggccgccgcccatatccacgatggctgcggccaacaccaactgcatcggcatgcggagtccacgccgcgcgacctcgagcgcgcacggcaagcaagacccctgctcggtgtcagcacccgctgaaacgtggggggaacccaaccttgacccgtacggatgtacaaaaccgaaaaaggtgcgaggggttcaacgtacgtagttcgtgccagcaaattttgagcagatggtggcaccggcggcggaggcggaggcggaggccggccgcaagaccttgccggatgagtgcaagaccctgtggcagatcgctgggccggtgatccttaccggcgtcttccagttcctcatcggcttcgtcaccgtcgccttcgtcggccacatcggcaaggtcgagctcgccgccgtctccattgtcatcggcgtcatcgaaggcctcggcttcgggctccttctcggcatggggagcgccctggagacgctgtgcgggcaggcggtgggggccgggcagctccacacgctgggcgtctacatgcagcggtcctggatcatctgcctcgccacggccgtcgccctgctcctggtctacatgttcactgaccccatcctccgcctgctccggcagtccccggagatctcggcggtggcggggcggtacgcgcgctggtgcgtgccgcagctcttcgcctacgccgtcaacttccccatgcagaagttctaccaggcgcagagccgggtgtgggtcatgacggtcatctccggcgccgccgtcggcgtgcacgcgctgctcaactgggtcgtcgtggccaagctcggccgcggcctcctgggcgccgccatggtcggcaacgcctcctggtggctcatcaacgcggtgcagttcgtgtacgttgtcggcgggtccttcccggaggcgtggacggggttctcgcgcaaggcgttcgccagcctcggcggcttcgtcaggctctccctcgcgtccgcagttatgctctgcttagagatgtggtactacacggcagtaatcattctggtgggctgcttgaagaacccagagattcaagtcggggccgtctccatatgcacgaactacaacatctggacactgatggtatccgtcggcttc

SEQ ID NO: 6220 - DNA, 839 bp, Triticum aestivum
  Clone ID: PAT_TA_6220
gcggccgccttgcctcctaccaccgcacatggcgttgctgaggcgccgggccctccgccgccgcctctgcctgccgaccctctttccggggcccacggagttattgtctcgcctgtcccgccgccggagtctccccgcctccaaccatttatcgaaaccgacgaaattattatctcaaataaatcgaggaatgggaggccccgccagctgctttcgatgggcccaaatgagtggctcgaagtgactgttggtgttgtcggcaaacgtggggagatgcattcattgaatccaagcatcacagtcaaagaaagtggtgaaattttgtctcttgaagagaaatttcaaggtggaactggaatcaacttgacaccacctccagcaacaattatgagtgaggatgcgctcgagaagtgcaaaaattgtatcgagatgatggcgaacacattgggtttggatggcttttcacgcatcgacgcatttgttaatgtgcgtagcggagaggtgctgttgatagaggtcaacaccgttcctgggatgactccgtccccagttctgattccccaggcactcacggaggaaccgcccatctacccccacaagtttttcagaacgctccttgacctggcgtttgcaagggcagactagctagatatactacccagtagtgcccccaaggtctcttgccagatgaactcgtccctttcagtgcaaataaggtcgtttttatcaccatttatcgatctgtatcatgcaactgccaatgtatgcaagtgactgttatgtcggtgtgaaaaaccgtgtgaaaagtttgtgtcatcgcgcgaaaaaaaaaaaaaaaa

SEQ ID NO: 6221 - DNA, 573 bp, Triticum aestivum
  unsure (1)..(573): unsure at all n locations
  Clone ID: PAT_TA_6221
acgaggcccgccaaggccctcgccgccgacctcctcgtccactacggccactcctgcctcgtccccgctcacatcctcactcctccccgtgctctacgtcttcgtcgagatccgcgtcgacgcgctccgcctcgccgccgccgtccggggcgccttcccggaccctgacgccgcgccccgcctcgctctcgccggcaccgtgcagttcatcgccgcggtgcacgcggcgcgcgagatgctcacgcgggacggctaccgcgacatcgttgtgccgcaggccaagccgctctctgccggcgagatcctcgggtgtacggcgcctacgctgaagaaggcggagggggtgggcgtggtggtgtncgtcgccgatggcaggttccacctcgaggccttcatgattgccaaccctgcggtgaaggcctaccggttcgatccctttcttggtgtgcttgtgctggaggagtatgaccatgttgggatgaagcaggcgaggaaggaggcggtgctggcggcgaggaaggccaagagctggggggttgtgctcggcacgctgggccgccaggggagcttgaa

SEQ ID NO: 6222 - DNA, 557 bp, Triticum aestivum
  Clone ID: PAT_TA_6222
gggtgcgcggccgcctgcccaagcctgccacctccacgccccgttccgacctgcgaaacttccaattcctcctcctcctcctcggcccctccgcgcccgctcgcgcatcgacggaagcgcccgagctccgcaggccacagagatctcgatcgacgcgcggcccccagatcccgatcccccggatcccccgccgcggccgatgcgatccgcgccggccccgcgccgccggactcgacagcggaccggctgactccgcccccgcgccgcgccggaatttcgcccgcccgaatttcgatgggatccttccgactcgccgcgctcgcggcgctcctcctggccttcgccctgctcccggaccccgcggcggctagggttttgcagggcaagaagcccggctccggcgaggaagcgcctgtacctaacgtggctacaggtggatctgagaagggcgccgcctcgaaagaaccggggcaaccatcgactccggcggggaatcctgagactggtaaacagcaccagaaaacaccgccggcggaaacaacgccaacaccgccacc

SEQ ID NO: 6223 - DNA, 330 bp, Triticum aestivum
  Clone ID: PAT_TA_6223
ctcattgctcacatgaaacagttgatagccacatcgcaaaggtcatatttcaggatgtcatttaggaagaaccctctttctttctttttttgacatgaggaagaaccctcttttgtccatgttagaattattaagcacgatttgtgctgggttccggcatgttacatgtctgtaaatcttttttcgaaccttcaaggactgcacatgaatatatagatagaaaggtaacaaggttccaaacgacatggtacatgtgtaagttgtacagaagtttgctgctataaatatactcccttcgttcctaaaaaaaaaaaaaaaaaaaaaaaaaaa

SEQ ID NO: 6224 - DNA, 578 bp, Triticum aestivum
  Clone ID: PAT_TA_6224
ggcttgaactgtctagcggactccagatagagcaagggtgttgccaatggcggaagggtcctattgcatgcaggtttcccatacaaggaacgagatccttcaaggaagaccaactcatataaatgaaattaaacaaaattttgtgtgacttagcttttcgtggccactcagatggctgtcacggctgcagacggcaccagaggggggctgatcgacatcaccttctccttctcctctcctctcgatgcgtcggcttcaaaccggattctcacagcttgcgcccccacctggcgcgccaaagatgtcgggggaaacgacacctatgggatcacaaagaatcccttctgctacggttggcgggcacggggttgcgagaagagcggggttagaagatcgacacggggggtgtatccaggttcgggccacaagcgatgcataataccctgctcctgctggtttgcgtttatctggtgttcttggactagctacaaagtgtgcagggtccaaaaaatccgaatccttccttagtacgcctcgggcctccttttataggcaaaggggtcaccacagtggcacac

SEQ ID NO: 6225 - DNA, 988 bp, Triticum aestivum
  unsure (1)..(988): unsure at all n locations
  Clone ID: PAT_TA_6225
cgcactagcagcgccctctgcacacccatctcacctccccccccccctctccctcccctctccctagctaccatacacacacagggagcgtccatggcggggacgacccggctggaggccggcggcagcgacggcgagtacacgcaggacggcaccacagacctccacggcaaccccatcctccgctcaaagcgaggaggctggagagcctgcgccttccgtcgtagtgtacgaggtgttcgagcggatggcctactacggcatctcgtccaacctggtgctgtacctgacgacggagctgcaccagggcacggtgctctccggccaacaacgtcaccaactgggtcggcacaatctggatgacgcccgtcatcggcgcctacatcgccgacgcccacctcggccgctaccgcaccttcatggtcgcctccatcatatacctcctcggaatgatcctgctgaccatggccgtgtcgctgccgtcgctgaagccggcgaaatgcggcctcggcactgctgaccccaactgcgaccacaaggccacaagcgtgcagctgggcgtcttcttcctggccctctacatccccgccgtcggcacgggcggcacccagccaaacgccgccactctcggcgccccccggggcgacgaccccctcccgcgggggcgcaagccgaggctccccttctgccactgggtcggtgttcagccgcggctgccccccgcccctcgccaacaccgtcctcgtctacatccaggacaggatcggctgggaccgtcggctacgcgctccccancgccggcctcgccgtctcatcgccgtctcancgccgggacgcccttctaacgccacaaagcaactccgaaagntccttcgccaagatggcggctcatcgtcgctgccgtncgcaagtgcgcgtcccgcgccgttggaccgcgcgactgaagaactcgattcaacaatacangaaaagaaactcgccgttccnn

SEQ ID NO: 6226 - DNA, 759 bp, Triticum aestivum
  Clone ID: PAT_TA_6226
gagtacaaaaaggcggaggagcacaagaagaaggacggggagcacaagaaggacggcgagcacaaggagggcatgatggagaagatcaaggacaagatcagcggcgacggccacggcgacggcaagaaggacggcgaccacaaggagaagaaggacaagaagcacaagaaggacaagaagcacggcgagggccacaacgacgacgaccaccacaacaccatcatcgcatcccattagcattctaccattttcctcggagagaagtagccagaaacagcagcgccatggccggcatcatgcacaagatcgaggagaagctccacatgggtggcggcagcgacgagcacaagaaggacggcgagcacaagaaggacggggagcacaaggagggcatgatggagaagatcaaggacaagatcagcggcgacggccacggcgacggcaagaaggacggcgaccacaaggagaagaaggacaagaagaagaaggacaagaagcacggcgagggccacaaggacgacgacggccacggcagcagcagcagcgacagcgacagcgactgagccagctccggcccgcgctccggcagcgtgcaggcgagatcgatgatgaacacttgggagaagtgtgacagacatatatgttgcagggtttggagcgtgtggtagcatatgtatgtaatgcgtgacatgcctcatggatcttgtgatgtataataattacccggctgcactgcactgcacggtgccttgtaataat

SEQ ID NO: 6227 - DNA, 639 bp, Triticum aestivum
  unsure (1)..(639): unsure at all n locations
  Clone ID: PAT_TA_6227
ggccgctcgaggccnggccggggcccgggacccaccacaacaccatcatcgcatcccattagcatcgccattttccttggagagaagtagccagaaacagcagcgccatggccggcatcatgcacaagatcgaggagaagctccacatgggcggcggcagcgacgagcacaagaaggacgaggagcacaagaaggcggaggagcacaagaagaaggacggggagcacaagaaggacggcgagcacaaggagggcatgatggagaagatcaaggacaagatcagcggcgacggcaagaaggacggcgaccacaaggagaagaaggacaagaagaagaagaaggacaagaagcacggcgagggccacaaggacgacgacggccacggcagcagcagcagcgacagcgacagcgactgagccagctccggcccgcgctccggcagcgtgcagtgtaggcgagatcgatgatgaacacttgggagaagtgtgacagacatatatgttgcagggtttggagcgtgtggtagcatatgtatgtaatgcgtgacatgcctcatggatcttgtgatgtataataattagccggccgcactgcactgaacggtgcttgtaataataacgttaatcatgttggtattga

SEQ ID NO: 6228 - DNA, 682 bp, Triticum aestivum
  Clone ID: PAT_TA_6228
gccggccggttccggatcccattagcatcgccagtttccttgccagagaagtagccagaaacagcagcgccatggccggcatcatgcacaagatcgaggagaagctccacatgggcggcggcagcgacgagcacaagaaggacggggagcacaagaagaaggacggggagcacaagaaggacggcgagcacaagaaggacggggagcacaaggagggcatgatggagaagatcaaggacaagatcagcggcgacggccacggcgacggcaagaaggacggcgagcacaaggagaagaaggacaagaagaagaagaaggacaagaagcacggcgagggccacaaggacgacgacggccacggcagcagcagcagcgacagcgacagcgactgagccagctccggccgcgtgcagtgcaggggagatgaacgcgtgggttaatttggagcgtgtggtagcatatgtatgtaatgcttgacatgtctcatggatcttgtaatgtaataaccggctgcactgcatggtgcttgtaataataacgttaaggaatttccattggtaatttggtaccatccttttttccaaactttttgtgtatgtatgtatctatgtggtgtctctgttcatctctggatctctccgaccgagcgtgattaacggctgggggatctttaggaatggtt

SEQ ID NO: 6229 - DNA, 918 bp, Triticum aestivum
  Clone ID: PAT_TA_6229
gcgccaccagcctgcatcgcatcccattcgcatggcgcttccccatcatcgcatcccattagcatcgccattttccttggagagaagtagccagaaacagcagcgccatggccggcatcatgcacaagatcgaggagaagctccacatgggcggcggcagcgacgagcacaagaaggacgaggagcacaagaaggcggaggagcacaagaagaaggacggggagcacaagaaggaggacgcgaccattttcctcggagagaagaagccagaaacagcagcgccatggccggcatcatgcacaagatcgaggagaagctccacatgggtggcggcagcgacgagcacaagaaggacgaggagcacaagaaggcggaggagcacaagaagaaggacggggagcacaagaaggacggcgagcacaaggagggcatgatggagaagatcaaggacaagatcagcggcgacggccacggcgacggcaagaaggacggcgaccacaaggagaagaaggacaagaagaagaagaaggacaagaagcacggcgagggccacaaggacgacgacggccacggcagcagcagcagcgacagcgacagcgactgagccagctccggccgcgctccggcagcagcgtgcagtgtaggcgagatcgatgaacgcttgggagaagtgtggcatacatatatgttgcagggtttggagcgtgtggtagcatatgtatgtaatgcgtgacatgtctcatggatcttgtgatgtataataattagccggctgcactgcactgcacggtgcttgtaataataacgttaatgaatcatgttggtattgatgcaaaaaaaaaaaaaatttgatatacccatgttttttccacactaaagcaaaaaatagcaacattaaaaaaatgttaacgtggtacc

SEQ ID NO: 6230 - DNA, 1278 bp, Triticum aestivum
  Clone ID: PAT_TA_6230
ccccgcgtccgttctgccgctccctcgtgacgtgcgccttcaacaccaggaaattgagtcctgtctttgttgctggccccaatatggatgaagctccacctgtctgggttgaccgagttggattcaaagccaacataacagagagcttcacaaggcagagcaaattcacatatggcctcgtcgtggaagaaatcacaacacgtgatgaaaccaacagtatctgtacacatggttctcgggcaatgcctagtggcggcttgagcatggatggacctcccacaaccctcagtggtactggtgtagatcgaatggcatttctacaagcaaatattactcgagacaatacagagtttgtaaatggtgcagtcattggcgacagatgtattttccagttggatcaaggtcttgggatcggaagcaaaagcccactcttcaaccgtcatcagcttacattgacaaagttcattaatttaaataatcaagagaaaggtgttggcaagccgctgccagctgtgttggttcttcatggtcattatgcaggttgtgtaggagatctgccaagctatgatgcatttacacttggaggaccttactcagttaggggctatggtatgggtgaactgggtgcatctaggaatgttctggaggttgctggtgaggtgcgcatacccgtgaagaacacatatgtttatggatttgctgagcatggcaccgaccttgggagttccaaggatgtgaaagggaaccctactgagttcttccgacgcgttggccatggatcttcttatggtgttggcgtcaagcttggcttggtaagaggagagtacatcgtagatcacaatactggggctggaaccgtcttcttcagatttggcgagagattctgagtgcatttcattcagcacatatcttgaagacgggatgtttaatgcacaattgaggcgttgagtctcaaagtggctatgcatgtgggtgtgaacggcaggtgacttgtgttctgctgaataatgaagttttgttccttctttgaggaagagagataagttagtgtcagggtgagttctttgcttctagtaggaagtaaggtctgttattgcagagcttcaagctggttgaatagatgaaagctgagctcctagtgttaccaaggaatgttttgacaaggctttgtgtcatagtcaatttgtttccatgtaacactttgttgttcaatcggttagctaattgacaatggagtgttgcgctcaagaaagtggtgaagagaatattgggtaccca

SEQ ID NO: 6231 - DNA, 486 bp, Triticum aestivum
  Clone ID: PAT_TA_6231
acgagggttttgataatcacctcttgcctatgtgttcctgcgtagtttttgtactgccacagcttggttgttttggcaggataatgtattttcttatgaaaaacacgaatgagtaattacatgatatattattaatattagactgttgtttctctgaaactaactttgtatttcagctttggaaactggtgttctaatgttagttccgacaagagggccactataaccaccaactagtctgagtttcgtcgccatgccaacattcacgaaggagacatctgtgcattttgtttcaggatcacttaaaagcgccgcctggttttcaccgtgcaccgcctctagatgcaccatcgaagacactgcagcccctgtgtcaatataatctagcactaagtcctcttaattatgctctatcctgtgataacctatggtttgcttttggccctatcacaagtttttaaagacgctaaaaaaaaaaaaaaaaaa

SEQ ID NO: 6232 - DNA, 648 bp, Triticum aestivum
  Clone ID: PAT_TA_6232
gccgggctccagttccccgtcggccgcatcgggcgctacctcaagaagggccgctacgcccagcgcgtcggctccggcgcccccgtctacctcgccgccgtcctcgagtacctcgccgcagaggtcctggagctcgccggcaacgcggccaaggacaacaagaagacccgaatcatcccgcgccaccttcttctcgccgtccgcaacgaccaggagctcggcaggctgctcgccggcgtcaccatcgcccacggcggcgtgatccccaacatcaactccgtgctgctccccaagaagtcccccgccgccgccgagaaggaggccaagtcgcccaagaagaagaaggccgccaagtcccccaagaagaaggtcgccgccaaggagtagccgccaccatagcctagcctgcgccgaggaaccgtgtcgtgttgcctaattagttggatcttgtatgtagtgcctggtctcgagttgcaaggtgtagcgtagtggccctttcatcagatctcgatgaggaaggccgatattctgtgatttctgtgggaatggctaaagatgcaatcctttcaatcttaattctcctgtgaacctgaatcttgtgagtctttgtcacctgcctttgcatctaaaacatttggtttgcatctg

SEQ ID NO: 6233 - DNA, 824 bp, Triticum aestivum
  Clone ID: PAT_TA_6233
accgccgccgccaacaccacacctcgagagtcctcgccgccggagaagcaggcaagcgagatggccgggaggaagggcggcgagaggaagaagtcggtgacccggtccgtgaaggccgggctccagttccccgtcggccgcatcgggcgcttcctcaagaagggccgctacgcgcagcgcgtcggctccggcgcccccgtctacctcgccgccgtcctcgagtacctcgccgccgaggtaaccacagatcttcgctgtccttgagcgtctgttctgctctgttcttcttgtgttggacaggtaaccgatctcgttcttggttgatgaatcgcaggtcctggagctggccggcaacgcggccaaggacaacaagaagacccgcatcgtgccgcggcacctgctgctggccgtccgcaacgaccaggagctcggcaggctgctcgccggcgtcaccatcgcccacggcggcgtgatccccaacatcaaccccgtgctgctccccaagaagtccgccgccgccgccgagaaggaggccaccaagtcgcccaagaagaaggccgccgccaagtcccccaagaagaagcccgccgccgccaaggagtagcctggcctactacgccgagggaccgtgtcgtgttgcctagttccatgtcttttggttagctggatcttgtatgtagcgcctggtctggagttgcaagctggtagtagtctgtagtgtagtggccctttcatcagatctcgatgagcaaggccggcatggcactgtgtctgcgatttactatgcgggaatggctaaggaaagatgcaatcctttcaatctt

SEQ ID NO: 6234 - DNA, 1374 bp, Triticum aestivum
  Clone ID: PAT_TA_6234
ggccggccgggctgggacaaactcagagcaccacgactccagcgcaaccgccgcagacaccacacctcgagagtcctcgtcgccggagaagaagtagcaagcaagatggccggaaggaagggcggcgacaggaagaaggccgtgacccggtccgtgaaggccgggctccagttccccgtcggccgcatcgggcgctacctcaagaagggccgctacgcccagcgcgtcggctccggcgcccccgtctacctcgccgccgtcctcgagtacctcgccgccgaggtcctggagctcgccggcaacgcggccaaggacaacaagaagacccgcatcatcccgcgccacctgctcctcggccgtccgcaacgaccaggagctcggcaggctgctcgccggcgtcaccatcgcccacggcggcgtgatccccaacatcaactccgtgctgctccccaagaagtcccccgccgccgccgagaaggaggccaagtcgcccaagaagaagacctccaccaagtcccccaagaagaagaccgccgccaccaaggagtagccgtcccccatagcctacccagtgttgcctagttagttggatcttgtatgtagtgtggtggcccctttcatcagatctcgatgaggcaaggccggcattgtgtatctgtgatttgctgtggtaatggctaaagatgcaatcctttcaatcttaaaaatcctatgtatccgaatgtctaaagaaacaatcgctgcaatctaaaaaaaaaaagctacaatgcatgagggtcttatgaatgccgacaaatgcatcatcctagtaaccacaagctccttggtggtgtccagagatgtattcagcagatcaatcatgaaagaatacgacaaagcaatggaaacttatcaggaaggcctaaagcatgatccgagtaaccaggagctgcttgatggtgtaaagagatgtattcagcagatcaacaaggccaacagaggcgatcttaccccggaggaactgaaagagaggcagggcaaggctatgcaggaccctgaaatccagagcatcctgacggaccctgtcatgcggcaggtgttgattgatttccaggagaatccaagggctgctcaggaccatctcaagaaccctggtgtgaagcaaaagatccagaagctcgtgagcgcagggattgtccagatgaagtagacctaaatgctgagtgtcggatgtttagtttagttggttgacattttcttgtccgagggccaatttccctccggattcgggtttgtgtaaaagtacatttcgtggtggttcttaattggcttgcttgtgatgtgatacttcacctcgtccgaaatttggtctactttccgtcgtcaaaaaaaaaa

SEQ ID NO: 6235 - DNA, 759 bp, Triticum aestivum
  Clone ID: PAT_TA_6235
tcggcacgcggtttcctttgtggtcgacttaataaccaagcaaaatggcctccttccttgttgaatgcctagggtggctcatcgtcgtcctcttttccttgtacatcttccagctcctccgtgacgctcgccggcgtcttcccccgggcccctggccgccgaagcctatcatcggcgacctcctcgacctcggggaggacggccagcagcaccgcgcgttcctgcgcctggccgaccgctacggtggcctcatgtgcctccgcttcggcatggtgccccacgtgatcatctccacgccggacgccctgcgcgccgtcttcggcggcgaaggcaagaaggtggacaacatcgccggtcttccgagcttggacgtcctcagcgccatgggccaccgcgcccacaccatcttcgcgctcccgagccaggacggcaaatggcgcgcgatccgcaagttcgccgccgcagagatgctggctcccaggcggatctccgccggggccggggcgctgctgcagacaaagatcgtcgaggcgctgcaccgccaggtgtccggccacgccgcgcgcggcaccgccggtcgcggccaggcacgccggtcccctccccggccggtcctgctcgccggggccgcgccgccccgccggcctgcaccccaaggagcgggccgtgttcagggacatcatcgaagagtatcgttgggatgctcggcacggctaacgtctccgacatattcccgccgatcgccgcgctcgacctcca

SEQ ID NO: 6236 - DNA, 661 bp, Triticum aestivum
  Clone ID: PAT_TA_6236
cagcgaccagccggccggcagcatggcgcccccggagtacgtgcagatcgtcggacaggcacagccggcgtgcgtgacggcgccgctcccggtggtctggctggagggggacgtcctcgcagagtacgtgcagttcctcaaagaggccgaggaggccgcagcaccgccgcttcccggcgtcaagtggctggagggggacgtcctcgccgagtacgtgcagttcctcaaagaggcggaggaggccgcagcaccgccgctgcccagcgttaagtggctggagggggacgtcctcgccaacttcctgcagtttctcggacaggacgagcaggtcgtgcactacggcagcgacaacagcagcagcggaagcaacgacggcgactccatgtgtgaggacgaagatgacgacgaggaggagatggcgtatctgctgcggcacatcacgagcctcccggcgttcatggcgcgcgcggcggccgccacctcggtgtaagattaatcgggacggcctcgttcggatcaagagatcttagagatggtagctgcttggttacttcctcctgctttcatgtgtgttctgtaacagtgccttatgcctgatgaaaaagaacaaagatgaaaacggcctaattttatccgtcacaaaaaaaaaaaaaaaaaaaaa

SEQ ID NO: 6237 - DNA, 1012 bp, Triticum aestivum
  Clone ID: PAT_TA_6237
ccacgcgtccggaacagtggaggagtgcataatcagctcaggtctctcagttcgacaattaagcgtcttggaagcaggatcaactctgtgtgtgaatactcagctaaagaaacctgtgcctattgctccacaccggttcacttcgagtcacctgacatagccttgtgtggaagtgtcaatcctgctattgttccgacagaaaggcacaagctgtcaagatgtgcagcatcgatgcgcttatgctctgttctggaaccaacttggtactgtgtatgttgtggaggaatggttgataagcttgtgcctgacacctatttcgccatgaagacatctcctttgttgggtgctgccaatccagacgatgaatcatcactttactcagcacctgctgttcctcgttgccccttctgcggcatattgctgcagaggttgatgccagagttcctgctctctgtctccccggtatagaagctagtgagagttttttgctcaagtgcacgtcgtctctttttgcattattgtgcgtttgttctttattcctagaggctgccaaaaaaggatggaaagcaacatcatcatgtcgccagcatgattgttcttggggagatgcttgttttgaatattatgttggtcagcgtagcttcggtagagatcaaggaagagccagatagtctaaaggcaaaaggaaatggttcaagagaagaggcctagcggcttaaagccttcaccgttcttcatcatgttgtacgtattaatgtttgctcttttttttttccttttgtctctgacggtccaaaaggcttctaggactcataactggtcaagtgttttagcatatgatgtacacaagattattttccatttcttagctgtggacataagagttctactatagggttttcatgtcttgatttatatgatgcgtcattttagcttttggtgaggctatgcttcagattgttggttacttatatataatagacagaagcaagtgagtttggcaaaaaaaaaa

SEQ ID NO: 6238 - DNA, 627 bp, Triticum aestivum
  unsure (1)..(627): unsure at all n locations
  Clone ID: PAT_TA_6238
gcacgaggacggcccgcgctgcagcgttgccgcctaccgccacggtgccaccgacgatcgaccacgacgcttccatggcttcctctgcttcccgcctctgccttctcgccatcgcgttcctcctcgccgtcgccgcaccccgcgtcgacgcgtggggcggccgcttcttcttcagcaagatgacgcgccccggggccgtcgtcgaggccgacaaggcggcggacaccgccaccgtggcgacggaggcgctcgacaccaacagcgcgccggcggcattctcgcggccgtccagcaaccgcggctacggtctctacggccgcccggaggagaacgagaagtacccgccggcctacttccgccgcggcgtgcaccgcgacgccgagaagctgacgaccaccaacgtcgtgccggagacagagccgaggcacggggaggaggcggccgtcccggtgcaaggaagaacaatcctcgggcgaggaggagccggcgttccccgcggacggcagcggcagggggcggccgctgtcgtacatgcgccacggcggcaagcacgaccgcgactactacgggatgagcgacccggntctgcaccagggccgcccgttccacgtcgacgtggngacngnn

SEQ ID NO: 6239 - DNA, 866 bp, Triticum aestivum
  unsure (1)..(866): unsure at all n locations
  Clone ID: PAT_TA_6239
ccgaatttgggaacgacccacgcgtncgcgcgcgtggggtccccaaatccctaaccctaacccgaataggcggcggctgagaggggaaagcggagggaagatggcggcggctgctgaagggaaagcggaggggaagatggcggaggctgaggaggggaaagcggaggggaagatggcggcggctgcggaggggaaagcggaggggccctcctatcctgaccgctcgacccccccgatccttgaggtcgccctcggcaaggatttcgtcgacattccctccaacgccgacgagagccccgcctggctgctactcgtcggcgtcatgagcggcggcctacgcttccaccgttttggcgtggcgagatctgggcggatctccggtcggagcgacgacacgctccagatcttccacgacctcaagaagcgacagggttgcagccggagcgcccgcgcagccatggcatctgacggccgctcgctctgcctcttgcagcgggtcgagaaggcgcaaaccgaggcccttcagcttcagctgccggccgaggaggagctgccggccgaagtactgcttcccccgttggatccaagcatgcgtggccggtgcgtgcccatctccgccgacggccacatatgggcggtgtccgctagctactgttctgccaccagcttccgtctcgtcctgcaacgcctggtcatccaagaggaagagggcgtggcgggacaacattgggagcaggtcggcggccccttcatccaacattgcaaagtcgagctctcccaccccatgtggagtcctgacttgctccagggctacgcagtactccctggccagggccctgacgggggcacgctcatcctgctctncc

SEQ ID NO: 6240 - DNA, 740 bp, Triticum aestivum
  unsure (1)..(740): unsure at all n locations
  Clone ID: PAT_TA_6240
ancccntnngnnnntttnngatccgccaagctcgaaattaaccctcactaaagggaacaaaagctggagctccaccgcggtggcggccgctctagaactagtggatcccccgggctgcaggaattcggcaccacgccgcctccctctctctccccggtgcagatcaacgccgccacccctctctaaccctagcttctcgtcgctggcggcgccgccctccctccctcgccctctcctccttccctcatcacggctgcctccaccacgccacaaaccccggcgacggcctcatgtagatcccatcctgctccgcgtcgccgctctcccggccatctcttcgttcccccacagccacacctcatcctccccccctcccccggtcccgtccccagccccgccgcccggcgccacctcatcaccttaagccgccgcagcccatgctttcacccgtcctccgcctccgcggcagcctcctcgttctacatcgaccggatcctgctgcccagtagcttctcgcatccgctctcgacctcctcccgggacaaggacaaggaggagagcctcccgcccgcgccgccggcgtcgtgggtgtagaggtggctcccggccggtggggcggggaatttcatcagtgtgtttgaggccgagctcgccgacaccgtcccggtggtcaaggcattcatcggcggcatgnnnatcctcgggacattgtgcgtgggcaacaagaacgnnnttcttct

SEQ ID NO: 6241 - DNA, 1291 bp, Triticum aestivum
  Clone ID: PAT_TA_6241
ttcctcccctcccactgtcgctggatcccgatggacgtccgcgacggctgcgtcctcctcggccgggaccacgggaaggacgcgcggcctccgatctgcagggagctcgcggtgtgcgaccccctgcaccggcggtacgtcctgctccccccggtgcccgacgccctcgtcgcctcggtggagcgcccgccccccgtgctacgcaggccctcggacgagcctctcctccttcccctcagcgagaacgatgcggcggcggaagggacggcattcacggtgatctctatggtgcattgcgagactaagctggtcccctttgtattctgttcgagcaccgggcagtggcgagccgcggcacccatgctttggtcggccatgccagtgtcgcccatggatcctgcttatctcaggcggcaccacgcctatggctgcttctactgggactccaccaatatcaagaggaaagagttgcttgtgcttaacatccagaggatggagttctccatcgccgagctcccatcctctggttggggcactctcgccgtggccattgtggaggcaggggaaggcaggcttgggctgtttggcatccgtgatggaaccgcaggtggcagcaaacatgacctctgctacagcgttaggcagaacaaaggcaagaattccggccagtggcggatggtgaagacgttctcactaggtcctgagggcctgcattatctcaaagctgcaacagagaggtatgtgctcctgatatgttctgaagccccacggttcgttggcttgtctatggtgatgccagacttgttggagtatttctcggtggacgtcaagaagttgcagcttgagagggtctgtgtgaagcctttcgggaagtccttgtccaggacgcgcatatatgcccacttcccgccatcgctgtcttcgccgacaatatgaagtgattcgctggagccgcaaacagatcagcattctcaattcaagacaactgggatttcagcagcgtggatgtagcatcattgtgaatgttctcaattcgcggtagacgtcatcaccttgcctataggatggtactatttacattgctttgcctggcgttcgtcatgtatatgttttggttaattattgtagcatcattttggatgttcttttctgagtgcggcagtgttcgtgtctatgttgtgttcttcctttgataccataagaatgttacattttaattaacggtcccaatcaatcaagaactgtagtaaatccaaaaaaaaaaaaaaaaaaaaaaaaaaaaaaaaaaaaa

SEQ ID NO: 6242 - DNA, 1098 bp, Triticum aestivum
  Clone ID: PAT_TA_6242
gcccttttggggttaagtttctgtgttgctcacttggttgcggctctttcgtgtaatggcggggatgattatccgtgagtgacgtttgtgtggatccgtgcaatccaggcgcttataggttgctatttggattttgttgctattctatgatgtcctgtcagaccctgggtaactgtggttttcgtccttcgatagccgttctccttgagtgttgagaaggggcgataaggtgcatgcacgggtgattctggtgagcggtacctgagagaggtggtcctatgatcgagcgaacaaccttctgggcccactatgcattctcccttgtaccctttttgtcatttttgatcttgcgtttttttatgttccactgggctgatcctttttgtggatagatttcttctgccgcacacctgtatttactgtttgactttgggtttcgggttcccattcgtatcggtgctgttcttgctagggcgatgctgatcaaccgtggctgatatatgtgtgcctttgagtaatctagttacctgtgggtatcatgttggttcctccctcttgtctctagaatcctttgtgatcctgtgatacttattgatccgtccttggatggtcattcttcttgagtgataaccagggcagctccactgtataaacagattgatctggtgataagagatgatgggggtaggttatatgatcgaggaaaggcgaatctgagcccactatgcaatgaacctccaaccccctctcctagtctgtccagtcgttgctgtctgatgctccagggtgcttcgccgccgtgcgttcggtttcattctcacttataactttattgcatataagttgttcttgatcttttattgttcgtcattggtccttgatttagtctggttaggaactcttctgtctcttatgtaaagatttcttctctctcataccaatgtttgtccatgtagtaacagatatatatttcaagcatgacatgaataaacctgaatggtctttgagatgagatgcatggttgtacaatatagggtactaagttagagatcggctgtccctatgaatgcaaactattgtcagctataaacatgtttg

SEQ ID NO: 6243 - DNA, 2600 bp, Triticum aestivum
  Clone ID: PAT_TA_6243
tcttcctctcctccccaaccactcaaaaagaatctcatcctctccccgcaaaccctaagcaactcgccgccgccccccgcccccaaatcccatctcgtcctctaagcaacccgccgcctgccggccggccatcccccgcccccaaaaaacgctccgcccgccagatcgccgctgatggcttctggatctacttgttccggctctgttccccttgggaggagggggctggtgtcttgcgcgcacagcctcgactgccgcgccgacgacgcgcctcctctcccccccgaccttgaaaaggtcgtctacgagctcatcgtcggcttctacgaccatgagcgttcgaccggctgccctgcgagagtggattccgggcctcctcgacctccgcgccaacggtgggctggggctgacggattacacaaccccagcattttcgggagccgcagtataaacttgatattatctgcggcccggaggcaatcaaccaagggccgcccccccttgggtgagatgtgctaccgcgtgaacttcactgctacttctcatttgggagcgtgagaggaggctattcttcgctgagtttttgttctcaggtgggccaaggccagagacctgctgccctctaccttatgactatgcaggccgttgctactatggtgagcaacccgcgaggaaaattgtgtatcctgatgacgccaaatacatcccggcacgatatcacccatcctggaacccgacgcgtggatgacatgctagagatggacgtcgtccacttcagttccgagatggacgtggagcttgcagagaaactcaacaagatgcatgccaattgaagagtgagtctgagtgaatcttctgttccagcggtcgtgcgtgtgatgctatcagctggcgggtgtcgccgccgtatacccctcattgcgcatgatgatgagcccgccctgtgttgcctcctgcggcggaaaatggccaattctccatgtccgtaagaacctcgacgctgtgtggtcgaccaccccctccactacagaggacaccgccaccgccctctgctgggacggaaaacccatctcgtcgctgcagtgcggactgtctgacaagctgcaacgttgcctgggaagagcggatggcctggaacaatatttgaagaagaccccgtgcagcgttgacgcctgcgattacctgcagactctcaagatgcgcctccacggtatgattcacaacttctgcatcaaggcgctcaagctgctgcccacaccatcgggctcgcttatgtgtggcttcctcatggccggccactgctacggctccatggaccctgtctctaacatcatcgtcaactccatttggtacaacttccttggcggtcctctcccagcgtctgaaggcagcaagattgagcaatacaatgacatacttgaccccctatctctgctccgcacacaggtccactccctcaagggccttatggagctcgccacattcgccggcccccagttctcaacagaggcttgtgctctagagttgctctgcggtacaaaatgcgacattgttgacatgttacaatcatcgctaaagatgattaaaaagaaccacttccatgaagctgccaaggccgctggacaccctctaccgcttcagctgggtgaactgcaccggctgctggtggtgttccccgagcagcgaagcgtgctgctctcctttatgaccaaggctcgaactgacggtaccgtgttgcgcctcgatgacatgacacttcatattaggcgcatgtggagcagatactcgaaggttcgtgtcggctgctatgagcaagctcctgatctttttccagagtctcggaggttggtgtctagcatgagatcacagtatgaggaggggaggagctggttccgttcaaagattgaacaggtgctgaaggattacacgacccagcatttttgggaaccacagtataaacttgacattatctgtggcgtggaggaaatcaaccaaagctgccccccctcgggtaagatgtgctaccgcgtgaacttcactgctacttctgatttgcagcttcagaggacgctattcttcgccgagtttttgttctcaggtgggccaaggccagagacctgctgccctctaccctatgagtatgcaggccgttgctactctggcgtgcttaccgcaaggaaaatcgtgtatccagatgacgccaaatacatcccgcacgatatcacccatgacggtacctgccacgtggatgacatgctagagatggacttcgtcctcagttccgagaaagatgtggagcttgtggagaaactcaacaagatgcacactgaagagtgagtcgcggcgggcaagcttgtgtgtgatattatcagctgtgaagttggaccatagtactatgcttcctgctgtgtgttatgatgttctaattaatgagcatcctgcattgtagtattatcatagactggatgacattcttcagcatgcatgtttggttgccttgagctactcttatgcacgtctccgtgcctagcttgcttgcttggccttgttaaatttgtgtgtaaaccaagttgctatcgttatgatgaactatatatagc

SEQ ID NO: 6244 - DNA, 1161 bp, Triticum aestivum
  unsure (1)..(1161): unsure at all n locations
  Clone ID: PAT_TA_6244
gcggggggcccagagtgaccgcgtcctcctcctccttctcttggaaccaaaccaagataagcaatggctctagttggtcaggctgcctgctttgcccgattcgcaggggacgacgcctactcctccttctcttggattggaacactggatctgctccaagatcgatcctgaaccaacccaagataagcaatggctctagttggtcaggctgccatggttgcgcagtttgcaggagtggacgcctacgggctcatcaagatgatcgccgatgcggcgcagacggtccggaggaacagagccacctgcctgcagctcgcgcgccgcgccaagatgatcggggacctgctgcaccagctccacgccgcgcagctcatgcagcagccggagacgaggaacccgatggagcagctcgaggagacactccggcgcgcgctgctgctcgtcaggtcctgccagggccgtggatacctctaccggtgcttcatgggggcgcgccacgccgacgagctccgcgaggtgcagggtgagatcatcttctacctccagcttttccctctcgtcagctacgtcgacaccaccctcacctgggtcagactcctcaacaaagatgctgctcctgaagctccttcatgcaaagaggcacctgtggtaagaccatattttgtgccggatgaatggttgttgctagtttctcattcaggaagtatactttggcactgtatacacatgttgtacatacttctcttcttgtaatatctactaaccacccgtcgggaaaaatttatcctggcatgtatctgcaggagttgaaattgttgtgcaactgaccagttatttcttttttctcatcacttcactaaaataattagcaattatctagctagcacaatgtttctgcaactgctagttagcattgtgcttgttatgtattgcgttcgcgctcttgtctctggagaatctggctggcatagagtgaaattcaagttcagccaatccaaaccgcggttgtaagtcaggtcattcggttcctgtgcaaaattaggtatgttggtattttcttttccttgcacgaagataagatcatagttgagaactgaccagccgtcactggtgctgttggataatcggcctcaaggctcttcctcgccccaangnancgtt

SEQ ID NO: 6245 - DNA, 1600 bp, Triticum aestivum
  unsure (1)..(1600): unsure at all n locations
  Clone ID: PAT_TA_6245
ggctcgtggccgaccggcggcagaagtgctggacctacgcccgccctcgcctgctggtcttgaggctcggcgagagctgcttcggccccctgcgggggccgttgtgccggcctcttcacgcgctccttcgtcgagaggcacgtgaatttgcaaatgaacttcgtgcaagtacgaaagcaccaaaaaatccagctgtttggcttgaaggttctaataatgctggccagaatggcagtagtgctgatacttcaacagtatctgatgcatactcaaagatgcttacgatatttatcccgctgcttgtggatgagagttccttctttgcacattttatgtgcttcgaagtacctgcacttgttccagctggtgctccttacgttaacaagcgtagatctggagcaaatgaccctgatgatgacgacctgagccttatggatccggatggcaatgatatcaaaccagataatacatcctgtggagttgggtacattgaatgatgctcttcaagaactgcttgatggaatccaggaagatttctatgcagttgtagattgggcgtacaagattgatcccctgcgttgcatttcgatgcatggtattacagaacgttacctttctggtcagaaagctgatgctgcaggctttgttcgaaaactacttgatgacctggagtcaagaatatcagtccagtttagcaggttcatcgacgaagcgtgccatcaaattgagcgtaatgaaagaaatgtgcgtcaaacgggaatgctagcctacatcccaagatttgctgtccttgcatcacggatggagcaatatattcaagggcaatctagagatttgattgataaagcatacacaaagctcgttagcacaatgttcacaactttggagaaaattgcacaaagtgatcctaaaactgcggatattgtactgatcgagaattatgctgctttccagaacagtctttatgacttggctaatgttgtgccaactcttgcaaagttctaccaccaggctagcgaatcctatgaacaagcttgcactcgtcatatcagctcactcatttatcttcaattcgagaggctgtttcagttttctcgaaaagtcgatgaattgacatacacaatagctgctgaaggagataccttttcaacttgggttgtcaaaaactgatctaaggagggtgctgaaatcaagtttatctgggattgacaagtcaattggggccatgtacagaagattgcagaagacattgacttccgatgaattgtttccctcgctatgggacaaatgcaagaaagagtttctggacaagtacgagagctttgtccagatggtgacacggatctacggaaacgagcctataatgccggttgccgagatgagggacacccttgctagcttctagatacaaatgagtgcagcgccatgtatcattttcacagtgctgtagcttatatctatattcaattcattnctattggattttgcaggttccccttnctctaggcctctttagggtgggttnctacatgtatgttgtttactggccaaattgtcatgtgtgtagaaatggatgtgagctattgtctggtcgcaaacc

SEQ ID NO: 6246 - DNA, 1012 bp, Triticum aestivum
  Clone ID: PAT_TA_6246
cgtccgcggacgcgtgcgcggacgcctgcctcttgaagcccttcacacatgtcaagacccgtctcagatgtcaccaccaagttattcctttgaagcctcgccctccttccacaggcccatgacgaagccaacctagcttgcaccacgtaccgtgtggtgtggtattatatatacacccaccggccctccgtgccatcccggcctccatcgccatggcgacgacggggagggtgaggcgttctcctctcctcgcggcgtggctggctctcggccttgcgtggcattgcgcgcttcaccatgctccggcagcggccgtgacgctgtcgacggcgtcgcggtgggtcgtggacgaggccggggaccgcgtgaagctggcgtgcgtgaactggccgtcgcacctggagccgatgctggcggaggggctgggcaagcggcccgtgggcgccatcgccggggacgtggccgccatggggttcaactgcgtcaggctcacctggcccacgttcctggtgaccaacgcctcctactcgtccctcaccgtcgagcagtctttccagaggctcaacctcaccgagtcgctcgccggcatcagggccaacaaccccgccgtcgtcgacctcaagctcatcgacgcgttcaaggccgtggtgagcagcctcggcgagaacaacgtcatggtgatcctggacaaccacgtgagcaagccggggtggtgctgcgacaacacggacggcaacggcttcttcggcgacggctacttcgagccggacgtctgggtcgacggcctcaccaagatggccaccatgttcgccggcgtcccccacgtcgtcggcatgagcctcatgaacgagctccgaggtcccaggcagaactcaaacgactggtacaagtacatgcagcggggcgcggaggcggtgcacgcggcgaacccgcgggtgctggtgatcctctccggcctcagcttcgacaacgacctggctgttctcatctcccggtaggtgatcctgatctt

SEQ ID NO: 6247 - DNA, 696 bp, Triticum aestivum
  Clone ID: PAT_TA_6247
gttttcttcccggagtggctggcaaatccggtcctggtgctaaagaagaacaagcaatggcggatgtgcattgactacacgagcctcaacaaggcctgccccaaggacccatttgctctgccgagaatcgatcaggtgatagactccacagccggatgcgagctgttgagtttcctggacgcgtactcaggatatcaccagaccaagctgaacccggctgacagactgaagaccgccttcatcacgccgtttggagccttctgctacctcaccatgacgttcggcctgcggaacgccggcgccacctttcagcgttgcatgcagaagtgcctcctcaagcagctcggcaggaacgcccacgtctacgtggacgacgtggtggtgaagacggagaagcgtggaactttgctggaggacctcaagcagacctttgagaatctgcgccggtcctcctcctcgctgctccaggcgggccccgcccccgtgcccccgcctgaccccgggcccgcccccggcctcgctggcgccccgtccgcgccgcctgcggcccgcccagccccgcagacgcccctgcccgcgggctcgccgatgcccgccgcccgcccgatagcgccgccctccacggcctccagctcggcctgggcttctgaccggaatgcggccagacggtccaggtccagccctggataccacgtc

SEQ ID NO: 6248 - DNA, 926 bp, Triticum aestivum
  Clone ID: PAT_TA_6248
gcgtatgcggtttctggagagctgcggcgaatgctccggctgttcctgatggcaaggacccctacatcaccaaggaatacctcaaggggaaaagactacaacgtatatgtccacagttacttgtactacggtggtttagccgctcgtgtggagatcttgaaggcgaagaaggggccattcagctcctgcatactccgtggattcagtggtaagtacacctacaatggcgaggagtacgacgcctcagcctcgccggagggcgcggcgtacgacaagtgcagggaggagatcgccagggcgctgaagctggacgcgccttgcgcggccaagaactgcaccttcggcggcgtgtggaacggcggtggcggggccggccaggacaccatctacgtcgcgtccttcttctacggcaaggccacccaggtcgggtgggtcgacaagggcgcgcccagcgcaaagtccagcccggcggcgtacctggctgccgccgagaaggtgtgcccgctcagcgtccaggaagccaaggccgcgtaccctggcctcctcgacgtgccctacgcctgcatggacctcgtctacgagtacaccctgctcgtcgacggttttggaattgcgccgagcaaggagatcacgctggtggagaaggtgaagcacggggagtacttgatcaaggcggcgtggccgctgggttaggccatcgaggccgtcgcgcccaagaaacgacttgcgcgatttctactctaatcctccggccgtcggccggtaggatcgattgtgttgtctgttgtgttgtgtgcgggttaatcccattgatgtaacacgacgtgaactgtattgctcgatggatggatcgattagcaacaataatctcggatgaggaagtaaagagatatttgtctttcgcggcaaaaaaaaaaaaaaaaaaa

SEQ ID NO: 6249 - DNA, 400 bp, Triticum aestivum
  Clone ID: PAT_TA_6249
tcgacccacgcgtccggagccacacatctcgtcacttcgtcagtcgtcacggagatggccgccgccgccgccgcggatgagccgtgccgctgccacattgttggcggtgccgttccccgggaggggccacgtcaacgccatgatgaacctgtcccgcctcctcgccgcgcgcggcgccgcggtcaccttcgtcgtcaccgaggagtggctcggcctgctccgctcctcctcctcctccgccccgccgccgcccggcgtccgcctgcgcgccatccccaacgtcatcccctccgagcacggccgcgccgccgaccacgcgggcttcctcgacgccgtcgccaccgagatggaggcgcccttcgagctcctgctcgaccgcctccgggaggaggagggggag

SEQ ID NO: 6250 - DNA, 1216 bp, Triticum aestivum
  unsure (1)..(1216): unsure at all n locations
  Clone ID: PAT_TA_6250
ttttatcgcgtccgcccacgcgttgggatgctactcccaattgggaagacattttgtccttgggagaacagcagaggctaggcagcgcccgcctggcctggcccgtctgttctttcactctcctaagtttggtatcctcgacgagtgcaccaatgccacaagtgtcgacgtcgaggagcatttgtacaggctagcaactgacatgggtataactgtggtcacttcctcccaaaggccagctctgatacccttccattcgttggaactgaagctcatcgacggcgaagggaagtgggagctgtgcgcaatcaaccactagccgttgccgtcgccttaatttttgatgggctttagttactctcagctgtatactgacttacatacagtacaaatagtcaccttgctgcctgaaatagaagcagcagcctattattggagatagagcagaacaatatacaggggttgtagaagggaaattcctattctttccaaacaggataacatggtatatatatatatataatcatgttctcatacaaaaaaaaaaaagacacagccagccgccggaatccaccggcggcgacatgtagcaaattatttgtataaacactgggtggcgcgaagcgtgccatttgtaaatatcaactagttcaaaattcatctccctgatgctgcaaattgtcttgcatttagttctgcgtcgaccgagtcgcctgctggttccggatctctcttctgtttgggggcacttgctgcgtcgattttgtaccgagttcattacagttgagtatgaatatgcaagttttgtcctagactcggacttgtatgttttcggggtcgggaactgaactgtttttgacaaattttggcaaaatttcgaatgtcgaaaactcatccgcgcccatgattataagctcgctcatatattagatggaggaaagaaagaagaaggtattttggggtaagctgaagaggaggctactatggggagggggagacttgctgctgggagaggaggacgaggaggccctggggcccgacgaggatctcgctgaggaagctgacgaggccgaaccagaccaccggcgtcacgtcgacgccgcccagcggcgggatcacccggcgggtggcggccaggatgggctccgtgggcgcgtacgccaccacgtaggggaacttggtgaccggcagcccggggtaccacgacatgacganc

SEQ ID NO: 6251 - DNA, 650 bp, Triticum aestivum
  Clone ID: PAT_TA_6251
gaccaccaccaccaccacactcccccctcccccccccaccacaccaacatctgctcctccgtctccgacgaactcatccccgccgacgccttcattggctctgtcgcccaacttctacgccgcctcctgcccgagcgtggagctggcagtgaacgatgtcgtcaggtcggcctccaccttggaccccagcatccccggcaagcttctcaggatggtcttccacgactgcttcgtagagggatgcgacgcgtcggtgctgatccaggggcagcggcacggagaggaccgacccggcgaacctctcgctcggcgggttcaacgtcatcgacgaggccaagaggctgctcgaagccgtgtgcccggcgaccgtttcttgcagcgacatcatagttctcgccgcgagagatgccgtcacttttaccggaggaccgtcggtgcccgtctccctcggccgacgtgacagcctcgtctccctcgcgtccaacgtgagagcaaacatcatcgacaccggcttctccgtggacgcgatggcggcgagcttcgcctccaaggggctctccctggacgacctcgtcaccctctcaggcgggcacacgatcgggtcggcccactgtggcacgttccgggagcggtttcgtccggacgcgaac

SEQ ID NO: 6252 - DNA, 932 bp, Triticum aestivum
  Clone ID: PAT_TA_6252
gagggtatgcgccatctgccttggcagtatgaggacagggcacggacaggccctgtttactgctgaatgctcccataagttccatttccattgcatcacttcaaatgtcaggcatggcaaccatatctgcccaatatgccgtgccgactggaaagaactgcccttccagggacctcaacttgcagatgccacccatgggagagctagagtaagcccggtaaattggccccaagacgacggacacatggctgttatccgcaggctttccaactcatacagtggaaatctgctggagcaatttcctgtcttccgtactcccgaggcagacattttcaatgacgatgagccaatagatattcagtctgaaactgtggaggagaacaatgcagtcactggttcggttgaaatcaagacatatgcagaagtgcacgccatacagcagtcagtgacccagaaggtcttttctatcttgattcatctcaaggctccgaagtccttggagtcggtgagctcccgtgcgcctcttgaccttgtgaccgtgcttgatgtcagtggcagcatgaaaggggccaaacttgcacttctcaagaaggcaatgggctttgtcatccagacgcttgggcccaatgaccggctgtctgtcattgccttctcgtctacggcacggaggctctttccccttcgccaaatgaacgtcaacggacgaatgcaagccatgcaggctgtgaattcccttgttgatggtggcggcacaaacatttctgatgggctaaagaagggtgctaaagtcatcgagcaccgtcggctgaagaatcctgtttgcagcatcatccctctgtcggatggtcaagacacatattcggtgccaacctatgacgatggggttcagacaaaccacagcatgcttgttcctccctcaatcctgcctggaa

SEQ ID NO: 6253 - DNA, 839 bp, Triticum aestivum
  Clone ID: PAT_TA_6253
acgacgcgtaaatcaagcttcggagagtcctctccctctctgtctcggagccgccgcggccatcgatcgaccccgaaggaggcgcggcctgcagcctccaccccccaaaaaagaactctctctaatcgaatcggtgactccacgacgcccccccgctcggcgctcgctgctctctctccctttccctctgtctcggcgccgccgcggccatcgatcgacctcgaaggaggcgcggcctgcagcctccaccttcgctcagtcaagtttctaaaacaatcacatgtccaaggcacgcaacgccttagttgtcactggcttggtgatctttgctggtactggcctagcatttcccttctactttgtgaaatcaaagaacaggcctattattgattcaacgaagcctctgccaccgcaggctactttccgaggaccgtatgtgaacactggatcgcgcgacatagggcctgatcacaccgagtaccccaagaagtggatatgtatttccatcttgttttctctttgtttttcaagtgggcatgcaagaaaaccagtgagtggaaccctgtaatgctgatttaatagcgaggtggtgataatcggctcgtggatgctggggcaacgcgattgccagtgcattaactgcagaacaacgtgttacgtgcagtccgcacgcatcgcttcgctgttctgcgcccatggtagcctcgtttcatcgctgcctgccctccagtgactattccttccaaagcgttgtgccgctataggctatacctatgttaggcaataaaaaaaatgttgggtttgcgttgcaaaaaaaaaaaaaaaaaactcgagactag

SEQ ID NO: 6254 - DNA, 763 bp, Triticum aestivum
  unsure (1)..(763): unsure at all n locations
  Clone ID: PAT_TA_6254
tctctcaccccaaacgacacccacccggcgacggacgcatccgaaggctcccatcccccatctcccatctgagcatctctctcaccccaaacaacacccacccggcgacggacgcatccgaagtcagccgccactatggtggcgatggcggggcaggagcgcaaggcaatcgatctggaggatgggtggaatttcaagcagaagggcaagatctacaacctcatcaatatccccgagcgcaagccagaactacagtttagttctatagtttccggccatgttcctctctttttgtcgcgcaggacaaattgggagccttcaccatggccgccaatatccatctacggattcaaggggcaattacctcacacatcttgatctgtcatctcctttttccgagtcaggtttgatgaagatttggataactagatagatttgtgtggaaattctgtacacttcgctgatgttcgccgacatgcgatagctacagatgcagccaaattaatttaccatgcatgttccgcaaattttcatttaatggttttatatcgtatatggggcaatgatttccttatatataaattcttatgataagattgtgtgcgtttgtagataaggcatcacgaatagccatagttgaataaaagcgtcaggtattagctactacattntttaattgattatgtattgtgagaatagctggagtgcttgtggccatgccgctccatgtcttacatagaatcaatattgctatcatgattgc

SEQ ID NO: 6255 - DNA, 937 bp, Triticum aestivum
  Clone ID: PAT_TA_6255
cgcacagcatgctgtcattcagatcgagcagcgtcaggaagaagaagaaacagctccattggtgtcagcagcatcggccaaccctactgtcgccaatgaggagcatacacaaatttcttcatcaaaaccggccgaggaggggtttgagatgtttgagtctagcaggggcatcaagctgggacttggcgattttgtcttctacagtgtgcttgtggggagggctgccatgtatgatctcatgacggtctatgcgtgctaccttgccatcatcgctgggcttggctgcaccctcatcttgctgtcgatatgcaggcacgcattgcccgcactcccgatctccatcatgctgggagtcgtgttctacttcttgacgcggttgctgatggagccattcgttgtcggtgcttcgaccaatttggtgatgttctgagttctgactaatgttcttttgtcgtagttacatgtgtgccaagtgaaaaagcaattgagaacatcatgtggaagtgactactactttgttggtcacatcttgtaggtagactgtcatgtagttatgactaggaaatggcattgagactttagactcttataagtaaggtagcatcagttttatctgggatcaactagtccatgtcttgtcgtataggtctatcaacatggcatggtattcaaggagaacacatttgcatttcagtttcattttttattcttgcattcttcttgttttttgctggcgttctccctttagattagtgataaagtataaatctatcatctgcctgcaattttcttttattttcttttcgtgtctggtattatttcttacattttactaatagagaatagagttaatcaagcgaatgtattatttgaaaaccatttatgggcaattcaggaacgcagcacttgggaaaaaaaaaaaaaaaaaggcccctaa

SEQ ID NO: 6256 - DNA, 558 bp, Triticum aestivum
  Clone ID: PAT_TA_6256
aaaacgagctgctctccatggttcactcgctgctgttctcgatccacgagacagagctccaggatttcgtaagaggtcaatgtactggcagctgcatccgtcatctgctcgtgaagctcctgaggtactcgggatacgacgcggccgtctgcgtgtccaaatggcaggggttcgacaagatacctggaggtgatcactgagtacattgatgtcataagtagacaacgacctgacgggtccagagcgtctgatcatcgacatcgacttcaggagccactttgaaatagccagagcagtcgatccttacggcaccctgctggactcgctcccggtggtctatgtcggcacccttccaagactgaagcagttcctgaacgtgatggccgacgcggcgaattggtccctgaagcagaactccatgcccctgccgccctgcagatcccggtcctacctccaaatgaagtggcactccaagtacgagaggaatggcctgccctccgaccagcaagagttccagggcgcatctccgagccacgcgctgtgcttcgggcatctgaa

SEQ ID NO: 6257 - DNA, 1977 bp, Triticum aestivum
  Clone ID: PAT_TA_6257
catctaccctccccccccaccgcgcccccccccccctgcgcccctcccgcttgcccccccgccgcccccccgcaccgggaggccccctcctccccttcccccccccccccccagtccccacccaggaatggcttcacctgaggaaaaccccaaattcccctgcctgggtgccctccttggcccttttccggcccaagaggaagctcccgctagctttgcaagagcccctgcccgccgccttgcctcggatcccggtcgcgtcgtttcctgatgttcctagtggccgggtgactgaaattcctggagaaacttctgtgcttgatgctgttagaattttatctgagcacaacataagggcggcgccagtgcttcaccctgaacctggggttccggccgattggcaggggaggtatcttggcatcatcgagtactcagccatcatcctttgggtactagataatggatgatctcatgggggtagctctgttggctagatctgcaactgctgcaccggttgatatggaagggggttgtcttgggggcgtggcatcatcaggtgcaaccgtttgggcagttgacgctgcttatcttgcagccgtagctctgtcagctggatctgcaacttctgcaggagttggaatgggggctgttggtgcagtgggtgtggcagcattaggtgcaactggcccggcagctgtcgctggattgactgctgctgcagtatgggctgctgttgctggcgcgttaactgctgaaaggtgtgttgcaaaggatggagtaactgctcctgatcatttaggggaagatttctacagagttcggcgacagcgagaacctttcaaatcgactacagttcggtcaattgttgagtcctgcccgtggtctccttttgttcctgttacgcttgacagttcaatgcttgctgtactactgttgctctccaagtacaggttgagtaatgtcccggggattgaacctgataagccagttattaagcactagcttacgcgaacttttgttgtcaaaggccttccgcagtctaaaggaagggattggttcgactttatttcggcacaccctcttaaagacatggggcgtccattcatgtctcttgatgatggtattacggttaacagtgatgatctaatcttagaagctttcaagtgcatgaaggataacaaaattggcggcgtacctgtagtagatggtcccaaaaggaaactggtcggtagtgtgagcataagggacattcgctttcccttgcttagacctgacttattttctgatttcaggcatcttaccgtcttggagttcatgaatgctctagcttccactcttcaagattcagggggcaacggactggtgaagccgccgctcacctgtgcacctgatgcctctatgggcagcgtgatcgacagcatcggatcgaggataacccaccggatatacgtggtggatggtgactttgaggtggttggtgttgtgacactgcgagacgtgatctcttgcttcatccacgagccccctggcttctgcgacagttatcttgcttcagcgatggagaagctcgaggacaagggcgatgccgattcctccgttgagaacagctgagccctccattgagaacagctgagctctcgggagcgcaagacggtggaaataacagacagggttagtgagcaagtcttgtagctgggctggttcgttcaggttgcggtgtttatacagtcaattctgtgtggggtgacaaggcatttcagtgctttgttagtgtgtgctttagtttgtcaactgctgtgctgagttcccgagttcgctgatccgcacctgtttcctggtgcaaacactgcagtggcgattctgtgatctgtaaaaacgttgacgtaccaaaggttgcctaatctgtcatgtgtacctctgttatcctcctcgatcaatcaatagtctaatgtatggcagttgtttaaaaaaaaaaaa

SEQ ID NO: 6258 - DNA, 544 bp, Triticum aestivum
  unsure (1)..(544): unsure at all n locations
  Clone ID: PAT_TA_6258
tcttgcaactccgcagtctacgatatggacatgaagtctttcgttctcgcacccagctcatacttctgcaaaccgtatgattccatcaccgtgtccattaggaaccgatgcagcagtggcaatttcttggaccacgaagatgatcacggcctctacgtcatgaacagcttggacgacagctttgagttcttcaattactgcaaggttggcttatctacctatccgttgctgtacaataagtgggactggagtcctctgccgtctccaccgtcccgcaccagtcctcttgttgcagcggcggtgattgacaactccaccatatgcgcgtcatccaagaacggcacatacacctttgatatttcgagggaggtgtggagccacactggcagctgggtgctgcccttccaccgcgcagcagagtatgtccctgagcttggactctggttcgggcctccaaggcccctgggcaacctggccaaaatcgcttatgtgcaattgancttttcatcctctgccaatgggnggnantccggctccctttcan

SEQ ID NO: 6259 - DNA, 921 bp, Triticum aestivum
  Clone ID: PAT_TA_6259
tcggcacgaggccccgatcgaccactatacatacgacctcggtcggtctggtggagcggtgaaccggccgcctttgaattccaccccgcgcgctccctccccgcccgccgcgtcccgcccccctgcccgcggccgcgtccctcgcgcgctgagtgctcctcccgctccttcggccggccccctccactgtcgctctcagctgtcctcccactgctcccgctgctccgtcggctggtgcagagatgggggagaacggcgtgggcaagaacaactaccaggggagcgcggcggcggcgcccatggaggtgtcctccgcggagcacggccaggcgggcggctccaagtgctacgacgacgacggccgcctcaagcgtaccgggacgatgtggacggcgagcgcccacatcatcacggcggtgatcgggtccggggtgctgtcgctgggctgggccatcgcgcagctcggctgggtggccggccccgccgtcatgctcctcttctccctcgtcacctacttcacctcctcgctgctcgccgactgctaccgctccggcgaccagagcaccggcaagcgcaactacacctacatggacgccgtcaacgccaacctcagcggcgtcaaggtccagctctgcggggtcctgcagtacgccaacatcgtcggcgtcgccatcggctacaccatcgccgcctccatcagcatgctggccatcaagagggccaactgcttccacggcaacggccacgcggacccctgccacgtctccagcgcgccctacatgatcatcttcggcgtggcccaggtcttcttctcccagatccccgacttcgaccagatctcctggctctccatcctcgccgccgccatgtccttcacctactcctccatcggcctccgcctctgcatcgtccaagtcatag

SEQ ID NO: 6260 - DNA, 1274 bp, Triticum aestivum
  unsure (1)..(1274): unsure at all n locations
  Clone ID: PAT_TA_6260
tcctcacgatccctcgatcctccgccccccatcgccattggagatcgtgcgaggagacgagcatagagtgcgtgggccggcggcgatgaaggtcggcaacagcctgagccgccaggtcgtggagctgctggcggagtgggacgccgagttcgtgccccacaagcacctcaagaagcggctcaagctcatcggcctcggcgccgacggcgaggagcggcaggccaagcgggcccgcgtctcggaccccgccggggacggcggcgacggggcggcggcggcgatgacgcccgaggagggcgacttcatgcggctcctggaggccgagctcgacaagttcaattctttcttcgtcgagaaggaggaggagtacatcatccgccagaaggagttgcaggacagggtggcccgggctgccgggatggagtccagggaggagttgctgcgtgtgcacaaggagatcgtcgacttccatggcgagatggtgctgcttgagaattacagcgccctcaactacaccgggctggtgaagattctcaagaagtatgacaagagaactggggctcttatccgtctgcccttcatccaaaatgtgctgcttcagcctttcttcaccactgacctcctgtacaagcttgtgaaggagtgtgaggccatgctcgaccagctcctgccatcaagcaaaccatctgtatcaattgaagagggaaaagaagatggcaacactgcggaccagcatctgaaccccagtttttccttggctaacagcaaatgtattccggagcttgatgagattgagttcatggagagcatgtacatgaagagcacggttgcggcgcttagggcctggaagaggatccgaagcaaaagctccccagtcagtgctttctcgttgcccccctctcaggggaataatgccacccgaagacaggaaaggggtgcgacgaagatatctgtcatgcagcatggctgacaaataagcagacggacactgtgacacacgatatctcttagtcaatcttccttaagctgttcgctggctgtgcaaccaagccctcacctgttttgtttcatgtaatttgtaaaataaatcgattgatacctaatgtaaaatggtggaaatgttcatgtagtgattgttgtaatcatataatgccctcgaaaacctcacaggtgagcctataaggttttattcactactgtgaattaaaaaaaaaaaaattaatatcccctgggccggggacacnantcaagtccttggtacanaaaaaaaaaaa

SEQ ID NO: 6261 - DNA, 545 bp, Triticum aestivum
  Clone ID: PAT_TA_6261
gcgccaccgctctgcgcgtggctcgtcgccgcgggcgcgcacgcggactgcggggcggacgagcagcaccgccagacgcagtgcctcgatgccggctccggcgcgacgttcggcctcgacccccgccccctccccgcgccgccccgcgcgtccgcgcgctctggaatggccatgtctgttgccttgcagcctgaaagggtaattgtcgagaagaagagacctgatgttaaacaaaggagagtggtcgtcactggcatgggtgtagtgacgccactgggtcatgatcctgatgtgttttacaacaaccttcttgacggtcatagtggaataagcgagattgagacgtttgactgctccaagttccccacgagaattgcaggagagatcaaatccttctctaccgaaggttgggttgtacccaagctatctaagcgaatggacaagttcatgctgtatttgataactgctggtaagaaagcattggaaaaatggtgggctcactgaaaaagtcaagaatgacttggataaaaccagatgtggggttc

SEQ ID NO: 6262 - DNA, 744 bp, Triticum aestivum
  Clone ID: PAT_TA_6262
tagcgtggtcgcggccgaggtaccaggaagagacagaattgatgaaaagggagatagaagacctcaagacaaacgcaaaggtttttcaactaagcaagtgcacagcccccgccctcccccttgatcttcctgctgtccatttcatgtgcatgcactcgttccatcttcgctgccttggggacaatgagaaggagtgcccggaatgtgcacctgaatacagatctgttatggaggcaaagcagaagctagaactaaatgccagggatcatgatctcttcttcaggcagttaaggggttcgaaggatggcttttctgtggtagcagactacttcagcaagggcgtagtgagcaaaacgacgattccacctgaaaatgccccatagtgaagagttactgccactgttttgcgttgtacagcttatacatcatgtttattgtgattcaagtgtgcttacggtttccatcagtcactagcatgcgcaggccatgataccgagccttccccatgtactcagttgtgctcactagcctatttgatccatgctctgatctttttggtgtacaatggcgttgtaaatactttgttccagccgcccttttttgctgggtgctggaaataggttgctcggagtgagcttcttccagcaaaaaaaaaaaaaaaaaaaagtatgtgcccttatgttggactgcataagtttcttatggattgcatttttaattgttaaagccggattttattttcaa

SEQ ID NO: 6263 - DNA, 873 bp, Triticum aestivum
  Clone ID: PAT_TA_6263
cttctgccgccccaccaccaccaccaccaccaccttcctcccgccccacccccgacctccactgccttctgccgccggggccgccaagcgccgtgccgtcgtccgacccagccacctccaacacctggcgcaacgcagcgccgccgctcaaccaccagcatccgcgcgtgccgccgtccacaccaacctgcgcgccgccggcgctctgttcatcaccacccaaggcgacctggctacctccaaccgttgccgccctgccgaatccggtgagatccggccgctcgggtgacccggctacctccaaccgccgctgccctgccggatccggcgagatctggccggcccgccatggctcgccccctaccccgacgacctcctactacggaaggcatcaaacaggggcgttcgacggcgacctgctcccggccgactgcaaggacaaaggccgtgtggcctcgcgggtgcagttcgctccacttctcgatggggttcgctagccccggtgctgcagggcgcctcgaggttttcttctccttgggtgcgtgaaggtttgtccgtcgtgcgggcgtgaacatgcagttcaccggggacctacagaagaaagaaaatcattttatttattttcacttttttcttgaatgtgcgagaaaaaatgtaaaggtatgtaaaattgatacagtccgttggtgcactccttgcggctcacgtggctcgtgtttgaagttttttgttgtattttattttttgacctcttttctagaaagagtttgttgaaagcatgatgcagttttcactgttaaaaaaccttggtgttttctttgtaaaaaaaaaaaaaaaaaaaaaaaaaaaaaaaaaaaaaaaaaaaaaaaaaaa

SEQ ID NO: 6264 - DNA, 788 bp, Triticum aestivum
  unsure (1)..(788): unsure at all n locations
  Clone ID: PAT_TA_6264
cggacgcgtgggtgcgtcattgcctagcacccaagaatctgtacaagatgaagaggctgagttcgtagaagattcagccccgattatcacccctataacttcaaggaaggataccgcgactcaaactagtccagatctaagtaggtcttcttcgcccagcgccaggccttcatttgttcgctcattctcaatgcaacaagccaaagagagggagagctgtttctctgatcttgagatcagggatgtgcagatggatgagcgagtgagtcttaccagatggtccaagaaacatgtaacacaagcctctaacaagaattctacaaatatgttagagtggaacaaaaagacggtggactctaaatcttcttcctgggaatcaacagaaacaaaatgcacattaaaggttgagagagaagaacaaaacttactgcttggggaagaatcttcaaaaagcgaaaccgaggctgcaattcagaactagtgatgaaactccaagaagaaacgatcattttccctggacagaattttgaacacctcaagtctgctcaaagaaaacacaagggatgcntgatgcaacaacaacaagccaagacgaacactttgcaggaaggcaaaaagacatcacacgttcaaagaatggcagtaaattctgatggtgttcacttgcatgcttcaatacatcatccactacgagatnggaggcctcacaaggaagtcaganccatcgtagtaagatcagcatctaacgacccntnatttaaaaanagcgtgccgnttacaggacanct

SEQ ID NO: 6265 - DNA, 1338 bp, Triticum aestivum
  Clone ID: PAT_TA_6265
ctctatgcaatttgccagattctgcttcgacgtctgtaggttgtggaactaagaaggataggccttgtgacaagatcgccgctagaacgcaagacagcactgcatgtttaccctctttcttgccagaaacccatgcctagagatgggcaagctgctgaaagtgtcaccaataagagtggtgctgccgtctggagttttattgatctgaatgaagatgcaccaaatgaagataactcagagtcatctgtagtgtcaagtgattgccatgtgacctccttacagaacaagcatgcaaagcctaagtttctgattgatttggaagtgccagcttgcgaagatgatgatgctgctacagctgcagcagagagcattcttgcgttgtcgatggatgtgccagccactgcagagacacctgatgatacgttgcagtggtttgcagagctcgccatatcaagcaccgacgaccatgccgggcaaggggaggtccaaggctgtgccaataattccagtgatgatgatccagattcattcgaatcgttgacactgaagcttgaagacatcaagactggtgggttgtgcagcaggccaccggcgcccgcgataacaacatgtgatgagcagaccgtctcaccggtgaacctcctgatgaagccgaagagaggccagcaaaggaagcgtcggcagaagcgggacttccagaaagacatcctgcctagcatctcgtcgctctgccggcctgagatcatcgaagacatccagctgctggaggggctggttcagacgacgggcggatcctgggagtcgagcttaactaggcgaaggcgtacgaggggtaacaagaagcccaagaaaagggtgctggacgccgtagaagaagaggtccaggtcggcgtagaagaagaagaggtccaggtgagcccgcccgcgaaacctgacgacgcggacatagaaggtgaaagcaacattggcatgatcgggtggggaagaacgacgaggcggtgtcgcaggacgagatgcccttcgggtatcaccgtcgccgccgcatcctgaagaagcgttggtggcgcaattgtgctattcggtgatcatcctgaaatgtgttgtagttggactgggtgtaaaggtgtacatacttgggtggtcaatttggacggcctcccgtgctctttttgggtagaaacttggccgtacaatttatcgatacattcttaaccgaagtagttgatgatgagacattggtgcgtaaacttgttcatctttgaaggggtatagatgaggattccggtttgtctttttttcttcaaaaaaaaaaaaaaaaaaaaaaaaaaaaaaaaaaaa

SEQ ID NO: 6266 - DNA, 1616 bp, Triticum aestivum
  unsure (1)..(1616): unsure at all n locations
  Clone ID: PAT_TA_6266
gcacgcggcgcgtcggctcgagtgtcaaggtcatcgcctagcctcccgccgccgtcgccgacgccgccgccgccacaagcgaacaagagagttaagaagatggctgaagttgaaaccttcctcttcacatccgagtctgtcaacgaggggcaccctgacaagctctgcgaccagatatctgatgctgtgctagatgcatgcctggctgaagaccctgacagcaaggttgcttgtgagacatgcaccaagaccaacatggtcatggttttcggtgagatcactaccaaggccaatgttgactatgagaagattgtgagggatacttgccgtggcatcggttttgtgtccaatgatgtagggcttgatgctgaccactgcaaggtacttgtcaacattgagcagcagtcccctgacatcgcgcagggtgtccatggtcactttacctatgcggcctgaggagattggcgctggtgactcagggccatatgtttggatatgcaactgatgagacccctgagttcatgcccctcagccatgttcttgctaccaagcttggtgctcgtctcactgaggttcgcaagaacgcgacctgcccgtggttgaggcctgatggcaagacccaggtgactgtggagtatcacaatgacaatggtgctatggtccctatacgtgtccacactgtgctcatctccacccagcatgatgagacagtgaccaatgatgagattgctgctgatctgaaggagcatgtgattaagcctgtcatcccagagcagtaccttgatgagaataccatcttccatctcaacccatctggccgctttgtcattggtggacctcacggcgatgctggtctcactggcaggaagatcatcattgacacctatggtggctggggagctcatggtggaggtgctttctctggcaaggacccgaccaaggttgaccgcagtggtgcatatgttgcaaggcaggcggcgaagagcattgtcgccagtggcatcgcccgccgctgcatcgtccaggtgtcttatgctattggcgtgcctgaaccactctcagtgtttgttgacacatacggcacgggcaagatccctgacaaggagatcctcgagattgtcaaggagaactttgacttcaggccaggcatgatcatcatcaaccttgacctcaagaggggcgggaaggggcgctacctcaagacggcggcatacggtcacttcggcagggagggcgcagacttcacctgggaggtggtgaagcccctcaagtgggagaagccttctgcctgagcaaacacttagcgaagtctctgaataaacttagttttacctatcacagcaagtaatatctctattcactgctccagtgctgcaatggtgcaagttttatttttcagtgtctgtgtttagaggtgcttgtattgtcggtgtgctacttgtgttcttatctgctcatgtcatggtaatggtggcgacaagattgaaactgttaaagaaatatgacttacctcaaaaaaaaaaaaaaaaaaaaaaaaaaaaaaaaaaacaaaaaaattnaaanacaacanaaaannnnnnnnnnnnnnnnnnnnnnnnnnnnnnnnnnnnnnnnnn

SEQ ID NO: 6267 - DNA, 461 bp, Triticum aestivum
  unsure (1)..(461): unsure at all n locations
  Clone ID: PAT_TA_6267
catcttcctgaagcggaacggcaccaacttcctcggcaacgtgtggcccggcgacgtctacttcccggacttcatgcacccgcgcgccgccgagttctgggcgcgggagatctccctcttccgccggaccatccccgtcgacgggctgtggatcgacatgaacgagatctccaacttctacaacccggagccgatgaacgcgctcgacgacccgccctaccggatcaacaacaacggcacgcaccgccccatcaataacaagacggtgccggcctccgccgtgcactacggcgggcgtcacccgagtacgacgcgcacaacctcttcgggctcctcgagggccgcgccacgcaccgcgcggctgntgaggganancgggcgccgccccttcgtgctcaagnaagtccaccttcgtcgggtccgggcggtacacggcgcactggactgggcgacaacgccgg

SEQ ID NO: 6268 - DNA, 455 bp, Triticum aestivum
  Clone ID: PAT_TA_6268
aggggtggatccagtcgacggtggtgttgattttgctagcggcgatggtgctcttggccatggcgaccgtgccgctggccagggtgacggtgtccgcggccatggcggtggcaacgttggctgcacatggtgacggcggaggtagcggtgtcaatgtcgtcaggtcgttctcagaggtggacaactagctggggagcaatagttaagaattatgcgacccagcttgcttcacaaccatggtcacagcttgcccagttgtcgccgacgtctgggtcttccagcggcgacaggtgtgcgccttcactctattttactatgatttatttcatctgcaattagtttgttgttgttgttgtctgaatttgtgcattaacttgtctgaattttgattgtttgcactgtcaattaggagatttcaaatttgttattatgcaacaatctatgttaaattttgt

SEQ ID NO: 6269 - DNA, 479 bp, Triticum aestivum
  Clone ID: PAT_TA_6269
aggcgagagaaagccctagactagaaaccacaaatcgatcaaagaactgccaagctcgatcgatcgctgtaacagcagtgccgacacaacatggcgaccagagctgtgtctcttgctctctgtgctctcctcgcactcaccctaggcggtctctcgtgtggatcctgctggaggagtggcggtgaaccggtacccgtgcggcaatgtggttgtcatccacatcccgcacgagtgtgtctgccagcaggaccattgcggcgggctgtgcgtggagcagttcatgtggaagtacccgggcatcaaggccgtcataggcgactgcacggatgagaatacccatgaatgcatctgctcttttctttgctaattgaacttgatgtataagggtattagccaatgttgtgatgttgtttggctcggaagaaataaaacttgccgcgcattcttttcaaaaaaaaaaaaaaaaaaaaaaaaaaaaa

SEQ ID NO: 6270 - DNA, 774 bp, Triticum aestivum
  unsure (1)..(774): unsure at all n locations
  Clone ID: PAT_TA_6270
nnaggtacagtctgacagtggtgcgcctacagagaagattacacttgatttgaacattacagatctgaacacaatggacgaggtgaaactgcgggcgatccttggctcatcattgttgcaagcactggacaagctcagaaacagcaagtccagcgacgactccaacaaggctaaatcaagcctctccgataaaaataaaaacagccaggtgaaaatggagatgaaatccgacatgagcaccaaacataggtgcaattgatagtgttagcaagactgcccctactccagctgctggataagaagaatcctcaacgatccggttgtggagtggagtataccaaccgtaggatgttacagtagtggtagtatcgtcctttctagtagtttatacaaggcatatctgctttgtctcgagtcaaacccttctaactttgaccaagtttatataaaaagtaatatcaacatctatcttctgtacctcggccgcgtccacgcttttttctatatacttggtcgaatttaagagagtttggcttgagacaaagtagatatgtcctataaactgaatagtagcaggtagtggcatacgcataggtgaaagaaaacctatattttgcatgatattttgtgttttggaggaagaaagataggcagtcagtttgctgctctgtatggctggctgtctgaggcagaacagttacctcgtattagtaatgaaaaatcctttctgttacaaaaaaaaaaaaaaaaaaaaaaaaaaaaaaaaaaaaaaaa

SEQ ID NO: 6271 - DNA, 907 bp, Triticum aestivum
  Clone ID: PAT_TA_6271
ccgtcgtgttcgtcgtgatcaccgccggaatcgccatgatcaaactgactagagggcagatcccgatgcccatgctgttccccgacgttcacgggacctgggcgtccatcttcaaactcttcacggccgctccagttcttgtcaccgccttcatttgccactacaatgtgcaccctatccacaacgagctcaaggacccggcccagatcaagccgagcgtgcgggcgtcgctggtgctgtgctccgccgtgtacgtgaccaccagcttcttcgggttcctcctcttcggcgaggaaacgctggacgacgtgctggccaacttcgactcggacctcggcatcccctacggcggcgtcttcaacgacgccgtcagggtcagctacgcgctccacctcatgctcgtcttccccatcgtcttccacgcgctgcgcctcaacatggacggcctcctcttcccctccgcccggccgctggcctgcgacaaccggaggttcgcggcgctcacggtcgcgctcctcgccgtcatcttcctggccgccaacttcatccccaacatctgggacgccttccagttcaccggggccaccgccgccgtctccatcgcctacatcttccccgccggcatggcgctgagggatcgccacggcatcgcgaagaagagggacaaggtcctggcgttgttcatgatcgtgatcgcggcggtgtcgaacggagtggccgtgtacagcgacgcttcctcgttgtgatttggtggcatactggcatggcatgggactggcagcaccggcacggagcggtcgcctacaccatggcgctatgtatgtatattaggttggtgatgagagaccgacttgagtccttccacctataaatgcatgtacatgtaaataaaaaaaaaaaaaaaaaa

SEQ ID NO: 6272 - DNA, 613 bp, Triticum aestivum
  unsure (1)..(613): unsure at all n locations
  Clone ID: PAT_TA_6272
gcccgtccctcccccccccccgccctgggctgccgtcccccgccgccgcccgccacggcgggggcggcgccggccgccggcgccgcctccgcggccgccgccgcctgctgggccgcctacggctgcgccccggacctgctctgccgcgtccgggtgggcgccggggcttgcctgtcggcgcggacgtgggtccgagatgtgccccggcgcggtggcctccgcccgcgccggcccccggcgcgggcccccccccccccgccgccgccgcgcccgcgccctccgccccccccggggggcccgcggcgccccctccacctccccccgctgcggcaccgcgggccgcgcctccggctcccgctccgactgggccggcgcccggccggccgccccgcgggcgcgagctccggcgggtgcgggacggccgggcaggcccccgccccccccggctccccccgcccggccggccccccccgcggctgctcctgctgcagctgcaactgagccggcgcccnnnaggccggccggcagaggcgagcacgnnnatgaggaggacaagcaagcaagcaccatcaccaccagttcaccaccacccagcgtatcatcaccagccgcc

SEQ ID NO: 6273 - DNA, 1380 bp, Triticum aestivum
  unsure (1)..(1380): unsure at all n locations
  Clone ID: PAT_TA_6273
ctccttccccctcctcccccgcgcgcggccatggcgcctctctccaccgccgtccgcctcctgcgctcccccgcggctccgcccgcccgcctcgcaggggcgccagcgcgcgtccgaggcggccgccgcaggctccggtcggtgcgcgcggaggcggccaaggaggcggaggtgggggagctgcaggccggggtgtccgtctacaagccgcgctccggcgaggtgctcgtctccgacgccgctcgctccctcgccgccgccatcgacgacggcaggacccgcctcgagatcgagttcccgcctctgcccagcagcatctcctcctacaaggggtcttcggacgagttcatcgatgccaacgtccagctcgctctcgccgtcgttagggacctcaaaaagctcaaggggactcggtcctgcatagtgtttcctgatcaaccggagaagcgaagggcctcgcagatattcaaaacagctatagatcagatcgagggtatatccatcagttcgttggatgatctgccgaccgggcctgtcgataccttcttcaaatcgatacgaagtacccttgatttcgattttgctgatgacaacgaagatcaatggaagtctgacgaaccgccatcattatatatctttatcaacagcagcacgggtgacctttcatctatagagaagtatgtggaccaatttgctgcctctgtacctgctgttctctttaacctcgaactagataccttgcgttctgacctggggcttctgggattccccccaaaagatttgcattaccggtttctttctcaagttcaccccagtgttttatatcagacagcgtgactactcgaagacaattgcggtccctccttgcgttgcgggcggcggtgccccggtcttccctcgaggccccttggcccggggccttcatgcttagagcgaggcgttggtccgaggcatgtttcgcaagagagtgcatcctccggtcactttnggggcaagccaaaggatgaactattgagagttccccggttttgcnaaaaaaagtaagcagcacttgaatccctccaanaannaggatccaagaatgcactttgtgggaaagaaattttgntttaagggnaatcaaccgccgttggcaacttttaaancaactgctggttcaacctttaaacncatcctgnactgggnaaatgggaatcattngccaaagagtcaaatanatccctnttaaananattcaagaacctgaacnatgaccaacngaaatncagaangaaccacnacaatgtataatcatcaatgtgganatgctgtctgaangcccatcnaatanttctagggaaatccccacnttttggatagtcgatanatntatnatcancc

SEQ ID NO: 6274 - DNA, 1056 bp, Triticum aestivum
  Clone ID: PAT_TA_6274
cccccggccccgggcgccgcccccggcccttctcctgtgcccccgccgccgccccgagccccgccgccgcccgaggcacccgcgctcagtcccgggccggccgcgctctccgccggcgccgcgatgcccgcggcgggggcggccgcggcccagggcggcgtggccgctcacccgagcctgcagtccatgctcgcggcgctcctctacgaccccttactccccgacgtcccgaggaagccctcgctggcggacgtggacacgctcatcaacctcgagctcggcagcgccatgagggtgaccgtcctcaagctggacaacaacctcgttcgatgtcgcggtgttgaacaccagctacgctcaaggatttgaagctggctatcaggaagaagataactgagatagagcagggccagatgggccatcgtcacatcgctgggccgccgtctcggctcatcgtctgcctgactcagctgtgtgtgtcgttgactgaggacggttctgctctttcttcctacgacattcgaaataattccaaggttggtttctcaccgcacgtcatgtcgagagtacatcagaagcattctaggagaaggaaacaccgtttcttccacgggcttagcaggaagatgtgatcccacctcatgatttctgatcaggagatacccttagcgccatgggggagtgattacttgcgaaatgaagaatgctccaagatttagctatggcgacgaaacggggtagaatttcgcagaagcaacccaccgattcgctgatgccattcaggagttgcagaagattgtgcgtttcgagcggccgcccgggcaggtacgtagtgcacgggcacgtcagctaatgtgtgttgtaaattcgaagctactggtttggtcgtgtaatttgccagtgggaagtgcacttcacaatatgttgtaatgcacttcaggttatctatctgcaggcttttgcaggtcagctagctctggtaaactactgactgcttcatttttggttcagaggatcaagtcgtaactctgctcgtttttactcaaaaaaaaaaaa

SEQ ID NO: 6275 - DNA, 581 bp, Triticum aestivum
  Clone ID: PAT_TA_6275
agggtgatcgggcccttgctgcaacctacggtgaacgcgagcagctctgtcatagttgatttcttgaaaggcgataatgaggtaaagagcaagatcagaaacttcgtggatgttcgggacgttgccgatgctctcatcttggtgtatgaaaccccggaggtctctggacgctatatatgcagttcacatgcaaggaaggtctctgatgtcatagacctgctgaagagcatgtatcctgcttacaaatttgccaacaaggttgtccaagtggatgacgaaccctcgtttagttcaaggaagcttgagatgctgggctggaaaaccaagccacttgaagagaccctcagggacagtgtcgaatcatacaaggctgcagctgtcttgagttgaacaaacaatgttgatgtagtttctttcataagcttgagatgccggtggctgattactgtgccgataatgagcacattctggattttgttcattttgtaagtttatgtcagcctcgtttgtctcgagcttcgcttgaataaaatttgactatgcgcatcaaaaaaaaaaaaaaaaaaaaaaaaaaaaaaaaa

SEQ ID NO: 6276 - DNA, 803 bp, Triticum aestivum
  Clone ID: PAT_TA_6276
acagttgctgttcgggacatacaaggacaaggattcccagatgagtactctggagctgctgatgctgtgttcctggacttaccccagccttggctggcaataccgtcagctggtacaatgctacgacaagatggtgttctatgctccttttcaccttgcattgaacaagtacagcgtgcttgcgaaactatgaggtcttgtttcacagatattagaacttttgaaattcttcttcgcacctatgaagtacatgaaggtgctctgaagagtgcaaccgtcaacgaagcctctagcgagggttgttcacttcctgggaagaaacggaaaattcggtcagctggagaagcccggcacggggctcagacatcctctgttattgctaggccttgcagcacagctagaggacacactggctacttgacgtttgcaaggaaaagtgtgcatgggagccaaactggggccactgaagtttgccccacatcttagaccagtaaaaatgcacattggtgcccgaatttttcccatccgaagtatgcgctgttattccttcattcatagtgcacaccgctgcagaattcctctaacctgcactgagttgtaaccatttgcggacgtggtagggagaatattatgccttagggaacaacaaagtgtgaagcaaagtcgtggcgtgatgcggccagtggatctacttgatgaattatgatatggtcgtagccaatgggcatgataccttcagattgttgtgaacggcgttgtagtaactatcgaacttataaatgatttatatatcaaaaaaaaaa

SEQ ID NO: 6277 - DNA, 484 bp, Triticum aestivum
  Clone ID: PAT_TA_6277
aggaattcaggcccgcggagaggagcggcggcaaggtcagcgccgcgtctctgtccaatctctctcttctctccgtcgacaggaaccggagaaaggcgccgccattggcgaccatggagctcagtgccccgccttcctccacctcgcctctgaccccctctgcaccggatccacctagccaagacctctgtggctctgtctcgtcgtccccgagggcgctgcttgcaggtagcccgccaacaagctccggcaccagccctcggtcacctccacggttgccctcaccgtcgtggtgaaaccacaagcgtcgtcaagttcttttggcaaccgagcgcaagctttgattcatgatctctttgccacaatgtttggaatccctactcgcatatcccaggagactgaaaaaagtactctatataaactgtgctaattgaatgcaagcggccaaggtgggactttatttaaaaaaaaaaaaaaaaaaaaa

SEQ ID NO: 6278 - DNA, 911 bp, Triticum aestivum
  Clone ID: PAT_TA_6278
catgatctcaagtttctgtgctggtccaagttccttcgcttaatctctgtacagggtttgaaactccaggagttgcccgatgagattggtgacatgattcacctgcggtacctacgtgttgaatgccctggtctgaagaagctccctcgcagcattagaaggctactcaatctgcagacgctcgacataagcaagaccgctgtcgtggagattcacccgcatttctggaagatcaaaacgctccggcatgtgcttgcagagaagctcacactcccaacatcacttgtgaacgaactggctgagctacagactctgcacggtgtggtggccggtgaagggaaatgggaccaaggaaggtctccgctggacaagatggccaagcttcagtcactggagctgcacgggttcaacgctgctaaccatgggtctgcactggagggtgctctcactaacatgcatctccttgggcacttgaagctggaaggtgatggtatcccctcatgcttgtttaccgggcctgtccttcgatgcctccagactatggagctagatcgcgctgcgaaatggcctgtggtcagatgggatattgttcgcaaggtccgccccaacctggttgggctcaagcttaagaataacagccaagtgccaaaggagttgttggatgaaatggaagcacagaagctgatgctgctttcttgatttctgaatgagcaaaccctcctagcatgtcctgccaattgattctgaacctcactgcaagtaaggcactccttttactctttggctgtccaacaaacagggaataagagttgtggcgaatctgaatggtgttgatttggtgttgatttttacatacgtaacgaacagtatgtatatttgttcttttgaaaaaaaaaaaaaaaaaaaaaaaa

SEQ ID NO: 6279 - DNA, 359 bp, Triticum aestivum
  Clone ID: PAT_TA_6279
cgtgcagctcagcattgaccactgcctcttcaaggcacaatacagtgacattggaacaaaagagtcatatgagcggaactccagaggtgtggagatattctcaaaatgttggtttccggagaaccatcgtatgaaagcaattgtttgtctctgccatggttatggagacacctgtacctttttccttgatgggattgctaggaagattgcttcggctggatatggagtatttgcattggactaccctggttctggtctttccgaaggacttcatggatatattccaagttttgatactcttgtggacgatgtagctgaacattgggctaagatcaaagggaatgctgaatacagagatc

SEQ ID NO: 6280 - DNA, 666 bp, Triticum aestivum
  Clone ID: PAT_TA_6280
ccacgcgtccggttcgtggcttggggaatggcgtcgtttacgaatctctccgtgccacttctcttgctcaccatcctctttcctacactcgcactgtgctatatcaatccagatgccacaagcgtacaccaaaatgccacaaaatcctctgcttcccgtgcttacatcgtgctcgtagagccaccgcgctcgaatgccggcgaagacgcccaccgccagtggcacgagtctttcttgccgacctcgttggcggatgagtccagcgagtcgcgccttctccactcctacacagaggtgttcagcggcttcgccgtgaggctcaccgacgctgagctcgacgctatggctaagaagccagggttcgtgcgtgcattcccggaccgaacgctgcagctcatgaccacccacacgccggaattcctcgggctaaagaacggcaccgggttctggagccgggctggctacgggaagggagtcatcattggactactcgacaccggtctctatgcgaagcacccttcctttgacgaccatggagtttcgccacccccaacaaggtggaagggctcgtgcaaggcggcccggtgcaacaacaagctcatcggtgccaagtcactcattcagggtgatgaatttggtgacgaagaggggcacggcacgcacacc

SEQ ID NO: 6281 - DNA, 1494 bp, Triticum aestivum
  Clone ID: PAT_TA_6281
cagcaatccaatggttcctgcatccgaacttattgttcaagactcaaacttcgtggacgagcgacatggtttcctcctcacaggccccatttggcacactcactgcccgcctcgcggttttactgagagtcgatcgggactcctgacaggtattaattatgtcgaccccattatgtggtctggttcaaactttgaaaagcatgttggtacgaagggaggtaggctcggtaaatattcatgtgaacatcctacctccatgacgtagcgttttcgttggtggctcggtcttttctgctcagtctctgtcatcctccagttctaaatgaactaaattctgccctcagggcaatgtggctgtcccagatctctatgtgaatggccgtcctgactccgtaggagctgatgacctccactctgtcttgcaaggtatataactgatgggttctggaactcatcgtattacatgtcctcctcaaacaaatggcgccacagaattcaggcgttctgatggtacggggttccttgctaatacacgaagctgcatgctgagtggtccagcaagcaggtttccacctcaaagcccctatttcgcctaccaacctgtaggcttcggtgaatccgttgggttcccggaggtcttgcaaggtcaagaagtttctcagacggttcctctgttccaaggaattgtgtctgatacatgttccgcaaaagggggatatgggctgtacaactacatgcgcacctcgtctgccatgaacggagggttttcatctgcagctcaggggtatcctctctccctgtctactccgccgccagcagaggcggcttcgccctcatccgcagcggttccaccacagctttggctggcaagcaagagcaacgaagaagctgcgaatggcagccagcttaaccaatttggaattccaaagtctcctggtgatggcgctgctaagcttgggtctgatggaaggaaggttgccagaacgagttgcatgcttttcgggttttccttgactgagaagatgttgccaacggaagaagactgtgccaaggaagggagccatgaagccgactgtcagaatccgcggatgctagacttgtttggatacaaccgcgctacccccggcgctcttcatgccctctgcgccgctcccctgggaatatgatgccactccaattccagtatgatccaagtactttgcagtgctctttctaagaaactttaataatcagtctgcgcattcagggaccttcggtgaatatgcatgtgagcatgcagctgccactccttgcatcaccccagggacagtcagcattttccctcggtcgttctagtcccagccgtattcctgatgcacactacttgtcgttctagtccatccaatcctacagccctatatgtattttagactattttatgtgtgtcgcttctgtatctgtatcgaaccttcatttgctatctccttggacatgcctgtatcaccgctagtactt

SEQ ID NO: 6282 - DNA, 982 bp, Triticum aestivum
  Clone ID: PAT_TA_6282
cctcggtgccatgttgcgccctcttccccatcgccgccggccaccatccccacactttctctcccttttcccgtggatccatctcttccatggacgcctcccacaccgtctcctccttcccccatctcatcactagggaagaaaaaggcaagcgagagggagatcggccgtgtaggtcagatccatccgccacgacctcgacggagatggccaagtggatggagcggacctgcaaatcgtcaagccaagggcagcagggctccatccttgttctcttctccatgggggtcacgcacagggctccacctacaagtgaagagaagaccactgctcctccgggtctgctccttcctactcctcaaggtccctctctccctctcatgctctgcttgaattaatggcgttaggtgtcacaaccaaactgaaacttttttatcttcagagaggagaaaactgaatctttaattaggttagcttgcacctgctgctgcttttttatattcatttatttatcagaaatagtaatttacattgaagttttttttaattattcacagacacttatttatgcattgttcttcctgtatataatagatgttttatttttagttgttcaggttctcattgtatgtttatccactgtataatgtaggagtgcaatacttagagctgaattttacttaaatgagatgcaatcgcgttttttattttacaaataacactaatctaatctaccttaattagatcagctatgtttatggcaaaccttcttagaaagcaagaaatgccaattcttgtttatgtggttcggcactctttcattgttctgtaactaccctgtgtcatgaattcagttatacactgctataggatagatagcctggaccacaaaaggcgtggcattgatttagtggcagctgagctgctgataaagggcatgggtgaacaaatgaaggtgactgagattttgaaatgaagttaa

SEQ ID NO: 6283 - DNA, 566 bp, Triticum aestivum
  Clone ID: PAT_TA_6283
ttctacgtgtttccaggcaaaaatgcatgcacgtacaaatattttggagggcttggtttgcatgatacacacgaaggttcatgttcattaatagatgatcaaggcattaaggagaaggttgcagatttcctatttctattcttcccacacaaagagaagttccaggcagaagcgagcaggacgtgtgatgcatggcgtttactttccttgaaagaagtcggttggggtccacctgaagatcgagatgcactagaagatgcatggcgcaccaatccaattagagtccataatcatcccgatgctagagtccaaattaggttaaagtttccttttattttattgtttggccgtgtaagtcgtatagggatatatttgtttcttttagacttgttataacgtgtgtgcgagagggcaataggccaattagtgtccggctattatatatagctatggggcgttcattctacgggcaggtgatatttttatgaaatagacacgatgtgtttttcagggtagacacccgtatcaagttttggaggacctttaaaaaaaaaaaaaaaaaaaaa

SEQ ID NO: 6284 - DNA, 842 bp, Triticum aestivum
  Clone ID: PAT_TA_6284
ctgacgagtgctgccagcgtcctgactcgggactgggctcagggctctcaacaacttgcaaagcatttgtatgacatcaaagttcaaccgtcaacgttgcttccaaaacaaattggtaacatgtatactgcatctctgtatgctgcattggcatctgtaatctacaacaagcatgctagtctgaccggccaacgaattgtcatgttctcttatggcagtggcttgacatccactatgttttcattcaaactaaatgagggtcaacatccctttaatttagcaaacattgcttctgtgcttgatgtgacggcaaagcttgaatcaagacatgtgacttcacctgagaagttcattgacacactgaagctgatggagcaccgatatggagcaaaagattttgaaacaagcaaagacataagcttgttgccaccaggaacgttctaccttacaaaagttgattcaatgtacaggaggttctatgaaaagaaaaccgatggcattgttgacggcaaaatcaagtgcagcaatggcattgcaaatggtcactagtggcatatcatcagatactgttagttcaccttgcattttattagccatcatccgtacaatttgttgtatttatctctagaattcccagtttagctcagtttcaaataagccattattctctaaagttgtttcccccacactcttcagcttattttttgtgttgagctgaactgaaaccttcgtgtagtacaagcattcttgttttcctctagcttgctcctttgatttgattgttttgttgctattgaccacttactgttctgtatattatcaatgaattgggcagtaggcat

SEQ ID NO: 6285 - DNA, 547 bp, Triticum aestivum
  Clone ID: PAT_TA_6285
tcatcattggccagcgtgccattttactcggctaaaaatggcacactgggcgtatttgcggagtaccaacagcctttgcggcagcagcttccatcagatccgaagcggctggaaagctatgccgatctgcagaagaggaacggaatagagctcatctcagggttcctgcagcagcagcccgggaaagccgcgcggctcgggggtgctgggatcctcgtgagccccgtgtcggacccggtggcggccctcaaggcgcagtacggctcgagctcgaagttcctgggcaaggacgccgaccacccctggaaagacataggaaacaggtagcagcagcaggcaccagtagtagcattaggcgggcaaatagtgcatgcttttcttttgctctctccctgtaccatatttagtttttgtaacttgggatggaaggaactgaaacaacagcagggaaagcgaatggctttcctgtccatatcgtcgtagggctttcttttgtcgtgggattaactcttttctgcagctccgtcgtcatacttaataaaaaaaa

SEQ ID NO: 6286 - DNA, 753 bp, Triticum aestivum
  Clone ID: PAT_TA_6286
cgtgagcgccctccaagcaggagcggcagcctcccgtctcgcgaccctgttcggctcgctgccatgccggatgccgaagtaggtgcgcagctcgcacgtccacccggcacggtcgcggcgcgccccagcgcccccctcgtccccatgcgcgccccccaagccgggccgcaacccccccgggtcccccccccgccgcaggcgctcccccggccgctcccccagctctggagcactcccgccgggacccgcaccccgcaccagctggtctgcgcgtacgtaccagctggcaattgtatagattctgccgtctatctgtctgactaactcccgtcgcctccgctctccacatcctacgttaggtactgaaccccgtagatagcttttccgcccaggtttagaacgtcgctgcaaatactacgcatgaaaaatgagatacctccttgtgttttttctcgctgaactgctgctatgttggccactttgtcaccgacaaggaattatctcctaggcgacccatcttgttattgtgtacatttgcttaaggttttgctttatctatggtacgcaattcatgggtcggctatcaatggtcgcctgttggctgttgctggagaagatgaaggagaaaaattccaggaggcttagtatgacatttgttaagcagagacatactataatgtatccaagactcgtctcttttgtctaatgatcttcaatcttttccttggtgaaaaaaaaaaaaaaaaaaaaaac

SEQ ID NO: 6287 - DNA, 989 bp, Triticum aestivum
  unsure (1)..(989): unsure at all n locations
  Clone ID: PAT_TA_6287
ctgacatcatggaacaggaggttggtgtgctgctgtctcggctgagatacatacagtcaaccctcttccacacccatgtcacgtacctcgagttcctggacagggtgcactcctccgagctcaagctcagggcccagggcctctgggaggttccacacccatggctcaacctcctcatcccgagaagcaccatccaccggttcgcgacggaggtcttcggcaacatcctcaaagacagcaacaatggccccatcctcctctacccagtgaacagatcaaagtgggacaacaggacgtcagtggtgataccggaggaagaaatcttctacctggtggggttcctgtcgtcggcaccgtcggcgtcaggccacggcagcgtcgaccacgcggtgagcctcaacgacaagatcctagacttctgcgacaaggccggcgtcgggatgaagcagtacctagcgccctacaccacgcagcagcagtggaaagcccacttcggggcgaggtgggagacatttgagcggaggaaacacatgtatgatcccctagcaatcctagccccaggacagagaatatttgcaaaggcgtcgctgcccatgtcctcttgacaaacagcatccgccatgtaaaggcctttctaaagcatatggtgtacataaatgtaggaaatgtcccctgtaaagacaagatctgccgaaaaaggcggcctgaagaacacgcagcatagcaactagtagtagtgggacggaggtacctcaacgaacacttcagagtagagcagcctgacctttagctctgggtgtagagggtgtgactttggaggcaatcatgcgttccaggattatactggttcgagtaacgacacaagcccaccagctgttgttcgttacagcgtagagcagagttgtgtaatagctagctaaccagtggaactcatgtagaattgtttgtgttcattcagtcaataaggcagagagnactcagggtagaac

SEQ ID NO: 6288 - DNA, 923 bp, Triticum aestivum
  unsure (1)..(923): unsure at all n locations
  Clone ID: PAT_TA_6288
tcacaatcggttcggtgatggtctccggggatcggctggctgccgacgattccttctcccatggtgtggtacttgacacgaagcaaaatctgctgaatgtcagctacgatataggctattatgctccagctgatgattgggtgcgtcctacgaatgggtcgtactcgttctcatatagccctgagacacggcgacgaatctcagcagagggtgtttatgatcctgagagcggcatactgtgcatggtcggttgccgagagcacaacggctcgaccgactgtcaaacactgggtaaccgtgaagttcgcctcccttgatgccaggggtcaggggcacggcaggggggtaatcagcagcctcagagacaagtccgatcgtcttttcttcaagaaggtcgacatcactctgtacgggatgtactcagaccaagtgtcggaggcgatatctaggatggacttggaaggcatcatgctggtggcgtccacgacgctgtcgtgcgtcttcaccgtcctgcagatcctccgtaccaagaagaaccccgaggcggctccggcgacgtcgatcaccatgctcgccatcctcacgctgggatacctcactcctctcgtgctcaacttcgacgccctgttcacgagcaggaggagccggtactccgtgtactggatgagcgactggcgcgaggtgaacgagtggtatgagggcgcccacgctggtcgccttcgtgctgcagctgcgcctccttcagctcgtgtggtccggccgccggaagtcggcggaccaaacaagtcgccacccgtccccgtcgtgtcgagagatnctgctgcaaatatcctgccgctttacgtnctcggaggagcctggccgcggcgtcacgtgtttatcgccccgcgccaggccctccccgccggccccancccccgcat

SEQ ID NO: 6289 - DNA, 677 bp, Triticum aestivum
  Clone ID: PAT_TA_6289
cggctgtgctgtgcggcgcggcgcggagactgggaggtgccccggccatctgagactgtggattaagttttgctgagcgacgaggcagtgaaagttgaagttgccccagccgttctgcccatggtgataagctacctgagcgacatccccgtggttcttcatgcaatcggcggcgaggattgtccggtggacatcggtctgtgactttacctgccgccttgccgcacgtgaccagcggcagctcgtctggccggagggctgcccgtgagtgtcgctccggcctcggcgggcaagcctgtcgtgttagtgtgggacagactcctagcgctactgtgcccggctgcgttctccccgccctctggcctccttagggtcgtggggtctcctggccttcccgttctccccgtcgccgcctccccccgcgggcctcaaaatgttcgtgtggtcaagtggcctaactttttgctccgaggccgcctgtccaggcgactcatattccccctgctgttgtgtttgtccggtggggtattccctggtgcctcctttacttcttgtacagttagggtgatccctcctgcgctctgtccgccggtgggtgcccgcgctattctggcccaaattaaaaggaagggacacctcagctaagctctgtccaaaaaaaaaaaacaaacttgttc

SEQ ID NO: 6290 - DNA, 460 bp, Triticum aestivum
  Clone ID: PAT_TA_6290
tagcgtggtcgcggccgaggtaccatattggaagttcatgagaagcttccgtcaccctttttctgttggaatgaggtttaaaatgaaatacgaaaatgaagatgcttcagaaagaaggtcaactgggatgataactgggagcagagagtcagacctgaagtcgcatggttcgaagtggaaatgtttggtggtgagatgggatgatgatgtagagtgccgtcgccttaatagggtatctccttgggagattgaacttgctggatcggtttcgggatctcatctgtcctctccccattcaaaacggctgaagccatgcctcccccaagttaatccagacatgttgcttccaagtggaagtgtttcttcggattttgcggaatctgccagattccacaaggtcttgcaaggtcaagaattattgggttctaaagcccatgatggtacctgcccgggcggccgc

SEQ ID NO: 6291 - DNA, 724 bp, Triticum aestivum
  unsure (1)..(724): unsure at all n locations
  Clone ID: PAT_TA_6291
tgtcaaagctgactgtagtaagaactatgctgttgcacctgaagcggtgacagaggccatttccattgacttgtcatctggcttgataccattcttcatctgtgcaacagtaggcacaacatcttcatcggccgtggaccccttgcctgaactaggaaacatagcacagggccatgacatgtggttccacattgatgctgcatatgctggaagtgcttgtatatgcccagagtatcgacatcatcttgatggagtggaaaaagctgattcattcaatatgaatgcacacaaatggttcctcacaaacttcgactgttctttgctatgggttaaggacaggagttatcttgtggaagcattgtctacaaatccagagtttcttaagaataaggcttcccaagcaaattctgttgttgatttcaaggattggcaaattccacttggtcgtcgttttagtgcacgccagccatcgttggtctcgaggcgttggcgcctgcaaagtctgcagtgtcacccctgctggcccagtcacgtggcccgacagttcggactcctggtcccagctgccgctccatctctgctggtgtcgccggggctgttttcccttgcttctttccgccgtctgnccccaacttctgagggatganggggggncncnacttaactatgacctaaagggtgcccgccaactcaagtgggaagatcntcaacccaanaaaccggt

SEQ ID NO: 6292 - DNA, 435 bp, Triticum aestivum
  Clone ID: PAT_TA_6292
tatgatttcttatgggttgctgaagtacggcatgaagatgaagtgttacaatggcagccagctatgggatacagctttgacagttcaggctatatttgctaccggcctcacaaaagagtttggccatacaattaaagtcgctcatgactatatcaaacattcccagattcgtgcggactgccctggagaccaaagcaagtgggggcgccatctatcaaaaggtggatggacacactcaactgctgaccaacggtggcctgtatcagattgtactgcagaagcatttaaggttttgttgttgttaactaaggttcctgaactggttgatgagcctatagaaacaagcacacttgatgatgcagtcaacattctactatctttgatgaatgacgatggcagttttggtgcatatgagctaacaatatcttatgaatg

SEQ ID NO: 6293 - DNA, 668 bp, Triticum aestivum
  Clone ID: PAT_TA_6293
gggcccccccgtcgccggccacccgggaggcgctgtaccgcggcatgctccgcggccgctccatgctcaggaccgcctgctcctactaagctgccggcgtcaattaacccccgccgtttaatccatcccatccccgtcttagtccggccgaagctgccagtgcctttcgcgtttcttgttcattagcgtcgccgctgattgggagatttttgtaattagtgagcatcccgtacgctacgcgcgagcgatctgtgtggtgcgtcctattgctggttccactccttggcctcccgcgcgcctccgcccccgcttcccccccgccgaggtgccgaagcgggtccaggcgcggcgcggccgcgcgttgcgcgtccgcttcgccgccgtcgtcgttgtccccggccctccccgtccggcgccggaggaggaggcaggcgcccgagccgtcctgcaggggcgccgcgatgccggcgaatcgggaggcgctgtaccgcggaatgctccgcggccgctccatgctcaggaccgcctgctcctactaagcaaccggcgtcaattaacctcgccgtttaatccttactacatccattccatccccgtcttagtccgtccgaagctgccagtgcctttcgcatttcttgttcattaacgtccgtcgcctgattgggaaa

SEQ ID NO: 6294 - DNA, 669 bp, Triticum aestivum
  Clone ID: PAT_TA_6294
ccgcggcggtacgccgcgtaggggatacggactgcagcccccccccgcgggtggcggccagcgcagccgcggcgatggccggtgttcatcacaggccccgtacagctgggcgtccttagcctcccgcgtggccgcgggcggcagtcgagttactgccaatggcgacgcccagccaggtaaggcacatggctgtcgacgatggagctgtcttccaccgaccacctgagcagtctggaccaccagggacgcctggggaaacccgtatccgccgggaacacccgttggaagattctggggcggctctgtctgtcatgacctccagtcgtggcctaacaggaagtagctacactaccccgaggggacactgtgtactgaaaggcttgtgtgcttgcgacagctcgctcccgtccgcaaggttctgtgccccacggcggcctcgcaacgggcggggccgccgagacgcaggcctgcaagcaggcgctgcacgcccgcgtgggcgtgctgcggcccccacagcaagcccacctggccgcggtcagcgccgataggcatatgtgtgtggcggatggtgatgctgagccgtaagcatctgagcaggctggactctcagggttaggattggagctgctgctccaggaaggcaccttgccctgggcgaaccacactttt

SEQ ID NO: 6295 - DNA, 1214 bp, Triticum aestivum
  Clone ID: PAT_TA_6295
acgaggttcctctcctgcttccgcggccgccccgacccggccgtccgggccctccacgatccgctcgtgcgcaagacccggctcggggatgccttcctggacgaccaccacgacgacggcacggcgaagcttgaggagagcgggacgcccaaggagggtcccggtaacgacggaggggtcgacgacgacctcaggcgagaggcaaattatcttaaatcttgtggcgcaatatcagatacccctcccgaaattctgaaagcatcaaaccaagtcgaagagcaagaaattaatgagtgcaatgagacgtccaacaatgcacaggagactaaagaggccctggtgtctgaaaataaggattacttgtctgaagggttcaactccgacgggcacgatggagctttgaagcatgaccaggacaccgacgaaggcactgacgaccatgtcacggaggttgaatcagcgccgagatcatcatcgcaggaaaggtcttcagcccagatcatcaggaaccagaatcctgatcctagcgactcgcctttccccactcctctggtccttagagacgatatccagactcctggattcaccacacaccaggggaacttcaagcccgggaagcgcgggagggccagcaagcaatttgtataccccgtcctgagacccatcgagaacaagctgcagtggacggagctgagagacgtgccctcccccgtggccgccgctctcccccccgacagcgggtacctccccgccccgtccccccccaagccccggcaccgcacccggcccccctccgccaccgccagctccgagctggccccgggggcggccccgcttccctccccgtccggcgggaggctgctgcaggctctggccgatgagaaaccacaccatcagaggaagatcagtggaaagctgatccacctggaggaggacgcgatagagagcccggcaagtgcgactgcttcctcgtgatcggcagtacgagagggtccagtgtttggccaatccggcccgagccacctctagctgcatcagtgtctgaagctctctgaaactgaactagtgctactacattcttgtccgctgaagcattttgcttgcgcctcagtgcaacttttgcacatcacctgctggttgatgtgatgctgggtatattcatcaataatgaaaataagagactctgcttcggtttaaaaaaaaaaaaaaaaaaa

SEQ ID NO: 6296 - DNA, 613 bp, Triticum aestivum
  Clone ID: PAT_TA_6296
cccgcccgcccgcggcggcgacttcgagtaggcgcccatcgtgcagacgccgtcgtcgacacctcccccgccggctcaacgctccaggtgctcggccgcgccctgaacacaggatcatcgactcctctcccaccctcatcgcaactgtagccgacgctgacggcgctcattatatcacctgggaggacctgggagtgccgcacggcggtgtaggcgtgcagctactctccgaccccgtgcggcgaccgtccataacttgccgcagcgctgggagcggatgaggtcacaccgcgcgcaggattggggcggtggtcggacttggatctggcgagattgatgtggttgtgtcctgtgcctcccggacgtccggatactttcccatccctcctgtgaagatgccagtgtatggattgtcagacttgttccaaatctgcacctttaatgtctcactctgagcgaatcaaggatcaggtgacatagtttctactgaagcactgtacaagtcaaaccgatgcttattgctcttgtgactgaactatatattgagttaatccttgacaagatgctgttgcggatgttgatgtgaatcaggatggaaaattgatagagcaga

SEQ ID NO: 6297 - DNA, 681 bp, Triticum aestivum
  Clone ID: PAT_TA_6297
ggcgggttgctcaaaaaaaacacctctccacggtgcgcttctgcctcctgctccccccccccgcccccagcccacgaacgtcggggaagggaagcggcgcggcgcagcggaaggcgacacatgggcaggaggagacgatgcagtggtacttcgtggcggcgctcctcaccgtcctcaccagctcgcagggtatatggaccacgctctctcagagcaatggcaagtataagtatgactatgcgaccattccatttctcgcagaattcttcaagttgtcagtctcgagcttctttctttggaaagaatgccagtcttcatcaccaccaaggatgacaaaggagtggaaaagtgtgcgactatatcttgttccttcagtcatatacctcatccacaacaatgtgcagtttgcgaccttgacttatgttgatccatcgacctatcagatattggggaacctgaaaattgttacaactggaattttgttcaggcttgtcttaaagaggaaattatcaaatctaccatggatggccattattttacttgctgtgggcactactacaagccaggtcaagggatgtggagatgcaccatgtgattcggttttctcagcaccattccagggttacatgcttgggatactttctgcttgtctttctgcactagctggagtctacactgagt

SEQ ID NO: 6298 - DNA, 780 bp, Triticum aestivum
  Clone ID: PAT_TA_6298
aacacaaggcgcacacccggcaccaaattgcccgttcatgtgcaccgcactcgcatccaagccttcattctccacaatccacactgcacccgcccgcgcgcccgccggcgcgcccgccgtcctccgcgccgtgacccagcggcgcttcacggccatggacccaccgctgagccagcagcccacgctgctggcgctgtcgctgctcctcctggccctctacctggcgcgccgcgccctgctcggcaagcgacggaactacccgcccgtggccggcaccatgctccaccagctcttcaacttcggccgcctggccgagtaccagacggagctctcgcagaggtaccgcaccttccggatgctcaccccgacctgcaactacgtgtacaccgtggagcccgccaacgtcgagtacatcctccgcaccaacttcgccaactacggcaaggggaccatgacccacgacgtgctggaggacctcctcggcgacggcatcttcaacgtcgacggcgccatgtggcggcaccagcgcaaggtcgccagcttcgagttctccacccgggtgctccgcgagtacagcagcggcgtgttccgcgacacggccgccgagctagcgggcatcgtggccgcccccgccgccgctcggggagagggtcgacatgcacgacctgttcatgcggtcgacgctggactcgatcttccgaatccgggttcggggccagcctggggcgggctgtcccagtccagccaggagagcgcggcgttcgcccgggcgttcgacga

SEQ ID NO: 6299 - DNA, 727 bp, Triticum aestivum
  Clone ID: PAT_TA_6299
ggcgcgcgggccttcccgcactggcggccgccgagccggacgcggccgccgccggggagcgtccccccgtccgggcgcccgctcgcccgcccgcctgccatgggtgccgctcccctgagttccagatgctgctaaatcagatccggggcaaggcggtggtgttcaccggccactccctcggtggagccatcgccgctcttgcggcgctgcactacctctgcatctcatcgttaagctcgccatgcagtccgtctcctcctgtgctgtgtgtcacattcgggagcccactgctcggcaacggggccctgtccagggccatcctgcgcgagcggtggggcggcaacttctgtaatgtcgtctcacagcacgacgtcgtcccgaggctcctcttctgccccctagacgctgtccctgtgcgcgtcatcatcggtatgcagctgcagcaatggccaggacacactcaccacacgggcgtaatgaccactcgtgttgtggacgccgagcaggaggggctgcgtcaactgatacaggcgcatgtccgcacggtggccatggagcagaagctcgtggacccagagtcgcgaggcgggagcccttaccgtccgttcggggcctacgtgctgtgctcgccggaaggcgcagcgtgcgttgacaactcaacagctgcagtccagatgctctatgccacattcgccgcctgctacacgcggggcgacacgacatccct

SEQ ID NO: 6300 - DNA, 675 bp, Triticum aestivum
  unsure (1)..(675): unsure at all n locations
  Clone ID: PAT_TA_6300
tttnganccgntaagctctttngaccccttnagctcgaaattaaccctcactaaagggaacaaaagctggagctccaccgcggtggcggccgctctagaactagtggatcccccgggctgcaggaattcggcgcggcttccccttccccacagacttccgacccacgccaccgccgatgcccacccgctgctagtctagtccagtcgtcgagaggctcggagcgatgggcgagatggagtcgacctcgccgccgccgggaggcgcgggcggcgccgtgctgcaggtggtgttcgtggacggcgagcggagcgtggacctgggcacggtcaccgtgcagccgtcgctgggcgtgcggaagctgcaggcggtcgtggcggaccgcgtcggcgtcgccccgcagcagatctcggcgtccctggcccggccgcggcgccagcgccgcgtgccgctcgacgagggcgccgacctcgccgccgccgtggcccgcgagggcgccggctgctacgtcctcgccgggctccgccgctcgcgccgcgaccgccgcgggggccgctccaggcgcgacaggaagggcgcgggcgcgggggcggggcctcagcagccgctgctgatggcgcccacgatggcctcggagcggaccatcctcaagcgccgcccgttgaccgatctggcgt

SEQ ID NO: 6301 - DNA, 626 bp, Triticum aestivum
  Clone ID: PAT_TA_6301
gtctcctcgcctcgccctcatccgctcgcccgccattgtcgctcctcgtcgctcgccgttctcggtcctcgcctgctcgtctcgccctcctccgcttgtttccgtcatggctcctcgcactgctgctgttgcgtttggctaggggctgctgcgtctggtttgctctccgcttgtgcgtctatttaatcctcctctgtgaggtcctcctttccgacgtctgcctgcccgatcaactgatctcctcgctcctggttcgtggaaggcctgctgcagtttggttcacctcacgccccgcgccttgtctttcatcttgccaagatgtcgaacaaaaggatcagccttctctcgcagatccatgagaaagtgctcttctggaatgctaaggttctcgtgtctcgcatctggcacttccgaggtgggactgatgagggtaacattgtgcacactgacttagtggtgcttgaccaagagggcacccacatgtatggccagattcctcctgagccatcggagcggctgaaagatgtcttggtggaaggcaatgtttatctgatgaagggattcatgtgtaaacaagcaaagcagacttacagggctgttgatagcccatacatgatgcaattcac

SEQ ID NO: 6302 - DNA, 945 bp, Triticum aestivum
  Clone ID: PAT_TA_6302
cggccgcgccggcccgcctcgtgggctcctccgcggggctcggggccccctcgcgccgggtgcggcgcgccggtcgacgtcgctccctggcccgcgttgatccccgcgctggtgcccgtaccgcccccggtccgcccggttccgcggcgctgcccccctccggcgtgggggccggtggcgcgcggcccgccggctgcgctagacctcgggtggtgctcctcccagggggctgcggcgcgagggccgtttcgcctcggtggccgcccccttgcgttcggctgccgggggtcctgctccgtcgacgcgcccccggggcgaggaagcagacggcgacgacaactttgaggccggcgggggcaccgtctccgcgttcgatggtcgtggtgaacgccgtgggctccaacacggccgccattggctctatcccctacagggcattactcaactgagctgatgaagtaagaggaatccagaggtgtgggatttccactgtgtatcattttaagcatggttggccgcatcgttggctcctcttgaaagcacatgtactacttgcaccaagagcaagaatttaacagtagaaaagccgtatcaactatatgtatgccccaatgcgatcaacaaaaaattatgctcgcaattacctagcgcgggcactgtgtcatttgggaaggatgctcaagattaggaatgtcaccaagaggggctcggttagagttatcaccaagaggggatcagcacagatttgtcgcctccatattttcaagcgtcctggtctgtcggcgcttgtaacgaaataaaataaaccattattatttctgtgaactatacacattaaatatatactgggacaaaatccaactttgaagcatgcgatcaggttaggcgagataatctacatctgcaatattagattagtacattgtcaaaaaaaaaaaaaaaaaa

SEQ ID NO: 6303 - DNA, 845 bp, Triticum aestivum
  unsure (1)..(845): unsure at all n locations
  Clone ID: PAT_TA_6303
gcacgaggcccatttccaatccccccacacttcctctctctctcccccgcccctcgccgtcgccggagagagagagagagagggacgcggccgcgggagaagaaggagggaagatgatgatgacacgggcctccatgggggccatggagggcgcggcgctggacgaggtggtgcggcgattggtcgagggcggccgcggcgggcggcaggtgcagctgtccgaggcggagatccggcagctctgcgtcgacgccaagcgggttttcctgtcccagccgaacctcctccgcatccaggcccccgtcaagatctgcggtgatatccatggtcagtttgttgatcttctgaggttgtttgatttgggtggttatcctccaacctcaacctatgtattcctcggagactacgtagatagaggcaaacagagcttggaaactatatgcttactgctggcctacaaaataaggtaccctgacaaggttttcctgttaaggggtaaccatgaagatgcaaaaatcaacagagtttatggtttctatgatgaatgcaagaggaggttcaatgttcgactgtggaagatattctctgattgcttcaactgcctgcctattgcagcactcattgacgacaagatactctgcatgcatggtgccctcaccccacaactggctaaataaacaaattaaagggacactgatgggaatccggcatcgcctcatgtttgcctgctcggcccacccacgctgcaggggtggggagatgcaaagcgttggttcgcgggggttctctaaaattctttacgcnccacagngnaaaggtaattttccaggattccaactcaccaa

SEQ ID NO: 6304 - DNA, 845 bp, Triticum aestivum
  Clone ID: PAT_TA_6304
gacccacgcgtccgctgctgaatcaccctatgctgatcacaaactgcagctggctcaaaggcctaaggagttgcttgacagtacaacacttgtggaatcatccatcactaatgctgcttcttcctctctgccacagtcaccatcgtgtgaggtgccagatatcttggaattggagctcaacacctccccccccttgtcttcatgtgtcttttcattgacgcctactggtctacttattaaatattttgtcagagttgataaggagggacgttttcatacatatcctgatcgcggtggggaccctttcagagtttgcatgaagctcaacaagctattgactcacatcatgtcggtgggcgaaataacttgtgcatggatggactttcatctagggagaagtccgtgcggtatgctttatactggcctcatgatggcacaagaagaaattctgcagcagcctttgctgccatgaagacccgtcgccctaaacaggaagttgttaaagctctactggacaagtacaacgaggacaatgatctttttgggggatcttgcatatcgactagaagaaatagtgagatataaaccatgttttgacgggaaagactgtgattataggtcatattcacatttgaatatgaccataaagactaaaggagccgatgatccccgcaagaagctgtattttgctgaagtcacttgtatgagaggcgaacatgaagagtatgtgctcacctgtatctgcgcagttgaacctgatgccaatggtgaatgccttgtgtgtggagatcaaatgaagcaccccattgatgctaaatacaaccatggtcgctccacgccaatct

SEQ ID NO: 6305 - DNA, 495 bp, Triticum aestivum
  unsure (1)..(495): unsure at all n locations
  Clone ID: PAT_TA_6305
ctcgagtttttttttttttttttttttttttgaaatattatatttcatttgtaattttttgaactgttttttgtgcttatacatcccacaagcagttaagcaggcaacaatccgaaggccaaatcggcagagcactaagagcagccgtacaaaccggccagtcgtccaattctcaattctttaacttagctgacgcctgacggcgcgggccgatgactccaaccctcaaactggccggtgggaggagcaagaatatagaaaacaattatgcttcttccctgctcggctactcccggcctagctgcggcaacgacggtggcggcggcgccccagccgacggcaccacctggcccctgcagggcaccagccaccagcaagcatgccgtcccctcacgccggaatcttccccacccaccctgtcctctcccgccctcgccgggctccnaanaaacctcgtngaccaattaaagnanccgncaagcncaagggaaaaan

SEQ ID NO: 6306 - DNA, 644 bp, Triticum aestivum
  Clone ID: PAT_TA_6306
tgcaggcccttcagatagcaacttccagggcaacagcagcaacagttgtcacaagtgcagcaacaacaacagtttgcgcaaaatcagaccactgagcagcagcaacatcctagtaatgcccaatagtccaatttccagaaacaaaacaactcatcagcagcgcagacacagaagaaaaacaagcctgttgggaagccaaaacaaaatctcagtaaggacaaagggaattcttcgactgaatatgtggatgtcatctgttacagctgtggggagcctggacatcacaaacccagtgccctaagcctccatcttgctttatctgcaagatggtgacccataaagtagaggaatgcccagtttggaagaagcctagaactcctgcaaagtttgttggcagtggtgctcctagtttgggatactaccaggtggatgtgcctcatgttaatgaccagcacatggggcactgaagaatgtgggcattgtgtatgttgagtctgggcaagtgagcaaatctgagctagcacacaacctatctctcatatataaaactaactggtgaaggaaatatgccctagaggcaataataaagttattattcatttccttaaaaaaaaaaaaaaaaaaaaaaaaaaaaaaaaaaaaaa

SEQ ID NO: 6307 - DNA, 700 bp, Triticum aestivum
  unsure (1)..(700): unsure at all n locations
  Clone ID: PAT_TA_6307
cccacctccccaacccgacactccaacccctaccgagaggtgcacgaggaggccgcccaccaccaccaccaccaccacccaccatggccatggcgacggcgctccgcaagctctccgcccgcggccagcccctctcccgcctcacgccgctctactccatggcgtctctgccggcgacggaggagagatccgcagtcacctggcccaagcagttgaacgcgccgctggaggaggtcgaccccgagattgccgacatcatcgagctcgagaaggcccgccaatggaaggggctggagctcatcccgtcggagaacttcacctccctctcggtgatgcaggcggtgggatccgtcatgaccaacaagtacagcgaggggtaccccggcgcgagatactacggtggaaacgaatacattgatatggccgagacgctgtgccagaaacgtgctttggaggctttcaatttggacccagagaagtggggagtgaatgtgcaacctctatcgggttcacctgccaacttccatgtatacactgctctgctgaagccacatgatagaattatggctctggatcttcctcacggtggacatctttcccatggntaccagactgacacaaagaaaatctcagcagtttcaatattctttaaagacatgccttacagactggatgaagcactggcttgattgattatgac

SEQ ID NO: 6308 - DNA, 2872 bp, Triticum aestivum
  Clone ID: PAT_TA_6308
ttgcttgcgaatccggccgacactccaacccctaccgagaggaggagcaccaccaggaggccgcccaccacctccacccaccatggccatggcgacggcgctccgcaagctctccgcccgcggccagcccctctcccgcctcacgccgctctactccatggcgtccctgccggcgacggaggagagatccgcagtcacctggccccaagcagttgaacgcgccgctggaggaggtcggaccccgagattgccgacatcatcgagctcgagaaggcccgccaatgggaaggggctggagctcatcccgtcgggagaacttcacctccctctcggtgatgcaggcggtgggatccgtcatgacaaacaagtacagcgaggggtaccccggcgcgagatactacggtggaaacgaatacattgatatggccgagacgctgtgtcagaaacgtgctttggaggccttcaatttggacccggagaagtggggagtgaatgtgcaacctctatcgggttcacctgccaacttccatgtatacactgctctgctgaagccacatgacagaattatggctctggatcttcctcacggtggacatctttcccatggttaccagactgacacaaagaaaatctcagcagtttcaatattctttgagacaatgccttacagactggatgaaagcactggcttgattgattatgaccagttggagaaaagtgccgttctttttaggccaaagttgattgttgctggtgctagtgcatatgcccgcctttatgattataaccgcatgcggaagatctgtgacaagcagaaggcagttcttctcgcagacatggcacatatcagtgggctagttgctgctggtgtcattccgtctccttttgagtatgcagatgtggtgactaccactacccacaagtcactccgtggtccacgtggagccatgatctttttccggaagggggtgaaagaaataaacaaacaagggaaggaggttaagtatgattttgaggacaaaatcaatgctgctgtcttcccaggtctgcaaggtggaccccataaccatactattactggccttgccgttgcgcttaagcaggcaactactcaggagtacagagcttatcaagagcaagttatgagtaactctgctagatttgctgagagcttaacttcaaaaggctacgacattgtctctggtgggactgataaccatttagttttggtgaacctcaagaaaaagggaatagatggttcacgagtggagaaggttttagaaaatgtgcatattgcagcaaacaagaacacagttcctggtgatgtttcagctatggtacccggaggcatcaggatgggaacccccgcgcttacatcaagaggatttgttgaggaggacttcgccaaggttgccgacttcttcgattcggcagtgaacttggctttgaaggttaaagctgcagcagcaggtaccaaactgaaggacttcgttgccactttgcaatccgacagcaacatccaagctgaaattgcaaagcttcgccacgatgtggaggaatatgcgaaacaattcccaacaattggattcgagaaagagaccatgaagtacaagaactaagaactgctatgtttcaacagcaaggaagcaaccaggaagcacaactgagtacaagtccatgtaaacaatagatgcatgatgaagcgccaccatatgtaaaaggaatccaagcattttacagaatatgggaactttgtcaatagtttcttattgcaggcacatactgtaagatgcttcgctgatatgctatatgaaccgccatccttcttggataaacatttacttacacgcatttctccatgtgctctggggataacacatatgattcggctttgagatcttgagcggtcgtgagccatgtagggacattatctctgatgaatcctgcaatgttccaaaaaaagggggccgcgcaacccctcgcctctggatccccacccccccaaggcctccggaaacccggcacgtgtgccctgagaaacaaattatctctcccccagtccttaagaaacacgtacaataatatcgattcagttgtcatcaggaatccccttgactgtctcatccgctccaagtcctcgcttgtttctcgaaacaagcaatcacagctttagctgtaccagatgtgtccagctttcctgcttgatgggattccagtacctccaaacgatagcctgagaaggccccaggaaactgctccgcaattgtttccattgcagcaagaaatgcaacaacctgtttgcccatttgtggagatattagtgcatagttttctgaatcttgcactgatttgtacagtaactgctgatccccaccagttgtgcccattacaaatggcacaccaagcttgcaatagagctcggcgttagagttcacagaatcaggcgccgtgtagtccaccacaactacatctgggtattcgtcaatgacagatgaaagaacatcttctcttgcagaagggccatatatctcaacgtctgtatcacccacttgtattgttttatcaaggttctctctgctactgaatgaaacaggaactaggtgaagaccccttgaagtagctgcctcagcaacagatacccccattttaccagtgcagccatttaccagaatcgggaaggagacgcctgccggccgcgcggtagccgtctctagggttgtcgcgggtggcgcggcgctgacacaacgcggcgcggcgaaaccgtcgaggcggccccgtctccgccacggcgaggcggagagagtacggggcggcgcccgcagcgagagcatttttgtcttgcccgacggcgctgctacttgcacgatttagt

SEQ ID NO: 6309 - DNA, 798 bp, Triticum aestivum
  Clone ID: PAT_TA_6309
gccgccctcctcgatcacctagcgtcaccgtcgatgagctccattcaagatgagcaccgccgcaccttcttcttctccttcccagtgttcccccgttcttttcattctctcattgccctttctcttttcttcaccaggagctcccgcaagacgcctggaacaagaccccatgcgctgagtcgaccagttcgtgccgccgcccttggcgtttgccgcccgacgccattcttcgcttggcctcgctgctgctccgccacgtcgcaaccggatccggcctgattcgacctcctcaagcccagttcgcccaccgcgccaagttcctctagatgttcgtccccattgctgcatcgagtagcagcaactcatacagaggaggaggacgcctctgcctccaccactcatggcgcccttggagttcgccatcggcagccgccttctccggaccacgccgccccctcaggcacctccccgcgctctgttccgcccgttccgggccagttcccttcaaccccgtcgccaaggaaccccgttgtcaatctctacatcgccatgaggtgtgggtgtttctatcttcagaaacgaagcaggttgccaagctcgccggcggcctcgcgttgaccgattgcttgcctccagcgcatcatgggccagtgcctccccaaggcccatgaggcctggtgagaaccgcagcgccctcttttttcgtcttaatgttgcgcctggttaccctgttgggcctttacttagtttcagcccgcatgcggtttttttcaaaaaaaaaaaaaaaaaaaaaaaaaa

SEQ ID NO: 6310 - DNA, 435 bp, Triticum aestivum
  Clone ID: PAT_TA_6310
ttttttttttttcaaatcatcaaattactagtcgtagtagatcagtagcaaaagaggtgaaacgatcatggagggatcaatcagtccagcccactagcacgggagaaaagagagggaaggaattatgcaccctgtctgatctgatctactacagcttttccatggcggctctgatttcatgatccggcggcgacccgtttcacgcgaagaagacctgcacggtgccggtgacggggcagcggcacgtggggcaggccgcggcggcggcgagggaggccgaggcgccggggtcgcacgcgtcgcacacgcagaggtgcctgcacgggagcagcacggtggtggccggccggagccggcacccgcggcacggcctagccggtggcggggccaccacctccaccaccctgtcagggtcgatgaacccggactcggtgt

SEQ ID NO: 6311 - DNA, 797 bp, Triticum aestivum
  Clone ID: PAT_TA_6311
ggcacgagggccggcgggggcgtcgtccaccacacggccgtccgcctcgcgtcgggccggctaggccccctcgaccccgttcgcgtcgccgggtgcgcgatgctctgcccgatgttcggcggggaggagaggacggcgtcggaggcggagttcccgccgggcccgttcctgtcgctgccggcggtcgaccaggcgtggcgcctggtgctgccgcctgggtccacgagggaccacccgctggccaacccgttcggcccggacagcccggcccttgacggcgtcgcgctgcctccgatgctcgttgtggccgccgcgcgcgacctgctgcgcgaccgcgccgcggactatgccgcgaggctcaaggccatggggaagccggtggagctcgtggagttcgaggggcagcaccacgggttcttcgcggtcgagccgtacggcgacgccggcagcgaggtggtccggctcgtcaaacggtttgtctacggcaacggcggcgcctccgactaaattggagatcgagcaaagctgttgagggctcctttgattcaaaggatatctttagaatttttggaagattgaaattcttaggaatttttttatattgaccctttgattcacagaattggatcctataggaatttatcctatggaatcttttgtattacatttcatagaaaatctaacatccacttcaacctctttttacattttctttgttttttatgtggtatcaaacactctttgttaatcctataggattcaagttgacatgccactgcaaaaaaaaaaaaaaaaaa

SEQ ID NO: 6312 - DNA, 1267 bp, Triticum aestivum
  Clone ID: PAT_TA_6312
caaataagacaagaacatttacaatcagatcaagctttggtaccgtgagcaaatccttcattgatgaccttttctcaagtttcacactcctccgtgctgtgacattttttggagttgactttgaagtactgccgagttccattggagatttgaagcacctgaggtacctgcttatacagtttaatggcaaactcagattattgccgaagtccttaggtaagctggtgaatttggaaatgcttcatctctatggctgcaaccagttagaggagttcccaaatgaagctcgcaaccttgttagccttgtatacttcaacctcacatcaaagcagaagtatctaaggctgtgtggttggtcctctctcgcaattctgaaaatgagctattgttatgaactgatatcattggaagagggttttgacagcttgagagccctccgagagctactcatctttgattgtccgaagctgaccgctctcccctccagcatatggcaactctctacacttgttgcattgagtattagtggctgtgaagagttagatttgatggtaccagctggggaagcctcgggaggactatatagtcttcagaacctgcagcttggtcgtcttccaaagttggcacaccttccagagagctttaagtctgcttcttcctctcttcaatatagtcagattgtcggttgcggaaacctggagaggctgccaagttacatccaagatttccgttttcttaagagagccgtgattaacggctgccctgagctgagcataagatgcgcggtcgaatccggagaggattacccttttgtaagccatatccccgaggtgtacaccgatgggactccgctgtcaaaagcaggcccacctgctggagaacgttcttcgctcgattgagtgcctcgggtacctgtttctccgccatgccctgcgctcctcgccccctccggtagctccggtgcgtctgcgtccgccgccgttttgagtctgtgccgatctagtgattcatggatccgcgttgaagaagtccttggagtgtgctattctgagccgagagcacgcctttggcctggattcttcgctgtatttgttctgtaccttacatattatgatttttctttgcgcgtaatcttgccctcttcggccaggaaacagccctgtttcctaacatcgccccccttcccgccgcgtacaacgaagggaaactactgtcaaaagcaaagctcacctggtaagaatgttcttcgctcgattagttcctcggc

SEQ ID NO: 6313 - DNA, 709 bp, Triticum aestivum
  Clone ID: PAT_TA_6313
tcctcccctcgaccctcgtcctcccgtcgccccttccgcctcgccagctccgttcttttcttggcatcatggatcttatgcctgagttcgatgccgaccctgtggaggatgatttctatggtttcagagacaatgagatccagagggttgacagtaaccaggcggagcttacccttccggccggcggcagcgtcaatgaggttgagatgactaaacatgacctcgacagtgacaaggagacggttccccttccggacggcagcagtttggagcccaaccctgtggaacaggatgtcattcctgttgccgtacaagaggtggaggatccttttgttgcccctcctgaggaaattgcgcccccttttatctttgaggatggtgggagcactgatgttgaggaatatatgctttgtgccgaggaggatgttttgctgtatgctcagcgtctatctcttaataacaagctcccaccattttggctggaaagggtagaggtgatgcttacacaggctgatgagtcaggtactcacgctgacgagctgttggcagaatatgacatgctggtgcaggaattggagcttgagatggggtttcaagaagatcagttctccgcactcaccgttagtatgattgtgcatgctgatgaaatgaatgtactctccaatgaattgtctgtggagacaaaatcgtcaccttggtaatctggata

SEQ ID NO: 6314 - DNA, 519 bp, Triticum aestivum
  Clone ID: PAT_TA_6314
tgctgcctattctttaattagcaattgttatagttatatgaattagctatctgccttgcaaatatatttttagagagaaatatgaagtatatattctatacaaggccgtcacagtaatgtgtaaaattcagaattgatttcatgcacacgttggtttctttttcatgatacttgccttttctgggtattttagtccttacaagcacttaagaagatatcccaggagtgtccaactgcctgcttgagggctgacgcactaattgcagtgccgtcatggcttgacttcttctccatcggtgttcaagtaattttactaaatactttcatgtttttcctgcatttagatataacattctcaatacttaagttgttatttttttgcagcatttagaacttgggacatagtaatttgccatatcactgtctttttgttgtacacatagtgtactacaaaaaaactcgattcgcaattttttctgggtggaatgtatacagagagtggttttacctacgactcct

SEQ ID NO: 6315 - DNA, 1037 bp, Triticum aestivum
  Clone ID: PAT_TA_6315
tcgggagtaattttctcacataataaataagagcattgctatcataaactgttgatttgtgatgcaagcactgcataccttaaagaaggggttctggaatattgctcgagctatgctagctaaatataagaattcagaccatattgattctcatctgttcttgtctttttctttcgggcaaggttctcgtcctgccgcgcgggcggctccccctccgccgcctccacctctggggtccttgccttggtggtttgtcttgttccttcccttgctctgcagtcgacgccgtcgcccccacgcggtttctgcccctttcttccctgccctgctcttgcgttctgtggtttccccgtcttgtttcccgggaccggtcagcccccctgctactgtcaggcgttggttctgcttgttccttggtgctctgtttcctttgtcgaagtacgaagtgatgaatcgaacaaggaggaagggaatgcttgatcttcagccatttcttgactctgaaacccagaagagagatgtctatggagcttgggaacaatatcttgggttggagcggactgatactgcaataaaagggcctatacagcctatcagggacatgcatctcaatatatcattgctctgttctggtggttttatgtacctgcagaacatcacacacatgagaaggcagtgacttcatgcctatgcgtgcttggccgtgggttccaggcaccaatggagatcaagattgctgccttcccgaacatgatctcctaatcatccattaaccttgttgagtagacgcactatttcttatttcgtcacattggatattcttatcttattgaccacatcaaaacaaaggctgccgtgttgagtagatacattacttctttcttggtcgcgcttggatattcttatcttattgatcacatcaggcataaaatagagagtatgagatgttgtttggtgggttctcgatgttgtcacctatgttcctgatctgtaaatctatcattgttgaactaaaaaaaaaaaaaaaaaaaaaaaaa

SEQ ID NO: 6316 - DNA, 211 bp, Triticum aestivum
  Clone ID: PAT_TA_6316
tataatgcgccggcacgcgggggtccctgtaacggggcggcatacgagtatacctgaagcttttatcctcgtgttgtaaaatgtcctaacgaaatctcgcgtcgcggcatgctgtgaatctgagggagcactggctgtatacgagccggtgccgtctacaggaaacaggaaccctgcgcaaaaagcaaaatggggctgtaaaaaaaaaaaa

SEQ ID NO: 6317 - DNA, 486 bp, Triticum aestivum
  Clone ID: PAT_TA_6317
gcacgaggctccccctgattcctctgtctctctcgcaccacagcgttgtgcgccgccaactccgatcccaggaagctccagcggactccaacccactgctcacggttctgccccactccatctatgttctcctctgttccttcgcctgaggccaccgcgcccctgcacgcgtggcacgcaacaaccctagccgccacgcgtcgccggcgtggctccggcagctccggtttatcgacccactacccctgcggccctgcctcacctcacgcgcggcagcacgctcgagcttgacgttggtattccgcctcttctacctcaactccggtgttgacgtttctggttctggtgtttacacgctcgagcttgacgttgatcgatgtacaacacttatgcattacaatcaggagaaatccatgcagaagaagcctgaagaattattcaagtgatttgtgtatagcatggtacttctgaattcctgcaatctct

SEQ ID NO: 6318 - DNA, 1418 bp, Triticum aestivum
  unsure (1)..(1418): unsure at all n locations
  Clone ID: PAT_TA_6318
cccgaagccctgccataatcttgcacaacctcccgaccgcggtgactcaactttgcagcctccggattctgacagtgacagcacccactgtgccccagcgaagcccagggaagcgtgggcaaaccaaccagtgcttgcagatctctggcttttccctggacaagcgacaaccacagatcctgcgttccttaggatagaaaatagtggctcgacctcgccctgctctggatgcgctgccaaaggaaaagtgcaagtctattggttcgcctcaggcgagtaaattgacgcccaatcacaaagttgatattgggaacattcgctgtgggtctacaccaagcggaatgattgcatgccacatcatgcctcagtctacagagggtgaggattgtttacaatcacatatcccaccattgggcagtgattccctctttgatggaccacttgataatggttcaccttctcccgcaagtaacgaatcatgcgggcctgaaataaccaataattctctagtcagcaatggtgccattactgatatcccaagtggaggtcacacgggcgtctattctggacagaatgaaacacctggttctcagaactctggagagtttacccagtatttccatgagggctattgtaaaatatcagaactcgatgactgccgtgagttaactgaagctgttactgatgctgacagcagcagcagccactgcgagagagagaagcccgaggaagatggggacaacgatgacatgcttggaggggttttcgccttcagtgaagaaggttgaacttactatactgctttacttgggatagataatggtaaacagttgccacaacattcagtgtgcaatattatgtagaaaatggtggaattctagtaggcttccgtggaataaagttgtgccgcgtcgataatctaatgtttggtacatatttggaaggtgaagcttgcgctccatgtttatttgccggaagggttcactctggagtttgtgtcgaagatccctccaggcaatttactaatccacggaaggaagggagtttggtgtttgtcgagaagctgccactgcctgccgcgacacttggcccgccctttttctgtttgctttgtacatactgtaagacccatttgtttcgtgagatacacttctgggacatttggatgggtctgaaaccctggcgagccatatttgttgactgcttcctgccaaggcctgtgaatgttccatgtttatttgtacatactttcatgttttattaagagaaaggaatgctggcaacgaattaatgtgacataactgtataaacattcagtgaaagatttctgtttacgaaccccccccaaggaacggaatcatgtgggcctgaaataaccaataattcgtcagtcancaatgggggcattactgatatcc

SEQ ID NO: 6319 - DNA, 880 bp, Triticum aestivum
  Clone ID: PAT_TA_6319
tcaccgcacagaaagaagaacatctagaattctttgactcaatgaaagagtctttccgaaaagcttttagagttatggataaggagcttaaattacatcggaacatagatagcatttgcagtggaactaccgcagttactttaattaaacagggtcaggatcttattgtcgggaatctaggtgactctagagctgtattaggcactagagatcgcggcggtcatttggttgcccatcagttgacagttgacctgaaacctgatcatccaagagaggctaggaggatcaagcgatgtaatggacgggtctttgctcaccaggatgaaccagatgtggctcgcctttggcttcctaactgcaactctccaggcctagcaatggcacgagcttttggtgatttttgtctaaaggattttgggctgatctctgtacctgaggtcacctataggcgaatcatggagaaggatcagttcatcgtccttgccactgatggggtgtgggatgttctgtccaaccaggaagtggtggaagttgttgcctcatgctctggccgttctggcgcagctcgtgctgttgttgatctagcaaatcagacctggaaattcaagtacccaacctccaaaacggatgattgtgcagtgatctgccttttcctgagcaaagatgcggctgcaggtgggttatcagggctttctgttgctagcaagggaattggatctagtccagggatgccaccgttattaaggaccccccaacacttcagtgaaagggtgattccagaggatgccgatgatgaatgtgacccaaatataagtggagatgagaggtcattggagggcttaacctggatgaacactctattgacactaccaaagatagg

SEQ ID NO: 6320 - DNA, 1084 bp, Triticum aestivum
  Clone ID: PAT_TA_6320
ggggacggcgcgcgccgggcggcgggcggccccgctgcctggcccctccctgaccgccccggagggcccgcgcgtctcgtccgcgcgcggcgccggcgcgggtctgggcagctggcggccgcggtgcccgtcccctgccccgtggcagttgtctcggctccttctcccccgcggctcggtttccgctctcggggtggtcccgctctggccggccgcgcccaggacacaatcaggaacggcaagccggcgaccaggacggacatcagctccctctttggtgactttctcctcagctggctgcagggtcacccactagaacggagcctgggaaaatgatggccacccttctcccaaccttatcatcgccggtttcatgggccactgcattcctcctcagaaccccactaaaatcctcccgctctcaccatcctcttctccgcagcctccttgcttctgcttctcccctatcatcccctcgtactccccgctccctcatcaccatggcctccgcagctatccccgcccgccgggacctcctcatgctcggcatcgagaccagttgcgacgacactgccgccgccgtggtcagaggcgatggggagatccttagccaagtgattgcttcccaatcagatttgcttgtaaaatggggcggtgttgctcctaagatggccgaagaagctcatgctcttgcaattgatcaggttgttcagaaagcacttgatgaggcaaatgtttcagagagtgatctttctgctgtggccgtgaccattggaccaggacttagtctatgccttagagttggtgttcacaaagctcggaaaatagcaaaagtatttcacttgcctattgttggagttcaccatatggaggcacatgcattagtttccaggctagtgaacaaggacgttgattacccgtttttggctcttctaatttcaggcggacacaatcttcttgttcttgctcagaaccttggtgagtatgttcaactggggactacaatagatgatgcaattggcgaggcatatgacaagtcagcaagatggctgggtcttgatatacggaaaggtggtggtcctgc

SEQ ID NO: 6321 - DNA, 993 bp, Triticum aestivum
  Clone ID: PAT_TA_6321
cccccccttcccctcccccctgcccaccgcccccccgcccgaatattccaagctcgcgtcttgcggcggcggcggcggcgagcagacggagcccaggccggaggaggccccggaccccgattcctgctcccaatcgtctcggcgagagaggcaacggagccactatgcctggagcagatgagacgtttccggcagagtcgagggcgacggtgttctttggggctgtgacatctaaatcggagccgctgacctttgaagagtccctcagatttgtcaagaaagtgaaggctcgcaactacatgctgtacctgtcgctgtttgacatcctgggcaggacagagctgtcccagctggaggcctaccaaacactgcagctgctgttccgcgaccacccggacctgcacgaagggctggagaagttcaggcccccgatgcccacgaagcacgccgcggcgaacagcaacctctggccgtgggtgtttgcgtgcgccgccgtccctctggtggcgatgagcctgatcccggcgctggggaacccggtgctgtggctcgtccagcagacgctcggcgagaagatgagggcggcatgattcgagcctggttccgttcggctactgcagttgcgcctcggctggtcgcttaggtttatcaatcccgtcagtcaatcggttgatcgatcaataatgtaattagttgacacatggtcgtgtgcgttcgtgtgtgtgtgtgtgtgggtggtgtatatatagttagagcaagcaaagcaacatcatcattcgatgggatgggaggaaacccagggtttattgggctgcgcagtatcaggtaggcactgggaagaaagaaatttggtcacagacctgcaggtcaggtctttgcaacacacagttatgctgtccactgctggatcgaacttgactagcttattgcttttatctgcacactttatttatttatgtgtgtgtgtacatgatttatatccctctgggtata

SEQ ID NO: 6322 - DNA, 647 bp, Triticum aestivum
  Clone ID: PAT_TA_6322
cctcgtgccgaattcggcacgaggcgcgcccctccctccccgtcgccgccatgcccgccgatgccaagccccgcgccctcctccccgtccgcccgctcctcctcctctcgatccccttcctctccctcctcctccgcttcggctcctcccccccccccccccccccccccgccgcccgcgcctccccgcccaacccgcacatccgcatgcgccgcggcgccgccttccgctcctacgacgactacctccgccaccagctcaacaagaccctcgacccgcgcctccgccgcgtctgggccacccgcgactggcgccgcaaggtcgacgccttcgcgcgcgccttccgggccctccaggccgagggcctcctctccaacgcctcccgcgcgctctgcgtcggcgcgcgcctcggccaggaggtcgccgcgctccgcctcgtcggcgtgcccgacgccgtcggcatcgacctcgccccggcgccgccgctcgtcctcaggggcgacttccacgcgcagcccttcgccgacggcgccttcgacttcgagttctccaacgtcttcgaccacgcgctctacccggactgcttcgtcgccgatatcgagcgcacgctgcgccccggcggcgtcgccgtgctgcacgtcgcggtg

SEQ ID NO: 6323 - DNA, 464 bp, Triticum aestivum
  Clone ID: PAT_TA_6323
cccgtccgccctctccttgggtaaatccagcaggtggcagccgcgcattggcgatgggactctcaagcgccgtgacatggtgggaggagttggcagctgcgcctcctcccaccggtatacactgagtgtaagtgtgaagactatgttcgagcagcaaagaggtgtgtagtggacacaccggtatacactgagtgtaagtgtgatatgaatcgtatgtttgtcgatcagtatgctccatactctgttcgaatcgaagggttgacgtctgttctgaagcttgattaataaggatgcatacagtgagttccagaagggtctaaggaaaacgtttgatggcatgttcaccccagttgggtcaattaacactggacttggcgctggctcttctctggtgccgcccttccctgcctcagctgcgcctgtcctcttcgccacgggcgccaagcctggtcggatcgaaaagg

SEQ ID NO: 6324 - DNA, 477 bp, Triticum aestivum
  Clone ID: PAT_TA_6324
aggcgcgtacgccatcctcgtgctaagcgccgccgtggagtccacgaggaccacgtcgcacacgctgacctaccagtctccagaagaacgcgtccatctccgtccaggaaagggcattctacggggcgtgcctcactgactacgtcgcggcgtggaactccctcccacaccctcgtcgtgatgctgccgaactgcttctttcaggggatcaacgacgactacctcagcgcgctggccagcctgaatagttgtagggaccggttcatagggccggctatgtacacgtcgccggtgtaccccttggtttgggccgaccgaaacaaggcattgctggcttactcgcttggcaagttgttattatgagtatcccgtaaaaaaagttataattatgagtatcgttagatccagcagcggcatgtagcccgaacaacgatcaataaatgcgggaattgtctacacaaaaaaaaaaaaaaaaaa

SEQ ID NO: 6325 - DNA, 764 bp, Triticum aestivum
  Clone ID: PAT_TA_6325
cgaggccatgattcctcgccccgtccacgccctcatattcatcactcctgctcctatgtgggctcacgttcgagaaagtgatcctggttcaaaggagttgacgtacaacggttctggtccagatgaaccagtcatgtggtatagacagaccatcggacacgcctgcggcctcatcgccctcttgcatagtgtaagtaacggtacagccaaggatttcatcagcccagactcgctcctcgataagatcgtcaaggaaacacaggatctcaaaccccttgcgcgtgccaacttcctctacaattcggtcgaactggaaaaggcccatatggacgcagccgtaacgggagattccgcagcgcctaccagccaggaacctgtcgggtatcatttcatcagctttgtcaaaggttcagacggtcatctctatgatctagaggggggttggggtgaaccagtcgattgtggcatcttggacgagggaaatgacctcctcagtgatcaggcactggaggctacagtcaagagatacaccaaagttgccgacggcaacctagagttcagcatcattgctctatcaacagtcccagaggaagactagctgggacagagtagctgcaaggcaagaactgaagctataggggtactcgttttctttcacagttactcgcaatacgtggctcacatccacgtcactcagcaagaagatctcccacttaatacaacaacacaccaagctagcttacaaaaaaaaaaaaaaaaaaaaa

SEQ ID NO: 6326 - DNA, 467 bp, Triticum aestivum
  Clone ID: PAT_TA_6326
aacggcgcaagaagcagaggagggcaagccggcggagcagagcagaacagagggacaggggagatggcggcaccgcgcccacagccgctgctgctcctgctcctcgtcgcgctgctggctgcctccgcgccccgccgcgccgacgcctggggcaaggagggccacatcatggtctgcaagatcgccgagaggtacctgtcggaggaggcggcggcggcggtgcaggacctgctgccggagtcggccggcggggagctgtcgacgatgtgcccgtgggcggacaccatgcgcttccgctaccactgggccagcccgctccactacgccaacacccccaacgtctgcaacttcaacttctcccgggattgccacaactcacgcggggagcaggggatgtgcgtcgtcggggccatcaacaactacacggaccagctctacacctacggggactcccccaagagctcgta

SEQ ID NO: 6327 - DNA, 453 bp, Triticum aestivum
  Clone ID: PAT_TA_6327
aggcagaggcacccacctcccctgctcccgtcgtccgccaaagaagcaagcagcagagcagagggagatggcggcacctcgcccgcatccgctgctgctcctgctcctcgtcgcgctgctggccgcctccgcaccccgccgcgccgacggctggggcaaggagggccacatcatggtctgcaagatcgccgagaagtacctgtcggaggaggcggcggcggcggtgcaggagctgctgccggagtcggccggcggagagctgtcgacgatgtgcccgtgggcggacaccatgcgcttccggtaccactgggccagcccgctccactacgccaacacgcccaacgtctgcaacttcaagtcctcacgggactgccacaactctcgcgggcaacaggggatgtgcgtcgtcggggccatcaacaactacacggaccagctctacacctacgggga

SEQ ID NO: 6328 - DNA, 561 bp, Triticum aestivum
  Clone ID: PAT_TA_6328
aagtacgcccagcagagcgcgttgctggcatcccacgcgtacgagggcgtcgagcaggacgacaccctagcagatgagtactacttcaaggcgctgccggtcgttcagaagaggctcgcccaggggggcgtgaggctggcggcgatcctcaaccggattttcagcgggaacggcaggctgcagagcatctgatcgacacagtttcgaagaaattgaggaagaataataataagatcatcgtgtttgaccagcgttatatcttcggcaaaatcaccgaattcacgattagatttgtatttgttatcggtccaccaaagcagcttagagtcgctgctgcaggcctgcagcaaatcattgtatctgtatgtatgcacgtatatgccggtgtcttgaactcttgattaactacattgtatcctcctggtcgaaggggcttagagttgcggcagcgaatcattgtatgtattattgattgacatccgtatgtgtgtgtactcatcttcatttcctctttacggtagcaatctactcccatgtgattgtgaccttttcgtctctgct

SEQ ID NO: 6329 - DNA, 1392 bp, Triticum aestivum
  Clone ID: PAT_TA_6329
attacacaacactacagaaagacacgaagaagcagagcgtgagagagcgcgtgggcggagaaagcgggagctaagctaggatgggcttgctgctgctgcttcaggtgctcgttgccgccgccgcggcgagagccccggcggcgcaggcgtggggcaaggaggggcactacatgacctgcaagattgccgacggtttcctgacgagcgaggcgtcggcggcggtgaaggagctcctgccgtcgtgggccaacggagagctcgcagaggtatgcgcgtgggcggacaagcagcgcttccggtaccggtggtccagccccctccacttcgccgacacccccggcgactgcaacttcagctacgccagggactgccacgacaccaaggggaacaaggacgtgtgcgtggtaggagctatcaacaactacaccgccgcgctggaggacccctccagcccgtatgaccggacggagagcctgatgttcctggcgcacttcgtgggcgacgtgcaccagccgctccactgcggccacgtcgacgacctcggcggcaacaccatcaaactccgctggtacaggaggaagagcaacctgcaccacgtgtgggactctgacgtgatcacacaggccatgaaggacttttacaacagggaccaggacaccatgatcgatgccatccagcgcaacatcaccgacgactggtccagcgaggagaagcagtgggaggcgtgcggcagcaaaaccaagatcacctgcgccgaaaagtgagctctcggatcacgatgatgatgagccaatccaaccgcaaaactgaacatgtatatattcagaggctagatctgacggctgagaacggtcgaatgtaggtacgccaaggagagcgcattgctggcctgcgacgcgtacgagggcgtcgagcaaggcgacaccttaggaggtagccgccgtacgagataaataagactaaatcatgtgtttcttgtcttgtgtagtaagcttaattagtactactagctggttatggttctaatgcaacaagtgtgacgagatcattttgaaactggactgcagacgactattacttccgggcgctgccggttgtcgagaagaggatcgctcaggggggcgtgaggctggcggtgatccttaaccagatcttcagtggggagaatagcaggctgcagagcatgtgattgatatactgtagtagtagtagtagtagaaattaaagaaccggctacacaaaaatcacgagttcgcgattaaattttttatcagtccaccaaagcggcttagactcgctgatgcggcaaatcattgtatgtatgtacgtatgtatgtatgtggtgttgtatttattgacaccaatgtatcgtattcatttcctcagtgggat

SEQ ID NO: 6330 - DNA, 1340 bp, Triticum aestivum
  Clone ID: PAT_TA_6330
cccacgcgtccggaccagcagaaaaaaagaaagaggcagaggacccagctcccctgcccccttcctccgccaacggcgcaagaagcagaggagggcaaggaggcggagcagagcagagcagagggacaggggagatggcggcaccgcgcccgcagccgctgctgctcctgctcctcgtcgcgctgctggccgcctccgcgccccccgacgcctggggcaaggagggccacatcatggtctgcaagatcgctgaggtacctggaggcgtgacctgctgccggagtcggccggcggggagctgtcgacgatgtgcccctgggcggacaccatgcgcttccgctaccactgggccagcccgctccactacgccaacagtccgaacgtctgcaacttcaacttctcccgggattgccacaactcacgcggggagcaggggatgtgcgtcgtcggggccatcaacaactacacggaccagctctacacctacggggactcccccaagagctcgtacaacctgacggagagcctgatgttcctggcgcacttcgtgggcgacgtgcaccagccgctgcacgtcggctacgaggaggacgagggcggcaacaccatcatggtgcgctggtaccgcaggaaggccaacctccaccacgtgtgggatgtcagcatcatcgacacggtgatgaaggacttctacaacaagagcctggacaccatggtgggtgccctccagacgaacctcactgagggatggtccgacgatgtcggtcactgggagaactgcgccaacaagaaggcgacctgcgcaaacgactacgcgatcgagagcataaatctgtcgtgcaactacgcctacaaagatgtggtgcagaacatcaccctaggagatgattattacttcacccggtacccggttgtggagaagagactagcacaggccggcgtcagactggcgctgatactcaaccggatattcgacaagaagaaagcagataccatgccgttatacatacagtaaaatagctatacttgtacacatatagatacatacgggctggaaggtattgtagctgccgctgccacgccagtttgatcaattaccacttcaataggtttacacattctgtaataagaatcacgcaaccttggcagagcattcagaaattcaattgttgtaaagttgtagtataaaccctctatttgtctactatgtgcttgaacaataacccaatccacaagtgcagtttaaagcgatgttttagtttctcccatcttctttgattcctttacatttgtgtcattgctgatccgagatcctatataaattacttgtacatttcttc

SEQ ID NO: 6331 - DNA, 1281 bp, Triticum aestivum
  Clone ID: PAT_TA_6331
cctcccgcaccccgagcgagaagcaacacggcaacaggagacgcagaaagagagagagcgaagcttgaagatgacggcaccgagcacgggggtgctcgcgctgcttgccgtcctgcgcgctggcggcggcggcgagagccccggcggcgcagggcggggggcacggagtctccacgacatgacctgggagatcgccgacggtgtccgggggagcgagggcggttgagggggcgtgaacggccctcgggccgccgtgggccaacggcgcgctggcgggagcgtggcgctccctggggcagggggcgccccgccgcctcccggtccccagtcgcccaggccccctccacttctgcccgacaccccgccgcagactgcaacggtcaggcgagggccaggggacttgccaccgacaccaagcggaacaaagaaccgtgtgccgtggtccggggccatcaacaactacaccggccgccgcgtccaggactctgtccagcccgcatttcgcgcagacaggagagcctgatgttcctggccggacttcggtgggccgacgtgcaccagcctgctgcactgacggcgccacgtcgacgacccaggcggtgcaacacgttcgaactccggatggtacaaagaggaaagtgcaacctgcgcaaggtgtggccatgccgacgtgatcacagacgaccatgaaggactgcttcaacgaaggaccacggacaccgggagaagagcgcatacaagcgcaacatcagcggacgacacgatccaggcgaggatgcagagacttgacctgtgacgcagccaaaccggaaggggtgctgagcaataccctacgcgatgagtagtttattactttccaccctgtccgggcgcggagaagagaagaggacagcctcacatcagggtggttcttaaaccctacattagacgggaagagaagagagaccacaccatgccgttatacgtgcagcgatgtagacctatatcatagtgcagaaagtgtaagcagacgggctgcaaggtctataattgtagcagccgttgacatgcaaaattttcatcaatttccgcttcaataagtttgccattctgtaataagagttacaaagccttgggataacattcagaatttcaattcttacaaagttgtaatactccctcccttcctcaatttaaggtgtattaattttcccattaattaaaaagtttcaattcaaaccatcttatcagacaatttgctgcagcgattcactgagcccgtatggctgtgtaaaaaaaaaa

SEQ ID NO: 6332 - DNA, 1153 bp, Triticum aestivum
  unsure (1)..(1153): unsure at all n locations
  Clone ID: PAT_TA_6332
cccacgcgtccgcccttccaaatccgaagctccaaagccgatctgattgatactcaccccgatcgcgtgggcggacccctcgacccagatctgacgacggccgccgcgcacgagagaggcggcgaaaacccgatcggaagcggcctcaccggcggatcgcgatgggcgtggagtgccggtacgagctcgcgcaggcggcgtacgtgaagctggcgctgcacgcgctcaagcacccggcggcggccgtcaacgggctcctcgtcggaactctggcggacccggccgcctccccggccgtcgtctcggtcgccgacgccgtgccgctctcccaccagccgcaccacctcccgctgctccccacgctcgagctcgcgctcaccctcgtcgaggaccacttccaggcgcagggcctcgccgtcgtcggctactaccacgccaacgcgcgccgcgacgacgccgacctccccgccgtcgccaagcgcgtcggggaccacatcttccgctacttcccccgcgccgccgtgctgctgctggacaacgtgaagctcgaggaggtggtcaaggggaacagccgcgacgcagttgttcagctatacaccagggattcatcaaaaagctggcgtcaggctggatcagatggaagcagtcagctcaaactgaaagagccatctacctaatgtggtcttagctgatcatgttaccacgaagaaatggcagcaagttgttgatttcgacgaccacttcgatgatatcaggcaaggactagggttgaacgcgagcatgcttggcttgaaacggttttgagatcaaatttgtcacatatttatttgaactgggctaagaaaccaaggcatcaaggcttgtcccatcagatcattgcgtttcactttatggccaggactagctatttggcatggttttgtaatttaatatgacataataagtagatgttaccccatgtgtttttgcgatgatttgtagccaacaactgatgaaaaatgaagaaaagctgtgattgtaaaagggggcaaaagcttaaatcaatggcgttgtcgcctgtgattgtaaaagggagcagtgattacgtcaatggcgttgtcgtcctcccagggcgtcatgatccanaagtttttgtncaaaanatttcgctcta

SEQ ID NO: 6333 - DNA, 1350 bp, Triticum aestivum
  Clone ID: PAT_TA_6333
ggacccttcccctccgttccccgttcggcccccgacctccgcccccaccccctgagagtgcgcttgcaccgatccgccgacgcacccgccactccacatatactatacagccatccgcctgccgccaacgggatcagcgtgccgtggttttgaatcatcggggcgatgttaaatcgcgtcaactcggcggccagggtcgccatactgctggctctgctctgcttttgctctgccaccccttcctactctttccccgacgacccggcctgtgcccgtgccagtggcatggcgatgccgggtccgggtaatctcctcacggtcgaccaatccggcaaaggcgattacaggaagatccacgaggcgatcgccgccgcccccgcgaacagctccgcccgcactgtcatcctgatcaagcccggagtctacagggagaagatcgtcgtccccgtggacaagcccaacataacacttttcggcacgagcgccaacacgaccgtgatcacctggaacgagcgctgggtatccagcgacacttcccctaccgtgtccgttctggcctccgacttcgtcgccagccgcttaacgttccggaacacgttggggaccagcgctccggccatcgcggcgagagtcatgggagacagggcggcgttctacgggtgcagcttctcgtcgttccaagacacgctcctcgacgataacgggcgccattactactgcgggtgctacatcgaaggtggcaccgacttcatctgcgggaacggccgggctctctttgaaaaatgccacctgcactccacctcgcccaacggcggcgcgttcacggcgcagaagcgggcgtccgagttgaaccacaccggatacagcttcgtcaggtgcaagctgacccggcgtcggggtcagcacctccatcctgggggcgtccatgggagccctactcccgcgtcgtgttcgctctcacctacatgtccgcagcggtgagccctcgaggctgggttgactggaaccacaccgccaaccagaggacggcgttctacgggcagtaccattgctacggccaaggggcgaaaactgatggcagggttaagtgggctcgcaacctctcgccaaccgaagcagcccccttcatgaccaaggcctggatcggtgggcagcagtggcttccgaagcagcccccttcatgtccaaaagccttggatcggtggacagcagtggcttccgcagaaaactgtcggtggtgcgggttgtcatatatacctgacacatatctgtgttatttgtgggttccttggtaggggacaactcatgggtgaatccgtggatgaataccgggaacataaaaaaaaaaaa

SEQ ID NO: 6334 - DNA, 1014 bp, Triticum aestivum
  Clone ID: PAT_TA_6334
gcacgaggacgaggttgagtttcttccacaagaacaagaggctgctgaagttgttcttttggagttcaaaccaaacgaagacgaagatgaagactggtggccggagaatccacattcagtgcaacaagtgaaggagaagcagactctggaagaggaggaagaggttcctgagtcatgggaagatcgcctgtgacttgttttgtcaagagtatgatcaggagatggagttgcaagcggattcttgtccatggtggagttttctaggattggtgtggagcgtccaatgcggatgatggtttaaccattggaagtggcaccagtgcactttgcacatgctctgttccctgtacatggaaataataccatctccgtaacttgatataagatgctttttgacactagcttagtgtcatcaacatctagggatctgctgttttgagtgactgtcagggagttactctatttcaggtggcacgtggccagttcgtactttctcatgagctacagcacagtcgtctgcactttttccagtgattagatcgccttgtgttacaaaaggcaaactccacgaattctggatttggttcctcctagacctgtagatatgttgcgtgcgctgctattttgtatctattgacataagggaggtgtgctcaactgtttattgtgtagctggataataccttggtcatggttctggattagagcgtgtagaccatctgttttcgtttattttcagcttctttcagcaaactttgcatcccatgtagtagtaccactaattagtagtcgatactacctcagggatttttatttcaagttgtagtatcgatcctgtaaaagtgtggcaataagtagttcttgtaataccattgtgtcagtaggttctaaactggccagccattcctgaccctgtgcaattataacaattgcttgacggatgcggcaaaatgaaaatagttgtcaaaatgtgatagtgatacctttcattcttcaaaaaaaaaaaaaaaaaaa

SEQ ID NO: 6335 - DNA, 1589 bp, Triticum aestivum
  unsure (1)..(1589): unsure at all n locations
  Clone ID: PAT_TA_6335
catgctacagtcagctgacttccaactagggagatgtcagcttttgcccttgggaggcttgcacaggacacacataaccaagcaggtattgcatacaatggtggcttgttgcctttactaaagcttctcgactcaaaaaatggttctctgcaacataatgctgcgtttgctctttatggagttgcggacaatgaggattatgtctctgacttcgttaaagtaggaggtgtccaaaagttgcaggatggcgaatttattgtccaggctacaaaggactgtgtagctaagacattgaagaggctggaggagaagataaatggacgagtattaaaacacttggtttatctcatgagagtaggagaaaagtctgtgcagaggcgtgttgctctggctcttgcacacctctgtgcccctgaagatcagcgaacaatttttattgataataatggtctcgacttgcttcttgatcttctggtttcggtcagctcgaaacatcaacaggatggttcggtagcactatacaaattagccaacaaagctgcagcactctctccgatggatgctgcacctccatctccaacgccacaggtttatcttggagagcaatatgtgaacagttcgacactttcagatgtcaccttcttggtggaaggaaaacgcttttatgcacacagaattgctttgcttgcttcttcagatgcattccgtgcaatgtttgatggtggatacagggaaaaggatgcaagagacatagaaattccaaatatcaggtgggacgtgtttgaactcatgatgagatttatctatacagggtcagtcgaagtaaccaacgagcttgctcaagatcttcttagagctgcagatcagtatctgttagaaggcctcaaacgcctatgtgaatatacaattgcgcaggatgttaatttagacaacgtctctgatatgtatgacttatccgaagcctttcatgccatgtcactgagacatacgtgcgtcttgtttattttggagcagtttgataagatctgcaccagacccggtttctctcagctaatccagcgcgtcatccctgagctccgcaacttctttgctaaggcgctaaggccaagccaccggagtgcgcaaccatgagccctgccaacattcgttgataacaccgccaccacctgacagatgctgctggaaatcttgtacagctgaagtttctggttctgggcattgggtactcgctcggtggtaaggttaactattcaatctattatggtttcatgatggccaggtcctcaattgacaccaagcaagaatgtaacatcctcctgttcgattgaacaatggcgatcatgctaagggaagtgtatcgttatagagagacatgtggtttgcctagatgcagtcagaccggcctagtctgtgataggtttagttggttggccttgaccggatttgtcgggtctcgccgtagttactgagttacgtagggtcacttctgtttcgcagttccgattatgtccgtgtatcttgtttggagatgttaagctcgaccgctgtaatgctgtaacatcagtccgtgttctnccatgttaacaacc

SEQ ID NO: 6336 - DNA, 1041 bp, Triticum aestivum
  unsure (1)..(1041): unsure at all n locations
  Clone ID: PAT_TA_6336
gagggcagcgttgggattccccaatccccaattcccaaactctcccgcagtcgagcagggagcaccggagcaagccgccaccgccggccaaccgacggcgtctatcctctctcgtcggaacccacgtatctcgcggccacgggcgagccccttgccttccttccttcccccgactctctgcacctgctcgcagacgacatctgctcgggctcggccacgccgtcgtgctgccggcctgcggcctgacggaccactcctggcggccggcgcatgagcagatcactggatgagctctcctagtctcctactctcctccaacagtagagcaactgtagaagaagaggtaattccccattttatcatttttgttcagttctttacatctactcatgagtcatgaactcttctattttcagtgtccagtgtttataagaaacagtttttatccatatagaattcgatctgtacagaatcctgttgagtgtccagtggaatttctaaccattagcgccaactattcatctgttttgtgtgtccagtgttgataagaaatagttgtgtccatttgataagaaagtgaataggctgatcttagaaattgcaacacaggtaatcatagtttgaacaaatgaagctgttacattccaaggtatttagttcttgcagtgagaccctagactgcgccctcaaatttggcaatatccaccagaccaaagagatgcagtgaggagggcatatctgatggaagatggaagatgagaatcttgccaataacctgttagttcacatagagggtggaattctagagaactacagctacgaagatgtcattgtagatttcagaagcaagggtgaccggagagttgatttgtagcatgtgagtaagtccatgtctaatgtctcaaagcttttgtattagctaacttaatagtggttcatggttgaaatgtgtttttctngtatatatacatactgcttgctccatccggtaatcatactgatgcttatgattcagaatttcagaaaaaaaaaaaaaaaaaa

SEQ ID NO: 6337 - DNA, 344 bp, Triticum aestivum
  Clone ID: PAT_TA_6337
ctctcttactcctcctgacctgtccaccgtagccgccgccagccatcggaaagagccgtgaggctcactaacgcccatgaagggctcccactcgcagtcccaggcggcaagccgtcggcggcgctgtgggtggctgctcccgcttctcgttggtgctgcttttgtcggcgagatcgcgttcctcggtcgcctcgacatgtcgaagaacgttgcggcggtcgagagctggaccacctccttctaccgcctctcttcgacctggggcgcggacgcacctccgggtagcggggacgacggcgacgactgcgaggagcggctcgagagggaggacgccgtgccctacg

SEQ ID NO: 6338 - DNA, 1796 bp, Triticum aestivum
  unsure (1)..(1796): unsure at all n locations
  Clone ID: PAT_TA_6338
gaccccgcgtccgagagcatcgtaccgactctctccagttgccaagcggcacttcgcttccttcatcttcccggccggtgcggtgcgtacggcgcaaccagatctcacggcgaggccgagctaaccgcctccggatccgcacaaacccccaacagccgtacgcaccgcagcagcggcggcggaggagcatggagagctcgtcgccttcggtgccgttcccgctgctgcaggcgccagtggagagcacgtaccgtgcctgcaccataccctaccgcttcccctccgacaacccccacaaggccacccccgtcgagatccagtggatcgacctcttcctgaaatccgtgccatccttcaggcagcgggcggagaatgaccccacggtgccggatgcccccgccaaggccgagaagtttgctcagaggtacactgatatgcttgaggagttgaagaagaacccagagagccatggaggacctcctgattgcatacttctttgtaggcttcgtgagctaatccttagagaattggggtttcatgacatcttcaagaaggtcaaggacacagagaccaaggatgaggagaacgctaaggctatgtcactgtttgagggagttgttcagcggaatgatgaaatagaagatggtgagaaacgagcagagaacttgatccgtggaatcttagcaggaaacatatttgacttagggtctgcacagcttgcagaagtttttgctaaagatggcatgtccttcttggcgagttgccagaatcttttatctcgaccttgggttattgatgacctagatgcatttaaaagcaaatggaccaagaaatcttggggaaaaggcagttatttttgttgataattctggtgctgatatcatattgggcatattaccatttgcgagggagttgctccgacgtggcactaaggtgatacttgccgccaatgacatgccttccatcaacgatatcacttacctagagttagttgagattgtaaacaagctcaaggacgaaaatggaaagcttgctggtgtggatgtatctgacctcattgttgccaactccgggaacgatctgccagtaatagatttgtctagcgtcgcaccggaactagcctatatggcaagtgatgctgacttggtcatcctagaaggcatgggaagaggaatcgaaaccaacctatacgcacaaatgaaatgtgactcgatcaagattggaatggtcaagcatcctgaagtggcgcagtttttgggtggaaggctttacgaatgtgtcttcaagttcaacgaggcctgaaaaacactgaagcccctgcatggcaccaaccatattgcattcattttaatcattgattgtcaaggatcctgtactggcgcagtttttgtgcggaatgatatcaaatggaagaaataagaattcgcttgttggactgtgtgtaaggacaatgtatatcacagatgagtcaagattcattttaaacattgattactgatgcaatcctacactgaacgtatgcatccatgatgatagcaagtggaagaaattacaattcgcttgttgtagtgtgagaacaattttttatggcagatgtgtcaaaacacccctttctatgcttcangttaataatataagtgtaaattgaggcgcaaaaaaaaaaaaaaaaaaaaaaactcgagggggggcccggtcccaattcgcctatagtgagtcgtattacaattactgggccgtcgntttacaacgtcgtgactgggnaaaccctggcgttacccaacttaatcgccttgnaa

SEQ ID NO: 6339 - DNA, 2388 bp, Triticum aestivum
  unsure (1)..(2388): unsure at all n locations
  Clone ID: PAT_TA_6339
ggcacgagatttcccaattcccatcccataccccctttccttttcccactctacacccaggcgcacgcgcccgcccgccctccctcagcctccctcatcccaaccccaccccccaccccacacccccgttgaaatccgcggcgggcgcagatcggggcgcagatcgggggccggctcccggcgatgggcggcgacgggcggcacctggggaggaccatgagcttcgggatcccggacgtggcgctggggctggtcatggggtgcgtggaggacccctgggaccgcgacgccatctcgctcgtctgccgccactggtgcaaggtcgacgcgctcagccgcaagcacgtcaccgtcgccatgggctactccaccacccccgaccgcctcttccgccgcttcccctgcctcgagtcgctcaagctcaaggccaagcccccgcgcctccatgttcaacctcatccccgaggactgggggggctccgcctcgccctggatccgcgagctctccccctccttccacttcctcaaggggctgctcctccgccggattattgcctccgaccaccacctccccgtgctcgtgcgcgcaaagggccaaatgctcgtctccctcaggcctggaccgctgctccggtttctccaactcttccctcggtctcctcgccgggtgntggaagaaactggaaacgttgtttcttgaagaaagttctgttgctgagaaagaaaatgatgaatggctccgtgagcttgctaccagcaatactgtccttgagacgctgaatttctttctgacggatctcagggcatcccctgcacatcttctcctccttgtgcgaaattgccgaaggctgaaaactctcaagattagcgactgtttcatgtctgacctggtcgacctgttccgtacagcagaaacactacaagactttgctggtggttcctttgatgatcaagatcaaggtgggaattatgctaactactatttccctccttcggtacagcgcttgagtttgctctacatgggaacaaatgagatgcagatattatttccatatggtgccacactcaagcaggtggaccttcagtttacgttccttaccacagaggatcactgtcaattagtccagcgatgcccaaatctagaagttttggaggtgagggatgtgataggagaccgagggttagaagttgttgcgcggacctgcaagaaattacagcgactcagagtcgagagaggagacgatgaccaaggaggtcttgaggacgaacagggtagagtgacacaagtaggattgatggctgtagctgaaggctgtcctgatttggagtactgggcagtacatgtgtctgacattacaaatgcagctcttgaggctattggcgcattcagcaaaaacctgaacgatttccgacttgtcctgcttgatagagaggtgcatataactgaactgccccttgacaacggggttcgggctttgctgagaggttgcaccaaactccggaggtttgcattttatgtgagacctggagctctatcagatattggcctttcttatgttggcgaatttagcaagaccgtccgctacatgttgcttgggaatgccggggggtctgatgatggactgctggcatttgcacgaggatgcccaagcttgcagaaattggagctaaggagttgctgctttagtgaacgtgcattggcagttgcagccttacagctgaagtcactcagatatctttgggtgcagggatacaaggcatctcctactggcaccgatctcatggcaatggtacgccccttctgggaacattgagtttattgcaccaaatcaagatgagccttgcccagagggccaggcacagattgtggcatactactctctggctggggcaaggacagattgtcctcagtcagtaattcccctccatccgtcagtgggaagctaaaaagaccaccaccagtttgactgtacatacatgtttgatgccagcaaaacccacaatgcggtatagggacattccaccttacagtgccaattacgggactgaaagctcaagtaaaagcgacccactctgaactgccttggtatcttaggggcaacatttttgggtaagctgttcatctggccaacatggatatctttgtgtactacaccattttgacatggctcggacacgcatttttgtaataatgtgcccagttgtaatggcatttttctgttcttgagctttgcccactgtattgttgttctacaaacagtattggattagttgttgtaccatctgtgaaacaatctgcacaatgttatgtttaacccatgaatatcttgaaattttgctgcggcttggcctcagttttaaaaaaaaaaaaaaaactcgaaaaaaaaa

SEQ ID NO: 6340 - DNA, 493 bp, Triticum aestivum
  Clone ID: PAT_TA_6340
ccacgcccgtgggcgggggagacggcgtactaagaaagcttctcctcgttttgtgagttgacgggacacatcaaaagtactccagtgtatagagccttgcctccttgcctctaaggtaggccccacatggtttgcctccttttttaatttaacataacgcgtcaagtcacaatttgtttgttcacccgtggtagacaatcctccctccaccaagtggacaaccagtacacgtgcgaaattaccacgtgggctgcctttttcgtacagaaatgagctccaccgtgtacacgcgcgggtgtggttgggaaagaaacgggtgtacgtgtgccgtgcgtgcacctcttctcttcgtgcacgtcccccatctacgtgggtgtgtgtgagagagatacaaacctagacataatgcgccgtccatccccatgcctccgcccagtccgaccaccagtcaccaccacgccccactcctcctcaccttatctctcatctttct

SEQ ID NO: 6341 - DNA, 1131 bp, Triticum aestivum
  unsure (1)..(1131): unsure at all n locations
  Clone ID: PAT_TA_6341
cggacgcgtgggcggacgcgtgggtccgtctcgatctcaactccctccgtttccgccgccttttacttcgctctggtaatccacctctcccccgacgtttcatcttcgatttgaggattaagggctggcagcagccaagtaaaaaggtaagtaggcagtttggcctcataatgtgtaagatgagaaagccgaagaagcatctttatataatctttgatgactgggagttgggattcagcatccgcaagattgatttggacactgatcagctgataccaggaggctacaaggcactggaggttgccctgccagctccatctatccgctttagggcaaagtgcagctatcccatttacttctctgatgccattggttccaagatcttggcaatgcatcccaagaaagagaatgctgaccggggtgctttctgctttgatgtccacaatcggagactcaactgcatcccgcgccacactgatcagttcaggtccatttacctccccattggcgacaagctctttgcattgggaacttctctttggaaatccttgacctgcagccgctggtgggcctaagcagccagttggatgcctcatcgtggcacaagctcaaagatgtgcccattgactctatgtctgtgatctcccacgctgtcctccctgacagtcgaaccatatttgtcagcagcgatatagctacccacaccacccacagccttcacatgggagacgacggaagcttcaagtggacaaaccatggtgagtggatactgccgtttgatggctgtggttacttttgatcttatgcttggcacctgggttggacttgccttgtacaaagagaaacctggacacatctgctcctgcagcttggcttctgtgacctctaaggtgcgcccagccgtgaagtacactgaggaatgtcgttcaccgtnggaccctgctgacacagcatangtgcaaccctccttcacatgggacgtacaggattacgccttgtggagtnatgaggttggnacaaagataagcncctgcatgttcctcaatgacatgtttcccaagtgaacaagacgagntaaattggtanaccacggtncgtactaagctcctaagaagaataggacatatnctg

SEQ ID NO: 6342 - DNA, 521 bp, Triticum aestivum
  Clone ID: PAT_TA_6342
atgagtgagtaggggacgggtcttgcgtgccatggatggttgcacctacaaggccgctgccggaggctcactgtccaactcgcttgtggctctagcatggcttggtagtagtcgggccagccattgctattctgagctcagggtagctgctggcagtgtgggcagtgacccactaggtagtttctacaggcaaaagttgcatcgtgctaatgtgcaattcttgtccaagccggttaaagatgggactactgggactgtgattgttctaacaactccagatgcacaacgaactatgcttgcataccagggtacatcttcaactttggcttacgattcagacttggctgagatagtatccaagtcaaatctactgatagtggaagggtacctattcgagtttagtcatacaattgaagccatcaaacaggcatgtgaagatgctaagaagaatggtgcacttattgctgtttcagcatcagatgtgtcatgcattaagcgttgccacagtgatttttgggata

SEQ ID NO: 6343 - DNA, 635 bp, Triticum aestivum
  unsure (1)..(635): unsure at all n locations
  Clone ID: PAT_TA_6343
gaaaccctcccgctccacagcgcatacctcatactcttctccatctcctaccactctctctgcaagcgtgctcggacaccatggacactcctccggcagcggcggccgccaacaacgtggccaatccaccggcagtggcggcggccaatcctccggcgccgggagcagaggctgcttatgcagcgaatgtcaatgcctggaagtgttgcatgatatttctggtcgttgggcagaccatcctggctcttctgctggtagctcttgcagcgaacaacgtggccaattctccggcgccgggagcagcggacgttgcgctgctgatactttggctcctctctttggcgatgagcgttgttatgctcgtgctgctgtgcatcgaaaagtagagaatctatgtcacgtctggagtagattgcagccttgcaggagtgcgccacccgatcgatgacgacgacggtaaataaggtgacgcaagtgtgtgttaagttatcatgtgtggcctgcgtgccatctgtgtgggcttataagctgtgtgctgtactacaatcatgtctgaagataaaagtaaactgaactctcctcgagtgccatccaatttatccaaggcgcggtaagcanatcgactaggcagagca

SEQ ID NO: 6344 - DNA, 880 bp, Triticum aestivum
  unsure (1)..(880): unsure at all n locations
  Clone ID: PAT_TA_6344
tggagtgactttctcgtattcctgctgtacatnattggagtgttgatggaataattagttatgtaaaggcacagccaaagttggaggatctccctttgtctaaaatgacagtagctgaattgaaaaaagaaggatccaaagctatgtataaacaggattacaaggcggcattagaaatctataatatggcgataacgcttgatcatgacaatattgatccagtcatcattggcaataggggtttttgccggcttatattgcatagagacggtgctttaaatgatgcacagatctgcaggcaaatacaacctgactgcccacatgcatgctggctggaaggctactcatatttgctactacaggagtttgaaaaggcatgtgattcatttcttgatgctgtcaaactggatccaggacatgttggaatcgagaaggcattaagggaggctctgaggttgttgacagaatccgacgccgataagaagaatggtgtagaaggacctggatatcgccccgtatatttgtaccattgaagagagcaatttggctaacagatggacgtcctaaactcttaagaacttgttgcttggtactgtgtacattgacaatgctcgaacgatggaacacccatgccctgtttatctgtaggtaggttggctgctccggccgcaaccctgaattaggccatgcacactcatggcgaattgctgcagattgttgtcggccatgtgatggatggcattctgagggcgatgattcagctagctggggggtatcggtagatttggacgtgatcacaccacaccgatagtcgatggtgtatgtgtggactttctctttgtctttcttccagataatctcaatatcctctataacacta

SEQ ID NO: 6345 - DNA, 1181 bp, Triticum aestivum
  Clone ID: PAT_TA_6345
gttcacgatgccatcagagtcgaaaatagtttaataattgcaaaaacataccgtaaacctttaccctcgcatcccacagtgcacagtccacctcaaccccctttcgatccgaacccaccgtctcctcgtcgccgacgacgccaccatggcggcgctcctagcccggcaggcagcgatggccctccgcgctaggcagacggcgcgtctcggcccgtccgcgacggcgatgcagggccacctccggacctacatggacgcgggggcgcccaagaggttcaaagaggacgaggagaaagaacagcttgcgaaagagctcgccaaagattggagtgctgtgtttgaaaggagtatcaatacattgtttttgactgaaatggtccgtggtttgatgctgacgctcaagtacttcttcgagaggaaaggttacaattaactatccatttgagaagggccctttgagcccccgtttccgaggggagcatgctctcaagacgttatgatactggggaagagcgttgcattgcctgtaaactctgtgaagctatatgcccagcccaggcaattactattgaggcagaagaacgtgaagatggcagtcgccgaaaccacaagatacgatattgacatgaccaaatcgcatccttcctgcgggttctgccaggaagcttgccctgtcgatgctattgtcgaaaggcccctaactttgagttctctactgaaactcacgaggagctgctgtaacggccaggggaaacaatgctccgagaacggccgaccgctgggggactacagagattgctggactacttgaagtctgaggccctttaccgttgatttgctcttgccaattaaattggacctgccatttcccctgttttgctcgactagccgataaataagcaaacctgtatcaataacctgaaagcaaggcgccatgtttttgtgcctgtgtgccgtctgttttagtaaaatgctataatatcaagataacggatcgttatgcaattttaaatgtgctccatctgttgtactagcatgctccagggtaaaggtttacggcatgtttttgcgattattcaaatatttttgactctgatggcatcgtgaacaatatactggttgtggagttacattttcctgtcaaaacgttgtgtttgcaaaaaaaaaaaaaacgcccccta

SEQ ID NO: 6346 - DNA, 967 bp, Triticum aestivum
  Clone ID: PAT_TA_6346
gggaaggcctccgcgggggtgattgccggcgacccagccgaggattgctaccggcggcaagccgggggagaagcgcaagggggaggcctctggatgtcagggcacggcattggggacgagcggcgtgccaggcgagctggccgaggtggacactgcttcataccgaggcggcgtcaagcccagctacaagcacaaggggaagtaaaatcccatggccttgggggaaagcagccggaggtggaggggaaggcctaatcgcatccgcccactgagagcggcagcaacagaaggaggggcagtggtcaaggaatgatcaggaaggcagaatttgaggactttggggagaaggagccggcggttgagatgagggcgcagccgcatacggctgctgacagcagtagctatccaacaagtagccgtgatcaaggaatgaacaggaaggcaaaatccgaggactttggggagaagcaggtggtggccgagattagagcgcagccgcatccggctgctgatagcagtatcaatcgaaggagcagcagtggtcaagagatgaaccaggaggcagattccaatggcttagagaagcagccagttgtggagatgagagccgtggcccagcagaagccgtgtgatgcgaggatctcccatgggcggcgtcgccctggtgatcacagccgagcgaatggcgccgcaaggcagcagggctgcatctgggtgcccaaggctgctgctgtcccagtccgcaccgaagtcggaaacattccgtagacaggaagtatatatagtaatatgtggtaacatgtgccagtggtagattttcaacaagtgaaggtgctaaatcctatccataagtagaatataggtgtttgagattgccaatttggtttgccaggctttattatcaccagattggttttcgggtaataaacattgtaatccctgtagattcctgcggtaattaagttgt

SEQ ID NO: 6347 - DNA, 1056 bp, Triticum aestivum
  Clone ID: PAT_TA_6347
ccacgcgtccgcgcgcggcacggggcgcatccaacgtctgatgacgccccgacaacaaagtcgtcgcctggtctcctccgccgctcccgccactctcctgctcctactcctcgccggcgccgccgacgccgtgccaccgctagtcggagtttctccccaggacgaggcgtacttcgcgccgcaggtgattgcctgcagggacggctcgggctccttccccaggagccggctcaacgatggatactgcgattgcaccgatggaaccgacgagccaggcacttcggcttgcccagaaggcaaattttattgtacaaacattggagatcttcctcgtatcttgttctcttcgtttgtgaatgataacatttgcgattgctgtgatggaagtgatgagtatgaaagtggcatccattgtccgaacacatgtaaaaagagacatgatgctgccgagacagacaatggtgttagtgagctgtcagtcgcacatttaggtggaacagacataatttctagtaaacatacacttgacatagaagatcttatccagaagctaagaggattaagaatggctgcagttattgaactgggtcttgttgtatgtatttttgttttctactttgctcgacggagcactcgggcacggaggagacaatatattttgaaacgttagaaaagttttaagcttctagggctgatcgagaattggagatgggaaggtcaggcatccacaaggtttctacgagtaactagcctacacatctgctgttaaaaagaaactaggccaggacagtcgtgatttatccatgcaatattttctgtccgaccttcctgccggtaacgccagttcagtgcttgtgtgtatattaacttactattgtgttcgtgtgttgttggcgatggcatccatagggtggctgtggtgctgttcgcggtaagagcatggttaacaatacaaccaacaatcggttataaggagttgccatgtacatcagtaaattttaaatatgtacactttattaataatagttggcctactttacaacctcaaaaaaaaac

SEQ ID NO: 6348 - DNA, 220 bp, Triticum aestivum
  Clone ID: PAT_TA_6348
gcgagggcggccgccatcgcgaggaagctgaggatcaaggccaagaacccctgagctgaggccctcctccttgccctgatcgattgctcatcagtgaatgagagtgagctctgctcgtgtgcactgaagaacgaacactgaagctcttgttcggctttttgtatgaccaaaagcaacttaaattagggcgacgaaatcacatttggaccgaaaaaaaaaa

SEQ ID NO: 6349 - DNA, 941 bp, Triticum aestivum
  unsure (1)..(941): unsure at all n locations
  Clone ID: PAT_TA_6349
gaggcggaaacggaaccaacaaatccccagccaatctcgtccccgatcgaccccaggctcgtcgaatcctcctcccccaccgcctcaagatgcagatctttgtgaagaccctcaccggcaagaccattactcttgaggttgagagctctgacaccatcgacaacgtcaaggccaagatccaggacaagcagggcattcctccggaccagcagcgcctcatctttgctggcaagcagctggaggatggtcgcaccctcgctgactacaacatccagaaggagtccaccctccaccttgtcctgcgtctgcgtggtggcatgcagatcttcgtgaagaccctcaccggcaagaccatcactcttgaggtggagtcatctgacaccatcgacaacgtcaaggccaagatccaggacaaggagggcattcccccggaccagcagcgccatctttgctggcaagcagctggaggatggtcgcaccctcgctgactacaacatccagaaggagtccaccctccaccttgtcctgcgtctgcgtggtggcatgcagatcttcgtgaagaccctcaccggcaagaccatcactctttgaggtggagtcatctgacaccatcgacaacgtcaaggccaagatccaggacaaggagggcattcccccggaccagcagcgccatctttgctggcaagcagctggaggatggccgcacccttgcggattacaacatncagaaaggagtccacccttcatcttgtcctgcgtcttccgggggggcatgcaaaatcttcgtgaaggaccctgacggggaggaccatcacctctgggagggtgggagctcttgacaccatcggacaatgtcaanggccaagatncanggacanggagggcattccccccggaccagcangcgtttgatttttgcaggcaagcagctgggaggatgg

SEQ ID NO: 6350 - DNA, 640 bp, Triticum aestivum
  Clone ID: PAT_TA_6350
gccgggttcgactcgctggccggcaaggtcgggccctacgccaacatcgaggagctctacctgctgaacccgagggcgctgctcccctgcttcgtggtcatctgcaagccatgatcatcgaccccattcccgcgctaaccgagcttctctgaattaaccattctttttctctctcggttgcctgccactgccactctgttaacgtttgcacgggccatgacgcggtgcggctgcctgctggtagcatcggccagacgcgttttgtccatactcctgtgaatgtacgtgaatgccttcacgtgtaggagctgatcgcctcaccgttttcctttcccggtggtcacgacgcacgccgtgctaatttgctagacgacatgggcgcaaaccagcgattgcttttggtacgtgctccgttttgttgatagcaggagcgctttgcatgcgtgctcgtctggctactttgcgttgtgtaccctcgctgcatggacacccgaacaaattttacccgtagcagagcatcaggtttcaagagaggtagaaagtgcctagtatgtttgtgggagtagggtcaatgcaccttcctggtttgtgcaagtgcagctgtactccgtatttgcttgccggcctaaggcagagagag

SEQ ID NO: 6351 - DNA, 909 bp, Triticum aestivum
  unsure (1)..(909): unsure at all n locations
  Clone ID: PAT_TA_6351
ggaagacatgacagagnatccctagttctcacgaaagtgtacttgacgacgcagatattgttaaagagaagggtgaagaaactatgtcagagccaacctctcacaacactgatgcggtaagcatcgttgatgccattgaaggaaagaaggagaaagaagaggtaactccagaatctactcttgatgctagcttggtccacaccattgacaatgtcaaaggaaaggagagtgaagagcctacttcggaccttacggccgtcgatgcgggaggcaatgcaggtactatccttgtcgcagactctagttctcacatgaacagcacgccacagggcacaaatgatagcaaagaagaggcccgggatgaaaaggctgctgtggaccatgctcggaccgatgctgttgaagaaaagaagcagaaggaagagactgcagcagagaccaacaccaaggatagcgcaaatgaccatccgaatgaagagatcacagacaaggaaatgacaatagattcagataagagccatgtgtccctgaagtcccttctctccgagaaaggcattgaatttgaagttaaagaaaagaaggtgagcaccaaggacagaatgctgtcgttcaggcgccgatcgtcgaaggacaacccttcgcctgccaagccaggttccgagcagcaagactggaactctccggccaggttaccggcggagaagtcgccgaaagggaagaagcagcagtggatgccgtttatttgctgccactccatgaactgaccgttctgagggtctttctggagttcatactagtgtatcggtgtggttaggcttgtccagatttgtaaatggccattccggtttgttctggcttgtgttggcactgatatgtctcagacttcagtttgtcccatcatcacttttt

SEQ ID NO: 6352 - DNA, 795 bp, Triticum aestivum
  Clone ID: PAT_TA_6352
gggggccgcacgggcccgcccctgctgggcgctcgcgccgggctcgcccccgccgccctgtccgcgcgcgggagcccctgctgcccgtcgaccccaccaccgccccgccttcccaccctgaaggcgacgaaggcggtgaagaggcagtgcggccgcgcctctccggcgcccccgctgaggtggaggatgagcaactggtcatcaggtacgcgccctatgcgcgccgtgatgcgtacgggccgatgggccgcgggccgctctctgcggcgcaggtggcacggttagtgctggcgggcgtcgttctcctcccgctccgtctcgtcgcaggggtgctcctggtcgtcgcctactacctcgtgtgccgtgtgtgcacgctgtttgtgggcggagtgggagagggccgtccccgcctacaggggttgaggagggaggccgtgctgcgtgctggccgcgtgttgtcgcgggcaatgctgttcgtgttcgggttctactggatccccgtgtccgatcgaagcttccccaatgccgaggtcagcacgcgaccttcctctgtcacattgtaatttatttagccgatgtgtcctggctgtttccctacgtacagtacttgctagtgggtcccacattacatgactatgtcgtggttggcgaacatggcactggtttgaaagagagagaatgttgtgataccgaggtgtgcgtgacagcgtaggactacagatgttctgtggtgctgtaagttgtggtaactatggtgaatcacataatgtgtgggctatttgctaggcgagtact

SEQ ID NO: 6353 - DNA, 649 bp, Triticum aestivum
  unsure (1)..(649): unsure at all n locations
  Clone ID: PAT_TA_6353
cgaggacgccatggcgggggagaagaagaagcggtggtggaggaggaggaggtnaaggtcgaggagcagcagcagcggcacaagnagcatcgtcttcgatccagccaaagtcccagatatcattactgaagtaagtgccagatatctggtcacgggaacgatgcgatctggtgctgaaaaggaagactcaaatgggactttgactccaaaacgcaaagggcttgaagcacatgaaaatggcaatggtgaaattaatcatggtccaagcaacggcaagttagaaaatggatcgcactcgaatggttcacatcaggtccccaacgacggtgaacctaagatggaatacatgtttgaaatcaacaagactgaaatttatccaactgaagttgacaaggacggacatgtcaccgaggctcaaccgaaggtcgaagagtacgacctcgagaagattttggatcagcaagaaacttatgaactgttctgtcccaactgcacctcgtgcataacccggagggtcatcctgaagaagaggaaaaggacagtaagaacaacacccaccgatgaaccgtcaaagagaccgtatattgaaggacaggtgcctcctgttactttgcctgatagggttgaggaagaatcgcccgaagtattc

SEQ ID NO: 6354 - DNA, 568 bp, Triticum aestivum
  unsure (1)..(568): unsure at all n locations
  Clone ID: PAT_TA_6354
attcggcacgaggcaatgctgccgaggtgcagcagacacctcaagttgtggagaagagccaggccgcggagaagagcgagaagaaggcggagctgaagcccgatgaggcgaagaagctgatcgagttcatggagagtaagtacgacgagcacgtggcgaaggtggactcgttcgacgacttctaccacgccatctacgagctcatccagaagttctgcgaggagcgcgggcaggtgcagtacaggatcccgcccagggagaagctgcaggaggtgtacacgaagcaccacaaggcggggagtggcgaggtgaagcgggaggagttcgcgaagatgagcggggagctggtgaagcgggacagcttcagcttcggcaaggcgacgacggagctgctcatgttcctgttcggcgcgcccatgtgcgcgctggtggccaagcgggtcctgccggggctgggatggctctccgacgacaccgtcattccgctcgccacctccggcgccgtcgccttccttgtccacaccaaaaagctcngatcgatcgatcatgtctcaaccgagtattgtat

SEQ ID NO: 6355 - DNA, 766 bp, Triticum aestivum
  unsure (1)..(766): unsure at all n locations
  Clone ID: PAT_TA_6355
aagaaggcaccaccaccacctgcgccgatggcccgcacgaaacagacggcgcgcaagtccaccggcggcaaggcgccgaggaagcagctggcgaccaaggctgctcgcaagtcggcgccggcgaccggcggcgtgaagaagccccaccgcttcaggccgggaaccgtcgccctccgtgagatccgcaagtaccagaagagcacggagctgctcatccgcaagctccccttccagcgcctcgtccgggagatcgcccaggacttcaagaccgacctccgcttccagtcctccgccgtctccgcgctccaggaggccgccgaggcgtacctcgtcgggctgttcgaggacaccaacctgtgcgccatccacgccaagcgcgtcaccatcatgcccaaggacatccagctcgcacgccgcatccgcggggagcgcgcctaggttccggtaatactgggtggtagctgttcttgtcttgtgatctgggtgtgtgtcgggtgcttctgtttcttggtgttgatatgatgtgtcatctggtcctatgtatcacgatgctcgaatgaaattgcaagggaagagttcagttatcatctgatgctaattttgctctccaatgccactgttcgctatttcattgctnnntgattctgctacgtgntcttgtcnnnnntannanngtgttgcagnnnnnantnnacantgcatgatgcnnngnnnnntgggnnnnnnngnnnnnnnnnnnnnntgnnnnnnnnnttnnnnnnnnnnn

SEQ ID NO: 6356 - DNA, 1402 bp, Triticum aestivum
  unsure (1)..(1402): unsure at all n locations
  Clone ID: PAT_TA_6356
gggatgtgaagccagaaaatttactccttacttctgatggacacatcaagattgctgattttggtagcgtgaagcctactgtggacactccaatcaaagtcctcccaaattcaactaatgagagggcctgcacatttgttggaacagctgcatatgtaccaccagaggtcctgaactctgccccagcaacttttggaaatgacttgtgggcattggggtgcacgttgtttcaaatgctttctggctcttcgccatttaaggatgccagtgagtggttgattttccagcgaattattgctagggatctcagatttcctgagttcttttcggatgaagcaagagatctcattgacaagttgctggatgttgatccaaccaaacgaccaggtgcaggacctgatggttatgcttccttgaagaagcatcctttcttcagaggtattgactggaaaaatataaggaagacgcgcgcaccatagcccgctgtggaggcaaatgcaaatgaggatgaggataatcaggattcagattggctgtcacacatgggaagtgcacatgccaaccaaaatgntccctgttgggaataatggtgctgcgtcatcttcgggagagagagaagaaaaatgaaaacggggggaaacggtcgactacatgctcacaatttttccacaagtgagaggtgattcatgtcagtgcatattgctttaacaatgtggcaggcaggatttcctggagccagatgaatctgtagtgttgatatctaagctgaagaagattaataagctatcaaataagaaggtccagctaatcctcaccaacaaacctcagttgatctgtgttgaccctgcaaagatggtgaccaaggggaatattagttggtctgatgatccaagtgaactcaatgtacaagtagccaactcctcgcattttaggatctccacgccaaaaaaggtgttcgtatttgaggatgcaaaacagcgtgcctggcaatggaagaatgcaattgaagacctccagcactgccaaaagagctgattttcaattgaaatcaagataccgaaacgggtgatgttaagcactctgagcacaccttagccatcttttttcactttgaggaacacatgggagtttctccgctcctgccctcctccgcatgcctggggaaggaaatcacttgtggcatgttgatcgatgacccccgtctacctccctaagcagttttgtttgtttgttagttgccgcagcagatagcatcagagtgattgaaatgttggccctccagaacaattaacaaaagaaatccatgagatgatcgatttgtattgttgtatttgtatcatcgaatcaccttaacaatgctgccttagcttaattatattctcttgcgtccaaaaaaaaaaaa

SEQ ID NO: 6357 - DNA, 358 bp, Triticum aestivum
  unsure (1)..(358): unsure at all n locations
  Clone ID: PAT_TA_6357
gattttgtgatttgccatttggtggggcggcaggcacacgtctccgtgcaacatgcctagagcatccttcatcgttccagcgccagaggttgcaacagccagggacaaagctagcttgtttccacttgggatgtgccgacaactctgatatctttggcgttgcctgcccggacagcaacagcgtgcaccacaaaatggcacattgtgttgacctcaccatgagccactaaaataaaatgaaaaaggaatatgttcgctaaaatatgggtgatagttagcgcagttctgtncttgagtagttatctgctgtgtataagtgaaacaaatcccggctgaaaacttccacctaaaaaaaaaa

SEQ ID NO: 6358 - DNA, 657 bp, Triticum aestivum
  Clone ID: PAT_TA_6358
ccatcattgcgccaggccgtcgccaaggcaaagcaagaggccgggcgggcgacgcagaagcacgacaaggacggcaaggctgtggccaaccataataacgccaaggagcagctcatcgaatttatggacaacaactacgatgcaaagctcgagcctaccaaaaccttcaatgagttttaccacgccatcttcgagctcatcgaacagttttgtgagcaacaagggcagctgcagtacaggatgccaccaaaagatcaactcgcggaagagtacaaggctcttcggggaaaccggcacggagtaaacctcaccaaggggcagttccacacgatcactgagaacctcgtcacggtgcacagcttcagcttcggcaacgccgccttcgacgtgctcgtggtcctcttcggcgcgccgatgtgcgcgctcctcgtcaagagggtcgtccccggcctcaagtccttctccgacgacgtcgtcatcccggtggccacctccggcgccgtcgtgtacctggccaagaccaacaagctgtgagccggcggattatatgcaagtgtaactactactactacctgcccacaagaagaaaaataatgtgtcgaatcgtaatgatgcaactgtgtggtggctcgatcgcgtccagattgcaaaatctct

SEQ ID NO: 6359 - DNA, 543 bp, Triticum aestivum
  unsure (1)..(543): unsure at all n locations
  Clone ID: PAT_TA_6359
ttcggcacgaggccgaccgccgactcctccctaagnacgccgcgccgcctcgacgccggcgatctcctccggcatactggacttctccccggtgattggagcaagaagactgatgtgaaaagggagacatcgcctggcatgatcaaaaaggagattttgcgtgtagaagtagagctgatgaagtgaagtgtaccagctaattcctatgttggttctcagtcaccaaaagaagcaacaataaacaacctggatggataaatttctctcgggttctcaaagctagatgatcatgacaccacaagatggatacatgtgtctgcacgttgttgaaatgaactattgttgtcgtaatgaattgttgttgtcgaagatcacgttgtttgataaattatgattgctgagatttgagattcgaagtcacgctgttatgataaattatgttcttgctgtgatgagatattgatttcaaatcgtgcaaaattatgttgcttctaaaaaaaaaaaaaaaaaaaaaaaaaaaaaaaaaaaaaaaaaaaactcgaa

SEQ ID NO: 6360 - DNA, 1331 bp, Triticum aestivum
  Clone ID: PAT_TA_6360
gctcttacctcgcagcttcggcagctgccggatccgccgaatcccccaccgatccatccctctagcagcacatctctccctctctcgtgtgacccctcgtgccgcggccaacgccggccaattccgccaacgccccccactgcgcagcagcctcacgagctgctctccgacccctccgtccgccaagatggctggatccgccgcttgtaaagctctttcgtcgagtgcgcgatcatgacaggactcgaggaagaagccccggctaactccgtgccagcagccgcggtaagacggggggggcaagtgttcttcggaatgactgggcgtaaagggcacgtaggcgtgtctccggtggcgactctccgtcggaaaaagtgccccctcacgccctctccacctcttggatggcgctccctagctcggcgcgctcgcatgcgttggactggacgccggcgatgcgtcctcctctgtcacgtctccggcgcagctatgcacatgtggcgacctcctctgcctcgcgaagccggtggccaaccttcgctgcgagcgctgcatcgcctacaaaccgagcagaacatggggtgttctggagcagatgctgcttggtagagcaagcacaggcgccatgaaaggggaagaataagagttcttgcacataacatgtttgatgaaatacaggcaccacaaattgaactcatctccaagctatgctttatgagaggctacagactgttacattattttgtccagtccatgatgcaagattcattcatttgtgattgttgcaataacgattattggccaaaagcatggttgtgtgtggttcctgctgctgtactgtggtattggttttcttccgcctgcctgatgtggtgatgctttggtgtgcctattgttcgcagagattaaccaatatttgggagatgtggtggctcacccgatcggaaacagaacaagatgaaggagcttaagtatagccacatcagggtgacctgggaggaaggaagtttacgtgtgataggagatgatcgccataatctgggtgctaaaggcctttggaaacagaacaagatgaaggagcttaagtacagccacatcagggcgacctgggagcaaggaattttacctgtgataggagatgatcgccataatctgggtgccaaaggcccaggggattataacatggtttttttatagaaaggtgactaaaacttttttttttactttgctgggtctaatttagttttcctatgtttatagtactcctgtactgtatatagagaccaagtcgagtaggccatcagttttgtctttaggtaaaattaattaaa

SEQ ID NO: 6361 - DNA, 855 bp, Triticum aestivum
  Clone ID: PAT_TA_6361
ctcttgaatgttctcgtggatacccatccgatatagctgccaatcgaattgttaatgaagcaaccctacctcgaggactacgagatgatactacctgcatcgtggtggacatactacctccagaaaaactagctcctagtcctccaacaaagtggcagggaaaaaccgtgctcaataatatgttccgcgttgatctgaaaaataacatgttccgccgaaaaaattcagatgcatcttttaaaatagatagagaatatgctgagccggatgtggtggaagaaatatttgaggacgggtctgccatgctttcaagaaggcttagtacaggatacgcacttcggaacatgtttgaaccctccagctgtgcgatttgccagtttagactgaaatctggccaggggatttccatacatgctaacccactgcaacaggaaaaaatgcaaggttggcaaggtcctttcctctgccaaagctgccatgaaaagaagaaagcaatggagggtaaacggcgtccaatagattagtcgaccgcagatgccttcagtcacgtcgggcaggcctaattgctgaaaccattctttgatagacattcctttgttttctttaccaggaacattagtcagttgaccacatatttctttttgtacattgaccactctagtcaagcagtacaaagtattcttgacaagttaggttggaaattcattgatcagtcccaccgacatggaaaagggcacccttttcaaatgaggaaagcatagtcgttagaattttagcttgactgtacaggggtctaaaggatcactaatattctttttgtagatgagttgaaaaaaaaaaaaaaaaaggccccta

SEQ ID NO: 6362 - DNA, 814 bp, Triticum aestivum
  Clone ID: PAT_TA_6362
gagagccgcgaattccctcctcccgcccgccgagtcccgggctaaaccaagacgttctccccggggatctcctgggatccgctccgcccccatcggttttccttgcaggatagtgggatccccttccatccccattttaaaagccaagcgctagcagtggctggaagaagagatccctgccttcacttccattgacccaaacaaatcatggctgctgatcggcgccacccggctgtgaacgacgtgtacctgacgctcgtcggcgccagcaacaccctcgccgacgtccagcgccgccttgacctcgagttccgtgcctcctaccctgaccacgcaaacccggcgaaactggtagggcgagtgaagcgggtgcaagaggaggtggctgcgctcaaggatctctgccgcgacctcctcgcccagaagcaggagctgatcgacatgatgcgcacgagcctggctgcgcagcggagcgccacgcaacggcttctcgcctcctccgggctgcccctcatgaccgacgacgaggaggccgcctgcgccagcctcaagcaggtgatcgacgagtggactgatcagctgaagccaatggcagggggtccggatggggagaatgaagacaccaaccagatcctcttctccgcaatcctttagagagactgaaaacttcttgagcatcgaacaatttctctgttggaagtttttccttccatcttgtgtgcgtttttagcagattgcgacgggcttgtcaattagcgtcttgttgagtgtatatgagaaaaacagtgttatttctggtttggatgctattcct

SEQ ID NO: 6363 - DNA, 1189 bp, Triticum aestivum
  Clone ID: PAT_TA_6363
agagttcaaccctaatgccgctgccgccgcaggtctgaggtcagcgaatatgggtggtgtgacgtcatcggtggccgctaagttcgccttcttcccgcccgacccaccgtcttacggcgtggtggacgaggagccgcttccgccgggcgtggctccggcggggagtgacgctgcagcgctttctaggagggtgttgatgacgggggttctgtggagagagggggtggaggcacgtcgcctccggacgcggcggggcacggagatcattgccatgtatgtagggtgtcctaaggcgagtctcaccgtgctgtactcgcacggcaatgccgccgacctcggcaagatgtatgagctcttcatagagttcagcgctcgcctccacgtcaacatcatggggtatgattattctggttatggacggtcatcaggcaaggtcatcgagactttcccccctgttaaatgccctgttctggtgattcatggtacaagtgacgatgttgttgatttttcccatggaaagcggatatgggagctgagccaacagaagtatgagcctctgtggatcgagggaggcgatcactgtaacttggagaccttcccagtgtacataaggcatctgaagaagtttctgtcggctgtagagaagttgcctgctggaaaagaagcagcacctgagagtgagaagttgctagctggaaatgaaaaaccttcagatagcgtcgctctttctgaggcgcatttgatgacctcgcagaggttagagccatcgaggaagagctcaaggcatgagcagcctcctaggctgagcactgaacgtgtagataaacaccatcgaagtacagacgtcagggaaaagacaaggtccatcacacataaggagagatcaaggagaagtgtcgatacatttgacaggacaagagatgaaaatgaacagacagacaaaccaaggaaaagcattgacaggcttggcgagatgattagatcaatgggcctatgcaatgttgattgcttcaaagagccttctcgagaaaccgaggcttgctgagtcagtgagtggtttttcatatgtagttatagaatcgttttgtttctctttgcagcggcagagtcaacaatggtttgtgtggtcttgctgatgaaaattgtaaaattgtccacgaacagcaaagataaatatagtgcaactcct

SEQ ID NO: 6364 - DNA, 409 bp, Triticum aestivum
  Clone ID: PAT_TA_6364
ttcttcttcttcttcttcttcttcttcagagaacaagaaaaatgtgtgcagagaggagagggatgggtacaagcatactacaaacatggaggaccaattgccatggacaagctcagatcaagaatgaatcaagtcttataattactaggggaaaaacatggagtaattaacaggaaggaaaggaaaggaaaaaaaagcaatatcatggatgatcctagtagtatttcacttggctactaatcttttaattaacaacaatggcggctcccgcctctagccgcccgcccgtccgtccaccgccgcactccggcagggtcttcgtcttcttcgtcaacttcaacttcacgaccgattcacaaaaccaaaccaaaaacaaaaaaacaacctccacctcgtcgttacagatcga

SEQ ID NO: 6365 - DNA, 896 bp, Triticum aestivum
  Clone ID: PAT_TA_6365
ccgcgacgcggggccccgtgccgaaccgccccgcgcccaccgataccacacgaccgctcccccttcacagcgaagccccccctcttccgagactgctcccccctccccgtcctggcggccccccccccttccgggcccacccccccgcgacctctccttccccagcaccgtccctccaccctgacctccgacctacccaccatgcccagcaggtccagctccgccacggctcccgcagccacgcgccggcagaccaagcaggcgcacgacgtggctctcttccccctctccacctctgtttgcttggttttggttgctgttgttccgatctctgttgtccaacttggcaggggcgcaggtgcacgccttgtggtcatactcttccactctggtggccaccatcaggcttccacccctccagtgggttcagcatgcagcagtaagttacacccgattcgggccggaatgagctgagcagttgcagccttcctcctcgcctagggcggtgcaggagctccttcacattagcagcagctcaagcaaaacataatgccgtggttcatcaattttgttcctagcccaccctacgattcaggtagagcggtgggcttcatgttttctctgtacgctgtttgttccttactggtatttcttagataccccatttctgcggtgtttgtctgtctgtgttctgataccgttccctgtggttgcgtggccgtcctgccgagtgtttgtcgggctcgctattccttcggaacttgtatgtctgtgatcaaataacttttatgacacatgaagtataacagtctgttctgtctcatttgatcaattaatctaaacactgatggtcggttgtatttcaaaaaaaaaaaaaaaaaaaaaaaaaaaaaaaa

SEQ ID NO: 6366 - DNA, 922 bp, Triticum aestivum
  unsure (1)..(922): unsure at all n locations
  Clone ID: PAT_TA_6366
gccagnacttgctccacagtactataccatacagagccgcgcccttgtgatatgataagaagaaaaggggccaggccgccctcttttcttttccgcaccaagccttcttgtaaaatcgggtgtatagctcagttggtagagcattgggcttttaacctaatggtcgcaggttcaagtcctgctatacccaaaacaaaaaaaaccactcttgtattcgtaaggatgcatagtagccttcaaagagcactctttggccttgagaaaagcccctttctcatcaacatctcgacttcgctcgttgtttgaggtcagtataaaggagatcagatctgtcccgggaatcgaaggatacagaaatatggaatcgagcacagattataggaaacaagcaaacagaacaggttggatcccatctttaactgcacagagcagcagcctactattgattgatgatcttaccttcctgagagtcgaggaacagcagatgagatagccgaaaggggggaccccgggtaataggtttccttttccggtttaggcttgagagaaatcaggaactgaactgagcactccacaagtatggattggattggattgtttcattctgataccaactttcatgctggaagataaggttgccatactgggaaagggggaaaggaaataggatcccctctcttctctacaggaatgaacttctcctcgccgaccactggcactatacttaggttaggcgcaataggtgacttaggttgggttgtctggatcaatcctacaacgaatagctctctttccttttaatggaacactcactagattctgctaaataaggataactgcaaagataagccgggtcatccgaaaatcaaggaaatatttccggattttctgcatggcatatttcctatcatttcacaaccta

SEQ ID NO: 6367 - DNA, 1525 bp, Triticum aestivum
  unsure (1)..(1525): unsure at all n locations
  Clone ID: PAT_TA_6367
ttttttttttaacccgttctcatgagtgttgataaactatatattgaaaaattcctttctttgttgttgttagcccttgtttttcggtaatatacatcggaggcactcaggttgtacttcatatctacaacccaatctcgtagctcttttctctttacaacctacagacagattgaacaaatggagattgctatatggtggactacctacagattactaaactttacaaaatccctctatcatcctctcaatttctgatcctatggaattcattgtcattaggcaccttttgtaccattatatccgagaatcgcaacggctttggtggttatgccaagagggtttcagaatctcctggagaagcacccaaatgctttatttcactccagttttcatcatgaccatcaaatcctgatcatgcagtcaacaatgtcatgcctttggtgccctttgttgcacaaagggcaggagtcaaatgcatcccttcagttatgtatgctaaacgcctagatcatattccatcttgcttggcacatgcaatcatgcatgggcaaggtgaatttggactcattagttttccttgaatgcgatgccccttcagtctcaatggtgcactatttcccgcatgtagtgcttgaatcgactccatctgatatttgggtcgtcaaaggataagactagcttccgtttgttgggttttattaactttgcattccctcctaacaggtaacgcctgtgtcccatcaaaaagtgagggaagttccccccttggagtcgtcacaaacactacgctctgatcaccgacggtgcaatctagtgcggctcccccagaacagtagccctcatacgaactaagcttttttgttattgctatactaaaaatttcctttctttgttgttgttagcccttgtttttcgaatatacatcgaggcacttaggttgtactcatatttacaacccaatctcgtagctcttttctctttacaacctacagacagattgaacaaatgaaaattgctatatggtggactacctatagattactaactttacaaaatccctcgcatcctctcaatttctgatcctatggaattcattgtcattaggcaccttttgaccattatatccagaatcaaacggtttggggtatgccagagggtttcagaatctcctgagaagcaccaaatgctttatttcactccagttttcatcatgaccatcaaatcctgatcctgactgtcacaatcccatgcccttccgccaaagcttcacaaagtccgaggacagccccccacccgggggtgccacgccttgtttgtccacctgctggatcacgcaacagtctgggaaggngtanaggaacataggttgcgaatgtgatgccctatgnacaaggngaatantcacaagtgggctgaacaaccatcgatantgggcgcaaaaaaaacactcgttgtggttatgcttgatccccaaaggaacccgttcacaaagggggaatccctggtncnaaaattnccanaa

SEQ ID NO: 6368 - DNA, 1222 bp, Triticum aestivum
  Clone ID: PAT_TA_6368
gaattcggcacgagcacctttctcctttccgccattccctcgctcccgtcgtctctcccctccgacgacgacctgatctcttctcccccctccgcgccaccgccacctcgctctccggccggctggcaccatcttcctcgtcctcggcctcggcgcagcaggacctccagcgccgcaccctcttcgaatttggtcagaccgctcctccgaccgccaccgccgcgtcaggctgcatacagtattgtggcaacgggattatggggacaccacacgctgattcagaaaagacggagattggagaaatagatacaagggctccttttgaatctgttaaagctgcagtaagcttgtttggcgaggtccggttttcctctgaaagatccgccaccagaaaggcacaggccccacaagcagagagggtgttggctaaggagacagaactgcacttggctcagaaagagttggataaatacaaggaacaactgagtaatgctgagactaccagactccaagccctctctgagctggagagggctaaaaaaagcgttgtggatctaacaaataagcttgatgcagtcaccaagtcaaaagaactgaatatccgggcaacagaaaatgcaaatattcgaacaaaggagctcgaaggtggcagctctagtgaagccgttggaaaggatggtcctttgaagcaggagctagacaatgcgagggaacagtatgctattgctttggcagatcttgatgcagcaaagcaggagcttagaaaaatgagaaaggattttgaaacctcactggatgctaagttacttgctgcccagcaggaagcagagtctgtgcagtcttctgaatcaaacaaggaaaaggcatctcaactccgtaccgagattgcaatggttcaagagtcacttacgcatgcgaaggcagccacagagcaagcacgtgaagaggaggcaaacatccttgctgagaaggatgctgccaggagaacttgtaaagaatctctggaagaagctcagagaaaattgtcaaatttgagaaatgattttgatcctgtagctttcaagggcctccaggagaaactcgatgagacttattctgagattgcatctttgcagaagaagatcgaagatgcgagagatagagatttggagtctgtttctgctgtcagcacagagttggatgatgctaaagaaacgttgcagaaagttgcacaagagcaaac

SEQ ID NO: 6369 - DNA, 1062 bp, Triticum aestivum
  unsure (1)..(1062): unsure at all n locations
  Clone ID: PAT_TA_6369
gcccccgcaatccccaatccgncctcgttctcctccgcggnttgatcggaaaggttcgtctgtagtagcgctggcgccggttgcgccggggggaggaggaagcgtggaggcgggtgaaggcacccatggcgagcgacgtgcccatgaccccggagctccagcagatggatggagagatccaggacatcttccgcgcactccaaaatgggttccaaaagatggacaagattaaagattctaataggcaagctaaacaattggaggatcttacagggaaaatgaaggagtgcaagcgcttgatcaaagagtttgatcgtattctgaaagtcgaggagtcaaagaaccctcctgaagtcaacaagcagctaaatgacagaaaacagtatatgatcaaagagttgaactcctatgtcaccttgaggaagacataccaaagtagccttggtaacaacaagcgggttgaactctttgatatgggtggtacaagtagtgagcctgccgcagatgacaatattcaaatggcatcagctatgacgaatcaacaactcgttgattctggaagaaaccaaatggatcaaacagacgaagctattgtcacgttcaaaaatggttgttgcgcaaactgtcgaagttggatctcaaactgctacaacattaacacagcagacggaacaaatgaagagaattggcaatgagctcgattcggttcacttttcgttgaagaaagctagccagcttgtgaaagagattggccggcaggtagcaacagacaaatgcatcatggggttgcttgctctgatagtttttggcgttattgcaattatcgttgttaagattgtcaacccgcataacaagaacatcccagatatcccaggaatggctccacctgctcaaaattttcagactaacaggagattgttgtcagcaaaagctttcagaggtctttgatgattgcatgcggtggtttcatgctgcagtccttttgtaacaaagctgctggcagtgcgccatgagatacgttgtaacaattgttctgnctcatgtatattattttnctgntgt

SEQ ID NO: 6370 - DNA, 773 bp, Triticum aestivum
  Clone ID: PAT_TA_6370
cggcacgaggctcctctcctcacacccacctcctcagcagcaggtcgagagaaatccctaggtcgtcggcgaccgcagccggcgagagaacaaacggcggcgaaaaatcacgggggcagcccgcacaggcgaggaggtcgaccacatcgctccgcgcggaggcgaagcaccaccagtttcgattgagagggcgaccgcgcggccagtgaaggggagggagaaggtacaggcggacaaatcggcgacgcgaagacgacgagggcgcggcgagctgcttcatccccgtcgggaagagagtacgcaacagaaatagtgaaaactagccaagcacaactttcccaccatccctggcatggcagtttttaagatggaggactccccagatcaatacgatgaagcaaggtgcaatacaatagacaagatgcaattcaagagccaagagtcagcagcttttattatctagcatccaagttatacatgtgtaaagggggaggcaagaacagggacaagaatcaagccaggttctgaaacacttaggtacaggggcaatttttgcaagtagtatatcaggggggggtaggatatagagagggaaatccactagtttctagaattaaaagaagttcataaacattggaacaactttgtttaccttttgctgttcactgggagaaatttgcccagctctggcaattgaattgccctcgatctccagaatttttgcctggtcagcacgaaagagttgcagacacaaaaaaaaaaaaaaaaaaaaa

SEQ ID NO: 6371 - DNA, 1113 bp, Triticum aestivum
  unsure (1)..(1113): unsure at all n locations
  Clone ID: PAT_TA_6371
gcacgagggtcggggacgggaggaggacgactcaagccctcaagacatggaatgtgacgtgcacatactcgcagttcgtcgcgggaagatccccgacgtgctgcgttgcgctctcgtcgttttacaacagcaccatagtcgactgcaacacgtgctcatgtggctgccaagacaacagcacaaacccagtgagctgtgtcaagcccaactcaccttatctggcttctgtcgtgcccggggatagcaccaacatcccggcacctctcgtccaatgctcccctcatatgtgcccaataagggtgcactggcacgtcaaggctaactacaaggactactggagggtgaagatcacggcgacaaacctcaactacctgatgaactactcgcagtggaacctcgtcgcgcagcacccgaacttcaacaacctgaccactatcttcagcttcagatacaaagatctgaacccttatggaacaataaacgacaccgggatgatgtggggcatcaagtactacaatgacctgctcatgactgcccagcataatggaaatgttcagtctgagcttttgttccggaaggacccggacaccttcaccttccagaaaggatgggcgtttccgaggcgagtgtacttcaacggcgagaactgcgtgatgccgcctccagatgcgtacccatggctgccgaacgcttctcatcgactgtcggcgtcacttaccattccattcataaccgtttgggcagcattggcattcttgctggttcatgcgtagtgaaggtcggtccaaggaggaatgaatacattagatggaattgcacagaggttttcacatgattattgaacaaccgttcaggggctcccgaacaaaggtttagatgacaactatcttgaagctctgactgatggttgtacaattactactggatgtgctttcttttttctttnntgcggggatacttgttgtgcattctaactaaggcaaaatagatacttaattcaaaaaanannaaaaaaaatcgagggggggcccggttaccnaattcgncctatagtgagtcgtattacaattcanttggccggcgtttaacaacgttcntgatgggaaancctgg

SEQ ID NO: 6372 - DNA, 358 bp, Triticum aestivum
  Clone ID: PAT_TA_6372
attcggcacgaggggacaacattcaaaacacctatactctgaagcatcgagcatgttgaagctgatgctagcgagaaggattgacttctagttgcattagatagttcatttcttgggttgccatgtggtagtactggtctttttgtatcttgtgtggttgtttgtggttttcttccttttttggtgtattgcggtcgtttacattttgtcctaactttatataaatacatgcaattcttctggatggttcaaaaaataaagttcattcaccagctatgtgcaaaaaatcaccacccacatgccctcatcattgaaaatttgacacactagcaattggtggtgacttgcaaaaaaaaaa

SEQ ID NO: 6373 - DNA, 653 bp, Triticum aestivum
  Clone ID: PAT_TA_6373
ttcgcacgaggcaatcttgggaatgaagacccgctgcagctgctggcatctcatctgccagctctcacttatctcagccttaacagggtgagtagtgcaggtacattggtgctctctgcagggtgcttctgtcagttgaagacgcttgtcttgaggcgcatgcctaatgtcaagcaactggagattgaggagggtgccattccgtgcgttgatggtatctacatcgtgtcgctctcagagctcggtatggtccctcgtggcatcgagtcgcttgggtccctgaagaagctctggatgctagacctgcacaaggacttcaaggctgactgggatttgaaccagatgcacgacaagatgaagcatgttccagggctccgtgcctagctagcagagagcggcagagatgcagaacatgatgaagcatggtccagagctccgtgcatagcaaagagcggcaactacatcctttggtaattaaaaatcataagaattgcttatgcactgtaagcgtacatgcttttaattatttgtaatggcactgtaatagtatcatcagctcttgatttctttgcaactgcgtcttgtcatgcctgcattgctggttgtttctgtaataattcctgaaacacgggcatttcttgccaaaaaaaaaa

SEQ ID NO: 6374 - DNA, 868 bp, Triticum aestivum
  Clone ID: PAT_TA_6374
gcggaagtaaagataaggccgagttgtctcccatctctggatgaggattcctgttcgccattgtcgcttgtgcagatctgcggtggagcaattccgcgcggggctttgtcgggatggtgttcttgctgcagaccgattaggagcactgcggtgatggaagaagtgaacgacagccagcttccgatggagccgcttcactacccggcgatggccactgaagctgagcagctcccgcccatggcggctggtagcgttcaggggcagatctgtgcggccgaggggggagccgtaggcgacggggaagccgagccgcaggcatctgaacaatcaattggacagattgatcctgagactccaggctggactcgcagggttagaattggagcagctgcacccggaagggcaccttgccgtgggcgaatcagcgcccttgagaaggcgatacgggggtttgctgatcaaccaggggacatggtaattgtcccagcacttggtacaagcttcgatacactcgaggaggcatatgacttttacaatctctactcgcgggagaagggttttggaatgtggggagtacaaagtgcaagcaagaaattgtttgtggctgtgcgggaaaagctggagtggagatgtccgggccttgccggtgcgagtgccctgcactgataatgctgctccgttcaaaggacaatggttggtacatagctgagcatcatgagcatcacagccactcattgtctacgacatatgggcagacaatacactggccttcacacgagcacatcgacattgacaaaagagacttggttgagcaattgcgtcagaacaatgtgaatctagccaaagtatatagcatcgtcggaagggt

SEQ ID NO: 6375 - DNA, 718 bp, Triticum aestivum
  unsure (1)..(718): unsure at all n locations
  Clone ID: PAT_TA_6375
ggtctctctctcctcgcttttctacgcaattcgcccgtcaacgtgcaagccctagcgccgctcttcctcctctacatctccaggtcgtattttgatgccaccctcgatttcagcgttccatcgatactgcaatccatctagaagaagaggactcaatccagatgaggaggtgtatccacaataatttgaagagaagaggatgacaacaatacttgaggctgccaagtggaggaattatgttggagtggtggtggcagccaactcacactctaaatccaattcgagtttgtctcccagcaatcccctgattatacgttaggggaggggatgagaaccagcaggggtggtctgcaatgcctaaagtggaagcctgcacgggcatgcctgcgatgaggatgatatttggttgggtgcagtgatagcatgagcttgagagcgcccaactcctccatcaatccctgctgttaaggccagctccttaatgctcctacaggtcccgtttggctactatatacagtccagggtcaatatatcgggacaatcaggaaggccgtatcatatttgcgctttgtttgatgttttcttggtctgcgcacatgcttttgaaatagttcccatcatgtcatagcaatgagctttgtacaaggcagaaataagtttgtgatcaagcaaagaaagtgaatacatttactaaaaatatatgtgtgtatncctgcga

SEQ ID NO: 6376 - DNA, 803 bp, Triticum aestivum
  unsure (1)..(803): unsure at all n locations
  Clone ID: PAT_TA_6376
gccggcccgcggtcgagcaccctcttccctcgccgccgccttctctcctctccctcgattctccttgcaccgccaacctcgttctgcatccgcgcctgctccgagccccttctcttccccatgccgcctgcctcctcctctgtaccccccctccgcccctcccgcccgcctcctcccccccgcgtctccgccccccttgccgcgcctgttctgggccctcctggccgcggggggcggcggcgtccgggccgtgcagcggccgccgcctcgggccgcggcggcggccgcctgcgggggccgcggtcggcgcggccgtcgaccgccggcgcccgctcgcctcgcggcccgccggccgcgcctcccgccgtggccgccgcccgggccgcccccccgggcttcggtgtgggccgcgtcctcgggcgtttcggtttcgccccgcgcggtcggcggctctttggcccccctcccgcgcggcggcccggagggcggggtcccgcgagggctcccggcgtgtggagacccgctaggacgtgcctcctgttctgggcaggtaccaggatggtggtgttcgggaaactgtccgtaaggtcgctgggggggcaccagtgggcccgctgagctctctgtttccctaagaacgaaggatacactcacacgtctctatcttttcttaaccaagcaatttcctatttcaattttggccattcctatcaatgctgggatgaaagctaggattaaaacataataagcagaagcagcaatnctcaggaaaagcatataattgnctnggtaaaataaatgnc

SEQ ID NO: 6377 - DNA, 917 bp, Triticum aestivum
  unsure (1)..(917): unsure at all n locations
  Clone ID: PAT_TA_6377
gcgcggcgccccccccctcgccgcccccgccccctccgctccggcgccgccccccccctccccccccgccgcccccgccgccgccccccctccgccccccctccccccagatccggcgcagcaggggtcggcggcgccgcaccagcagcgccctgaccagttgatatcatcatcggcgacctgtgaagagtggatgcaaaagtgaatgctcaaagcagcgccgaggcacgtctttctcacgaccctaggctgaacggcaacggcactgccaggcacttgcatgatgaatggctggaagagtatgaagcaggtgttttcatgaagctgaaggatctcggcgacgggacccgggaattgacaagggttcggttcagcaaaaggcggtttggggagcatcaggctgagaattggtggaaagagaaccgcgagaaagtttatgaccgatataatataaggacctcccgacgagcgccgtcagcacctctaccccactcggccccatcacgtaccttcctgtttcttcacgcacaaactgcaaggccagccatcaatgagcagcagcaaatcgtgaacgaaactaagggttatgtcatatgtgtactggggtgtagacccgccatatgtgatctttatcgtctcttgatactgtgatattgagactggtaagtaaggttcggttggtgcttaatcactataggccgtagcatgggtcctatcctagtgtaatgtacataatgtagtagaactgaacccattagttgtgcaggtttatgtagtctatttaacgggtcaataggtcttgtcaaaacccagcccattcctgcccttgttttgtcttgctatgtgtacatctattgtcttaagcagagcctagtggtggaacctgtccacccggcagagncttgacagggtaggct

SEQ ID NO: 6378 - DNA, 1151 bp, Triticum aestivum
  unsure (1)..(1151): unsure at all n locations
  Clone ID: PAT_TA_6378
ggcacgaggcaccggcanagagccgtccgacgctacccggtccaggtatactcacctgtgcatgactgcgttggttcggctcgccgggagagcagcttcttggagcaggggcgccagcatcgcgcctccgcgtggcctcggcttgctcccgcagcgcaggaccgcgttccagggtgcgaggatggcgaatggcggcggaaagggcggccgcggcgcgctcatagtcctggaagggctggacaggagcggcaaatcgtcgcagtgcgcccggctgctgtcctttctgcaagggaaaggctgcgcaaccgaagggtggcgcttcccggacagggacaccagcgtcgggaagatgatctccgcctacctcgccaacgagtcgcagctcgatgaccggaccatccatttgctcttcagcgcgaatcgctgggagaaaagaagtttgatggagagcaagctacttggtggaactacactcgtcgttgaccgctactcttattctggagtggcgttttcagctgctaaaggacttgacattgggtggtgcaaggcccctgaggttggactgctagctccagatcttgtaatatatcttgatgtacaaccggagaaagcggccgaaagaggaggctatgggggtgagagatacgaaagagttgagttccaaaagagagttgctgagcattaccattcactccgtgattcgacatggaaggttgttgatggttcccttcccatggagaccgtggaagaacagctaagagaactagccatgaattgcatttcagaatgccaagacaagcaacttaccaatcttccctggtagagttcccgcgatgaaatgccaaaccacataggcacatcggcaagatctctctttagtatgtgattgactgttgctctgttagatctctgaagtgtgtgattgactgttgcgattgactgctgctccgttagatctcttttaagtgtgtgattgacgactgttactctggatgagatacaggcatatcatttctttccccatttatgcggatggctttgcctgttacgcaccccggctcctgcctgcacccgctcattactccggcgccggggcacttcctcccaagggagcctaaaaaaatgggcgtccgnaagcccccaacgggggg

SEQ ID NO: 6379 - DNA, 556 bp, Triticum aestivum
  Clone ID: PAT_TA_6379
cgccgccgccgccccgccccccccgcctgcgcccgtgcaccgcggcggctcggggggcggagctccagcgcaccggccggcaccctcggcggcgacctcgaccgctccaccggctgcttccacctcagcgacctcgcccaggtgaagatgacgctaaagaattatttccgtgggcaaaatgatctatacctgctacaaattgacactgccaagattgcagatggcttaatttatgaggcagctgatggctgtaactactttcctcattcctatggccctgatcggagctttgcaccccttcaactaagtgctgttgtcaaggcacgacaaaatagagctggcgaacaatgattttacttgcagtttacttgatggagcggccacctaattctaatgtgtaactgtaaggtctcacccttggccctggctttcataaccttcttgtaagttccctgtcaaagccatcaacgaccgtccacatgcttaagatagttatgggaagttcacaaatttaatggcaaaaaagccatgaaatggtggttatgtaaaaaaaaaa

SEQ ID NO: 6380 - DNA, 1158 bp, Triticum aestivum
  unsure (1)..(1158): unsure at all n locations
  Clone ID: PAT_TA_6380
aaatgcatgtcgagttcgctgccatatatctgaaaatcatggcccaatgctctactcttgagttgatgagctgcaacctttcagnagctctagcctttgacttctataatggctgtgaggtacaattggtgtttgaatttgctcacttgataaaatggaagattgctccggtgctatctgcggtgcatacagatgaagcccacagcggccagtgtgtatttttcacgggattgcataattgggactcaggtgagaagcttcttagttcggttcagtgtgttgtacggacgctttgggatcctggtggttccacatttggtcggcttgagggcaagccggattttaagggggagggattgtcagcaaccttccctacatctactacctggactggacagtgggccgctcttgggccatgggcctgcggagaagccatggaaagcaatgactacatatacgggtggagatggaaacgagcgactcggcttggatcggaaggcttcggcctgccggtgctgccgcgcgtcgctctctctcctctctggttcctcatcgtctccctcctctgatctccttcttcctccatgtaacttgagagatgtaagcaaattcatggtgattgagtcaatatagtactgggtacctaacacttggcgctcggtgccactgctcctagcctctagcttcctaggtaattttgttcgctccacccctgccttcgtcctgctgggtcaggtgccctccctcctcttcgcctgccccaagggcgttcttcacgcccggatcagcgacgttcgtcaggtggtctccttcgagtcgattcgccagttgttccgccgctttggtgatggatatgtgatctgtgcttacgagcggatggtggacgggatgtacggcgtggaggcgtacattgagttccggtctcgatggagggcggcacgagctcgtgatgccctggatggccatgctatctatgatggttgctgcatccttgccatcgacctcgtcccgccggtctacaccaccatcaccatgccggctgacgacgggatggcgccctcgtacttctacaacgacaccccctacacggagtggactgcagcgttggccgcggccgagcgccatgatgaggcgccagctacatccagcgacgacctc

SEQ ID NO: 6381 - DNA, 1204 bp, Triticum aestivum
  Clone ID: PAT_TA_6381
ctcgtgccgcgcgcttcaacccacccaccgctcccgactccgacggccgcaccgagggcgccagaggatggggagagaccaccctccggcggcttcgtgcggggaggcgtatgggccgggggagaggtggggtccgggtccaccggcgtcgcgctgagcaccctgcagagcggctgtgccggggaggccctgctttccgggcgcgttctcgtccgcgtcctccccggttcgcgctgcctcctcctcggcgccgcgggttctggccagaccacttgcttgttgggtcttgctggggttcatattgttggaggagaggatgttgtccgtctgcttgatgtttctgctcagcacgcgactcaattagtttgcagtggtgacccttcctactggggtaatctgtgtggtcggaatgtcagttcacttggttgttgttccactacagtggcgatttctctgctgagcacatgatatttggagttgatggagcttgatcctgttaggcgagaagaagctgattgatctactggatattgatctgcaatggcgcatgcataaagtttcagacggacagcgccgcagggtacaaatttgcatgggccttcttcatccatacaaggtactcttactcgatgagatcaccgtggatctcgatgtcgtgaccaggatggatctcctcgacttcttcaaggaagagtgcgagcagagagaagccacgattgtctacgccacccacatattcgacgggctggagacatgggccaccgacatcgcgtacatccaagagggcgagctgaaaaagtcggcgaaatactcggacatcgaagagctgaagacggccaagaaccttctgacggtcgtggagtcatggctgaagtccgagaccaagctcccaaagaaagagcccgcgcgcgtcgagagccagcccaggcgctcctccccgttcgacgcctcccctttccgagcgtcgcgccacatggcctactaccgatgatgatcgtgtaaaacctctacacccattccggtgtcatacaactctggagtctgtatctttcttctttctgttcctcatccatccctgtatacggcaatgtatctgtctaaaaaacaaacaagtcgagcttaattatcctatccccatgaggccattacactcattttttaccatacaaagacagcttgctccgcatctaatacagatatacag

SEQ ID NO: 6382 - DNA, 879 bp, Triticum aestivum
  unsure (1)..(879): unsure at all n locations
  Clone ID: PAT_TA_6382
gcccgcccctccttttctgccacttccctccctcgccgccgtcccgttgttctctcgggcacagtactggccgtgttgcccgtcttcgtggtggtcgggcggctgggggaggggggaggcggcatagaccggggaggcgcagccgcggcgcgtggagggccggcggcggggggacctgggcgcccgcaaggccgccgggggccacttcacgacccactgcgccaacgaacgccgcactgtcgctgctcgctttgcgccctctcggcgcctcacgttccggtccattagctacgagctcgacgagctcgcccagactcaccccgaccggcgatgcttcccccggcgacgccgctaatgtcccgggcgtgtcctcccagacgtgggtgaaggtcatgggcaccgtcttcctaatgaagggcgagggggtgggccaggaccacctcgcctccacattggacggcaacgacgatggtgaggacgactctgggggccaacccctccgagccccagtcagctggtggacgcctctgaccatcattcaatcggctctgcggtctctgcgctccctgacagagtcattgtaagattgctgctttgccgtctctgaaacttatcctagtgcttgtccctttgttccggtgggggtgtgtgtgtcggtggatgagtctaaagcgtatgtcttctgatctgatgtgtgtgccccatccctgtagaggagtgtagggcttgtgacttggctactggctaagcttaattgttgtcgattagtatatgcgtgtgttcttattttggggttggaaaaatgatggttcagtgtaactgttcgcacacttgtccgttaatacagttgtgtgtgtgacntctcacaaaaaaaaaaaa

SEQ ID NO: 6383 - DNA, 698 bp, Triticum aestivum
  unsure (1)..(698): unsure at all n locations
  Clone ID: PAT_TA_6383
gtcggcgcgagccctagcaacagccgtacagccgagcgccgtccaccgccaatccgccacccctggcgccgcgaaccctggcggcgagggcggcgcgcctccagactccggtcctcggcctctcccctccgcccggccgccgccccaacctcccccctccggaccggcggccgcctcatctccagcaagaaatctgggaggttctccacctgaagatgctgctcggaagattgtgcttgagaacgctggcacggttgtgcgcgtggagatgagttattgaaaagttcgcgtcacgcgtccgaccactatgagacgggaagcaatatcctacagtactttttgggtttgcattagccctgtgcctttggtttaccaggcactgtgggaggcatcatcatgattaagccgggagctggccatttatgcctttaagcctcgttatttaattttagaggacctggccacggttcttagcaccccgctggcttgtatcatcgctctgcctcgtgtgtcctactcagcgcaccattcaaatgtttaatgggtactgtccctggatcttcgaaacgggtactctaatacctgtaaaaaaaatcatctgctgtactcatcacactactcaactgtgtcatggttatgctaagtgcatcataaaaaatgccactctaaaacgttactgtaccatatnacagccagat

SEQ ID NO: 6384 - DNA, 1518 bp, Triticum aestivum
  unsure (1)..(1518): unsure at all n locations
  Clone ID: PAT_TA_6384
gcagctacggcctgaggcagacgactccctacgctcccccgggctgcggttcgcacccacctgcccccacccccccgatccccggcgtcccgattccctacgctccccccgccggcggttccggacccaccccccccgatcccccgagcccgagcttccctcgctcctccacgcccaacgcccgaggtcaacccaccccgcccccccgctcctctcagcctctgcccgccccccgccggcccgctccgccgttcctagtcaactcctctcccgcctccgcgttcgccaccacggacggaggcccacgtcgagcatcgccaccagttgacatggcgccatggtcgccgctgcgtgtcgaggacgaactgcgtctgaacggccggccgccgctgtgccgccgaggtggccgctactggacgcttcgatgctctcgccaacccacctgccgctgccctcctcctctggcccctcccgccgccctgtaactggtcgccgacgcactactcgccgccagccgcatctggctccacgaggtagacgtgactggatggcgggaggccttcgctgctcacccgcccattggaaccacctcctcattcgtcctccaaggggagcaaggaagagcaagcagctgagaggtcttaagccaatggttcgactgctcagcttgaggctgcgtcggagggacaactgcaggtagctgtgcggtgtcgtgtaaagcttctctccgccgaaactgctgctccccctagttctggtgaacatcatattagccaaccggataaagcaacaggtagctccaaccggacacgccctcctatcacaacccatgtgctggacacggctcttggatcgccagcagctggaatcggagttcacctggagatctggtgggaatcatcaggtccacccctatttagctacaaagaagtccactgctagacaacctcctgcaattacagataaacccaacacggccccagcggccagctcaacggacatgcgtggacagctgtcgctctcgcctgccgctccgacttaggtgtcaacttcctacaaagtatgcaccggcgagagttcccccgccatttggacgacaaagaattcaagggttagaagaaccctgacgaatcgcgcttacaaacgttcctctgttcccttcggcttatcttttgacccacgtacccaggcaccctcccggtttctttctcagtagatcacattcattgatgttagtgtcctgcaacaagcataactggtcgtaaatcatgtttttgagttggcactgaccttgacgacctagcatttccatgttcctcttttgcattctcccttttcctttaccacttaccgtggcagctaagctgtcgatttgtgtgtaaatcacattgagtgatggtggtgtcctgaaacaagcataaatggtcgtaaatcatggtattaagttggcactgacattgtgatacctgaataatgttgttccgtgtaagggaagctnagtancagggcattcgagca

SEQ ID NO: 6385 - DNA, 716 bp, Triticum aestivum
  unsure (1)..(716): unsure at all n locations
  Clone ID: PAT_TA_6385
gcgttcgccccgcgtccgcaagctctccgtcgcacgcgcgcacgtgatccggcccagcccgtcgtcgtcgtcgtcgtccacatggccctcaacctgacccaccagaccggcgctgcggccatcgcggccacgccggcgccgggcgcgcgcgcttcggtgttcgcggcggcctcgcccgccgccgccgccgccgccggctccgccgtggcgccggcgcaggcgaccagcctgaggatgcagacgcagctggtggagcccgcgcagccgcaggcgccggagatgttccaggccatggcgcccgaccagcagcagcagggcgaggccgcgcacccggacgcgggcggcgaggaggcacgcaaggtgggcgtgccggtgttcgtgatgatgccgctggacacggtgcgcaaggacggcagcgcgctgaaccggcgcaaggcggtgcaggcgtccctggcggcgctcaagagcgccggcacggccggcatcatggtggacgtgtggtggggcatcgccgagagcgagggccccggccagtacaacttcgccggctacatcgagctcatggagatggccaagaaggccgggctcaaggtgcaggccgtcatgtctttcncaccagtgcggcggcaacgtcggagactcagtcaacataccacttccgaaatgggtaacggaggagatggacaaggaccaggacctggcgtacacggacaggt

SEQ ID NO: 6386 - DNA, 2322 bp, Triticum aestivum
  Clone ID: PAT_TA_6386
gcccacgcgtccgtcgcggcaggccgggacaacagcagcaactcagctggctccgccgtcgccaccccacccacccattcctaccggccgtcggacccactaacaaacccccttacccccgtccgcctgtgcggtccccggtgatctgatcttccgttgtgcgtcgtccgtcctccggccgccgccccaggcctcccagccgcacgagcgcgcccgagccggcgtggccgtccgcgtgggccaccggccccccggcccgcccccccagccaccagccgcgggcagcgggcaccgcccgctgccgggcgcggggcggccgggcttcggggctgccgccggctccgccggcgcccgccgccgccgccgccgccggcgcggggcgggcgcaagcgagccgcctgaggctgcgcacgcaccgggggggccccgggcaacggcgccggccggggagctgccagccaatggcgcccacccacccgcgcccgggcgggccggcccaccggcgggcgggccggcaccagggaccacgacgggggcctccgcatcgcgcgcatgatcggccgccacggcgccgtactcaacttcacctgcgtcgaggtgcgcaaccacggccagccgcagggcgcgcagtgcatgcccgaggcgctcgtgagccaggtggccagcgccgccaaggaggccggagtgggcctcgccggggagaacgccctacccaggtacgacgagacggcgcacgaccaggtgctggccaccgcggcggagaaggctgaggaggaccgcatggtcgccttcacctaccttcgcatgggccccgacctcttccagcccgacaactggcgccgcttcgccgcgttcgtcaagcgcatgacggagaccggcgtcagggacgtgagccgggagcaggtggagcgcgaggctcagggcgtcgcccacgccacccagggcgtcatccaggaggccgccgtcgccctctgcaactaatcaactatgcattacatacatacgtaccgtgatgatcgaaggtgtgtaccgaatgaaggtgggaaggaaacgtagggggatcgatcgatcgatcgggtgacttgggagtagttgccgcgcctgaagcttcgatggcatggcgatgcccgtcgccccgccgcttccgcgccgcccgcagaggactgatgtactactacgtactaagctgccgcagtagcatgttccgccggccccgcgatccccggcagcgtcgtcccgtggcccgaggacaccggcttcttccgccgcgacggaggatggaacaccgactacggccagttcttcatgagctggtactcgcagatgctgatcgagcacggcgagcgcatcctctccgcctgctcctccgtcttcaccggcagcaccggcgtcaaggtctccatcaaggtggccggcatccactggcactacggcacccgctcccacgcccccgagctcaccgccggctactacaacaccaggaaccacgacgggtacctgcccatcgcgcgcatgatcgcccgccacggcgccgtgctcaacttcacctgcgtcgagatgcgcaaccacgagcagccgcaggacgcgcagtgcatgcccgaggcgctcgtcagccaggtggccggcgccgccaaggaggccggcgtgggcctcgccggcgagaacgccctgcccaggtacgacgagacggcgcacgaccaggtgctggccaccgccgccgagaaggccgaggaggaccgcatggtcgccttcacctacctccgcatgggccccgacctcttccagcccgacaactggcgccgcttcgccgccttcgtcaagcgcatgacggagaccggcgtcagggacgtgagccgggagcaggtggagcgcgaggctcataacgtcgcccacgccacccaaggcgtcatccaggaggccgccgtcgccctctgcaactaatcaactatgcatgcatacatacatacgtacgtacgtacgtaccgtgatgatccgcgtacgtcgtggtgtgtaccggacgaaggtgggaaggaaacatatggggatcgattcgatcgatcgggtgacttgggagtagttgccgcgtctgaagcttccatggcatagcgatgccggtctcggcgtcgctagctcaaagcttgcaggggactgatgtactactacgtactaagctaccgcagtgcagcactgctactgcggtagcttagtacgtagtagtagtgctgcactgtaagatcgatactctgaaaatgttgtaacgccttgctgtatctgttccgctaaagtgaaatcaagaacagagcttggcgagcaaaaaaaaaa

SEQ ID NO: 6387 - DNA, 1034 bp, Triticum aestivum
  Clone ID: PAT_TA_6387
cgtgagatcgggttcgggcaggccgccgagtcgtcgtcgtcgtcgagctcgatccggaccggaccccaccacccgccccgcgccggcgcgcccccggagatcggagcaggatcccggcctcgccatgaatccggagtatgactatctctttaagcttctgcttatcggagactcaggtgttggcaagtcatgccttctcttaagatttgccgatgactcatacctggagagttatatcagtactattggtgttgatttcaaaatacgtaccgtggagcaagatggaaagactatgaagctgcaaatctgggacactgctgggcaagaacgcttcagtgctagctcggcagctactatcgcgggcttcttggatcgtcccgtgagatcgggttcgggcaggccgccgagtcgtcgtcgtcgtcgtcgtgcccgatccccaccccaccacccgtcccgcgccggcggcccgccccccggagatcggagcgccccacgggatcccgacctcgccatgaatccggagtatgactatctctttaagcttctgcttatcggagactcaggtgttggcaagtcatgccttctcttaagatttgccgatgactcgtacctggagagttatatcagtactattggtgttgatttcaaaatacgtaccgtggagcaagatggaaagactatgaagctgcaaatctgggacactgctgggcaagaacgcttcagaactattactagcagctactatcgaggggctcacgggatcattattgtctatgacgtgacagaccaggacagcttcaacaatgtgaagcagtggttgaacgagattgatcgctatgctagtgagaatgttaacaagcttcttgtagggaacaaatctgatctcactgacaaaagagttgtatcatatgagacagcgaaggcatttgctgatgagattggcatcccattcatggagaccagtgcgaagaatgccttgacgtggggcacgctttcatggctatggctgcttgggtcaaggacaggatggcgag

SEQ ID NO: 6388 - DNA, 1380 bp, Triticum aestivum
  unsure (1)..(1380): unsure at all n locations
  Clone ID: PAT_TA_6388
gtcgagagcgggttcgggcaggcggcccggtcgattcacgggaagagcgagacgccaagcaactcgggcaagccgcgaggccgcctggctccgcccgcccagggactcgatctcgagccccgccgacaagggaacccgcgggtagcgccaagatcccgccatgaatcccgagtatgattacctcttcaagcttttgcttattgggagactcgggtgttggcaagtcatgtcattctgttaaggatttgcatgagcgactcgtacctggatagtgacaatcaggtaactattggagttagatttcaaaagtaagggactgttggagcaggacggtaaagactatcaagcatgaaaattttgggaacactgcttggggcaaggaaccgttttcagaactattaccaggcacgctgactaacctgaaggggccccatgggagttattatctgtctatgattgtcgcacaagcccatggatagcttcaacaactgttgttacagtggttgaacgagattagaccggctatgccaagagagaaagtgaacgagttaatcgtggggaacgaatgggatctgactaatagaaaaactgtgtcgttggaaacatgagacaccactgggcaagaacgcttgagaactattactaggagctacctatcgaggggctcacgggattattattcgtctatgacgtgacagaccaggtacagcttcaacaagtgtgaaggcagtggttgaaccgaagattgatcgctatgctagtgagaatgttaacaagcttcttgtagggaacaaatctgatctcactgacaaaagagttgtatcatatgagacagcgaaggcatttgctgatgagattggcatcccattcatggagaccagtgcaaagaatgccttgaacgttgagcaggctttcatggctatgtctgcttcaatcaaggacaggatggcgagccagccagccgcaaacagcgctcgcccagccacggtgcagatacgcgggcaacctgtcgaacagaagacgagctgctgctcttcttgaaatgcaggcagccgccatccatgttacccaaatggagacgcaaacttggccgcgccatccttgagtccatgcttctacataggcctactacatcttacaccttcattccattctttctagtgtacttattagctcttgaatcgttggacttgtaacaccggatggagtttggagacagtatcttcttctagttgtgtatcttgaatggttatatgttacgatttgcagctgttgcttttcttccctaaatttaaggcgatttctacttttacttgaaaaaaatgttcggttcttcaaaatattatctgacagtatgcttatctttgagngtaaaaaagg

SEQ ID NO: 6389 - DNA, 520 bp, Triticum aestivum
  Clone ID: PAT_TA_6389
gcaaaatcgtatgaggtataaatgttgtccttgaattattttctcggcgtcaaatcaacattgcttgttttttcatggttaaacatttcatacttctctttaggcctcgttcggcaagccggtattgacatggtttgtagacatttttccgggccaagccgaacatctccgaaattccgctatgggccatttggtagacaagactgccaagatgtttgtaaaaggctcagatagtttgatgtttggaatcaaacactgaatcaaggtgttgtctaggtaactaaactttaacttgtttgtatccacactatgatgttccgacaattatgatgttgcaacaaactaagatgttgcctcaactaattccagccatatataatccaaagatcaagcatgatagattaattgtaatcgttagtttttaaataccatgtgccatagacaatttgatttttattagttcattgtaaacgactatgaattttcaatattacgatggcttgaaataccaaaaaaaaaa

SEQ ID NO: 6390 - DNA, 574 bp, Triticum aestivum
  unsure (1)..(574): unsure at all n locations
  Clone ID: PAT_TA_6390
ggnctgcaggnaattcggcacgagggagaggggggataagccggcgaacctggagaagaagaagaagggggacgcggcggcgaccccaaagaagaaggagaagaagggcggcgaggtcggcggagcccggatccggatctgggaagcaggagccgtcaggcgaagcggggaagcccaagcccacgcccaagaagacgaagcagcaggcgtcagacggggcggccaaggagactcccagcaagaggaagcgcgatgacgccggggaaccccaaccccagaaggcggccaagaaagctgacaaggccacgcccaccaagaagaagcaggcctcctccggcggcgctgagaaggccaccacgcccagcaagacaccccagaaggaggcaaagagcgccaagaaaagccccggcaaagccggagaaggccacgcccaccaagaagcagcaggcctccggcggggcggagaaggccacgccgagcaagaggaagcacggcgatctggaatccccaaatgcggcgaagagcgggcagaatggctcttcgcctgcgaagaagcagaagggcaaggcggcag

SEQ ID NO: 6391 - DNA, 1063 bp, Triticum aestivum
  Clone ID: PAT_TA_6391
gaaaagagcggcgaatagagcggcgagggcgtgaggggcccctgctgcttgtggcggcggcatggagaggggcgagagcatcctggatgccgtgctcgacgaggagaccctagattttggcggagatgacgtcgagatggctgacgcggaggcggaggaaacccccatccccgacccccccgccgccggagcaggaaccgctggcggtggtgcgcaggcgggcggaccggcgggcaagaaaaagaagaagagaaagtccgggaggagtaagaacagcgggaggcctgatgggccacccaccaagatcggtgacattaatcgttttgtacttgacacgtgcaggcgcttgaaggagaaaaagtcataccttgtctggaatgctattggctgccttggcgtttctgctgtcagcgatcttgtccgagaggttgaggccattcagaagtgtggtgggcagacgattgctgatggaagtcgtttccggacaggtggtggaatcctctggaacatcttgaaatcacgagagccaaaggcatacaaggaaattatggtgaagggaagggagcttgagaagcagttcatgtatacgaaaggcagaccacagatgagcagaaatgaagatgcaagctcacagggcagcgtgctagttgacgaggaaattgaagcacatgatgaccctgagcacttagtcgatgcagaggaagcacctccttctgttgataaagctgaacctcgtaaaccagtagccgacaggattcgtgtgcctgttgcttatgatgatctttttgaggatggagagatacacgaagaacaaccacaaaattgaagtattccaaaggttttgcctgctcagaaagcaagattgcagaatgcgagggaagagggtcgatgtgtgtatgaatgttgcggtgaagcgaccttctttcccaaggactcccctttttccccttgtgtgattgagcagtaagttatgcaaatatgcagcaactgatgagttctattgctgctaggagggaagttgtacgaacaatattgagcctaaattcagtgcgaataaaactag

SEQ ID NO: 6392 - DNA, 555 bp, Triticum aestivum
  Clone ID: PAT_TA_6392
ttcggcacgaggaccaacttgaatagcatcaatactcccctttgtatctgaagggagtccagggttacaatccctccagaattcagaatctaagtcactgcaagctagctgaacctggcctgattatcctcctatggctggcttagtagctagcatgaaacgaacccggtcgattggtatcttaattatcacacaccagcacactgtaacatacaacggtacaagtacatacggtggtttgattctaacgggcatttcccatagccatacatcccacaagtgccagttgaaatgtcagtggtattcaaatgtactaatttgacctgcaaatgctggcactagaggtttctctacattcaatagttctctgtctttgcatttcttagccatctgtacatgcaggccagacttttgcaaatacattcatatattccctagtagagcatgcaaaacaacatgaaaaacacatgtctagttttgaacactgaacttgtacccgcatcatcacaatccccgagcaaaaccatgattgggttggaaaggttaaaaaaaaaa

SEQ ID NO: 6393 - DNA, 1594 bp, Triticum aestivum
  Clone ID: PAT_TA_6393
ttttttttttttttttttgtttgattacacccaatgcctctggcattgccgcgttcaaacccgctgcagttttctacagctactgtactaatactgaggacatacttacaaatcttccagattctttacaagtctggtagaaaaaaaaatgcagagcctcaaaaggctgtagtgggtatttacaggacaaaaaggggaggcacatgcctcagtctagatattcagcagtcttctcctaacccactgtacttagagatgccaaaggcagttacgtacgagaccacgactgtgatgacgtccagcttcccgccataatgccggtacccagcgcctggggccggggtcggtaacggcaccggcctgttctggtcctgggcccgaaggcgtgcgtcggccggttccttctctgcgctccctggcgtgcccgcgccgcgatcccttgcgcctaccactacaggtgtcctgccgttgctgtacgtgttatcgaacagcccatcttgtccagcgacatttacatcaccagacgcgacggctaccttgaagacctgtgcagcattaggcaagtcactcgaagttgccactgtgaagttggtaggagaaattgaaatcatgttgttgtacaggtgacctacacaatgtgcagccatctcggatgactataaagccactgtcaccaagattaattgcttgtattccctgatttgttatagcaatgatacatgcggtcgatgaacccggcactgttgtgctactatgggccttctctagtacccttgtaagatcaattgaatcttttggctcttcttctattgcggttactgcattagacataatatctctagcatattgacctgcatcaataccgtagcttgcccaaccaccaacgccatcagctatgcctatagcctgttcatcccaaataaaatgtgcatcctcaccaccagtttcttccttatccggatgtggtagataacatacccctgaaacaagcttcaaggacctatctcctaacatagtcttatctgaggtgcctacggacttctcaggctgcgagacatccgcctcgcgggcggccgggctgaaggacacctcttccggagcagcaccggtcgcgaaggagcgcccgccgccgacgaggagctgctccaccagcaggcccggcctgggcacgctgctcgcggcgcaccggaaccaccaggacccgccgctgccgcccgccgcgggccctccccagatccccaggaacccggccgcctcgctcccctgcaatccgcgcgcgggagacagcagggccccgcccaggcccggcagcgcggcggaggacgcggccctcggcgcgccagcgccggcgccggcggctccccggagcagccacgcggccgcgcgccgaagcgcgatcgccggggacatcctgccgcggcgcccctgctgcgcccaagacgctgccggagagacgctccggcgaaggtggtggaaaccctagggtgcgggagagggaggaacaaggatgagatgccgtgccggggcagaaggatgcaacagtttttcaacgcggtttttttttcgcacttgctatcggcccgacccggccggc

SEQ ID NO: 6394 - DNA, 534 bp, Triticum aestivum
  Clone ID: PAT_TA_6394
gccccctcaggcctcttgtgcatacattttccattgcaggagcttgactgccgcccgaagaaatggaccccatcagcatagagaagatcagggccatgaggaagtacaggaggaacaggaagcagcagcagctgctgctgctccctgccctcgcaccgtacctggtggccacctgtgccgtcctctgcctgctgctcaccagccctgcctggttccccggggtgtgctcgctcctcgtctccttcctcctcaccaccctccctgacctggccaccgccttcctgctcagccccaagtgcctcttcgtcgtcggcaacctcatcgtcgccttcctcatcgcccagtctaggctagctccgaagagccagcccgcttccgttgtggatgtcgatgacgtccacgaggagcatgtgaagaggaacgtcgctccgactatcgcaaaggctgcgacgaggaccacggtgatgttctctgatcacagtgcttcggttgaagcagtttgggagggggagaaggagaaggaggaggaggagg

SEQ ID NO: 6395 - DNA, 577 bp, Triticum aestivum
  Clone ID: PAT_TA_6395
cagccatgcagcccatgcaggcgtacgaggaggcgtgcaaggaccagaactgggcgacgccgacgccgccgacgcgggcttcgccgaggcggcgggcttcaccgggctgcttcttgacggctcgctgaaccagaacccgaggccggcggcgagggacgacgccgatgaggcgtactcgccggcgccagagtactgagtggtggcgacctctgcacatgctttgcctgcatgcacccgagaccccaccaggcacatgacacagtaaatagttattagtggtgaccgtggaataagatgggactaatgctagtactacagttaatcgcgttcttgggtttattatctgacacagtgctctgattagacgtgcgagcaagaaggttttatcgatcttggagcttgttgcctgcagctaccttcggcaaaattacttacatgtgttgtaaaactaagacaatgatctcggatttcttcttcttcttcgaacaatgcctgataatttatctacttaactattgtaatcttatatccactttcatcaaccatatacagtaacgctaaaaaaaaaaaaaaaaaa

SEQ ID NO: 6396 - DNA, 560 bp, Triticum aestivum
  unsure (1)..(560): unsure at all n locations
  Clone ID: PAT_TA_6396
attcggcacgaggcataaaaatcgtatccatgtcctcttgcatgatgaaggtacgtagtagaacattttcaaagtgatgaggcgctttttggttaaagaaaattttattaatgccataagataagacaaaataagtacacttcgcctcttgaacaacatgatgacaagacctcgagaatgcacacaattaacatgcatgaacctccaaatacaatgcatatgttttaagtagagaaggagcccaaagttagagacatgctagagcgtgaagagaagtcctccaagaagtttagtgatgcacatgcatgccaccatcataaggtcttcaaataatggtcactcaaggttgaaatcgtaccatcctcaccagatccactaccaaggccgccaggtcgaaacacactccaatctgagatgccaccatccaaacatgtcccaccacattggccatgataagttggcatcgatggtcacctaaatgagctaggctaaccacaatgaggagctacggagttacaaacggttcttttacagaataatttatacgnagnaaataaaat

SEQ ID NO: 6397 - DNA, 841 bp, Triticum aestivum
  unsure (1)..(841): unsure at all n locations
  Clone ID: PAT_TA_6397
gcanccagctggaggccgcctctccatctgagaagagatgggtagagttggaaattcagggtgccgatccgcaggcgtcggcccgcgcggccggcaaggttttctggcccctagatgatgattggtacaagggttccatcacggcctacacggaactaaccaagaaacattctgtgaagtatgacgacggtgaagcagaagaccttaccctagctaatgaaaggatacaattttccatttcatccgaggaaatgaagtgcctgaacctgaaatttggaacatctaacctggataagaagggatacgatgagctgcttgcacttgctgtcagctttcatgactaccaaggtcttgatccagatgatctagtgtgggctaaaataacaggtcatgcaatgtggccagctgttatagtggacgagccaaatgttcatgctagccgggccctcaagccaattcggttagatcaatcaatacttgttcaattctttggcacccatgattttgcaaggattaagtcgaagcaggcggtgccctttctgaatggccttctttcttccttgcatctcaaatgcaagcaagcacgcttctcccgaggcttagaagaagccaaggagtttctcctcacacaacagcttccagaaaatatgttgcaacttcggaaatcaattgaaaatgatggttctgatgttaatggccaagatgacgcaataggctcttgtgataatttatcagaagaaagagcagaagaaaatggagaggatgctgaaatgactcaaatagaactaggaaatcttcgtgtgagcaacctaggcaggatagtttctgattcaaatcattt

SEQ ID NO: 6398 - DNA, 1105 bp, Triticum aestivum
  unsure (1)..(1105): unsure at all n locations
  Clone ID: PAT_TA_6398
tcggcacgaggcgtacctcttcccctctccccccttccccgcccagccgccgtaaacccaaccgaggatcccaccgcacctcgccgtcggcggctcaccggagacacgagtgccccgctactgccacccatggcgtcccgccgcgtcctccacctcctaacggcatctcgaggcatctcctcaaccccacatctcgcctccctcgggtggatcaacaagatcaaggacaccttcaccggcaagaaggccgccgactcacccttccccccgtccgaatccttcaatctcaacatgttcgcggattcgatggagatggcgaggaaggtgggaactttcaagaacttcgtgtcagggagatgcagcgaggccaccgtcgtagccgcctgcgagaagcacgccgccgttctccgctacctcgccaccatcgacccaaccggcgagaagctcaaaaccagtgacaaaattagtgccaccaagcattgcaactgcacaattgctgatgtggagcacatactggccaagtacacatgggctaaagatgcccaaaagaagattgaaaaactcaaagaagaaggaaagccagtgccaaagacatttactgaggtgcaaaatctaatgggtaatacagcctttgaccttggaagagctaatctggaaaagagtggtcagataagtaggaatgctctctgcccatgcggttctaagaaacgatataaaaagtgttgtggggcttcttgaggtgaaaacccatgctttccttttgcttgctagcgctgactggggcagagttctgctctgctgtgatcaagaaaagcacgtcgggattctcaacctagacagcgagactgcctcagcggctgaaagagccaaacttagttgtcgcaaacctggctgcgggacttgtaaagcgccataagcggctctgtactgtgggataaaccttttcctaaaccctgtgatgtctggccttagtttatttgatttgcttatgcagacagttcaaagcatccgcgggcatggaagcctgatgtttcaaacttcctatgggtcaatttattgaagttctatgtacattgaggagcnnatattcttgcatcnaacaaaa

SEQ ID NO: 6399 - DNA, 882 bp, Triticum aestivum
  Clone ID: PAT_TA_6399
gatctatgcagtcggtgcagtgggttcactactcggggttgtcctataccaaagtgctctaaaggactatgatttccgcagcatgcttttatggggtcaggtgctgtcaagcctgacagggatgcttgatctagcgctggtgacccgactaaacacgaaggtcggcataccagactacgttttcgcggtgatcgactgcggcgtttctgtaatggtcggcaagcttcagtggatgccggttctcgtgctttgctccaagctttgtcctccgggcatcgaaggaaccttctatgccctgctcatgtcgatacaaaatgtggggctgcttatgtctgcctggtggggtggcctgctgctgcacacgctgaatgtgactcgatcggagttcactaacctttgggcagttgtattgatcagaaacgtctcgaggctacttccgctgatgctactgtttcttgttcctcaaagcgaccagaagtcgacgctccttcctgcggagatgctccatgatgacgaatctacagaagctgtcaaggatggatcaggcagtgttgagttttccgtccttgttgcggatggttcaggttgtcatccttccgttgaggatgttcaagatgagagaatcacagtgactgatgatgtacgaggggatgtagagttgatcccactgatgaatacgaacagaacagttgggtgatcatctttttcgtaagagggttgattcatgattcatttacgccacgatcatctgattatacgcgtcggtagctgttgctaggaatgtacataagttcttaccgcctgtttagctgtagtttgtagacgttaaatcaactgattagcaactgaagcatacattttcttcgttctttcgtttttgcg

SEQ ID NO: 6400 - DNA, 622 bp, Triticum aestivum
  Clone ID: PAT_TA_6400
ccacgcggccggagggagcgagagagagaggagagcgccccacttcactccacctctccactccgcaggtcgccgccccgagtggctcctccgaatcggagccctcctgcttcgcctaaccctaactctcccgccgccgcccgtccgccgtggggcgccgccgcaggcaggatttggagccgagagtaatgaaataagatgctcctcaaaagcaaattcaagctggccacggccgtcggcatcatcttgtccatgctgtcgctgctggtgcaccttttccttgcaaattattctgccgggggaattagtaagtacagcgtggacaatgttcttccatttggatcgaagcctcgaccccgtaggttgtggggcccattgagtacacttgatctcctacacccttatgcaaaacctagacaattgtaccctgctccagctaaggataatggttttatttatgcaaagatttacggtggctttgagaagatacagtcttcaatctgtgatcttgtcgccgttgccaggctcttaaatgccactcttgttattcctgagatacaagcgacaactcgtgcaagaggcatcagttcaaatttcaaaagtttttcgtatctctatgatg

SEQ ID NO: 6401 - DNA, 563 bp, Triticum aestivum
  unsure (1)..(563): unsure at all n locations
  Clone ID: PAT_TA_6401
ttcggcacgaggggctctgctactgaatggagcaccactggcagaaaagagggatggtctgacttttgaggatcgctcgtggaaggcgacgctgaccagtgccatagtgctgggacattctgttagtgtgaatgccccacaaggtcttgcaggcccggacaagcatagaggtgccggaaggccgacaaacaacagggagaaggccccatacaaaggtctaagtaaacgaaaccaaattctgcagcatttgtcatcgcgaaggccacaaaaggaccacgtgcccggagagaggggacgcaccgaaaaagccacgaaaacccaggaaatgcaagaattgagggatagaaggacatcgacgaaatacctgcaagcgggcacttggttttgccgataactcagccatatgtttttcagtctgtaatatgtgttgtcgttctaaacggggggttttctagtgtgtttcagttgagcactgaaactcaaagagcatgaattatgtttacagggccgtgtgtcatactgtgtctaagagcatgaattatgtttatggntgtctgaacttc

SEQ ID NO: 6402 - DNA, 801 bp, Triticum aestivum
  unsure (1)..(801): unsure at all n locations
  Clone ID: PAT_TA_6402
cgcctccgctacacacgaagctgctgctcaggcccgcatctcgagcgcctccgcccctgccctgcgctcctcctcctccttccattcccctatctgctagttcgccacgctcgttgccctctctctcacatctccatttctgctgcagatcgatatcgtcatggacgccgagcgttgctcacctccgagtcgcacgccctgctgctggaaagcgatggcgccatctcctccgacttcgccggatctacactccagccaccggattaattagcccgatgttattaattagcctcaattctcttcctttcttctcgagcagaggaaggggaggggtggatgtcggaacaacacaggggcacggggatgcgacgcgacgacaaagtggggatggcagctctgctccgtttgaagatggagacggatccatgggaatcccagcaacggccgagcaatttgggcgacgggcgcggcgatgcagtgggcgggcggggggtgcgtgcggacagcggaagatgcgtgcgtttttttttttgacgtggtcattatacgacgaatcgtttttcgcacttatgcgtggcattggtgggtaattctcgccaacttcaagggtaatttaaatgacgatgaacaggcgggcagaagcgataatcgctttattattagggaaagattagggaaagattttgtctcctacgggtcgttctacgtctagttgtgtaactattgtaggcttttattattttcttaattccatgtccagtgtctatgaaacttaaaatataatcagnaactaaaaaaata

SEQ ID NO: 6403 - DNA, 1062 bp, Triticum aestivum
  unsure (1)..(1062): unsure at all n locations
  Clone ID: PAT_TA_6403
tcggcacgaggcgccgacgttgccttcggggaggaggtgatcaccaccaccgtgacgtcctccggcgcggccgtggaggactgggtcgaggaggtgtactccatgtacgccggctgccccaaccaaatcctcgtggggctcgacgtcgagtggcgtcccagctacagccgcgtgcagaaccccgccgcgctcctgcagctctgcattgaccagcgctgcctcatcttccagctcctccacgccgactacatccctgacgccctgtcggtcttcctcatggacaaccagttctggttcgtcggcgtcggcgtggccgcggacgccaatcgcctggcccaggactacgacctgcaggtgcgcaatctggaggacctgcgcggcgtcgcggccgaggagatgggcatcccggagctccgccaggccgggctgaaagacctggcgccccaagtcttgggggttaccatgcagaaaccacggcggataacgatgggcccgtgggacgcctgctgcctctccgacgagcagatccactacgcctgcaccgacgcctacgtctcctcgcagatcggattggagctgttcaccggaaactactagcgatcgatcgaggtgatgccgtggcgagccctgcaaacttgcatacgaaactcggtccctaagtgtgtttgggttagtttctgcagcattttgttcttactctcctaagtgttgattgcttatgtcgcgtattagcttaagcttcaagagcaggggaacggttgtcaacatgttctgtggctggtctgctacagtttggatatgtgtgcatgtgatgcttaccaacggaacccgatgttccaaaattgtagggctttttttgtctctctcttttacaacataagaggaagaggactctactctantggcatacaataagaccaagnaatgttcacgagttcaagaaggtnnacatacaacacaatttgatttnaaaagaaacanaacatttcanatttggcctcaatctgctanagctaangtctccnanagntcaatttaaaacctcaccaaatagntaactca

SEQ ID NO: 6404 - DNA, 522 bp, Triticum aestivum
  Clone ID: PAT_TA_6404
tgcttgcggctccagcttagatgttacttttggaacaaacacaatgactagtcttgagctgctgaaggcttactgctccgaaggatcttcagtgaagttttccggcctgaagaatctagttggactcaaggaagtcctgattaagggctgctgtgacgacatgctgaaggaagacctgcagagccaactcaacgatcattcagagaaaccggttttgaagctggaggaatagccacgtttgccctgatggatactgaatgaatggtcatgtccctgttcatttgtcttactctttttcccgcatactactcgatcctgttgtttttctgcgaagttcaatatacagatgtgtaactgtcctgtgctgtaacatgccaatgaacgctgaaacttatagctgataatctgttggcgaagtagttttttttataacctgttgttttcatttcccttcttttagagtaataccttgtaccgtagaaaaatatcagtttttttttgctcgatccttgtatttatttt

SEQ ID NO: 6405 - DNA, 898 bp, Triticum aestivum
  Clone ID: PAT_TA_6405
gttctattacttgctcacctcggcatttgcgatggatacaggaaccccgtcgcggtcctggtgcttctctccgtgggttcgcttgctcacctcggcgtttgcggcttctacaggaaggactgagcagccattgtgctggagtagactgtgtgacaggttttttcctctctctcctacccgtgattggtttctttggtgaagaaagcatcactgtctttcaatacatcatggatgctcaacctgtatgtctacatggtacaagaatgaagattaaccattcaatctattgattcagagtgagacaagggtgaaacagaataagctcatttttgtgatgagttccctaggccccagaaggccagaactagcattttaattacaaaattcagtttttgatcacgttatttcagtttcattatagaccttataatattttttatgcattaatataaggtttataatattttgtggagcaatcagttgtgcatagaaaagagctcacctaaattaatgacatgttcatcttatcttcgattaaaaaaatttgccccctaatattcagttctactgagagttgtagaaggcaaaaatccagcaaattaactcaagtaagtgtttttgttatttcccaatgtaattaaaaattttcttctcaaaatacgacatggtcattgtcggaaaagaatatttagcatgaatgtaggtgctttcatatgaagctggacatgtttacaatgatcgaccggataccgttacacgtgtcctgaatatgaagtttaatgatttctgagaagatgttaaaagtggacatttgtttcgtccaattcaagcttgtaagttatttacatactgattttatccggcttggtttaaatctttcaattaatataatctaact

SEQ ID NO: 6406 - DNA, 708 bp, Triticum aestivum
  unsure (1)..(708): unsure at all n locations
  Clone ID: PAT_TA_6406
ggtcaaggtgcgcgacatcattgtgttcgtccgctgccccgacggccggatcctcgtcgatctacgtcgcgccacgccggtgaacagggactggggaggtcaagaggtggcacaggcgtcgcagctggccatcgaagggggcgcctttaccgtcacgtactacccaggccgcggcggggaatcgttcgtcgtgccgcgagcagtggtggatgctgctgctgagagagagtgggaggtggacacgccggttcgccttctacccaaggacgaaggtggtgcatgttcagcaacagggctcggcgtccggcgtgattgcaagaggcaccatcggtgcagtcgtaccaggggctactacatggcgcagtctccaggttgattgggacggctccacatcctcaacacctgctgtcaacaagtggcaagtcgaacccgagggaacccgtgatgccaagagacgcaggctctccaagactgtgcctccggtagcatcgacagcccaaagaggagtcaagctgtttggcaagacccttgttccagagggaagtggctccaggagctagtgtacccaaaataccattttttttgcatgctagcatcggctgggtaaaactggtgtttcactcttcagactagtttgtcatatcattacctgttggtcacatcgatgttgatgctacatactannttgagtacctgtggcccgaaact

SEQ ID NO: 6407 - DNA, 473 bp, Triticum aestivum
  Clone ID: PAT_TA_6407
gagactgagatctgcaagccctgcgctcggccccgctccgggggggcggtggcccctctcagtccctcaatccagatggcaggattcctgagctgattttttggcacataccaagtacagcatacgtcaaggtggcaccaaagcctaagactgagatctgcaagccccgcgctgggtctcgcgccccgcacggggcgccgccgctaggggccctggccggcgggggcgacgctcgtgccgagagccgagctgccgggcgctctcccccccgcgcgacgggtgctgcccgggcgcgcgccccgccctgtgtctcgcgcgccactcgggtcccggtaggattcagaatcgtatgcacaatgcaaacaatttggagcttgccgttcgatgataccccacccaccccctggatacggatggagaacgggagcacgcacagccatattacattgtacttgagtttgattcggctagga

SEQ ID NO: 6408 - DNA, 867 bp, Triticum aestivum
  unsure (1)..(867): unsure at all n locations
  Clone ID: PAT_TA_6408
gtcggctcctgccggcgtcgtcacggttggaccggctggactaggcttgtcagagtccgtcctggctttctgttccttctcctacggccggcgttgtctccctcttgggctggcttgcctatggtgacttcaaggctgggtttgagatgggtccatggtggcagcgtctttttaatggctattccatcacaacatggatagttgtgttcaacttaggctctaccgggctgcgggtcccatcgctcccgacgtgttccgcctccgtcgtggaggtgttctcgacttcgctggccgtgccttcgtctttggttttggctcttgctcttgtcactgtgtgtcctgcacttctgcttctcctgggcttcgccacctccatggcctccctgctgacgttggttttgcctgtacacctgctcgtcgtgtgacctccagctctgcctgccgcggccatggtcgtccgctctactgccctccagctggttgttctgcctgttcgcgcgctggtggtctaaggagcagcattagttgagtatcttgggctcagcttaaatcgagtcatcccttgagtacttgaggctacaatgttcaaaagattcttcggttagcatcacgcttcagggaatgtaaataatcattgaggtgcagacctgatattagtggacaataggctaactgctggggggctttgctaatttgtattcaggtagaggatgctgattgctatgttcctttcggattcagaaaggggactatgggctcactgccggtggctttgctaatttgtattcaggtagacgatgaaggctgattgctatgttnctttgaatttagaaatggaaatatgtacacatatncnccagttagttt

SEQ ID NO: 6409 - DNA, 663 bp, Triticum aestivum
  unsure (1)..(663): unsure at all n locations
  Clone ID: PAT_TA_6409
tggcgacgacggtgggctcgaggcaacgacggagaggtctcggcgacggcggcgtaggttgattggaattcagttttgcaagtctctacagccgtcaattaaaattgaggcaacaccaatgcttttgtgatgatttccttgtgtctagatggaactgaaatgctaccatgtgctcaattttatttaatgtgaaagtcatgctatcttgtcaacataatatactacatatattagttactaggtggttgtttcgattcatggtgtccatgaatgctgtagtcttgttttacattctgcacatatgaaaatctgcagcaatttggtacaagcagtaccctgaatcacatatctgaggtgttccatcttattctattgtctctatatatttcccatgtttttttttgttatcacgcaaggcccggtgtcccgcccatcttgcttcttgctgccctcgcccctgcttgtcgtgggccagttgcccctttgcggcggttcctgctgagttgtgctctagcctcccctcttttgcttggctcctgtgggtgcaaacatatcatcccccttaccantcatacagcattctcngnaagtatggaactagtatagnggaaccgcgaatttctcaagagtngnccactgcttaggggcacttccnttttgggg

SEQ ID NO: 6410 - DNA, 946 bp, Triticum aestivum
  unsure (1)..(946): unsure at all n locations
  Clone ID: PAT_TA_6410
cacccgctggccggatgtcggcgcctgcagttcccgactgcgccggcgactcgtccgtaccactctgtctgggcgggctctccccttgtggctaccccctggcatgttaagaaagaggttcttgacaagcttgtgcttaacttcctcaccacctgtggatcgtccccagaagacgaaagccgtagccgatcgtccctctaagagcgaaaggaataggcatgtacttctcaaagcggtgtttacctccagaagaggccgtcaacgcccttgcatcttcacctgagctgcgcttgaaacccagaactgttcaaggcagcaatggtgttcctggtgctcctcaggttgatctgttcccctcgcaagaagtgatggtcctgacaagctgatcctgatgcagcctttcttgaattgggtccttgcattggcgctttaaaacaagcaagaaacctcttgggtaataatggtttaatacaaagggcactcaggtgcaatatggcattgcatcctgctcctagctgtgtcgtgatttttggcaatctgctactagctttagtgggtttatagacatgtctcccattggcgtgtcccttctttcgacgccgccactgcccttgcgccttcacctgagctgcgcttgaaaccgagaactgttcaaggcagcaatggtgttgctggtgctcctcaggtcgatctgttcccctcgcagaagtgacagtcctgacaagctgatcctgaagcaggctttcttgaattgggtccatgcattgacggtttaaaacaagcagaaacctcttgggtaataatggtgtaatacaaaggccactcaggtgcaatatggcattgcatcctgctccgagctgtggagtgattttttgcaatctgctctagctttagtgggtttatagacatgtgtcttttgtcatgtcaattgttccattgcnatata

SEQ ID NO: 6411 - DNA, 991 bp, Triticum aestivum
  Clone ID: PAT_TA_6411
gactgaaaagctagttttttgcataaataccacaagtttctgaaccaaaaataggatccaagcaacattcatagtacgactaacagcaaatgatcctcaacagagcaaaattaaagctcctcatgacattcatagaaacagcaggactacccagagaggagtaagtttcttgattgccaccagtagagttggaagatagcctacagcctccttcccctccttcctcccttccggcgggtgctgtcagtgggaactggagtcacgtcctctgcagcacaagaacaagcattatggtcaggcatatgcagacacaatcctctttgattcgcaggattgtaaaaacatgggaataggaaaaacataggattgaaatgtcatgctcatctcaatcctataagattttaggttgtttgattgcatcataggaaaaacgagggattctttcaagggcttatgactggatgctagaaatcctatgggaagtagaaaaaaaaatttcatggaaaaaaatcctataggattcaatcctatgaatcaaacaaccaatataggaaaatttcctaagattctaatcctccaaaattcctatgcaaatcctttgaatcaaaggaaccctaagatgggacatatgtgcttccacaaacactatatcagaaagcgttgcgtaccaatgcgcccaattttcatcccagaacgagcaagagccctgagagcagactgagctccaggtccaggtgtcttggtcttgttgcctccagtggcacggagcttaatgtgcagtgcggtaataccaagctcctgaaagaacagaataaactctgagacaaagcatctcaagggagcaatgcagcactacatcctagtcatgtaccggcattccaagcatcagtctaatgaagagaatacaactggtaataggcacagctgaaagtgaagccttgattttgaggatgcataccttgcaacgtgtagcaacatcctgagatgcaag

SEQ ID NO: 6412 - DNA, 600 bp, Triticum aestivum
  Clone ID: PAT_TA_6412
aaaggacaagtgggagtaagtaacaactaatctgacaaaagagttaactccatttcatggtttccatagactgaaaaactagtttttcgcataaataccacaagtttctgaaccaaaaataggatccacacaacattcataggactaacagcaaatgatcctcaacagagcaaaattaaagctcctcatgacattcatagaaacagcaggactacccagagaggagcaagtttcttgattgccaccagtagagttgaaagatagcctacagcctccttcccctccttcctcccttccggcgggtgctgtcagtgggaactggagtcacgtcctcaatgcgcccaattttcatcccagaacgagcaagagccctgagagcagactgggctccaggtccaggtgtcttggtcttgttgcctccagtggcacggagcttaatgtgcagtgcggtgataccaagctccttgcaacgggtagcaacatcctgagatgcaagcatagcagcatagggtgacgattcatcacgatcagccttgaccttcatgccaccagtgatccgcaccagggtttccctcccagacaagtcagtcacatggatga

SEQ ID NO: 6413 - DNA, 1489 bp, Triticum aestivum
  Clone ID: PAT_TA_6413
caaagacaaattccgatgggtcattctttgcagggcccttgtatgaggatataggatatgaagtcgaagcctcaaaggctggctatcatctcaagcaaactggcccatacagctttgcttgtcagaaacttggtcagatattagttcatatttatggcgaaaatgatacagagatgttaccggcagtattattatccttgagtggtgaaggaggttacagaaaaaactcagtcagtggttctggtggaactttcagcttcgataacttatttcctaggagttattatctccgcgctcttcttaaggaatataaatttactccatcaacagttgctattgatctcaattctggagagtctagagcggttgagttccgtgcaacccgtgttgccttcagtgccatgggttctgttacactgttaactggccaaccaaaggaaggtgtttttgttgaagctagatctgaatcaagaggttattatgaggaagctactacagattcctttggtaggttccgcttgagaggacttatccctggctcatcttactcaataagagtagttgcaaaagataatctcaggttggcagcacttgagcgtgcttcaccagaatctgtatcagttgatgtcgatgaggaggacatctctggtattggttttgtggtttttgaacgcccagaagcaacaattttgagctgtcacgtggaaggaaatgacattgatatgttgcagccacatttatctgttgaaattagatcagctgttgacccttctagaatagaatctgtagttcctgttcctctttcctaccacgtcgaagtaagaaatttacccaaaggaaagcattttgttcagcttcggtctggccttccatcacatacccatatatttgaatctgagttggttgaagttgacctagaaaagcaacctcagattcatgttggtcctcttaaatataaaacggaagagcggcatcacaaacaggaactgaccccagccccagtttttcctcttattgttggagtttctgttgttacagtcgtgatcagtatgccaaggttgaaggacttgtaccaaagcgctgtaggaatgacttccctaagttcaggaaacacaccgagcagaaaggaaccacggaagacaatattgagaaagagagcctgaaacatatgatcctgactaggtgtggagaatttgaacttacacatcaggattagaaagtagctgtttcctttcttcccaatgggtaattttgcagatgcggaagctaacagttaatagtttgtaccattgttgactaatacaaatttcgtctcattgttggtcattgagagtgcgatgtagtattatactccctccgcctgaattacttgtctagataggaatgacttccctaagttgaaacacatggagcagaaaggaaccacggaagacaatattgagaaagagagcctgaaacatatgatcctgattaggtgtggaaaaaaaaa

SEQ ID NO: 6414 - DNA, 808 bp, Triticum aestivum
  unsure (1)..(808): unsure at all n locations
  Clone ID: PAT_TA_6414
gcggactaatactntggcataaatacacgaccagagatgatctgaagtgaagcacagctctgaattaagcgacagtcaaatattctgaactcagagtaaactgacgggcgactacataggatctataataaggctactcaaactgcaaattcttgatgacgaccatgagagacgatgaaaaagaaggtgtctacagcctccttcctctcctgccgccctttctgcgagtgctgtcagtgggaacaggggtcacgtcctcaatgcgtccaattttcatgccagaacgagcgagtgccctgagagcggattgagcaccaggtccaggagtcttggtcttgttgcctccagtggcacggagcttaatgtgcaaagcagtgatgccaagttccttgcaacgcgtcgcaacatcttgagaagcgagcatagctgcatatggtgatgactcatcacgatcagccttgaccttcattccaccagtaatacgaacaagggtctctctcccagacaagtcagtgacgtggatgaatgtgtcattgaatgatgcaaagacatgagcaactccgaagacatgctccccttcacggacagcaggtccaagagtaacattctcctccttaggctccctggttttcctcttcgacatggtggggcgaggcaacgagggatcgacgcgtcttctccttctgcttcaggtcgcgagctcgccgccgccgccggaaattcgtgaagagagataaaggaattagcgggagaggttatatgcgacggcggcggatgacgggtagtactagggtttaatacggaggat

SEQ ID NO: 6415 - DNA, 1701 bp, Triticum aestivum
  unsure (1)..(1701): unsure at all n locations
  Clone ID: PAT_TA_6415
gtttttctatttattttcacttatttttggcaagaagagaatcttaactcgcatttcatggtttccatagactgaaaaactagtttttcgcataaataccacaagtttctgaaccaaaaataggatccacacaacattcatagtaggactaacagcaaatgatcctcaacagagcaaaattaaagctcctcatgacattcatagaaacagcaggactacccagagaggagcaagtttcttgattgccaccagtagagttgaaagatagcctacagcctccttcccctccttcctcccttccggcgggtgctgtcagtgggaactggagtcacgtcctcaatgcgcccaattttcatcccagaacgagcatggaactgaaaagctagttttttgcataaataccacaagtttctgaaccaaaaataggatccaagcaacattcatagtacgactaacagcaaatgatcctcaacagagcaaaattaaagctcctcatgacattcatagaaacagcaggactacccagagaggagtaagtttcttgattgccaccagtagagttggaagatagcctacagcctccttcccctccttcctcccttccggcgggtgctgtcagtgggaactggagtcacgtcctcaatgcgcccaattttcatcccagaacgagcaagagccctgagagcagactgagctccaggtccaggtgtcttggtcttgttgcctccagtggcacggagcttaatgtgcagtgcggtaataccaagctccttgcaacgtgtagcaacatcctgagatgcaagcatagcagcatagggtgaagactcatcacgatcagccttgaccttcattccaccagtgatccgcaccagggtttccctcccagacaagtcagtcacatggatgaaagtgtcattgaaggatgcaaagatgtgagcaacgccaaagacatgctctccctcacggacagccggtccaagggtgacattctcctccttgggctccctggtcttcctcttcgacgacatggtcgcgtggagcggcggtggaccggagacgacgacggcgaggaggaggagtgcgcgcctggttgagatcacgatgagtgcgccgccgccgccggagttggtgattcccccactcgaaggaaaacgatccttttttatccatcacggcatcagttctcagtgtctgcaagcggatgccaagatgctgttccttcaatcactgctaaaatgggtctataccttgaaggatcagtgtcacctgcaactcctgatgttcatatcatgattctggcagctggaaatagcaagtatgcgatgctgaagaaaggtgatatagcaacagagacaaagacaaattccgatgggtcattctttgcagggcccttgtatgaggatataggatatgaagtcgaagcctcaaaggctggctatcatctcaagcaaactggcccatacagctttgcttgtcagaaacttggtcagatattagctcatatttatggcgaaaatgatacagagatgttaccggcagtattattatccttgaggggtgaaggaggttacagaaaaaactcagtcagtggttctggtggaacacgcgtcttctccttgtgcttcaggtcgcgagctcgcngngcgccgcccgcgcgtccggaaaagagttaaagnangtgtgggcggacgcgtagtcgac

SEQ ID NO: 6416 - DNA, 486 bp, Triticum aestivum
  unsure (1)..(486): unsure at all n locations
  Clone ID: PAT_TA_6416
cgcctccngtaccgatttccaggtttgaggggcgggtccgatcgtctctcgcaacaccggcgctcccggcagccgcgccgctcgatccacctcaccgacgacagcactagcaggtcccggccatggatgccagagcacgagctccctcctcctcgttgcacgcatcacccgtcggagtcgccccggtcgccgcctcgccaagctccgtcgccgccggtgaccttcgcgtcgagatgccggagttcacgcccccctgcacctgcatcgtgcctcttccgtcctctgcattgaagcagttgcagaggaggatgagcacctcgaacccccttgtatcgctcgcgttgaccgcgccagcgcgtgggtcacgccaggcccagcgccccttccgacctgctggttcctcctccacccaccgggtcaggcccactgggcccgcctttgtgtcggggttgtgtctacctcctcatttggtagctacgcggcgac

SEQ ID NO: 6417 - DNA, 601 bp, Triticum aestivum
  Clone ID: PAT_TA_6417
caggacgaatggccgataccgtagttccgattctggagacgacaggatggatattgcgtcccccaaagaacatgatgatgaaagtgagtattttgcttcatgggtagttaggaagcaactatacccggagactgtcaactggataccgccggttcggatcttccggtacacagctatctttgaggaggcctggggttgggaccggctactgccacataccagtgttccgatccccacgtatttggagtacctgacggagtatcacaagcgcaatcgcatggattacgttgctgctgccgctggcaactcaaaacctgaagactggccgctcaaataccgagcagtgaataatgatacccaattcgacccggatgcgtcacttgtagatgccgcccagttttgtctgaaaatggaggagcgtttcatgttggcatggaataacaaacgcgtccgcaatgtgaaacatctgagccaattgatacaggagcgagcccgtgccatcatctccactagtgaagaattctctgaaactgctgctgctagcttggtgtgtatctccaatgaggctgttttggcgtctgagcttctgcaccgttgggct

SEQ ID NO: 6418 - DNA, 800 bp, Triticum aestivum
  unsure (1)..(800): unsure at all n locations
  Clone ID: PAT_TA_6418
gagggnnnnnntntattnccctnctcgaanttaccctcctnagggaacaaaagctggagctccaccgcggtggcggccgctctagaactagtggatcccccgggctgcaggaattcggcacgaggttggctccgcctagggttttagcccctccctcaccacccccgccccacctcgcgccgcaccctcacaaatcccctccccaaacccaatccctcctcccatcccacccgccgggcgacgagcggcggccggcgcccagggcccgagatggacaggtaccagagggtggagcggccgcggcccgagtcggccatcgccgagaacgagatccgaatcaccgcccaggggcttatccgcaactatgtctcctacgccacgtccctcctccaggaccggaagattaaagagattgttctgaaagccatgggacaggcaatcagtaagtctgttgctgtcacagagattatcaagaaaagagtaccggggttgtaccaagatactaacatcagctctgtcagcataactgatgtctgggaacctattgaagaaggccttgtcccactggagatgactcgccatgtttcaatgatttctattactttgtctccagtagagctggaccaaaattccccagggtatcaaagcccagcttatgttgaccagcccaggcaacagcagcgcctccagcaggcaccagcaccgatgcgtcaacctcgccaacaagccatctgattatgaagactcctatgtgcggggtcgtggcagaggaaggggccgtggacgtggtaggggttggg

SEQ ID NO: 6419 - DNA, 624 bp, Triticum aestivum
  unsure (1)..(624): unsure at all n locations
  Clone ID: PAT_TA_6419
gcttgtctcggaggaagaaaaagattaggcctcctgcaatctacagactagacaaggcggcgggatgatctaccggagctggtcgctgctctcgtcgacggtggcgatctggggcggtgccgccgccgcagggctcgccgtcgtctccctctctggcggcaaggaaaagtttcaggactacctgtgccgcgaaggcgataggctgaggcggcaggacagggccaccatggccagcgccaactaacgaacggaccatgaaagaaagcgccacggagacgaagaaacgagcatttcatcatgtatccgcatccgtgacggcgtcgtcttggtccaataatcctcatttgcggtgctttaaacatggtgtggtctggtgtcctcatcgaatccaataatcgttgatagacatgatgtggaacttggtacggcctgatgagcttcgctttccggcttgtcaagtggcccgaaccattgtcttggcaacaatttcgtccttgtcagtgaacaatctttgtcccatttcggatttgatcactgtttcgggtatgcgtgaaaataaacaccgtggtccgtgggatccgctaaaatccaaatccaatgggctgtttggatacaaaananaaa

SEQ ID NO: 6420 - DNA, 633 bp, Triticum aestivum
  unsure (1)..(633): unsure at all n locations
  Clone ID: PAT_TA_6420
ggnctgcaggnaattcggcacgagggcttctccgccggaggctaccagcagcagaagcagccctacgcgcccgccgatccgtactacgcgcaggggtaccaagccgccccaggttatggtcctgttgttcaaggtaggcctgttcgagcggccccccgggcagggcggcgccttccatgctgtgggctcggcatgggctggcttctgttcattgccggcttcttcttggctgccattccgtggtatattggtgctttcgtcctaatctgtgtccgggtacatgaccacagagagaaaccaggatatgttgcctgcactgttgctgctataattgcggccattgttataccccttggagtaacaaaaggaacagactcatggtgagccaccaccagctcttggcaggcggttctgttgctgaatataaacatcgttatttctggcccaattacatgataggttattacaaagtctgctggttgtatttcatgtatgagtgtgtcttgtatacatatatgtacagtaaaaagagtggggctgcatcttcgatgttctcttgtatcgatacttgatacttatagtgtgtaataaaagctcgaatgtacaacacagaaaaaaaaaaaaacgcgaaga

SEQ ID NO: 6421 - DNA, 588 bp, Triticum aestivum
  unsure (1)..(588): unsure at all n locations
  Clone ID: PAT_TA_6421
ggnctgcaggnaattcggcacgaggccccaggnagaaggcgatgcggcgcgaggtggtggatgatgatgaggactccgagtccggcgagtccgagggcgagggggtgccgctcgtgaccatcgccgccgccgccaagaggaagcgcgccaggaagctctccgacgagttcgaccgcatcgccgccgcgcagctcgagggcggcgcgaagaagaagcccatggccgcggctccggccaaggcgtcgctcaggaagaaggctgctgcttctgctgcggcggttcctgctccggccgctgaggcacctgccaagaagtcgctgaagaggaaggcggtggcgcctgcggctggtgcggagccgaggacgtcaccgaagaggaaggctccggaggtgccggcggcaaggaggacgtcgccgaggtcgaagcactgatggataggtgctcgtttccatttgcaatccctgttcttggttcgtcagattggtgggtttagcgattgaggtgtgatcttgaagaggcagtatactgtgtgtttgtcgaaatgcttgaatggaatctagtgtcgtgcttctttctgtaaaaaaaaaa

SEQ ID NO: 6422 - DNA, 831 bp, Triticum aestivum
  Clone ID: PAT_TA_6422
ccgcggcggcgccagtgagccagcctcctctgcgcagctgcgcctgcgccgcgccgccaccggccatggagatggaggcggcggctcctcttcccaagaagaggaggtcggaggtgcccggaagcaaccaaccggaggaaatctcgagccacgagccggcggcggcggccatggaggcgcccgaatccgacatcggtgaaccaccgcctggtagctggaggggcagaagacggggtcgaccacatcagcggactgcccgacgccgtcctcggcgacatcatctccctcctccccaccagggagggcgcccgcacccaaaccctcgcctcccggtggcgccacctctggcgctccgctcctctcaatctcgactactacgacctccccgccgaaggtgacgttctgatacgcctcatttcccagatcctctccgcccacgctggctccggccgccgcttgtgcgtctccgcgcaccacctctaccaccaccctgccaccgtggatgcctggctccggtctgctggcctcagcaacctccaggagctcgagttctgctgcgccggtgatccactggtactgccggcggtgacggcgcccaccttccgtttctcgtccagcctccgtctggccacattcagccaatgccgcttccccgacagcatcgtccagacgcttcatttccccgagctcaagcagctcgcacttgaagaggtcagcatctcggaaggttctctgcagagagtcatcgctggttgccccgtcctggaatccatgcttcttaaccactgcattggcttcggctgcattcggatctgctccccaaaccttaga

SEQ ID NO: 6423 - DNA, 616 bp, Triticum aestivum
  unsure (1)..(616): unsure at all n locations
  Clone ID: PAT_TA_6423
ggcgggtacatggcgccggngttcgtgatggagggcgtgttctcggtcaagtcggacgtgttcagcttcggggtccttctcatcgagatcctcggcggcaagcggaacggcgcgctctacctcgaggagcacgagcagaccctcatccaagacgcatggaagagctggacggaggagaaggcggccgagttcatggacccggcgctggggcgggcctactccaaggaggaggcgtggcggtgcttccacgtgggactcctctgcgtgcaggacgacccggagctccggccgaccatgtccagcgtcctgctcatgctcatcagcgaccacatgaacctgcccgcgccggccaggccgcccatgttcacccggctgaggaccttcccggcggcgatgatccccttctccaccaagaccgagtccaccttctcgccccagtccatcaacgacgtctccatcaccgtcgtcgagccgcgatgaggttgatggtgcccnttttgttgttggtgttacataaactggctagcagctgaaatgttccttccagaaaggccgggccgcccgttggattttttgtaagttatgggggaagtgcgtacacactgtggcacaaagc

SEQ ID NO: 6424 - DNA, 985 bp, Triticum aestivum
  Clone ID: PAT_TA_6424
gcgcacttcgacctcagcggcgccgccttcagcaggatggccgtcgccggcgccggggcgcacctgcgcgaccgtgggcagctcaaggtgatctaccgaaggacggcgtgcaagtacggcgggaagaacatcgccttccatgtgaacgaggggtcgacgagcttctggctctcgctgctcgtcgagttcgaggacggcgagggcgacattggctccatgcagctgaagcaggcgaactcggcgaagtggctgggacatgaagcacgtgtggggtgccacgtggtgcctctacggcgggcccacggcgggacccttctccgtgaggctgacgacgctgtccgcccccaagacgctcacggcccgcgacgtcatccccaggaactggacacccaagggcacctactcctcccgcctcaacttcgacgcctcgctctgatggcggaaggcccgggccacgttttatcggcctgggatggagcgaaggcaggcccacatggcgttctctttggaattggacgtacgtagattgtgttttgttgcagcttaatcggtctgttgatcgcctagtcgtaagctagtgtggtgtggcgtgagtagtttcggatgaggaggtgagtgatctgggtgcggagcagccgtcctctccaaaagggagagagagcgtatgctgctgggaatccgatgcggaagccgactgggagggttttggacccctctgggtcgccgcttcactcctgctgtcgtgtgctgtttttatcttttcttgtctgttttgtttgcgtgtttgtttgccctggttggttgaattgaagggctcgtgacaaatgtgtttagttacttcgaatggcgggcttgtaccgaggtcaggattcctgcttgttcgcatttccctcttcttattatggacatgtgtgttcgtttggagtactcagagaagacacccttcgtgtgaatgttatttctaaaaaaaaaaaaaaaaaaaaaa

SEQ ID NO: 6425 - DNA, 684 bp, Triticum aestivum
  Clone ID: PAT_TA_6425
gcaaggtttggtgttacagtcgttccatttgggtttgtcggagaagatgacattttagagttggttctggattacaatgatcaaaagaacattccgtaccttcgggagtggatagagtcaatcaacaaagacggccagagagtgagagatagcgtcaaaggagaggaagggaatcaggacatgcacatacctgctattgttcccaaagtaccgggacgattctactacctttttggcaaaccaatcaaaatggaagggatgaacaatgttctgacggacagggagagcgcaaataaagtgtatttacatatcaaatcagaagtcgagaacgcaatggcatacttacagaggaagagggaggaagacccttacaggagtatagctcagcgtgctgtgtaccaggcaactcagggtgtttctgctcaagtcccaacttttgaaccatgaagactaggtgcaaatatattcctgtgatagtgtgactgcacattggcagatagtaggtatccattatagcagagtataacacagtacataatgtgtagctaacagatgtatctgaatatttgtattacgttttgaatgtacatgttacttactcattggtagtgattaattaacaccaaaatgttactgattatttgatacttgttcacaataaagggtctcttttatctctcaacc

SEQ ID NO: 6426 - DNA, 488 bp, Triticum aestivum
  unsure (1)..(488): unsure at all n locations
  Clone ID: PAT_TA_6426
ggtcgagcctgcggatgagatgtcgaatggtgccaacctcaagccatggaacactggcgatgacctagcacaagttgagtcgttggtcatctccatcaccgtcagtggccaaaagatgtcgtcaagtcgccttcgctctctcggtttccctgcttgcctgcagcccagcaagcatgcccagcaagcatgggggcatggggcaatgttgagcagtctcatgatcttaggctttgctttatgtgctggtttgtatctctcctggcgctagatattttctcatagtggatccttatgctaaggttcttttgctcgttgatgtttacagtagaaatagatttagtacgtaggaacattttttgtgttgctctagccagtgaaactgagggactggtgttcctttagacgaggaacattttttgtgttgctctagccagtgaaactgagggactggtgttcctttagacgatgatcactacccnnnaaaaaaa

SEQ ID NO: 6427 - DNA, 636 bp, Triticum aestivum
  unsure (1)..(636): unsure at all n locations
  Clone ID: PAT_TA_6427
ggggttgtgggtttgtaggattcatattcaaaagagatttccaattatattattattttgatatataatttattttttggtaattaaatcaagggtcaaaggttgaccaaaaatacaatagggctaataaacccaggcaaaggtagttaacaattgaacttgaactttagccctcttcaatcttcatccaactttgtagagtatcgcgtctgtccacacttatttggccaccgcggcctccttgcagtcctctttcccgaaggcggagacggggaaggtcctcccgagtccggtgggcgtcttgaaggtgatcttggaggggtcgtccttgtcgatgtacatgtcgcagagggtgatccagatgagaagctccttgctcttgaccccggtcatgcgcttcatcttgcagtcctcgacgaaggccgtcacctcggtggcgtacgagacctgcctcccgatctgcttgaaggtgtgcgtgagcgccttcttctggcgcagccagacgaagccactggcgcggttgtagcccacctcctggatgtccgccagcggcagcaggcccagcggcatgttggtctcggccagcagctccaccgcttctccgcgcacagcgccgccccgtggtacactnccgcg

SEQ ID NO: 6428 - DNA, 672 bp, Triticum aestivum
  unsure (1)..(672): unsure at all n locations
  Clone ID: PAT_TA_6428
attaaaacagttcatatatatatatatatatatatangaaaatgagtacatgtagtattcatcgtggtgtcaaactctgtatgcccgaaaagaaatgactctttatgccggccgtggtctcttatttggccacgtcgtgcttgttgtcgtcctcctttccgtaggcggagacagggaaggtccttcccagtccggtgggcgtcttgaaactgatctttgagtgtttgttcttgtcgatgtacatgtcgcagacggtgacccagatgaggagctccttgctcttaacccccgtaatgcgcttcatcttgcggtcttcgacaaaggccgtcacctcggtggcatacgagaccagcctgccgatctgcttgaaggtgtgtgtgagcgccttcttctggcgcagccacacgaagcccgtggagcggttgtagccgacctcctcgatgtccgccagcggcagcagacccagcggcatgttggtctcggccagcagctccaccgccttgtcggcgcacagtgccgcgccgtggtacacctccgcgccatttctgttcacctcgatcacctgtgacgccatcgtgatggaataagtttaaactctcgaagcaaactctggctcaactctgacgctcgggagatgcaggggactttgtnttggaggcttattgcgaacgc

SEQ ID NO: 6429 - DNA, 1610 bp, Triticum aestivum
  Clone ID: PAT_TA_6429
gtttttttttgttttttttttttttttttaagcagcgaacagcacatataagattataaagatcgcacgatcatatgcatgatacaaccctcggcaaaacaccggagcagagtattacaaccccttatataatccgtagtttattataaagataaaagcaaatagtactcttcatccaaactttgtatatagttaatattggactcgaggactcttcatccaaactttgtagagtatgccggccgtcctcacctacttggccacgacggcctccttgccgtcggcagccgcggccttggccttgccgtcgtcctgcttctcgaaggcggagacggggaaggtcctccccagccctgtgggcgtcttgaaggtgatcttggaagggatcgtccttctcgatgtacatgtcgcagagggtgatccagatgaggagctccttgctctttgaccccggtcatgcgcttcatcttgcggtcctcgacgaagggcatcacctcggtgcccgtacgagacctgccgcccgatctcgcttgaaggtgtgcgtgagcgccttctttctcggcgcagccagacgaggccggtggcgcggttgtagcccacctcctcggatgtctgcccgcggcagcatgcccagcgggcaatggttggtctcggccagcagctccatcctccttctccgcgcagatcgccgcgccgttcttcgacctacgggccctccctcttagcccagatcgcctgcgccatctcgagtacaatcttctctggaagtaaattgagagattcaactgtggatggggtcgacgagacttgggttgctgggggtctttttcgatgcggtcgggttgctggggccttttttgggcatggggattgtgtcaggaggggttgagtggcgcgggggggcggccggctgccgcgggtcgccggtgctccggcctcttccgttgacccagagccccattcccccacccccggcagaagccgggtgggccccgatcttaacggcgaaagctgatggctccgtactttggatgacgcgtcgcccgcccgaaggccgtgcgatccgtcgagttatcatgaatcatcggatcagcgagcagagcccgcgtcagccttttatctaataaatgcgcccctcccagaagtcggggtttgttgcacgtattagctctagaattactacggttatccgagtagcacgtaccatcaaacaaactataactgatttaatgagccattcgcagtttcacagttcaaattggttcatacttgcacatgcagtacgagacctgccgcccgatctgcttgaaggtgtgcgtgagcgccttcttctggcgcagccagacgaagccggtggcgcggttgtagcccacctcctcgatatccgccagcggcagcaggcccagcggcatgttggtctccgccagcagctccaccgctttctccgcgcacagcgccgcgccgtggtacacctccgcgccctccctgtgagcctcgatcgcttgcgccatctcgactcaaatctttcctggaagtaaactcagattcaactgttgtggatggggtcgacgcgctcgggttgctggggccttttttggtcttggggattt

SEQ ID NO: 6430 - DNA, 659 bp, Triticum aestivum
  Clone ID: PAT_TA_6430
gagcgcgggttaccagaaaccgtgctactgctaaagtttacgtgcatcgcgttattttggcccgcgctactgctaagtaacaatagcgccggcttccatccccgtgccactactattgctctatctataggctttttcctagtagtgtggtgtccttacttcctcctctcttccctacacttcaattttacccacatcaagttttactcaatttagggtcttatatttgaagtgcggaagtaactatgtctctctatttttctacccgtttacatctctacttacccatcttatttatgcaagcccttcatcctctccatccctctaagctcgaaccatataatagttctaacgtagaaaagcttcagttgctttggcttattgagtctagctagtctgattgacaatcaaaatgatgagactggtattatgttatctgtttactagcttgaggggcatcgggacaagcatgtgtctagaagtgcaaatgcagaatttggagaacaaacggagtggaaccgcagacaaatatgtggctggacacgctggcatctgtacgaggctaatatcaacgatgcaacatgcttcaagattagggatccgacattttacttttttttcaagcacacgcaagacaattgtgcgcttttggtattaag

SEQ ID NO: 6431 - DNA, 975 bp, Triticum aestivum
  unsure (1)..(975): unsure at all n locations
  Clone ID: PAT_TA_6431
gcggggactccccacccgcacccgtcccccatccgatctcgccgggnaaacctccgatctaagcgaagccaaggctctctcgtcctcctcctcaagatgcagatctttgtgaagaccctgaccggcaagaccatcaccctggaggttgagtcctcggacaccatcgacaacgtcaaggctaagatccaggacaaggagggcatccctccggatcagcagcgtctcatcttcgctggcaagcagctcgaggatggccgcacgctggctgactacaacatccagaaggagtccacactccaccttgtgctcaggctccgtggtggcatgcagatcttcgtcaagaccctgactggcaagaccatcaccctcgaggttgagtcctcggacaccatcgacaacgtcaaggctaagatccaggacaaggagggcattcccccggaccagcagcgtctcatctttgctggcaagcagctcgaggatggccgcacgctcgctgactacaacatccagaaggagtccaccctccacctggttctcaggcttcgtggtggcatgcagatcttcgtcaagaccctgaccggcaagaccatcaccctggaggtcgagtcgtctgacaccattgacaatgtgaaggccaagatccaggacaaggagggcattcccccggaccagcagcgtctcatctttgctggcaagcagcttgaggatggccgcacccttgcggattacaacatccagaaggagtccacccttcaccttgtcctccgccttcgtggaggcatgcaaatctttgtcaagaccctcactggcaagactatcaccttggagggggagtcatctgacaccattggacaacggggagggcaagatcaggacaagggaggggcattcccccgggaccggagggcctcttttttgtggggaaacgcctcgtgggggggcgcccaccttggnngacctacaacattnnnaagg

SEQ ID NO: 6432 - DNA, 498 bp, Triticum aestivum
  Clone ID: PAT_TA_6432
cgtccgcggacgcgtggggccgatctatcactttcctacagcctggtttctcttcaaaactgaattactatatgattagtacatatttgtaattctgtattatgtaggatattgttatttgatattctatagctaattatccttagttagcactcttatcacatgaatgtgatgaactccatgagaaatagccaggtgcattaggctcacctaagtcttctttgtttccgaacatggtcgccctttagtacaggtctgaagattcgggtaatgcaccatgtaaacaatctacttattggtctgaacatttttattttagaagtacgtcttattgcttattatgtcttggtagtactgattagttgtatttactatcaaaattgttgtatggactaatgtatatgatgttataccaaaccataaaaaaaaaggctgtctgcatacgcgaaccatgcttttaccatacgaatatatgagacttcctcatgggtttttaaa

SEQ ID NO: 6433 - DNA, 627 bp, Triticum aestivum
  Clone ID: PAT_TA_6433
gcccgcgccgcacacacccaaacatctcgagtagtttccagctcgccggagaagcagcaagcaagatggccggaaggaagggcggcgacaggaagaaggcggtgacccgctccgtgaaggccgggctccagttccccgtcggccgcatcgggcgccacctcaagaagggccgctacgcccagcgcgtcggctccggcgcccccgtctacctcgccgccgtcctcgagtacctcgccgctgaggtcctggagcttgccggcaacgcggccaaggacaacaagaagacccgcatcatcccgcgccacctgctgctcgccgtccgcaacgaccaggagctcggcaggctgctcgccggcgtgaccatcgcccacggcggcgtgatccccaacatcaactccgtgctgctccccaagaagtccccggccgccgccgagaaggaagccaagtcgcccaagaagaagaccaccaccaagtcccccaagaagaaggtcgccgccaaggagtagctgctcgcccaccggcatagcctagcctttgttgcttgttccatttctcatggacaagacgagcagtcttttggttagttagatgagtaatggccctgtccttagcggcataacaaaaata

SEQ ID NO: 6434 - DNA, 823 bp, Triticum aestivum
  unsure (1)..(823): unsure at all n locations
  Clone ID: PAT_TA_6434
gagtnaccgtatcgtgcatttgcttggcagctttgcactctagttacatatcaattgctaaataaataaaaaatgttattcacttttctgtgttttgttgaataattctcatgctttcttttgtgaggactacaaatcatagtgcttaaaatacagatgtgtgcgtcatacttgaactaaaaaagttacaggagaaagtacctctattccattactttgagaagtacaggtacacctttctaaatagtacagtgcatgaccggtgctcgccccgcataaatggagtcttcagctcaccacgctacctcccgccggtggggctccgttgctgcatcgccccgaccgttcactgccaccaacccaggccgttcaacgaggcagcgccaagccgttcgatgtcgcaactcaggaggctgcctcctttccctccctccactgcactgaacctaaagaagaaagcaaacatcagtccagctggtagacgtggaggtgatttttgtatctaggccgcgatcggctcctctccgctccctccactccgcttcggagcggacgagcctctagctcatttttatggagcggcctaaactatgctccacaactccgcggagtcggagcggatgggatggattccgaacacggccctaaaatcatatgtgcttttctctccaattgattgtttgtgttgaaggaagcgaggagaagctacagcataaaattgtgtatgatcgtggagctgtgtatgtgtatgtaatgtctgcaatacgtgtatgaacaggaaggaaaatgatgtatgtnattnanaaagttcaatgtaaaataa

SEQ ID NO: 6435 - DNA, 866 bp, Triticum aestivum
  Clone ID: PAT_TA_6435
gccggccggtccgggggtgagtttctttgccctcctctctgcattcacccccaggtcattcagcctccgccgaggcagaacattcaccggaggtagaggggaaacgcgcaacagccatggcctcgctccgcatcctttcagtgatcgccgtggtcgccatctttgccctcgccggcaccgccgtcgccaatgacctccccgactacattgttcagggacgggtctactgcgacacgtgccgtgccgggttcgagacaaatgtcaccgagtacatcaagggtgccaaggtgaggctggagtgcaagcgcttcggcactgagaaagttgagcgctctatcgacggcgtaaccgacgagacgggcacttacaaaatcgagctcaaggacagccatccggaggatatctgcgagatggttcttgtccagagccccctcccaaactgcaacgaggttcaggctctcagggaccgcgccgagatagtcctcagcaggaacgttggcatcagcgacaacatccgcatggccaacccgctcggctacctcaaagacaagcccctgcccgccttgcccgacctgctcaaaacgttccaccctactactgatgatgatcactgagcagggcaggcaaaacggcaacatgggacaactggagaggctgctgcaccacaccaattaaatctgttatcatggcatgcaaatagcatggttgtatcagcagagtacagcatcaatgcgtagctgtctctaatgctacttacagcctccagatgttccacatctagccatcgatcctccttctgtaacaagtcttttctacttgtcaacaaaagtcaccatccacctaacctaataagaacatgcccattt

SEQ ID NO: 6436 - DNA, 439 bp, Triticum aestivum
  Clone ID: PAT_TA_6436
tttgatcatagcaggaagaacgtggttgaagttaccattatccaggaaatcttgcaaaatctccgaagagcttgttctaagactatgaagaaggtcacagttggtgtcatatgcccatactctgctcaagttctagcaattcaagaaaaactgaggaaaatgaagtttggccccttgtcagtaaaaattagttctgttgatggcttccaaggtggggaggaagacataatcattttatcaactgtcaggtccaactctgatggggtggtagggtttgtttcagaccgacaacgtacaaacgtagctttgacaagagcaagacattgcctttggattttgggaaatgctgcaaccctatccaggagtggttctatctgggcagatctagtgcgcaatgccaaggaacggcagtgtttcttcaatgcaaaaagtgatgggg

SEQ ID NO: 6437 - DNA, 479 bp, Triticum aestivum
  unsure (1)..(479): unsure at all n locations
  Clone ID: PAT_TA_6437
gctcagctcagctcccaacgcgcacgccacccgccaccgagacactcgccgcgcgctcgccatggccggcggcaacctcaagaacatggccatcgccttcctcgtcccgctcccctccgtcctcttctacctcgccttcgtccgcccccaagacggccacagcatcgtcgcagccggcccggtgtcctcgtggtgcgccgcgcacccgctcctcctcgccaacgccctcttcctcctcaacgtcgacgtcctcttctggctcatcggccacctcctctccaacaactggctcatcgacctgtactggaccgtcatcccggtgatgctgctgcactacttccgggcgcacccggccgccgtggccaacgcggccaggtcggcgccggcgctggcgctgacctgggcgtggagcgcccggctgacgcacaactacttcaggagggaagggtggcagtggggcaagcgggangatggcggtn

SEQ ID NO: 6438 - DNA, 666 bp, Triticum aestivum
  unsure (1)..(666): unsure at all n locations
  Clone ID: PAT_TA_6438
ggtgtactgttgccgaggcgaagcatggccagaccgagcttgacggtgacgagaaagcagtggcggagccagcttggccggcgagccggcgcaaagtacacggagctgttgtctctcagttgtttgcccctataaaatggtgattagctctccatttactgctattactcaaactagaatgcatggctgagcccgggcagctatcccgggtagccgggaggtggctccgccactgcgggaaagaccaggatgcggacacgcagctggaggaagcagcctcggtctaggaagcggtgccgtctgcgatgctaccgctggccgcgggaacgcagaccatggagttggtgtccaaggcagacgcggtgggcaaaacacggcaagtatggatgacggctgcctagacttgctcatcacggctggcatagtcttccacatggctttcttctcacacgttgtcgctggccgctggccgccagaattcataacttggttgcggcaactatggcagccgtgggtgtcgcaggatacggcaagctcggacgatggccagcgcgaacatagtttttctagttcatcctaactttgctccacgtagtaagcagaagactggaaagaaggtgcaggactttagggccctgttcggtacgaaggatttnggaggaatcg

SEQ ID NO: 6439 - DNA, 625 bp, Triticum aestivum
  unsure (1)..(625): unsure at all n locations
  Clone ID: PAT_TA_6439
gccaccnttcgtcnacgccnacggtgccggttactnnctcgtctggngaccaaanatcatcgcnttaggcgccattaatccaccccgagctttcccctgttttaaggaacttccgcaggaggaggggcgcgaagctcctgacaaagctgtgagaagaatttggtatcatctggtgttacactctctgtgccattagcaaaatcaggccaatatgtatcactttgcaacagagaaacagagcgcttgtcaataatttacctgtagtttatccgacggagccaggtctcttgtctccctcagtacatgcgtgcctgccacttttaacatgaagggcttttgggagtgagtgattttcacggcatgataacccggtttcttgtggcctggggggcgcatgaagaacttttgtgttgctttgctcgcagcttcataggctgatacacattgatattgttgtactttgtttctggactaatgtggatatgttgttactcttgtgtttgaaaaaaaaaagtgatcttgtgggcctcgtgggcgccccccgtccccaattcgccctgtcgtccctcggacatgttaaccgggatgggaggtaatactaatataaatttcatgccaagaaaaa

SEQ ID NO: 6440 - DNA, 438 bp, Triticum aestivum
  unsure (1)..(438): unsure at all n locations
  Clone ID: PAT_TA_6440
gagggcccagccgctggtgtctctgcccgaggaaggatcatggttccccacctctctacaactcatattaaaattttggtatattcttttcttactttatttcccgtgaacaaaaagttggaacctattcttaatttcccatagtggttttgatggtatttggtcagtgtgttcctggctggaattgcatgtatatcttacatatttaaattgcaacaattaataaggagaatagaagcatttgcatcgtctaatactttgcctgccatgcttagcgagaattcaaaatagtgacctttggatatcaattatgggtttgtaattttgtgccaggacctaaaagcatttttgtctcatgcttcgactagcatatctattttctttgtaaattctagacatccagttcaggttatgatctttgcatgcccaaaanaaaaa

SEQ ID NO: 6441 - DNA, 609 bp, Triticum aestivum
  Clone ID: PAT_TA_6441
agttcccagccacgacccacgcgtacgctctgggtccttcctttttttttttttttggagactaaattcagggctcacttattcataacctgcagaacgacataagtttcagatccaaccgataacactgcatcacagtactgtagaaacaaagacaccaacagcagaaccagacgagacacccgacaactctaacaaaggcaccaaggcttgcaaacccagaaacagaagcaccattgccaggagcttactggccaccacggagccggagcaccaaatgaagggtggactccttctggatgttataatcagccagggtgcggccatcctcaagttgcttaccagcaaagatgaggcgctgctggtccggtgggatgccctccttgtcctggatcttcgccttcacgttgtcaattgtgtccgaagactcgacctccagtgtgatggtcttgccagtgagggtcttgacgaagatttgcataccaccacggagcctgagcaccaagtggagggtggactccttctggatgttgtagtctgcaagggtgcggccatcctcaagctgcttgccggcaaagatgaggcgctgctggtccggcgggataccct

SEQ ID NO: 6442 - DNA, 949 bp, Triticum aestivum
  unsure (1)..(949): unsure at all n locations
  Clone ID: PAT_TA_6442
ggctgcaggaattcggntcgaggagaagggccttaataaagaagaaacaaaggactgaaaagcaaaaccctagctcttcgggcatctatggtgatggcgacagcgacggcgatctccggccgcgtatccggcgaggccagcgcaatcctcgctccttccgcttcgtccctccccgcgccggtccgacgcgccgccaactccaagggatgctttcgtgcttttcctcgtgttgcatctagcaagctcatgcttacaccaggacgactatgcattgagcgccaaagctgtccacggatatctagtgcctgctctgctctttcaaggcgggacttctctcctgttactcaagacatggaaggcttccttcacagtattgttaatatgggatttcttgaccgtctgaaactggcttggaagataatcttcccagcaccaaccatacatgagaacacaaatgcaagtattgcaaagcagaggctgaagatgattctattctccgacaggtgtgaggtcagtgacgaagcaaagaaaaagatagtggaaaacgttgttgaagcactatctgaatttgtcgagattgaatcacgtgataatgtacaagtggatatctcaactgacgctggccttggcacagtgtattctgtggctgttccagtgcgccgtgtaaagcctgagtaccaggaatctgaagagcagcacagaggaaaaatcgttggtgttgacttcaaggacactggagaatcatctggtaatgttgatgtcaccttcgatttctatgttccgaatgtgaaccactgattccttgacctagcgcgctctgttgtgttcctttatcgcctcttgagactcctcgggtaggatgctagaatttcacttctgatgtaaatatctaggcttttctttcatttggtgtttcatgtaattcgattttagaattttgttcaggagg

SEQ ID NO: 6443 - DNA, 568 bp, Triticum aestivum
  unsure (1)..(568): unsure at all n locations
  Clone ID: PAT_TA_6443
gagatcattttgagatggacaaagtcaccaaaggcgccttgtcaacgggaacatctcctcactgaatgcacattgccaaaaatcctgaaataaatccagaaaaatgcgagcaccagaacctgaaccctagtgaggctggagatacaactgtcctcctaaccttcaagctgttggttcgctacgacaaattatagttaatttgttttttgaacacaacaaattatagttaattgatcccaccataattgctactcgtcggctcccctaccacgaagtcatcttttttccgcatgtgcatgcaaaggccacacatggccaatgcaagagaaagtggccccaaataatgtcaaggatcatctccacgtacattagctgcttggtaatattaattgcattgagtgctgaacgcaaagaaaagggactgtttttattggcggtcgagggaccggcctcggataaatgggcacgcttgtattgctgtccgacccaataaagccgggcggagggagtagttcacaaggattgctgtgatcttnacccacatatcacatataatattaggattttg

SEQ ID NO: 6444 - DNA, 844 bp, Triticum aestivum
  unsure (1)..(844): unsure at all n locations
  Clone ID: PAT_TA_6444
gaagcatagngnggaggcagatggtcccgaccaagaaggggaggaggagaagacagcagatcatgcacaacagttgattaacaatgggtccaatgttaacaaggagggggactttgttaacatccttgaatgcgctatccatgccacagagaacagggttccatcaccttgtggggaagttgctccaaggtgtaccagcacggtcaacaaatgtggatncagcttgctatgtgaagctcaanaggcgtctgatcctttgggcgatgtccccaagagtgcacggaatgaagaatccgtgaagagttcagatagtatcancaaagatggcgctgggaacccaaaaaacctgcagtagcagtgttgatgatgctccagtttcggagaaaggtgattctgaataatgtgttctacatactcgcaactcagggctgcactactgtgccttgaaatactcaagtttgccttattatctaggtatatgtatggaataatttctcaaacaagccatggaaccctctgccatcaacatggcacagatgtgaagtgtgtttgggacttggaacagtttgctgtgtggacatatatcttgaactatcaccatcattcgatatgggaccatttaattcgagttgttttcctaatgtttacagtagtgcgcattgtccagctttaagacacagatcgtggatgatgttgcacagagcatagggaacttttgcttgctccaaacaagcttgtttgtgaacgtgtacctggtgccatgtgccagttacaccacacctatttctacaattacagtaacggttattcagcacttctgtaaaaaaaaaaaaaaaaaaaaaaa

SEQ ID NO: 6445 - DNA, 843 bp, Triticum aestivum
  unsure (1)..(843): unsure at all n locations
  Clone ID: PAT_TA_6445
gcaacgattccgtcatcctccccttcccttttctccggcgaggcactgccggcgattcccacaggtggcgcaatgacgcggcgcggagacggaggtttgcgtgcggcggggaggcagaggctcgcgcgcggcaagtggcaagcggatctcggaccgcgaccatgtcgacgacggcggaggagagggacccccgcgtgtggtggtgtggtgattccggcgggccagagttgccggagaaatggaagggaggcggcggcgcttcttgaggaggctggactcagatgggggaggggcggacctgtccccgatgcggcgctgctcgaggaggcgggcgcggagggggatagcggcggcggagacgacgctgaggcgttccacaagagcggcgatccctgcagccataggtttggggcgggcactgtggatcaggctcgagggcgaacatggcgctcctctgctttcatcgagctgccagcccaagcagagtgcaacggatctcgccgtggcaacgctacagccgcggcttgagctatcaccacggcgactcacagcacaagaccccgccgttggattaatttctctgctggtagcatcttgctgaaccttcattcatatttgttcggttcatcttctgcaattttttgcaagtcatgccatgacgcagtagatgcataccagatttgtgattgcagtctcactgtccacgaccatatacaagtgtatgtggtaccatcatagaattagaataatgtttgccatgctcaaagattgtatcatgtacaaagttgccatgctgatttttacagataaaaacagtcaaacatttnnataaaaatttgcatg

SEQ ID NO: 6446 - DNA, 859 bp, Triticum aestivum
  Clone ID: PAT_TA_6446
ctcactcagctcggagctcctctcccagccccaacaatggcagctcctcctcctcctggcactcgtctccctcgtgctcttgacgaggagactgagcaacaaagggctcaagctaccgccaggcccagcccgggctccgatcctggggaacctgcaccagctaggcgtgctgccgcaccggagcttacgggatcttgcgcggaagcacgggccggtgatgcagctgcagctcggcaccgtgcggacggtggtggtgtcatcggctgaggcggcgcgcgaggtgatgaagacgcacgacgaggactgctgcacccggccggtgtccccagggatgaagaggctgtcctacggcctcaagaacgttgggttcgcgccatacggtacctactggcatgtcatgcgcaagttcttcgtggtcgagctcttcggcgtgcgccatgtcgaggcagcatggcatgcacgccagcatcaggtggagaaactgatgagcaccttgagcggcttggccggagagccggtagcgctcaaggagcacatcttaagcctggccgatggcatcatcggcatgcttggatttggcgacatgtacaacagcgacaagttcccacaccacaagaacttggagcacgtgcttgaggaggccatacacgtgcaggccagcttctccgctgaggactacttccccaacatcatcggacgcctaatcgaccgaatcaccggtctcaccgctcgccgcgagcggatcttcaagcatcttgatgccttcttcgagatcatcattgagcagcatcttgaccctcggcgcgttaagcctcagaacggcggcggtgacctcgtcgaccgcctcgtcgacctctgg

SEQ ID NO: 6447 - DNA, 1162 bp, Triticum aestivum
  Clone ID: PAT_TA_6447
cggaatcctccacgaattaacgagtttcccctcccctgctgcccggccggcgcgcgcggtcaccatcgtccatcgaccgaagccagtgcgcccccgcggccagatccgagcggagggatgacgggggcggcgtcgcaggcgtacggggaggcgtggtactgggacgagcggtaccgcaaggagtcggggcccttcgactggtaccagaagtaccccgccctcgcgccgctgctccgcctctacgtgcgcccgcaccagcgcctcctcctcgtcggatgcggcaactccgtttttggtgaaaacatggttcaggatggttaccaggacgttgtcaacattgatatatcgtctgtggtgattgaacaaatgaagaagaaataccatgataagcctcaactaaaatacacgaagatggatgtaagaaacatgtcagactttgagtctggttcatttgatgctgttattgacaaaggaacactagattctattatgtgcggccaaaattcacaagagcatgcagcgaagatgctaggggaggtgaacagaatcctcaacgataagggggtctacattatgattacttatggggatccaagttatcgattgaatcttctgaaggacctccaattttggacagtaaagcttcacgtcatagataggtgggagagaagttccaaaaagacatgggacctgaccgagccactgcctttacaagatgatagtacatcgattatcaaccttcttggcccaaaacctgatgttcactatatttatgtctgtataaaggacaacgacagtgcaagagtggacttgaaggccgaggtcaatgaagcagacaaatgatcgcatattataacctttttggatcatcgtgtataaccagtgtagcgaataatgtagggaatacattttgtaactcttgacttgtgtcgttgttggcaacaatttagcaaaattacagctaaggatgttgcttcttcgatcatcgaatttggaatagaaatgaatgtgttgttttcatgtctttcgattttgtgtagaatttacttccgtgttcacggaacataggacccgctcggagtgtgggaaatcttagagaaaatgatctaggttttctacataaagaaaagccataatcttgtgggacgggaaaaaaaaaaaa

SEQ ID NO: 6448 - DNA, 884 bp, Triticum aestivum
  unsure (1)..(884): unsure at all n locations
  Clone ID: PAT_TA_6448
gctcccacccctctccgctctcctctcctctttctgccgccgccgccgccgccgccgccgaccccccccctccccccccccgtcgccgcccgtccgccgtggaccgcgcgatcactaagatggctgatctgtgcaccaagtttaccttgtccggatgccaccggttttaccctgagtttccagatcactggtatgatctggttgaagctcctgtccatgtgccgaagttcacccctcgcaagaagcacaaccgtgcgtataggtcccgccatggccatgttatcattggtttccctgaggcaaatgaagacatagagcagctgttcgaggacgatggtgtggaggaagaggagcagctgttcgaggacaatggcgttgaacctcgtgctctgtgcggtcgggccggggccgccgttggtgggggtgggcctcgcctgggatgtgggtgccccgcagaggaggaacatgtcgaggatgatgacgtggaagcattagttctgaatgaggtcgcccccattgatggcggagatgttcctgaggaatacactgagtatgagggtggccttcttgcggctaagcttggtggagaggacgacgacaaggtcgagctttagattgctactatttctggctcatcagcatcgaaggcctgaagatgccggctggcttcgcctggcctctctcgtccaccttcttgttccttgtttttctcccttgtctcccccggtctctaccgcggggaactacgtgatgattatggccgtatgtcagtgtaaatgtctcgtctactgctgaatgcactgaaagtactttctgcatgtgatgattatggccgtatgtcatgtaaatctctcgtctactgcnaatgcacnaaagtactttct

SEQ ID NO: 6449 - DNA, 431 bp, Triticum aestivum
  Clone ID: PAT_TA_6449
gcaatgatatgaaggctgcggtcttcaaggcgatgctccacttcatctacactgacgagttgcctcctttggaagacatagcccttgctgcgggagacggcgtgatgactaccgctggggacatgctcgctgcggcgtgccggttcaagctggacaggatgaaggacaaatgcgagaccttatttggtcagtccgtctcgaaacagaacgcgtcgagcatgctcaaacttgcgcgccatcaccactgcgtgaagctcaaggattactgcttgaagtttgaataatctccacgtacgcgtggatagctaactaagacacgagggcaatgacaacaattccggagcatgtactagctaattttagttatgtagcttgtcaactgtttgcggttactaaagggatagtttttcctatatcagtcaaaaaaaaaa

SEQ ID NO: 6450 - DNA, 826 bp, Triticum aestivum
  Clone ID: PAT_TA_6450
gtgaaaagaaagaagaaacaacacaacaagccaccacgtacgtaagctttatcaccttcaaaaatgtcgggttggttcggggggaagacggacgccaaggacgacgaggccgccaagacggggccgtccgtccaggaccgcgccatcgaggcgaaggaccagaccatcagcttcatcggcgagaaaaaagaggccgccaccacggcggcgtcacgacaccgccgacgcgggccatgaagatggggacggcgacgccatggggaacggcgtcgaggaggcggggcaggccatcacggaccgcgccatcggaagagcaaggaccaggacgttcgggcttcttcaggtgagaacgaccgagggccgccaagtcaggagtggccgccgggacaaagcgcgacgccgccaagcaggaagtccgccgaaggcccgcaacagttgcgtcgacggagaacgcggcgaccttcaccggggaacccgccgcccccaatggagcccaccggcggcatgttcaagggggcccgcgtgcaggcgatgggtgccgctacgagcgccagggacggggttaggaacacactcgacatgagagcagccaaagccaaagtccgcagcgccaaacgaagaccgccatgcgcaaatgaggtctatcccacttttcgtttcgttattccctccgtattcctttatttccgttccaagaaactgatctctacgcatgcgtcggtgtaactttgtccggtgtatgcaaagatgctttgaatctacagacttgctaattctcatctgatgaatatattcttcacatatcagaaaaaaaaaaaaaaaaaaa

SEQ ID NO: 6451 - DNA, 407 bp, Triticum aestivum
  Clone ID: PAT_TA_6451
ctcgtgggtcgatacacgcctctagaatatctcgaaccatgtttcagcccttgtggctcttgcagtagctacccctttagaacaaagtccagaaattaaattcattgagaaaggcattagtggagagggaacaactacccgttattgggattgttgcaaaccttcctgctcatggaggggaaacgtccatacacctagcggagtaccagttgcctcatgcgatagatctggagtgaacagggttgatgataatgcaaaatcaggttgtgagggtggcggcagtgcttacatgtgcaacagtcaacaaccatgggcagtaaatagcactttggcatatggttttggtgccgcgtctttcagtaacggggttgatgtatccctatgttgcgcctgtttcttacttagct

SEQ ID NO: 6452 - DNA, 1004 bp, Triticum aestivum
  Clone ID: PAT_TA_6452
ggtctccggcgccgacgtccccccctgccccccctcccacacaccggcatcagcccgacctgctctctctccctccgtgatgctccaccgtgtaagctcggcctgcctgcctccaggagctcgcgtcgatgcccgccgccacgagcccggctccaggggctccaagagagatcacggcagggttccctccccgccgacggagctccttctttcaccggagctcccttacccgccggatccgaccccctccagaccaactccggcctcgaccggctctgctccgggcagcgacgtcgtgcaagcagcgcagatggcgatggggtggcgttccgtgcagcaccttcaccgtgcgaatcggcgtgacacttgacatctttgcaattagctgcttgtgccgcacatttgagctgaccatctagacgatgacttccgaggatgttacttccattttgcggttagtcctcgttcctgccttgcaatcatatagacacagagaggatagcgtgcattgtagatttgcagcttgtaattttcatccggggcagtccgctcgcgggtttgcttcagggatgtatggtcagggaaacaagcatatatgcttggcacactgatgtctgaagaaattaacatgggatgttcagatatattgttgaggaattaggtagtgtgctaccaaggaactgtatgtgtcgtgtatgattagcaattgtgcaataatatagatacagagaagaaccagcaattaaagattgatttccatcaaaggctcgtgtgcatttcagatttgcaggttgtagtattcaacagtagtaatgcacttgcagatgtgcttcatggatgtatgggtagggagacaatgatgcatatatgcctgacacactaatgcctgaagaaattagtgcaatgctcagacatatttgttgaagaattaggttgtgtgctaccgggtaattctgtaattgtatgttccttgtatgattattaggcgttgtgcaaaaaaaaaa

SEQ ID NO: 6453 - DNA, 728 bp, Triticum aestivum
  Clone ID: PAT_TA_6453
cccggcccggattcccgggtcgacccccccccccacccacgcgcaaaacaaacccaactacccccgcgtcccgcactcccccgccccagcgcgtcacctgcgctgcccgccccccgcccgcggtcatctccgcccccctcgcgcagcccacgtacaaaaccaaacaaaaaagcgccgagcaacgcagcgccgcagatagagtcgttgcgtgcgtccaccgctctcgcggcggccatggaggccacggcgcccgactactacgcccgcgacaagaagggctccgacctcttcgtcgtcgacgacctcctcgcgctgccgtgcgacgacgaggaggaggaggaggaaggggtgggcgacgcgccgttcctgccggccaacgccgcctccgccgccgcagtcgtcgtcaagcaggaggccgggttcgggaacgcgtcggccgactcgtccacggtcacggccctcgacagctgcagcaactccttctccggcctcgccgacggcgacttctccggcggcctctgcgagccgtacgatcagctggcggagctggaatggctgtccaactacatgggcgagggcgaggagagcttcgccacggaggacctacacaagctgcagctcatctccggcatcccctccgggggcttcccctcggcgaacgggccgcctgctccggcggccaccgctgccacggcgcagcccggcatgttcctgccggagggccccgt

SEQ ID NO: 6454 - DNA, 943 bp, Triticum aestivum
  Clone ID: PAT_TA_6454
gtgctcgctcgtgttgagcgtgcgcgcggccgcgctccgcctcctccccccgccgcgcttgcccttcccgccgcccccgccccccgctctgtcccgttcgggtggccgggctgcagacagcggtggcgtggtgctggtggtggccagtcagcccgcgcgtgtggctcggttgaccccttctccccccgtgtctgggcgccggggcctcctggccaccgcagtcctgacgccctccgtctcgtgccgccgccgtctcgatcggctcttagctcttcaggccagtttgctagctcggtggacatcttgacactttgccttgtgccttccttgtcctcctgagccggcacttgcccccaactcactgaaactgtgatccattctcgtacggggtccgtctcgtttggttattaggtctagaggccgagagctacctgtgtggctttcttgactctgcatgcagtatgtggtaatatcacctgggcgcttcaggccctcaaatcactgacactggagttctcagcccaatcaaaactgccagaatgggtaggcgagttgacatctcttgagaaactagagatagcttagcacgacgagctagaggaattgctcaataacacgaggcgactgaaacaactacaatcattaacactacaagagtgttgtagcttgagacagctgccgttgtggtgttacgagaacttacctctctcaagaaactggtaattttgaactgctctgccataatgactttgccaaacagcatacaacagctcacaaatctccaagaattagcaatttactttcgcactaacttaaagcagtggcgtgaagcagaggagaacaagacaaagcttgctcacatagaacaaaaaggtatgcaccctgccatgtatgtattcctattaactctgcacttagaacgcattccatcatcggtagtacc

SEQ ID NO: 6455 - DNA, 638 bp, Triticum aestivum
  Clone ID: PAT_TA_6455
ttcggcacgagggcggcatggtgctcagcggatttgacttggtcttgggcggtgccgtcgttgctgttggtggtgcagactcagcggcgcggtgctcggtggcagtaggtggcatcggcggtgtggtgagttctttgggttcctcagtgccgggcaacacgggagctaaatcgactgcgaccgcttcatgctcaacaacggccacgacggcactgctccatctcacgggctacggcgtcactgctccatctagcaggttatggcggcgtcacggactccattttttccactttggtgggcggtcgtcgattcccaataggcggaccagtcgtgcaacatcattggtggtcctcggtgtcaggtttccttgattattggcttgcttatttgatgtgctttgcatctcctccctacaacatggccagcaaccaggtcttcgatgatggagctctccagtatcgtcccctctcgataaatttgcagtagaatctgtctattttatacgcccaatatggttatatttagtaaagaagtttagttatctgcccataagtatgaaactatgaatctttgttgacttgcagcttctttgctatggtttattttttgttactacgcatgttctaatatagactgtc

SEQ ID NO: 6456 - DNA, 1619 bp, Triticum aestivum
  unsure (1)..(1619): unsure at all n locations
  Clone ID: PAT_TA_6456
attcggcacgaggcccgtttcagtcgttgaaacttactaccaagnaggagccggctgccgtggcggcccatacccccaggcggacctccaaggtcgcgcaggaggggggcgaaattctggaattggagaacgcggaagtggaagaagaggtcgtcaaggaggaagcacgcaccaatggcaaccacgacagtgaagccgacagagctgggctcgccaaggacgaagggaggagcagtgccggcgaggagccgcaccgggagtccaagtcgtcggaggcaagcagcatggttcatcatgtccatgtagtggagaagagtgtggtggaagaacattcagatgccgctgcggttcccgggaaggcctacaacgatgacattgaggtggcacggggctgcaggtcgcagttcgagcatgccgcaaactctgcagccaatgtatccaaggtgctcgaggttgggaagatgccttaccaccacaagacctcaggactgaaagtatcctcatcgatgataatctgtggccggccttcagtcggcgaggagttcctgcagtttgtggaggacaaagctacagaacatggcaacctttcttcnacattgcagaagctctacatgtgggaggagaagcttcttgaagaactcaagaccgaggagaagatgagggtgctgtatgataaaaaatgtgaggaactaaaagttctttatgagagaggtgctgaggctcataaacttgaggacagtgaaacttatatcaggaagctatcgacaaaaataagtgttgccattcaggttgtcaacactatctcaaagaagatcaataagctgagagatgaagaattatggccgcaaacaaatgagctgattcaagggttgatgcaaatgtggcatgccatgtcagaatgccataaaatccagtgccatgccttggcccaagctaaaagcatcgactccaccgtcgcagctccaagattcagtgaagctcatatcgacttaatcaagcacctggagcttgagttgctggatttggttgccagtttcgccgcatgggttaacgcgcaaacgagctacattggcactataaacgactggctgaagaaggggattgactacgtgcctgaagtgaccgacgacggcactcccccgttctccccggggcgcctgggagcaccccccatcttcatcatctgtaataactgggcgaccggaatcgcgaggataccggagacgggggtggtagacgccatgcaggctcttgcctcccaggttctgcacctgtgggagaagcacagnctagagtggaggcagggcatgatggccaacggagacatggacagggagcttnnnntgatggagagggatgaagcgtnnntgcgcaagnnncttgnnncacagaataagannctcgtgctcgtttcgaatcnnnncggcgtgtccttgtctgcgcnnnncgtgcgggnnnngtgatccgccctctgaagtggnntttgcagtcatgcatgaacaggttcttcgaagcgatggagagcttcgccgccgcctgcgcaaacgcgtacnnnnntctccatcttcgnngnnnnnnnnnnnnngctcgacctgcccaggagacngacnnnnnntcct

SEQ ID NO: 6457 - DNA, 532 bp, Triticum aestivum
  unsure (1)..(532): unsure at all n locations
  Clone ID: PAT_TA_6457
ggctgcaggnaaaattgtcatacaagcaggctataagccccactatcgtacatgctcttagttcgaacgtacatactagtactcatccagctcttctaagcctccacaagatcggaagctgtgggtaggccgggcatggatgcatccatggcgccaacggagggtgacgtgcagcccccgttgcgcatcctcttcttcccgttcctcctccccggccacctcatcccgatggccgacatggccgcgctcttcgccgcccgtggcgtcaggtgcaccatcctcaccacacccttgcaagcttcgaccatccgctccatcgtcgaccgtgccaacacttccctggggtcggtggatgtcgtcgtcgttcctttccccgacgtcgggcttccccccagcgccgagagcgggactggcctgacatccaaggactacaaacgacaggttccttcggacggcggagctgctccgggaagcccttcccgccgcttcctgtccggccaccacgccggggtcggcgccctcgtctccgacg

SEQ ID NO: 6458 - DNA, 1299 bp, Triticum aestivum
  Clone ID: PAT_TA_6458
cttcgccacgggcctgtccgtcttccgaccacaccggtccatcgatctcggcgatggggatcggcatgagcagcggccggcagtacttcgccggccggacgctgccgctgttggctgtgcagatgcttctacagtacggcccggccgacgcaagccgcccgcccttgacggccgcgctggtcgccgccaacgcgctggtgtacttccgcccgggcgccgtcgacacgcacctaccccggctccggcacgtcatgttcaacccccatctcatcatcaagttcggcgacctgagacgtttcttcctctcagctttctaccacttgagtgaaggtcacttcttcatgaacatggcttctctcttgcgcacgggggcaaagcttgaaacatcaactggcagtcctgagtttgcttgcatggtggtttccttgcttggcctttctcagggcttcacactgctcttgtctaaaggcttgctttcgctcggcaacgacatggcgtattatcaatattctgctggatttagtggagtgctgcttggcatgaatgttgtgctgaatgcccgagaaggcgatgttgtctggcatggggtgaccgttcctgcaaagtatgcggcattgcttgaactactactcgtccatgctttcaatccggaggcacacttgatttgcaatgttggtgggatacttgctggcctggcctaccttttgctgaggcacggtccagaacggctcgctcccatgttttcaggaattgcagacgttgtgagtcagccggcgagatttgctaagaaacttctgaggccagcagcacatattcgggggagcagtgtccggcgccatgttgcaccggcgcaagaagaggttgggcaaggtatgcggtggagatgcataacatgttcttgtgacaactcgcgttacacagatgtctgtgagatgtgcagcactccgcacccggaccatgccttttcccgcagacggcatctccaagacgatggaaacaacgagctctcagtcgaggagatccgccgtaggaggctcgaaagatttggaggatgatgtagtctgcaccaacgcaacttccatagggaagtagcagtgcaatgtccaagtagtccgcacggagaatggcaggcatctgcccgttttgtgctagatggtttagtgttccttggttctagcattagttatatgtggaatgctttacgtaattgaaattggtcttaatcaccattactgttgctgatacagttatttctttagcttgaactttgacaccccgaaaaaaaaaaaaaaaaaaaaa

SEQ ID NO: 6459 - DNA, 869 bp, Triticum aestivum
  Clone ID: PAT_TA_6459
ttcggcacgaggggctggattattatatggctttctagcaccaataatggccacattcgatgcagttggagaaggcaaagaaaatacatttgttcattgctttgtggatggaacttggagcactattactgggagttgtacagtggtcagggatttgaaagacatgcttttccactcctatttctcaattatggatgaccttcgtcttcagacacctcctggtggaaagccatatgagataagattgcttgatattcccggggcgttgttgtctgctgcttgtggactcatactggatgtaataatgttcacactaattgccatctacaagtgccctgtgatgcttttcaaagggtggaaacgactgattcaggatttgattgggagagaaggaccttttctggagacagcgtgtgtgccattcgcaggtcttgctattcttctctggccatttgcggtactaggggctgttcttgcatctatcctctccagtattcctttaggcctgtttggtgcagttgtagcttaccaggaatcctctgtagtcatgggactctcttatgctgtctcatctgtgtccatctttgatgagtacacgaatgatgtgcttgacatggcaccgggatcttgcttcccaaggttgaaatatcggaaacagaaaaatgaagattcttcacatggtggtcaactatctaagccaggctcattcgacaaggagaaccaagaaggaaagaaacctctaaaccgtgtcacatcatttaagaacagcatggatgagttcaatccattcaagatgctggaccacttatttgctgaatgcaagcggcagggagaggttttggtgaatgaaggagtgataacaatgaaag

SEQ ID NO: 6460 - DNA, 561 bp, Triticum aestivum
  Clone ID: PAT_TA_6460
atgcggcccgtgggcagttacggcgaactcgacatagtcaaggtatgggaaagaaccatggaaataagaaagggctcaggtggtaagcacattgaaaggatcgacggttgacaacccgatctatctcagtgaccatgaaggtagaggccagaggttaagagcctgtttggattccttccataaaaagcagcctaagccaggcacaaaccttaggcgtccgattttggaggcctgaggctgagatctctgcctgagtaaagacctgcctgataggcctcaatccaaacaccccctaagattgtgtagtgaaccatgcctttgtgagaggaccaagacaaaagttcaatgctgcatcgtttgcttgcttcctttgctcggttcgagatccaggccgggagtaggctaggaccagtgataagaacgtcagggtgttgcgtcatggctgtatacatgtgttgaaagcattgagcttaatttagatatgtaggtgcaattccttttcgtgtataagataatgggtttatatataggctgtccctgtccgtggtgccagttgaagtt

SEQ ID NO: 6461 - DNA, 741 bp, Triticum aestivum
  Clone ID: PAT_TA_6461
cggagagagagaaccgaatcaccaatcgaccgcacagcgatccgcatccgccactgagtcccacctcgccgccggcgaggtccgcgtcgttgcccggcggcatcgatggagaggctcgccgccctcacgcgggagcagtcggtgtgggcttggtcccggtagttacaatcgattggtgggggcgggggcaggcaggacaggagagcgccgcggcgatgaaggccctgcggcgatccagcacctcgtcttcgtcctcatcctcgtcgtccccgaggacgccatcctcgccgccgccgtcttcgtcgcggatccaccgccgttcgcttctgctcgtcgcctcgtcggcctcctctttggcggcgttggggaaatcggccgcggcggcttcggcttcagcgtcgccgttgcttgcggcagattcctcgtcgttatccccacccgattcggaccgaggtgcaattaaatctccatggtctcggaggaaaagaaaacaagcactctcttgtcaaaactggagccgtctattttctgtgaatgggaagtttcgtgatggaggaagaaaatttctgaagaaagttcgcagtgggggaattgaaccaggtatcagggctgaagtttggccctttctacttggagtctatgatttaaatagttctgaagaggaaagaaatatcatcaagacaaagaaaaggaatgagtacaaaaagctcaggcgcaaatgccatcaaattctgaactgcc

SEQ ID NO: 6462 - DNA, 1196 bp, Triticum aestivum
  unsure (1)..(1196): unsure at all n locations
  Clone ID: PAT_TA_6462
cgaggggagagaatgcagcagcagcaggagcaggagcagcaggcggcgcggcggcggcggcggagcccggggggctgggagggggccgcggcaccgtggacgaggcctccatggagcgcagcaagagcttcgtcaaggccctgcaggagctcaagaacctgcggccgcagctctactccgcctccgagtactgcgagaagtcctacctcaacacccaccagaagcagatggtgctggacaacctgaaagactacgcggtgcgggccgttgtcaacgccgtcgaccacctaggcacggtggcctacaagctgacggacctgttcgagcagcaggcttccgagatctcgaccttcgagctcaagcttgcgcgcttgaaccagcaagttttcacctgccaaatctatgtggacaaagaaggctccaggcagcagcagatgatgggggcaagcatgaagcaccacaagcactacatcctaccatctactggttataagagaactcaggctgttgcgcacctgggaaccgacactaatcaggaatcacagcctagaccttacccctcagcaaagacgctttcctggcatctggcatcggacaatagcccttcggcaaatagagcacataaacctacattcatcctagatgatacgataccatccaaactcgcatcagatggtccgcatcttcttggtaaggagttgcctgcttctcccgtgcgtaggcctttgcaacttaacaggaatatcaaatccgacgtcgcacaaaaggttggcgcaaaggatctgtcggcgtttagttctttcgacaggcctacagggcgtgaaatccaaaaggctcctgccagcactaagagcgtgctagcatctctttttatcaagcacaagtcagcaaagatgaaaagtatctcagctcgatgatcctcccttgatgtaattgaagtttgttgtaataaccagtacaagccaagtaaaatgcaattgtatctcttcaagatgtcaagtcataacatctcttatctgtgtaatatgtgctgattcaaagcctgtaatgaaaatcatatgcaagtttggaagtgtgtttagttatattcatccaatagcatgatcttccctgagatactgatttganctagtaaattgtacgtgtcttggcacgtcattnaaatgnatataaaaagcatgggaaaatacatttga

SEQ ID NO: 6463 - DNA, 545 bp, Triticum aestivum
  unsure (1)..(545): unsure at all n locations
  Clone ID: PAT_TA_6463
ggnntgcaggaattnggcangaggcacctgctgtccctcgatnctccctctcctcttcgtcgagaagtccctatctctctcctttccatctccctctccggccgccggcgttgaaacaacaacgcccagaatccaaatcatgaggtccagcggctgcgcgctgtgattgcatcttttttgcgacgcagggctgtagctccgtggaccaataacacggctgcataggagtcggctatccgcctttatagctcgaggatctgaggaggctctgtggtcatttcaacatgcattatgtattccatctatcttgaagtcatcaagatgactttctgttcatgctagttggcctgaggattgatttgtactctatcgcccgaaatgctttcctcgtgaagtatatctactagtcgctgctgctaagttgattttttcgattccttttgtctaaacctggtgcacaaaggaaaacaaatgctgtacaagtctatatgtacttctacttcggttgtcatttatgcacttggatgcttcgagtaaaaaaaaaa

SEQ ID NO: 6464 - DNA, 677 bp, Triticum aestivum
  unsure (1)..(677): unsure at all n locations
  Clone ID: PAT_TA_6464
agggggcacgacccgcacgcacgcacggnagnaacgcacggccccgcggccgaccaccccccgcacgcccttgcgtgcgctccctcccccgccgctctcctcctagggcgacactggggcgccccccaaccctagccgtcacagacccccaccacaaccacgccttcgccgccggtggcggcgaaggcggctcctcaaagcagggacgcgtctcccgtcgaaatccaagtccgttcgcgcgagcttctccgcccctcgatccgatcttcaccttcgctcatggtggccgtcagctggcctcccgccggcggccaacttgatctgcgcggcactcggctgcccgcatggcctacctcctccccatcgcggcactcggcgcggcactcgttggccgccgttgggcctgcttgcggcgcacaggtcgggtcgcgcgcgacggctacatcatcgccggacctgtccttccgtccgaccgcgaccccaaccccagcgccctccatccaccgcccgcttcccccactcccgcttgactccacggggcccgccggtcgcgagccccggcccggagtcccgcgcggctccgggggccagccccgcgtggcccgccgcccgctcggcgctcccggcccgggcctcgccgtggttgcccnnnnntcgtnnnnngctcctgtgtggnn

SEQ ID NO: 6465 - DNA, 277 bp, Triticum aestivum
  unsure (1)..(277): unsure at all n locations
  Clone ID: PAT_TA_6465
gctncaacccctcntgcggcaancggtggagggagtgnncgatccgcatctcctgcctgcggaggccaccgtcgtcccgtgccctttaggccttaattgatcgtgctctggaatttagcttccgatagcattagccgtcttgtcagagcacaagagagctcaacttgtgaaacatattattgtggtttcagtgcttgcccgtgaccatgtacttaatttacaaacctttatatgtctctagtgagactaatctcattttatagatttggttcttgcc

SEQ ID NO: 6466 - DNA, 2306 bp, Triticum aestivum
  Clone ID: PAT_TA_6466
cgccccgcacgcgcgcgccctcccccggcaggccgtcgacctcgccgtccgtcgcgagggctcgccgctcgccgggatcgggggagccgccgccgcgcctccatcccatccagacacagcctcctgggccgctcgctcggctgccactcaccagctcagcgctcgagagcccagatcccccgctatatagagcccccggcgagccttcgccgccgcgccggccatggatttcatgaaggccttcgatcagaccgtgcgggagataaagagggaggtcaatctcaaggtgctcaaggtccccgagctcgaacagaaggtccttgacgcgacaagtgatgagccttggggtccacatgggtctgctctttcagagctagctcaggccaccaagaaatactctgagtgtcagatggtgatgggtgtcctctgggccaggctgggtgagcgagatgcaaactggcgtcatgtgtataaggcactgacgattattgagtacttgatagcgaatggttctgaccgggcagttgatgacattctcgatcattattcaaagatctcggttctttcgagttttgagtttgtggaacctaatggaaaagactctggaataaatgtgaggaagaaagtggaaactctggtggggatcatcaatgataaggagagaataaaggctgtgagagagaaagcggctagtaaccgtgacaagtacgttgggttatcatcaactgggtcatatagatcaagctcagcctctggaggtagcaactacagttcaggtgaacgctatggcagttttggtggcacaagggaggctgattcgttcagtaacagttacagggacaaagaacctgttaaaacctcttcaagtaatactggcaggcgcagatctggcagcaagataagaaaggatgcggatcatgatagaagctcctcgaagtccccatctaacacaaaaggcaatgaggatgagtttgatgactttgatcctcgtggatcttcttcaaatggtgcagctaatacaaagactgccgaggtggatcttcttggcccaaacttgatggatgatttccttgacgagcctgcagccactccatcagcaaaaagtgctgtagaacctcaggttgatctgtttgctgatgcagacttccaatcggcaatcccaggtgccgaaacaactgcgcatcaggatgtccaggaaactgttgaccttttttcgggaaatgctacctttgcttcagcatttccaccacagactgggtttatcccaccaccaacttctgggacaccttctaatgctaatacttccgtgtccaagaacacagtacctgaaccatttgatcctttcggtgatattcctttaagcagttttgggggatctgacccatttggtgacttcagctcatctagtgcaccaccaccacctgtacacagctctactggaaatatcagcacgtcgagtcagaaccttgaggcagcatcggactttggtgcctttgaatcaaacaccgtggatacagctaaagaccccttcgacttttcttccactggcaattttggcaaagcagatgtagcacctttggcagctcccaaaactgatgcgtctgactttggtgccttcgttgcaaacactgtagaagcaactaaagacccctttgatctttcttcaagtattaatggaagggcagaccaaacacctttggctgctcccaagcccaacaccaagaaagaaaattttcaggttaaatctggcatatgggctgactctttgagccgtggattaattgatctgaacataactggaccaaagaaggtgaacctagccgatgttggggtcgtcggcggcctcagtgatgggttcgacgacaaggctcaaccctcatggaacatgggtgcagggggatctggccaaccctcatggaacatgggtgcaggggggtctggcctaggaatgtctggaattcctccgtctacgcaaggcggtggcatcgagagcttggcaaactacaacaagtatcagtttggtggcttcaaatgagctccataggagaacatttctagcacctggtgtttgttgcttttttgctggactgcgcctttgggctcttattatctttttattggttttgtcatctcgcttttgttgaccgtcacattgcttataattgccgcagtattcaagtatcgtggtctttgtccagtgttgtcacgcatgtgttgtgtttgtcaggtttgcggatacgctgcccttgtgtcacatcacgattcgattcaatcttatagttaataggtgccctctgtaaaaacaa

SEQ ID NO: 6467 - DNA, 1438 bp, Triticum aestivum
  Clone ID: PAT_TA_6467
ggagtactggctcacgctggacctcctggcatcatcgtcagcagcaccgtgcggtccggcggcgagggttgccgactctcgtgatgcggacgtgatcttcgtccccttcttcgcgtccctcagctacaaccgccactccaaggccgtgccgccggagaaggtaagcagagacatgtacctacaggagaagctcgtcaggtatctggtggcgcagccggagtggaagaggtccggcggtgccgaccatgtcgtcgtcgcgcaccaccccaacagcttgctccacgcccgatcggcgttgttcccaacagtgttcgtgctgtctgacttcgggaggtaccaccccagggttgccagcttggagaaggatctcattgcgccataccgacatatggcgaagacatttgtgaatgacacggccgggtttgatgatcggccgacattgttatacttccggggagccatttacaggaaggagggaggaaacattcggcaggaactatataatatgctcaaagacgagaatgatgttttcttttccttcggaagcgtgcaggatcatggtgtcagcaaagccagccagggaatgcactcatcaaagttttgcctaaacattgccggggataccccgtcttccaatcgtctctttgacgctatagtaagccactgtgtccctgttatcataagtgacgacatcgagctcccctacgaggatatcctagactattcaaagttctccatctttgtccgttcctctgatgctattaaaaagggctacttgatgaggctaattaaaggcataaacaagcatcgatggacaaggatgtggaagaggctcaaagaagtggataaacattttgagtaccaattcccatctcataaggatgatgcggttcagatgatctggcaagcattggccaggaaggtgccgtcgatccgactgaaggcacataggtttagaagatcttcaagatctgaaagaggaagcaaataaacaggaaggaggtgtatgtattgatgatgtgctccagatgatagggcaagcagtggctaggaaaggtgccttcggttcggacgaagtcacatatgtttagaggattttcaagatctgaaagaggaaccaaataaacaggaaaaagtgtgtatgtatcttgcttctaggctaatctaacacagcattcactgacactggcacatcagttgcattttccctttgaggaacattgtaaattagaagattcaggttgaatgtttggttataccttggaacaaaaacagatagctcagacttttatcggtccagttgaatgtatgttaggaaggcaaatgcttattgttaatgtaacatatactccatccgacagatagctcagaatgtatgtttgctcggagtttatcccacttctataatttacttcaaaataaaaaaaaaaaaaaaaaa

SEQ ID NO: 6468 - DNA, 990 bp, Triticum aestivum
  Clone ID: PAT_TA_6468
cagccgcctgcgcctagggtcccgcccccacgaccgtcgccgcgccggagatgccggcgtccgagcccaagctcctggccctcgccaggtgggacgcggtcatcgcgcggtcgggtgtgcctcgccacgttcgtcgcgctcatcttcgtgcattgcgcgctgcgctgggtcctctgctcggcgttcctcgcgttggtctcatggcgcgccttgccctggcttatcttcactttcccgccgccccccggtcccttgactctcttcgcctcgacctcattgtgctcctcgcccccctccaggaagtctacgacagcgcccgctgaaactcttcgccaggttgcgcagatgacgctcaaaaggcctctcattggtttagcgctcttgttgcgggtgcttccatcccgcatacatttgattatgttgaggtggggggtctggtgggtgtggaaggatctcagagggaacggtttggttcaatagtgagggatgtggggtttatgggtggttgcgcaacatgttttcttgtcaccttacccaccaggatactggcggagtaggggaagatagtgagttatggggttgtgctgttgtgacgtagcactgaacagatggtgttaagatgggcaagacaaatacaagagtcgactcttcgctgaagtttgtggccgcagataagtactggattatagttagttagttacatgtattcacgactgtagattgatccgctgctagtatcgagtactccatgtgctaggagctctcgtaattcgacattgtgccgttgaagtgtttatttgctgctgggaagcctggaatacatgaccagacaagtgaggggtgggccaccctctccgaggacagtgcttttgtaggcatatggttttttgccatgttggcagtgttatgtttgatgacaaccatttcttcgcaaccggtcggcccctggggcagtcattgtagaaggttatgtttgtagcgatccagatg

SEQ ID NO: 6469 - DNA, 511 bp, Triticum aestivum
  unsure (1)..(511): unsure at all n locations
  Clone ID: PAT_TA_6469
gaggaattcggnacgagggcagtttgcggctgaagaaatctcgtccatggagcttgttaagatgagggagacagccgaggcctaccttggcaccacggtgaaggatgctgtcatcaccgtcccagtctacttcaacgactcgcagcgcccactactacaaaaacagctatagccaatatggacaataatgacgcactatacatgtggtgcgccattactaaatagtaatggcgcactatgtgttggtgtgctattagtgtgcaaatactaatggcgcaccatattcacggtgtgccattagtaatttttttttcaaagctgcgccattactagtttaactagtaatggcgcaccactcccacgatgcgccattagtagtttggcccaaacattcccccgaatgcagcccccctccccctgaccgccttttcagttttaaaaaaataaaataaaaggatagaaatgtcaaaaaaataaaagaaaataagattcccatgtgataaaaaaaaaa

SEQ ID NO: 6470 - DNA, 967 bp, Triticum aestivum
  Clone ID: PAT_TA_6470
cgcccccctcgcagccgccgtccggcacgtcgtgaccgggcgcgctctccgccaggcatccgtcccgcccgtcgcctcccggtctgagacggttgctccttctgcccgttacagcgctgccgcacgaaagttcaacccactctgttgaacagggttgtctcgaggcgcaggatcctgcaggctaggaagatgaagtcgcgcgaggctagaaatggcttcttgtcttgaatcagcaaaggaggcttgcattaagttttcaaagcaaaaatgtaatgcaccattccgagatgcaaggattgcctctgaaggtctccttgaaaatacagattttgctgtctgggatgctgggcgtaacaagacagcatcagcatccttgtctgttgcaaacagccgctgctcatccaatcctgggcttggtggcacaagctacaaaggaagtgacttgctagacagcttagcaactgaaggcaatagcaactcagggcgatgacctatcaagggcaccactgtggtcagcgcttaggagaccgcacatattatttggagctggattcatcatcaatgaaataatggtatatgacattgtcgaggcttgtgttctcctgttatgtggttttctgttgctacagttggctccatggcaagaaaaatagtgaacaattaattgatagaagaagactgcggctgggaggcttgagattgaatggctagcattctgaagtctcgcgaggccaagaagattaagaatatttggatattgtttcctgctactgtcttggccgtttctgttgattttgagatgctgggcaaaggcgacacaagatgcaaaagctgtacatcaaattcataaggggtgtattgtgtagcagtagcagtatcggtgaatatgtagtatatgttgatcatttgttgctgtaaataaatcacgcccagctgaagtcgatgaaaacctcactatccaagtgcc

SEQ ID NO: 6471 - DNA, 852 bp, Triticum aestivum
  Clone ID: PAT_TA_6471
ggttgtttttttttttttttttttttggggcacaagctttattatttattcactacgaagtaaatgcagcttcccgggtacatagagaagtagtaacagaaaaacacctacgcgcgatccttattctactagttgggcatgtgaaacgccaaccacgcactaaatctccatgcaaggtcctcgatcagtacttctcgatcagcggcgggatgctctgctcattcctgaagtagtcctgaggatccaccttgcccttggtaatggcgagcctttggaagttgcccttgaagtacttctcgccccaaaccttgccgctgctataggttgagatgtcgttcaccacctcgttcctgccgaggtcaatgtccctgtagttggcgtacgcctgcctggggttcttgctcacgtacggctccatgaaattgtacatgtccttgctccactgcagcggcgcggcggcggctgcctcggcgaaccagtagttgacgtactggatgttgaagagaacgccctggcggtgagggaacggcgtcgccgcttcgggggtggcgctgatggtggcgccgtatgggtccatgatcatcatccccccaccgggcttcgtgagccagccgaagatctgctcccacacgggcttggggaagggctggtacacgtagtccgacttgtattcggcgaagggcttgaaggtgttgttccggttgaggaggtcgaccaggctggcctctttgccgaggtggatgaaggggatggacttgatccagggcatctcgttgcagtgataggggttcatgccaagctcggggaattggctgctcatcaacggcgtcagggtttggccctcgtgccgaa

SEQ ID NO: 6472 - DNA, 1251 bp, Triticum aestivum
  Clone ID: PAT_TA_6472
cgcgcggcgccgcgcctgggggtctccctcgccaccgccacccgccggcgcgacgcggcgcacccctcccgccagcccatccccccgtccgggtcagccgacacaggaactcatcctcttcgacatctccaccccggcccagactgacagctacctcgtcccgccagatctgttcgtctacacggccgccggctcttccccctcggtgcagcggctccctccgtgcactgagcgcgggaaaaagccgttcctgatggataaccttgccacaggcatcctgcggctcaaagcggaggaccgctacatcgtcgccgacctcaatgtctactctgaagaagcgggcttgcgtgctgaactctgcgtcttcgactcctacctcaataagtgggaaatcacccccaagatcgctttcgacgaccacatcaatggcggccagttcaccaacctctggtcaacccaccatgtgtttgcttttgctggtcgtttcctttgctggattgactacttcagcggtgtcctgctatgtgacttctccatgacagactcaccggtgctccgcttcgtacctttccccggagaaaaagagtaccatgataaggtaagggttgaaaattacttacccgagagattccgaagtgtgtccatcagccaaggcaagatgcgctttgtccacattgacaatgacttccatgaccgactccatgatcccagccaatggattcagcttcctgagagaaaaagccatgagcagcatcagcctccccagaaaatcaccatttggactttgaactcccaagttcgagtgggacctacatcatgatattagcctgcatcgtctctgggggcaacctgcttaccgagctctgggtatacatcaacgccttcctgagttcccaatcattagcgccgatgacccgtatgttctgtgctgcaccttatgtggacggccatgccggggtgcgcgctggctctcctgggtcggcgtctgcgcatgcgtgcgctcaccctcccctgtttctgactctccccctgcttccgcccgccttctgcaatttccttgaaaggccagcagggatgacatcggaaaacgacaaggttacaactctttcaaagaagcataagcgtgcagggtttctttcaaagaaccgtaagctcaagtgtgtgaggtgaagacctggaatctggtgactgttgttgagcactttggtgacgctcgtatcgaagatgacgattgctcaagatgatgatcca

SEQ ID NO: 6473 - DNA, 913 bp, Triticum aestivum
  unsure (1)..(913): unsure at all n locations
  Clone ID: PAT_TA_6473
gcacgaggncgcgaacccgacgccatcatcgccacggccgaccttgccggcgtgctcctcgtcgtcctagacggcaaggagcttgtccaaaagcttcgtctgcttctgatgcttccactacgaggatcggttcgagccgggcgcctctacatcgcggggatcgagcccatcttcaacctctgttagccaccgttcgacgcgtcgatccgcgcatctccgacagcccccggcctcgccgagccctccccaagatccgcttagaccccgaggccgatgatgccctggtgattgactacgtcgacgacgacacttcttccttttcagcagagcttccagtgacaagagatccgatggccgccgcagcagctgctccggtgatgaagccggcgacaatcaacaccaacaccatagcaccgtgctgcccatctggtggacgcgttacttcggcaagcacaacaactccaatctgtacaacagtcctgccgacggagaaggtgacatccatcagcgtgagggcttccgcggcctggatgatgacgccatcatcgggcgagtgctctaccatgggcttgatgacaactttgattgagagagatcggccgaacacgaggttgccccgagtgacggcaaaatagacgtgcacatccatgggggttggttacaaagaagaaacctttaggcccggggtgcaatggtaaagtgggttacggtgaaaagtgccatatatttggaccagctgcgtaatttttctctccccattgttttgattatttatggtgtatttatagagagcccggccccccgctatcacgctttgccaccttggttcggtggctccaagggtgggtgtggtgtttcatttgtattgattgcgcgcgtacattcccaagcataggtagggttcttttatgtt

SEQ ID NO: 6474 - DNA, 1329 bp, Triticum aestivum
  unsure (1)..(1329): unsure at all n locations
  Clone ID: PAT_TA_6474
gagggaagaccaggnaggagctggtggctgcatcaggtgatgaggaggaagagaacccagaggaagtagaaaatgaaacacaggaggacccagaggaagcggggatggaagcactgaaggagaagaagggagaagaggtaaaggtggaggttcctgctgatgagaagatagctgaagaagcagggaagagcgaacctcgcgtccgaacaaaggcaacgggggnaagttgacaaggaaggggagaagggtgcactggggcaagtagaagcacatttattcctgcagatggttgcggcatttggactgaaagacaagtttgatggagagttcttgaagagcctgtttgttgctaaccgtcgaaggaaggaacttgcgaggtttgcctttatcctcgggtttgaggagaccgtcgcagatgttgttcaggaattggtcacttcaggaaatgtaatcgaggctatatatattgctcatgaggcatgtttgcttgagcgatttcctcctgcacctcttcttaactcttatataaaggactcaactgagaaggcccaggccattctgagtagtggaagacgctccagttcttctgttgaggagtctaagaccttggagtgcaacgcctgcaaggctatcatcaggtgtgtcgagtcctgccagctagtatcagtatttaacatcgatcacttaaaaaagaaggtggcgaggatggatagagagaaggctgatcggaagaggctaggcagcggaaacagattccagaacaagcgagcacggggagcagccggacctcagtccttccctgcttccaagtccgcaagggcatcaggctcaggcccaggctacgggccatcattccagaacccagtgtcccgttcctttggttacgcggctcgtgctgggtacgtgaacccggctgctgctgctcagccctactatgcgccggggagcatggcagcgcggcgtggcggcgtgctgtatggtgggcctggagcagcattcggggcgcagcagccgtaccaccgttaaggccagccatagcagttgatgttgctggaccaattgctgtttcttgctgatttgtaccaccttgcgttgtagtaacatttatccttgccgtgttaactcttggtcgactggatgcgatttgaagagattcagtcttagtacatgctgctgctttctttttggttggctctgtatgcgagataccgtttgtctgaatgaaactgtatgctgaatgttgtagagattgagcgccattgacactattcaaacctggatatgtctttaaaaaaatccatgtgtagatcaaatttaggttcggctnnn

SEQ ID NO: 6475 - DNA, 1226 bp, Triticum aestivum
  unsure (1)..(1226): unsure at all n locations
  Clone ID: PAT_TA_6475
cgccgccgccgacatgctgctctccgccgacggcgaggacccggacgcggacgggctgctgctgctcgacccctccccgcccggcggggccgacgacttcctccactccgacgccggggacaagagcgactacgactggcttctcactccacctggaactccactcttcccatctcatgaagctgcgccaaaaaggtctccggtgagccaaacagggtcaccaaagactcgccagaactccttgaaatcaaggttggccaaccatccagatcctccatcaagaaccacacatccattgagaacaacatcatcgaacagcttgaactcagctgcgacaactcgtcggccgacatcatctggagggcctacgtctaattcttcgagaccttcaacaccaactggacgtgctgcatcgaccgccgcatccaaaggttcaagaccttcgtcccccaatgctcgggcaactctgcctgccaaagactgcacctactgccccaagatcgtcgacgcccacttccaggtcaacactcccttcaacaaggtcagcactgccttcatcaaggtcaacaactccatcaaggacatctggccctgctactgctaccaggacatctggccctgctgctgctaccaggnacatctggccctgctgctgctaccaggacatctggccctgctactgctaccaggacatcagttccttcaggcagagcatcagcacctgctagcagatcatcaacgcctacttcaagatcatcaatgcctgctactaggtcaactacacctttgtcaaggccctccttaccagcacaaagcaagcctgcatcaaggtcatcaaccccaacaaggcggtcttctgcccctcctacccacgcccagcacagtaacttgcccggaccagttcgatcctcctcaatctctagaccaggacctacaatgcccaaaagttctgcattgccagcaacaacaacagcgccagcaccttcaaggggcagctcacctactgtcaaatcaagaccatggaaaccatctgaaatgcctggcttctcacttgatgcacctccaaatttgaggacgtcgctaccggaaagaccaacctctgctactcggggtaggcctggcgcacctagttctagatcttcctctgtggagcctgggccagctgctcgaccgaaacgccagtcttgctctccttcaagagggaggacatcaaatggcagtgtgcc

SEQ ID NO: 6476 - DNA, 334 bp, Triticum aestivum
  unsure (1)..(334): unsure at all n locations
  Clone ID: PAT_TA_6476
gccgaacttgacggtgtccgattggcgttacccgcagctacacggnaactttgcggtagatggctttgtgccaaaaccacactagagagacgccatcagttttgtaccttagcatgtaacttaactacagtatcgtctctgagagcccctgtgccttcggacttggatctgttctcgttttatgagctccttggtcagtgcaagatcatcggtatctcatttctacagctagcagtaggtgaatatataccgaataagcagcttatgtttgtgacaccccgtcggcagtattatttggagagagaataaaaacttgcttcatagaaaaaaaaaa

SEQ ID NO: 6477 - DNA, 777 bp, Triticum aestivum
  Clone ID: PAT_TA_6477
cgggtacggctgcgagaagacgacaggaattgacgggcctgctccagaaaatttgcatggtcaggatttaatctgcacagatgagcatggacttgtaccttgtactgaatcttctgattttaacgcatctgaagaatgtgaagaagcacctattgctcttagttgtggtgctccttctacatttgatgaaaaacttgattctgttttaagtcagccatatgaccaaaatgaatacaaagagcttatgagaaaagccactgaccagaagcctgtgagcagacaaagacaattgcgaagtggatccaagcgctatgccacaggattcgttggactgtcgtatcttgatcactacccagatctggccaagcaaatcgacactgctgacactaatgagagacgactgaacctcctgcgaaaattcttcttctggctggagaacttatgccatgatggagcacacatgccatggatccccaaggcgctggcctgcaatcccatcgcaacagacgactgaccgagaaccggaacagatacgggttgtccaagatgccacaagactgaaggagaaacaggcagggtgcacatcgatgcagcaactcctggatcggtggccatgtagatatgtcaagcatgtacttttgttgcgcagctgcaagtaagtagcctcgtatatgctgctttgggtttgtgatttagccagatctgtgtgtgatcttcggtgttctctatggtcctatggatatttctatacccttatatagtgtgcgaataatttta

SEQ ID NO: 6478 - DNA, 476 bp, Triticum aestivum
  unsure (1)..(476): unsure at all n locations
  Clone ID: PAT_TA_6478
aggccccgacaacctcgagcccccgccgtccactcctccaaacacggcaaccccacctcaggccaccgccacgtccaccccgccgaacccggcaacccctaatcccccggcctccaaccccacgatgtcaagccctaaccctaaccccgtccccgcccccgcccccgcccctccggtcgtcctgccgccgttgccccctgctccggtatccttcgccccttccttccggccgctgggtgcaccgcccccgccgcaggtgcagcagtacggtgctatacgtaatccgggctacctgatgggacagccgatgcagccgccaggcgtgcaccacgtgatgcgtccgccgaccatgtacgcgccccagccgggtccgtacatgcagcagcncgggcgtcgccgttcctcccggtgtgcatcngttatcctggaccatacactatgatgcgtccatgttttcctccacgcccaatgcctcc

SEQ ID NO: 6479 - DNA, 1172 bp, Triticum aestivum
  unsure (1)..(1172): unsure at all n locations
  Clone ID: PAT_TA_6479
taggggccttttttttttttttttttcaaagacaattacccatgcataatagtattaacaaaagcgaggtgatcaaatattacactgtccacaaatgcaacagtaccacttaacatacaccacctaagcaacagtaccacttagcatacaccaagcaacagctagtcagctaccacatcataacataagtagagcagatctcggctaccactacatcataacacaagtacagcaggccaaatgagttcagatctcctgtcagcatcagcctttcaaggtcagaatccacgacggaaaagggaccaggcaacactcacttccatactacatgagccaaccgtcagcacaaaacctgggggagttataccagccatctcaggttttaaggctacctcactgctatcagcaacttcatcatcgttaataggatatgccatggcagagactttgagcatctcctcaaggtcaacggaaaccacactgcgtgagagcttgaccatgccatcagcaccaacaggcaatccaccatctccaaaatcaagtaacttgactttcaggtcatcagctccagtgttgtaggcagtaaacatacctcgaaaaccatctggccaagacccaccagtgacttttatgcggatcgtggcctccacagcgcacataatgtgaccgtatttaaattcaattgtgctaatcctgctagggtaaacgtcactaagcacgcatccagatctaaaattcaaaactagctcgcttaggtctttatcatcagatttagtggtccccttcactttcagcgaaacctcaatgtgcgaaggttccatcgacacagcaacagcacggcttgggcctgtcaatgctagatacggatcattcttattgatgatttggcagttattcctctgtcgctggaagataatgttgcgcttgtgatccaagatatcacgcacggcaaccataccaaacacttgcagtggccagcgtaaagagtcgtcattgatcgacacgattttgagagaaacgatctgcagagtttccgcggtcttgtcctcgaccgtctccccgggagtagggtaagtgtaacgcataggtgggatagatgtgatttnccgggaaggtggcgccgtggcgggcgtgctgttggttccagcctcgtgccgaattncctgcagncc

SEQ ID NO: 6480 - DNA, 521 bp, Triticum aestivum
  unsure (1)..(521): unsure at all n locations
  Clone ID: PAT_TA_6480
gctgctccggcgatctgtcctcgacggcctcgagnatcgatgggggccttgccgtgccggctggaaggagtggttctgtcctccaagtggagtcccaggattccatggttgcagcagatgcggccgacaaagcacaggcagacggaggtgcggccatataggaggtgtgttctgaagctacgagtggctggacacgaagggataggatggggaaagctcctgacgagagggagatgaagcctgacaagaaaacagcactggaattgtctgtgcgcgcttatgctgagaaaggagctggtcatgttgtcaatcccagcaattggcacatcttttgactcgttagatgaggcttatgagttctacaacctttattcctgggaatgtggttttggagttccgctatgttgctcggaaaaggtgcatgcaagagattgtttgtgattgtgcggtaggtgatcgcaaagtgncattatgtttgcatgccataatgtttgaaggactgtttgagcctaanaaaaaaa

SEQ ID NO: 6481 - DNA, 598 bp, Triticum aestivum
  unsure (1)..(598): unsure at all n locations
  Clone ID: PAT_TA_6481
gcaaaaaaaaaacctcgggaagcctcccacgattgccaaggcgatcttggcggcgatggcgggtgagacggcggcgtcgacgctggcaaatccgtcggggcagaggaactcgaatcctggagggggccatgagttgggtctcttcagcggaagggagtgggagcaaataagggagagatcgaggcggatccttcggggagcgacggatcgggaccagactttgatccggtcgagaagaagagcgaaggagacggcggccttgctggcaggtgatattccatcgaggcctgggaaggatataaggagtggattgaccgtgtgtcccgcgggatcagatggatgcatactcgcaggggaagggcgctgtttcagccggtagttcagagataggttcagtagataaggctagtttttaaatttctcaggattgtagaatcagtttgctatggggattgaagtttgcttcgattttgtttncctgccgttggggagtgcatttgagggaaagggaggattttcttggaacagaggttaggaaactactctttcatgactttttattcacatttaattgcatcaatttcgtttaaaaaaaaaa

SEQ ID NO: 6482 - DNA, 1430 bp, Triticum aestivum
  unsure (1)..(1430): unsure at all n locations
  Clone ID: PAT_TA_6482
ccggcacgaggcttccgtccgcccacgcgcccgctccccctcccctgccgctactcctgtcgccttcactccccgccgctccaactcgcaccccgctgcccgcctccgcctccgctgctgctgctccgccggcgatccggcggcgatggtgaaggccatcagggtccacgagctcggcggccccgaggcgctgcggtgggaggaggtggaggtgggcgagcccggtgacggcgagatccggatccggaacaccgccatcggcgtcaacttcatcgacgtctacttccgcaagggcgtctaccccgctcccctccccttcacccccggtatggaagctgttggtgtggtgactgctgtgagggcccggcctgaccggcaggaaagtcggggatgttgtcgcgtacgcaggcaagcctatgggttcttatgctgaagagcagattattccagccgatgttgctgttcctgtcccgccttcagtgaatcacaagacagcggctgccatcatgctcaaggggatgactgttcatatgctagttcgccgcatatttaaggttgagaccggccataccgttctcgtccacgctgctgctggtggagttggatcactcctttgtcaatgggcaaacgcccttggtgccactgtcattggaactgtttcaaatgaagagaaagcctcacatgcacattttgatggatgtcaccatgtgatcatctacacaaaggaagatgttgcaaccagagtcaaggagattacaggtggaaaaggtgtaaatgtggtctatgattctgttggaaaggacacacacaaggcatccttggagcgcctggcgaaccgtggttcccgggtgacgtgcggtcaatgggtcacctgcgcctgaacgtatctccacctgccaagtcgcggcgaagtgcctttcccggacacgcccaagggtgttgtactggccgggcacgcgttgtgagctgccgtaggcgacgggcgacgtgtctgccaagttggccaaccggacgcggcacagccggctgcaccacacctcgcccgctgcgaggcgccggcgccctgcgggtccgcgctcctggtcgcgcggaacacagcacgctccgtactgctgatcccgtaaatttaataaacgatcttcccttccctgtaggagaagtaggatctacgaaagccggtctagatgttggatggagtcggcgtattaacacagactcgtttgtatgtctgaatgggttatgttgtattcagtatgaaccaatgttaggttgttttagctgggtaatggagggagtcagtataagttgaatttttggtggttatgagtttgtttgggggtgttgagcctctgaacactgaatcctctgtctgtctcacctcaccggttatgttgattcagtagtaagaatgaatgttgggnattatgtgt

SEQ ID NO: 6483 - DNA, 897 bp, Triticum aestivum
  unsure (1)..(897): unsure at all n locations
  Clone ID: PAT_TA_6483
ttcagtnnngtttcnanctcatgccannnagtgcagttctctcggttgcagctcggttnnnnngtcgctgaagtatggaggcacttgagaagtttagaaccattagcaaccatagaatcttcagttttgcagtgaagtctgtagtgtagtgcagttaactactggggaacaacaccggcaaggcgtgcaaaaaaataggacgacaggcagcgacgtagccgtgcagctcgctggtcatggtgcgcgattctggctgtgccgacaagcagtacatggccacgcctgcgtcctagtggtgcagtccggtgtccgcggaacatgcagctcgctacctcattgcacgcggttccgccggcgcgcggccgcggtacaaggaccacgcccgtatccgagtggtgcagctcggtgctgttgtccgtgcagtttgctgttgtattcgacaacaatggcaacagaagcttggtccccgctagactaggaacatatggaaccgattgtgtcttgctgatggaaaagaggtaataatacaaggagttcttcagactgggtagtgttgtcacctgagaaggggatgggagttcagactgaacatgaacacgataggtagttgctcagtttaagatattggattcagttacagccacatcaatgatttaaataaaatatcacaaaagatgtggaacccaggcctatataaaggttacatgcatgcattgctaggctgctagcaccttggacttgtggagccatgggcagggcatgagaagcattggccaacttgttcgtggctaaactgtactctttccgggcggccgctcgaagcacactcttcttagataatctgtattatcagccccacatcaagtgcacacactcttttgntttctattactgnta

SEQ ID NO: 6484 - DNA, 956 bp, Triticum aestivum
  unsure (1)..(956): unsure at all n locations
  Clone ID: PAT_TA_6484
ccacgcgtccggtcccagttacacacatagccatttccgtttggctgcttccaagctatcatatctgctgctgcactgacacttcccttcctctgcgctttcttttctctctggcccgggggttccaagcaaacaaactcggcaacgctccctcacactctttctctccctccggattccaagccaccttctcctccaattttgagagcagaaccgacagacaagattatatcttccgcgagccgcactggaagcagagtcatcggtcatcagtgcagtggcgtcagccgtgttctcaatgaggacgaagacttcatggcgcaaacgtggaaaccaattaacatccagttgatgcagcataaattctatggtgttgcaagcaaaaatgatcgtgtactcatctaaaagctcaaagggaacgctgtttcctgtacgatcaatgcttgtcttcttcattgcactatttggtttctatgtctgctacttctccttcactcaaatagccttagaaaatgaagaaggagaaatgaacggagcagaagaacgaacaagcattctatgcaaaagaccttcagaaattccatatgatcagatgcagtatgtgcactttccaagacctatgagttacgacaggggagaatgcgcatgtaccccggtccgtttcttcgtcattgtatctatgcaaagatcaggcagcgggtgngtttgagactctgctcaacagccaccccaatgtgagctcaaatggtgaaatcttctcggtgagggagcgcagagaggatatcgcgtcaaccttgtggactcttgacaagctgtatgatttggattggcgcaccagcgcagcaaaaaatgaatgcacggctgcatttggattgaagtggatgctaaatcagggccttatggattatcctgatgagattgtggattatttgataaaaaagggtgtgatggtgata

SEQ ID NO: 6485 - DNA, 1230 bp, Triticum aestivum
  unsure (1)..(1230): unsure at all n locations
  Clone ID: PAT_TA_6485
ggaattcggcacgagggccgcctgaaaaccccaagcaaaagaagcccctttcctcctccgccgccgccgccgcttcggccgccatggacgtgatggtcaagcgcggcgccgaccagcccaagctcgcgcgcagccttgtcatgctgctcgtcaacctcacccaggtcgagtccggcatctcggccctcctccaggttggtgatgaaaaggtgcaagggttgtatgttgcaaagcttgtgcgctcattctgcaggtcatcctgtgactctgaagatgaagatatatttgaacacattgcctctatacttgtgaatatctcaaaggtcgaagctggacggagaatactgatggaacctaagagaggtcttctaaagcagattataggacaatttgattcaacaaatcaacttagaaagaaaggggttgctggcaccatccgtaactgttgctttgaagctgatacccagatacaaaattttgctttctatagcagaatatcttttggccagctctacttttgccagtagctggaaagaagatctatagcgaagaagatagatcgaaaatgcctcccgagcttgcaaatgcactttctcatgaacgggaagctgttgatgattccgagattcgtgaacgggcactggaggctatttatatgatcgtgatgcaggatgatggacgaaaggccttttggtcagtcaatgggccacggatactgcaggttggttatgaagacgaagaggacctgaaagtgatgggagcatatgagttgattggttctttgcttgtcggcaagggtgaaattgaacaagatcaagagcaaggagaagataagcctcaatgatgagctcagctatgtacaatttttattttgtcttatctacttgctgcaagaaaacagggctgcatcgcttccaatcttaagaatgtcctgtcgtattgatccaaatttcttgcagtaactggcttgttctacctcctggtttcagtttgttgtccacagtattaatacaactatgtaagggcattaagaacatgtccagtgttcgcctctgatggacagattgatttacagcatgntgcgtagatggtagatgtgtccgactagacctgtgttctttttnttcttctcatggtgtaattgttcagagatgtgcaaattgtgctctcatcagttctgaagggaaaatagagattttgatgctgcatagaaaaaaaaaaaaaaaaaaa

SEQ ID NO: 6486 - DNA, 660 bp, Triticum aestivum
  Clone ID: PAT_TA_6486
tttttttttttgctggatcttttaaatagtttcttatgtcctatttttttggtttgtagtaataatctgcctgggcagcaaaatcaaaattgatcgaaggcttcgaaattacagaaacaaccgcaaacgcttacacaactgttaaaatttgttattttcttttcgcgcatacaacacgtttttgcacagcaatattggatcagaacatggatgtcatgatcttacatgtcaaacatacccaagtccaccacatgagtatcctactcacacattgctttgcttgcttcagttttacagttcagcacttcgctttttgacacatcgcacacaccccttttgaataggcacaggtgtagcagtagttaccgtcctggtgcacctgttgcttactgattatgcatttggtatttccataaggagtccacctgctcttcttggtgaggagcgtggtctcgttgatcttgcggccgccgccctcgtcggtgttcctggcgccctccttccacttgtccgggacgatcaccttccccagcttcttctcgcacttggtgcacaccatcgccgccgccgccgccggagatcgttttctcttcctcttgcgatgctggtgatcaggatactgtctggaagggaagagcaaaggagatcctcgtgccgaat

SEQ ID NO: 6487 - DNA, 602 bp, Triticum aestivum
  unsure (1)..(602): unsure at all n locations
  Clone ID: PAT_TA_6487
gcttccaccgtgtcgctgccgccaccgccatcgcgctcgcctcctcttcgatgccacaccacacccagttgcccgaccaccttcgctcctcctcgcgccctctcctctgcgccgttttgccggtcgctgagcctcgcctctatcggtctacggtgctggcgcccggatccgttctgggcggtgcttgttcgcctcggctcgacgttcgcaaaagattcttccttaaccccctctccagcaccactaaccaccaccgtgtcactcggctcatctctcactctccacggcgaggcaatggccgatggcagtgacgcgaggggcatgtagaacaggcggcgcgggaagtttccacggctcagctgcacaccaacccaacgaccaccatggcgagcttggaacccctccttgatttaggctacataattatcgtcctaatttgctcaaagttatatgcattgtggccctcagaagcaggtctaagactncttagtgttattatggtgtgaatggcatgatgaataactcaaaatgcagaccgtgatgttacaatcactactattataatctccctcttcatgtgtgatgttatacatccactaata

SEQ ID NO: 6488 - DNA, 311 bp, Triticum aestivum
  unsure (1)..(311): unsure at all n locations
  Clone ID: PAT_TA_6488
ggctttccctatcacggnaggcagcagcggtggcggcgggtcgtcttcttcgtcggggttcggatggaaagaggggtgacatcttttcttttcttgtcgttttgagctgaccaaagtgagtgatttcaacatatgttcctctncttggatgaagccgtgacttgtagcttagggaaatccattcagtacaaggaggaataattgttcagcaaatcagttttncttnctataaacaggaggnaatgtataactacgagtctacaaatncatacctgggaagctctccatgaattacttgtttaaaaaaaaaa

SEQ ID NO: 6489 - DNA, 319 bp, Triticum aestivum
  unsure (1)..(319): unsure at all n locations
  Clone ID: PAT_TA_6489
gccaatgggttcacagtagcaaccataaagtatgatgagtaaccgcccgctccgaccggttttgatgcatatcagcgtcacattggtacctggacgatcttcccacatgcagctgacctgcaagaccagtgaacttggctttgtactatggttgcttgcttgctagaacatagaaccatctagaaatctagtnctagtcggcctaataaaccaaattgtgtattaaattgttnctcggttncaacctncgttgatagcagtagtcatcgaagatgagtgatccgactagtactgttaattttttgctgcaaaaaaaaaa

SEQ ID NO: 6490 - DNA, 225 bp, Triticum aestivum
  Clone ID: PAT_TA_6490
gattcgacgagaagtgatgaacagtgtgtgatgtggcatactgactagagtaggtacatagcaattcaaaacggaaatcctaaaaatccgacatcagattttaggcatggcaaatcgaaagttttcatgccaatttatgttgtcgcaggaatagcaattttctactcccttcgttcctaaatatttgtctttctagaggtttcaacaaacgactacatacggagc

SEQ ID NO: 6491 - DNA, 703 bp, Triticum aestivum
  unsure (1)..(703): unsure at all n locations
  Clone ID: PAT_TA_6491
cggcacgaggcaactgtagtgcttagctataacctatatctgattctcaaaaaagaaaagaaaaggttgtaacctggatctcttctcctctctgtgaacttctttcccaagattgtgtagccaaattcctgcaagtaatccgccatgagaggaagaggattcgtgctagtgtgcacctaacaatattgggcggtcaagatgaatcagaagatgaccgggcttggcagctctcgacgaatggatccaacacgccttcacaatcttttggatgctcaaaaacacaccttcctcgatcgattacaggcataacacctagtagtgcttcaactggaggatggccgctcttcgtcaagcgcaaccgtgcgacatcatttcggtcgagccacgacaggtgtgccacccggactccttcctgaggagccctcgttgaggcagtgtgcaccgccggtgtggtggcgccaatggcacgctcgcccgactcacggatgaggtgcttcatatgctataatatgaatatgcaaaacacaagaatatgacaggaatggtgtaacatgcaaaaaaaaaatagagtagagttttaggaaacacgagaattttacaaatttagatgttggttcacatgaatataaaaacatgagaagatatagtcttgtcttctacatctaatttgtaggccagacatctaaatttgnacatattatag

SEQ ID NO: 6492 - DNA, 784 bp, Triticum aestivum
  unsure (1)..(784): unsure at all n locations
  Clone ID: PAT_TA_6492
tctttcttgattctatgggtggtggtgcatggccgttcttagttgctggtgaagttaaagaacaggtaattttatcagcttaactgaacagaatcctttttggattgttgaggagtactgaactacagttttggtcacacttaacaatcctctccaggttgagttagtgcatgcacagctcaaaagagcaaaagaacgggttgatatgcctgatgatgagttctacaacgacctattatctctgtataacaagacctatgacccaagtgcagaactggctatccttgaaaggttgtcagaaaagctacacctcatgactatcactgatctcacgcaagagtcacttgctctgcatgagatggtggcatctggtggtggccaggatccaggagagcacattgagaaattgtcaatgctactgaagaaaatcaaggactttgtgcaaactaacaaccctgagatgggccctcctatggcttccaaaataatggataccagcggggaccagaaatctgtcatcgttcctgatgaattccgttgtccaatttctctcgagctgatgaaagatcctgtgatagttgctactggccagacatatgaacggtcgtgcatcgagaaatggctagcatctgggcatcacacttgcccaactacgcagcaaaggatggcaaacacaacattgacgccaaactatgtccttagaagtctcatctcccagtggtgtgaaaccaacggaattgaagcgcctaagcgctcatcccagcctaacaagccaatgccnnnn

SEQ ID NO: 6493 - DNA, 464 bp, Triticum aestivum
  Clone ID: PAT_TA_6493
cgttcgcccacgcgttcgtccaattggtcacgattcctaacaagccgagcagaatcgcgggcgcagagtgcccggagaggagcgtggtcagtggagcagaccacgctgcagccatgtcggtgcaggagtacctagagaagcacctgctcccgcgcaagatcgaggaggccgtgaacgcggccgttcgcgccaaggccgccgacccggtgctcttcatctccacccacatgcggcgggcggcgccggccgtgatcacgcgggtgtgcgcgcggcagatcctggacagccgcggcgcccccgcggtggaggtcgacctgcacaccaacaaggccgtgcaccgcgcgtccgcggcagggccgggagcccccgagggcgccgcggtcgacgccacgagggacgtcgagaagcggaggctcctcgccaaggcggtcgccgactcggtgcggctgatcaacggcaaggtg

SEQ ID NO: 6494 - DNA, 799 bp, Triticum aestivum
  unsure (1)..(799): unsure at all n locations
  Clone ID: PAT_TA_6494
ggcacgagggtttactccacgaaaggacataaagaatcatgcggagccaataagtcgtgagccagagttagtgtttaataattttgaagcacatcttggctatcgtcttcaaaggttgatatcgtctcttttccctcaagctgatttcaataaacggcaagtgttcacatttgaactgaagcaacagcatatactgttccgtaatcacagcattgagaacagcgaggatcaaaattctgttgtgcaagtgtgcatagtaaatgctaatctgtggtcgtacgagatggcattgagggctagaaattatattgacccactacacgatgaagcaagattaaggaatacaagaaaatgggagtgggtatggttttacactttacctcgaacagttggtgggtgagtaaatgggaggataggctctcctactgaccttgcccaaatgtggatcaaagagagggattatggggcaacatacaggggccggcagtgttggccttctcatcagattgaggtgggcggaaacgtggttgggcctagagatattgggacaggggcagaggatgaaacgacatgcaatgcaagacaaaaggatggtagggacataagtcgaattatgagcagtgcgaaaccgggtcaaagcgacttattatcaccagcaactgaaaaatttcattttctacatacattttatgtagtggattacatacatctaccttaatgaaggaaatcatatatgtttgttctccagttaataatgggtgcatttccttattatatggacctnnnnnnnncnnnnngc

SEQ ID NO: 6495 - DNA, 532 bp, Triticum aestivum
  Clone ID: PAT_TA_6495
cccacgcgtccgcccacgcggccgcccacgcgtggagtggaacccagaggagtatctcggccccgccgcgctgctccatgccaacaggtggatccaagacagccgtgatgagttcacaaaggagcgccttgactccatcaacgacgagttcaagctgtaccgctgccacaccatcaagaactgcacgcatgcctgccccaagggactcaacccggccaagcagatcgatacaataaagaagttgcagctcggagcctgagtgaggtctactacaccgtggagatgtcgaaagttgtaatcagcctgtcatttggtttgttttggctccgtggtgacgaataatggctggaaacgcaggatattccccgcttgacgattccgtgtagggcgtgaataattgctaccagattttattcttttcgtgctgtatctagtttggtggttcaccgttgatcatcttttgatgtccatgcatcaagtaattcataaacttttgaattggtaccaaaaaaaaaaaaaaaaaaggccccta

SEQ ID NO: 6496 - DNA, 1303 bp, Triticum aestivum
  Clone ID: PAT_TA_6496
acgcgcccccttcccctctccaacctcccaaaaataaaggagaaaaagtagagagggagagagagagagaaacgcgaaaccccaaatcgatggccgccgccgccctcctccgccgctcgccggcggcgcgcgccctcctttcgccggccctctcctcccgcctcgtcgcctccaagccccactcctcatcccccgcgccgccgccgccctcgtcgaagcccgccagcaccaagaccttctcgatctaccgctgggacccccgactccccgtcgaccaagccccacctcaaggactacaaggtggaacctctccgactgcggccccatggtgctcgacgcgctcctcaagatcaagaacgagcaggacccgtccctcaccttcccgccggagctgccgcgagggcatctgcggcagctgcgccatgaacatcgacggcgacaacgggctggcctgcctcaccaagatctcctcggagggcggccggggcctccacgatctcgccgctcccccacatgttcgtcgtcaaggacctcgtcgtcgacatgaccaacttctacaaccagtacaagagcgtggagccgtggctcaagcgcaaggacccgccgtcggccggtgggaaggagatctaccagtccaaggccgaccgcgccaagcttgatggcatgtacgagtgcatcctctgcgcctgctgctccacattcctgcccgtcctactggtggaacccaggaggagtatctcggccccgccgcactgctccatgccaacaggtggatccaagacagccgtgatgagttcacaaaggagcgcctcgactccatcaacgacgagttcaagctgtaccgctgccacaccatcaagaactgcacgcatgcctgccccaaggggctcaacccggcgaagcagatcgacacaataaagaagctgcagctcggagcctgagtgaggtctactaccccgtggagatgtcgaaagttgtaatcagctgtcatttggtttgttttggctccgtggtgacgaataatgggtggaaacgcaggatattccccgcttgacgattccgtgtagggcgtgaataattgctaccagattttattcttttcgtgctatatctagtttggtggttcatcgttgatcatcttttgatgcatgtccatgcttcaagtaattcataaacttttgagtatatgttgtttaaaaaaaaaaaaaaaaatggccgctaaccgttgaccaaaatttgatggccgggaccaagtaattcataaacttttgaattgggaccaacttttggatgttgcgggcgg

SEQ ID NO: 6497 - DNA, 1471 bp, Triticum aestivum
  unsure (1)..(1471): unsure at all n locations
  Clone ID: PAT_TA_6497
gacactttcattgtctgcacttcgacctttcacttgtccgttccatagggtctggaagttgtcagtggcttgtgccatgttgtctctacaactcattttcccatccttgaggttcttggggcttcatccacgtgagctccgctttgaaacattcctctttccttttctgattccaaacgtgatcaccttcactgatgttctttatgggccagagctcccagtatgtgcttctcaagggttatagtcttccttaggcagcatcttacagcatacgatctcacgtacttgcatagcgcgcacgggatacatgatgattcagcctctgcaagctaggtgatcccttttctaccatgggtccatggggagaattagatgggtgaaccatctcccgcggaagtcgatggcccttctgttctgtttttgtcaggagtcgcttgttgttcagctggggctgcccacgcggtttcggttcttgttactgcctgacttgtcatgcttcaccagtttcaaggttctagcagctgtttgattctggacgtttgcgtttcccggaactctgccgctctctttgccgagatgcggtgccttatcttggactgggcctgaaccaaatttgtcttctgatcctggggtgccctcaatactgcccattgagggaaattattctcgaggcaacctgatgcttcagaggatcaagtcctacattgcctgtctggagccttcacgcgagcagcttcccgctgtggcctgtcctcgtcattttgttttcactgattctgatatggcagtggtcgaggatcttggacatatcttcacgagctatcctaattggcaccttgctcttacatttcgtaataacaaaggccaacccttgaactctggatttatagcggtgagaggggccagagatggcatctctaagtaagtgaacatctatgtaacagatcttaggatgaaaacttggcattgccgtaaataattcttcatttgcttttagggctatcgaattcttcaccgaagttcttaaagcatacaatctaaagtatatgaaggcgtcccgcatnttggngatcaattancactgcatgggttgngaagcttatctatcatcagcctttggaaaatttttaggcatgaaacattactggngaagcaatggagcatctgttctggtttgncttgggaagtttataattggactcacctgaggcgctggacaattcatgggatgccttggatgtaanggtggtcatttaaagggtcaaaaagcgtttgatctcgaggcatgggattntacaatnaactcttantttntgaatgngggcctaanctgaaagggnanacaaaaagattttgacctttgtcctgnnaangcanngnnnnccnattgncnccaaatnnttttttnnggccggcccacntgntngncnnggnaatagncccnnncnannagnntngncnngtncccagg

SEQ ID NO: 6498 - DNA, 1554 bp, Triticum aestivum
  unsure (1)..(1554): unsure at all n locations
  Clone ID: PAT_TA_6498
ccacgcgtccgatccatctcaacctagctaggtttccggcgaggcgatggccagcctctgtggccagcaccggccatctccgcgtctacggtccggcgttgcctcatgaaggcaccctgtcgtgggaggagagagagcaggacacgtcactcctcctcctcaggatcgggcaccaccgcgacgaagccagcaggctgctcgcctcgcaccccgatctgctacgcttcctcgatgcggcgacctgcgtcggcctgctcgatcccgtctccaacatagtcgtcagcgccatgcttgccgccgccgcagatcccgtcggcggggcctcggcgctcgtcggcgtcgccgacatggacatgaagcagcgctccctcgacggcctcgtcgccttcctcacctgcttcttccctcacctcaccgactgggaggccgtcaggtaccttgtcctcgccgaggccgaccccctcgttgccgcgcgcatcgtcctcgcggcccgccgcaccaagtgcttccgcccaggctccgcggccaccaacggcgccctcaggctcgctctcaagtgcgcaacggtcgccgccaagcatccgtgtccctccgagctcgcgggcgcgctgtgctcctcccaggactccaatgacgtggtcgtcgccttgctctcggcgttgcagcataatcaatcctcagacatttcccacaagttggtcaagcagatagcatctctcccttttcctgctcctggtagcagcaaccttctcgaaccatgggagcttgccgcccgccgcaggaagcacaccaccaaggtgacccaccagtattcctggtcactgaggcgagtgctcctacatacgatccatggtttctacctgcaggcactcgccaggatgccgggtggcgagctgcggtctcgttaccaccgtagcatgctcaaggctggccattgctatggcccttttgatcctgtcaccaatatcatcgtcaacaccatctggtacgaagtcacattcccaccactgagtcaactggacgagctcgacattcttggcaccttgaacctaatgcggattgaagcacaatccttttacggacttgtctctttcctctgcacccgtgacaaagatctcaactccgatcaggccataaggttcttgctcgacacggatctcgacttggccgcgacaaagcactgcagcactgtccaggatgaacaagaagccttcagagctgctgcaactgcggcatggcaccccatacctgatgccccagtagcattcctcaagctcctgccaagacgcctgcagtcctctcactgntgttcagataatggaggtcaacaacaggctcttctccaaatgtgtcccgcgccttgccatgcctaattggtaacatgcgtttccgttcactgggatntttgccccataaaagcaaccgttgcctttataaccnaccgggctgagctacccagttaaagcgcnacacgaagggcttangaatctcccgaaacagggggcgcagcaatatgggcacnacagcggaaactacatggatgcgggaacaaat

SEQ ID NO: 6499 - DNA, 643 bp, Triticum aestivum
  unsure (1)..(643): unsure at all n locations
  Clone ID: PAT_TA_6499
cgtcagctcccgcgccctcctccgcgttctcctcggccccccccaccccccctctcccccccccccccgccctctgccgcggcccggcggagcggatagccgccgggggggccgaggtcgggcttctgcgcccgcgccctcgctcgtctgggcggcggccgggttcactcccctccgccggccccccaagtgccgggcgcggggggggtgcgggctcggcgccctccggccgggcttggcgcgccttgtgtcgcgtcctggctgtctgtgctcgcgggggcctcgctcgtatgcttgtcttccgatttcaggtccccgttcggccgcccgacgggtggcgctgggatgcgggtggttcaggcggcgcagctggtctgcccgaatcaccacgcttctcgtccgggctctgtcctggcagagtcacccgcagcctgtctgctgcgccggcgtgcttttgcacttgctgaccaggacctgcttctcgtgttgggcagccctgctgccgattcgcttttgttatttttgttgttggtcatgtgctggcacctactgcgaagcacgattatatatcaattgatttctgggctgcactgaatgatatcagcaagataaaggattggaattgggnnnnatacgtgttgnn

SEQ ID NO: 6500 - DNA, 533 bp, Triticum aestivum
  unsure (1)..(533): unsure at all n locations
  Clone ID: PAT_TA_6500
tcggcacgaggactttcccggatctgcgttgacgtgcgccgccggccaccaccaggnatatcgagctaccacccaccaccaccaggatgccaccctctacgcgtggatccagtcttatcggaggtcccccctggacggaggaacacagggctgagccgccagcgcctggaggagcaaaactggggcgaagatagccagcaccaggataagctcgtcgcgcctcacctgaccaactcctcccgagctcgctggcgacagaggatcagagctcctgctcaattcatggtctggcgtgggtctcccatcaacaggtgccacccaccatctccccttcccaagccgacgccccaggctccgatgtggacgacccccctgatgcccctgtcgtgccaccctctccctttcctactccccatggcttttagataacaaagtgattgctctgctctaccacaggccttcggtttattgcaatggcccaagttgtgtgtttagagactgcatcttgtgctctgtatcttttgcagaatatg

SEQ ID NO: 6501 - DNA, 316 bp, Triticum aestivum
  Clone ID: PAT_TA_6501
ccacgcgtccgagtaagttgaagagtgagcttcctcccttggccgagccgcctagcgcgcctcgcggcatcgatcggaggtgttagaagtaagtaatctgtcgtagtcgcagagcgagtagcctgtatctatgcactacccatatatgtctggggatcctttctactgctagcccagatggatatgtgatgaccaaccagcagcttgtattcagtttcagattgccatgttcctcttctgttttatggagactctgtaaccattagccggcctgcacaatggaatgaaatgaaagggcgttgctcctctcctaaaa

SEQ ID NO: 6502 - DNA, 803 bp, Triticum aestivum
  unsure (1)..(803): unsure at all n locations
  Clone ID: PAT_TA_6502
atccaaaaggacaccaaatccatcgtgtctagatatatacataggcatacatttgtaggttcatatgtccagtattacatcactagatatataccatcatgtctcagtaagaaactgatccccatcctagagtgctacttcatcagatagatactanaatgtccataacttctttagatgctagaaatagatccttttagctcacagaancacacatctacgaacttgtgactgcaagagtagtatactagtgacctgaaaaaaagaagtaaccaattacagcatctcacaagtattgaagttcgaggatgcattttgaaaatcacctaaaagcaagacctagtcagaattatatttctccctcctatccatattaattgattctgggttagtacaaagttagtagagagtacaacagttattcccctgaaaaatatacggacacaaggaccatatacacataccaaacatgctttatgaacaacagttaatccttgacgtgtcccaggatagcatgcacgaacccaatcatatcagtcacccaaccttcaccttgaacaaatacaaagaagaaagcaagcagcacatcgacgcgaggaagccaattttccgtgagcccacacaattcgtccggacgcgtgggcggacgcgtggggcgacaggggcagcttggggaagtggagatgatggaaacagctcttggttcggatggtggatagagaagactggaggaggcgggtcgatccagggacgcctttgggagatgcggcgcgccggcgccggtgtgggtgtagaagcagcga

SEQ ID NO: 6503 - DNA, 737 bp, Triticum aestivum
  Clone ID: PAT_TA_6503
atgtctcagtacgaaactgatccatcctagagtgctagttcatcagatagatactaaaatgtccataagttctttagatgctagaaatagatccttttagctcacagaacacacatatacgaaccttgtgactgcaagagtagtatactagtgaccattttcctttggtaacgagccaaggaagcactctcttgacggtgaccccccgatcacattcgcttccactctgtgcaagcacaagaatttctttctattccatttcacaccattcaccatgacccagcaaggttttttctgacatggcaggggcacaccataggcaacgcaaggtgaaaggcgcgtagagcttagagggcaccgaaggccaggcgcagcccgccagcgcggtcgccatggtgaacaaacttgccggcgcaagcgtcgactgtgtgctctggacggaggagaaatcgccaggcggtttgcggaggtcgcctccgaactcgtcgctgacctccgacggatccctcagccggccgtcatcgtgaacatcgcggtggaagcgccagcgacaggggcggcttggggaagtggagatgacggaaacagctcttggttcggatggttgatagagaagactggaggaggcgggtcgatccagggacggatttgggagatgcggcgcgccggcgccggtgtgggtgtagaagcagcgagatatgggaggcgatgcctcgctgcggaaggcggacgctggg

SEQ ID NO: 6504 - DNA, 486 bp, Triticum aestivum
  Clone ID: PAT_TA_6504
ccgcgccccgcgtctccctgttccggccctcgtccgtccccccgcctccagtcttctcctcccgccgtcccaaccttcggcggtgtccgtcctctccgcttccccgagctgcccctggcgccggcgcttcctccgcgctgttgaagtagcactctaggatggatcagatagatactaaaatgtccataccttggatggatgctagaaatagatccttttagctcacagaacacacatctacgaaggtatggacattttagtatctatctgatgaagtagcactctaggatggatcagtttcttactgagacatgatggtatatatctagtgatgtaatactggacatatgaacctacaaatgtatgcctatgtatatatctagacacgatggattgttgtccttttggatgtgatgtagtactggacttgtgaacctacaaagtgtataccaatgtatgtatgcagacatgatgtattgttgagat

SEQ ID NO: 6505 - DNA, 844 bp, Triticum aestivum
  unsure (1)..(844): unsure at all n locations
  Clone ID: PAT_TA_6505
ggtcgcccggngctccggctccaggggcgcctggtgtctcctcgcacgcgcccgagcgctcactccgccgcccgccgcccgccgccgacgccggtctccgtcgcctccctctactccgagctgctcccgactctgcaccggctcttcttccctgcttctcgggaggaaatactgtgtgagccaagacctcaaagatgaacaaggggaagatttttaagttagccaagggattccgaggaagggctaaaaactgcataagaatcgccagggagcgtgtagaaaaagcattgcaatattcttacagggatcggcgcaacaagaaaagggacatgcggtctctctggatcgagcgcatcaatgctggtacacgactccatggggtgaactatggcaacttcatgcatggactgatgaaggagaatgtccaactcaacaggaaggtactttcggagctgtcgatgcatgagccatacagcttcaaggccctcgttgatgtatcccgcactgcattccctgggaacaggccggctgccaagaaggaaggacgagcaagcattctataaacaattcattcctcgacaattcagtctactgtgatgaactcatgtgatggggggtatgtatcacatcacgttttagtccatgtcattcggtctgttggcctgctgaacanagggnacatgnactgnacttttgcncttcnttcttcagataatgtgctctgtttaccgtcaataaatccagtanagcagaaaggttttaataaaccatgtaaaaaaaagatgtggttattttgggcagaaagtttttctagctttcatctgaagtcatgtagnagtccnta

SEQ ID NO: 6506 - DNA, 579 bp, Triticum aestivum
  unsure (1)..(579): unsure at all n locations
  Clone ID: PAT_TA_6506
ctcccgccggtttcccctcgcggtgcaacagccttcagtttaccatggcttcgaggtgccacatgaaaatgtttcttctgctccttatactggagatcgttctgctcattaccatgccttctggagggctggcgggtccgagtgtgacacagagaaacaatagtgacaaccccaactgccccccttgctacagacctccttgtcgtcattgttgaaagtatatggggttttgccccatttaattttcattcctcaaaagacacatatggagtgaaggagaaatgagaccaacatataagggactctctctcacacacactcctcattagagcatgataagaggactagtagtggcgtgccttctccgcagccacaccgcaccgctcgcctacatcttcgattcctggcgacttattcaaacctataataagaatgctccttggtgcgatagcaacattgtaagccatccaggagcatgtgcttcatcgttttccaatttgcatcctttatgtcgttgctatgtttttgtgctgtgtaaagtctaaaaaaaaaacaatttgataacanaaaaaaaaaaaa

SEQ ID NO: 6507 - DNA, 845 bp, Triticum aestivum
  unsure (1)..(845): unsure at all n locations
  Clone ID: PAT_TA_6507
ccttgcaaagcaaattatagaagcaaaatatcaggagtcaagtgaaggcaatgacaatcctgatctgaaagaatctatatttagagaggtcacttctcctattttggcaacagctaaacggcatgaagggtaccaaacgttgtggcagatttgctatgatatcagtgatacggttctcctccgcaatcttatgcatgatagtataggacctcaggggggattcagtttctacgtttttaaacagctaatcaacagccggagttccgctaagctgttaaggctgggagaagaattccaggaagagctagctaattttctgaaagaccgtagcgatcttttgtggctgcacgagatatgcttaaatcagttctcaactgcttcagagactcttcatacctgtgctctgctttcaagtcctggagaagatgctgacctaacaagcaccagaaagtcgctgtcctttgttgaaagaagacgtcttctctatctctctaaaattgctgcaacagcaggtaaggatgttgattatgaagtgaaggttgcacagatagatgctgatatccggattctaaatcttcaggaagagattgttcagcatgatccagaatatgcacagggcaaacatgcaagcaagcttcttccgccatcagaactgatcgagatgtgcatgaagagaggccgcgagctttctctcaaagccttcgaagtatttgcttggacaggctcctcgttccgaagctccaacaannnccttctagnnncttgctggacgaacgcagccgaccaggatgactgggtcaagctctcacnnnnntcagtttcannnnnntggagcgannnnnnnc

SEQ ID NO: 6508 - DNA, 710 bp, Triticum aestivum
  unsure (1)..(710): unsure at all n locations
  Clone ID: PAT_TA_6508
tgcaggnaattcggcacgaggcccgcccctccagtgtcgccggctgcggttcctcccaaccttcttctgcgctacgtgctctgccctctcccccctgcgggctctgcgctcggaatccagaaggggaggcctcccatctagctcgtggtgactccagtgagactcagatttgtctctgctagaatcttgcaatgacaatttttgacgacgatgatgatgcggagccacaactgaaggtcgtttgacaactactattttgtgaaagccaaggacgagtttgtttgtttcagcaccttgccccttaagtttgatgagaatgataaagtctccgggaagggtatctacttgcgtcgatattccgcagatggcgcccctgcggtatacaagcaggttgtagcttggacagtagcacttaaccgtgagcagccaaagatctcagtgctttcaagtgagggctattggatagaattggatctattgaaaccacggaaaatctattggaagtttgctcgatcagcattaacgacagttcaaatgctccactttgtcaaaaggcaacccagaaaaccgatgataagtctttctgttcaccttcgtgaagtattcagtaaatttgaaacggaagagatggaggatgctttagggaaacaccatcacataatcaagcgatgtgcagagagggatcctgctttaatgaggtcaaaggttct

SEQ ID NO: 6509 - DNA, 708 bp, Triticum aestivum
  unsure (1)..(708): unsure at all n locations
  Clone ID: PAT_TA_6509
ggcaggggagggacgcaagaaatcggggccaggggaagcaagtacaaattactgatggattttgggactgaattgaagggatgtgtttgccggatcaacaactgcgccatcgaactcttctccatgaaggaggatttggagattgaagacgaagactcatgggacctggttgggagggacctccggctgaaggccaccttcttgtatattgacctcagccgtgtgatctcctcctgtgagagcgatgaacgcaagaagatgctcactggcctagccaacaagttcttctacttcatggacgagttgggcaatgcggtgaaggacagaagcgcccccctggtgcaggtgtgctacagcgacacgactcatgttcttcgcgaggtggtggccgcccttgtgccgtcgcattagtctggctctggcatccatgctgagaaagctgtaagatctgggagcttcgcagttcttggaaacaagaaattgtccaaaaagctgtacaaagaggacaggccaacatgaggggcctccgtggcctcctggtcggttatgttatgtacatatcgttaaacggctgtggagtcgaagcaaactaaatgattagtgtccggtttgcccctggatttaaggtgtnccggcaantttaatttgnttcanttcggagttgcttggtcaacacggnggnaaaaaccncctgggtgtgnnaccaan

SEQ ID NO: 6510 - DNA, 596 bp, Triticum aestivum
  Clone ID: PAT_TA_6510
ccgcgcagcagccggagggccggcttcccccggcgccggggcctccccgccccccacgccgcggccgccccgcccgtctctgacgactggtaaggcggcctgctcctgcttcttccatctcaagaagctcaggtggagcaggatcacttcggtcctcctgccgaggaaggtctccgagccctcctcctccaagatccgccatgcaagcgtggcgcacgctgaggatgcctgcccgagcatcgtcttcctgtcgcagtgggggctgccggtgctctctggcccgtcggtggccggtaacaggggcaagcactcccgtgggaagggctactgagaggcagcagcagaggcttctgcacattttccaggtgtcgtctctgttcctagcgacatatgcgtgtgtatgatgtggtatatatctagttgatcctgtaaatcggattgtgttcgttgctctgtgccggggtagatctgggatcgggtgtaccctgctgatcgatcgtgtctgtgcgaaaaaatgtaggtcgattttaagttgatgccaggcgttcgcccagcctgtcaatgcctcccatagcatcacttctaaacggggtaat

SEQ ID NO: 6511 - DNA, 620 bp, Triticum aestivum
  Clone ID: PAT_TA_6511
gtgcagcctgcgcgccactctcctcttcccgtcaccgtggagcttccctgatccgtcgccgaggagctgagccgacccgtcactgaggacgctgcgccgacccgtcgccggggtgccgtgtcgtggtggttgccaagacaatgggaacaaggccggcgacgtcgaggcttccgccgttctgtccagtggtgccgcactgagccagcgaggcgcctggtcaagttgagcatcggcggctgggggctacctcgtgctgggctgctgctgcccacccgtcggcacaaggcaacggctgttccatggcgtcactatgggtggagacggtcactgaacaggagcattggtcgagtcaaggccattgtggatagtggatacggcgtctccctctggagatttgagcggatacaggcagttatccggccagcaaagtgttgagatgaaccgtggtggttgcagtgtagtatagctctgggtcttttttccttttgtggtattgtgataagtctgtactgggtcttttttccttttttcttaattttttatttcctgacatgtttatgcaatttccttttttgtttaataataaaattaccagtaaatttttcttattaaaaaaaaaa

SEQ ID NO: 6512 - DNA, 426 bp, Triticum aestivum
  Clone ID: PAT_TA_6512
gatggcgtccatggccttcggcctggggtcagcgaccatggaggcctccgggcctccaacgcgggcggcgcggtggcgctctcgcttgtcggcgacgacgagcaccaggctgccgatttccaagtccacgccgaccggtcccgcagccacgtccgagctgccgctcggctccaacccttgcagtcgatgcttttcgccgccgcacactggtgaggccagcgcacgcccctcctacttttcttcttctgttggttcctaccctccatagccagcgacgggtaagctttaggaggaggaatcgtccacggcgaacggtgtacgcatgtgattttttttgcaatttaaatgcacacagtaggccgatggcgacatatgattgtagatggggcatggcaactccagtataagttttattcaaaaaaaaaa

SEQ ID NO: 6513 - DNA, 627 bp, Triticum aestivum
  unsure (1)..(627): unsure at all n locations
  Clone ID: PAT_TA_6513
tgcaggnaattcggcacgaggcggcgctgcgtggaggggttgacgctcatcgagcgcgtcatccagtccaaatccttccagaacttcacgtacccctacttctccttggaggagctgctcaacatcacggcggagttccccgtcaacctgctgcctcggcacgacaacgactccaagtctctggagcagttctgcaaggacaccgtcatgaccatctggcactaccacggcggctgccaggtcggcagggtcgtcgacgccgagtaccgggtgctcggcgtcgacgcgctgcgcgtcatcgacggctccacgttcatacgcctcgccgggaaccaacccgcaggccaccgtgatgatgctcggcaggtatatgggggttaagatgcgagacgagagggtgcgtgctgaaggattaaggaggagaaaactgtaatccactcgatgaagattggcaggcacattatgcatttgttattgcagtatgtgaactattgtcacggactagaattcaattggaatgagttgcgcgtcattattggaagtgcgtgttcgtttgtaccgtaatcaacacaaaatctgtattgtccgnaagaaaaattaaatttgtgtttgagaagaaaaaaaaaa

SEQ ID NO: 6514 - DNA, 1246 bp, Triticum aestivum
  Clone ID: PAT_TA_6514
ggcagggatttccgcccgcggcgcacttcttccgatccctacaggaggcaagcctttttttgtaggccccctttgatcacaccaggttcgtttcgcctcttcgtccgctccgcggcgccttacctggcgcagggccgatgggcgttgagaccccatgtcctccgcgtgttccgcgcacaacagcgggcaaagttctgctatcaggcaattgccgatgagctgaaaggtctggttaggatttcaaagcaatcaagcatttccggcgggctaagtgcgtgtcctatgcaacggcccgcagtgtgtggccgcctctcaccgtgtcagatagagtgcatactgttctccacatccagcactccacttggcctgaccatggtgtgccagatgacagcagtactgtacggaagattctaaaaagattatattaccttcctaaagagcacccagttgttgcacattgcagtgcaggcattgggagaactggtgcttacatcacaatccataatacagtagagaggatattacgtggtgaacaagctgctacaaatcttgtggaaactgtcgggaagtttagatcccagagacctggcatggtccaaacagaggaacaatacaagttctgctatcatgcaattgcggatgagctgaaagatctgattaggaattcgaagagctgaagcattttcggcggtatgcttgatgcagagactggggtaattgtgagtcctatgtaacggcctgacgtatctgaccatctatcaccttctcacttcctcaatttgttaagcttagccgacatcattgttgtacatcacgaagactggaattcgaatttcagccggaagctctcggagacactttcctttttcttttctgatcaggatttcaccaatttgatcgtgtcggctggctcacatccagaatcacgtgggtacctcgctatgcattcacctgcgttgcttctcttgctgaattgttatgtgctgaggccagaaggttgacatttcaactggtgcattaccaccttagcttgcgtgggttgatgacagatgtatgaactcagatgtctagcaaagtttgatgcggacgtatctagaaatggagattgaggctgcataagccattctatctccatttcttgatacgcctcttgtttgtttctgtccagttcttgatgctgcttctgaaactcaagaccagaatcaaagcatctgcggtccatatttgtaaaaaaaaaaactcgtgc

SEQ ID NO: 6515 - DNA, 797 bp, Triticum aestivum
  unsure (1)..(797): unsure at all n locations
  Clone ID: PAT_TA_6515
tgcaggnaattcggcacgagggaagatcgctcgacatcaccaaattcagcagctactacgagttacgtggtgagctggagcatctatttggcctcgaaggccanctggaggaccccgtaagatcaggctggcagcttgtattcgtcgaccgagaaaatgatattcttctcgtcggcgacgacccatggcaggagtttgtgaatagcgtagggtgcatcaagatactctcgcagcaggaggtgcagcagatggtccgcggcggcggcgagggccttctgtcttctgcacctggagcgaggatggcgcagggcaatgtctgcgacggttattctgggggccacgacctgcagaatctcaccggcaacatggcctccgtaccgccactggactactgaaacggagatcggagtccagaactaaaccagcactccaggatcgcatcatcatcacggtattgcgacgtgttcggttcaccaacctagctagccctctcctcgccatgaactttagtcaataatatagttagacgatctaccaacatcattccgatcatggatatgttgtgtgatcgctgcttcggctctatgatagcctagtctcggaatggcagacaagaaccgctcttatgaatgtgaggcagtatggtaccgtggaagtgaccaccttattatgtagcaatatgaatgacctaaaaccgagtattccgactggggacctaaaactgattatcccggctggagcctagacttttcgctgtgaattaagtgtggtnatccgccgtgttggagtcaaagatt

SEQ ID NO: 6516 - DNA, 686 bp, Triticum aestivum
  unsure (1)..(686): unsure at all n locations
  Clone ID: PAT_TA_6516
tgcaggnaattcggcacgagggcggcggcgcatctagcagatagcagagnaggccggcgggaggaaagttgaaggccaccgtcagtacatctagcagcagcagcactactacaacctgagatggacagaaagacaaagatgttaatttatgcggctgcggcgcaatggtttatcaacatgataacattggttgttcaatccagaaaaagaaaaaggagagaagcaattacgtatgccccaattgatgagagagataggatgagaagagagtattttgacaacaaaatatggaagaatgacacaacctgtgtgaacatgcttaggcttcggagagaacctttctttaggttttgtcaactctttagggatcgcaacttgctaaaggacacaatacatttgactattgagcaacaagtagcaatgttcttgcacaccgtcgggcacaacattagaaatagggtaattggcgccaattttggtagatccggtgaagttgtgagccgttacttccaaagggtactccatgccattggcgagcttcgagatgaccttattaggaagccttcattggagacccaaaccaaaatagaaggaaactaccggtgggatccatactttaaggattgtattggagctattgatggtacacatgtgcgagcctccgttacaccggatatggaggcttc

SEQ ID NO: 6517 - DNA, 2167 bp, Triticum aestivum
  Clone ID: PAT_TA_6517
gccggccgggtcgggaaaccaccgcgtcacgtaaataaccccccgtctgtcgaaaaagcggaagtccaaagcagttggtcgctcgctccctcgctcgccaccgccgcgttggacttttccctcgccggagaaaccgccgcgaccacagccgcaaccgccgccaccgcctccggaggaggagggtagtaccaccagggagggaggaggccatggcggggaggtacgaccgcaaccccttcgacgaggatgacgtcaaccccttcgcgggaggaggtgtaccccctgcttctaattctcggatgccacctcttcctcacgaacctgctggattctataatgatcgtgctgctaccgtggacatacctcttggttcatcgaaggacttaaagcaaaaggagaaagaactgcagtcgaaggaggctgagcttaacaaacgggaaagagaacttaaaagaagggaagaagctgcagctagagctggtattgtcattgaaacgaaaaactggccaccatttatgcccatcattcatcatgacatttcaaatgagataccaatccacctacaaaggatgcagtaccttgcattttgttcattgttgggattgacgttatgcctcttttggaacatcattgcaactaccgcagcatggattaaaggggcaggtgttgtcatctggttgctagcaatcatctacttcatctctggtgtccctggggcgtatgtgttatggtatcggccgctttataatgcaatgaggactgaaagcgctctgaagtttggatggttttttctgctgtacttgatccatataatattctgcatctggtcagctgtgtctcccccagataactaatcatcttttttttggtactcgtcaaatgatcatatgcaagcaagattcatcgttaaaaaaaggaacaccaaagtacaagttgacattacaagacctcccagtcaaactgggaatacatgctcatgtgaaacagctacaaccaaagattaagagtttcatgacaacagccgtgcttcaatctttaacaacagtccgcaggattttcacttcatggatgggcctatcatttttgtcggtctgaatacttccaaggcgcttaacaatttccattcctctgcatactctcccaaaaattgtgtgcttaccatccagtgattgacaaggtgcaagagtgatgaagaactggcttccgtttgtattcggaccagcatttgccattgatagaatcccagccccggtgtgcttcagctctggccttatctcgtcctcaaattttgctccgtagatggattcgccgcccctgcctgttccactaggatccccaccttgcacgatgaaatccttgatgatgcggtggaagacgacgttgtcgtagtatttgcggcgcgcgagctcgacgaagttcctgcaggtcttgggcgcgtgcttgtggtacatctcgacggtgaaggatcccatggaggtctccagggtgacctccggagtccctccgtcgtcgccgccccacatcttgaggtggcgacaggcgagacaagagacggtggcggcggcgcgacaaagggggagggcgcgagagggggacgtttcctttcaaaggaaaatctatcgctgggtttttgcctgcaattgacgtcataggcagtaatgttattgtggggatattttattttgttggacttcggactgttctgccttgaagcactgctcagcattgtggtgatcccagccaagtatacatgtacttccgtggaagtggaaaggctgcgcagatgaggcaagaggcagcacgcggtgccatgagatcggccttctgatagagcggtctcgttgatgaatggatgagaataggatgtgccaagtcgttgatggcgtcttgtctttgtacatccctatacatattctgtgcgtggctgagagagaatacttgtagctatagatcttcttgcattcttgtaatatatatgagtgcttcatttctttcctaggccccagatccatgtgctttatatgtagcttaatcttttgggagatacaacttccaacatcactattctgacgagcttgcttgcaatgtcactatattatggttatgtatgtgaagtgctaaaactagtttatttcgccccaaaaaaaaaaaaaaaaaaaaaaaaaaa

SEQ ID NO: 6518 - DNA, 1214 bp, Triticum aestivum
  unsure (1)..(1214): unsure at all n locations
  Clone ID: PAT_TA_6518
gcttcccctctcgctcgctgaaatcgcccccaaatccacccgttgccgctgcccaaattcgcctcgccgctgcccaaatcggtgctctcgagcggggttcggcatcgcagggggtcgccggttggagttgttgtcccgcacggcacgctggccgcggggagcggctctcgctcgcgagctcggcgaccgtgcaatgctcgactcgcggggtgggggactgttgcgaagtgagattgccctcattttgtgcggttgcgaaggaaggagacggtactgcgacgcgaaggtacctatagcagaggagcaaggtgtttcaacaggtcatgtttacaaacgcaagcgccagaaattggtcataacccgggggaagcggcctgcggatattggaagtaacgaagaagaaccagtaggagatgtcaatgaagctgatgttacacaagatgcagaacaaaagaaaaaacgacgaaaagtgactgaaaatgagggtcctaggaacaggtcatcacctacgaggctttttaagttgaacaaggatcttgtcaaagaccaaaaaagtattatcagaggcatagactttgggggcttgttggatatcacaactacaagcatgcccggtgatctcagacagtggatcatgaaacactacgacccagaaaagtctcaaattgttataccagatagaggcaaaataccagtggatgcagaaagtgttaggaggatttggggtttgcccaacagtggcaggaaagtatgttttgaaatgaatccagatgttataagggaattcaacagtattttcaagatcgagggaaaaatgcccctacattgacttcatggtgtaaaatgattgtgaagatgaatggggcgtccgatgacattttcctccatgcttggttggccgtggcattctcctgcttccttgccccaaccacaagcttgagcatctcaccaaggtgttacactgctattcttcacacaagtgctataaaagacaccaagatatgcgactttgttattgatcaacttagattggcattcatgggttttggtgacaagaagaaggttgtttgctattgtgttttccatctagttgtaagtatgaggaaactcatttctaatatgttttcttttccatagtttttccttttcaatgcaagcanaaagagccatgtgtttcctaatagtttttgcaatttaaaacttctacagatttt

SEQ ID NO: 6519 - DNA, 962 bp, Triticum aestivum
  Clone ID: PAT_TA_6519
cggacgcgtgggtgcgccttctcgccagccttcctcgcgcgtcgtccgccggcccccgccctcctcagcccgcatccagcctaccccacctccctctgccttctctctttcctctctctctaatccccccacaaccccttctcctcaggagctcagcgctagcgccatggatgcccagtcctcgagctcaccttggaggttcgaacgccgccactggacctccaccggccagatccggcgcctggctccccggatccgcgcgcccctcaccccctctacctgatctggcgccccacccaccctcccacgaggccccgcgcgccgtcggccgcctcctgccccatcccggctcaatacgcgccggcgggcaccgcatgccgcccaatcccatctcctccccccccgccgcctcgtcgccgttcacggctcccgaagctcgagcgggccgatctacgcgtcggcgacctcgtgggaggcagaggatgggaaggtgtgctgtgctcgagaagagtgggctcgagtaaggggattggagggtggcgtcggcgggctcgcggacggggatggagagggcggttgctggcaagatcaaggctgggcaggccggaattgatctaaaaaaacaggttgatgcaacagaggggtaggggcagttcgtcttcctcgcattatgatagttgatgcagccccataaaaaaaagaggccaacatggcgctgtggtggtcatgactgcaacctaacggatagttgatgcagcgtaggatgaggtgttccgatggtgatttaaagtagattgcgatgccgccataatttgtgcattgcccagtggagaacctagagaggatggaaatcacatcaacttacctatccgatgttgtcgagtttgtcctcggttttcaaactctccactgccatgtaacctatcctgaaattcatttaatgaatcgacaaattatcttcc

SEQ ID NO: 6520 - DNA, 1186 bp, Triticum aestivum
  unsure (1)..(1186): unsure at all n locations
  Clone ID: PAT_TA_6520
cggacgcgtgggcggacgcgtgggtctggatcgtcagcccacaaccgacacccaaggccaaaacccgacgagatcctcttctccctccatctccactccatccacagagagcaaggcaggcaatcgcgtcgcgcgtcaccaccgtcgatccccccgtccgtcgaggtatgagacaggaggccgccagcctggtgatcacccacgaagacgaccggcagcaccaccacagccgcccgccgcctcccgacgaggaggaggaggagcacgggcgccgtggccccgccgtcctgcgcgacaatcctgctgcggcgggagggcggcgaggccgaggcgggggaaggcgaggagccgctgcagctggtcccgccgctcaacttcgcgatggtggaccagggcgtgtaccgctccgggttcccggacgcctccaacctgcccttcctcgagaccctccgcctccgctccgtcctgtgcctctgcccggagccgtacccggaggccaaccaggagttcctccgtgcccacgggatcaggctgttccaactcggaatcgacggctccaaggaaccctttgtgagcattcccgaagacagaatccgcgaggctctgaaagttattctagacacaagaaaccacccggtgcttattcactgcaagcgtggaaagcatcgaactggctgcgttgttggatgcttgaggaaactgtagcgctggtgtctaacatcagtattcgacgaataccagcgttttgctgctgcgaaagcaagagtttctgatctaaggtttattgagctattcgacgtctcaagcttaaagcatttaccagcgtctttctcatgttgagcaagaagcatacagtacatgtcagcctctgggggcccagattggcatttctttcgcgtatctagtaacatggccgataagaaattttcaaaaaaaaaactgttaatactacttttgattctgtttttggctcacgaatcatgaagttgaccctgccaagttaaacattgtaaatcatttttgaagctagggtagatattagataggccgcatgagttatattctccccgttgctgcatttatcatatgtttgctggcattatgtaagcatgtaataatagtctgtaattattgttatgttgtatactaaataaaactcagtctggcaagcaaanccttgtgttat

SEQ ID NO: 6521 - DNA, 1091 bp, Triticum aestivum
  unsure (1)..(1091): unsure at all n locations
  Clone ID: PAT_TA_6521
gggctggttggagtcgccgagcgtccggacggaagccttccggagggagccgagccaccagcgaggtggccgtgtcctctccccagttccaatggcgcgccgccgcgtgctcctctacctcaagcccttcgatgtctaccctccgcgccctctctccggcgcctcctccctcaccttcccgccaccgcctccgccgccgcgcgccgccaaccccaagatcttaagttatctggaccatagatgcagagtccacaaggacacaatcaatctctgtaagagtgtactacagcgcaagccccttgactggatctcagtgcagcgaaatcatttgtcaaatccaatacatgatgtggatcttgtgattactgtcggtggtgatggcacacttttacgggctagccattttttggatagctcgattcccattttaggtgttaattcggatcctacgtgttctgatgaggttgaagagttaaccgaggaatttgatgcgagaagaagcaccggatatctttgtgcagctactgccaggaactttgagcagatacttgatgcaacccttgctggcagtagacactattcagagctgtcaagaatatctgtgaaactaaatggatcccagctaccaacttatgctctgaatgatatattggtgtcacacccctgtccggcaagtgtatcgcggttctcattaagaaaaagaagcaatggggagacctcatgtttgattaattctagatcaagcggtctcagggttgcaacagctactggatcaactgctgccatgctatcagcaggaggatttatgatgccaatatcaagtcgtgagcttcagtatatgataagggagcccatttcaccaacggatgccgacaaaccactgctgcatgggttagttaagcaagagcaacatatgcttgttgtttggtacaatcaagagggtgctgtgtatattgatggttctcatgtaacatatccaatccagcatggggatacacttgagatctcctcagatgctccagtcttaaaagttattttaccagaatatctgttaaagcaggcatctttataanaaataacggtatcactgt

SEQ ID NO: 6522 - DNA, 1294 bp, Triticum aestivum
  unsure (1)..(1294): unsure at all n locations
  Clone ID: PAT_TA_6522
gcgattcccacacacatcgctcggtttcccctcgatatcgagcacacaaacctcaagacagctttgccggtcgagcttccttccatggccaacttcggcaactacgcttggatttgagctccctagctaaaccgatctccgctgcctgaagcttccaccacgcttgaaactctccgctacctgagattcccaatgatcccggttgctccttccttcgaacctatcgatccgcaactcctttaacctttttgcgcagaagacccgcgggagcaaccttccgatgcactctccatctcaccggacttcaccagcaccaacacacaacggcgcttcaaacagaggatgcctccttcaccgtgtaaaccaccatcgccatcccgccgaacgccgcacccgcacaccatctcagcatcaccggaggatcaccagagaagccctgccacccatgaccgaagcttccaccgtctttcccctgcttcaatgagcacgcacgcacaagaacattgatgtggagcatcccaaggccatccccatggacccaactacatctccttcgacgcctctttgacccatgacacgagcacgtgcaagagctcttgaaaccgaggtgacatctctcctctcacatttccattttgatgtgcatgagacatggctactacctcatacggatactttgtgcatcctcgggtaccatggagaagctaaggagtaaggagaagaagaagaggaagatggaagtgaagacagagatgaagaagaaggattgtttaaagtctccaggctccggacgaccgacgagccccggacgtcggacgacctccaggctccggacgtctggcctcctccggacgaccgacactaccacacccgagccaaaacagacggacatccgacgccctacggacgaccgacgcccggacgtcccgatcggacgaccgaccgaagacaacccgagccgaatttacggacgtccgacaggcaccggacgtccggaccctcgcgagcctccggacgaccagtgacctccggacgtccgacgcatgtgcaccgtttcatgttgggccgcagcccatgtaccccttcgcccccctcttcggcactaggactatatatactccacctcgtccaactttctagggttagtaaaggattagctcatatttcgtgtgagagctttgctcatccacttggttaccttctcctcggagattcgagcctccaccggagaagatcccccaatcggattcaagacccctttagggaagaactcaagacctccncacggnagaag

SEQ ID NO: 6523 - DNA, 450 bp, Triticum aestivum
  Clone ID: PAT_TA_6523
ttttttttttttttttttatgaaaaaatctgtgtgcatcatcacatgaagtgcactggtggcacaaatgcaagccttaaaagtcttgttaacacaaaataacactggcggattcaagatgctgcaatacatttttagggcagccaattggattccaggaacgcaaagcaattccaggtcatgttgtaaccatcaatttgctgccccttgactactcccaagtttggtcctagtctcaccatgtacatcaatatgggtgtatgctataacattaggatctattattagaatatgcactagaatttatccaaaagcaaagacaagctaacatcaagtgctttatttggctgaagaaagggaccccatgccatgaggccatgacttgctttgtcataagcccgctgtttgaaccgcaagatatgaccaggtgttgtgtgatccagattcttaa

SEQ ID NO: 6524 - DNA, 1024 bp, Triticum aestivum
  unsure (1)..(1024): unsure at all n locations
  Clone ID: PAT_TA_6524
gcaaagtnccccaatggtttactccaatcacgaggagaaatcaccctaatatggtttcattgatttgaatggattgatgtgttgtataaggatggagatgggtcgggtttggaccgggttgagcaatattaaatccatatccatatccatgaggcagtcgcagcccattcatgaaaaaaaatccatggacgaaaaattgtgatcatgtccaaatccgatggatatccatacccattggatatccatcaggtcctctcaagacctatacataagacataactcattgcacaatgtgcactctgcattggcgtgctcactccctgccgtgtagtcatagcccttgcatttgtcccactgctgcgggcatgcatcaatgcgtgtgtggaaaagcgaagacagaggggtcaaggagatatggagctaggttgtcgcaggccagttgtggctgctgcagtgatccaccttacgtgggggtagcggctggcagcggcggccacctctagggctatgagaggagtaactcaaggagatggcactgattctcaatgacaagtcatttaattagtgtagatactaggatgagaaggtgcgttggagtatgttacggtggggattgtgtaatttcttttggatgttttaggtaaaagataaaattatagtgggacatgtgactatggggtaggggtagcagaatattgctcatgaagtcagacgatcgggccgggtttggatatatccatgggtacaagattatgtccataccctatccacgagtaatcgggtcgggtttggcgctgcccatgggcgcaaaagcgtatccaaaccctatccattcgggttggatatccatggatatccatgtccatggataaaattgccatccttactattgtaccattgtagggtcctcatcaaatgtatgaattccctcgagggagtgggaaacaaatcaaattattttcttttgatcggagcagagggaaagtgtacctcttcactcataaacttaatgcaagtgaggatt

SEQ ID NO: 6525 - DNA, 947 bp, Triticum aestivum
  Clone ID: PAT_TA_6525
gcgagttccggcccgacgcgagcaaggagaggggtagggagaggcacggcaacggcaacagccagcgagcggcaaggcggcggaaggagggggcgcggcaaagtggcgatgaggcggatcggcagcaggatcaggcggcgggcctcgttcgccaaccgccgcaacggcctgcccaggaagtcgtccgagctgtcggggcgctgcgacgccgaggtcgcgcccatcatcttctctacccgcggccgcctcttccagctctgcacatcctcatacatgtacaacacactagtgcggtgccgcagctgcaacttcaactcccaggaaaccgcaactcaggagactgaacaaagcaattagctggagtacttgaagctgaagacaagagttgagttcctacagacaactcagagaaatcatcttggcgaggacttgggcccacttaacatgaaggaacttgagcagcttgagaaccaaattgagatatctctcaaacatatcagggcgacaaagagccaacagtcacttgatcagctctttgagctcaagcgcaaggaacaacaactgcaagatgttaataaagacttacggaagaagatacaagaaactagtgtggaaaatgtgctgcaaatgtcttgccaggatgttggacctagtgggtctagtggccatgctaatcaagctaatcaacaggagtattttcatcatgattgtgacccttccctgcatatagggtatcaacgaaatttcctggatcagttgaacaaagaatgaatggttgtatgagctgagcctgagcgcagatgtcctacgttgggtcgatgtgataaaaatttaatgcaatgctttcttttatcaatgggttctaacttaaaacaacctattatgtaccatcccgtcctgtcgtgtgttattttaaacttgagagaagaattatctgaaaaaaaaaa

SEQ ID NO: 6526 - DNA, 676 bp, Triticum aestivum
  Clone ID: PAT_TA_6526
gctgggccgtccttggaaggaccacgcaaccgtggtgtacatgttatgcaccatcgacgacatcatccacgcggacggatgggtggcttggaacaagaccaaccccaaggaacgcgtcaaaggtggcgtcactcctggccacgagggccaccttttctttggtgagttcgcgaaccacggcgccggcgccaatgtcgaccaccgcgtcgactggcatgggtttcatcgcctcaacgaggcacaggctaggctgtatgcgccggggaggttcatccagggaggcgcctggcttccccagacaggggtcccacattatctgggcctccgtgatggtgagtagtgcatccatccatcatacctgtctgcctgctgccgccgtttgagagccatccgtttgtatctctagtagtagtattgtagtagtagtagcagtagttcgtacaagtaccgcgggcatattgtacgagtgcgtagaggagcttgcagcaggatatgatggattcttcagcagtcggccaattagctagctatgtcctagctagcttctgagcatcattggcccaataaagtaagcatgcatgcgaccccctagctagctagaagctaggccagcagtccgtagtagcttgtgatcagtgatgtgtatcagtgttgtttgtgtgtgtatcagatctgt

SEQ ID NO: 6527 - DNA, 1003 bp, Triticum aestivum
  unsure (1)..(1003): unsure at all n locations
  Clone ID: PAT_TA_6527
ttgcagattgatatagatggatccgtctacgagatggaattcccagaggccttccaacggctggtatgtaatgtagctctatatcttaatgggcataataaggtgccggatgagacggcatccgtgcaaaggctaagagtgttggaaggtctaagtgtctaccttcagtcagttgagtttctcaaggggccggcccgacggaaaaacctaaggaggctgggcatggtattaatatactaccattgtggccgtgattgggaggcgaatctgaagcaggcacaatcttccgtgtgtgagctgggaaaagcaggactcgagtctctgcacctttacatcgacgaggaagtggttgagatcttcgagatggattcatggttctccgttcctccttatgccctgcgggagcttgtcatcgaggggaaatcagtcacaagagttccgacatggatggcctcgcttgacaacctcgagaaactgcacctccgcatatataagatgcctgaggaagaggtgaagatcctgggtggcctgccatctctgcgtcatctctgtatcgagtgggctgattttgattatgacggcatgtttgacgacccccccatggaggtggttgaggctgctgtacggaaagcgatggaagaccatcccaaccgtcctaccttggtctggacaactgagtgggacccattgcctagcttcttgcagctccgaagttaaacaggcatgatgtcaatcttgcacggaagctggggccatcttacgtttcctactactaagtcaatccacgttctttcttctacggtgggccacaatgaaagaaaagctgaggctcagcagccaacccaactgaagttcctggtacacccgtgaattagtactattacatatttgcatttaaatctacatttccaaagcataaataaaggatcgtattagatcattgtatcgtcaaatgtcgccgctgcttatttaaanacgttaatgtaaaatgnaatcgtagtaa

SEQ ID NO: 6528 - DNA, 716 bp, Triticum aestivum
  Clone ID: PAT_TA_6528
ccacgcgtccgactgctcctgcttcttctccggcacggcgtcttccgccggtcgctcctaagatcctcgcaccaccccgccgcgcccagccgcgaaagggggcggaatgctgcagtgcgtcttcctcctctccgattccggggaggtgatggtggagaagcagatgacggcgcaccgcgtggaccgcgccatctgcggctggttctgggagtacgttctcgcccacgccgccggcgacccgtccaaggtcttgcaggttgtggtgtccccaacacactacttgtttcaagtatatcgcagtggggtgacattcttggcatgcacccaagtggagatgccccccttgatggctatcgagttcctctctcgtgtggctgatgtcttgacagattaccttggagatataaatgaagacacaatcaaagacaacttcgtaattgtttatcagattctagatgaaatgatggacaatggctttccactcactactgagccaaacatcttgaaagagttggttgcccaaccaaatatggtcagcaaaatgttaaatgttatgactggtaagagttctactattggtagcaaacttccagatgcaactgcttcttttgtaccttggagaacaacaattgtcaaggatgcaagcaatgaagtctatgttaacatagttgaggaactagatgcatgtgtgaacagggaaggggttctagtgaaat

SEQ ID NO: 6529 - DNA, 522 bp, Triticum aestivum
  Clone ID: PAT_TA_6529
gcggaggcccgtgtcgctggaggagatcaagaaggcggccgccgcgggcgaggtggaggggctgaaggacttcgcgctcatccgccaggcccggctgtcggtgatgcccgtggcggtggaggtctgggactggatttgtgagatggggggtggctttgtggaagatgggaaggtggaagaagatgaagcagagggttgatatgctctgaactctgaaggtgacatgcagttggaagggtcattctgtggtgtcttttcgcctgcaagtacaagagatggtattttgaggagcatttcagtggcattttgtgtatcctctctacttctcaagtgtttgcctcctctgccttgcggcgtgaccaagtgtgtatcctctttagcgtttgccatctctgcatcgtggcatggccaagtgtttatccgctagctagtcaatgtaagttcagtgatcgatgttggcaatgttgcaagaacggtcgagtcatatgatgttttctgtggctgtatggatatgctgttcac

SEQ ID NO: 6530 - DNA, 1137 bp, Triticum aestivum
  Clone ID: PAT_TA_6530
gcccccccccgccccccttcctcgtctctcgtttccctctctttcagtcgctgccccgacgccccctcgcccccgcgcccaggcccgccgcccgggccgccgccgccgccagggccttggggcccgccgctctcccctttggcctcatcaatcttccaccttcctccggcctcagggcaaatggtcctgtgtccccgtccccctcccccatcccgcttgccgcggcccgccgccctgctccgtccaccggcccccggcgcccgggggcctgcagcctcccctccccccgccgccggccacgtcacccgtcccccgctccccggttcccttcagcttccacttgcgacctgggcggggggccgtttggcttttggtgccaaaattgcaacaaaatgtgcaaatgagaacactcgcgctgaagagttgaactcgagatcagatcaagcaggcgaacttgtagaagcagttgaagacgtgactccccaaaagaggagtgctaaaatccatgatttttgttttgggattcctttcggtggtcttttgttctgcatggggcttctaggctacttcttctctaggagtactgtaagtcttgtcctaggtgttgcacctgggcttgctacgctccttcttggtaccctcagtttaaacttctggaggagtggaagatccagcttcctgtttatattgggccaagcagcaatttctgctgtccttgcatggaagtattcccatgcatacttactgacaaatagaattcttccttggggcttctacgcttcactgagcactgcgatggcttgtttctatgcgtacgtgctgcttgctggaggaaatccaccacccaagaagttggcgccggcaccatcatcgtagagccagggagcaggcatacctttctgtcctagcttaatttgacatttgtgctccataaaatgctgcgagtacgagcacagaagagtttgtcttctatatttgtatatgtttcctagtcttgggttcgcttgtggcgagctcttggatttttggcggaacatcgagcaaataatactggcaggatggttgtaacgatccagccctgatgagcattttttctttcggctacttgaacatgatgaaggataaccggtccaaaaa

SEQ ID NO: 6531 - DNA, 1077 bp, Triticum aestivum
  Clone ID: PAT_TA_6531
gccgctccgtgccggccggcttcgagttcaccgcgctagagacgctgtccctctcgtcctgcactgtcgacatcgacaacctgctctcctcctcatccatgtttatttcgagaagcgcgacctgagggtcagctcggcgtcgctgcaggagcttctcctggatacgcctcagggccacggcggatggatacagcgtatcagcatcgttgccccggtgcttgagcaattgaccatgtccttccccgccccgagaggcagcatttccatcttggcacccatggtgaagaaggtccggtggcactgcgacttaagcggggcgtctgttgacttcaatctttgggcaatccagcagctgactctgcagacggcggagggacaaggacatctcccttctctgcacattcatgctactgctcgcttttatatttctctcgacgaagaggacatcatgacaccggagatagagaagcatatggttgccgagttttctgctttggagctacatctcaaaacaaatggacatgtgtttggagcattcgcgtttcatctccttgggatgaatcggatttgcagtgctatgcagaggcttaaggttgtcctacagagatcagaggtggaagaaacatgctcaccgcattgtccatgtgactccacggattggagatcccaaactatctccttggctgctctagaagaagtggagatcgacggctttggaggagaccatcatgagattgatttcttgaaactgatattcacatgtgctccattgcttaaaagagtgaccgtgaagctgtcaaatgaggcctcatcaagcgacaatggatgcacaaacatatacaacatcttcaaggcccattcttccgtggaactctatgtttatcctagctctgattacaaatcagagcttatttcaattagcctcctctgaaggattaatgctcggcagccatattgcccctcagcatgatttccatggttatgtatggttccatggttatgtcttacgatttagctctgttgcttcaaccgattatcttatcttaggtgttgttttgtcagtgtactaagctttat

SEQ ID NO: 6532 - DNA, 1033 bp, Triticum aestivum
  unsure (1)..(1033): unsure at all n locations
  Clone ID: PAT_TA_6532
gaaaacccaannctcctcctcatcctcttccatggcgatggcgtccgcgctcccgctcctcctcggcccccgccccatcatctctccgaggcccactgcaacgggccgcttcctctccagctccgctcacctgtccaccgcccctgcccccgtcgagcccctgaagggcggcggccgcctcgcgcggctccagacgctccacgcagcctcctgctgcaactccgcccccgcagcagcatctggaggagtggaggcggcccgggcgaagggcttgcagctcgtggcctggtaccttctgtctcttgacaagcatccggtggcgaccaaggctgtcacttctgctgtgctgactctggccggggacctcatctgccagcttgtaattgataaagtgccagagctagacctgaagagaacatttgtgttcacgttattgggacttgtcctggtggggccaacgttgcatttctggtacttgtatttgagtaaattagtgacgatcagcgggacatctggtgtcatttctcgcctgttacttgaccagttcatcttctctcctgttttcattggtgtcttcatgagcttactcgtaaccttggagggaaagccatctcttgtagtgccaaagcttaagcaggagtggttctcttcattgatcgcgaattggcaattgtggataccgttccagtttttgaatttctattttgtcccacagaagctccaggttcttgccgctaattttgtagcccttgcatggaacgtgattttgtcatacaaagctcataagaaggttatcgcggagtaatcaaataggtgagagagtagactctagggcggggtacctagccggttgcaacatgtggcgatgtaaggctgaaagaataaacctactatcaattatcttggcgtctcttctgtgttatcctaccgatgaaaaacttgcttagtattgtaaattaatgtccatcttgtctgtcgagtgcagcccgcaatgccggttaagcatgcgttgtataatccaaaaaaaaaaaaa

SEQ ID NO: 6533 - DNA, 1336 bp, Triticum aestivum
  Clone ID: PAT_TA_6533
ccacgcgtccggtgatgatgaaatcagcagggggtggggtcccaagaagttggaggcagcgccagcagtgagggatcatggagctgtgcttggtgcgctcactcgggcgctggcctcgacggaggcagcatacctcgacatgacagaccaatcgatgggatcccacccggagttggcggtgaccggggcatgcctgcttgtggcattggtgagggatgacgacgtgtatgtaatgaatcttggggacggccgcgccacggggcaaggccctgtcggatatcccatgattgggctcgaggcattgcagttgtctatcgatcatagcaccagcatcgaagaggaagtccagaggatcaaacgtgaccatccagatgatgatcagtgtatcgtaaatgacagagtaagcgcccgcttcgaagtggcccgcccgtggggcgctgggtatcttccacaggcgaagttgaacaatggattgctggagatgttccgcaatgagtacataggtgatgcaccatacatatcatgcataccttctctttgccatcacaagctcacttcaagggaccagtttttggtactttcttccgatggcttatatcagtacctgagcaacgaagaggtagttctgcatgttgagaatttcatggagagatttcctgaaggcgatccagcacaaagtctaattgaggaacttctttcccgtgcagcaaagaaagctggtatggatttctacgagctactagatatacctcaaggggaccggaggaaataccacgacgatgtcaccgtcatggttgtttccctggaaggtagaatatggaaatcgtctggaacttatgtgtgatgttcagccggaacaatgtcggcatcaacatttatggtgcggcccctgcggctggtcagcgcctccgagcgagttcgtacatgctcatcaagacagaaacatccccacacttgacagcttggcaggcagatgatgtgctccatgcatttctaaaagctgtattctctgatcggagaccatggctggtccagatctcaggttcagcgcaaaacacggcccatgagtcagattaacaccgcggagaaccgacagggaaaagggggagcaatccctgtcagattagagttagagttcgccttgtcccgccacccgcagcgttaattggtcacgggactcacctgtgacaattttcccccacctcgctgtggtgttgtagaaggtttgcttcttttctttccttgctgggagcggaagaagacctctggggcaggcaatttttctgggtcatgtagggggtgtcatgagcctgtacggggcccgaactgttcttca

SEQ ID NO: 6534 - DNA, 617 bp, Triticum aestivum
  Clone ID: PAT_TA_6534
ggtaccaccaacctccgccgtcagcctaggctcgaagaaccggtacgcttattcactccgcagggcatcgaccacggggcatccccccgcacggcagggaagaagttgatgtgaaagagaatctaatcagcagggctagtcctggctcgcatgctccaacatgctccatgctaaggagacactgaggaagatgtactcagtcgccaagggctactactgcggggggctagccgctcccaatccttttccagcagcatgggatcttaggctttctctcaatccctcaaggaaagcgccgggttttgttaacccatgcagggcccgttcatatccgcacatcgcggaaagctctgccggccaagagattgtgattgctcttggaagcaatgtgggggacaggatcagttcgttcgacagggcgctgcggctgatgaaagactcgggcataaagttccccgcgcccgcctgtctggacgcccccgcccccgagtatgtgaccgaccagccgcggttcctcaactccgctgttcggggcacgaccaagctggggcctcatgatttgctcaagaagctgaaggagatcgagagggatataggccggaccgcggggataaggt

SEQ ID NO: 6535 - DNA, 683 bp, Triticum aestivum
  Clone ID: PAT_TA_6535
gtcgaccccgcgtccgtcgatctcatacctaatccttaactgccctcccaacgcacgacgcctcttccccccctgcccccctctccgtctgacacccccttcttccccccctgcctccgtccacggtttcgtcctcggtttcctccgtcgattcattccctcctgcggttcctgaaggccaagttgacaactgctgctgctgcttcgggtacagaagagaggcgtcgatcctggttcacctgcgactggattcttcgttggattctgccttggtcgccgtggatcggccatgttcgtcaagaagctcgtggagaaggcctccaagaagcagcacagcggcggcaccggcgggctgcgcgccgaggacgtgagcccgcggctggccttccactacggcgtccccgccgacgccgccctcctcgcctacgaccccctcctccacgtcctcgccgtcgccaccaggaatgggcagatcaagctgctcggccgcgacaacacgcaggcgctgctccagtccccctcccccatccgctccaagttcctgcagttcgccgatggccaaggggttctcctgagcgtcaacactcagaaccagatcgaggtctgggacatcgacaccaagaggctgtgttatctgcatccctttgagaagcaaataaccgcgttcacagtgctgcagaaga

SEQ ID NO: 6536 - DNA, 727 bp, Triticum aestivum
  unsure (1)..(727): unsure at all n locations
  Clone ID: PAT_TA_6536
gcgaccaggnagctgaagctgcggtatcttcgcgcgccgccgcccccgacccggcggtccggccgcgtcgccagtctccccaagcaacccgattaccgcgacaagaaagccccgagaaggggattaccacctgatcgtgtgtacgcgaccgacgaagctagagactacgccttcaccaaggccaaagagctcaataaccagctgtcctccgctcacccctccttcatcaagcccatgacccgtagttatgccacgggtcacctgctgaccatcccgcagcaattcaagaagagctatctcccatggtttgatgagatgatctttctggtggatgaagaggatggggagtttcccatgccttacatggcgcaacatggtgccatcggctctgggtggaacttgttcgccatcggtcacaagctggctgatggtgattgcttggtgttccagcaagtccagaggacaaagtttaagtgccttgcaggatggaaatatatgactgaagcgaagatcaatgggagccttgctgtcctgaagtttaatctattaacatggaatgaagaatggtagtggaaacaaagtatttcatttggttaggtctttgtctctagaaactagaaaatgtacccttttcagaccttaagtatatttacctatgtattttcagatatattcgcttttaaattatttaatgtgccgatgctttggcttctgaacaaaaaaaaaa

SEQ ID NO: 6537 - DNA, 373 bp, Triticum aestivum
  unsure (1)..(373): unsure at all n locations
  Clone ID: PAT_TA_6537
ttcggcacgaggcgcagggcacgtggnaggtcgcaattgagcacttgtacatgacggctgggtgaccgggggagacgttttgcgtggaggtttctggacgttttgcaaggaggtttcggaatcctcgtggtgtcttgtccgggttctgttttcatagatcgatctcgcagtgtaggaagatttgtgtcttgcgttgtctgctatctaggtttctgttcaaatgttatctgggtgcatcttctgttcaaatgttatctgggtgtaaggcttgtgtctgttaagaagtactggtcgaaatctgtattggcgtttgtctggatgtaacgcttgattcgatgataatggaagtggatgtcgggaaaaaaaaaaaaaa

SEQ ID NO: 6538 - DNA, 253 bp, Triticum aestivum
  Clone ID: PAT_TA_6538
ttcggcacgagggcaagttacagaggacatctcccttcgctacagctgaggatcatcagggcaatccagaacaatcttctactattgttactgttatcttttgatgggtattttgcatcttggatacagtagaagaaccaattttttgctaggagaggtgaaagggaaacagagccattacttgtgctgtcgattgcacacttgtcctggtgccagaagctattttcatagcccactgaaagcaaaaaaaaaa

SEQ ID NO: 6539 - DNA, 703 bp, Triticum aestivum
  Clone ID: PAT_TA_6539
ctcgcgccgcccagccggcgtcccccgccagtgccaggtccagccgcccggagccccaatttccctctccctccaaatccgacctcgcttccgaattcccttctacccctcccctggtttgctaggctccacctcgcctcggcaccgcgtttccgtatcgactctacgccgcataggcagcggccagccatcgtccccctccagtgcctagagtaacccgctgaagtggcaatccagccgaacttgttttcgatcggagccgggcacggcgagggcgaatgggttcggcttctaagccatctccgacggcggccgcgcctagccggcgtaaggtagcgctctgcctgacgctcctcaccctgcagtacggcgcccagcccctaatctccaagcgctgcgtcgggcaaggagtcatagtgacttcattagttcttgcaattgaattcttaaaggttatatgcgcggtcattttattggtggcagagggtagtctgaaggcgcaattcagtaattggagtcttgttggatcactgactgcatcaggacttcctgctgccatctatgcacttcagaatagcctgttgcagatatcatacaagaatttggattccctgaccttttcaatccttaaccagaccaagctattattcacagcattcttcacatatcttattttggggcaaaaacaatcgcccaaacaaat

SEQ ID NO: 6540 - DNA, 357 bp, Triticum aestivum
  unsure (1)..(357): unsure at all n locations
  Clone ID: PAT_TA_6540
gactgaagctacatctctgtcacacactaggcaaatcattcatcgcgaagttcagacagggactttgcagcaggaaaaccacaactgatgcaattcttttatttatattgcagttacattttactaacctaagcttcattcatataccaaggaaagctgttattgggagagcagcagaattcttccggattttcttattgctgattttgtaaatgcagttcagattcttgtacaatgtgtgtgtatttctccctcattcaactcaattttttcttttgttattatagaagaggtcctaggatgcagncttgtatcgaaagctataataacaattcaactgatttgtcaaaaaaaaaa

SEQ ID NO: 6541 - DNA, 535 bp, Triticum aestivum
  Clone ID: PAT_TA_6541
ggaagacttatcaagcccggggttcactgggctacagcggtgccagatgagctccacggacgccaccgcccctggaggcctcttcgttgaggagtcgaagtcgtggccggaggtggtggggaagtccatcaaggaggccagggagatcattctcaaggacaagcctgaagccgacatcgtcgtcgtcccagcaggggcaccggtcaccctggacttgaggcccaaccgtgtgcgcaactttgttgacaccgttgccgaaacacccttcaccggctaggcagctttgctggcatgaaggaatgtatgcctgcaccatgcatgctcatgaatacgtttttatcaatggataaataaatgcaggcatgtcaagcattagcatgccaaagcatggacaccgactaggcagctttgctggcatgaaggaatgtatgcctgcaccatgcatgttcatgaatacgtttttatcaatggataaataaatgcaggcatgtcaagcattagcatggcatggcatggatctttaaaaaaaaaaaaa

SEQ ID NO: 6542 - DNA, 580 bp, Triticum aestivum
  unsure (1)..(580): unsure at all n locations
  Clone ID: PAT_TA_6542
gctcctcgcccatggnacgcatctcgtctgcgagctccgcttttccctttcccctttccccgtcttcccctcttcttccatctgtaggtgcgcgccccctccctccccccaccggcgacaggttatgccggcctgccatggcagctcgtcggccaatcgccgcacacaacaccctcctcgccttttccgccctcgggggttcatcaagctcctgctcatccgccaatcaccagcaccgcaccagtgccgacaaacccccggctgctgctaccacgacgtagtccaagctccaggccaagcggtgttggaaccggcagggggcggtgctgcaaccgttgtcatctaaagctggaatcaacaggtgtggctcctgcaagcccaggccgatgtgctggaacggcggctacatcgtgctacgacgggcaaacaagatgctggaacgggccttggcgggagttacaatcagcggccttttttgctacaaccgttcttttgttttgttggaattagcgacttttttgctaggatatgtaacttgagatgtttttttctggaaccagctctaatttttgctaccacc

SEQ ID NO: 6543 - DNA, 660 bp, Triticum aestivum
  unsure (1)..(660): unsure at all n locations
  Clone ID: PAT_TA_6543
ggtcacgctccacaccacacctgcgttctcgccccctcgcactagcaggcagggnaggatggccgggnagcagcgtctccggcggcggcggcggccgcccgccgctgttcgcgacggagaagccgaagcgggtgctggcgtaccggctgtacgcgggcaccatcttcgcggggatcctcctcatatggttctacagagccacccacatcccggcgaggggcggcagcagcctggggtggcgggcggggctcgggctgctcgtggccgagctctggttcggcctctactgggtcctcaccctctccgtgcgctggaacccggtccgccgcgccaccttcaaggaccgcctctcggagaggtatgatgatgaccagctccccggtgtggacatatttgtgtgtacagcggacccagctcttgaaccacccatgcttgtcatctccacggttctgtctgttatggcttatgactacccgccagagaagctaaacatctatttgtctgatgacgctggttccgctgtaacattctacgctcttcatgaggcatctgagtttgcaaagcactggattccattttgcaaaaattacaaggtggagcccatgtcaccagcggcctactttgccgaaggagctacccctcatgatgcttgtagccctc

SEQ ID NO: 6544 - DNA, 589 bp, Triticum aestivum
  Clone ID: PAT_TA_6544
tcatctgtttctgacaccaatctaaggctttgatatttgcactggcatccaaataatctccggggttgttatctcttgagccattcataccaggtgcaaacaatttcttcagcactccgtcaatgtcatagagacacacatacttcacaccaagagttttgagccaatataacagctgattgatcttcacggtattcttagcttctctgctatctaccacgatagcgaggtatttgagtctccccagttggagattccgatacttccacaacaacccagatgaaataagagaacactctagattgaaaatcagatgagaacataagcttaaaaggctgattgctaagtggatgatgcaccagagcaaacccaaagtgagctttataatcattgatggtagagacatcactattcgcagcggacgcgtggtcaggattacctttgcctcgaccatgtcaaggattgctgtcccaccagaatgtgcgcttcaaaggctgattgttcagtggatgatgcaccagagcaaacccaaagtgagctttataatcattgatggtagagacatcactattcgcagcggacgcgtgga

SEQ ID NO: 6545 - DNA, 1759 bp, Triticum aestivum
  Clone ID: PAT_TA_6545
aataagccgacactctagattgaaaatcagatgagaacataagcttaaaagactgattgctaagtggatgatgcaccagagcaaacccaaagtgagcttttttttttttgtttgaagagcagtttacgttcaaattgaaaataatttattttcctaaaccaaagttaaatatcgcacgcactacaacatgctgtccccttttttgctaaactttattcatgctaaagctctgaagtatcgattatttagtaagtaagcattatcattcgccttcccacaacataaggtacaggataaactgtcattcattaagaacacacggtaatacaccttacactcaagaatatgacaagatagggagtagaaaagactttgaagaggctggttttcgtactacgtggaagtttaccgtggcgggggcgacacagacgctgaggcgcatgcatcgaccggcacacactgccggcccacggtcgctttcgtgatgcacggaccaacgccgcagtagaagctccagttctatgtttttccatgcgaggcatatcctacctggagagggcgcgagcaccccggggcgacggcagtgatggctcagccgtggagcacggggctctccaccgtgaggccgggcccgatgccgaggaggcggccccagtcgatcccctccccggttgtggcgtggccatcctcggcggggcgcttgcgcatctcatccatgatgaaggggacacaggcactggacatgttgccgtactcggagaggacatgcccggtcgcgccgatcctcgcgttgggccggtgtaccttggcctgcaccaggtcagggacgccggcgccgcgggggtgggccccccaggcgccgcgggagcacggccgcatcggcgcgcccgcgcaaccagggtgtcgaggtgggactcgtgcgggccgcggaaggtgacggcggtgatctcggagcagacgacgagcacgcgcgcgccgcggttgttctcggcgaggtccttggcgaggcggagcacggtgccgccggcgaagcagccctgctggtacatcatgaggcgcttgacggaggggcgcaggccgagcatcttggtgagctggtagtcggcgcccggcatgtcgacgccggaggtggtgcagaagacgaggtgggtgatcttggaccgcggctggccccactccttgatggccttctgcgccgccgccttgccgagcttggggacctccacgacgacgatgtcctggcgcgcgtccagggagggcgccatgtaggcgcacatgttggggttctcctgaaggatctcctccgttaggtgcatgtatctcttcctgatctgcgacttgtcacacatcctcttgaacttctccttgaggtcggccatgtggtcgctcttggtgatcttgaagtagtagtccgggtagtcggcctggtacacgcagttcgccggcgtcgccgtgccgatggcgagcacggtggccggcccctccgcccgctgcgccttcctcacctcctccacggtcatggtggccgccatcgatggatctacgtacgtaccagcggccgacgagctaggagttgtcgcaccagtggccggctgtgtgacgtctaagtttgcgggacgcagagggaagcagctagcaggtggtagacaaatgacaggcgccgcttgtactggtggcgacgcggccgggcgagagcggagtagtcggtcggctacccctgaattcacgatctggacccggcgaaactcgaacgcgtggg

SEQ ID NO: 6546 - DNA, 885 bp, Triticum aestivum
  Clone ID: PAT_TA_6546
aagaacctaggggaatggacactgaagtatgagaaattgaaggaagagcatgaatcgttccgtgatatttctgatagaatgattgaagagaaggaacgggagatagctaaacttctcaacgcaaacaaggatcttcatcattctttagaggctaaagcagcagtcagcaaacgtgacaatcaaagtccaggatatattaaacaggatgcactaagtattgaattggctgagcagcaaattctgcttcttgcacggcaacaagcacaaagggaagaagaattgagtcagtcacataggcatatcttggcgcttcaacaagaagttgaagatcttgagcgtgaaaaccgtcttcatgatcaacaggaagcaatgttgaaggctgagcttcggaatatggagagatcacaaaagcgagaaggagtagatatgacatacctaaaaaatgtaatcttaaagcttcttgaaacaggggaggtgggggccttgctgcctgtggttgcgatgctactacagttcagccctgacgagctcaataaatgccaacatggcgtcctctcaaatgtcgcttccttaccagctacagcattgtcagatggtggatcgacaccaaactcattctttggaagattcacattctaataccggtgcaagatgttggttttgattatccatattttagcagaggtagatatttacattcatggggtgatccaaaatcccagcgattttactgattgtgaaaggtgacattcttttgtttgcatgcgtctcatctcttcttacctttcgtaaagtagtgtatattatataaatagaaaaccataactatctatatatgtactttcaatacaagcattcattttcaaaggggacattatttttccc

SEQ ID NO: 6547 - DNA, 754 bp, Triticum aestivum
  Clone ID: PAT_TA_6547
catctcgccggagcaaagaagctgaagcagcagccgctacatccttgccggcttcaccattcaccgggggacccgccaccatcggaagagagggcacaggcgctcaaggcgccatcagtgccacacctcgccgaagccgaaccggtagcggctacctcctcgccggcttcaccgtacaccggcgtctcggtcttcatcccggcaccgccgcctctacctggcgtgcccgcgttaccgccgttgcccggcttcccgggcatggcaggcgcgccttcgccttcgccttcgcagcagctggccagttgcttgggaccgctcgggcgtgtgataacttgcgctccgtacctcaccgactccgtacccgcgccgccgagtacatgctgcgacggcttcaggtcgctcgtcggcagcagcgcccggatctgcttgtgccatgccatcatcggcaacctgagtacattggccaggggggagatcgaccagcttcgcttgctcgtgctgcctctgacgtgtagcacgatcgtgcccccggacttgcttctcatgtgcatcctgtctccggtgccgccgattatgcctcagcactacggcgccgatgtcagagaaaggctcggtgctctgggcggctaggccattggcgtgctcagaaggagtgtctatttagaagtcgactgaaattgaattaggcttcagtcgagttcatgtatgtctatcatctatgttccccgcgcactgcatgtatgtcgattttcat

SEQ ID NO: 6548 - DNA, 778 bp, Triticum aestivum
  Clone ID: PAT_TA_6548
gatgtacggcgtgcgaggccatcatgaggatagatgtgaagctagctgacggtggtgttttgggtggtgtgatgccatccccaaggtgagctgctgcgacgacggcggcgagatgtacgtgaccagtggtgtgatgccgctgaagaacatgcaagtggagatcgatggtgcagcatggtgaagctgcagcgtgaggcaaggtggtgtggtcttggcgctgcaaagtcttggcaagtggttgtgggtgatctgcgttgatgataggagaatcaagattagggggtgaatgttagacttaatcttgattccatgtatctgcatatttagtttgctttcgttgtgcatgtaggataggttagagagtagctagtccggtgaagcttcagcggaggcacgcggagaagatgagatgtcaggctgccgtgcgacgcggcgagcacgaggagatgtcgatattgctatgcgataaggcaacgccgtgtgatgcggcaagatgcgaccgtggctggagcgtgacgggcggccctggcgggttgagccgagtgagtgggccatggcgggagtggggggcgtggctgaggccctagctgcgtgtgtgcgtggtgctagccgagtcaagagtcactgcatgcgtgagtttgttagtgattgacatgggcgtgcatgtagctagtcagttggcgaatgggttagtgcgtggagggtgctgttagtggccggaaatggtgcctggtagtggcgtgagtccagcacctgatgtatatatacatgttgcata

SEQ ID NO: 6549 - DNA, 708 bp, Triticum aestivum
  Clone ID: PAT_TA_6549
gttcaaatccacgatttggagacaagaagacttatcagatgaacccagccaattacagagaagcccttatagaaactgcagcagatgaagcagaaggagcagacattcttctggtgaaacctggattaccatacctggatattatccgacttctacgggataattcagccctgccgattgctgcataccaggtgtcgggcgagtactcgatgatcaaggccggcggcgtgctgaagatggtggacgaggagaaggtgatgatggagtcgctgctgtgcctgcggcgcgccggcgccgacatcatcctcacctacttcgcccgccaggccgccaacgtcctctgcggcagcaagcggccgtagctcatcacggaagtcgatttcttgtagtagtagcaccatggccatggcgcttcactgcattgcagagtatgtggcgcggcacggccatgctctccggtagatagaggtttgtcaccggcttcggtttggtgtaattaacgaggctttatttttaactgattttaggggtggttttttagaactgatgagaggtttgcgagaaggagacgctcgttcgtgagcactgacaggtgggcccgccaggcctgcctgcgtgggccgggccgccgggctgcatgcacgggtcagcttgacgttccggtgacatcaccggcttttttgaattgcacgcgacctggggcaccgc

SEQ ID NO: 6550 - DNA, 1098 bp, Triticum aestivum
  Clone ID: PAT_TA_6550
cgaattcgcggccgcgtcggcctccaaaacccgctgcttctatttctatagcctggtgggaagccattgcctgcaaagctgcggcatggctgccgcctcgtctggccgtgcagaggtcgacacctctcgcgcgttccggtctgtcaaggaggcggtcgccgtgttcggtgagcgcattctcgcgacggaagcacagttcaggccgggtgcacatgccaaccatcgtgttgttagggagaggagttcttggcgagactctgtcgccattgcttcctcaaaagagaagcttgaggggagttctgacctcatcaagggaagccactccaccaatccaaacgccatcgccgttgccattgccaagcacgagggaaatagcagtgagcctgctagaattgtaatgccagtgtctaatgcccagccaatgtgcctggtcccgttgtctccacggtcccaggcatcatcgtcgccgtctctagcccacggcgacggctacgacaagcaggacgggaaggaagccaatctcatgatcatgagctccatcaagaaggtggaggaagaggcggccaagacaaggctggaggcggtgcaggtcaagaggaggctggccgacctggagctagccatggcgaacctcaaagcgaagctccaccgtgccctctcgaggctggcatacatggaggctgacaaggcggcggccgcaagggccaacatccagcagagggatatcaacacgtcggcgctgacggtctgggccgaggccaagaccgagcggcacccattgcgacacctgctgagcctcgacgatgccgacgaggaggtgaagcatggcccggaaagggagatgacgacgacaacgacgaagaggaagatgcagaagcagaagccaatcatgccccttgttgttccgctcatcagtgaggtgcttttctccaagaagaagaggatgaacgacaaggagagcttgtacctgaaggagctctacagcttgctaaggctgtcttgatcggtggtctccatgctgattaaacttgtgctgatgtgtatggattgtttgattctgcatacatagagcattattttattacctaagtgttaatg

SEQ ID NO: 6551 - DNA, 255 bp, Triticum aestivum
  Clone ID: PAT_TA_6551
caagggcctcctctgcctgttgagccacctgtgcgccgcaacatcattccactgcacgcccaccttgcgtgccaagtagaagttcagtttcgcttgcaaggtacgtacgcctccatgtgtagtttcagtgtaatgtgtcgccaaattccccggtgctctattcctagtttcagttgatgatgttgtaaggatagaaaaaagcttgttatgcatgtttccagttcaccaagctatgggtgttcgttcttggtgcaa

SEQ ID NO: 6552 - DNA, 598 bp, Triticum aestivum
  Clone ID: PAT_TA_6552
ggccgctgccgccgccggcgagttcctctagcctgcctgctctcccccccggcccccgccgcccccgccgccccctccctcctgccccctccctccccgcgaaatccatggctgcggccgcgcattgtgccagggcgaccatgcgttccacggccttccagtgcgctgctgctaccgggtaccgaacagtcaagcttgcgcgccgcaagcgccgcgtgtcgtcggagcagaaaggaattcggcgccttgatgggccaatacagcatcgagggcttgtttcgccccggccatccttcagaacactggcttgcacaggacgaccgtccggcgacatggatgaacgatgggcccatatttgttcttctgcactttcagccaagcagggcgatatgatggggcaagtgcaagacgattgtccaccatcaaatctggagttaggcagtgcctaccccggtggtttgtcagagaaggaaatcgaaagaagacgaaagattagtgctgcaaacaaggggaaggctccctggaccaaaggaaggaaattaacccaagagcacaggcagcgcatcaagcagggcactatcgaggctctgagagatcc

SEQ ID NO: 6553 - DNA, 804 bp, Triticum aestivum
  unsure (1)..(804): unsure at all n locations
  Clone ID: PAT_TA_6553
tgcaggcaattcggcagacgcctcctttcccctctcctcgccaccagnaccccaaggcctccgccctttcgaacgactgccaccggcgtcccacagagggcctctagtttcttcagtatccctatccgcgccttcaccagtatctccggcatggctgctgggacgcagcagcagaccgtggaggttagggagagcgtggagctgacggaggaggaggagcggatcttcgctaggctgctggacgtcgtccgccacttcggactcggcacccagctccgcgtcgccgggggatgggtccgggacaagctattggggaaaggctctgctgacattgacattgcacttgataatatgacgggccaaaatttctgtgagagagtaaatgagtactcaaaattcatgggtgaagagcagaaaggaatcggcgttatccagtgcaaccctgatcaatccaagcacctggaaactgcaagaatgcttatatatggcatatggattgattttgtcaacttgaggtccgaaaagtacgctgaaaacagtcgtattcctactgtggagattggaacagccaaagaagatgcactccgcagggacctaacaatcaatagcttattcttcaatatcaacactaaatcagtggaagatttaactggaagaggtcttgaagatctgaaaaagggcctcattgatactcctttacctgccaagtcaactttcctggatgaccccctcaggggtcttagagcaattcgggttgctgctagattcagctttacattagctgaagatttgaaagaagccgct

SEQ ID NO: 6554 - DNA, 531 bp, Triticum aestivum
  Clone ID: PAT_TA_6554
gtcggaggtgagcgcacggcaccatggctctctccttccatatcttcctccccgccatgacctctctccttcttttcttccatctcccgctcgagttgtagctagcagaggtcatggcggaaactgcagatatgtgagattcgcgcgcgggcgtcggtgccctgtggatggaggtggttctccccgaccggtgctcccaccggcggcatagcgtgggcgtggccctttgggagagaggagacgagtcatgctggctgctctagtgcttggtggctgctgctcctaaccgtcgcgcttgaacttctgagcacagatctggcctcctcccctcttgatttcttctgatctggcctcttgtgtgcacagccggctgtccagatgcatgtggacttagtgctttgaagaatttgtccccatcgaggaacgatgtgatgctaaatcggtgttcaataggaacaacgcaatgcatatgtagtttgtgtggacggtggataagtttcctagctaattgctagaaatgcaaaaaaaaaa

SEQ ID NO: 6555 - DNA, 191 bp, Triticum aestivum
  Clone ID: PAT_TA_6555
ggaagggtcttcttcttccttgacatgacatcgatccatggatcggcttacttatatatatcgagtaattaagtggaggtggtgtgctcgatccaacgtgtgagcatctgtgcgtcatacatacaatgtcggtacccacagtacaatgctacaataggaaccctggagtatgtatcaacatttataaactg

SEQ ID NO: 6556 - DNA, 573 bp, Triticum aestivum
  Clone ID: PAT_TA_6556
gcacaaaatggctatgttcacctacgttctcattgcagctctgttgttcttcccgccatccgaatcgttcaccccatacccacaccaacaccacataaattttgagatagcgacagggaagttcgaggagctgatggccagcatggatcagatcgtgtcatctaacgtcgcgttaggcgcgttaggcgcgacgggacgccgagcgctggcgcttaaggatcgtcgccttctggggagcaccctcgtcaccttcttcaccacgttggcggtggaggtggaggctggacgcattagtctggcgcgctcggacatcggcgaggaggcttccgcatgaggcacatgtcttcgtcagatctcccgtgggccgttgttgccttatcattcccctaacctcccttatgctgtctgaggcggagcatttatgtcgttaatggttatcctcgtgtcgaatgttcctagtactagtataagtggtcgtgtcctgtcatcctgttaacttttactacatgctgaaattggattcataatcaatgatatgtaatcgggctcagagacttttcccgaaaaaaaaaa

SEQ ID NO: 6557 - DNA, 525 bp, Triticum aestivum
  Clone ID: PAT_TA_6557
gagagagagagagagagagagagagagagagagagagagagagagagagagagagagagagagagagagacgcacatgttgcttctccctgccgcctcctctcctcaccacggctcgccctcggcatcctctccccaccacggctcgccccgcagcctccacctccgatacgacctcgcgctgccagcaacgcttccggtctcccctgtatcgacactgccgccggtgtccaacctcagcgacgacgccagcctgcccgacgcagctcctggccgcggcggcctagaacgccgaggtatagaagcctgctccggctgccaagctgccgcccaacctgctctgggggttccatatgatacaagactcaaaggtctagatgatgacagaggaaccaaaggtctaacacaggatgcttcaaagtctcattttaaaaggtcaacaggttgatgttctttttcatatctcatcttgtcggtctgatatttgaaatatcacagaattattgttcagatgcacctgttatct

SEQ ID NO: 6558 - DNA, 684 bp, Triticum aestivum
  unsure (1)..(684): unsure at all n locations
  Clone ID: PAT_TA_6558
gcttttgagctagnacaagctactttccctgaattcagaggagaaagagcctacggtgatgctaggcttggctgagtacaataatgcggtggtggtgcagacggttgccggccacttcatggtccagcttgtgtcattgcagttcaagaagatgtccgaaaccagcagctggcatttccatcaaccatttgaaagtgtctatactggagaaacaagcattggtggtggaggacacaatggagctgaacttttgcacaacgcttaagatgactgtctggttcagtatgttattatgacgtattggttgagtaggtgtctagaactgcgttctggttgctgagatgcatgaacgggattgtatgctgcaggttcttccattttgtgcgctttcacatgtcgaccgactctctgtagcacacactcgtcgtcaagtgtggagagtaactgcaggaattaatcgtttaatttgataactacccgctgttattatctaatcgaaacttcttcccgcacaatacttgtgcccgacatgtgcacgatgtgcaaatccagcggctaatgcccttctcagtcatatgcatgcccggctggattcagtcatcgtctatgaatcatgcaaaacttgccgtgtgtatagcacgaatcttatctaatttctgtacacaaatagccattcaactttca

SEQ ID NO: 6559 - DNA, 1326 bp, Triticum aestivum
  unsure (1)..(1326): unsure at all n locations
  Clone ID: PAT_TA_6559
gcaaaaaaacccaggccgtcggacgccatccctagccaccgcgccgctatgtccgccgccaccgccgcgctccggccaaccgagccgttccctctcccgagcggcctatccctcgcgcggcgcctgaagctgctcctctccttctcccgcgccgacctttccgtgagccccgtcgacgagtggcagctcaagtccgcgctcctcgccttcctccgcaacccgccgctctcgctctccctcctccaagactccgacctgtccgtcagccgcctcccggacctgcagaagcgccgtcgggacgatcccgtcgcctccggcatcctgtacgtccgcgatctttccttcctccgcccaagcaaccgcacaggagacgacgaagccgagaagatgaccccagagcaggaggagaagaagtactcacagtggcggagctccctgatcgagaagctcgatggcatcgagctcaaccataagggggttatgtaccggatgagtgccgagatccccgcctcagatgacttcatggccatgaagaagtcatgggaggatttttacgcctccgagctcttcagtactaggaatccggtgaggaagatagcaaaaagaccagatacaattcttgtgagaggtgtgccgtccaggtggtttgcggagacgaggatatcgtcgaaggcgtccacattggtcacccacactatcttctcagctcttggtaaaataaggaccttaaatatttctaatgatgatgaattagatgaaaaaaaagatgagactaataagggtctcatatctggactcaattgtaaggtgtgggtgcaatttgagaattatgatgacttccacaatgcaatgaaggcattatgtgggcggtcattagagaaggaaggatcacggttgaaagtgaactatgatgtgacttgggacagggaaggtttctttcgtaatacacaatacgagcctgcacataacaaactagaagaaatagatgcaccggtacatggaaggaagaaacattacacctcgcgaatcgaatcagatcataggaagagattcagggattgatggcgcaaaggacatgatgggttgtgaaattacatgtcataaggaggagaattggttgtattctgtggtctgtaccattgtgatgtcccctattcgttttttgtcaccttttacttctcatcattagtctaacagtaaaatcattccggccgagtcgctgatttgcactccctccggccctcggggtgggaccttgctgctaccgtggggtcccgcttgtctagacttagcggtgctcagtaagattcncctttagcaaaaaan

SEQ ID NO: 6560 - DNA, 199 bp, Triticum aestivum
  unsure (1)..(199): unsure at all n locations
  Clone ID: PAT_TA_6560
ggttcgatgggcgtgcgtgcgtgcgtgtgttgatacttgataagttgatgataggctgatagccttgtatggtcacgtgttatgtaatgtacgtagtacgaatacctcatgcaagagcgacaggagacggcgtgtttgttcctnccgtgacaccagaaagaaatgtgatgggagatcgtttcgacactcaaaaaaaaaa

SEQ ID NO: 6561 - DNA, 592 bp, Triticum aestivum
  unsure (1)..(592): unsure at all n locations
  Clone ID: PAT_TA_6561
gtcccctcccgctccccgtctcgcccccgcccccgatccggcccgcgcctccccgtgcctctcctctccatcactcaccaccaccgccataacatggagctcagccgtccagcgtttcttcctccatcgttcctgctacgccggtctccaccaccgccttctctaagttcacctttggctcccgatgtcgccgtgtctccacctgcggcgccccccgcccccgcggccctccgtccccgcagctccgttgcctccctccctggtcggcgacgttcccgctggccgccctgtagcccccccgggaggcgcccttctcgagctcggtgttggctgtgctccccaaccccccccgccagcgtcagctccggcaagtcggcccaagaccaccagcatcacgccctccccaccatggtaggccgagctcctcctaacgctggcctcctccagcaaggtcctccagctccctctcctctgcaacgccctcgccacccacactccctgtcgatggtaagagtagaactgcctagaatggtcgtgcggtggaaatgactccgctttgcttctgaagtaacaaatttctggngatgaaact

SEQ ID NO: 6562 - DNA, 827 bp, Triticum aestivum
  unsure (1)..(827): unsure at all n locations
  Clone ID: PAT_TA_6562
gcttagnaaggcccaggnattggtggacataggctactagatatgagaacccagccacaaaagctgactcgccgatgtgaagtcactgcaattcttgtcttgtatggactcccccaggctactaactggctccatccttgcccatgaattgatgcacgggtggttgcgcctcaaaggctaccgaaacctaagcccagaggttgaggagggtatatgccaagtcatgtcttacttgtggctcgagtcggagattcttccagcttctacaagacacgctcaaccttcaacctcttatgcttcatcctcgtcgtcttcctcgtatcgaccaccatcatccaagaagggtggcatatctcacaccgagaagaagcttggcgagttcttcatgcatcagattgccaatgacacctcaacagcgtatggtgacggattcagaactgcctataaagctgtcaacaagtatggccttcgccagacactgaaccatatacgtttaactggagggtttcctgtgtaacacaaggaaacaccatgtccatatcggagaaatgcagagatcataggcacatacataaggagatgaatgtgctacagaagaagggttcggatttcagtgaccttgcattttcagaggggtcattcagagtgaatcaggaaaggaactgcatttgctcgaagtaacaggatggaaggtgtaataagatgacacaagaaacaccaatgtaactagcagcattgccgatgctaatgtattgaggtatttatgtatgtatatgtgtaaagtcaagttgtctattattgcataagcatgggcaccaaaaaaaaaa

SEQ ID NO: 6563 - DNA, 925 bp, Triticum aestivum
  Clone ID: PAT_TA_6563
gacactacttgccttgacccggctgatcgtttgacagcgtcctctgcattaagaagtgatttctttaccactgaaccttatgcatgcgaaccatcgagtctcccaaaatatcccccaagcaaagaaatggatgcaaagcgaagagatgaagaagccagacgttcaagagctgctggtggtagacctaatggtgatggagctagcaaggcaaggacacgtgaccggcccaggggagctgcagctccagaggcaaatgccgagcttcaagtaaatattgataaaaggaggatagcaagtcatgcaaatgcgaaaagcaagagtgaaaagtttcctcccccgcatcaggatggtgcagttggtttccctttgggttcttcaaatcaaatggacccactgtatgaacccccagacccaacttccttcagcactgtgttttctcatgagaaaagctccgtgcctacttggtctggaccattggtcaattcttccgcagttgggaaccaaaagcggaaacacaagtccagccgctcatcaaaacaaccgtccactgcccgtgctcggtaagttgccgagaagtggtacttctagagaaaacgagtgtccactccgcgctgttgcctgcacaatgtttggcaaacaaggcgtgtgatgataaattaatttgtcgcttcatgaatattttggtgcacttttttctcgtggaatctcattgtatagactggggaaggaactcaagcagttacttgtgtacattaggttctcctttttctattcttataagcaggtgcatttgatgttggattcaattgggtggaagcttagatctctagcatttcaggacatccccttccattgtaacaccttttacagttgaacctatatgatcatttctcatcaattccagttgtaattttgaacttgtggt

SEQ ID NO: 6564 - DNA, 567 bp, Triticum aestivum
  Clone ID: PAT_TA_6564
gtgtatatgtgagtgtgctattcaaaataggtataataatgttttggagcaaaaaattcatgcaaatatgtaatatgtttgagtttaattcatagtgcaaagttcctccaacacttacatttagagaaaacaatttctaaaaaacactactggtgaaaacaaaaatgacaaaaggagaaaatatgtagagtgagaaagggagaatattataaatgcattaactcttcaattgtgacacacagaagtcgcgatctctcttaatgatgaactttggtaataactatgtcctatatatttcttaagaaagaagtaaatatttaaaagggaattaatgataatatcaactgctagtgcggcaactaactgaccggaaaagaaatatataaaatatattatttaataaatttggccgcgcaattgcactggacatatatgaaattatcctcatggaaaagtaaaataccgatttagcttccgaacaaattgtatactacgtccataggtagctgaaaattgaaatagaattcggtaaaagtaaaaaagaaattgtccatattgttttcaaaa

SEQ ID NO: 6565 - DNA, 1954 bp, Triticum aestivum
  unsure (1)..(1954): unsure at all n locations
  Clone ID: PAT_TA_6565
cacccatccacgcgcgctcgcacgccgccacagaggaatcgttctggcattcccgttccgcctccgtcgtcgtcgcactcctctgctgggccagcatagaacggagatccacccgggcttggaggattggtttcttcggtgctgatgcaaggtgtttgttgtatctgagaattcagaatatgggttctcggtttccatcccaccaattaagcaatgggctttatgtctctgggcgacctgagcaaccaaaggagaaggctccggttgtttgctctgcagctatgccatacactgggggtgacatcaagaaatcaggagaactagggaaaatgtttgatctccatgctgagaagtcacggaaatctggccctttgggtaatcaaccttcaaggaatacttcatttggtggtgctgcttccaattctggaccagtatctagtgctgcttctcgatccaactactctggctctatttcagcagcggttcctggcactggaggttcggcaagggcaaaatctaattctggaccgctcaataagcatggagaaccaacaaagagatcctctggcccccagtcaggaggagtgaccccaatggctcgccagaattctggccatctaccgcctattcttccgacaactgggctcatcacatcaggacctatctcctctggacagttgaactcatctggtgctctacggaaagtatcaggcactcttgattctactgtttcgatgaagatgcgtgccacctcttctgcttacaacccggctgttacaaatattaatgagcaaaatagctactcaattaaggccagtttgccaaagccaatactatgggcggctattctgctctttgcgatggggttcatagcaggtggcttcattctagctgctgttcataattcaattttgctggtagttgttgtggtgatatttggatttgttgctgcgctcttggtttggaacatttgctggggaacaagaggcatgactaggtttgtcagtcgctatcctgatgctgatcttagaattgcgaaagatggagagtatgtgaaggtcacaggggttgttacttgtggaaatttcccccttgagtcctcatttcaaagggttccaagatgtgtatacacttcgtcctgcttgtatgagtataggggctgggactcaaaagctgccaacactcagcatcgccgatttacttggggattacgttcaattgaacggcatgcggtcgatttctacatctctgatttccaatctgggctgcgagcattggtcaaaataggatatggtgcacggctaatcccatatgtcgatgaagctgttgttattgacataaatccagaaaacaaggacatgtcccctgaatttttgagatggctacgggaaaggaacctctcaagtgatgatcgtataatgcgcctaaaagaaggttacgttaaggagggaaacactgttagtgtcatcggtgttgttcaaaggaacgataatgtgctgatgattgttccaccacctgaacccttcaacactggttgccagtggggcaagtgcctcctcccaactagccttgatggactagtcttaagatgtgaagacacgtcgaacggtgatgtaattccagtatagctatctagcctcgttctcgcagttcacctggggaaaagggaaaacaatatttgactttgggttcattttatggattgaaaaatgtgcaaatgcaaggtgtgattaaggtttagtacaatattgatagtcagttgcccacggcttgattgtgtagtatttttttgcattttgctcttttttggttgggcaatgaatacctgtaagattgatggcttcagtactaccatggagctctttggagatagagtggaaccatgttcatatgttcttttttattttggtttgtagcattacagcatcataaaccatnctccagttgccccaat

SEQ ID NO: 6566 - DNA, 579 bp, Triticum aestivum
  Clone ID: PAT_TA_6566
aagaaaagaagatgaagaaggcggcagatgccggtgcgaagtttgcccgtgagaacagtaacaccataaaagataccgtcaagaaccacctgcctggaggagacgccccaaagccgaccgaggacaccggcgcaccggcgcaacgcctccccatcaccaaccgcccgcccccgaccccgcccccgccccctcacgccgaccttcccagcacaaggctcaggaactgggtctacacggaggtcgctccaagtgtggatcttgttcatgttggcgaggcggcggctgtcgctgtggccgtgggggtggcgatctggtggctgaatgggggattctagaagtatcggctcggaatgaacaaagctagctgtttgagcttaagaccctgccctgcttgggtgaaagcagcctatcttcattttactgtttgttaagttaagcatcccatcgtcgttctgtagtaaagtagactgaaggttgggactatgtaagcagtaagcgaatatgaatatgtaagcaagtaagcctactatgatgatatatctatgtaatccgtaagcgaatgaattttgaaggttcggg

SEQ ID NO: 6567 - DNA, 870 bp, Triticum aestivum
  unsure (1)..(870): unsure at all n locations
  Clone ID: PAT_TA_6567
gattcgcacgaggcccccgcctccgcccgccgccacggccccccgttccgcgccgccctcccgttctcctcgctccgcccgttctggattcaaatttcgaatccccccaccgtttccgcccccctgcaccaaatacctgacccgattccttttcctcccccctcccaccatgagtgacgcacccggcgcagcagcctcagctatgggcagtggcagggagctcgccaacccgccgtcggacggcatctccaacctccgcttctccaaccacagcgaccacctcctcgtttcctcctgggacaagacggttcggctgtacgacgccgaggcgagcctgctcaaaggggagttcgcgcaccccggacctgtgctcgactgctgcttccacgacgactcctccgggtttagcgctggcgccgaccacaccgtgcggagattatcatttacttcgtcaaaggaggatgttctggggcgtcatgatgctccagttcgctgtgtggagtactcttatgctgcaggacaagtcataactggcagctgggacaagacaattaaatgctgggatcccagaggagttagcggaccagagcgtacacttgttgggacatatgctcaaccagagcgtgtatattctatgtcactggtaggaaataggttggttgttgcaacagcaggaagacatgtcagtatttatgatttgcgcaatatgtctcaacctgagcaaaaaagggaatcgtctttgaaatatcaaacacgctgcgtccgatgtttccccaacggaacagggtatgctctaagttcgtcaaggacaatgtcatgagttctcactgtcgagtcgaaatcaaaaatatcttcaggtatcgnaatcgn

SEQ ID NO: 6568 - DNA, 572 bp, Triticum aestivum
  unsure (1)..(572): unsure at all n locations
  Clone ID: PAT_TA_6568
ggnctgcaggnaattcggcacggggcacgcggcggctcagcgcttattcctgggaggaggaggaggaggacgtacacgcacgggagggtcgatggagatcgacgccgacctcctcgtcaccagggccgagatcacggacgccgcggcggccacgttcgcggactcaaccgtgatccccgacaggtacgcccggccggacgaggtcggggacggggtcgtggtgggcgacgacgagagccacgagctgccgctcgtagacatggcgaggctgctcgactcggagtcctcggaggcggaggccgccaagcttggctctgcgtgtcgagactggggcttcttccagctaacaaaccatggactcgacgaatcggctgtgcaagacatgaagaataacgctgtgcagttcttccgcttgccactggagaagaagaacgccgtggccatcgaggccggccgtttggaagggtttgggcaccacttcgccggagcatcctgcgacaaactggactgggcagagagcctgatactcgcgacgcaagagaacgagcagacgaacatggagctctggcccg

SEQ ID NO: 6569 - DNA, 971 bp, Triticum aestivum
  unsure (1)..(971): unsure at all n locations
  Clone ID: PAT_TA_6569
gcacgcattggtcgcgtccagnaccgtcgttttgctcgagcccctcctcttcttgccggctcagcgtgcccgtgcatgtccctcagctccgcctcgttgtctcccttcgtcctggacccctcccctctctggcagcttccttgtcggcgctcgccgccgcgcgccctgtggcgcactatgcttagttggctcggtgcgtgccctggccacttcctccccgtgccccctcgacctcttccgccccctgagctcctccctgtacctccccgtcgccttatgcccagcgagcaggtgagcacacgcatatgcggccatcgccgagccacggccacgagttcgcggtcgccctccatcacccctcctataaatggccagtcctgagacctcccgagctcaccagcctcttccccatcctcctctacgcctccctgtcccatccattcgctcccggggtccctcttcgcctctgtcggccgccatggccgccgcctcggccatcccaaattcggacgagttgtgcctcttccctccctctctccaccaccaccagctcacccgagctccggcgagttcccccatccacttccctcgtcgccggagcaacctcggcgccgaacccatcggtcgccgaaccagccatctgccacgttcaacatcccattcattctagtgctctccggcgaacgtgactcctctagttgggtacgccactctgcgccgttcatctcggtggtcggagctccgcctgaggtggaccgagctgccgggacgggcgccggcgccaagctccctcccctgcatcacggacgatggaggatgaagccgatgacttggcgaagcaggcctgtccatcccctcagtcccatacgtcagccagacgggggcattgacctcggatccgcatgcgttttaagtggaggcgtactatgtgtttacgtgttctacaagtgaaaatatattcttctgcgact

SEQ ID NO: 6570 - DNA, 826 bp, Triticum aestivum
  Clone ID: PAT_TA_6570
gcacgaggacaaaacctgatgcaagagtgaagttgattccggcagaagacatcacttatgtacggcatggaaagccttttggtagaacagttggctcagcaaaactgcagaaaagacactgcagacgaagtgtcactcctcctccgagttcgcgtaaaatttctcttgcgagatcaacaccacttactcacaagtctacgacaccgtttactcccaaggccatgccaccgcttaatcacaaggcttcggcgcctcttacccacaaggccgcgacacctcttactcacaagcccatgacaccaccccatcctgttgcctcgtgtctttctcctaagagagttgagacagctcacaaggccttgagacctcttagtcccaagcccactacaccacccctgcctgttgcatcgtgtctttctcctaagagagttgagacagctcacagggccttgggacctcttagtcccaagcccacaacaccacccctgcctgttgcatcgtgtctttctcctaagagagttgagaaagctcacaaggcctcgagacctcttagtcccaagcccactacaccacccctgcctgttgcatcgtgtctttctcctaagagagttgagacagctcacaaggcctcgggacctcttagtcccaagcccagtacaccacccctgcctgttgcatcgtgtctctctcctaagagagttgagacagctcacaaggcctcgggacctcttagtcccaagcccactacaccacccctgcctgttgcatcgtgtctttctcctaagagagttgagacagttgaaaacaggcaatttttctctctcaa

SEQ ID NO: 6571 - DNA, 371 bp, Triticum aestivum
  Clone ID: PAT_TA_6571
gcggcagctggtgcagcagagcctgcagagcaacatgcggcggatcgtgcggcgggcgcggctcccgcaggacctggcgccgccggacggcctcaaggcgctcacctcctcctccacctccaaaagcctgccgttctaagccccaccgcaggaggagaggcgactttgttgcatgacagtgggcaatggtggtgcaagcgttggaggccgggaatctcatctcttggtgcctgtggacggagtgatgggcgatgcttgtttatgctctgccatgacggagctcacgtgctcggatgcatcggcagacgggcgccgagatgttcttctttctcctcctaatcgcttttgcttttggtgttttaaaaaaaaaa

SEQ ID NO: 6572 - DNA, 625 bp, Triticum aestivum
  Clone ID: PAT_TA_6572
tcccaaaccatgcccctgccacgtgctccgcactcttagaccgcaggcagagctccagctcgacctctagctagcatccatggcgcagcctctcactcgccgcccgcccctcctgcggcctcccctgcgtcgccggctcctccccctcccgctcctcgccctccttctggccgctcccgaccagcctgcgaccgctgccgcttcgcgtgctggccggacggggaccaccacgacggcccacggcagcatgagggccagcagcaggtccctgctccagcagcagccgcctcccagactagactgccccaaggtgtgcttgggccgctgcgccaacaactggaagaacgagatgtgcaacgacaagtgcaacgtctgctgccagcgctgcaactgcgtgccccccggcaccggccaggacacccgccacatctgcccctgctacgaccaaatgaccaacccgcacaacggcaagctcaagtgcccttgatctagagcacatcatcttcagatgtgtcttctgtcatgcatgttctactgttcccaccctcagggcagtaacggcctgccatcttatcaaagcataaataagaagagagagtttctaaaaaaaaaaaaaaaaaaaaaa

SEQ ID NO: 6573 - DNA, 851 bp, Triticum aestivum
  unsure (1)..(851): unsure at all n locations
  Clone ID: PAT_TA_6573
cgtccgggtaactgtattgtgcatgatatgtttggccatgaagttgtggaaaaaataaaggaggaatactgtgatgcatttctaactgcacactttgaagtcccaggagaaatgttctctttgtcaatggaagcaaagacgagaggaatgggagtagttggatccactcagaatatcttagatttcattaaataccatttgaagcaagctctggatcggaatgttgatgatcatcttcagtttgtattgggaacagaatcaggaatgatcacttcgattgttgctgctgtccggcaattatttgactcctatgaatcttccaaagaaggtgctagcattgaagtagaaattgtgttccctgtttcgtcagacgcaatttctaagacatctattgatgattcccatcatttcggctcttcagtagcgaatgatttagaacagattaatattgtgcctggtgtgttttctggtgaagggtgctctatccatggtggctgtgcatcatgcccttacatgaagatgaattctcttgagtcgctacttaaaatctgccagcagcttcctggtgaagacaacagtttatctgtttatcaggctagtcgattgaatcttaagacttcccttgggatgttggttgcccgggcagcgtgtagcccaagctcccgtacccgcacattccacgcaagggaaagatcaccgcccaagcccgttcaccaggttatccatggtaacggaggggaacctttatgatggccgttcctcagaatcttccctgtcaactttattcaggtgtttatggatgatacatcagtatgttgccccacttgagtacctcggccgcgnnnacgcta

SEQ ID NO: 6574 - DNA, 1966 bp, Triticum aestivum
  unsure (1)..(1966): unsure at all n locations
  Clone ID: PAT_TA_6574
ctccttctcctgctcctcctcctgcctcccgcgcgctcccctcctcgcccccgcgaggccgaggggatcgtccggccgaccggagccctggtcgactccggtgggcgcccgccctcatcgcccctcggctccgcgcttggctttcgtccccggccccgaggccggctcgccgccggcggatccgtcgccggagctactagggtttcgcggcatcgggcctcgccgccgccgagatctagggtttcgagctcaggaagggtggaagtttcctaaggctagatcaatattgaacctgatagttaccacagctgacgaatatcaaacaatcatgaaagctcctgagcagcgccgtaaaccaactgatacagaagcaaaggccaaacttggtggtgataagttgcattgcctgaagccaggaaaatacacccacaaatcatcaggcaatatcggggcaaaatgcagaagagaagatgctcaatcatttaccagcagtaagattgcattgaagggtggtagctttatggaagtaccatttaacaattcgacaaacttacctgctcaaccaccaaattattctaaaaagatgaagcttcagttttttccaatagatgaggcgattcaaaaggttctacagcaggaagtaaacacaatccttacctggnagttgactttggctccgcgaaagaagatgtcctcaattgtgcaacatctgaacacaaaatggggccgttctagctgtgcaaaaggcgatctcatgctcttcccatacagtgctacaccagatagcatagccagcagtaaaaaatggacccttaatgattcttgcactgctgctgatgtttatgttgctgttggcagcccttcaacattccgtttaaggtatggttggttcaagcctaatttgaagcaacaaaccagtgaagcttccttggcaccagtgcactctgcagaaaagactttgggcgacaaaccttcacatccttttgagtttccaagtaaatttgccagtccatccgttgagtgtaacacagagaagaccgtggtggataacaaccaaagcaaagcgacaccgctttcatggattgacagcatatccaatatcagttttggagcactgctatcgcaggctgtgccctctcaagacagcaagcaaccgcctttgcaaaacagcntcgattttccagcagcagattcctgccacgtgcgattcattcgatgctgccattgcttccttgattgctcgccagcaaacaagcaaccagccaaaggtgtcaaatccatccccctgggaagcagatgaaacctgccatgcattccctcctccccggaatcaaaatttatccagggtgccctcttgtggccctggcaacagcagtgctattattacctcaactatccttggttccattgctgaatccggtacagacggcgaccaccagcaacactggctaccagcgctctaccgaaggcacgaaagagggaccaaggccccctcagacaccaccaggcctggggcaatgatgatgatgatgtgaagcctgatgtgtcgtcgacggtaccatttagatttagggccttattataacaagacaaacatcgatatctttngagatgctttgctttgctttctccttgcacgtaattgttgataggtttttttataaatgggttactttcagacctgaatccacgaccggtgatggttcattttactctagtcctttgagtggaaccgacggtttggtaccgaacagcttggatgcgttcccgaagttagccggtctcgtagggcttggaagtttcatatgcaagacctgaagtagttacagatcctgtaaagatagatcagatcatcgtgctgcttcagtcggaattgattaccttgggcttactgaagccgattgtgcagatagataaatcatccaacgacacatgttagtcgcataaactttttttcttttcttac

SEQ ID NO: 6575 - DNA, 190 bp, Triticum aestivum
  Clone ID: PAT_TA_6575
ggccgagcgtgcgggtgtatgaagccgagatcctggccatcgacgggcggaagatcaaccgtggcgtggcgatctgccacctcgacacgtcagactggagcccggggcacggcgcgttcgtcgcgcttggcgggaagcccggtgagatggaggtgtgccattggatcttccagggggacatggtttggac

SEQ ID NO: 6576 - DNA, 1230 bp, Triticum aestivum
  Clone ID: PAT_TA_6576
caggaattcggcacgaggggcagatgggagagagatcgcagtcaagcttctcacaaatgccgcccgtcagggcatccgagaattcttgaatgaggtggcgttgctttcgagaatacatcacaggaacttggtaaccttccttggttacagtcaacaagacgggaagaacatacttgtgtacgagttcatgcacaacggaacactaaaggagcaccttcgtggaggacctaatgatgtgaaaataactagctgggttaagcgccttgagatagcagaagatgctgcgaaaggtatagagtacctccatacgggatgctctccaaccataattcacagagatgttaagagtagcaacattttacttgacaagaacatgcgggcaaaagtcgcagacttcggcctatcaaaacctgcagtcgatgggtctcatgtatcaagcatagttcgtgggacggttgggtatcttgatccagagtactacatctcccagcagctaactgagaagagtgacatatacagttttggtgtcatcctacttgagctaatctctggccacgagccgatctctagtgacaactttgggctcaactgccgtaacattgtggcgtgggctaggtcgcacattgagagtgggaacattgacgccatcattgacgcatcactggataccggctacgacctgcagtcggtgtggaagatcgcggaggtgggcatcatgtgcgtgaagccaaagggcgcgcagaggccgaccatctccgaggtgctcaaagagatccaggacgccatcgccatcgaggtgcagcgggaggcgccccaagtccagcagctcatgtccaagaggtccatgggttctgtctcgatcaacaccgacaacagtgtggatttggagcagaatgcgtcgtttgatgaaatgctcatgcggccgggcctcagatagaatcaggattcaccaaagtcgcttttcgtgtaagcaaggaggagaggttcatgtgttagttaggctttctgtttgctggtaattatttgaaagctgtggatgacattagtttagcttggaagtacaaactgggaatttgatggtgaaagactggtgatctggaactgttgttttatttgtttttgtgcttcagattggttccaaacttttaagatgtcaggtgggcgccaaggagatggggcaaatagaaaacgtgacagtatgggggtttgcaatcaaaatcacacgccaaa

SEQ ID NO: 6577 - DNA, 753 bp, Triticum aestivum
  Clone ID: PAT_TA_6577
ggcgccgatgtggacagcgagtcgaacgccaaggaactgcatcacgtgcaggcacgaagttactcaacatctttagtccaagaagaagtggaaacagtgcaagcttagatgctccaggcacaaccttctcatagttttcaatattttacttatgttttcaatttttttataaattatttgcagttccatctgcttctcatagtttgtgcaatcttcaaattcaacttgtgttcgaccctcccgtccgcacaacctatgatactcgcttgatcatcatgtatattctataaacataaagtgatgcactgaatgcattatgctcttgcccattgttattgtgtttattcctatcagttaagataaatatataactctcaaagttttaactatgggtgttggaggagatagatcgggcagaactacaacctgaggttgtgcaggtttacggatacctcttgccaaggttatattattttaggttttggcgaatatatatatatataataggtaaataaagatcagttcgtcactcaaataattatgaataccaatgtagtaaaggtatgatgtacactttcaaataacattttataattctttggtaacatcactgaaaactattgaattgtgttctctaatttattatagttagctttgtttcggattgggtgctaatagaaaacatatctgtgtattgatgcattcacatttgaagggaaacggctgaaaatgaaaggcgacatattcgatagt

SEQ ID NO: 6578 - DNA, 617 bp, Triticum aestivum
  unsure (1)..(617): unsure at all n locations
  Clone ID: PAT_TA_6578
gtcttaaacctgaactgagaggactaatatggaagggtgcatgcctagcaataaatgtggacaaatggtatgcatgcttagaggaaataagggcatgccatagtttaccggcaccgtcagaggatgagaagcttcctgttgggacaggtagcaacccagtcttcattgtctctgacaatgtgattaaaatcaatgctgaaggaggcttgggttattctgcccatggtttaggcacagagcttgagttctatgatcttctgcgaaaagtaggctcgcctttggtcaaccacatccctgagatcattgcaagtggctttcttgtgtacgaagatggcgtctacagaacagtcccatggaatggaaaaggaatgccaagatgttttgggctaaatactatcctctggagctttcttacgcaaacaagctgttttcctcttgggttatggagcaaacaacagtttggaatggatggttccgctgaatcctcgaacangacctatttggccttacatgggtaccagaaaatgcaaagggggatatctttgctcatggccgtgatacattgtccaaggctgacctattgaatcttgcatcatccttgggagttcaaatgcgaa

SEQ ID NO: 6579 - DNA, 590 bp, Triticum aestivum
  Clone ID: PAT_TA_6579
gcctccgcctccctccttcccatcccacggcgcacaacacccgcgcctcctcctccgcctccctccttcccaccccacgccgcgctagggcttatcaaaaacccccaggtgcgggcggtgtgtgcgcctagggcggtggtgatttttgctgtctgcgaggaggatgcaggccaccgggagtgtgacctgggtcgtcggcgcccaggcgtccgtcttggggagatgcagcggcggggtgccctacccttcgtcgtcgtcttctgcttcctcgggcaggtcccaggggctcggcacggtgcggtgctgcgtgcaggcgcaggagaagaagccacgggtgaggaagaccaaggaggagcggagggagatggtcgagtcattcgtcgacacgtatcgggtttcaaacaacgggaaatttccttcagtcaatcttacacacaaggaagttggaggatcatattatatagtccgtgaaattatgagagatatcatccaagagaacagagttcttggccctggtgacttgaatgctaagacgttgagttttgaggattgccctgattcttcagaattatcaaataggcatgaattgg

SEQ ID NO: 6580 - DNA, 763 bp, Triticum aestivum
  Clone ID: PAT_TA_6580
gaggtcatcaggagagtacatcccttctgctaaggttggttcacggctaccacacatgctggtgagaccactgtccgcttcgagtgagggcgtgttctcaacactggacctagtaagtggggataaaattgagtttgttatcatcatcgcaccactgaaagagtcatataagcttgcccaggctatgctgaggatagcagatgaattcgagctatcagccaaagtttgtgtcatgtggccacaaggttcaagggacgtggaagcgaaagggagcatagctgagttggcaccctggacaaactatgtcgatgtcgaggaaataccaagggcaactgtgaactcatcatggtgggagatgtgtcaggtaagtaacagaagtgttattttggttaggcctgatgagcacatagcatggagaacagaacctgacatggtgagagatgcttattcagacgttaggagagtcttttctcagattttgagtttaaataggccccaggtgtaagaatgcccagatatacattcagtaactgactgggttccagtgccaaacttagaacttcggccactagacgtggacattaaccgttccatgctgcattatttgcatgtacatgaccgtcaggtttgtttcttgatatcttctcacacatgttggttacattatcatacatttgacatgaacttcccggagatgttacatcaatgtgaataaaattatctttgttccttcaaaaaaaaaaaaaaaaaaaaaaaaaaaaaa

SEQ ID NO: 6581 - DNA, 339 bp, Triticum aestivum
  Clone ID: PAT_TA_6581
ttccgagtccacgggcacaggacattcctgcaggctatgtcctccgagcctcgtgaaatcatgaggacagaagcttccgtgcctacttcaactctgcaggaccaatgaagcttgaagtttacaagttgggggatgccagtgatactgatcttgcacgctgcttgctgctgtctacttgatgtttttaaatttaagtcaaattaagcgtcatgtgtcgttaaactttagttatgtccagtcttgcgattttggttcgtgtgcctgtgtgctaaactactgttggatcttggatgctatgttttgagtcaagatatgattatgtacaatctatctattgct

SEQ ID NO: 6582 - DNA, 1189 bp, Triticum aestivum
  Clone ID: PAT_TA_6582
cccccctgccgccccgggtttcggtcagcttgcccccccggagtccctgagagcaaagaggagggtgagaaggtgagaagaaatgaaagaggaagaagaggaacaagaagagcaaggaagacgttgcctgggtcgatcggctggaagattgaaggtgttgcagagcctgctacccaattcccaacaaggtcactccatttttccttctttctttgtcgctgaatttggtgctcctgcgtttatgtttgtgatgaaattaatgggttcatgtttgcattggtctgcggggttaggcatcaattcttgatggggccgttgagtatcagaagcaactgcatctccaagtataggtcattaagcatgcctggattcatttggatgatgatctcagtttgagggagatatcggtctcatcgatgacacatgcggggtaaaacttgagtttttaccatttgtcagagcggaggtttttctggggttgtgcatgtcgagcctgtttggctgtttatgagcaggctacactatagtcgatcaagcccttgcaagatagtaatgcatttttgcattctaggttacaatggcgataataaacaagacgaccatgcagatctgatagagaagagacccaccccggtgacctcctacaaccatggtcgatggcagccctagcaacgtgactcgcggtcacaggagagaaggatctccgtaccctaccaagctcgctggagacggatccataggagcacaaccagcagctcaagtagttttacccgcgcaaccatcctgctaatttgctggacctgaagaataccgacgagtcgacggacacaggacgttcctgcaggctgtatgttcttgttctgtttctcactgtcttctattcctaattcaattgcttctcaaatagtttgtgtagactgtatggtttgatcattcacctgaagtgactttgttgcacttttgatgattttttctgtatctgaacttttgaattttgtacgaatgtgaaagtcttgcaaccaaaataaaagtacagggatcgtgtgcaattcaaaaaaaaaaataataaaaacaaaaaataaaaaaaaataaaaaaaaaaaaaagaacgggcgcacaaaaggataaaaaattaatataaacatacatatgaagtgataccacacacttagcgtcatcggaattcaattc

SEQ ID NO: 6583 - DNA, 521 bp, Triticum aestivum
  Clone ID: PAT_TA_6583
gccagtgctgtgggctggatagagatagatagggttcggcgccgccctcgcgcgtgggtagcttcgaaattcatttaggaattgaagagcgggagcggagcgggtgagatccagatttccctcctcctccttcctcttctctttatctttatcagtagtactagattacaaaaagagagggagagagagaggaccacatcctgattcctcacgtcatccgatccgatataagattcgatttccaatgggaagtccacatcctgattcctctcgtcctcgcccgacggcaaccttgctggatccggattaaagattgatttgtttggtcagttggcccaaataaatagctagtccaagctagcgttggaggagggagagcacaagggttggcaatttctcgagtcacggggttatcgtccaagctaaatcaggccatgtccaagcagcggggtcgccgccggcgccaaacccgttacccccctgatgggttaattgctggttcttcaaggggtaaaagaata

SEQ ID NO: 6584 - DNA, 426 bp, Triticum aestivum
  unsure (1)..(426): unsure at all n locations
  Clone ID: PAT_TA_6584
gaggcggcagcgacagcgcccgcgggtgtcgtttcctttttngaggcgcttccaaggcctttagctctgcccctcttcgagctcagggggaaacccttggtctggttaccacgaccggatggcgacggcgtctcgacgtcgtcttcattcttgaaggtgctatctagcttgctcgcggtgtccctggtgttggttcaggtgatgttggaattcttgttggttcggcattgtcactcgtggttcgggcttggtgggtttagctgtgatgtatcttctgttcgtgccgagcatcccttgtctctctgctccgggaatcatattcatgcctgcctgcgttcgtgtcatgtgttgtacccatatgtactcattctactccttctatcaataaaaagatacgcaagctttgcgtattcgcgaaaaaaaaaa

SEQ ID NO: 6585 - DNA, 916 bp, Triticum aestivum
  unsure (1)..(916): unsure at all n locations
  Clone ID: PAT_TA_6585
tacacgannncgatagagnnnncgacgcacgaggctctcgcgcccgccccctccgccgctgcgcagctcctcggccggcggcgggcgcacgccccgccctgcgcgcccgccgccccggttccgctcccccggcatggccgcggccgcggcgtctctggtgatccgtctctcggcgctcgccgtcgtgctcgtcgtcctctgcccggcggcgtccgcggtgccgctggggaagcggtacagggtcggcggccctgaagggtggcgcgtgcccccgccgcaggacaaggagatgttctacgtcaagtgggcgtcccccataaccttcttcgtcgaggactccatcgagttcgtgtacaagaacgactcggtgatcaaggtgagcaaggtcggatactatcactgcaacgagacggcgggcatcggcaccggcgccgtgccgagggacggcagcacgctcttcctcctcgacgcgccaggcttcgcctacttcgccagcgccgacctcggacactgcaacgccggcgagaggctggtaattaacgtccgcgctgcctccccgccggcgccggcatcagcatcatcgccggcacaggcccccacggcaccgtcgtcttcacgaccgccgtcgtcatcgccgttctctccggcgccaggtccggccccgtcgatggagtattcatccgccgcgggtgggccgttcgtggcgtccctcgctcgcgccatggcacaagctgtgacattggtcctggcctgctttatctgagcaagcctaagtaggttacgtaatttgttagtcagttaattagtgtgtgatgtgcgtgtcataatcagggaccgttcgatttagtatcacagtattcgttttgatgtatcgtgcgccgtcttctcatgtgtcagtaacaacaactatattttt

SEQ ID NO: 6586 - DNA, 919 bp, Triticum aestivum
  Clone ID: PAT_TA_6586
tcggcacgaggcgcctcgcgctcgaccttctccgtgcgctgcccctgccccccgatctcctcgacccgctcctgctctcctccctacgctccgacctctccttcccggatcccgacgtcgccgcctcctccatcgcctcattcccgtcgctcccctcgcacctactcccaaccctcctctcctccgcgcacgccgacatcgctgccgctctctcctcgcccgccgagtcactccgccttgccgccgttacctccctctcctccctcctcccgcgcgatgacctcgcgctcatgtgctccaccaacccctcgctcatggggcacgccaccacctggtggggccgtctgaccgagctggccttggactctgcagacgcagtggcagccgcagcgttcgaggcacttgctcggctgttccaggagctggacgcgcggcgtatgagccggcttgctggggacaagctcgttgatggagagggcgcgctcgctgtgcgtgcccagtgggcagctgacgccatcgacttcatctggtcccggcgaaacatgctcattgctcgatccatggtgatgcccgttgagagcttccgggtcactgtgtaccctcttgtgcatgcagcaaaaatggttgcatctggcgcggtgaacacgctgcggcagattgccaaaccgggagacactacaatagccgataccgtggaggcgagtgcggagaagttggtgggggtgtctgacattgtctcgcacttgcttcctttccttagctcgctggaaccgccactggtgtttgaggtggggatcaatatgctctcgctcgcagatgcgcccggaggcaagccggagtgggcttcagctgccattattgcaatcctaacactatgggaccgacaagagttctcatcgatgagggagacgatcgtcag

SEQ ID NO: 6587 - DNA, 613 bp, Triticum aestivum
  Clone ID: PAT_TA_6587
cccggccgcgcccacgagcaagcgtgggcgccgctccgcgaaccggagccccgttagagccaaccaccggccgccgctgaccactgagcgccccagctccgtctccgccggcggcgatgacctccgcgcactccaagctctactccgatgacgtcagcctcgtggtggtggtcgtcgacaccaaccccttcttctgggccggcgccgcgctccccttcgccgacttcttgtcccacctgatccacttcgtgaactcgctcctgctgctgagcaacctcaaccacgtggtcatcatcgccgcgggtgtcagctcctgcgcctacgtcttcgactcgggcaatgcttatgccggaggcacggcagatgttgctgaacctttggcaggcgagccgaagatgaggagtcattagcagatgctcggagactgcagcatggcaccgtgctgatggcgtgccggtcgtgtttctgcgcgctgtccttgtctggctatatacagagattttccggtctggcactcggcatccgcaacccaggattttgtgcctgcagggttctccagacggacctgaacaatatgtggcagtgatgaattcaatattttcggcacagcgtt

SEQ ID NO: 6588 - DNA, 288 bp, Triticum aestivum
  Clone ID: PAT_TA_6588
gcgatgctggacagcgacaaggaagaatgggcgtggaccagctcatcgccgacctgctcgccgacccggcatactactacggcggaggctcttcctcttcgacgtcggagctggggtggggctgttgatcatttatttaactagaggttacatatgctttacattgggacggcatttaagcatatttcagggcatcacattttcgtttgtaacttgttattggtattcgctgaaccccgatcgatgatgagctattaagcgtgcgtttttgtttttttaaaaaaaaaa

SEQ ID NO: 6589 - DNA, 816 bp, Triticum aestivum
  unsure (1)..(816): unsure at all n locations
  Clone ID: PAT_TA_6589
gcagcagaccgaccttcctccacagnagcgttgctagatctgccccctacccggcacaatccctatggtagccaaagccgaccaccccgcctggctcctcactgcggccgaaggctacgtcggtgaccggtccaacgagaggaccgccagaggcatcacgagtaagggcctgagcatcaaggcgtcttttttccccaaccgcccgccacaaccatcaaagctgtgggtgcactgcccagaggccgcggtcgtccagactccccgtgtcctctacatcgccggtgacctgatcctcttccgggtccccatctcttccgatcctgtcccagaaaaccgtttcttttggccgctggatagcgactatttcgtctaccgcgctgaccccaatttgcgagagctcaagctcctcaccgacgtgcacatcagaaatttcgaagactgtcaggttggtattcttccccgtggtttccacgactacaccatcgccgcgctggttgttttgtcctctcaccatcgacaggtttatactccatttgttccactcggagacatctagctggacctccatcgtgccgcctgtggtggagccacaggagggcttcaatattgtcatccccactaacacggatcttcatcgccatgatacttccaacgttatcacaatcggtggtgagtacggcaccatgggttgggtcgatctctggcgaggcatcctgttttgtgatgtgctgtgtgagaagccaactctccgtggaataccattgccgctgccgatgtatcatatcacaggcggcgatgggatgggattatatttag

SEQ ID NO: 6590 - DNA, 1078 bp, Triticum aestivum
  Clone ID: PAT_TA_6590
cccacgcgtccgcttgtttatcttgtcagattacacaccaaatggattccatgtgacacctccttctgccttaagtagccacctccccctcttctatcaagtcatctccacactcactcatctctttgagaacccatacagcacagcggacacttttcttagctttccaatggcggcagccaccatgtccctctcctcctcgacctttgccggcaaggcggtgaagaatgtaccatctttagctctcttcggcgaggcccgagtcaccatgcgcaagaccgcagcaaaggcgaagcaggtttccttcctggcagcccatggtacggtgctgaccgtgtgctctacctcggcccactctccggtgagcccccgagctacctgaccggtgagtttcctggtgactatgggtgggacactgccgggctttcggctgaccccgagaccttcgccaagaaccgggagctggaggtgatccactgtcgctgggccatgcttggggcacttggttgtgtcttccctgagttgctcgcccgcaacggcgtcaagtttggcgaggctgtttggttcaaggccggctcccaaatctttagcgagggtggcctcgactacctcggcaaccccagcctcgtgcacgcacaaagcatccttgccatttgggcatgccaggtcgtgctcatgggcgccgtcgaggggtaccgtattgccggcggcccactcggtgagatcgttgacccgctctacccgggcggcagcttcgacccgctcggccttgccgacgaccccgaggcattcgccgagctcaaggtcaaggagatcaagaacggtcgtctcgccatgtactccatgtttggtttctttgtgcaagccattgtcaccggcaagggtccactcgagaacctcgctgatcacctcgccgaccccgtcaacaacaatgcttgggcattcgccaccaactttgttcccggcaagtaagctgccttgcttgcggtgaggtgtgtcgtcgtgcggtctgagttgtactaccatgatgtaaattacgaggattcaatgctatggaaaatttacgaggctcctgcgc

SEQ ID NO: 6591 - DNA, 1495 bp, Triticum aestivum
  unsure (1)..(1495): unsure at all n locations
  Clone ID: PAT_TA_6591
cccacgcgtccgggaacgtgtcaccatgcgcaagactgcggcaaaggcaaagcaagttgcctctagcagcccgtggtacggggctgaccgcgtgctctacctcggcccgctatcaggtgagccaccgagctatttgaccggtgagttccctggtgactatgggtgggataccgccgggctctcagctgaccccgagaccttcgccaagaaccgtgagctggaggtgatccactgccgatgggctatgcttggcgcgctcggttgtgtcttccctgagttgctcgcccgcaatggtgtcaagtttggcgaggctgtttggttcaaggctggctcccagacaccaaggaggatatcgccgtgaagcggctcgacaaggaagggttccaggggaaccgcgagttcctggtggaggtgctgatgctgagcctcctgagccaccccaacctcgtgaatctgatcggctacagcaccgacctcgaccagcggatcctcgtctacgagtacatgcccaacggctcgctggaggatcatctcctagatctcccggagaacgccaaggcgctcccctggcagacgcggatgaggatcgcggtgggcgcggccaagggcatcgagtacctgcacgaggtggccaacccgccggtcatctaccgggacctcaaggcctccaacatcctcctggacaaggacttcaactccaagctctccgacttcgggctcgccaagctcggccccctcggcgacgagagccacgtcagcaccagggtgatgggcacctacggctactgcgcccccgagtacgccatgaccggcaagctcaccaagatgtccgacatctacagcttcggcgtcgtgctgctcgagctcatcaccggcaggcgggccatcgaccccaccaagcccacggaggagcaggttctcatccactgggcggcgcctctgatcagggacaggaaaatgttcgtgaggctggcggatccgttgctggggaaggacttcccggtgaaggggctgtaccaggcgctcgccatcgcctccatgtgcatgcaggaggatcccagcaagaggcccaagatcggcgacgtcgtggacgcgctcaccttcctcgctgaacagaagtactatcctcaacgagaccgggaagctgctcaggcgaagggcggggactgcagcactcctcccaaaaaggacatggtttctgagatcaaagccgatgatgacatgaagcagagatgagcaagacgaccataggatataatatatataagagatgcataaaggaggagatgcagcagaactatatctctgccccctcacatttcttgtgtaccgtacaccacataggcaggatgtaagagcagcaacgaatcatcttgacttgatgatgctgatttgttagtcaaggcctcaaattccagcagcaaaagccaagagctgagccgtctattcctgagctgttccaaggactgccacgttcaatattagctnnnagatc

SEQ ID NO: 6592 - DNA, 1457 bp, Triticum aestivum
  Clone ID: PAT_TA_6592
cggccgctcaggcggcaggcgggtctccacacccaccctcattcttggagaacacatagaacctccatcgatcagattatggccgccgccccggcagcgcctccgatatcatcaatacgctttcccccgcaatctaattcccccccccaccatgcccctctcccccccaccctttgccggcaaggcagtgaagaacgtgccatcgtcgtgtcctcttcggggaggcccgcgtcaccatgcgcaagaccgcggccaaggccaagcaggttgcggcagcgggccctgagcgcgtgctcggccgcccggcctacctcggccccctctcccgcgagcccccgcggtacctcgccggggagtgctcccgggtgactgccggtgggactctgctgggccatccgccgaccccgagcctgaccccgaaacgtgaggccatggtggagggtctggaggtgggcgttgggccatgcgttggggcgcttggtcgtgcggcttccccgcgttgctcgccggctgcggcggggggtttggggaggctgtttggttccaggccggctgcccctcccagatctcagggcggtctcgactgcctcggcaaccccagcctcgtccacgcccagggcatcctagctgtttgggcatgccatgtcgtgctcgtgggtgctgtcgcggggtagcgggttgccggcggcccacttggcgagatcgtcgacccactcccccctggtggacgcgccgaccctcagccgccggccctgaggcattcgccgatggccatgctcaagaggctggtgaaggagaccagggccatcttctcaatgttaggcttcgttgtccaagctatcgtcccgggcaagggcaccgcccaaacccccgcagccgcccacgccaacccctccacaaccaccaccaacaccttgccaaccaccttggtcactgccttcggccgcgagcatgactcgctgttcgatggggtttttatgcgggctcggggtgctgtgagatgtgccgtcatgagtttaatatctaggattttggcataaacggtaagctaactgtgaattaatacaacgacagcttgcggacgtcgtgcttctcgagctcatcaccggcaggcgggccatcgaccccaccaagcccacggaggccacttgagaacctcgctgaccacatcgccgaccccgtcaacaacaatgcatgggcattcgccaccaactttgtccccggcaagtaaggtgtcttgggattgtgctcgccataaggcgtgttctcttgtgcgtctgagttgtactatcatgatgtaaattatgagaattttgtgcaaaagcactgctagatttgtcctgcttgaatgtcgtgccttgcatcggtccgatcattttgttgtgatatcatggttcatgagagcagataaataccccctctgttccataatataatatcgtttttgacactagtgt

SEQ ID NO: 6593 - DNA, 660 bp, Triticum aestivum
  unsure (1)..(660): unsure at all n locations
  Clone ID: PAT_TA_6593
aaacttacctctttgttgaaaatgatagattatatattttaacttggttattaaaattttgtatgcgcactatctcaaaaaaaaaatgtaggcgcaccaccgggctagtaatctctactcttaatgtctgaattggtagtcccgcctcactcccacctcatcccaccacctctatcttttgcccacctttcacgtcccgtcatagcagcctacttggaccggcccatttgacacgtgcattaactcaatcagatcaacaccttcccaaaacaacaccatacattaactggttcaaatactcaccaaaacatcaataatctctcccataaaaaatcatttatctctacttctgaagattcagttgggtaatccatcgatcgatggaaggaatagccagccccaccctccgctgatttggtcaacacaaccccaactcacacggaaacaaatcagccccaaaatcaggaatataagagcttgatctcccttgatcccgcggtccccatcattcgtcagattctctttctctctcccgaacaatctcggtggatgctcgacctcgacctcttaggtgcatgcccctctccattgccccacatgggaaaggatgcgcctctagcttagctcccaataatnaagcgctcaaagtccaaacagagg

SEQ ID NO: 6594 - DNA, 1126 bp, Triticum aestivum
  Clone ID: PAT_TA_6594
tgatggcaagcctgaaagctgaagccgttgctcgactatttactcactctgaattaccgcggagagaagctgatggttaacgacacaatcgacacggtgaataagcttcaaacagcgctgctccttgcagaagtttttgtcagtgggctgccaaaattcacaccatatttgaaatttgaacaaagatttcaagagtggggattggagaaagggtggggtgaaaatgctgagacgtgcaaggagacgctgaatttcctatctgaagtgctccaggcgccggatcctatcaacatggagaagttcttcagcagggttccagccatttcgaccagggttgtcttctctatcctggttactttggccaagagaaggttctaggcttgccagacaccggcggtcaggttgtctacatcctggaccaagtcaggtccatggaagaggagcttctgcaaagaatcaagctgcagggtttgcatataacaccaaagattcttgtgctaacaagactgataccagattccaaaggcacaaagtgtaatgtggagctcgaaccggttgaaaacacaaaatattcacacatactacgtgtgccgttcaagactgaagacgggaaggatttgcgccagtgggtgtcccggttcgacatttacccgtacctggagagatatgctcaggatgcctctgccaaaattcttgacattctagagggcaaaccagacttgatcattggcaactacactgacggcaacttggtggcgtccctcatgtcgagcaaactaggcgtcacacagggaacgattgcgcatgctctcgagaagacgaagtatgaggactcggatgccaagtggagagagctggaccagaagtaccacttctcctgccaattcactgccgatatgatcgccatgaacactactgactttatcatcactagcacataccaagaaatcgctgggagcaaggagaagcctggccagtatgaacaccactatgcattcacaatgcccggcctttgccgctacgccacgggcatcaatgtcttcgacccgaagttcaacattgctgcacctggcgccgatcagtccgtctacttccccttcacacagaagcagaagcggctgacagc

SEQ ID NO: 6595 - DNA, 848 bp, Triticum aestivum
  Clone ID: PAT_TA_6595
taccgtctgatcgcccggcccgggaaacccagtgaaacgacatggcgggcgggcaagaatcgtcagccgtggcggccgacttggaccccgtgtacgagtgggtcgacggcgacggcagctatctcctccgcctcaacctcccagaaggaggacttccgggtgcacgtggaccccgcgggccggctcaacatcctcggccacaaaacggcggatggcggagctgggaacgtgcggctgcacaaggtgtttcagctgccatctacatccgacctcgacgcaatcaccggccggtacgacgccaacttgctcacgctcaccgtgcccaagctgccttccgccccggccaaggacgtcggcgacaaaccaacggatgagaaatccaaggttatccgggaggcggagcggctgatcgaggcggcgagggcaaggttgcagctggggaggcacagagaggagacggccaaggaacccccggccacgaaagtggacgacaggaaacaggagcccaaggcaacagaaaaggtggtgaaaggagatgatggtcaggaccacaaggagaagcttgagtatgagacggcgacagagacggagacgcagagggagaagaaaggctgctggaaggagcgggcggcggaggaggggttcaagtgggcagataccataggtaagaacaaggaggtgatcgccgccaccgccgtcgccgccttcacgctaggcgtcttcgtctcccataggctcttctccagaaactgaaaatcatcatcatcactgaatgtaaatgcagcgtccgttgtgctgatgtgtgcgtgcacctaacaatacgagcggatgtacgaccagctccgaga

SEQ ID NO: 6596 - DNA, 334 bp, Triticum aestivum
  Clone ID: PAT_TA_6596
tgctagacatagatgtggcgatgacaagtgaaattgatgttaaggagtattagcatatgctcacaggattactggaagcttacataggtggaaattagcaagcaagctacagtcggtgcaaggatgtccaagtttacttattactttacgaagatgatgattcctgcatgttgattgtgcttcaaggtgttattaatatggggagaagagcagtccaaatggcggatggagtatgtgacctgttgatgttagtttcattttcagaaggaacaaattttctataatttgagtgtatgctgacgtgttaaagtcaatcatttggattcccaactcg

SEQ ID NO: 6597 - DNA, 1883 bp, Triticum aestivum
  Clone ID: PAT_TA_6597
gcccgcacccaggccccctcccgctctctccccctggcccctcccacttgcacgagctccctcttcgccgcgtccttcccatgctccccatcaccatagctgcacactgatgatgaactcgtttccgctgaccgccgctcttctggtggtggggtgagttggtgcgaagaaagttgggtaactgccaccggacggggaaccgtgcggggccgccgtgtgaggctagtcgcgtctctattgtggcgccttccagggtactccggggcacatggagaagagggaggactgccccggtcactgtatctctggatgcgtagggatctagctaggactattctgtcaattgaggtgtttggcatttttgtaagtgttgtagcagtggcagaaattggcaagcgcatacattaacttggtatgaggttttcatagatttgagatgaagcataggatgttttcggctagaaaatggtgaggaaaagatgcaagtttattagaaaggcgacttcacgcttatttgtgtgtttcaatgagggcatttgaaggaaagcgcaaactaacagttagcaatagctaaatgcctgtatatgtatatatttttttttagcctataatctgctcaagtttgtatcttatttactctttgtattaaactaaagctaaatgaataaatttacttgcctattacaactgtgtgttttgtgtttattataatacattgataagaagtttcagtgtgcgggtgtatcaagttaatttttgacacataatttgatgttgccattgtttccgttagctctcagaggctgtagttcccagtaggctgttattaatgtgatgagagatgggagttaaggcatgaggtgaagagcagtccaaagggcgggtggagcatgttacttgttgatgttagtttccatttccgctcagaataaatcttctatgatttgagtgtatgctgatgtgttaaagtcaatcatttggattcccaactagactattgtgcgttttcaatcttttattgtgcacaaagatgatgtttctgttctcgtttgtttcagtagtactgtaatagattggagacttaaactctgcatatagctctgtcaggctgaacatcaccctgcaggatttgtagggcatgtggggggaagcaagcttgtagcagatcttatcccccctcgatccctgccaaacctcttcaattccctgtgaaccgaacacagcttaagggagtttgctctttaggaaggttcttgtttgctgttgttattaaaagtaggaaatttatatacatataacagttgtctcaagcatagtctactgtaacgggtagtgtcagcaactacaattaattcatttatccatggaattgggataacaaaaagaggtctcaagaaagagaaaataacttgtggttcaagcagcaagaagatagccagcctaaatgaatcaaaacaagaacaagcgtcggtaatttacaaatgaggaagtgtagctggtgatgtaattactttcaatagcgcttcagctctgcaatcgacagtttgacctcatgctagggcagcctcagccagttgcctcttctattaaagggtccctcagctacttatgttttgctagacaatgaggaaccctttctttttccacaaggggcagtagctgtgccattcgatttggaggacaaagagttgatcacaaaggggtatcattcaggatatatacacaaaagagtatagaaccaaattatatgatgtaattgactactatctattaacttctcatgtagacaatgttcacaagttcatgtattaagtacattttattgtgtcacttgtgtttactcttttttaatgcaagtttactgctactcggagttcctaaaa

SEQ ID NO: 6598 - DNA, 776 bp, Triticum aestivum
  Clone ID: PAT_TA_6598
cagttaacatctgcaggtgcgccctctccctgcgcgccgcgtgcatgtcgcgccatttgcgggagtgtggggcaagccatgtgcttgaaatcccaatcccctcgcccgcacgccggacgccacacccctccctggctccctcctcgaactctcttcctcgccagtcttcatgaaaccaccaaccccatcctctgcctctcccttgcgtatgaccatgactgcgctgggtcggccagaggaagaaggccatggggattctgctggctgcgtgcggaagcagcatcgggtcatggagtggagtgagtccaccttccgtcattctagccacagccttcgtccggttgacgcttacgtgtatttctcatgggtataccaagggggtaatcttctatatttcaagtccaaagctttcaatgcatttttatctgtttttcatgtcccaatgatcatctgcaagtccgaattatgccattgttgatggtgcacaggtatgttgcttggtaaacccagtattagccctcctttcaagctcctgtgttcatcctagagaaaattctggaaaatacgtcggaactatcttttaatcttccaacagtgtattgctacgattatatatatggatacatcatatcgatgtgtctagagacctaaagccttaagagttaagtgccaaactggggactgatattataactgtagatgggctttattcagttattttcttcctagaatgatgatgtttgcagatgggatttgttcagtcataagagcttatc

SEQ ID NO: 6599 - DNA, 965 bp, Triticum aestivum
  unsure (1)..(965): unsure at all n locations
  Clone ID: PAT_TA_6599
cgtccgcccacgcgtccgcggacgcgtgggcaccgtacccaatcccatcctctcccctggtcgtcccgatccaccccagccgccgcacaaccctagcccctttcccctcgatccccatagcccctccctcctccttgctctccgccatggcctctgcactaggagcctctccatggcctcctacccatccccccaccaccataggtgcacacagacggtggatccgtgccggagaagagcagctccagttatggtggggtgcatctatgccgaagatgaaggaggtccgccgcccgtctttgcctcctcgctgcgtccttgttgctcctcctcctctctctctccgcacctagcagtgcagcagccaggccaaggggaaggagcagcccgacccggctccatccctctccttcatgcaggagaactggatgagcaggtggcgagggaagccgccacggctagcggcggcgctgcacaggaacgtccacctccaggattttactactgctatggacaaaagaaggctaaagctgggaaagacaacaatgtcaggagccaaccgagatccaaaatgccgagaagcagggtttattttccctcatcaccataacaaaggggagactccagggagagagaggaaagctgcgcaagtgcccctggaagcgaggaagctcggcgccgtcgcggaagaggagctacacttccatggagtagagcgacgaggggctccggcatcgctgcagaggagggaggagatccactgccactgcacctgacaattcgacaagaacctctctggatgattctgtcgcgagtctcctgctgttcatattcagactgcaacattttctanattttactttggctgaagttgttcttactggtacaccagatcagccgtataaatgcactatatgttctgcttgactgctttttttatcntaataaaaatgcatatctgcagc

SEQ ID NO: 6600 - DNA, 721 bp, Triticum aestivum
  Clone ID: PAT_TA_6600
cggcgatggaggcagtggagcgagacgccgccgccatcgccgagagctacgcctccctattcgcctccctccgcatcacactttccaacgttacctcgacgtcagccgataacatggagtgcttgggcgaagttgtaggccgcctccaggagtcagcacttgaagcgtcttccagaggcaataagtacatccattcatgcctgaggttaaatgaggaaatgcgaggcttggaaagcctaagtatgcagctaaagattatgcggaagatcgttgattcactagatttggctgttgatcggctgctccacctcccgtagttcatgcatctatcagtagcttctacaaggaacttctgatgaaatttatattcaccaagtagctgtcacatttgaagaggcaaccaactactgtaaatctgaagtggcgtgtacaagcaacggagaagttttcctcttccacgacatgacaaaattctcccaattcttcgacttttttgttcttcgttgtgtgtgattgggatcaacgatttgtgcttgttgcgtaataactgtttccaactctgccatcctttagggcatggtcaacagattgtatgttaggcgtgttggtaaaatgtccatgtcatcaaccaacaagctatcatacaactactccaatgggttgtatctaaggtatccaatagatgatgagaaaataaatgtgattgctctcaaaaaaaaaa

SEQ ID NO: 6601 - DNA, 643 bp, Triticum aestivum
  unsure (1)..(643): unsure at all n locations
  Clone ID: PAT_TA_6601
gcttttggtggtttttgtcccgcggcctctgccgcccgcgcgcgataccttcccctctcctccccactcccccgccccgcgtagagctcacataggccagaagcagccgagcagcagcacagcggcggaaagccaagccaagccatcccagtccagtcccaccgaccgggcagcggcctctccagatctcgcatgcgcggccgccgcaggagggggaggaggaggaggacgggctagggtgtcgccggcgtttccgagatgcgcggggagcggctggggagctgggtggtgtcctacaccgggatgtcggccgacaacatcaagggcctgctgctcgcggtctcctccagcctcttcatcggggccagcttcatcgtcaagaagaagggcctcaagaaggccggcgcctccggcgtccgcgcaggtgttggtggctactcttacctgcttgagccactgtggtggataggactgataacaatggttgttggggaaatcgctaactttgctgcgtacgcttttgcccctgctatcttggtcactccacttggcgcacttagcataattattagtgctgttcttgcacgtttcttcgggcgggcgcacctgctcgtgtccgggtgtttcttgtttgtgggtcana

SEQ ID NO: 6602 - DNA, 706 bp, Triticum aestivum
  unsure (1)..(706): unsure at all n locations
  Clone ID: PAT_TA_6602
gccggcacagctcctcctccatttccatctcagtcagctccaagatgtccggccgcggcaagggagggaaggggctgggcaagggcggcgccaagcgccaccggaaggtgctccgggacaacatccagggcatcaccaagccggccatccgccgtctggcgcgcaggggcggcgtgaagcgcatctcggggctcatctacgaggagacccgcggcgtgctcaagatcttcctggagaacgtcatccgcgacgccgtcacctacaccgagcacgcccgccgcaagaccgtcaccgccatggacgtcgtctacgccctcaagcgccagggacgcaccctctacggattcggcggctaggccgcgctggtccaggccaggaggatccgtcttgcaccaccggattagtgctagtagctacgcgttgtctggtggtggtgttcatggcctcggtgtaatggctgcatctcgctgttgttcgcgctggacttgtttgttgtttgggtgtacagcattttacccctgaattcgtatggaatctgtggctctgtcgatgtttgttcgtgcgtgcggtcagatattaccagtgctttcttcaatccccattgcctcgatcatcgaaaaaaatccccattgcctcgttttgtaaatttctgcccccaaatcctgtttgtgtggcttcagtgtttgcngattctcaaaccaaatct

SEQ ID NO: 6603 - DNA, 389 bp, Triticum aestivum
  Clone ID: PAT_TA_6603
gaagaaactgaagacgacgaagcgagagaaggcgcctccgtctgtcgcgttcgacccgcggcatcctcccttctctcccctgggaagggtataggctgaatagttgtcattatttgtaaaattcctcggtcgtgattcggcttggtgttcatattctttttgtgatagaaaagggggaggtaaatttaccttgttcatagctagagatggaggatgatgttgcatgtaccagtagtctttaggctgtagggaagcagcagcagcagcaaggccatggttatttgctgagatgaaatgcagagcagaggaggcagttccatgccccaacaccaacagaaagaagaatataaataaaaacagtgggccattgcttctgcataaaaaaaaaa

SEQ ID NO: 6604 - DNA, 884 bp, Triticum aestivum
  Clone ID: PAT_TA_6604
cgaggctgttcctatagcaccggcggcaacgacatcttcgccttcttctcggccacagcacgccgacggccgcgcagaagcagatgttcaccgccaacctcgtttcgcagtacaaaagtcatgtgaaggctctgttcggcctcggggcgaggaagttggccgtgatcgacgtcccgccaatcgggtgctgcccctacccgagaagcctgcaccctctcggtgcctgtatcgacgtcctcaacgagctgacccgtgggctcaacaagggcgtcaaggacgccatgcatggcctcagcgtcagcttgggcggcctcaagtactccattgggagctcccacgccgtcgtgcagagcatcatgaagcacccccaaagactagggttcaaggaggtgaccacggcgtgctgcggctccggcaagttcaacggcaagtcgggttgcacgcccaacgccacgctgtgcgacaaccggcacgagtacctcttctgggacctgctgcacccgacgcacgccacgtccaagctcgccgccgccgccatctacaacggctcgctgcacttcgcagcgcccgtaaatttcaggcagctagcggaggaccagtgctagatagagcacgcacgggccgcgtgcgcggtcgcgtctgctgcgttattaggtttggtttacgtgtctgtgatggtgatgtttgtgtgtaggatatgtatgcacagtgatgttcgtctctggtttcatttgtgtattattaggtgggcgcctggcgtagtgtggaatctaaagatcaaaatggtgccatctctgtaatgcaggttaattacttctcgaggttcgtatgtagtactgtatatccgaatgaactaaaatttaattaaaaaaaaaaaaaaaaaa

SEQ ID NO: 6605 - DNA, 606 bp, Triticum aestivum
  unsure (1)..(606): unsure at all n locations
  Clone ID: PAT_TA_6605
ggttttggatcagatctggggatttctcccgagctccacagcctcgcggcgcgcacatccgcgagccccggcaatggcttccacggcggcggatagagtaggcgagccggtggaggccaagggcaaggaaaaggaggaggaggggtgctggggaggggctcttcggcggccgcgacaactacgacaagcgcctgcagtacctgtccaaggaggcggccgtcgtacgtgcacgcgcggatgcgctgccggacccagttctccggccgcaacatcatcgtcctctctatcatcgccgaggaacattatttatcgagttttggaccagatctggggatttctcccgagctccaccgcctcgagctgccgtagttggtgtcatccgtgccggatttgatcagcctaccattttctgctaccgtgagatgttaggtttctggttggtgaacttttccttttcttcctctctagcacgacgagtgtatgtaggtaagttcgtatgtacaggtccactaggtgtttggatgtcctcggatctgcttaaattcctttggctgcattaggtggtcggatctctggatttttgttctatgcgggaganctacagca

SEQ ID NO: 6606 - DNA, 937 bp, Triticum aestivum
  unsure (1)..(937): unsure at all n locations
  Clone ID: PAT_TA_6606
cttccacctcgggatccctcccgatccatttcacccaatccgatcgcagcgggcaccactgctctcgttccccatccgtccttcccgcagctcctcgcagtcatctccctcgagcccgaggccatgcctcctctgctcgatctcccctgcccagcgcctcctcaaccctccttctcctgccggagccctgcctcgttcccctcgtcgcgagccagggagaggagctccctgcgttcgcccacctcgtgccgtccccgccgtctaccaccacaaccagcagctaagctacgtcgccccccttcccttcttgccgcacctccgctctctctccccctcctgacctcgttttccctttcatggtccaacagagcaggagtcctgccatggccgtccgaaccccgctgctgcatcgcgctgccgtcggggcctcatctccaccaccagacccggccggccttcgtcgcccttgcccgttcccggccggatcccatcggcagggccccgtccccgctgccggcggccgcgtcccgctcgtcccggacctccctttacttcgccaagctgtcgtccccggctgaatccacttcctcgcgtcggatctcgcctcccgcgcctgtcctggacaggatccngcgtcgtcggatctcgcatgcgtccgccgccgcgttcgtcttcattcgggagctcgagttcgagcgctctaccccgtcgctgctgccccatgcgcctcctctgcctggcgcgttgaccacgtggccaagttacgtcggccgcgcgaaagcctcctctgctcaaccgcgcgtcgcctgcgcgttgaccangccctgcctcgcttcgatntgcccgcganggccagcgccgtgccaagtcantttccgctggnctgctgcttaacgacctggcaaggccacaagtnnggcaagtcaaacgtgtcaca

SEQ ID NO: 6607 - DNA, 768 bp, Triticum aestivum
  unsure (1)..(768): unsure at all n locations
  Clone ID: PAT_TA_6607
ggagttctccggtgcagggaagaagccgcacggtggccatcccgccgtccaccgtgcgtttcccgcaagctgccaggccgctccacgcgctctctcagccacgcctcctcctctccccgccccgccccgccccaccgcgataagcagagaggccgcgcggggaaagaatccttcctgatcggcagaatctcgaacggggaggggccatggggatactactggtttccgggagattcttggctcgacggcctccactggcgctcgcccctcgctgctcccgaggctccccggacaagcgcggcagggacgaaggtgacacatcatcaactgactgggataaggcttggtctacctttaagaagaaagggaagaagaccctattctcagagttctcaccgaacaaatatgtgacctggaacccacggcgcagtgagtatccattgtcagaagaagtcgatccaatcaaaagagctgagaggtctaacttgatgttgtggacaagcccaagatttaccttggtaggggcgattatcatcgtttcggcattgctaatctatacattggttgtcccacccaagtaactgctgaagtgacagataacaggtgagccgtaggccgaagattctacttggaagtctgtattgtacatttagtttgtactatacgaagtatatcatggttctgtattgcttcaagcacattctaatagatcataatagagtactccttcatttaggaaatttcttcacccggcncatnaaaaaaaaa

SEQ ID NO: 6608 - DNA, 855 bp, Triticum aestivum
  Clone ID: PAT_TA_6608
gacaggtcagacagagcggcacgcgcttcctcccgctagctcggggcggatccatccacccggcgggccatctctcatctctctggggcgccatgtcggagcacgccgccccggagctacccaagaggtgccaccactgcgcagggcccctctccaaggacatggaaactagcagctggaccgtgactccattagttcgagatagcttctcaatgattggttccgctgttgggggtactgcaggcgcgttttatgcgtttaatcatgctatgcctgttgttcggcgttacataaaagggccaatgtggatgcattttcttgttggtgcccctccagttgttgtattctcttctgcgtgtgctggattagcagctggtacaataccagcccttgcacaactggtttcgtcgtcctgtcatgccgccatgtcatcgccctccttcgcccgccctgcttctcccgatgacatgcacaagagcagaggctcctcgccattgtaatttactagcgcaaccgaccagctactgtattgtactgctcgaagaaatctgtgccaccttataaaggatgtaaatgttaagatttcatgcggcaggatgttttaactgacatgtgctcctttcacttagtttttgttggtatctatttctatgtataggttatgccctctcatcttgtgttattgttttgtattaaaataagttttgcagtgtggtattccactgtgttgatgaaccagcttaaaccagccagaggttcagctattttcgtctgcaaaatgcaagcatgcgttggtctatgattgttcaaaaaaaaaaaaaaactcagactagttctctacccgcccgccccggg

SEQ ID NO: 6609 - DNA, 839 bp, Triticum aestivum
  unsure (1)..(839): unsure at all n locations
  Clone ID: PAT_TA_6609
tcctgccgcacgccgccaccccagcttgcagctggtagatctccgctcctcccctcccatgctccagctacttggcgccccagctccggccagcgcccctgccctgctcccacctgttggccaggccaatgtggatcttgcccttggtgtgggctctgatccaggggacaagggtaggctgctctaggctgcgggtgtcgccgtcggcatcggctcggcagctccggtgcaggaggcgccccccactgccgcgcgccacagtcctcgcatcctcaagatgtatgatggcgagcgggtcagctcagtggagcgcgcttccaaaaggaaggccgctggatctgctgcagactccagcggctccggccggtgtccaagctcctcccgcagccaccgcaagaaggccaaggtggtttcggtcgccgacatccaggatcttcagttcaccaacactccaaggccgctgaccagggccaagctcaacagttgaccaagtgctgtgacctcaatgtggaagccatcattgatgaaacatcttcctctgctttggccggcgcaggccctgctgctgcctccgacagttcatccgcttcctccatgggtgacgcttatgttcctgatgtgtaggtcgctttatgctatgctcaagttagtgtgttcagttgttgtcagtgtcagcatgcttagtctgttatctgcttttaatcctagtaggagttgaacttggtgtctgtttagtgcctatctatgttgttgcattagggtggtcatgtgccggatcagtttgtatcttgtctattaatcctatgctatctactgctatgttannatgggtctgtatt

SEQ ID NO: 6610 - DNA, 829 bp, Triticum aestivum
  unsure (1)..(829): unsure at all n locations
  Clone ID: PAT_TA_6610
cgtccgcatttccgttgcatctatcaacgcgacaccgccggcgatgagcgcgcggcggctctgcgacgccttggccgccgcggggttcgacagcggaggatccgctcgacccggagagcctcgattgggcgttcctccaaggagacgactccagccgcgtgctcgcgtggatcgccgcccgcctacgccgcgccaacgtcctctccgcctccgacctcgaactctatgatcagcttgaactagaagggaagcttttggaggggaaagacttggattccgctttcgacagtatttcggcgttctcagaaactggagagaaccatgaatacacattcctgtcggaagaaagtctgggagacatccgcgactcaaaactagcacttagagctgaagtttctgatttggaaaaaaagctcgcttctctggaatggcagcttgatttgcttacagcacaagctaccaccatcacgcagggaaagaaatcccgcacatctgctaaaactagcgcaactggaaaactcgcgagatttgatgaggaacttgccaagagaagtttagagatgaatgcagtacttggaaaacttgttgctacgatccaggagttgtcttactatcattcagaagctgatattgcccccgctgtcaacgtgattcaacatatataacagtacctgctgtcaaagaactacaatggttncaagaattgaaaggacncncggttttcaaganaatcagggggattaaacncacgttttgtacaacantatnttataccatgaancatgngnacttanancnatgaccaaccattnananatccaggatnntt

SEQ ID NO: 6611 - DNA, 1139 bp, Triticum aestivum
  unsure (1)..(1139): unsure at all n locations
  Clone ID: PAT_TA_6611
ccgtccccttcgttggcccggcccggccgggtattccgaatgcccccctctcgggccggcccacgcaggaccttttactggccgcatccccacccggccatgattcgcccctgtcccgccgcggacccggaacgcgccaccgttggccaatggcgatgctgagcgcaggattggcccagtccgcttggccgttagcggcttggcccgtccgaggccgtgcccgtgggcgacccgctgtcgcctgccggtgcatgcccggtctccgcctttctaccccgtcaagcggcccggccttttcacaggaatgggccgctgttgggccgtgccccgtgtcgacgtatcataggcgccttctgtccaatgagtggatgacatctgtcccaacgatgagccgacacgtgtttcctccagccaatgatgattttacacgtggaaaatccccattggtcggggctgttaacgggttatcggatccaaaacccgacccgatagcttaacggcgttccgttacggtggatgccacgtgtcggtcacccttgacgaaagcacttctgtgacgcgcgatttatcgtcatggaagtggacacttccgtgatgataattttggtaatgtcatggaacacttctacgacagcacaggtatgactatcttgattctgtcataaaattgtcatggatgtacatgcatgacaaaaaacgcgacctactgtgacaaacacgtatcatcacggaagtgtatttttttgtagtgtaaaggcagtctatggtgcaagtgtatggttcacttttttttctcgacgccaagtgccgaactcctcctggtccatcgccgaatcgtaggcttttgcaccgactgcagtgatctgtgcccgtgcgcgaatagcgggcagtccgatcccctcaggccccctgccgaaatgcccattagcgaccccgcacctacttcctccgccttggcggttcgcgcttcccccccgcggccgcaacaccacggaggctcccgctgggcagttcatcagggaccgtnancanaccaacatgataccacacnnacttnacggatcggacggcgaatggcgnangcacatagngttgnggtcanggggccggaccntncccaaagggcctntacccccntg

SEQ ID NO: 6612 - DNA, 836 bp, Triticum aestivum
  Clone ID: PAT_TA_6612
cccggcctgcaggtgaaaaccctagaccgggagcggtaaaaaagagaccccctcctcctcgttccttccacccctcgatgcagtgcacgccgcagtagccaggacaaactacatcaatggtgattaggaactaaatcgacaagcatcgatatttttgttaggaaggtgcgcttggccccgaggagtggtgctggtctcccgcggagcttgcccggatgactggcgtagcgtcccgcctccggtccaagcgcctgtgacggctatgctggagccatggtcgagcgcctttgcccccttctgcgtttgtcgcctgcggcggtgtcaggccccacgctgcccgagtggatgcctgttgtgcgagcctggcccagcgtgactagcgtggcatgtctcattgcagaagaaaggcatatgatccagactcagattcaagctgcattgagggttatgttggagacatggatgatggcttaaaccactatgtgcgattgtaggctgcggcggagacaggccccaggcagccccgagtggatgcctggggtataaggctgattccctttgtatactgtagagagcactgcagtgctggaaggcttcctaggccggccgggggtgtggctgaatcctggcgccgccactgaccataagcatgcctgcttagacgacgaaattatgttcgatactgctcggacaagtagcgatgactctacctaataccaccaccttctcgcgtcttggtccttgctgcgagaaagacaatgcatctctggcctttgctaatatagcttacttttataaagccaatgtatgacattatcaagtgatctgaatatctt

SEQ ID NO: 6613 - DNA, 1006 bp, Triticum aestivum
  Clone ID: PAT_TA_6613
atggtggtctcctgaagccatgcaaggggattctactatttggacctccaggaacagggaaaacgatgctggccaaggctttagcaaatgaatccggagctagcttcttgaacatctccttgtccaccatcatgtcaaaatattatggagatgccgagaagactatccgggctttgttcagtctggctactaaacttgcaccggccattattttcgtggatgaggtggacagcttgttagggcagcgtgatcgacgcaatgaaaatgagctcccgcgaagaatcaagaatgagttcatgactcattgggatggactcttgtcaaagtctaatgaaaggattcttgtccttgctgcaacaaacagaccgtttgacctcgatgaagcgattgttaggaggtttgagcacagaataatggtcggtctccctactttggaaagtagagagttgattttgaagaagctgctatccaaagagaaggttgaagaaggtattgactttaaggagcttgcaacatcgacggaaggatacagtggaagtgatctgaagaatctttgtgtgacggctgcctaccgccctgttagagagctcattcagaaagaacaacagaaggtaaaggataagaaggaaaatgcagtgcaagttaaggacccagaagcgcaacccaaaagtcagagaggcgcggcacaaagctcagaaagcaagaaaggcgaggatgtcatgctagaaaccaagcaaggggtgacagagaaaggcgtcaaaggtgcaaccgaagagactgtcaccctcaggccgctaaccatggaggacttgaggctggcgaaggatcaagtcggtgccagcttggctagtgaggggtctatcatgactgccctcaaggaatggaacgagctctacggcaaaggcgggtcaaggaagaaggagcagctctcatacttcttgtagtgcaaaggttgggagtttgtatataaatatgtgtatgtgcggttgaatgtgattcggcccct

SEQ ID NO: 6614 - DNA, 452 bp, Triticum aestivum
  Clone ID: PAT_TA_6614
gcaacttctgacttcacgtacaagagttttcggtcaaccgatgctcggttttcgggacctgatggaggagaacaagggagcggcggcggcggtgccggagaaggaggcgccagcgtcgtcgtacttcaagaacacggtggacgagggcgcgaggttggtggagctggccaagggccagtaccggcagttcaccgaggtgcaggcgaaggaacaatgggcgtgcatcaagaagaaggtcagctccatgctcgccgagcccatcttcggcgggtccaagggcgactccagcagcagcacgccgccgtccgtccactcgcagtagatcatcatcgtcatctagatagcctattagtaatttagttgcgtcttgtttctctctagcacttggacaaatttcagcattatcagtctgcagatatcataaaaaaaattcagaggtttcaaaaaaaaaa

SEQ ID NO: 6615 - DNA, 398 bp, Triticum aestivum
  unsure (1)..(398): unsure at all n locations
  Clone ID: PAT_TA_6615
gtggaaccgacagtttaggtctaagncggcttgctagcaaacagcttggatgcatttccgaagttcactgtttcgtaaggctcagaaatttacatcgaagacctgaagttatagatcctgtaaagatcaccatttggtttcttgcttcaagaactgattacttttgggcttactgaagctggtcgtgtagataatctgttaacggcccatcttagtcgcataaacttatttcttactgatcgctcgctacttgcgcgaattctgtattttcaaaactgtccataatctgctcggctgcttaccattttctatgcatcgtgtatttcgtcaaatgttttacgaacagacattctctttaaacttggacttaatatctgtagaaaaccggaggggctact

SEQ ID NO: 6616 - DNA, 511 bp, Triticum aestivum
  unsure (1)..(511): unsure at all n locations
  Clone ID: PAT_TA_6616
gaaatccagnaatccatccgcgccgtcgccttgtctctccacctccgtccccccgcttcctccctaccgcgccaatggagatcaccgacccgaggtgagcctctcgatcagcccgggctccacaatggcgtgtctggcgccgcacttcaagtgggccccgtcttcgttctccaccacccacgcgtaccggcacccttcctcgtcgtcctcatcctccaactcaggcaggtgctccggccgccgccccttccgtgtccagtgcgctgtcacttctgctgctgcagcagtcgtcgacgctgaccacgcggctggtgggccgctccacctcgtttactcgtctccggactcggcgccggttctccagagaaattttgagtcaactctggcatcagaaacagttctgaacaaagaggctgttgtaactgctgcagctgcagaggcagttgcccttgcaagagcagcagcttgaagctgcccaagaagttgttcacatggtacagaagagtagttc

SEQ ID NO: 6617 - DNA, 528 bp, Triticum aestivum
  Clone ID: PAT_TA_6617
gaaaagcagcagtccatgggactgcagatcctcagctccacgccggagcactcggcccagcactctaccggcgcgtccacggccacgaccgagtcgggtgccgccggccggctgccgacgccgctgggcctacctgtcgccatccccgacgaggccgtgacctcgcgctcggcgtcggcatcggcgcagtcggcgtcgtcgcggttcaagggcgtggtgccgcagcccaacgggcggtggggcgcccagatctacgatcgccacgcgcgcgtctggatcggcacgttccccgacgaggacgccgcggcgcgcgcctacgacgtggccgcgctccgctaccgcggcctcgacgccggcaccaacttcccgcgcacggccgggtcgacggagctcgccttcctggcggcgcactccaaggccgagatcgtcgacatgctccggaagcacacctactccgacgagctccgccggggcctgcgccgcggccgcggcattggggggcgcgcggagccgacgccgtcgtgggcg

SEQ ID NO: 6618 - DNA, 1327 bp, Triticum aestivum
  Clone ID: PAT_TA_6618
ggcagggccagtcgccgcgaaggcgacacaaccgcttcggacagtcgcctccagcccaaagccccaagccccgcgatgccctcactcccctcccccttcgccgccggcgactgctccgccgataagttcgaccccgactacctctacttcctccgccaccttcgcaccgaaggcagctcctatgtcctcgagctcccgccgggcggcgcctcccctgcccccgtcatcaggtacgagtcccccatcgccatctccgacggcgaatgtgtctcggacccctccccgggcggcgcaagcgccaaccgccgggcggaagagtgggactcgtcggtggagacgcccccctcgtggatcgactccatcgtcgacatcgacgaggattaccgcattttcctgcaccacacgtgcgtggtgaataaccgcctgaagctccagatggggggcgtcgttgtggactacgagccggacccggacgccgcgcaatctggaggcagcagcggggtcgaggagcaatcggagaaagacgcggccgttgcttcctcggagggagaggagcaggtggtcgactcagatgtgccggttgtaattatgccggagccgaacgcctacgactggcgtgcggatccagcccctcgtcaaaggatgcagggtcaggaagatattgggcacaaggatgctcagcctcgcgttgcttcgtcacatagatcagatgttatatggcctccacatatcaaccgtaggccagattcagacttcaagcgaagattgatggatgctcttcagaagccatttagccggaaagagtatattaagctgtttgacatggcttctattcgtactcctttagtgaagttgcgacaggtgcgcaatgatgcaaaattctaccctaccgaggagatgggcaattcatattttgatcattacccagatcttgtcgaacaagttacaaacactagcttttccaagggtttagctctgatgcgtggatttttcttctggttgcagaatagtgcacacgaggatcaattcaggccatggacagatgatctgaaagatcaagaggttattccattgatggacttagattacccattgccttagttcacccatcttctcttttgtggagattattccctaagggtgaaaccattctcagtacagaatatctgatttttatcattttatatatggagtgtgcgaataagtactgtagcagcctgcttgtgttgctctttctcttgggagaataaatgtatatattgctcaactggtgaaaggagaaatcattcccctgtgaaaaaaccaaggcgacttaaaaaaaaaaaaa

SEQ ID NO: 6619 - DNA, 745 bp, Triticum aestivum
  Clone ID: PAT_TA_6619
gtcgagcccggctgccccctccccctcgtcgcgcccccccgcctcgtcgcattcaccatgctcgtcggcatcgccatccccttcttcagtgggctactagggttctttggtggttttgcatttgccccaacaacctacttccttccctgcattatgtggcttgcaatcaagaagccgtcgaggtttagcatgtcgtggtgcatcaactggatatgcataatcatcggcatgcttctgtcggtgttggcacccatcggaggcctccgttccattatcatcaactacaagacctaccaattcttctcatgatctgctggaaacgtcatgcagcagtccagctacttgtcgtggtgcatcaactggatctgcataatcatcggcgtgcttctgtccgttttggcgcccatcggaggcctccgttccatcatcatcaactacaagacgtaccaattcttctcatgatctgctggaaacgtgcatgcagcagtccagctagctacttagatgcagcgtattatatgcatagtgtgtgttaccttgtcatgtttaaattaggccaaagaaatattcgtgtgtttgtggatgttgctcgatcagtttgtgataattaaagaggatcaatgcctaaatggaggttctctctttaaaaaaaaaaaggaatgtaagtttggtaacctaaaaaataataaaataaaaaaaaattataaaaaaaaataattaatataaatttatattaatatttaat

SEQ ID NO: 6620 - DNA, 1048 bp, Triticum aestivum
  Clone ID: PAT_TA_6620
gtttgtttttggaatccaacacaatatcgctctagaacgtgttatgagtagcaattagcagagttacattttgtaataataatttatacttatctagagcaggtttgcaattcaacatcaacttaaccttcagagtgccgcgacatggagaagcagggagtccatattgaccttgtgcatgacatgtgcactaaacaaactgactgagtgcgggcagctactcaagccttctcgactggcgcgccagataaatggagcatctcggtgtggcatgtaacctgttacactgagaaaagagagacagttggcaaggagcagaaggatgtcttattgtcctggggaaacgtgggaagtgggccttctcgaattaaagctctgacacctgagaataatatgtagggagggggcccatcaattcagcttaatcggatgtcgcccgttgagatgcgcaaacattaggggcgcccctgtattaaacccgtgcaccgccctcagcatggcaccggggccagaacgagtcacgccggtggcgtcgtgcaagacggagggggtggcccagtatgctgcttagaaggaggtggcagggctgggatgaaacagggagcgggcgcagcgggcgaacgcgcgggcgggcgccacgggtcagggccgttggcggcgtgcgccacggaggagttcgccccgcttcgccccccgtcaccaggcgtctggtagaggcgggagagccagcgggggcaccgggcggacgccactcgagcatcgcgccgggcgccggaatccagtcacggcggtggcgtcgtgcaggacggaggtgatggcccagtcgcgcccttgccggagctggtggcggggttgaggagggagaggcagcgggggcagcgggcggagcccgaggccggggttgatggtggggtcgcggtggaggtgcgcgccgctgcggagcttctcctcgtacacctcccgcgtccccccatgttcgccggcggctgagctaggcctggcttggggaagggggagcccgccgcggtcggcgcgtccggggaagagc

SEQ ID NO: 6621 - DNA, 590 bp, Triticum aestivum
  unsure (1)..(590): unsure at all n locations
  Clone ID: PAT_TA_6621
ggaacgggcgcgggacgggcctccgccggccgccggcccccggggcccctccgggccgccgacctccggccgcccgccggctacctggtcgctggagagtatatgaagcgccccgacgaggcacgtgctgggggagtcttcccgggctctgacaggagagcaacaccagtttcgcaggcatgagatgggaatcaccattggtgtggagtaagagaagaatgtcttgttattggactgtagacatccttgttatttgggggttcacaaccctgttagtttgcctcgccccaaggaataagcgttaccctccgcaacgaatatattagatcgagcatcatctcttgtactcctttatctggagatgtcttctaagtagaaggcatcccgggcgggcttgcttcccgccagctcctgttaatgtagcctggcatcccttacattttctccttaagaaccatcagttattctgtactgatgtcttgtatgcttccttctgcctgcattcatcattacactcctttgtttgttacacctgtttttgagtctctcaagccaaaaaaaaaanaatcattattacnggaaaaaaaana

SEQ ID NO: 6622 - DNA, 1565 bp, Triticum aestivum
  Clone ID: PAT_TA_6622
accgtggacgaaggtagcgcagatgcacgcaccgcgcgccacggggcagcgagcatcgaaatcttcttcctcccgtgcgagcggtgcggcggagcgatgccggccggtgagcccctccccggccgtggtgccagcagcaggcctgcagcgccggccacagcgtactctggcgttgccaagaagctgccactggctctgctcgtgttcttctcggcactgctctacaaccagattcagccgccgccgccaaaggtccctggctcgccgggcgggcctccgatcacggcaaaccggacaaagctcagggacggcaggcacctggcctacctggaatccggcgtcccaaaggatcaggccaagtacaagatcattttcgtccatggcttcttctgctgcagatacgacgtgctcaacgtctcccaggggctgctacaggaactgggcatctacctgctgtccttcgaccggccggggtactgcgagagcgacgcgcacccggcgcggtacggaggagagcatcgccgtcgacatcgccgagctggccgacaacctgcagctggggccccagttccacctcatgggcttctccatgggcggcgatatcatgtggagctgcctcaagcacatcccgcacagcctcgctggcggggccattctcgcgccggtacgcgggccggtgggcaactactggtggtccggcttgccgtcgaacgtgtcatgggacgcctggtaccagcagctcccacgggaccaatgggcggtctgggtctcccaccatctgccatggctgacctactggtggaacacccagaagctcttcccggcctccagcgtcatcgcctacaaccctgcgctcctgtccgaagaagacgcgaagctcatggagaagtttggaatgcgaacctacatgacgatgataaggcagcagggggagtactactgcctgcaccgcgacatgatggtcgggttcgggaagtggggttggagccccctgaacctcaaggacccgttcgccggcggcgaaggcaaggtgcacctctggcatggcgcggaggaccgcatcgtgccggtcatcctgtcgaggtacatcagcgaggggctcccgtgggtagtctaccacgagctccccaagtccggacacctcttccccgttgtccaggagatggccgacgccatcgtcaagtccctgctgctcggagagcagtgaccttccactgccacgggtgaagatggtctgtttcgagcgagagcgtgagatgggccattagggtgatttcgaataaattcaccaccttaacacttgaatttgattgagcacttggcccggggagtaaaggtagactatccctgttttaatactatgcacttcgagatgtaccctccagtgccaagttgctgcgatatcatatcaatcaaatactgaaacgtggttttggcgtgtcccctgcaatagaaaattgcagagatgagcgtgccctaggtacccctgtccgggcttacaggatccctcattttttttaggtcaaaatttggccataaacttaacaaatataaaaagtttgttc

SEQ ID NO: 6623 - DNA, 747 bp, Triticum aestivum
  Clone ID: PAT_TA_6623
cccgtcccgccggcctccgttcaacttccgtcctcgctccctctcccccacagcaataggagcttgaccggacggcctccgtccaactctggcgaccgtcaactccggccaccggatttgcttccccgccagcctccgcccaaccctggcgaccgtcaacttcagcgaggcagttttgcggtgaggtgtgtctgtcccggccatcgatgggtccgatgacggcgacaaggtagtggcttcaccggctggcgctggatccggcatccacgacgcctctcggcggcctcctcgtccatctcatccccgatgtgatcagctcgtgagcacgggcaccaggacgggtcaccgcgagatccggcgactccaagcctgaccgccaccgtattttatcgtcggcctcccccgctacttcagtttcagatatttgttgaacattctttgttgctttactagatcatcggccccccctggtacttcagtttcagatatttgttgaacattctttgttccttcacctgaccgccggcctcccctgctacttcattttcatatatttgcaacttgatttgaacattctttgtttgtgacagagagcatgcggtatagttttttgaaagagactgagatctatgaaattacttatctgaaaatatgtaattacttccctgtaatatatttgaatgtggtgttgcaagttgtgaaacaaatttatgtgaaatgatttgtggaatatatgtgaatttatat

SEQ ID NO: 6624 - DNA, 269 bp, Triticum aestivum
  Clone ID: PAT_TA_6624
gtcggcgctaaatcacatgcaagacttaagataagactattttatcaaccattgtacatgcccttagttagctggaaggtccgtgaattccctgcaatgagcccatcgatgtagcatttttggctacaaaactctatcgattaaaaagaacgctcgccgccgcgcggctgtcagtgcacatggactatcatgcgacggatggcatgtccctgagccactggtcaagcggcttgccaatggcgtagacgatgaacccgatgtcccggagc

SEQ ID NO: 6625 - DNA, 424 bp, Triticum aestivum
  Clone ID: PAT_TA_6625
aggaattcggacgaggccgggctcccccagctagcgcttgttcgtctcatgggtgggcacatagccgccctgctttgctcgtgacaggcgggctgctgctgcatttgacttcttgcttgtgaaggtgcctagatcctgatgcatagtcaactctcggtatatgcaggcgacctgcaactccgcgaaatgaatttgctagtgccacaacatatgatgtcttgtgtcttatgacccatgggctctagctgcaccagtttagcaaagaagaggaggtacaagccataggtgcaagcaaagcaattttgatatcagagatgaaaatgtaggtgtagagatggttgtaatttaggttgcactcacatggatgttattcataacagacaggaggtgctatttatgtcaaaataaatcacagattgaaaaa

SEQ ID NO: 6626 - DNA, 1375 bp, Triticum aestivum
  Clone ID: PAT_TA_6626
cgtccggtcggcggcactctggccatggaggcctgctcctcatgctcctctgatatgcctcttcgcccctgccgaggacggcggtgaggggcaaaggggcgctgtcgttctcccccctcagcgcgtgcgtcagagacggacaaggaagccgagcagtccgtcatgccgtcgacgccgtcctctcctaccaaggtctggattctcctcccccttccctcatggcggcgcctggatcctcctccctcttcgcttccatggcggcacccggacctgccgcatcttcctcatcgtcagtccgagggagaggagtggcagcagccatacacgcctcgtccgtgtcgcgtggtgtcccagatgcgtccgccccgtgctctgccgatgcctgtctcacccgtctacggccgaaggaggggaggactggatgccaaccgatctggaggaagaagcggacacccggacgaaatcgacggcgagatgcttggtgacatccctggataggcttcgtggtggagggcgcttcgtggtggagggcacggcctccgctgccgggtgcattatgaggcactcgaggggtagggtcgcttgcagcgcaggtgcccgtcgtgtgtcccagcggggcacttgatgcagctgcagcaggccggcaagtttggctgatttcaacactcaaggtaaattatcataaccatggaatgacacatactgatctcagcctggagaatgttcatgtaagggccagtacacaagcatgtctactttgccatatggatggtggatttagaggacaaatttatgcaccagctttgagttccatgatgttgcgccgactatgtggaacccaatgattcatagtgatgtattttcttcttcgagagagaggactgtgcaatcagaagtacaatatgtgatcatcaagtgtaagagatggcaagaatatgtgggtacagatgcggcggcgacaacgtcgacttcggtgagatggctggtggaccaaggaccaatcctgcatttgctttataatatgaagtaatgtcgatgtgtgatgttaacatcatggttatctacagatgtatgggtacgctccgtttatggtcgtctctataacgtgtggagtatcgagacctgtttacggaggtgtatacacgattggaggccacgacgagggatacttttaactgacatggatgaccgcatgatcttcggattggtcttcctacgctttaggcgttatacagactctttgattaagtgtatttcgcctttttctgttgttgttttttttggaacgtggacttggttatggctatgtgcatctcaattatgcagaggccgggtgtaatgcttaagtattttaagtaataaagcaccttttatc

SEQ ID NO: 6627 - DNA, 752 bp, Triticum aestivum
  unsure (1)..(752): unsure at all n locations
  Clone ID: PAT_TA_6627
cacgaggccttactcnagaaggggaccaaccccggtcgccgggatcctccgccgccgccgtcgtccatccatcctcccgccaggtccctgtgctagatggcatcttctactctgaaaccaggtgtgcctatcactctgcaagagcttgagccctcctcggagatgttcaagcaaggggcatccatccgagtaacaggaacccttcagtcatacgatgtggactccgcggttgccgtcatacgagatggcagcgcgacgcttagaattgacacccagcacctgagggaaatcggtttccgcagcggctctatgttccagttcatcggcgagctcctgatccggccaaacaacgacgcgattctgcaagcacgtgtgggcaggaacgttgatggccttgacctgaacctttaccagcagtctctgatcatccggcggcagcataaagccagactgctgaggagggattgatccaaagctgtgaagcaggctcatgcctcatttcagttccggaggacataatcacctcgactcgacaatcctgggcttcaattttttagatgggtgcaaacctacaaagtagtactagtagctgttaactgaatttcctgagcacagagtatttctctgtgaccacctcattttcaaggcttttcatgctcattttatttgagggtccatacatcgttccaccgcgtttttgtgggctggcattcccttgcagcagaggtgagtctnacagattagctgcagag

SEQ ID NO: 6628 - DNA, 621 bp, Triticum aestivum
  Clone ID: PAT_TA_6628
agaaggggagtaggcaaaatggcggtggtggaggtggcagtgggtgctgttcaggatcaggaacttgtggaaatggtgattgtgggggtggcgattgtggtggagatgattttggaggggaatacccgatggattactattcgcaggacgggggtgattggaatggctgctacatgaagaagaaaccctccactggcgagagaaagccgcgagttcgaatcggcagtagtgtccaagtcgaggagaagcaatgaaaagaaacatcgctgaggttacagaagccgaccaagatatcaacaaccttcatggctccagaatttttgacaccagacttaaatcttggcatcgtcattcttcacgcaacgcaacagaggacaaactttgccagtgctgacaggccttttataagcatcaaaatactctgagctcctttatcatcaatcaaacaagccaatgtacgatgttgttcgctgctgtggtaccgttgctgtatactgggatgtaatgtatatttattttccctgcatcatactgtaaacttgtgtatcgttcactgttgatctttcccccagggtgtcagccgctttggctctgttaaaaaaaaaaaaaaaaaaaaaaaaa

SEQ ID NO: 6629 - DNA, 461 bp, Triticum aestivum
  unsure (1)..(461): unsure at all n locations
  Clone ID: PAT_TA_6629
aggaattcggcacgaggtgtgtgcgtgagtcctaggtggtgttagtggcttacgcacagatcctgcctagggaccagagtacaatgccgtgagaggatccagagttgccgtgatgtagccattggaaagagggagaagattaggacgtgtgtgcgcccacggcggcgttcgtacgccggccggaaaaatccttgtgtccaatgtctcctttctcctacctctgtccatgagtgagctgagagaaagagagcagccaggcttggcaacgacaccaatcttgtttgtttttcatgattattgtggtaacactatagatatgggttaacgttacttcgtgtggactgagtggtggcatcaccatctggaagcgtttgtcgcaaattcgaagtctctacatggaatgacatcgattccacaaaaacgtttccaacaaaagcatttgtggtntgacaaaaaaaaaa

SEQ ID NO: 6630 - DNA, 437 bp, Triticum aestivum
  Clone ID: PAT_TA_6630
ggtcagcaaggtttcgttgctctacatcacttaccaacaacacacgagcaagatggtcaagaaacagaaaaaggctttggaaaatatcaactcccgtcttcgtcttgttatgaagagtggtaaatacaaccttggatatcgacaaacacttcgtatgttgagacaaggcaaagcaaaacttgtcatccttgcctcaaactgtccatctttgaggaaatctgagattgagtactacgccatgctggcaaaaactggtgtccaccattacactggaaacaacattgagcttggcacagcttgtggtaaatacttcagagtatgtacgctgtctataacagacccaggtgacagtgacatcattagaagcatgccagctccttctgccggtgcaggaactggtggcgattaaaataaaaatgttgcttccaaaaaaaaaa

SEQ ID NO: 6631 - DNA, 1615 bp, Triticum aestivum
  unsure (1)..(1615): unsure at all n locations
  Clone ID: PAT_TA_6631
cgttccgcacgaggagaagaccatggccgccgcggcgggcgacgagctggagacggtcgaggtgaagctgcgcgccgtcggtccgtcccggcccactaccatccgcctccccccgctcatctcggttgccgatctgcgccgcaccgttgctctcgaccggcgtctcccacaagaccgcctccgcctggtcctccgggggacgactctaccgtggggagacgacacccccctcgtcctccgccgcggcgggggccgtcttgtggttgccgtggcacctaaaccacctgctaagcatctccgcggtgatgatgatgatgatgacgatgacgatgaagaagaactgaagttcaagatacctcaaacaacaacctgggtggaagaaaaggattttcatatttcttcggagaaaaactgtagattgcccgataccttgttgatggcactattttctgcctcgatggttgcctcgctttgcttcccactggcgccccttgcgcgaacctatggcgcgggacctttaggtcgactcgctacaggttcctgcatcagacttcttgatcatacttcacgaccttgggaagacgacagcaaggtcatcttagtgcatgctcaattttcaatgaagcctgcagcatttaacgcggagcgcatagatcgagacccccgggcaggtcaattgtaagcccttatctgtgttgccaggactgcattttcctgatatttgagtgtgcaaatccaaataacaagagttacagcaccgatatgctggttttgtatctgacgagacctccacaagtgaactttaccttcaacagtggaaaggcccagctgctttcagccgctttttgcatgcattttctgcgcagccacccctggttgtcgtctcctgtgcgatgagcaacatcacaacataaacagaacttacatacatgtgctaatgtgcgtcagatctaccagggaagagttatctcatgtatatctggagttaaaagtcttgagccgatttgactatgtacgcctacgcgtcgcagtgcaggttcgcacatccacatcagaaacatgcgcaggtacatttgtaggagtaatgagagctacattcgtactactaaggccatgcacaatgcaagatgcttagacaggtgcttgtaaaaataaatttgttttttctggattagcacacagaaaaaagaaagaacatccaacctaacattccattccttcctgggttagcacttactctaagaagggtgtttgtttccagggacttactgatctagagacttaaagtgggtcatttgggggacttttagggacttatagttgtaatatggtcttatagagacttataagtctcaggaaccaaacatgtagggactttttagggacttgggacttataagttgggactanaaaaagtcctaggacttgtaaaccaaacagggcctaagatgggagtagcagttagcagctggttaaaaacttcttgatgatggatacgaatttagcatgccactattgcatatctatcaaagaatgccaaagtgtcaaccgtcctctaatacagtccccggttctcacttgtaatcaagcagcagcaattagtgcttcagccatc

SEQ ID NO: 6632 - DNA, 2270 bp, Triticum aestivum
  unsure (1)..(2270): unsure at all n locations
  Clone ID: PAT_TA_6632
ccacgcgtccgcattcttttccgctctcatccatcgatcgattctggctgtcccacgcgtccgggatttgggcgcggctgcctgtggcggcggtgaggcggcgggggtcgatcgaagccgagacgagtcgcaatgccgacggcgacggcgacgccgacgcccaaggcggtgatccaccagcggtacggcgccaaggccgtctacagggtggatgaggtgcgggaggccgttgacggcgtctgccccggcctcgcgctgccgcagagcaccaggtgcgtctaccgctgccagctcgacatccccggggtgctcagcgtctccaccccggggaccttcgtcaggaagaaggacgctgagcaggccgccgcgcagatcgccatcgaaaagcttggtattcagcccacatcaaatatccctaatacacccgaagaagcttgggaggaacttattagtcggatatcttacttttttacagatgagaacttccccacatcatctcatcctcttgttgggcacttgagtgtgacactcagaagaactggggatttccttggaaagatacctatttcagctattgttgcttgtgatgttaaggtccagacgttgtgtaaaattattgaccctaaggcagaatttgatcctctcttggttctttcgatgatctataatgccgccaaacaatctcctggtgtatctgttagtaacagaaacttctggattcagagtcaaaggccttattcctctgaggctgttgatttggcacttcagtgctggtctggtatttcagatcccataagagtagaagcagttcttattccttgtgcgatggaggatgaacctaagatggtaagccttaatatatcagagaatgaacattacatgggtgatatagcattgaagctctctgcaaccgactcatctcatgtccttgtttcaagaacagttgacaaagcatcctctgagatgaggttttatttcccagctccggatgtacaatttgtttctgatttatcaaaacaattggtggatgatcgtggagatcgcaatatgaactgcctaataaataagcgagcttcctacatttctggccaaacaatttatggagatgcagttttggcaaatgtgggatacacaaggagagatacagaacttcaaactgatcatgtcaatctatgtacctattacaggattcttctgagaaaattacctgatggaatttacaagatctccaaggactcgattcttgtggcagagcttccgtgtgtttatactcgtaccagttggaaaggcccctctccacgagatctcctttgttctttctgtcgcctccagaggctatcagaaccctatttcgctgccaatagggtaagtgcatcctgtaatgtcctaggatcagctgtgggctctgaagagatggggtcaccaaaagcaaccgcaggaaatcagtgcgcaaatgatggaaggattgccaaggaaaacccagacatgttcaagtgctctgtcaaaatatattcaaagaagagggaccttttactagagtattctacagattgtagctggagcaaggaaactgatgctattcagaattctgcgttgaaggtcttgatttggttcaatcgttattttaagcagctgaacacgcctgtggagaagctaaatcttcctaagagcactgatggcttcacgatatatccgaatatatttttacaagaatttgcaatgtgcttatctgtctatggcaagacaagtggtggtgattcaagaacatgcagcgcagttggatatttttctatggatacatcatatcagcagcttgaaagcagtgcatttttaacagacattgatggtcaagattctggcgtttttccatcccatggatcgttggcttgcataagctacagtgctcacctgtttatgaaggacagcagaaagagatacctcctagaagtcaacaatgagtttgagtttgagataggggctggagctgttaggaatcagcttgaatcatgtgcaactcaactctcagttaatcaaagtgcatgctttgtagatcaactgtctgatagggatttgagcctggctgcagcttgtgagttgtcactggacctttccaagatatgtagagacagctgcgtcttggagttctccgtaaaggtgttacaagtaactgaacctttagaagatagaatggagaaggccttgttcaatcccnctttatctaaacagagggttgaatttgctgttcggcacattaaccagctgcatgctac

SEQ ID NO: 6633 - DNA, 1019 bp, Triticum aestivum
  unsure (1)..(1019): unsure at all n locations
  Clone ID: PAT_TA_6633
gcggggccgcggccattttcgctttccagtatccacccgcggcggcgctcctcctcctcactgttgaatcccgccccacctgctccgccctcgaactgctcgtctgctcgccccgcccccctctcgctcacggacggggcgagctccggcggctccggaagaaatcggggcagggcctggccgcgggagctcctcgacgagcttggagacttcggcgctgacttgggccggacgaatcggtgcccgcctgctctcggattcacgggtcgagctcagggcgcgtcacctgttcgacggaatgctcagcaagaccgcggcgagcggcaagggtcacttcggcgacctccccgacgacctcctccggcacgtcctgtcctttctgcctgcggctgatgccctgcagacttgcgtgctcgacaccgggtggcgtgaccattggaggcgcaccaccagcctgcccctcatctttgaccagtcgagtttcccgagctccgaacgtttcaaacagctggtgaacctcttcatccacctccgcggggactcacctctcgacaagtgcaagatcgttggctgtcttgatgacgaggatgatgagcgcacatacacaaacaccatgctgttgatccagtacgctctaaagtgccaagttaaggagctcctgctcagtgttgctgctgaaggagatgatgacattgacgtcgaccctctcctactcgatgtgcctctcatctcccagcacttgaagaccctacaccttaaatgggtttacctaaaacgctccactctgaatttctcgcgttgctcggtattggaggaactagagatgcacaatgcacatgagcaccaggatanctcaaatcactaaacactgtcatacaattttgtccctccctgctgagttcatatcgntattgccccggtctanccatgcactngtgtatcatggntnaccctanttgatnagcacctaaacactagttgnaaacagatgaacatcngcttacggagangtatntttn

SEQ ID NO: 6634 - DNA, 1663 bp, Triticum aestivum
  Clone ID: PAT_TA_6634
ctccacatccccttccactcgctctctccctccctctctctctccgccagggggaaaggcaaaggaaaaaggaaggcgcgggaggccagccggtggtggggaatggccggcgcgtcctcgccgcccccgacgcccaagtcgcccaagctgcagccgccgctcctcgagcgcgccaagggcccctccggcctcgacaagatcgtgctccgcgacccccgcgggttcaccgccgaggtccgtctatatggagggcaagttacctcttggaagaatgagcagggggatgagttactttttgtaagcagcaaggcaattttcaagtctccaggagcaattcgtggtggcatacccatctgcttcccccagtttggaacacatggaaatcttgaaaaacatggatttgcaaggaaccggctatggctcgttgatgataatcctccaccgctcccagtaaacagcggtattaaaacttatgcagatctcattctgaagccttctgaagaagatctcaagatctggcctcacagattcgaattccggttaagagttgctcttggacccaaaggagatttgtttctcacttctcgaattagaaacaccaacactgatggaaagcctttctcatttacatttgcatatcatacatacttctccgtgtctgacataagcgaagtacgtattgaagggctggaaacaatggactactttgacaacctgaagggaaaagagcgattcacggagcagggggatgctcttgtgtttgaatcagagattgataaagtatatctggacacaccaccaaaaattgcaattattgatcatgagaagaaaagaacatttgtgctcaggaaagatggtcttccagatgctgttgtatggaacccatgggagaggaggtcaaaaaccattcttgattttggtgatgaagaatataagcacatgttgtgtgtggaacctgcagctgtggagaagcccattaccttgaagcctggtgaagagtggaaaggaaggttggagctctcagctgttccttccagttactatagtggccagttagatccagacaaggttcttcatggttgaaaatcctcacttggtgcatctcgtacaggaacacttcagggcactttatattacctggtgctttgtctgtctggtgttgatgctatgtggagttgcgggctttcatctcctcatcgtctccacctacatatgtttatttcttcatgtatagatggaggaggcgagcaccggaataacgaaacagcctgagtggctctatctcgaaatctgtcttcggtgcgctcagctcagtgttcagttgcagcaaaaaagaagcgaataatagcattccgtagtttagggtcgcctcctagccctggacaatgggtgatttgttgtacttctgcatcgggctaggaaatctactaccaattgttatcagactattgtctgtactcctctaagatctgtacatatgctatctttaggaacttcctggtgtgagataagttaaggagcacaatttatcatgtgctgctggtaatgcattatgcaagtgtgttctaaaccttaataacaaggggattctcttatttccttgtcgatttacttaactcttcagaaaaaaaaaaaaaaaaaagtcgacgcggccgcgaattcg

SEQ ID NO: 6635 - DNA, 431 bp, Triticum aestivum
  Clone ID: PAT_TA_6635
ggtttgttcagcacctcatagttcactgtatccatttcttgtggagagccatggtagtgcactacacagtggtttttgtttgtggccatgggagtccatactgtcactgcattcggctaggttatgaagaaaccaacacagattggatccaactgaataggccagggagcaaatcaagatgtgcctattcttgactgacgttaagaatcagtctccaagtgagtaggcgattcttttgtacaatatcgctgtacaatattgtttcaactatgcgtgtcttctaagcccgtcccgccaacgtaccaccccccggtactgcctggcaacgtaactgccggctgtttcggtgtctttaatctgctggcgtttctctttattaaatctgcgttgttttcatgatatgtaaaatatcactatactgccatccaaaa

SEQ ID NO: 6636 - DNA, 1329 bp, Triticum aestivum
  Clone ID: PAT_TA_6636
tccggtaaccgggcaaccggagcacactcttcagttcctgttaaacctgatgattctgacgagcttcggctagtgacttcactccacttgtttggttccctgttcgtgccatgcctggcagtttgcctccttccgtatcctaccgatcccctgagggtcagagcatagttcaacatgaaagaatgattgctctcgctgatgaatttggagctttccataatcaaatatttgaaaatacttttgccgtacatttcactaatccattccatgtgagcacacgtgttgttgacaagtgcaatgatggaactctacttctgcaggtaatattgcattctgaagtgaaggctactctgcatgtaaaggatgtatcattggacctacaagctggatttgagcacctaggcaagggagatggacgtccgccttcgagtttgttccctctggttattgctccttcttccaaagctggaatcttgtttgtgatacgtttaagtggcacaaaagacctagatgagctggaacaggctgacagcatgttgcatattaaatacgggatatccggtgaccgagcaaccggagcacactctccagttcctgttaaacctgatgattctgaagagcttctattcaagatttcactcaaactgaagcgccctgttctagatccatgcctggcagttggattccttccgttttctactgattgcctgagggttggtcaattagtcaacatgaaatggcgggttgaaaggctgaaggacctggaggaggcatctctgtctgatgatgaaatactttatcaggtggacgctaatccacagaactggatggttgctgggaggaaaagcggtcacatttcattctcagaaacacaaggatcaaggatcgagatcgccgtgacatgtgtcccgctggtgtcggggtatgtacacccgccccagctaggcctgcccgacgtaggcgatgcgaatatcagctgcaatccggcaggtccccacctggtgtgcgtgcttcctcccactctcagcacctcctactgcataccggcttgattcatgagccatctccgtgccattacgttagctacttatagaggccaccatttgagatacaaggtgttctgtttttgcctggaggctattcttttttctataggttacatgcacggtgtatattgattgactaggtgcgaatccgaattcttgtgatgagctggggggtttaaccctcaacatttgcattgccctgagtaatgagttgggggtaaaccctccccatttgcgctggcgccctcgccctttgaaaatgctagcattacagctgcttgca

SEQ ID NO: 6637 - DNA, 1265 bp, Triticum aestivum
  unsure (1)..(1265): unsure at all n locations
  Clone ID: PAT_TA_6637
cggcacgagcactccgatagggaggctcctagcctcctaggctgtttgattgtgtcgttgttcgtcctcgttgcatccttcactttacttttgcactcccacccctccatgccctcgaaattggcgccaccgccctcccgtgctcccccctcgcctgggctctcgacccatccctgctccaaccctaacctcagatggcgcttcccgcgtgagaggacgctgctgcggcagcagcgttgaggggggcttcgtcgttgtcagcgcgacagatgtataagcagggggcggccggaggggcggggccggaccggaagcgcatcagcgacgcgctcgataagcacctggagaaggcggccgcgtcaccctccacgtcgagaggctcggcgggtgcccgaggcaaccacaaccgcgtcgtagtgccgtcctccatccccaagggccgctgctccgaaggggagtctgaatctgacagtgaagcatcagatgttagtggctctgatggagaagacacctcatggatttcatggtattgcaacctaagagggaatgagttcttctgtgaagtcgatgatgattacattcaagatgacttcaatctttgtgggcttagcagtcaagttccatattatgattatgctcttgatctcattttagatattgagtcttcccatggtgatattttcacagaagaacaaaatgagctagtggaatcagctgctgagatgttgtatgggctaattcatgcgcgatacattctgaccagtaaagggttggctgctatgctggagaaatacaagaactatgactttggacgatgtccacgggtttattgctgtggccaaccatgtctaccagttggacaatcggatattcaccggtctagtacagtgaagatatactgtcctaagtgcgaagacatctactatccacggtctaaataccaagatattgatggagcctactttgggacaacatttcctcacctgtttctgatgacgtacgatcacctcaagccccagaagccctcgcagcgctatgttcctcgcgtatttggcttcaagctccacaaccacaagccatgatgcggaggtgaaggaaaagataagaggccccggaagactactgtaagagtgcaatcgccagatcatgctgcccacccatattgtgtgnccctgtctggtctattcaacattgaaatattggtataaaagaagacatgagacgatgttgtaaccnattccagctctactggctagtaaatctgg

SEQ ID NO: 6638 - DNA, 470 bp, Triticum aestivum
  Clone ID: PAT_TA_6638
gccagctagctagcaagtagcagcgtagatacatgcatgtgcacatgcatattaggaaactagatcgggttcgcgccttggcgcgagggtgccggtcctaacgttttcatcaaacgggtaatactaagtcaatattaacccaggtttagcatatgcaatcatacgggataacatgcagtgaagacgagatatagatgtgcagacacatgtgaacaaatttcaaaattacagtaatatttaaaaaatatgttaacacttcttaagttacacagaaaaaggctatagtagtcaacaatgaaagtatcttcaaacaagaaacccaacccatccgacacttctacatcgccaccaagtgtcctgtggtagaaatatcagccaaaatatgcaatactgattttctgaactggagcatcacattctgaacaagaaacaggaatatttttggtcgacgacgtactgaacttggttca

SEQ ID NO: 6639 - DNA, 835 bp, Triticum aestivum
  unsure (1)..(835): unsure at all n locations
  Clone ID: PAT_TA_6639
gggagaanggaaatgataccccgagagcaattacttcgtgctgatctgtttgttagttatcatactttacctaacaaacatttgcttgtggcggtgagatcagcggcaagcactagcggccaccagcagatgcatgtggaccacagcaccatcatcatccagtaccacggacggacggctggccgtgcaagcctggccgcggccgaggtcccgggctgactcaagtaccagaaggccacctgatgcgtatgaatatgccgcaaggtctcacgcctgctcctgcatccatgacgatcccgatgtcgcattcctcaaggccgacgctcgggttccccctcggcacggcgctcctgctcctcgtcatcttctccctcagcggcatcttctcctgctgctaccactgggacaggctccgctccctcctctggtctcggcatcccggcatgctccaggacggcccgcacaccgtcatctccgtcggatcggcgccgagcaaggcagcctccgagcacaagagcgagaaagctggaaaggagtgcgggttgcccgtgatcatgcccggggataacatcgcgaagttctacgcgaggcctgccccgcacgaggcgtgtttatctgcagcaacagcagagagggcgaagtccaggtgcaagtcaagatgttcagtttccgtgagaccgtcagtatccgtatatgaaatcgtagttagctgctcagcgacttatgatgggtagttagattgtatatatgcaagcgacttaatgacttatgattgcatggattgattgtgtacaagcatgcattttgacagtttttgcanaaaagnagcaaaaaa

SEQ ID NO: 6640 - DNA, 1114 bp, Triticum aestivum
  unsure (1)..(1114): unsure at all n locations
  Clone ID: PAT_TA_6640
gctcctagcccctttgccccccgccggatcccgtcgaaccaaccctagcgaccgctcgccacccgggacggctcgccgtcgtcgccatgccccgccgcagccagagcagtgcccccatcgacctcgatgaagaggatgagtgcaagaccaagcgttctcgagcgagtataaggccagcaccgaaggtgcctgggagctcaaatcgcattgcaagtagcagaagggacaaggaaaatcaagacaaactggatacccgtatcttcgatttatacatggagaacctttggaagcgtacagatgaagatcaaaagaatgcttgcgcatatttggatccgttatggtttaacagttacgtcaatggggacaaagaacagaaatcaagaattcttagatggacaaagaaattgaaaatattttcaagaaaatgtgtgtttgtccctattgttcgttggggacattggaacctccttgtcctatgccactttgatgagacagactgctcagatgcaaaaaaaggaccgcgaatgctgctgctggattcacttaacacaacagatccgaagagggttggcacctgaaatcagaggattcattcgtggtatttatgaaatcgaagagcgggaagaaagcgtgcacttcataaaaaaaatccgtcttgagtttcctaaggtgccacagcaaaatggggaggaatgtggtatatatgttctttacttcatccattgttttcttcaaaacggaaaattggcacaagttcttgagaataaaacactggaagaagatttcagccagctgtttgatgatggcacgtttgatccagaggaactagagaacttccgcaaggatgttcatgcattccaagtggaaaggagtaccgaaactggacagtaggtggatggtagcattgtgctgcatatatgtagttagttattataacgcagtggaaaatttcatcttcgctggtggcgaattctgaggaactttgaaggtcgtggagaagctggtggtaatatacagcttatgcagccgagagaaagccgactccatggagtttcgtggcagttagcaggtgttatanatctgtatggattctagaattgttgtgatccatctt

SEQ ID NO: 6641 - DNA, 669 bp, Triticum aestivum
  Clone ID: PAT_TA_6641
gaggaattcggacgaggagtggacggaggccagccggggcacgtacaacaagggggacagcgtggcgcgcagcaccgtgcaggtgtaccccggcgcgtggacggcggtgctggtgtcgctggacaacgtggggttctggaacgtgcggtcgcagaaactcgactcgtggtacctcggccaggaggtgtacgtcagggtggtgaaccccgaggacggcgccaacaagaccgagatggccgtcccccacaacgccctctactgcggccagctccacaagtaccagaaggagcagactcctcatcacaagacggcggcggccgtgcggccgttggccgcgcagagacagattgtcgcgttggtgatgctcgtcgtcggagccctcgtgttcgcttcgtagcgcggcgccgtggatccattttttgtgccgtgtctgaggtgacttcgtgtgtgtagtgtaggttaggatcagaggtgccactggactgtaccaattgcccatgcactgtgttttctttgcgtagcattaggaacggtcgatcgtgtttattcattcacctcgaggctgtctgagggctgtgatttgatttgttcacgaggagcaattctcatatactccggattcttttacagtacaatttatttagctcacctaaaaaaaaaaaaaaaaaa

SEQ ID NO: 6642 - DNA, 943 bp, Triticum aestivum
  unsure (1)..(943): unsure at all n locations
  Clone ID: PAT_TA_6642
aggaattcggcaccgggcaaaaaatccccaaccaatctcgtcgcccatcaaccctaggctcgtcgaatcctcctcccccaccgcctcaagatgcagatctttgtgaagacattgacaggcaagaccatcacccttgaggtcgagtcgtctgacacaatcgacaacgtcaaggccaagatccaggacaaggagggcatccctccggaccagcagcgtctcatcttcgctggcaagcagcttgaggatggcaggacccttgctgactacaacatccagaaggagtccacccttcaccttgtcctccgccttcgcggaggcatgcagatcttcgtcaagacgttgactggcaagaccatcacccttgaggtggagtcgtctgacaccatcgacaacgtgaaggccaagattcaggacaaggagggcatcccgccggaccagcagcgcctcatcttcgctggcaagcagctcgaggatggcaggacccttgctgactacaacatccagaaggagtccactcttcaccttgtcctccgccttaggggaggcatgcagatcttcgtcaagaccctcaccggcaagaccatcacactttgaggtggaatcctccgacaccgtcgacaacgtgaaggccaagatccaggacaaggagggcatcccgccggaccagcagcgcctcatcttcgctggcaagcagctcgaggatggcaggacccttgctgactacaacatccagnaaggagtccacccttcaccttgtccttcgccttangggaggcatgcagatcnttcgtcaagaccctccccggcaagaccattacactttgaagngggaatcctncgacaccattggacaacgtgaaggccaagatccaggacaagggngggcatttcttcggaccancaggggtnttattttttgccggcaagcaactgggaggatggc

SEQ ID NO: 6643 - DNA, 329 bp, Triticum aestivum
  Clone ID: PAT_TA_6643
ggataaaactagcttagaacgtaactgctgcgaaactttgcttatgtaaaagacaccagcttttcagctgccttttctaaagcttttagagtattttagacttttaaaataccattatgtttagcaatggttttgtggtaagttggtggttaggacaaatgtttacagtcaggcgctttttatgtgaatcaatgcttattttattgataaacactcaactacaatcatattttaaaagtatcaatcgtttgcacagtattcatggtgtttataatgcatctgtgctgtaagagtggaaataaatattcaacctttgatgaaaaaaaaaa

SEQ ID NO: 6644 - DNA, 1346 bp, Triticum aestivum
  Clone ID: PAT_TA_6644
gcccaaacagggtatccccttatcctccttcgtcccagcccccaatccctagcccctcctttccaccgtccgtaccgccgccagcgaccagaagcgctcaaggacctcggcaatctcctgatccggtgggaaatcgtcaacgagccagaccagatccaccggagcaatcaagaatgggtgagcaaaaagaatgtgccaagcgtgaggttgctcgctctcgtgataattacatgtcatggagtgatgattgtaccaagtatatgcttgagtggtatatcgagaagcaaagggacaagccaccaaccttcaagtggaaggcacaacaccatctacaatgtgctaatgatttgaatgacaagagttggaattacagctacagcgaaacaagttgatcgacactttaggtcattcaaggagaaatggaagtggataaagctagcaaaggggaggagtggatatggcttcgataaagtacttaacaaatttaacattgacaagtcagagaaatcaccaagcaagcttggcaaaataaaatttaactaccttactcattccatcaagttttatcatctcttggaagaactgtttagtgactcatctcatgcggatggctcacttgctattgatgtgaataatgcaaagtgagaatgtggaatctgatggtagtagtgaaacaagcagccacacatcccactgctgaacaaggtcttagtgattctgacatgattgcacccaacagtccagcagaaggcactagctcaaatctgaagcgcaagcatgttaaagcaccacataagaagaaaccaaaggtcaaggcgcgtcgagccagagtgttagatgatgatgtggcagcgagcattgtgagtcttgctgaaactgtgaaatctgccgcccctattcagccaatagcagctacagaccctaatgccaatctttggaagcacattgagtcgctaactctcccagcaaatgagaaaattgagttagcaacctatcttgctaagccagaacaagaagttttccgtggtttcctgaattgtgctagcgaccagacttttaatgcttgggtccttgattatttcgcgcacaagtacgacggcaaagatcccgcaactgctgatccatcaatctgaatgacatgtttggtggctttcttttggcaagtgcttttgtagtctacttagctgctttccatgcacttatgctaagtggtattcctgtgctctaagggtgtttagagggtcttaccttttgtaatgcattgctgtagcacaaatctgaattaagctagtttgtaagaaattacttgatggggaggccttgtgcatgctacgtgcaatattgca

SEQ ID NO: 6645 - DNA, 967 bp, Triticum aestivum
  unsure (1)..(967): unsure at all n locations
  Clone ID: PAT_TA_6645
acgaggaaagcatgaacaattttatatactacatcaattaatatagtgttaaaactctaaacaattttaaacttatataagcatttactgaaatatacggaaaatatataactaattctcatattttctattcaatatgcatattattacatgaatatttttaaatttgcaatttaatcatatgagtattgtataaactataaagacatttttatatttcataaatattattttaaatatatgcatattatctaaataatacatgaaatttttgaaaattaaatttatttgttttgtatttaaaatattatactgcaagaataattaaaccataattttattactgagattagaatttacatacctttaaaaatttataaaataacatgtgcggatgtcaagacgtaatgggtcgagtgcttaagttctgctatgtgctagccatggtcgcttgttcgagatctggggcttatatttttcgttctaattctaaatactgccttgacaggcgggacctattggtcatagaggcgaaaaaactgaaaatgccaacgtcgacaagggctgctgtgtgaaaaataaaaaaaatcgagggagtttgtgcaaaaaaataggccacatgctttcctccctgccttcccgtcactgacagcaggacacacgccacgcaggcgagcctagtcagtgctactttcgtatccaaactcgatttgcactgtatttgcacatccgagccaagtttttagacctgtttaaantatgtcacaagttctagcaccaaagtgacctttcacgccaagttctagcaccaccagtgtaattgactcttttatgattgtaacctcaactatctagctctcttgctttaaattgagtttaactgtaaaaataaaagtaacatatataaacacaacgtatcgacgaggcgcggcgtgccgccgcccgggtacatgctagtacattnaca

SEQ ID NO: 6646 - DNA, 589 bp, Triticum aestivum
  unsure (1)..(589): unsure at all n locations
  Clone ID: PAT_TA_6646
ctctggggaaagctcgtccggatagatcgggatttgncggcgcttggacaaaagatcctctcaagttcgacaactcctacttcattgagcttctgaaaggggactctaatgggctactgaagctgcctacagacaaggttctcgtggaggacgccgattttcgtcgcttcgttgaattatacgcaaaggatgaggatgccttcttcagggactacgccagagtcgcacaagaagcttcccgagctcgggttcacgccttctccgcgctaccctactggcgtgggggtgcaagagacaaagccaagagggctgtcacgagaactaccgctgtctttgccgttgccgttgccgtcatcgcctgcgcttacatctgtgaatccaagaggaggctctggggttagccgccatgtccccatgggccctgaactgcaaattcagcgttcggtgctggtggcccatcctattgctaccattggctggttctccactcgtgtgtgcaactcttctgccgagtcactgtggcgtttgcctgccacgatctatcgtctacggggcatcctgtagttgtacgtaaataannaaaatacag

SEQ ID NO: 6647 - DNA, 503 bp, Triticum aestivum
  Clone ID: PAT_TA_6647
aaacaattcaagttcttttcctttgtcaagtttaaatatttgaactctgtttccgggttggagtttatctctggccaggtgagggctgaggcagcttggcgttgccggagcacaggacagaggcactaggcgcaggcctggggcatacctctctggcctcctcgcctgcccccttgccaatgggccctgtgtccagtagacggaagaggacggagttgcccatggtgacctcgtcgcctcctaaagttgcattcactagatttcttccaagtccatgacctctgtatgttgattgttttagatggttttccccggtgagaacattttgaaggttatctctttaggttcttgtatttggctcacgactccaacttttcttgaagggaaactcaagacatgtgtgtgcgaggaagggaagaggagagaaactttgacatttttcataactttctttttccgtggcaacgcatgaccgtggcaccttacaagatgataaagatcaa

SEQ ID NO: 6648 - DNA, 1494 bp, Triticum aestivum
  unsure (1)..(1494): unsure at all n locations
  Clone ID: PAT_TA_6648
gaatcggtttgccaagnagtaatatccttggggagggcggctatggagttgtctacaaaggccggcttatgaatgggactgaggtggctgtgaagaagatcctaaacaatgtagggcaagcagagaaggaatttagagttgaagttgaagccataggtcatgttcggcataagaatctggtgcggcttttgggctactgcgttgaagggatacacaggatgcttgtgtatgagtatgtaaacaatggcaacctagaacaatggctccatggggccatgggtcaacatggtatccttagttgggaaagccgtacgaagattctgcttgggacagcaaaagcgcttgcataccttcacgaagccaatagaccccaaagtcgtccaccgagaatatcaagtcaagtaatatcttaattgataccgaattcaacagcaaggtttctgattttgggttagcgaaacttctggattccgacgcaagccatatcaatacaagagtgatgggaacatatgggtatgtcgcgcctgagtacgcgaatagtgggatgctgaatgaaaagagtgatatttacagttttggagttgtgttgttggaatgcattacagctagggatccagttgactacagtaagcctgcagatgagtcaaatcttgtagagtggcttaaaatgatggttagcacaaagagggcagaggaggttgtggacccaggccttgaggttaaaccacctaagcgtgcccttaagcgggcaattttggttggcctcaagtgtgtcgatcccgacgccgacaagaggccgaagatgagccatgttgtccaaatgcttgaagcggttcagaaagcataccaagaagatgagaagaagcacagccagatgggaagcatcgatctagagtcgcagcagtcagcagaggagctatcaaacagtgctgatgtctgaagctccagttgtgaacaaacccaaaacaaataggaaaccctaagttatttgatagtgacagctgatttgatcaaacatgttcaatacttgagtagagtgagtgaaacaggtttgcaatttgcttgcagataccggaggttgttgaattcagttaggtgcaagctgctcatttccatgttttttcctttttgtgatttccgaggattgcttctatgctcccctagaagagttgccttactgtttgttttctgtggatgagtcttataactcgtttcctttagtgttttgtctagtcttcttctaggggagcatagaagcaagcactctcttcgtcctgagttattgtcagtgagctaccaggaggaactgatttgattgaaatgcatgactatatatatagataccggattgcgttgccgatgtatagaataccttgtacccgtgggggccggtaccattcgccnaangatcgatacccgccacggcgtctttaaactctgacggaaacctgggtaccactannctgacaacccttccacgggtaanaaagcnnc

SEQ ID NO: 6649 - DNA, 849 bp, Triticum aestivum
  Clone ID: PAT_TA_6649
ctgctgcctcagcatcaccgatagatgtgaatgtgagcacaggagcatttggctggcaaccatcagccagtgagagatcgaatgctgcatcagcatcaccgatagatgtgaatgtgagcacaggagcatttggctggcaaccatcagctgacgagagatcaaacgcgggagccgcatggagcactggctacaatccaaacatgtactcaagctatggagcagcagcaggagcagcaccctctgttagaacctctcagcaagcagcagcagcaccctctgttagaagctctcagcaagcaccagtgaagcaggaatacaccgagccggccgcggctgcctgcgccgcggcccgtacgctgtgcggagcgtcccttggctccttcgcccggagctcgaccgcgcccgctggcgttgcccaccggggctgcccgcgccccgaccggcacgctcgcccccgcggggcctgccgccgtggctcggcggtctgcccttgccgcgggaccggcgggtttagccccggccggccctcgccgccgcccccctgcgggcgtcgggagagggagggcggtgtgtttcttccgcgagagcgggtaccgcagctacctgcacatgtcacgtcgtttctacaagagtagagaaatgcaagtttttgagattctttgggtcatatgtttccacttctgctgtggcggttgggtgtaccgagcacgttggtggtcgtccggcggaggggtctcccttctgggggtgtccccagggtgagtctcctgtgtgggggcatggctgtcttccactggagctgcctgtgtaccgaaaatatttcttctttaaaaaaaaaaaaaaaaaaaa

SEQ ID NO: 6650 - DNA, 932 bp, Triticum aestivum
  unsure (1)..(932): unsure at all n locations
  Clone ID: PAT_TA_6650
atcggacagatcatagctgggatcttgatcaggaaagtcgcatgaagaatttttnctggacagttttgaggtctcaggcccagtaccgctactttggtgatgtcatttcacttgatgtaatgtacttgcagcactctcgtgctagcctccctttggccacactccttggggtgaataaccatggccaccttgtgctacttggttgtggtctgctctccaaagacagtaaagagaactatgtctggttgttggaggggtgccgcgcctggatgaatggcaagccaccagaggcgattacaacttgttattcagatgttgtagcagaggctgtgtctgaggtcttgccagatgcaaggcaccgcttctgcttttggcatatcttgaagaagctccaagaaaacgtgggacgcacacatgagaaagaggcaatttctttgagattcaaggaggttgtttatgacacagtcacacttactgactttgaaaaggagtgggaggccatggttgagcattataagctcaaagataatgaatggttctctgcactgtacagctgccggaagcagtgggctcctggttatgtcaatcattcgttttgggctggcacatctgctatcaggaaggttgaaaaaccagatccatactttgatggtgttgtgacaagtaaaaccacattgccagttttccttgagcaatatgagactaccctcagagggaagctggaaagggaagcatacgatgatttgcgctcctattattctaggctcactttgctgtcaggattaccatttggaggagcaacttcgggagctgtttccagttcccgtgtctaaggcattccgaggcgtgttcggccaagtggggcttgttatttgtaaagaggtagacaggagcgggaattcaattacctacatggtcagcgagttaataca

SEQ ID NO: 6651 - DNA, 1086 bp, Triticum aestivum
  unsure (1)..(1086): unsure at all n locations
  Clone ID: PAT_TA_6651
ccccgccgcgcggccgccgtgcgctgttgcgatccaccgcccgcccgctcggccccacccttgaggttgagccggaggggacaggggcagatctgcgccggcccccggatggtggccgtcaactgggagctgcggggctgctgccagcacaaccaggtcgtcttcatcgccgccgtcggcgtctccaccgtcgtcatcctcgccctgtggaggacgttcctgctcacgcctttcaagctcatcaccgtcttcctccacgagaccagccacgccctcgcctgcaagctcacctgcggagatgttgagggaatgcaggtccatgctaatgagggtggtgttacacaaactcgcggtggcatttactggataatcttgcctgctggatatctgggttcatcattttggggaatggtgttcatactttcatccacacatctcctggctacaagaattgcggctggttgcttcatacttgcattaattattgttctctttgttgccaaaaattggtttctgcgctggctctgcattggtttcatcatattcattgctgttgtttgggttatacaagaatttacaactttccatgttctgaagtatgttattctattcataggtgttatgaacagcttattttcagtttacgatatctatgatgacaccatatcccgaagagtgaattcaagtgatgctgagaaatttgctgaaatctgcccttgcccttgcaatggcgttggatggggtgttatatggggcttcatctcatttatttttctctgtgcgtcgatatatcttggactggttatattgtcctgagggcttccacctccccgtataccattttgacctgacagggcaggcggtgcttgttgtttgtttccattggtccgggcattggctgcagcttgtattgatccatggtggacaggttgtacaaaatttatacatagggcaatcagtttatgccataattaaggttgattgaaattggataggggcagttattcatgcgattcttgcgtttatagctcatgtagatggcatttttcttgcatttgatatgcacagcnnatatagtattatgtt

SEQ ID NO: 6652 - DNA, 536 bp, Triticum aestivum
  Clone ID: PAT_TA_6652
cggcacgaggcaccgcggagcaccccgcggtgtcggaggtggactcgttccggcgccaggtcgacgacctcgcctccaagaccgacgtgctggagaggagggtgaacgaggtggtagggttctacgacggcaagaagcatggcagcggagggcgcagggccagtggtagcagcaggtatgcggcgaatggtgcaagggacagcaactgcaaagggatgcccgacctcacgcgccagcttaccggtatcattcgccagatcacgtctcatgaatggtcagcgccatttctgcaaccggtagatgttgtaggcctacaacttgatgactatcacaagattataacaaaacctatggatttctcgaccatccaaaacaaaatggaagcgaaggatggcaccaagtatagaagtgttcgagaaatatattctgatgttagattaatttttaccaatgcaatgacatacaatgatgaacaccacgatgttcacataatggccaagttattactcgagaaatttgaggagaaatggctccag

SEQ ID NO: 6653 - DNA, 465 bp, Triticum aestivum
  Clone ID: PAT_TA_6653
gggacaacgggcggtccttacgatcatcaagggcaccccggagtgaccggcaccggagcacacgggaccacggcgaccggcggtgcttacaaccagcaaggtcacgctggggtgacaggcaccggcgagaagaaaggtattatgggcaagatcaaggaaaagctgcctggccagcactaggcgccagtcagcgtgtttgtgaacaataggtacgagcggaggtggagcaataagcctataagtggctcacgtttgtgtgtagcgttggagtagttggtatgctgcagtactgtactgtgacgtagtgcggatgacacgtggagtcaggtgctagagtccacacgacagcgatcgtatcgatactgcagaagatctcaaccctatgtcgatgtatgagcatgttgtaagttgtaaccgttgtgtgaagtttcactatgttaaatattactttgtgtaaaaaaaaaa

SEQ ID NO: 6654 - DNA, 634 bp, Triticum aestivum
  unsure (1)..(634): unsure at all n locations
  Clone ID: PAT_TA_6654
gccggcggccgccctccgacgctcctcctcctccgcccgctggcgtcggcgcctgagatgagtgggagcgcggcgaancgcgtcgggacgccgctggccgacgcggagggcagccccaagcgcccgcggagcagccgccacccctcgctctccccctcgccgtcgcaggcgcgctcgcaggcgccctcgccctcgcagtcgcggtcgccgccccggtcgaggtcgcggcttctcctggcgcggacgtcgccgccaccatacatagggtcaccctcctacgccccatacgacgaccgggagtcccagcccgcagctacagcccgcagccgtcgccgtagccgcagccgccgtgtcaagaggaagacggacgggaatggggcgggccggtctggagggccgcactcgtacaagggagcacagcggcgagcacggggacggcgaagtacagcgtccgcatcggcgactaacgaaccgccttcttcatctgccccggcggcctccccatccgctccgccccgccctccccgggtccggacgggcgtgccgcccgcgcgaggtgccgtgacaacatcggggacaaccgctgcaactactgtgcggccaatggctgcgtgcgcagccgcgccgtcgagga

SEQ ID NO: 6655 - DNA, 1435 bp, Triticum aestivum
  unsure (1)..(1435): unsure at all n locations
  Clone ID: PAT_TA_6655
ttcggcacgaggattgctgagggttcttgaggcagctacggaggagccttctgttatacttagggaacacaaaatattcacaagtcgattccttccaagcttatccatcttatacaagggcaataaagattgtgatgccagattcctgtgtttgaagatactgtctgatgtgatgattgtgatcttcagcgattcttcattgactgcagatgaacaatgtttagctgacctgaaaacaatctctcacaaatattttctcccaatgtacccttcatttgcagaggatgaagatccaatacctatgtatgcacagaaacttctagtaatgctgatggaacatgattgtgttaaggtatctgatatcctgaatgaagcgacagtagcccggggctttgaattcttgcttggagatctttcaaatgcaaacgtaagcaatgtcaagctttgttttgctctggcatctgctcccgacatggactccaatatcctttcgcagcttcaggttgtcagaagaatagggaatctacttgagtttgtgactgccaaagatatggatgattttctggaaccaaccttggaactctgcagagctttcatcatccgtggcaccggcagcaacagaagtatcgttctcagcaaagaacctgcactccttgttgatagcgccttcagcatgagcattgctgttgatcaacaatcttgcatcatggacatatgcgaccttggtggcagtatgggtatatttctggaggtggttggaaattcagatccacagataagcgatttggcgtcagattgcgtggtgttgctgctcaaggcagcacctcgagnggccacaatgggcctgctgacaaatcttcctaagctgagcgctcttctggactcgttgaagcatggcgtccccctgccgctgactcgcctgctatacagcctagcattctcttgtaggcagtacctaacccaaggaatgatactctcaatatcagtgccagctctgatgcgagtagaagcgctcgtctcgtctttcaaggcctcacgggatagctgtcttgctgatgctgcttcgtgtgtgggtgccgaactgcagcgcctacctcgctgtggttgagcagagatgtggtgaaggaacccgtcagttggctgccattgcataagtgatcttaataggagggtcttggctcggcttggtatctctggcgccaagagtatgagcagggccattgcctcagttgctactgtctggcacgggagtgctgtccgtgcgcagggcaccgttacatgttatgtaatctttatccgcgatgatgtggggctgctgtatatggtacttttggccaaatctgtattcgccttgccagttttggttggcatgtaggttttcagtttcatgtaattccctagttgcgcatcatnatcatgtatacaacaatacatt

SEQ ID NO: 6656 - DNA, 649 bp, Triticum aestivum
  Clone ID: PAT_TA_6656
ctggatgcttgtcctgtcctggagaactttatcttgggtgtattacagactcgagtaaagcatgaattgatttctgctggagactcaagcatgagacggataccaggacatcagtatcgcaacatgaagaatgtcagtataatgggcttctgctctgcaaagagcatggtcgaactaacctgccatattcttgagaatgcaacttcactcgagtgccttatgttggacactgtatacgataatcgggaagacactgatggatgttgtgtcaagggatcttctggtgaatgccgcccgataggcaggagtatgatcatgcacgcccacaaagggctatgggctattgaaaaatatgttgcggagaaagttccatccacagccaagttaaatgttaagaagctatgcagccgctgccataaaatcacatgagttgtgcagctctgcaaccgttccatcctactcccttggttcctaaatataagcctttttagatattccaattatggagcaaaatgagtgaatctgcaccctaaaatatgtttatagatccgtatgtactctgtattaaaatatctaaaaaggcttatatttagaaacggagggagtatttgactaaattttcctcctgtaccttagtcaaggaagcaat

SEQ ID NO: 6657 - DNA, 455 bp, Triticum aestivum
  Clone ID: PAT_TA_6657
ttttttttttttttttaacagaacaaagatcacacttatttagtactcgattttatacaagcaagcaggttagtttgtacatgagcagcagcatatcccgtcacacgcagaaaccgaacaggcaggcgttctctaaccaaggcagcaaaaaaagcccagaaagaaaaaaaggagaagaaaaaagatagctcctagagccaaaccctggctggctcctcggcactctggatttatacaaactctgttgctactacttcgcacactctcgtcgcatatacaaagacgctagacacgttgtctccacgggaagagtcgacgtacgtgggcctgctacgggctcctcaggttggctgcaccgcctcttgggcgcccccttcggtcacgatccacgggtgccggaggacttgctccgcggagaacttcgggagacgtcgcggcacatcatgcgccgcatc

SEQ ID NO: 6658 - DNA, 253 bp, Triticum aestivum
  unsure (1)..(253): unsure at all n locations
  Clone ID: PAT_TA_6658
cgaggggattatttgctatggatgtaggcagggcctcggtctacataattgtgggtgtactgcctatataatatcaatatattgcacacatgcattctaggataaccatgagatattcatgtgtactctttcacatgactatgttacctgttgcacttttaccttatggtgaagagttgcaattgttgaacttatgaaccccagtcaattttttagcntatgaaaatacttcgaacaacttttaaaaaaaaaa

SEQ ID NO: 6659 - DNA, 590 bp, Triticum aestivum
  unsure (1)..(590): unsure at all n locations
  Clone ID: PAT_TA_6659
gcgatccccggngtcccgctcccttcttctatcctttgggcgggccgccggaaagcgactcgggatggtgttctacttcaaggcgcggcccgacgccggtgactacaccatcttcatggggctcgacaagcatgagaacgaggacctcatcaagtacggcttccccgaggacatctggttccatgtagataagatgtcctctgctcatgtatatgtgagactgaatagaggtcaaacaatggatgacataagcgaaggtttgctggaagattgtgcccagcttgttaaagcgaactccattcaaggtaataaggtgaataatgttgatgtggtttatacaccatggtacaatctgaagaagacaccatccatggatgtgggtcaagttggctttcacaactctaaattggttcggactgttcaagtagaaaagcgaagcaatgaggttgtcaatcggttgaacaagacaaaggtggagaggacgcctgacttaaaggctgaaagagaagctgtgagtgctgccgaaaaggctgaaagaaagttgcagcttagagacaaaaaacgtaaagaagagatggagaggctcnnga

SEQ ID NO: 6660 - DNA, 402 bp, Triticum aestivum
  unsure (1)..(402): unsure at all n locations
  Clone ID: PAT_TA_6660
gcaggnaattcggcacgaggtatataagcaatatctaaaatatgattgagtaagatattaaggaggtgtttggttgcaaggtactagacattttttagtaccagggactaaagaaaaaagaccctccagtagtccttttctagtccgtaaagaaaaagtccctcctatttggttacatagggactaaaagggactttttctagtctactccctataaccaaacagggccgaagttaacagctatttacaggtgattgctaagtatgctcgattgctcatattaaattgtttctttattatctagggtttgctgcattttcaacaacttaaatatgcttattgacttagtacttgttgctacataatcatactcattaaaaaggaaactctgtgaaaaaaaaa

SEQ ID NO: 6661 - DNA, 1002 bp, Triticum aestivum
  Clone ID: PAT_TA_6661
tcgcgttacccggcttcatcatcatgtatgtgtggcactattgcactgtaaagcggtatgaatttgagatgcacagcaaggtgtcaatggcctggattcttggccttggtccgagccttggtcttgtcagggttccagggataggctttgtgtacactgagctggcaagtggcgtaccgcacatcttctcccactttatcaccaacctacctgctatccactcggttgtcgtcttcgtctgtgtcaagtatcttccagtctacacagtcccggtggaggagcggttccttgtgaggaggattgggccgaagaacttccatatattccgttgcattgcaaggtacggatataaagacctccacaagaaagatgatgactttgagaagatgctctttgactgcctcacgttattcatccgactcgagagcatgatggatggttattcagattccgacgagttcagcttaccagagcagaggactgaaggatcgatcaacactgcatttctggcagacaaaactgtcaacacaatgtgctccaatggtgaccttagctactcatcgcaggattctattgtgcccgcccgggcaccccccggggcaaaccgccccgtccacgttctcacgcctgaccctcccgtcaggcaccggctttctgccgggcttgatccggtgcagggatgctggcgttgtgcacatcctagggaacaccattgtgcgcgctcggagagattcagggatcatcaagaagatttctgtagattacttgtatgccttcatgaggaggatctgcagggagaacagcgtgatgttcaacattcctcatgagagccttcttaatgttgggcaaatatactacatctgaaacatcattttccgcttggtttgtactggattctgagcaaaaagctctgatgtacccttctctggaagggagaagggggatggctgctttaaactgtaaatagggaacttatcgcatcgtagtaatataaatagcgaa

SEQ ID NO: 6662 - DNA, 891 bp, Triticum aestivum
  Clone ID: PAT_TA_6662
tcgacccacgcgtccggggcggtccggctggagatgctcttaatttcctttgactgagctggctaagtggactccagttaatatatttgctttgtcctttgagcattctcgtctgctctaaatgaaaagcagcaggaaaatcaagatctattaattatgtgtgcatagcccagcatttgggatttgctgggaatcggccagttgctgcttgtattatatacaagtgccttcttcattggagatcatttgaagtagagcggacaagtgtttttgatcggattattcagaccattggacatgcaattgagacacaggacaataacgaagtcttagcatattggctctcaaatgcttcaacgctgttgcttttgcttcagcggacgctgaaagcgagtggatcaacaggaatggctccacagcgtcgacggtcgtcctctgctactctttttggaaggatgacacagagcttcagagggactccacaaggtgtaaatcttgctctaataaatggaagcatggttagtggagtagagacactgagacaagtggaagccaagtatcccgctttactgtttaaacagcaacttacggcatatgtagagaagatatatggaatgatacgggataatttgaagaaagagatctctcctttgctcggattgtgcattcaggccccaagaacatcaagagcaagcatgatgaaaggatcttctcgttcaaacacaaatacagctgcacagcaagctttgattgctcattgacaagggattgtgaaaagcctcggaatttttcttaaacatacttaaagtgaacaatgttcctccattcttggggcggaaagtatttacttcagatttctccttctcaatgtaccgctatttaacagtcttt

SEQ ID NO: 6663 - DNA, 313 bp, Triticum aestivum
  unsure (1)..(313): unsure at all n locations
  Clone ID: PAT_TA_6663
tcggcacgagggctcgccccactgaccccagctccgcttctcttcttctccacgtcccgccgcccaaggcggaagaggagcctgctgatgggttgcctgggcctcaactcatgcgtcgcctgaacctgtgtgccaatgggatgctgcgcgttctattctagagtggtagtggtagtgttcactagattgagcgagtgctggttctttcttgttgtgtgttatgtagttttgatctcttgggcagttgggctagtgatcacttgtaatgctnctcgaggtgtttaatccaccatgagtttgtgtaaaaaaaaaa

SEQ ID NO: 6664 - DNA, 589 bp, Triticum aestivum
  Clone ID: PAT_TA_6664
acccacgcgtccgcccacgcgtccggcggactaagaggacttgggttgatgcctgatatcttggcatgccgcagtactcagccactggaagaaaatgtgaaactgaaactctcgcagttttgccaagttccggtttcaaacatcgttaatctccatgatgtaacaaacatctggcacatccctttgttgctcagggatcagagagcccgtggagctattttgaaggttctgggcctttggtgtgtggggaaagtgcctcaagaacctaagttgtctgaatggactgaaagagccagcagattcgacaaactgaaatctccggtcaggattgccatggttggaaaatataccggcatatcggattcctacctgtctattttgaaggctcttctgcatgcgtcggttgctttggacaggaaactggtagtggactgggttccttcatgtgatcttgaagattctgctgctgtagagacgcctgatgcctatgagaaagcatggggtctactaaagggtgcaaacggcgtactagttccgggaggcttttgagacagaggtgtccaaagaaaaattcttgctgcaaaacatg

SEQ ID NO: 6665 - DNA, 1660 bp, Triticum aestivum
  Clone ID: PAT_TA_6665
agctaacacctaatcagcttctcgtcggagctctaggacagcatggatttctccccagtactgtggcctgatccccacctcacctgggtagataaaccacataattgcacgtcgctctgttgtgccaagatcagataccatctatcgttaagctccccgatttgacaagcatctggcacaacccttcgttgttctggctacagagaccccatgaagctactttgatgtttccgggccggtcggcagcagggaaggtgcctctagtaaccttttttgccttgagtgcctgaggaaactgcctcatgaacctaagttgtctgaatggtctgaaagagccagcagagtcaacaaactgacatctccagtcacgatcggtatggttggaaagcttaccggcatacctgggtcccaccggacaggaaactgggcttgtcttgattcgtctcctgctatgtacaggaaactggtagtgtactggctccttttgtctattaaagaacatggtgtcgactaaaggatgcaagcggcgtactagtaccgggaggctctagagacgggtgtgtccagcgtaaaagttctgctacaaaacaggcgcgagaaagcaacggtacgaatctcggcagctaattgtgcatgcaaattgcagtgatcgagtatccgcagttctgtgatcaagcatgcttgatgcataatagcacaagattctgatgcagctctgagaaaaccttgtgttaccttctttccacaggccgctaaaactcacaggggtgcctccatgcccctcggttccaggaggacatttttcgcggtcaacaactgcaaatcaactaaactgtatgccaatgctaactatgtagacgaacgacatcgccacagatacgaggtgaatcctgacatggtctcagaatttgagaaagcagggctttctttcgtgggcagggatgaaagcgggagacgcatggagattattgagctaccaactcataagtttttcgtgggcacgcaatttcatcctgaatttaactctagggcctgggaagccatcaccacttttcttaggattgatcgccgcgtcatctggacagctagagcacctgcttcagcgcacttccggcgctgtcagctaaccgaccaggtgcattgccggtcccggagcccctaaggcgaagttaaggatgaacggcctggtgtcgacatacttcgcgaatggcagcagtattcacatctagcagcatggcagcagaccagttttttttcttttcctgcatgtgtttttcttttcttttttattttctttagtatggatctatctctctgatcaagcaagaagagatcggcagctccagcgacatgacgagccgtttccgggtttttatgaagggaactatttggggtcgcgcggaagcaaaactagctagggtttattagtgctgctctagttccgcttgctattcctttcgcttgttcgtttgtttctttaaggattttattatcaaggttgtaaggctggggatgtgcagctagcttcagattcaagcctgccgtctcgcctgcttgtacattgtaaaacagaaccgctgctctccagtgactgaatgattataagcagctactgtagtggtatttggggaaaaaatatgtaccaaactgttctgatctg

SEQ ID NO: 6666 - DNA, 534 bp, Triticum aestivum
  Clone ID: PAT_TA_6666
actggtaaagagatattgttgttccaatgattgattatgaaaaaaatggactgaattggacaagaaagctgcggagtacatttgctgattggaatacaagcctacagactatcattacatggtcgccttatggaactgaagcagaactacttgaacagtttagttctataaaggaacaggggactcgagttatcatttacaatctttgggaagatgaccaaggagatttggaactcgactttgatgctgatgtaaatgatattcaactcagaggtggtaaccgtgatgagaaaaatatcgagatggctaagcggtttcctaactccaagcatttccttacatataggcattcattgaggagttatgcatctattttgtatctccgactttcggatgctttccaaatttttttacgtggaaaagagattgagcaccataatattgtgactgacatgatgctgaagaaagacgttacatacaggccggttgcaactaatggacttccaaaagattcaaatatggtagctgatgtga

SEQ ID NO: 6667 - DNA, 602 bp, Triticum aestivum
  Clone ID: PAT_TA_6667
gttggaaccggctgccggcgctgtgccccccgtgcccgccgttgctcctcccggccgggctgcgaccgcgctggccgccgcccgccccgtcccgccggcccagtgggcgtgcttgcaccctcgtgctgcccgcccggctccgggcgtcggccgccggggcttcttccggcgtactccgggcggccgcccgacgccgccgccgtgcgaggggcggccgccctccgcccgttgcaggccccgccgcgcccgcgctgggacccctcggccggtcagcggcggtcctcgccgccccctgcgggcgccgccgccgcccgtcccggcgctcgccgccgcccgccccgccgcgagtggcgtccgcgaccgggcagcccgcccgcctgtcaccggcggcgccgcgacgtcccgcggggggtgtgcgcgccggcgcccggtcgtcgcgcgcccgcttccggcgtagctacacccgccggggcggcagccacgttgatctaggctggaaccaaacagccgtcgaagttgttttgctagcaccgacgatttgttttgctggaaccggtaaatttgtttgctgctaccagatattttttttgctaaaaaaaaaa

SEQ ID NO: 6668 - DNA, 513 bp, Triticum aestivum
  Clone ID: PAT_TA_6668
gccgctccgccgccgtcttccgttcctcctccgctccagcacggggtctcctgcgcgcgcgcttgaggaggagcggcgctgcctggcccggcccctctccggaagcccttctcgcctcttcagctcagattccggcggccgcgcgtcgtcctacaagcatccctgcaagttaacctgggccgcaaaaagcatatggagagtcagcttgcgtacctgagaaggatgctcgtgactggagagagatgagggaaatacttgaagcatcggcgcagcgcaatgaaaagtgcaagcgacaggacaaggtcgtaaactgtgctgccgccgctatgttccttgcgttgttcgcaggccacgtgctctttcgctgaatcaaaaaataggttgtgattgccttggcccatgccttgtttgccttctccctgcactctgcgctttatgcatttgaactatgtgtctcgacagttagaggcaaggcacttctatatggttaaacttttgggtccccaaaaaaaa

SEQ ID NO: 6669 - DNA, 1166 bp, Triticum aestivum
  Clone ID: PAT_TA_6669
cgtccgcccaggcgtcatccgacgcgtccgcgagcgctgaaagcagtacagtatgacgatcatgcggatgttcctagctctctgcgcccttgggttcgtcgcaggagtagtagaagatggatcgtcgtttgacgtcagcgcttacccggtcaagtgggatgaggacccatctgtgggatcaggggacgtggccgctccaccgtctcccggtactgaggcgccggcgccgcctccgaagcatcacatgatggtgaagaagggcatgctgtttctggagcgcgacctctttgccggggcgctcctgccggcaaacacccggctgggctacgtcagacgcacgagttcaccaggcccagtcatttcaagtactacaagcccagtaccacccttcaggtacagcagtttcgagaaaatcttgaagttttacaatgtaacgcacggctccaagcaagcagggaggatctcggagactctccagttctgcgaggaggcgggagacaaggaaccacacgcgtgcgcaacgtctgtggccgccgcgagagacttcgcggccaccgttttggggaccaaggagccgcgcgcggtcacttcaatccttcacggacgcacacaacccctccgctacgtggtggcgcccaacggaatcgccagcgtcggcggcgacgcggtggtgccatgccaccccctggcgtaccctgtggaggtcttttactgccacaaccccagcaacgtgcaagcgctccgtgtccaacttgttggacaggaggacccttccgtcggcgccacggccatcgcagtatgccacaaggataccagctactgggatgaggcatacttcatgatgctcaacggatcccgtggcgagccgatatgtcacttcatgccggccaattaccttctgtggctctaggaggtgaggacacgagcagcaagtacgagagttgagagacagccggccggtgacgtgtaatttcggacttagtagccgatctagcttaaataaacgtcactgtatctgtatgcccttaccagttattgtaagcgcatgtagcgcaaagatatatgtaccccgaaaaatgatacgtatgatacagatatatattgtgatgatgcgtgtcatgtttttctttttttagaaatgatgcgtgtcggtgctaaaaaaaaaa

SEQ ID NO: 6670 - DNA, 1027 bp, Triticum aestivum
  unsure (1)..(1027): unsure at all n locations
  Clone ID: PAT_TA_6670
ggccgccagcatcggcgaggccaagagctcttcgaccatgaatccttacagaaatggctgatcaagcaagtgaacttgaagccctggagctcatattgacagatgcaaatgcagagcctaccaagctatcatatgcacttataaagtcaattacaacaaatttctctcaagagattggtcttggtggttttggagtcgtttacctgggatatctcatggagatgaatggcaaatacgctataaaatgattaagggaatttgtcatggattgcaatatcttcataaagaacgtatcacccatttggatttgaaaccagacaatgttctgctcgacgcttacgtggaaccgaaaattacagnacttcggtttgtcaagattatttgatgaaggacaatctagagtgtttactaaaaacgttcctggaacacggggatatattgcaccagaggtcatagacaaaggagaaatatcgttcaagtcagacatatttgctttgggaattgtagtctcaaagctattagtggggcagaacaattatgacattgaaaattggcatgaatcattagatgtggactgcacacaagcgaagagctgcatccaaatagctcaatcttgtatggaagctgaccaacataagcgacctacagcagaggaaataatcaagaaactgaatgagatggagagcctagggtcttccatatacaggacaaactcatccgactcagagaacctgattcaggtagagcctcttgaactccatttccacttggagccaaacacgcacatatcagtgacacaaaaactaaagctagccaatattactgatgactacgttgctttcaatgcaatggaatggtccagcatggcgaagtatggattctcttggtcagggccaagcagaggaatcctgttaccatggtccacgcatgaacttgggctaataagggaagcacatgagatgtcaccactgtctgtgcagtgcaatgacgtgctcattgtgcggagcaccgtggtgagcgagggttt

SEQ ID NO: 6671 - DNA, 479 bp, Triticum aestivum
  unsure (1)..(479): unsure at all n locations
  Clone ID: PAT_TA_6671
cgtccgtggccgcagtgtcccacgggtgggaggcagcagggagaattaatgggtaagcgccaggttctccccgctctcctcctcgccctcctggcccttgcgtccagcggcggcggtgcccatccggctacgccggtgaaggcgccgttcagcaggcacagcttccccaaggggttcgtcttcggcaccggctccgcagcctaccagtacgaaggcgccgtcaaggaaggtggccggggaccgacggtgtgggacaagttcgcccatactccaggcaagatcgcagacggtggcaatggagacgtagcgctagatttttaccatcggtacaaggaggatctgaagttggtgttggacatgaacatggatgccttccggttctccatcgcgtggagcaggatactgccaactggttccatgagtggaggagtgaacaaagacgggattgcattttacaacagacttatcaatgnnaggtc

SEQ ID NO: 6672 - DNA, 979 bp, Triticum aestivum
  Clone ID: PAT_TA_6672
ccacgcgtccgcattggccgcagtgtccagcgggtgggaggcagcagggagaattcatgggtaagcgccaggttctccccgctctcctcctcgccctcctggcgctcgcgtccagcggcggcggcgcccatgcctcggcgggcggcggtgcccacccggctacgccggtgaaggcgccgtttagcaggcacagcttccccaaggggttcgtcttcggcaccggctccgccgcctaccagggcgagggcgccgtcaaggaaggtggccgggggccgacggtgtgggacaagttcgcccatactccaggcaagattgcagacggtggcaacggagacgtggcgctagacttttaccatcgggtcatggacgtgctcatggtggccgtcggcttctccatcgcggcctgccggttcccccccgcgggttccaggagccggccagctggctcactagggggtgcagtgtacaaagggcggatcgcagaggtcatagctaaaggcttgaagccatatgtcacactgcaccactgggacacacccctggggctagaggacaaatacggtggcttcctcagtgaaaagattgtgtaggtctccctggccctcggcgtcgcgtgcgccctccactccggcgcccgggcgtggccctggacctccgtcaacgtgccatgcacgtcctgcccccacggctacgccaccggcgtgttcgcgccggggcggtgctcgccgcacgtctccgcctcctgcggcgcccgcgactcggcccgggagccctacatcgtgacgcacaacatcctgctggcgcacgccgccaccgtggagctgtaccggcgcaagtaccagaaggcgcagggcggcgaggtcggcatcacgctggtgtgccactggtacctcccctacaccaactccaccgccgataaggaggccgccaagcgccgggtggagttcatgctgggctggttcatggaccccatcgtgca

SEQ ID NO: 6673 - DNA, 819 bp, Triticum aestivum
  Clone ID: PAT_TA_6673
tccgctcgcggctcggccctgcatgcgcagccgtgacctcgagctgtactgggtggtctgggcaggcgtgttggcgggcaagagagcgtgtgcaacagcagggatttgccggcctagtcagcgtggctatcagcaaagtatcacccgccgcctcagcattgctgccacatctgttgcatccttcgcctacttcccgtgcgtccgcgcggcggtttcgcctggcccgtccgggctcgctcgcgtctctgtgccccctcctggcaagccccgtgggccctccgtggtgcggggcggccccgtcccaagccctcctccccaagcggcctatctcttcccttcccggtgcactgtgttgttggttcccccgtccccatccggcccggtttcccgagtggccgttctgcagttttcgggacttgccatgccgctccgggcgctctatcttgataatgacccctttttacaagcctggtatgcattccgtggtgcagagctgcagctaccaaagcatttatttccaaacgtgatatcttttccctaccgggtggactatgatgatgttaatgccatacatatccatcctgaaatcctgagagaagtttatgaatatttcgtgacttatcaaacaactgcggtggaattggctcttgaagatgaagtaatggaacacactattgatggtcagacatacaaagataccgttttctttctcattggagagtgccaacgattcttcgaactgctagaactcacatggaatgcttttgcccttcctccgtcgggtttcctgctctcggaaattccctatgccaatcttct

SEQ ID NO: 6674 - DNA, 392 bp, Triticum aestivum
  Clone ID: PAT_TA_6674
ctgcaggaatttggcacgaggctcgatcaggcaggcagggaggacgaagaaggatgtcaggatggctatgccgtagtacgtccttgcagttgcaaacaaggaccggccgtttggcctgggccacttgaatcgatcgtggtaggttaggcacgcagcactgcagcaggaggcgcaaacaagaatatatgcaggacaggggagggacgatgataccaacgcatacgcatgctttggaagaggaaattaggacgtgcagatcagccaggagcgctggaatagtatagtttttcaaattgactagcacagttgccatgggaaccatctttagtgtattttacaaatgtaaatcatgtacttttatcttatagtacatacataatgcttttctgcgt

SEQ ID NO: 6675 - DNA, 726 bp, Triticum aestivum
  Clone ID: PAT_TA_6675
taaaattttcagtaagatgtttctacatcatattcttgaatgttcctgatttcacatccatggtatctgctttgccttagtacctgttcaagcttcactcatgatttgttgctttctccctatcagtcttaccattttgttttgcttgctttaccttgtagcttcttccagtagttgtttttttcctttatgtcagagctgctctgtcacacttcttatgcttttacgatgtcctaataaaagttttgtgtgggcagataattttttgcttactacaaaccgtaagaaactgaagcttactgatttggggcttgcacgagaggaaactataactgaaatgatgacgactgaaactgggacataccgatatggacatagagttcgttgaagatagaggtctggctgtgcatcgtcgctctccgccgcacgagagcgttcgtcttctcagccagggcggaggacgttgtcaatggaaaacatggctccacatgaaggttcacttgccaatagtcttcaagaagatgcgaaggtcatggttttgtgttgatgacccttgaaaaaataccttctcattttcttgtttgaaggaacgctaggaggaattgaggatgcgaaaaatgtacggaggaaagggagactaggagaggtgcacggtgaggcattgacgaatcctaaaaagagaaacttttgtcacggtgttctcatatccaaacttgaatcaagtag

SEQ ID NO: 6676 - DNA, 1606 bp, Triticum aestivum
  Clone ID: PAT_TA_6676
cggcctcgcctccttcgccgccccctccggcccccgcgggcacgccgccccgcgcttcgccgccctcgtcgtcttcgccgagcatcgctactacggcgagtccatgccgttcggcagcaaagacaaggcctacaacaattccaggtccatggcgtacctgacggccgagcaagcgctcgctgactacgccgtgctgctcaccgacctcaagaggaacctgtcctcggaaagcagccccgtggtgctcttgggcggctcgttcatcctcatggaatgggcgggggggagtcgcaggcttgtactgagatggtaatgcccatgtcttctagcgaaggtcttagcatgtttccaccacgatgaattcgactccgtattctacgcccttgtctctgtcgatttcttggggggtgggccttggcctccttccatcccttcagggtctcgtggccatgattttggtgcgctgcgggaaggggctaggtgggcttctgcatcttcgccaatcgttccacccgtgcctggcccggggttccacggggcccctttggacatggcttgacacgtgttgttgccattggtggctccactatggagcgcatcacactaaacctgcgccccgctaccaagggaagaccatgaattgggtccttagcctgagagaatcaaaacccgaggggagctcccggctggatcgcagttatccagccggcaatagaggcgccaattatactggtacggttgactgctttgatctagatgatgatcctcatggaatgggtggatgggattggcaggcttgtactgagatggtgatgccaatgtcttctagtgaaggtcttagcatgtttctaccagatgaattcgactatgcattgtatgccgatgactgtgtcaaaaactttggtgttaggccaaggcctcgatggatctctacagagtttggtggtcataatattagttctgttctggagaaatttggtagtaatatcatattcttcaatggacttctcgatccttggagtggtggaggcgtcctgaagaatatatctgagagtgttgttgccattgtggctccactaggagcgcatcacatagacctgcgccccgcgaccaaggaggacccggattggctcgtaagcctgagagaatcggaactcgagatcatatctggctggctatcggatcactacggagcaagagggggcgcgctctttcagcgcgcaaccaacaaggactcggctgcgtcataaggaaaccacactcctcccttaccatttgtcccaagcatgcaaatgtggtttactccttcccttgcttaaggattcagttccgactggcatgagatggccatctcagcggttcaagtccagcgatcgtcgccggcgctacaccgtggagatgaggatggtaacatcgtgggctgttttcgcttggactgcgcggtatcaataattatgcttgtataaattgtaatgggctggtgcgttgctcggtttcacagagagcagacaatgatgttgtgcatggccggcaaggcaggaactaacgctagcagaatagagatcatcaggagtttcttcaagaataaaaaaaaaaaaaaaaaaaa

SEQ ID NO: 6677 - DNA, 1383 bp, Triticum aestivum
  unsure (1)..(1383): unsure at all n locations
  Clone ID: PAT_TA_6677
cggcgctctaggggttgctcgattggctcggcggcgtcggccggcgattggcgagcgcagccgtggaggaggtggccgaggaggaggaggaccagggggcggacgtcgacctagtggtgtacgacggggcgaagtgggtggccggggcggtggaggagaaggagtggtcccggcgggaaggaagaggagaaggctcggaagcgggaggagaaccggcggagaagcgaggcacacgacaaggtcatggactccatcatcgagcacgatcccaaggtggggcgcgacgtctacacccggtttttcctcaagggacttctccgtcttcaacatcgacgaggagtcgtctgtccctccaatgcgatacactgatagtatctaccagagatgaatttgcggctagaacgactctgcaaacatcctcatccgtcagcatagtctcctcagatgcaggcttcccagtcgatgtctatggccgtgtcattgccagagacagcattgactacaagtgcatttatctctttcaccgcaatagagatgattgccagcgtgtcaacgaggatggaatgctgattttaactggcccatatcgaggtctagtgctggttgatttcatctatctagagatagatcttaaaataagggaagaaggagttccagacaggccatttagcaagggtctaataagcattgatggccgagtactgtctagagagaaagatgtcatggttagaagtgaaacccttgagagctggctcagcactacagaagtgagattcacaactgtcctgaacgcagtcgagtgcacctttgaaatcaagctcactgaggggctttttaaaggaaatataacagttggcatcgcggatgaagctcgcaagctggacaatgaacaaacgattgtgattcatgatagcacagcagatggcgtggttacaagtgatgaaagtggagttatcaaactccggcgaagtgtcattactatctgtctggaaagaacggtgatgtttcacataaataatgaggctgatggtgtttgtgctgaacgaaactttgatttcactccacgccgcactggtgcagatgaacagttgatgtaggaaattacgtgtggtgctgggaagttcagattcagggttgtctggtccttgatggactttaggctgtaatcctgtgtcttggtaaacatagttctgatgtaatggagtgatgcagtgatgtagcgaactaagttaatcgtgatgtaatgatgtggtgcactaagttatattattgttattaaataacttgagggattatatgtaatgagtagcgaactaagttattatataatggtgtggtgcactaagttatattatgttattaggtaactnangattataagta

SEQ ID NO: 6678 - DNA, 407 bp, Triticum aestivum
  unsure (1)..(407): unsure at all n locations
  Clone ID: PAT_TA_6678
gcaaaaacgttgttgccaggnagcaagnactagtcgagcaggtggcaagtgaagtgtttcgcgcttcgtagggatggagacctggagtccctcgtcttgctggctaattccaaagatggtgaagtgaagttggacgggccatttgtgctgctgatcttggaagttggttgttggctgtctattggctttaggttgctttgtcctagtgttcattttgtgttggtccctgcaaaacgggttgatgtattttgctcttagcatgtgcttggcgatattttggcccctgttgttcgggtnctgtagtatagaactttagtttgaatcttgctggatgcgcataactttcatgtggggggcgtagtttttgtagatgattaagagcagatagtttcattataaaaaaaaaa

SEQ ID NO: 6679 - DNA, 540 bp, Triticum aestivum
  unsure (1)..(540): unsure at all n locations
  Clone ID: PAT_TA_6679
gctacctgaccagcacccgccgcggcgacgccccccgggcggcgtgctggcggcgccttcaagtccctggtggacaacgcccccatctgcctctgccacggcctgaccggccccatcgccatcaccgtgcccgcccccgtgccctgcaggcccaggatgcccctcccgcgagacggccccgccccgcggcctccgctcgcgctggcgcagtgcgcctcggcgatcgctgcctccactagttcctccttccgctccggcacccccttctcccatcccaggtctgtgtcgtctacttcatccgtcctggcgatgtccgtccacgatgttccttttctggtcgaccacttactcctcttttttcggtatagttagggataacatatatttatcttaggttagtgttttatactatgttgtgtgctggcgatttagatctacaaagtacctattctgtaggagnnncttttcttttcatcactgtatatatgcggtgatcaatattagtccatacgtgcatcgcgaattcgtaagtgtctaaan

SEQ ID NO: 6680 - DNA, 807 bp, Triticum aestivum
  Clone ID: PAT_TA_6680
acatcccaaaatactagccatatctgataactatacagtttaacaatcaccactaagatcaatgatcagtcgatcatacacatatacctttccattaacctaccaatctatacatgcatacgagtatacataatactactaatcatcgtgcactaatctaaacctgcgtcatattactggcaaccttcttggggctttcatcgagctcgacttcatcgctggcgtgggtgtcatcactggccttcttgaatttgtaccacctcgcgcatgccacgaagtagaccaggtttacagcggcgatggcagccgtgacaaggtagaacaggtccaccctgccctcgtttaagtcttgagccagccagtccggccgcccgtcccgccgtcgcgttgccctgtgcaccaccgtcaccatcagaccgctcgcgtagctcgccaccgcgatccccaggaagctgaccgcccccgccacgctccgcatgttctccgggaactgccggtagtagaactcgatctgtccgatggcaccgaacgcctccgaccccacgcgtccgcccacgcgtccgcccacgcgtccgcacggcatcaatgagccgatcctccgtcgtcggcgctccaccgccgctgacactagcatcgtgaccactgagagcgccagcccgacgccgattcgctggagcagggtgatgccaccctcgcgcccggtgaagcgccggagtgccggcaccacgaacctgtcgtacatggggatccagagtgtgagggctagcatctggaagataatgaatgagccctgtgggatctcgaagc

SEQ ID NO: 6681 - DNA, 583 bp, Triticum aestivum
  Clone ID: PAT_TA_6681
gcggcccggccttcccccaccatcgcgtcccaattctcctccctgccctgctgccgccgccgcctgctccttccacgccgcgccctcacgctctcccgacgcgccgcctccccgccccagccatccacccaagcatatcccctgcggcgcgctcccttggactccggcgacagcatggccgagtgaccacggcgaatcaggggcgcgaatccggaccccgatctggatcgatcgctcgatcaaatccggtggcaatgggtaaggcatggtagcgaggaggcatgaagggcgtcggaaatccgaccctttgtcgaacaaagtggagaaaagtagcctatgggggcatgcagccaggctacgatgataactacaccgacgactccttcctggaggagatggtcatgaacgccaatgtcgtcaagagggacttcctgagggtgatggtcgactcagtctccatttcccagtatctctgcatcgtcgcccttgtggtttcgacatggacacatacgctgaatttgccctgccgcgagatcactctcttgaaattcgacattggtctgctgcttgttgggttcttggt

SEQ ID NO: 6682 - DNA, 515 bp, Triticum aestivum
  Clone ID: PAT_TA_6682
aattcggcacgagggcaaagcgtggtaggagagcaacaacgacgagcaaggaaaatagcatggacggtgaagtagcacagtccaacggggaatgggatgtgttagaaattcaagtcgggggcacgtacatgggcatattccacaaaaaatggtgaagctaggaagagccgagcacatggtggctcttcttagtttccgggaagagatacagatgctcattgttgtcaagccggtgccattcaatccgggatacaatgatgatgtagatttcatcagtcaactaggacaagagtgaattcagtaacgtctgaggcttctatgttattgtgcccatgtaatcctgaatggtttcctatgattcacataaggaccaaaccttcatccatgacagaactgtaatataagcagaaaagtcgcaaagtgtggcagagtgccacgcagtgtcatggagtatggttcaaccaaccagatggattactagcttaatgtgaaaacccaaaataataaaaaaaaaa

SEQ ID NO: 6683 - DNA, 1173 bp, Triticum aestivum
  Clone ID: PAT_TA_6683
cccgaataataataacaacaatgtacttaggagatggaggcacagatggaaaaaatcagggaaggaaacaccgttggtttaccaacaagtagcaacatgcatcaaaattgggctactctgccaggaacatgacccatccaaacggccttttatatgggatatgatacatgatataagagaaactgaaggtattaatggaaaaaccagcaatgcctgtgaacattcatttcggcagatagtcccttactcagaagacgacatgcttggcattgagccactcgaactacattttccttttgagcttaacaaacagatgtcatgcgcactccagctaacaaatgagacaaactcttacattgccttcaacatccaaaatacgagccccttgtcatactgcacaaaaccgcagaaagacattatgccgccacgatccaagtgtactgttgaaatgacaatgcaactgcagggcaaggcaccagggtatatgcatcgcgccaatgaacttactgtgtggagcaccaaactgaatgatagccttgcagttgaggatataactacaaacatgttcattaatgaggcggtcaacacggttgatgaggtgaatttggatgtggcttttgatgcacggccacaaagcgagcttcttgatgtccaccctcccgagcttggcccttccttggaatccagaaagtttgtagttatatcctcagctgcaaggcaagagttgccattataaatacaatgcaaggagaagtcgctggttctaggcactatagtaagcaaggatcaagtcgactccactcagccacatgaagcaagtgccgaaacaagtgaggcgcaagaaccacttgaaggggatggtgagaatatgtgcatctcagatgaagatctagatgctcgcgtagctcaggccccaccatgtctgcttcaattattcgtgtaggagcattgatcatgtattatgtcctgtggtgtggtatcgccggcttccccgggcgcggctagttcccccccgtgctcagctgtgcgcgtcatcggctcctccccggcctatgttcctggaaatggccctatctgagtgaataggcagaactaagatgtagcagaatgtttcccttaaaaaaagatgcagcagaatgtactttttttaggacatatatatatttgtactca

SEQ ID NO: 6684 - DNA, 827 bp, Triticum aestivum
  unsure (1)..(827): unsure at all n locations
  Clone ID: PAT_TA_6684
ggaagacggtgttgcacaggnatatatggaaaattcatgggaaaccgaccgttcatccgtaaggccgtgagcaatatcttctataggtttgtctccgaggccgaccatcacaatgggatatcggagctgttggaggtgtttggcagcgtaataagtgggtttgcaaagccattgaaggaggagcataagttgttcctatggaaagcgttgatcccacttcacaagcctaagacagtgggtgtatatctgccgcggcggtccttctgctttactctcttctccccgttggttcccatgcttgcggggtccgtgattaggggtctgtggatgtcctggccgctctcctatcgtcggtcggggctgttcctcgtccgggagctagtagcgctgctcgtctcgtgcggcttggcgccgtgtcagttgtgcagggtgccttttttccggaggattgcggcttgcccctttcccgccctttggcaggttgctgagagagccttattcttgtggaataacgaacatttgttcgatatgatctcccaaaaccgtcaagtgattgtgccaatcgtatacccagctctgggagagaaatgcacgtttgcactggaaacaatcggttctcaacgttactatgaatgtgagaaaaatgttcttcnacatggacgagagattgctcctgacttccagagcaacttcaagcngacgaagagaaccnagccgcagcggaggagcatcnaaggtcnnaanggagcaantggagcggatnccgaccctgaatccgacancaaagngcccctcttcgccccngaagtcccacgngaagaacgtcc

SEQ ID NO: 6685 - DNA, 625 bp, Triticum aestivum
  Clone ID: PAT_TA_6685
ggctccgtgccaccaaggagatgttcccgaggatgtccaccagcgagatggtcgggtcgggggacactgcggcggccgcggcggtctccaccgagcgcctgaagaagcgcctgcagcaggaaggggtcagcgatgctgccattgctgacagcgagaggatcgtgcgggaggagttcgaagcgctgcacaagcagcttgtgcttctcaagcagaagcaggcgctatccttgacacgctccgccacctagagacagaaaaggtcgatttggagaataccctcgttgatgagagccaaagacagtcgaaagagtatggatctgcttccagaccaaggaatgagaagcttagtgggataaagtgaagaaaaagaagaaaagattactagaagattagctttagtttttttttatttccttgcaattttccttttattggaaattcgaaagaccttcttacatttcttccttttataagcagtggagccgatttccatggatctgaagctggttcagatgatgaggatgactacccgatggatggaattgatccttctatgaagtctgttggaattaattatccgtatgtgagaaggcgtaagaagctaccagatccagttgagaaagag

SEQ ID NO: 6686 - DNA, 885 bp, Triticum aestivum
  Clone ID: PAT_TA_6686
gcggccttcttcgggaggcaggagcagcgcggcatcgtgagcgccgggcccgggttcccggagagctcgtggttcgccgagttcgccgagatggcgcgtcgcgtgtggctgctgcattgcctcttctacgcggtcgacggcggcgaggaggaggacggcgcgtccatcttccaggtccggaccggcgcgcggttcgcagaggtgtacatggagagcgtcaacgaggggcgcacggaggacgcgttctgcaccgccgccgaggaccgcaccgtcgggttcaccgtggtacctgcggctagtgccggcccgccggggacccgtcgccgcggctccctggcgcggccgcggccgccgccgggagccgcgagctgcgccccatcgtgagcgccgggccccggttcccggcgaccgccgggcgccccgtgggcggggagatgccccgtctggggcggccgtcgaggtctctcgccggtcgccggctggggtggggatcatggtggtggtgggggttatgtatctattaagggatgtagcgatgcgatcataatataagggacagtttcaacgaggggcgcacggaggacgcgttctgcaccgccgccgaggaccgcaccgtcggcttcaccgtggtaccggggtttagagtcggccggacggtgatccaatgccgcgtgtacctggcgcggccgggccggcggccgtgaaccggttgtagcaacaaattagaaccgtcctgtttgtagcgtccggcggacgacgacgactggggaggaaaaatcccattttggggcggccgtcgaggtctctcgccggccgccggctggggtggtgatgaagatcatggtggtggtgggggttatgtatctattaagggatgtagcgatg

SEQ ID NO: 6687 - DNA, 344 bp, Triticum aestivum
  Clone ID: PAT_TA_6687
gggcggccgatgtggaggctctggagcatgctttgaagagcatggtggaggcaaacctgaaccatcctgcattggaaatacgtaaatggtgtgaaaaggacatgttaccagatgagttataaaaggaccggacatgtactggatatgatggatacacatgttgcatccgattgctagtagatgtgaagaaactcttgcagatttactcgtttgcatttcagtcctcctaggctgggacccgtagattagtacattgatgtagcgaatatttgatgttgtaaccatgattttctactgttatttcccttgttattaagacctcccagtaagattgaaaaaaaaaa

SEQ ID NO: 6688 - DNA, 1203 bp, Triticum aestivum
  unsure (1)..(1203): unsure at all n locations
  Clone ID: PAT_TA_6688
ggcatatccngcctcctgcgccgacctcccaagtgtctacgctggatccgtcgacccgaagcacttattcacgtgacgtgttacagaatataaactagaagtgtgttgccatggctcaggatgctgtcgctcttaatggactgaattacgagagtcatatgcagtttaggaggtccgtcgtaccgattcttatatatcgtcgtcaacagaaagaggaacaggaacatgaaggagaagaggaacaggaaccagagccggaaccagaaccggaacaggcaaatccaaatgacccaatttctgttgttccgggcatagtcactgtcgctggtgagacattttgccacatcatagcaaataagagattgctttttacccgtcgtcgaggcaggtatagatttgaaattgctttccccaacatgaacttagaccttgacaacctcaatgtggaaagacatggcttgttggctgctttctactgccctgttcctgctggaattgtagatgccgtgcatttcagcaatcaaactgcacagaaccaaaaacttaagatgtatggatatcagattagtgcatcaggacaagtacaaagggatctaataatggctatctgactcacatagggaaccgtgtggggcaagaatacatcggacatgattgtactccttcaaagttatcgctaagtgggtcacccatttttaatgaggaaagacagctcgttggtatatcatacgcggattttggtataaccaaggccttgaatgtggagaatatagcttccatgctttcagagttttatgatggaatggagaactggcctatgtcagatatcttacaacgtatcagagatgttggtgaacatcaatttgttccgcctgcggatcatatgacttgatgggccttagtgtgaacttgaaggaaggaagttagaacattggttttgttttcgttgtttactcggtttgttacctagctttagcttctcattgactgttccaagtagtctacatgtgcaaacactgtatgtgccatttggttggtggtgtttccctgcacgcaacagaacattctcttcagtctgtaactctgtgtgcctgttgtgatccaatctgacgaagtagcttacatttgagatccagtctgatgagtagtgtgacaatgcgatgtcttgttattgnaactagatatccaaatccaatcaagttt

SEQ ID NO: 6689 - DNA, 879 bp, Triticum aestivum
  Clone ID: PAT_TA_6689
tttgtcacgcgttcggctcacacacacacagaaccggagacaatcccccagacgaggcgacaccggaccgagaagaggcggacggcggcgatgggcggcggcgacaaacgacgcacaggggcgataggcgccgcgacgcgcgcacggcggcacgacctacaagggctacaccatcccccacaacaagcgctggcacaccatcgccggccggcgagactgtccgaccctgtgcttctggattatgtatataccgaccgaggaaggggggggcggtcgtcggatgggcgcctgctccgggcgacgaggatgaggcttacaatggtcttcatcatccccccaaaaaaaagcgctcgccgtagtcttccccgcgcaagggcgctctgcgccaccatgggcggttttggattttctacagggcctaaacaggcgcagctctgtgctcttgggtatgcgtcatccttgggatggccattgatgatcatgcgcatggtttttgtttttgcacacgaaacatgaggcttcatccgtcgtgcatcgccgtcccattgagctcaacgctgaaagcgggctggacagagaccctgacacgtcgcatgtttcgatgcaagtctctgctaataaaaaacaatcacaactatcattattcacccctgttgtttgcaagttttttttagcacataaactggctttgttatgtattttggtttggagctgtggcgtccgtgggaatgcttcggcgtgcatgtgttgttgcttattgtgatcgctgcagctgttgtcgcacgctctgaggaatcctctgacaatatatgtatcccgttcgagtagcgcattgcaaacatgcctaagcgttactgctgtttagcactcttaacttcc

SEQ ID NO: 6690 - DNA, 646 bp, Triticum aestivum
  Clone ID: PAT_TA_6690
gctcctccttgccgaagaaaacctcatctgcaacacaaggggtagctagctagctagtggctgttgggaaatggcaggattctcacacctcccccagcagatggagtatggcctcgccaatgccggcagcttcttgctctgccatggcaaccctgaggatgcagccgcctcactggagggctcgtctggtgttcttgacactcctcttgtggccactgcttctgtggagaagaagaggaagcccaaggaagacactgccagcctcaactctgcccactccaaggaaaccaaggagagtaccaggaagaggggaggcaaaaagcagggcaaggagatggatgaggaggaggaggaaccaaaggggtacatccatgtgagggcaaggagagggcaggcaacagatagccacagcctttcagagagggtgaggagggagaggatcagtgagaggatgaggatgctgcagtccctggtccctggctgtgacaaggtcactgggaaggctctcattttggatgagatcatcaactatgtgcagtcactgcaaaaccaagttgagttcctgtccatgaggattgcttccctgagccctgtggtgtatggttttggcatggagagtggggctgccttcagtgaccaatcacaa

SEQ ID NO: 6691 - DNA, 529 bp, Triticum aestivum
  Clone ID: PAT_TA_6691
ggatcgatctacgttaatcccgctaattagatcgatatatatccacatattagaatagcaaagttcggcaatgttccgcggtggcggcagaagcaagatggtggcgacgagcacgagcacgggcaatgagctgcccgtcgacggcgtggtgcgggtgaggaaagtggagaggatccagccatacaacctcgtctccaggccatcggtgcaccacggcgaccacgccacctcgccggcggcgtccggaccggcggagagcctggccgtcagcgtcgtccgtataggggacatagtgatagtggacgacaaagacaaacccgacggcttactctcggtgtctatcgcgtagaagttttaattataagttggcgattgcgtcatactacgagcgacacgcgagtgtagcgtataataatgcatcctctcagggaaacatccacaccaatggttagtcggctatggacatctgtgtcttatgtacaattgcagtagtagctgatcagaggatccaggaaacaaaaaataaaca

SEQ ID NO: 6692 - DNA, 676 bp, Triticum aestivum
  unsure (1)..(676): unsure at all n locations
  Clone ID: PAT_TA_6692
cccccggctggancccgaaaccctcgtcgactgttctccgcccgccgacgaggcgaaccacttcgccgccggcgtcttggcccgctgtcggcgttagcttccgcctcgggttcgcctcctaaggcagcgccgccagtgcccgtgctgactgcagcgcagaaggcgctctgctccaacccggcgccccccttccgaggacccacccccaaaccctcgccggccgctgtaacttctctttgcaccacatacccccttcgtcctcgtctccatccatctgcactgagagcgaattagggcaatggagttctccgtcgaggaggaaccgaggtcgggcgcgcccctggcactcgggctcggggaggacgccatggaggcggtaaggagagctttcccgggtcaggattttgctattgatgtggtgaaccgagctttcggtcggcggaatccggcggagcgcagccaacaagattcctctgcctgtggtatcagtggagcatgtacatcggaaaagcctgtggatttggagcaggcggagaacgctgggaagagctgtgcgcaacaggatccctctgcctcagaaatgcagttgagatctcaggaagcggagcaagccggtcagcgctgtgatgcccctcccgcacctgcagacgtaggtgctgaagccggcgggggctgg

SEQ ID NO: 6693 - DNA, 361 bp, Triticum aestivum
  Clone ID: PAT_TA_6693
gcctctcttctcttctgtaccagtgacaagtgcctctcttctcctctccggccaacaccggaaacctccgacggctccctccgtccgccggccaatgccgccgccgccagggcgcgagggtcgtcgtagtggacaccgccgccggcgactcctgtggatggagtccgcgctgcccctgatgcggtggacgggttaactgatttgttggagctgcgtgcaaccgtgcgtgcatgcatgcatgcatgtaggcaagtctaatgcttggctgttgtgttctcatctgttggttccacttggctgtaattactaccagattccctttcttctgtactactactgtatgtgttcttcaaaaaaaaaa

SEQ ID NO: 6694 - DNA, 1023 bp, Triticum aestivum
  unsure (1)..(1023): unsure at all n locations
  Clone ID: PAT_TA_6694
ggcaacctcatggacttcgctcgccggaaagcggcggcgctggccgcgctctcctcgccggcgccggacaagtcaccgaaaggcggcgtagacgcccccatcgccccgctcctcgacgcgctgaactcccacgcggatctcttcaccacgtcctcctgctccggccgcatctcagttctcgcgcagccctcgccgcagtcccaagcggccgaccccaagcccaagaagaaggcccggggcggcgggtggttgtacatctcgcacgaccccgctgacccggacgcagttgtggagctcctgttcggtgggactggatgcggagagaggggtggaggggacgagctcgtgttcaggttcgagccgatgatcgtggcggtggagtgcagggatgctgcggcagccgcggcgctcgtggccgctgcaatcggggcggggttccgggagtcaggtatcacaagcttgcaaagacgggcaatggtagcaataagatgttcaattcgcatggaggtgcctcttggtctgacaaatgaacttgttgtttctcctgagtacatccggtaccttgttagaattgccaactgtaagatggaggcaaacaagaaacgaatggatggctttctagacgttttgcagtcaaagggtctgccaggtatatctaggttgcaagttcataccaaaaaagacgatcgatctttgggctctgaagttcaggcgtcactcaatcagagtgtacaaacacatgatgaactgttagttacggaaaagagacgtggcagctataattgtgacgctggtaccaaaggtgattgtgaaattggtgagaattcaatagaagggtcatattatgaaaatcgagatgctgtacgcaacaacattgcgaagcatggttttggtaatgctgaacggcatgttcttataactctccttttctccatctgttctatttttattatttccatatagtgacattttttnggctctttggatcctttaatgcaattnacatcatttnatattagaaaa

SEQ ID NO: 6695 - DNA, 501 bp, Triticum aestivum
  Clone ID: PAT_TA_6695
gttcgtcgctctcggcccgcggcgatgtccgggcgcggcaagggaggcaaggggctgggcaagggcggcgccaagcgccaccggaaggtcctccgcgacaacatccagggcatcaccaagccggcgatccggaggctggcgaggaggggcggcgtgaagcgcatctccggcctcatctacgaggagacccgcggcgtcctcaagatcttcctcgagaacgtcatccgcgacgccgtcacctacaccgagcacgcccgccgcaagaccgtcacagccatggacgtcgtctacgcgctcaagcgccagggccgcaccctctacggcttcggaggctagtagatacgtggtgtgctctgctggtggcggccgtgtttttctgtgttatatgtgccgtggtggatgggatgtacttctctgtcgtgcgtttgtgttcactagtctgcaataccattatccgttcaatgaaaatactccgatcctgagttctgtcgaaaaaaaaaa

SEQ ID NO: 6696 - DNA, 1343 bp, Triticum aestivum
  Clone ID: PAT_TA_6696
attcggcacgagggtgttgaacctgttgatggcgtcaacttgtccgacttgatggattacgatccgctggcactggatgccgacgacgaggagacaaactgcccagggaagaaatttcccgtggcagcagcagcgaaagtagacgatatatggagtaggatttacaccagacgcaacatcgagtaccagaagaagtgtgaggagattgaagcaagtgaagatgagaatgccacatttccttcttatcctctcaaaatactccctgaggcaacaggtctatgtgtcttgaggggcttttgccaccaccgtgaatataaaacccatgatacttccactgctagatcaagtcttgggttacgtgatccaagactgatgctacagatctttgcgatgcatttatcaatctccgaatcctattcctaccccgttagcgtctatggaattgttgctgttcgggatgccttggagccactacggaatcttgtgtttaaccgtccctgcagagatgatgcttttacggttgaccaggattccttaaccttgcctctttgtagtcctcgtcgaggaatgtatttagtaagggacagagcattactagaagttgatctttgggtaaaggaggaaggagatgggtcatctgacaaacagttgctttctttgtatgctgagtttgaggggatgtacgagttagatgaaatgctagatggagaggttagtagtgaccttggcagcttggtcattgactatctcttgcttgatgagagtgttgaggctgtaatacaagtctctgcaaagattgactgccctcatcatatgagattcactgcattcactagtggctttgatggtgagattgtgctgtttgatgataagttctctgggaatggaaaactgttccagtatgttgtcgcggtgaaggctgaggggaaattggatatttgcttaaaaatggaggaatcattgttttggtggactttccaggaaggagctgttggagctgttaggttcccggatgactcagttttaaattacgggcagtttgaggtgacggtgctttttgctcctaagaaatttaccatggatgactgaaacctgatctgtaatatcggtgtttttttatcttctatacttcctctgtaacttaatatacattgatcatttctactacttcttcggtcccataatataagatgttattacattcatagacaacatattatattatgggatgggagggagtattcgaatatccatttgtaagcctcctagaagcttgacgctttaattaacgttgtctatgaatgtttaattgcagcagatacttaaaaaaaaaaaaaaaaaaa

SEQ ID NO: 6697 - DNA, 602 bp, Triticum aestivum
  Clone ID: PAT_TA_6697
taggggcctttttttttttttttttttgaacaatactgaatttatgatcataaacaagccagttgtactgaacattttacaaatacactgattcatcggccgtcttttagactactgaaaaaaaataaaatgaaataagatacaagaacgtaatgtatgccgatcgactgatcgagctctcacttcctcttgttcttgctgccgacgagcagcacgacgtagaagagcgcgcggaagaagaagccgaagccggcggtgaccaggaggcacatccacttgccgaggtcggtgacggcctgctgcgcgagcacgtcggcgcccgtgaggacgcaggtgtgggaggtcatgcgcgtgcccagcgcgttgccgatggcgcccagcaccttcatcttgatggcctccggcatgccgccgatgggcgtgccgtcgaacatctgcgtcccgcgcgcgaagcaccgcgtggcgtcgccgaactcgttctgcagcaccgcctggtacgggtacttgacgagcgagatgtagtggaaccagatccagtagtccgggatcctgtcccggttgatgaagaagcccgagaagagcaggaagtagaccaggacggc

SEQ ID NO: 6698 - DNA, 1123 bp, Triticum aestivum
  unsure (1)..(1123): unsure at all n locations
  Clone ID: PAT_TA_6698
aggctcccatcctctcccccgcacaccactcctcgcccacgacccgaatcccaaaccctaacccctctcccctctccccccattggactgcctccgccaccgccccctacggcggccgatcctgccgcgacctcccttcccctcccacctcaagccgctcctcctcgcctttgtggccgaccacttgctcccgccgttcgagcccgcgcgcctgctcctcctcgccttccccgctgacaacccgctccgcgaccacctcatcaccaccgccgcctccgcgttcttagctccgctctccgaccactgaaaagatggagccgcacctctccaactctcccatggcgccagctggagccaacgaggtcagtccgcggccagatctgccacggccacagagggcctttcggatccgcgccgtcgtcgagcttgatccgcgccctcccaggcacaccatggccaacgtcctcaaggcgacatcgacgacgatgacaaggaggaggaggaggatgaccaggacatgcacgaccccacacccgggcctgacgagcttgaagaggagatcgccgagtccgacctcaagctcgaccatgacggtgtcgtccatcccgaccacgccgacgcgcgacagaagcagcagcagcagcacacgatgagcggcacgaggtgggcgacgaggccggcgaccttcacggcggcacagtacgaggagttggagcagcaggcgctcatctacaagtacctcgttgccggcgtccccgtcccgccggatctccgcctccccatccgccgcggctttgactccctcgcctcgtgcttctaccaccaccacgcccagcacaagtagaggctagttgtggtggtccgaaggcctccaggcgccgcatcaccacgccgtcccgacgccgacccagtcgcaaacgacggccatctctagtatgtaatatacataccttcaaccttcaacctgtaacagaattggatcttgttatccgtatgtgcggaatgctgtgggtcaagtcaatacttagcattggttgactgtgagcaactcagatgtttggtgttatgcctatgggctatgcagggncttaggcaggaactttcatacaataatcactaatca

SEQ ID NO: 6699 - DNA, 842 bp, Triticum aestivum
  unsure (1)..(842): unsure at all n locations
  Clone ID: PAT_TA_6699
gtcgggatctctcgtcgccggcgcgcgtggggaggggagctgcggaggggtggttgcgagggaggtggggtggtggcgtgggaggggggggggggggatgggcgggggcgggccgaggccgggcccagggcgggagagcccgtggggcttgccggagggggacaagcggcagcccaaggcgcaccgctgcaacgaccgcgtcgaggatgtctcccgggcgtcgccctggcggccttcgatgcgagtccgttccaggcccttcctcgtcctctctaggccttgcggccgcgcatgccctggggacctggcgagggtcccactgtctcatttactgccctgccccccgatcctcggaggagcgtagagacagtaaacagctcctaaatccttctgaagtgtgcgtgcgtatgtgccgtagagtatgttgtgaccatgttacctgggcgacgcgtggccctcggggtgttgattttttctatattttttatgagtgctaatccggtaaaaccctatccagaaataagaaacgcctttacaggaagggaattgccctaatgaggcggctcttggacgtgcttttgacttctttctgaccggaagagccaaactccgactgaccggctcctaaggttcgttgatggggcttgacacgtaacagggagttggtcaagcacgattctccgtgtagttgcaaatccctaaaatttatgnnnnngcgtaccagcctacctgtgtgccatatatgatgtttcacatctgttaagaaagtagttnnnntggttggttgggcagtatggatggtgcaacctttctggnnntatctcagtctggctggctgggcc

SEQ ID NO: 6700 - DNA, 637 bp, Triticum aestivum
  Clone ID: PAT_TA_6700
gccaggtcgggtccgtggcggtgtgaccggcgtcgatgcgtcgggtcgggtccgcaggctgggtcacggccgtgacgacgacgacgcaagctgcatcaactccggtgacaggcgggcgcgcggccccccgcgccgggcgcggaggcgtgtgaagacgtcgagctcaggcgttcaagatgacggtcgacggcaaggcgtgtcaagattaaggggggaaatgttagcactaatcttgatgtgcgtggtttccgttagcagcaagtcccgcggctgctacgagcggggcgtccggtggagttgccgagtcctggagtgcatggataaggtagttatctagttgcatgcatgtagctagtgggttagtcgcccggtcatgtgatagtggccggtgtggtgcatgcgtgcatgagttagttgatattagtggcctagtgcatgagtgagtgggcgttacgaaatgctgcggtggcggctggcaagtgcttgggtcagtcttgtacctagccagtgaagatggagcaaatgaatgtaaaaagtggcccgcgggggggggaagtgaatggcagcccgcgagctcccccaagggacatctggttggccgtgcggccggaggcgtttgtgcgccggggtaaaaaaa

SEQ ID NO: 6701 - DNA, 203 bp, Triticum aestivum
  Clone ID: PAT_TA_6701
ggtgagatggaggtgtgccattggatcttccacggggacatggtttggacggtggctgattgagcggataacggcgcgcgtggcccggtctgatttgaatttttagtccattcaagtgaaaagaaccttttttctgatcattggctcagtagcatttttttaactgtctgactccatatcaagaagatactacaaaaaaaaaa

SEQ ID NO: 6702 - DNA, 953 bp, Triticum aestivum
  Clone ID: PAT_TA_6702
ccccccgcccgaggggaaagggaaagggagcaaggcaagaaggcgcgggcgacggaccctagctctggcgcgtcgagcccttgcccgcggcgctccgatcccccgcgccgcgcttggcccgcgggcggcccgcggcgctgctgggcccccacccccgccctcgccgctccccggcccgcgcccggcggcggagcgccgcctccgcccccgcccccgcccccccctcgccgaccttggccgcgccgctgctcctccgcgccctgccccctcttctctgcccgcgccgcacgcggtcctcctcctccggtcgcgccgcctctcaaccagccgacaagttttgcttttacctgaggggcgcgaggatgacagctatgccagaaccaggctcaaaagtacttagcacgataatgctcgtgagtagtgaagaagaatgtttgaatgatttctggtatttcatgagtgtggtaaagaagaatgaggttcagcgtgcaaaggagatggaatacataaatatgaagtccagatacgatgaggaatgggaaaaggtacaaaatctgccatgggtccagaagttggagaacctccaagatcacctttcaaacaaggcttgggttttaattcctggtggcttactgcttgccggcctgggggagtcctcagactggaagctgccaagaggccaacacgcaccaccccctggacctggcggggggcccccccctctcctccggaggcccggggaggtcctgttctctcccgggggccggggcgcggcgtgaccagcctgggagggcgacgattcctgcaatgttttagtggtgtcgtgacttttgattctgactttcttgcctgtgtcttggtgggtgccccgctgttgcgcggctcttgcttaatcgacccgtctttgtgccgctggtgttatgtctgttgtgattatgatttcttgcatgatt

SEQ ID NO: 6703 - DNA, 731 bp, Triticum aestivum
  Clone ID: PAT_TA_6703
agaagacagatgtgtttgggtttggagtcctgttggttgagttgatcactggccagaaagcattagattttggaagactagcaaatcagaagggcggagtgcttgatttggtaaagaagctccatcaagaaaagcagctgaacatgatggtggacaaagacctgggcagcaactacgacagggtggagctggaggagatggtgcaggtggctctgctgtgcacccagtactacccgtcccaccgccccgggatgtcggaggtgatccggatgctggagggggacgggctcgcggagaaatgggaggcgtcgcagaacgtcgacacgccaaagtccgtctcgtcggagctcctgcccctgaagttcaccgatttcgccggggcggacgagtcctcggtcggcctcgaggccatggagctctccggaccaaggtgaccgacgacggcgaccgacttgatcgcgcagatgcttgcttgtgtctcaatggctattgcattcgattagcctcggagagcctgggcaaagggagaggtgacattttttttccatgttggatagggtaagggtaggggtggtggcattcatttgtacatacgggcatggtcattgtgtattgcgtgagctgagctcggcccatcgttgctgctcatgtacatgtaggctaagagagaagagaagagatgagatgagttgagtaaatatagaaaggaaaattttccattaaaaaaaaaa

SEQ ID NO: 6704 - DNA, 981 bp, Triticum aestivum
  unsure (1)..(981): unsure at all n locations
  Clone ID: PAT_TA_6704
ggcacgaggcttccttgcactccccccccgcccgccgcccgccgccactgcacccctagcagcagcacgccatggcgccgacggccgactccgtcgacctcaagggtcaaaagaaggccaagaaatccaactccaaagatgagagaaagcaccggaaggataagtatgagcgtcccgccgcggacgaagcgtctccccgcaacgaggccaagcgcaagcacaagggcgggcaggagggtaaggagcacgggaagaagcccaagaaggagaagaaggctggggctgaggccgaggctacgggggcgggggctgcggaggtgaagcggggagacgagaagatgaagcgggcgatggaggacgagaggttcgcggcggcgcggactgacccgaggttcaggccgatgcggcggaaggaggcgaaggtcgccctggactcgaggttcaacggcatgctgaccaacccgatgttcgcttcgtcggaggcgccggtggacaagcgcggcaggcgccgcaagaagggcgccaaggagaaccccatgctgcattactatctcaaacaagaggagggggatgaaaaggagaaagacaaggagaaagtgaagctggtccaagaagatgatgacgatgaggtggaagaagaggatgagcaagttgaagaagaaagttctagtagcgatgacgaagaggaggaggaggaggaggaggaggaggacgatgacgagtgctctgtcggcagtgacattgctcattacttgatggcgaggcatgatgatacacctatgattgataaggaaactcataggcttgctgttgttaacatggactgggatcacattaaggcggtggacttgtatatggtgatgacatcttgcatcccaaannntggacgagttctatcagtctcaatatatccgtcagaatttggactgaagtgcatgaacattgagncnactcaaggcccgtctactcttcttggtatcc

SEQ ID NO: 6705 - DNA, 547 bp, Triticum aestivum
  Clone ID: PAT_TA_6705
ggctcctcctcgccaccgccatcccattttgttggctgccctcgatgggagataacacacaggaaggagcagaggttgatccggtggaggatcatgaatccttgcccgagtcaccggaccagcgccgttgaggccgacctaggcacgcttgaggtcgaacgccggtgagttgatccgcaacgaccggaggctcgtcgcgtcttgatcccgagacggcggggaacgctggtctgatggggataaacgccctacatctggatctcgtggcggcggcggtagcaagattaaggatttccgatctgctgtttccattgtagttacattggagtcacatgcaggccttcagcatgtgctgatggagcagacactgaagagaagaggagacagagaaaaaagaaagcatctcaatgattaatttgcagacaagacaagagataatcgcaagattatgtcctgtactctgatggatagagtgtggttgctagttctcttgtttcatgtacattaatctctcgtaatcaaatcacttgatatatgaacgaattaa

SEQ ID NO: 6706 - DNA, 1042 bp, Triticum aestivum
  Clone ID: PAT_TA_6706
gaccgagaagtcgcagccctcaaaggtagtcacctttgcctttccaagtcgccctttagggggagacggagaagtgcctctagcttcagcaatagtagtggttcgtcctcccctatccgccgttagaactccagacatgttaaacccctggtaggtaaaatctttctgtctcgtcgctcttttatctctgatcatctggtttgcctgtgctgctgtcatcaaccttcggatcggggcagatatcattggaacgggcacacggttcttcgcctcccagcctgagaccagcattgccgggccggagtccgtctccctctccaccccctcgaaggttcagatcaccaaggcgcttttcacccagaagaggttatgttagtccaggtccgaagacgttctccattcgctcctagaaggatgacacctccaatgcggatgagaagtcctcccagaaggctgccacctccttatcgtcgtagtagatctcccattcgtcgaccaattcgctccctttccagatcaatttctcctgtcaggggtcgagcagctcctgtgaggcgtgggcggtcatcctcgtcattttctgaatcaccaacgccgccaagaaggggagccggaagggtactgagaagtcgcagccctcaaaggtcccctttagagggagacggagaagtgcctctagcttcagcaatagtagtggttcgtcctcccctatccgccgttagaactcccgacatgttgaacccctggtaggtaaaatcttctttgtctcgtcgtccttttatctctgatgatctggtttgcctctgctgctgtcatcaagcttcggatcgggtcagatatcgttggaacgagcatgcgagtctctgtctgagatcttcgaagagttggctttcgttctgtagtggattagagcacattaatcggttttctcgttgtgaattttcgatccatgagacctcgatatttatgttggtcgatttaattttatgaaattgccgtgcccgccaaacagatcgttgtttgtggattcatgtgaaaaaaa

SEQ ID NO: 6707 - DNA, 733 bp, Triticum aestivum
  Clone ID: PAT_TA_6707
ctctggttgggacagatcgttttttcggggaaaaaaaaggagagatgaaggaggcgacggcgtcggggggcggcgcgacggcgacggcgaacgacccgaggcagccggcgacggcgaggccgtacgcgccgcccaagctgtcgtcgcaggacctgcccgtcgactacgcgggcttcctcgccgtcgtcttcggcgtcgtcggcgtcatgctccactacaaggtgtgctcgtggatcgccatcatcttctgcgcgcagtcgctggcgaacatgaagaacttcgagaatgacctcaagcagctctccatggctttcatgtttgctgtcatgggtttggtgacgaactatttcgggcctcgcccaggcggcacaaaacgctaatctgcacaccatgcgccatatgaagtttcctgttaaatttttggtgcctcgaagctactggcatggtggcgcccacccacacttccgaatcattgagtcgggcacgcgtcaaatgtaccacctcatttgtagggaccaagacatgtatcatgatgctcagtaatctatttgcacggtacttgttcttccagttttattataaagatagttgaagggtctttgcctacatcaccaaattaatcaaaaaactgtggcctacttggttttgtattgtttcatcttatgcggagcagcaatcgtattcctctcattatcgggagtacaatcacttcaatccaagcaaaaaaaaaaaa

SEQ ID NO: 6708 - DNA, 894 bp, Triticum aestivum
  Clone ID: PAT_TA_6708
gcactgcggggtaactgcacaggaggaaaaccggcgaaggaagcggcggcggctccgggcgtggtcatggacgagaagacgcagggataagagtggagtgcggcggtgctggagatcctgcggggttccgacatggagtccctgacggagtacaaggtccgcaccgccgccgccgaacgcctcggcatcgacctcgacctccccctccacaagcgcttcgtgcgacgcctcgtggaggactacctcaagtccctcgccgaagaagaagacgagaagcagaagggcggctcccgcaaggaggggaaaaagaaacagcagcgtcaggaggaggaagagcaggaagaggatgaggagaaggagggggaagaagaggaggtggggggggccgacgtgccgggcctacggatgtgtgcgttcgacgataatggagacctcatcctctgccgcctgtcgaagagcaggagggtgacgctgcaggagtttaagggcaaaacgctggtgtcgatccgcgagtactacttcaaggacggcaaggaactgcccacctccaaagggatgagtatgacggtcgagcagtgggagacattcagcaaatcagtacctgcaatagaagacgccatcaaaacacttggagaatcagattgaaaggatgccacaaaaacctaaaaatctcgaccctcgttctggacctctgcaagtagagtagtccatgggtgctctgagtactccatggggctactagagttcatctggacttgtataaagcttctcccttagtcaaggtaccgtacctactgatgcgtgctgggtagacagtttgggtgtgttcgcgaactagttctccgccggtatggtggaccgaagtttcatcgctgtgccatgtgaaaaaaaaaa

SEQ ID NO: 6709 - DNA, 1087 bp, Triticum aestivum
  Clone ID: PAT_TA_6709
gggcgccgccgcgtcactcctcctccttctcaggcgctgcagcttcactcctcctcctccccaggcgccgcagcgtcactcctcctcctcctcaggcgccgcagcttcactcctcctccccaggcgccgccgcgtcaccgcttcttcgttcgccgcgctatctcctcccagtcgcccatggatatcacgcgtggcgccgccgcagctttctcgcggggtgccctttttgctgttcgctcccatgcgaggatcggtttctatgggggtttgttcatggttgtgtcgtcggttgccgggaaagtcgtcgtacacagttttccgcaccttggagataggctaatgcggtgctccaagtactgttcgctcgtcttttcttccataaccacgacatcggtggtagccagttccatcatccggtacaccatgcctgaccctgatatcatcttcgtaaaccctcttcctctgccgcctgccaggtttaatgccttggctgatccagatccggggttcaagcatgcttttggagagcgtctactctttattgagacacttgaccttaacaacataccttggttgatccatccttggattgatgctgatgctcgtggagatatcatcaatattgatgtggaccaagctacttccccctttgaggcatttgaaatatggcagttcatatgccaattgccagaggcttggccaagcttcttggcacgaaagcactgtcctatcttgatgtcaaaggtgaaggagcatctcgatggccatctttgggcacctgtgttacaaggtgattgggattagatctacggcagtgagtatctagttttgtttgttaacgtatgaagcagtcaagaaagaccttttttacattcctctttttgaaccaatggcaactgtttgccctaatggcgacttaagttatgattcgctctaatggcagattatgtgaagaactgctgctgttgcagtataagttatgaagctctaatggcaatcttgactatgtctggagtactgattctcctttttgtttatgggaacgcatatgtgatgttatttttataagaaaccaattatttccatt

SEQ ID NO: 6710 - DNA, 2712 bp, Triticum aestivum
  Clone ID: PAT_TA_6710
cgtccgcccgcctgccttcccagccagcgcgcggtttggtcgtcgcctcctgctcctcctcgccgatccatcccagatccacgccaccgggcggatccccgatgcgggcgccggcgatgctccggctggccgccgccgggatcgccctcgtcgcgctgctcgccggcgcgccccccgccggcgccctcccgccctcctccccggccgccctggtgcctcctctggttcggcatctcagtgcccctcgtgtttgttgggagctacctcgggttcaagaagcccgccatggagcctccagtgaagaccaacaagatcccgcgtcagatccccgagcaagcctggtacatgaacccgctcttcaccatcctgatcggcggcatcctgccgtttggcgcggtcttcatcgagctcttcttcatcctcacctcgatctggctgcaccagttctactacatcttcgggttcctcttcctggtgtttgtgatcctcatcatcacgtgcgcagagatcaccattgtgctctgctacttccagctgtgcagcgaggactacaactggtggtggaggtcatacctcacctcagggtcgtcggcgctgtacctcttcctgtatgctgggttctacttctggaccaagctgcagatcagcaagctggtgtcgggcatcctctacttcgggtacatgctgctcgcctccttctccttctttgtgctcaccggaaccatcggcttctgcgcctgcttctggttcacaaggatgatctactcgtccgtgaagatcgattagtcgctggaagcacagcaggcagagacagagcatagcatatgttttcagctttcgcggtcagaggtgataattgtatgattaaggtgaaggtggggatcatcccccagtttgttacacctttttgatgggaattggaatgacgcaatcactcgtttgactgaatgtgatcctcataacagcaagtttgtagtaaattctgaaactcctcaggaggttgaggtcggcaaagatatcatattcacctatgatgttcgctttgaggagagtgaaattaagtgggcatctcgatgggacacctatctgttgatgtctgatgatcagattcactggttctctatcgttaactctctcatgatcgtgcttttcctatctggtatggtggccatgatcatgatgcgcaccctgtacagagatatatctaggtacaaccagcttgaaactcaagaggaggcacaggaggaaactggctggaagcttgtccacggagatgttttccgccctccagtcaactctgatttgctttgcgtctttgttggcactggagtccaattctttggcatgctgctggttacgatgatctttgctgttctgggtttcctctctccatcgaaccgtggaggattgatgactgcaatgcttctcgtctgggtcctgatggggttgattgctggctattcttcttcacgactctacaagatgttcaagggtgcagagtggaagcagataaccctgcgcacggctttcctgtttccagggattgcctttgttatcttcttcatcttgaatgcccttatatggggggagaagtcatccggtgctgtcccattcaccaccatgtttgccctggtcctcctctggttcggcatctcagtgcccctcgtgtttgttgggagctacctcgggttcaagaagcccgccatggagcctccagtgaagaccaacaagatcccgcgtcagatccctgagcaagcctggtacatgaacccgctcttcaccatcctgatcggcggcatcctgccgttcggcgcggtcttcatcgagctcttcttcatcctcacctcgatctggctgcaccagttctactacatcttcgggttcctcttcctggtgtttgtgatcctcatcatcacgtgcgcggagatcacaatcgtgctctgctacttccagctgtgcagcgaagactacaactggtggtggaggtcgtacctcacctcggggtcgtcggcgctgtacctcttcctgtacgctgggttctacttctggaccaagctgcagatcagcaagctggtgtcgggcatcctctacttcgggtacatgctgctcgcctccttctccttctttgtgctcaccggaaccattggcttctgcgcctgcttctggttcacgaggatgatctactcgtccgtgaagatcgattagtcgctggaagcacagcaggcagagacagagacaaagcatagcatatgttttcagctttcgcggtcagaggtgataattgtatgattaaggtgaaggtggggatcatccccgtgtttgttactcttttgagggaaaagttacattttgggattagtttatgaactgatgatttatgtttattgttgtggtcacaagtgatgatacttgttagtgataaatgttggagttacaagggtagaatacaatacactgtgatggagttgtctgttttggcagaatttaatggatcagcgtataaaattcaatttatatttcatgaaaaaaaaaaaaaaacctgcccgggcggccgctcgaaatcactagtgaattcggcaagggagatgaactggtggtgaaggtgaacaagctgacgtcaataaagactcagctaccctacacgtattactcccttcctttctgcaagccgaataccatagttgacagccatgaaaaccttggcgaggatct

SEQ ID NO: 6711 - DNA, 484 bp, Triticum aestivum
  Clone ID: PAT_TA_6711
gcacattttcataagccacctttgatgcagtgagacaaaattaccatagatgcagatcaaagcaagcacctatggccggtaagatgagtgcagcttctgtgtttgtacattttggaggatccactaacattgactatggtctctggggttcctagttgcaagaatccatggatgttcacaatgcattttcagacagaagcaatagactacaagaatatgtatttactaagcaaaggacaaaaaagaacacatgcaacttctgaacatatcatgataacaggagcctccatatgttgatatatctgaggtcaacatagcaagcatgtactgtgccaactatcgaaggttcaaacatcattggagctataggacgggcgatcgtgttgcttgacacagggcaatgagccaaccattaacattgaacaccagcctaattaccaaagcctcgccaggcacctcacttcgaggctgggtaaaaaaaaaa

SEQ ID NO: 6712 - DNA, 963 bp, Triticum aestivum
  Clone ID: PAT_TA_6712
gctccttcccgcgccatcccgtccccggccccctcccctctccctcacctgcgctcggtcacatggggtggtgacgcatgcacgagtgcagaggatgtgtctacgtgggatgtgtacctcgggccgcagcggcatgccgccccgtccttgcctcgaggtcgcagccgccgcgtcgtcgacgtggcgtcagcttgggtcggtcaggccagaacccctcgcgcggcgtcgctgaatcttcctgtcgattctcgtcgccgtgaactgcatgacggcgagcgcacaccgacggtgtcttctcctattttttcggccacgagtccctcctcccccttgcttcctgcttgctcgggctgcgcttggtcacgtgcttgcacggcttctgtgttgttgcctgcggtgtctgcgctcgatgtgcgttctttctatgttgtgatcctttactgggtggtgttatctactttgtagttcatggtcggtaggtgtgtgtgctaggacgggcacggcggaaagcgacaccgcgatatctgattaggaagcatgcgtggtccatttggtgaccccaggatgtggctattgtagggacgacaaccccgccgcgtgctgcggccggccgctcccccatggtcgccgccccccgtcggcgcgactcgccctgcgcctccactatgaggttgttttaacctggagctgccgtgcctgcgcgcacgtcatgcagtttgagcgggcaaagctccggcagtccgccttcttctcgtcagcccgtgagatgcaagtctgcctcttctctctgcctcttctctccgattcccctccttttctgatgtgcttctttggttcgtgtttgtacttccatcttttttcatgcacggtagttgtttgtgttaatgcctataaggggaaatcaagttcctggtcattttcttaggtacagtgagctttccaatttgtcactcaggttttagt

SEQ ID NO: 6713 - DNA, 917 bp, Triticum aestivum
  Clone ID: PAT_TA_6713
gcatgtgcaagtatgaaccaatttgaactgtgaaactgcgaatggctcattaaatcagttatagtttgtttgatggtacgtgctactcggataaccgtagtaattctagagctaatacgtgcaacaaaccccgacttctgggaggggcgcatttattagataaaaggctgacgcgggctctgctcgctgatccgatgattcatgataactcgacggatcgcacggccttcgtgccggcgacgcatcattcaaatttctgccctatcaactttcgatggtaggataggggcctaccatggtggtgacgggtgacggagaattagggttcgattccggagagggagcctgagaaacggctaccacatccaaggaaggcagcaggcgcgcaaattacccaatcctgcggtgccgggcaacaccgccgcgctgccaggccccgcccccattgcaccaatgagcgcatcagcctcaacctccgacgatggatccaggctcccccggtcaggtcgcgccccaagtacccgcgcaggtgccgccgagttcttgggtcgccgcccctcggtccccctcttccacctcccatcctccgtcgctggagcagcacggccgtgggcgtgcagtgcgctgcgactcctcgtgcagtgtagatcgggaatcaggcaggattgcagtttcgttgtggtggctacatgccacagtgattttttagtcattttgtatttcactcgcttggggtgcagctcgcgggcgcatcctatgcagcgcgctgggcctatctggaggttccatgggcctcctctccccactgcatcgcccttcccggcggcctactgcaaacatggcgagtagagcatcaggagacgcataatgctcttctgcatttcattgatttttgtgcttttctaaacagaaaaaag

SEQ ID NO: 6714 - DNA, 830 bp, Triticum aestivum
  unsure (1)..(830): unsure at all n locations
  Clone ID: PAT_TA_6714
ttcggcacgaggcaccaactcgtgtgtgccgagnatggagagaagcgcgggtggcggcgacgattcggcgagggccgtcggcatgtgtgaccgactcctgaccttcctcgccaagaacctgtcgatgaacaggccgaggagcatcaccgaggggccaagagacgccggcgccggccgcgatcacaggaatcacgcagaggaggaagacgacgagttcgctgtgaagatcgagaaggccgagtacgagttcagccacgaggaagaaggccacaggagcttcacggccaccatcctagaagagacaactgctgatgtgagagcaagtgatcagcacaaggaggccacgggggaagccggccatcaggtggaggcgacggaagcgggcgcggcggctgtgcaggagaagaagccgaggaggaccgtgaccatcaaggaggaggccggcggcgtcaaggacaaggccaagaagtcgctgtcaatgaagaggcaatcgtcgtcgttgagcggcggcggccaggtggtcggggcaggaggggaggacccggtaccgaagccgccgctgaggtgggggctccggccgaggatgccggcggcgaacctgagggtgccgtccaacatcaatgagaagtcgtccaacttcattgaggagcgcaggaggggcttcggcgccggctgcaagccggggaaatgagctgacgctcccagcagggtggatgcttgcaagctgcaatgttaatacagtacagtaattaagtgtgtgcgtgtgtgcgttggtttggatgattgttggttgtatccagcagagtttcatnanatcaccagagaagaat

SEQ ID NO: 6715 - DNA, 536 bp, Triticum aestivum
  Clone ID: PAT_TA_6715
gggctgaggaattcggcacgaggcctctctctagtctctcatcgtcacctcgctccagcagcagcttctatctcgatctagggagagatcaagtgaggagagggtgcagccatggcggacgcggtggatgctcgccgggtctgcgggatgccggagaaggcgcagctccacgtggcgatgctggcgctgcagttcggctacgccggcttccacgtcgtgtcccgcctcgcgctcaacatggggatcagcaagctcgtcttccccgtctaccgcaacatcatcgcgctcttcctcctcgtccccttcgcctacttcctcgagaagaaggaccgccccaggctcaccctcggcctcgccgtccacttcttcttcctcgccctctgcggcatcacagccaaccagggcttctacctcctcggcctcgacaacacctcccccaccttcgcctccgccatccagaactccgttccggccatcaccttcggcatggccgccgcgctccgcatcgagaaggtgcgcctcgaccgccgcgacgg

SEQ ID NO: 6716 - DNA, 1046 bp, Triticum aestivum
  unsure (1)..(1046): unsure at all n locations
  Clone ID: PAT_TA_6716
nctgccgcccaacaaggnaggccgtggnacgctaacacgctgctgcactacaccaacgtcttcgacgccgtcgtggacgccgcctacttcgccatggcgtacctcaacgtcaccaacgtgccggtcatggtgacggagaccgggtggccgcacaagggcgacgcgtccgccgagccggacgccaacaacgacaacgccgacacgtacaacagcaacctcatccggcacgtcatgaacgtcaccggcacgccaaagcaccccggggtggccgtgccgacgttcatctacgagctgtacgacgaggacactcgccccggcaccgcgtccgagaagtactggggcctgttcgacatgaacggcatcccggcgtacgcgctgcacctgactggctccggcgtgctgctggccaacgatacgacgaaccagacctactgcgtggcgcgggagggcgcggacgagaagatgttgcaggccgcgctcgactgggcgtgcggcccggggaaggtggactgctccgtgctggcgcaggggaagccgtgctatgacccggacaccgtggaggatcacgccacgtacgcgttcaatgcctactaccatgggatggggatgggctccgggacgtgctacttctccggcgtcgccgtgatcaccacgaccgatccgagccatggatcttgtgtctatggtgggaagaacggcagcgcgttgctgaacggaacctcgctggcgccgtcgtcgaactccaccgcggactccggatcccggcgggcagtcggcgatgtcacgtcgttcgtccggatcgtcgtcaccgcgctgctcttgagcgtcgtcgctctgttgtaggatgtgagtagtaggaagtcaggcaggcagcagagtagggaagacgtgctattagtgacgtgagagattcttttttgttgtcaagtggaattggcctcggtgctgctgggtggcaagtgtcattccaaatggaacgggatgtggtttatgttggctcttaagcatatgagctcgtactctggtattggttgggaaaaaaaaaa

SEQ ID NO: 6717 - DNA, 1566 bp, Triticum aestivum
  unsure (1)..(1566): unsure at all n locations
  Clone ID: PAT_TA_6717
gacatagcaaggattgacagactgagagctctttcttgattctatgggtggtggtgcatggccgttcttagttggtggagcgatttgtctggttaattccgttaacgaacgagacctcagcctgctaactacccctcccgcgccccccctccgccgccggcttcttggagggccccgcccccgccgcccggcggcccgcccgggccccagcccgccggcgcccccctcccatccccgcctcccgcccctcctccgtgtggcccctcaccccgaccgccggccgtccagctcggctcctctcgctcgcccgccgcgcgcctgtcgccgccgcctcccttgggctatcccaagatacaggggttgcgatgcccggtgccaacattgttacccagaacgatctactcatcgttggcccaggtgtgcttgggcgactggtagccgagaagtggctaaaggaacatccaggatgcaaagtttatggccagaccgcaagcacagaccatcacagcgagctaaccgatattggcatcattccctccttgaagggatccactatctctcaaaaggctccatatgttattttctgtgcacccccatctcgttctgatgattaccctggcgatttgagagtggctgcctcaaattggaatggagaaggttctttcctgtttacgtcgagtactgctctttatgactgcagtgacaacagattgtgcaacgaggattgtccatctattcctgttggcaggggtcctcgtactgatgttcttcttagagcagaaaatgttgttctggaggcaggaggctgtgttctcaggctagcaggactttataaaatagatagaggtgctcattatttctggttgaggaagggaacactggactcacgaccagatcatattatcaatcagatccattatgaggatgctgcgtcccttgcaattgccattatgaaaaagagacctcggggtcgtatatttttgggctgtgacaataagcctctttccaggcaagaaataatggacgctgttaacaaaagtgggaaattcgacacggaattccacggtttcactggtaccgacggtccattggggaagaggatggagaattcgaaaacccgggccgacattgggtgggagcccaaatacccaagcttcacagagtttctcggcgtcgacagttagtacccggtcgcacacgttgagcaattcttcttgttaccctgagtgaatagcagcatcaaggggatcatacggatgtgctgtcgtaacaccaggttttgttgccccagcacagcagttctagaaaccttgcaaacactgcacaatagtgttatagcggtgtatatttgttctgctaggtggtcatcctctgtttgattttctgacacacttgttgcgttcgtctatccgtccgtttcctttcggtccgatgctcgttttttatccacgtttctgagcacgtttgttctgaaagtttttacctattttggtttcctggtacagcatggcctgaactttggtttgaggtgcattttataggtcttcattagaatcaaannanaaa

SEQ ID NO: 6718 - DNA, 287 bp, Triticum aestivum
  Clone ID: PAT_TA_6718
gtcattgggttcctcttgaattactcaattctgtagatctaagtttgctatgtaagcatgcatggctaccttgtatggcggcctcgggacaaagattgaccataactgtagtgttttgcaatgtatcttctaatatttttataactactattgtagtgtggttactgatctggattgttgattatagataggaggctacctttgaatctcattaccagaagggaatgcaaacatttatgcttgttatcaacgagaacatcagaatatttcgtatatgaaaaaaaaaa

SEQ ID NO: 6719 - DNA, 821 bp, Triticum aestivum
  Clone ID: PAT_TA_6719
gcaaagtcgtccttagtttaaagacattggggctaaggatggcaatgggtcgggtttggatcgggttaaaaaatatcaaattcatatccatatccatgaagacagtctctgcccaccaatgaaaaaacccatgggtgaaaatttgtgtccatgtccaaacctgatggatatccatacccattcgatgttcatcgggtcctctcaagacatatacataagacataacacaatgtgcacataagctattacacccatgcgtcaatgcgtgtgtgaaaaagcagagacagaggggtcgaggggatacggagttgctttgtcgtaggccagtggtgctggttgttgcagtgctccaccatacatggaggtagcagctgacaccgccgaccatctctcgggatgcaggaggagtaagaagaggagacagagctgatacttaatgatgagtcatttagtaacgagataaaaggatgagaaggggggctgaagtaatattaaggtggggattgaatgtcaactaataaaagttagggtgtggattgtgcaatttgtattgcatgttttagataataatgggaaaaattacagtgggacgtgtgactctagggtagggatagcagaatattgcccattatgtcaaactaccggatcgggtttgggtatatccatgggtactagattatatacatgccctacccacgagtaaccgggtcatgtttgggcgctgcccatgggcgcaaaagcatatccaaaccctttccatacgggtcggatatccatgggtatccttgtccagggtaaaattgccatccttaattggggca

SEQ ID NO: 6720 - DNA, 580 bp, Triticum aestivum
  Clone ID: PAT_TA_6720
attcggcacgaggcctcaccccatcccgcttctgcgctgctcgattcagttcaagactccaagtaaccaacaccagcaccagccaccgggaagaagcagggagcagtgggaaagaaaggacgccgcaagagaaggggctctgtggccgcgctgctcgtggcggtagagatccagcgggggcggccgaatcgacagccatgatgaggcacagagctcgctcttcccccagctccccgctcaccccatccaccagcatgaggtgacctatccatatcctcagctcttcttcttccgaggttttcttggtcgggtcttgcgatgaatgttcccggcaaatttatatgtgtcgctggaagttctcactggagctgcggccatggcatcctggtgatgcctggaccaggcttagatttttttttatttgctaccttgcttttcatttttttaaagcaatgcttgaaaatgtgagctaatacttagaacgaggaatccggagtcctttttgatactttatttagcaaagacaaaattctagggaaatactactgttccggctgcttccattctggagcgctgtgaa

SEQ ID NO: 6721 - DNA, 871 bp, Triticum aestivum
  unsure (1)..(871): unsure at all n locations
  Clone ID: PAT_TA_6721
gcgacaaggccatctccggcgacatggccaacaggcggcccctcctcttcccccccgccccccccgggcgccccccctcccgccgccgccgcccctccgcccccccccccctcctccacctccccgcccccgccggcctggcctccacgccggccgacggcgtcccccccagctcccacgggcgcggcccctccctcgggcgcatcccctccgtccccggtgtccagcaacagctcctggcccggtccggccagggctccactccggtggacggcgacccctttccccctcccctcctcctggccgtgagccaccaaggtgaacaactcctcctgtgatttcttttgcaaaaaagttcatctagatttgttgtaagctactgctaaagtatgatgttctcatcttgatttgctatgatgcgttgcttatatatggcagaaataattttgacatggatgtattgattgtaccaaatagtagtacaattgttgccctctggttgcatagaagaaatattgacatggtgcgttgcttatatatgctaccataaaagcaattctagatattgtttgtactacatattaattcttccaattcttttgtattgacatgatgaaaaatagatgaaagcacaatgggataatgtggagagcctttctcaccaccatgcacccattgatgatggtactatgggttccatccgtgatgctattgctacaagtgttttcccttgatggttagctctagggtgtatgcttttattgggagaaccatgtaataatttacagatcttttttattcagtacttcttctcaagtactcgtactacgtgagacagcgatgncatgtatgnatattcgtagcaagacaa

SEQ ID NO: 6722 - DNA, 617 bp, Triticum aestivum
  Clone ID: PAT_TA_6722
gtagaagctgctgtcaacaggaaggaccgtcacccgcggagccacctgttgcctaacttggagtggggcggcggccatgggattaactgggcgactctgatgtggtgcgaagcgagggacgagatggcacacctggttcagagggacaggagtgaccatgactgctactatggcgcatacctgcaaaggatcatttggtggcagaggccggacctcttccagttgccgccggagcccggtgcatcacacgcccaacaggcgcttggcagcgaccaatcagcttccgatgagatccaaactctccgctcggaactgctgctcaagatacatcaggttgaggtgagatccaggcagatcgatttggcattagagaagatcgacgccgcctccaaagccatcgatgcgacatccaagaaatttgatgagatatccaagcagctggatgggagattaaagcagttggatgcgaggtcggagcagctcggtgtgatacctgaaccaaacattgagcacgaaggggacgctcacgcgctcaagcaggcgctggctgccaaggagaaaaaaagaaatgatgacttgcaagatgcctggaatgctcggaaagtgctgatgttggc

SEQ ID NO: 6723 - DNA, 1076 bp, Triticum aestivum
  Clone ID: PAT_TA_6723
gggaaaacagtagttgaggaagaaacgagccatggcgcagcagctgctgcttctcctacccgcgccttcggggacgttctcgaagccactcccttcccctgccccctccatgccccggcgccatgtcccctccatctccatcacacgccgattggtggcgggagtcgccgccgcccgccgcgacctgctccgctgcggaatgcggcgctcagatttggtgtccgaattggagctcgccaaggacaagaagcagcagggtggtagtgccaatgccatattctggatcttgctgcttaattttggactctatgttgcagaccacttgttacagatccggcagataaaggcactctacctgtaccatgcattcccgtcttggtatcagtttgtgacatcaacgttttgccatgctaactggaaccacctttcaagcaatctgttctttgtgtacatttttggaaagcttgtagaagaggaggaaggtaacttcgcactgtggatgtcttatattttgactggtgctggagcaaacttgatttcatggttagttcttccaacgtcatctgtgtcgcttggagcatctggggctgtttttggcctggtcgcggccggggtactggtaaagatgtcctgggactggagaaagattcttgaggtccttatccttggtcaatttgttgttgacaaggtcatggaagctgcacgtgcaactaccataacaggcgccgcacttcaagtaaacaacattgcccatgtctcgggtgctttgattggtgctgcgctagtatttgtgatcaacagaatccccttatcatctattgatgataacccaaaggcttcaaaggataacaaggacaaaagaagttaatttaacctagagccgccatgctaacacactatatcgttcattacaatttttcttcttcaaatggactactcattgtgtccacattcatacgtagttctgatttctgttggaaaaaaaaaggataaaagacaacatcccatagaggttctactggaaatcatcacacttgtagtgtaaggttcatttctgtacctgcccgggcggccgc

SEQ ID NO: 6724 - DNA, 459 bp, Triticum aestivum
  unsure (1)..(459): unsure at all n locations
  Clone ID: PAT_TA_6724
gcaaccgccctgctacaggcagtttgccagcgacagatatgagagtggttagttggcttggcatgccggtgtatgatgtggatttcagttggggaaagccattggctatgttngcgtgctgaatcaaaccgcggaggctatgtgcacctgattgacagcgggcatggggatggcagcatacgcctagtcatgtgtatagaggcttcaattctcaaggagttcaagcgtttgttgtatgccaagtttgagagcatggtgtattccaagttctagccagctagtgtcgtatgcacctcatttttttttctttgagcacctcctatcctatgtctgttgaatattttagtttcagttaatccggatctaataatttgtatgtctcggagtgtattggagacgtgcatggacaattgtatgcttgcatctatatctatacctactaataaagcaaaaaaaaaa

SEQ ID NO: 6725 - DNA, 714 bp, Triticum aestivum
  unsure (1)..(714): unsure at all n locations
  Clone ID: PAT_TA_6725
ccacgcgtccggtccccgtcaggtccaccccggccgtcctcgccgcagccgaaccctagccgccggcgcgccgtgcccttggggctcgccgccgccgccacccatggcgacgaagcagccgccgccgtcctcttccacatcgggggccgcggtgtccatgaaggactacctcaagcggtaccagtcgggccccgccgccgccggcgaccagaagaaggccaagaagaagaagaagaaccccaagccctcggccggaggggtgctaatcgtcgacgaggaccccgtgtggcagaagccggtgctgcgccccgagggcgggccgtccgcaggggacgagtaagcctcaggtggacgaggacatcgaggtgaagcggatgcggcgcatggaggcgatccgcgccgcccgcccctacaactccatcgctaacgacggcagcgggtgggtcactctgcccgttccggagcctgcgggcagtggctcgccccgccgccgccggaacgacactccgtcgcctgagaggggcggcggtgccgccgggaggaaggaggacctctctcccccgcggcgaaggcagcggcgtgacacgccatcttctaagcgtggaggtgctgaggggagtgatattttcgcctncgaggcanaggcaaaggcggngtgacacaccctcaccggatggcaagggtacaggagagggaggcgatnttgtcaccgcc

SEQ ID NO: 6726 - DNA, 653 bp, Triticum aestivum
  Clone ID: PAT_TA_6726
ccacgcgtccgaagctgtgaagcccacccaagggcacaccacagcaggactactagtactagtacaccgagccaaagaagagaatgttcttggatccccttccctgcctgccacaacattcctactcccccaccctccttccagtccccataaacaaacaaaccaacaaaccttcctcctccttcccctcctcctccggcggcaccactggtcatcgacctctcttcctcatcttcttcttccgggtccgggacggtccattccttcgttgagtcgggatcttgggcggaagaatccaggagtaattcggcgggtgggtttagttaggtaccacagttatccaaaggtccgccggcccttcttttccgcgtctccagaggtcgccggaatctctcctcttctcctcaccagtggatgtgcaatctcgtgtcggctctccgcgtaatctggacgctcttcgccttccacgtcgcagcgacgtctcgggggattttgggctaagattgaggttttgcgtgcgtctgcctgtgtggggaaagtgctttccttttctctcttctttccccttggttccgcgaggatttggttctggtgtgtgcggggggccggaatctctctctgcctttgatcccaagcaaccggccgcctcgttc

SEQ ID NO: 6727 - DNA, 525 bp, Triticum aestivum
  unsure (1)..(525): unsure at all n locations
  Clone ID: PAT_TA_6727
ggcaaagggctcttgcaacaatcacggnaggggatggcatctcaagaagctttggcattcgcccggctcaaaagcttctgctccaacatcgtgaagaagctcgctcctcctctgctgaaagaagtacaagctgcaacgcttcggccataatctgagcctttcacccctaggcgcaccactcgcgcgacgaagcgatcggctcctacctgcaccacaaaggccactccggtggaaaacgtgctgcttagggcgcttggtttggtcccagaggatctcactgttgatgacgtggcggtccaggagctcaaggacttactcgactccctccttcgagagcagcacgtgagagtgattgcggccttgttcggcaagacagtcccgatgcatgacacggaggcaagcaaggcgagaagcgttggggccatataggcttcacgcgtgaagggtgggagtgggtggcttactttgtcatggatttaagccccgcactcatatgttggaatgttcgaggccttaaaaaaaaaa

SEQ ID NO: 6728 - DNA, 900 bp, Triticum aestivum
  unsure (1)..(900): unsure at all n locations
  Clone ID: PAT_TA_6728
tcggcacgaggcaaggnacaagctcgcccgggtcaccgtggccggcgccggcgaaggtgtcatgaacaaggacaccatggccgccttcaccgaaagcgcccgcatcttcatccactgcctctccaccacattggttgatgcaaaaactgcaactggaggccttgttgtttggacccaaatgacatctctaggtgactgtacacaaatgcgtctttaacttttacatccaggttttagaattcatcgaagattgcagggtaactaattgcaccttatggagaaggagcaggccgtggaggagtgcatgtagcaggttcccggtgactgcaaatctgaaattgaagatagggcagattgtattggttctgcttgcttgcagaacttgtggtatgctggccatggagtagtcagaccctgccaagaaagaggagcaggagatgaggagcgcaacatttagtgtacaatggtgcatgatatggcagttaggaccgggacacgaggagcgcggcactgggtgtacgaaggattagtaggaagaatgttaatcacagtgggtgaaaaggtatacgaaaatgcgagctcggctgatgtattgcgtactatttggctgagttgttttgtcctaaagatacaatcaagctgaagattcctttttgtatggaaattcaccatgggaatcgaaacaatggtactctgcacaaccgtttactttcttgcatcggttcttcattctgcaagtcacaccttttctatttggtaaaagaagagtgagctcatgcttgaacttccaccatgtatgttaaacacttggatgctgtatcaacccagtaatcatctgatccttcattgttttcccttgcattgcctcctttaactcttctggacctttgaaaagaatga

SEQ ID NO: 6729 - DNA, 497 bp, Triticum aestivum
  Clone ID: PAT_TA_6729
gaggaattcggcacggcgcggatcaatggaattgcacaacctactactagcgcgctatttatttagccaagaccaacctcttcttctgtaggtagcatgcctttcatttatagctcctggatctaaccacttgcctacatgaagacagggctggtctacacacatgttatggtggggtaaatattaggtgctactaacgttttaggtgataccatgatacggtctcttggtgagatccaacggctccagggagctcttgaacattttgcaaaaaaatcattcaagagtcttgaaattgcacgcacgtacaacaactcctcaaatgccgtcggatcttagatcgaatggtacagaagctcgtaccacggtagcatatgaagaccgatatcacctgatagtttccttgttatggagctctgtcgaaagatgagattaatgtgcccatgttgacacacaaacccttaaagtaatatatgtatttctgaagaaaaaaaaaa

SEQ ID NO: 6730 - DNA, 894 bp, Triticum aestivum
  unsure (1)..(894): unsure at all n locations
  Clone ID: PAT_TA_6730
gcacgagggcacttcgcagctagccgcccactctacttccgannnacagcctctccatcgaccgaccttcgttcgccctgcattactctgtgaagacgatgtctggcaggaggtcgcgcggctccgtgtcggaggaggagatcaacgagctcatctccaggctccagaccctgctccccaccgcgcgccgccgcggcagcagcagcaggcaggcgtcgacgacgaaaatgctcaaggagacgtgcagctacatcaagagcctgcacagggaagtggacgacctcagcgaccgcctctccgacctcatgtccaccatggacaacaacagccccgccgccgagatcatccgcagcctcctccgctagctacctagctggctgactgctcatcatcatcatcgatcacctcctgctgattgtcctaagctagttcatcatctacgtacagctcgtgcagtcctagctaattaagcgcatatgatctacacatacagtacatggtatatatgtcgtccgtcgatctatgcaagcatatatatgcagatcgatcgatatctaattaaggaggactgcatgctaaggccggctggtctaatttactttggtagggcatccatcattagctagctagggccgccagctaagttctatagctgcttcattagctcacccttgcatgcggtttcctcacagtttccatcccccctccccctctctcttattttcatttgcttgtgtaaacttggttatttgcagtctggatcgagttgtttcccctagagacaaccggccgaccgctagctacccatccggtggtggtactgctaatatactactactgctactcagtatcaatcacccatgaatgtatgtactatgtctgtcgggcttcggc

SEQ ID NO: 6731 - DNA, 1007 bp, Triticum aestivum
  unsure (1)..(1007): unsure at all n locations
  Clone ID: PAT_TA_6731
ggcctcgaaccttccatcgccattcccgatacgatacgagagcaaacatctgcacgcgacggcgacggccacggctttctccgctcgtaccctcccgatgcggctgccgcggcgaggcgcccgcccgggtctcgcccttctcgcgctcgccctcgccctcgccctcgcggcccgcggcgcggacgcgtccatccacgagtactccggcggcggctttgcgccgcgcgccaactcattcttcttccacggcggcagcgagggcctctacgcttccgaatcctcctcaaactcctccaactccttcatcaggtttgacattgttacatttcgacggtcccaggaagtcaagcagctanacatgaagaaatgcagcaaaagacaggattagtagaggctattattgttgagatccaggacagagacaaaatcgggggttcttacttgcactctgatgcactatgctgcacgcctgagcttgacaaggagaagtcctgtaaagtaggtgaagttattatacggccaaatcctgataatccagactggccaaaaagaattcagacattctttgatggtaaaaacgaagaaactaccatgggaacacagagcgtctctataaacaaaacagggatgtactatctctactttatgttctgtgatcctcaactccggggattgaagattacaggcaggacagtttggcggaatcctcatggttatatccctggaaaaatggccccgatgatgacattttttggtttcatgtcacttgcgtatcttgcacttgggcttctatggtttcttcagtttgtgagatgttggaaggatattttgcagctgcattaccatataacagctgttattgcacttggtatgtgcgaaatggctttctggtactttgagtatgctaacttcaattcaactgggaccagacctatgggcataaccttgtgggcgnnnacatttactgctgtgaagnnnnnngtgtctcgcgttcttcnnnnnntagt

SEQ ID NO: 6732 - DNA, 530 bp, Triticum aestivum
  Clone ID: PAT_TA_6732
acgaggaagcattgttaatacatttctagcgccgttttccgtaattaaaatagtaaaatgaatcctggtttgaaaaccgcaactcgagatgacgaaaatgtaaagaaagttctggtaactggtggagcgggttacttgggttctactatggttcctatgctgctggatgaaggatatgacgtcgtagtgtatgatatattcaaatggggtgtctatccattaacgccagtggttggaaatccaaggctcactgttataaacgctgacattttggacacagacaaactggaaaaggcattgaaagacgtcgatgctgttatacacctagcagcaatagttggctaccctgcttgctcaaaggagccagaagttgctcggcaagttaacgtaaaaggaacgagaaacgttgtaaacgcgttgctgcctcaccaacgtgtcatttatgcgtcaacaggttcatgttatggagcagtggacggtacttgtacggaagaaactccaatcagcccaattacattgtatgggaaact

SEQ ID NO: 6733 - DNA, 672 bp, Triticum aestivum
  Clone ID: PAT_TA_6733
atgacatcgatgatcagcacggacgacgctgctgcgacgagccatgtcgacgctccagttcaagttgcgacgagagatcacggggaggcggcggatgtcgacggcaagggcgccgcgtccgcggaagaacaggagcaggcggcggcgaggcgcgacgtcttcctgctggccgggatcaggaagctcatcaagagcttcaggagcctgtcccacatcttcgagctgtacaaggacgaggaggacgaggacgacgacatccagatcgggttccctacggacgtggagcacgtggcccacatcgggctggacggctccagcagcgtcgccagcctcagggggatggacggcgccagggagctgctctccctctccaccaacatctccctccagcagttcgagttcgccatggcctccatcgccgcgcatgacgaccgcagcgccgccatagcagctagcccgtaattatttacagtgcttaattaataactgggccacaactcgcgccgtggacgtacgactagttcttctgcccctgtacttggcgctgtctagcctacatgctattcccattcctggccaatgctggcagcctctacgccaaaacagggattggcagatggtgtatataatgtcacctatggatatttttgtaatttgagacaccaactgctt

SEQ ID NO: 6734 - DNA, 604 bp, Triticum aestivum
  unsure (1)..(604): unsure at all n locations
  Clone ID: PAT_TA_6734
gcgcgggcaccaaccacatccacattctgattcgcagaggcaagcaacaagcatggccaagatcacgttcgcccttctgcttctgctcctctgtcccctcctcgcccaatcccatgccaccaccactttcaaagagatttcattccagctgcaaaaccagagcttcgtcgagctcgacgagtccctgcagagggccctgccgcttcgtcagccacctcccccgaggtcggctgtcctggacgccgaagcagacgcggtgaaggagggcgtcctgatcttggtgcaggctctggcggaggggctcaacggtcgccgcggcctcctgagcttccacaacaacggcgaggacgaacccatggctgcgtcacaaaccgtggcttgacatcctgcatgcagcgtttatagtttatatattcccctaaagctcctgtaacctgtctggggagcaactaagaagtactcgtatgatgtaatcgcgctgtcctgtgcacgcgccgtcggtctaatgtggttgtaagatgttgtgctatcagttcttaatatacaaaaaaaannnnnaaaannnnnnnnnaannnnaaaannnannnccccccnnaaaaaaaa

SEQ ID NO: 6735 - DNA, 602 bp, Triticum aestivum
  unsure (1)..(602): unsure at all n locations
  Clone ID: PAT_TA_6735
gcttccggatccacaagcccagtcgatctcaatgacattgctgctagctcaagattcacgtgctccggtgcaaccctttggcccggtggaccgaaccttgcccagcatacccttgcttcttggtgttgtcgcgccgtcgccggacatccataaccatgtccatagctcgctggacatccacaaccactcccgtcctctctacagcttgtgcagtgcagccgcgccggctgcacgttggcatgacaatcactgccatacgctgcgtcggctgcaggtcggtcccagtgtcgtcttctcgtccgtgtgaccatagccaatgtcatgtgcatcgctgcagacgggccggaaattagagtcatgctcattgtgctctgtcccagcaccgttgctggcgctgccagaaacacgccgtgcacgctcattgtctaaatacagctggagagaatccagctggcaaccaataaatagacacatgggccggcggcttggttttaagtttcctttacacgcacgttccggtttccttcgtacgtacaatttccttgtacaaaatagtgtgcgtaatattaagaaaaatactcaaaaggggatcanannaaaaa

SEQ ID NO: 6736 - DNA, 1026 bp, Triticum aestivum
  Clone ID: PAT_TA_6736
gtaacactttagagtaaaagaataattatgtatgaagaataatattaccgagtcaggcagaatttgaccttagttctgaccaaattaatctttatttgtttgccaggttgtgtgtcaaacatcacttcatgttgtagtccattttttcctttcaaaagccacattatgaaatttggctttataagaagtttcactttattattagtggagaacgggagataaggaaagggaagggaaaaacagtaattctagcaactagccattgttccgtggcaaaacacaggtgtttgttctattatgtccatcggaaatctttacggaggagttgggactgagtgagtgacatagatttgcttgaggtcacaaattcttttctgctgttacttgcatcttacttgaatttttttcttcaagttcttcctgttttcccatatcctctgctctatagaagctgctacatcaaattaagtaagtgcatccttcttttttgtccaagtttgttctattctattactcagaagtctgtacaagactgagagagtgaagcatatttgcttgagatttgaatacttttttgatgtcgggtttgtacactatacagtttgattaatgaaaactgataaaagtagtggcaaacacttgattgagtaagcggctggatctttccggtgatgcaccgtggtttctggcttgatcatccgcatgacgcgtcccgcccgtggtggagcttgctctgcgaggggtccaatcatctcgtggtggctcttgctgcttcggcacgtgccgttgggccgacgggtacttcgtcgatcttgggtgccccacgccgctttccttgctggctgatgttctgtttctggatatttggagaggctatttgcaccgtagttcaagacagctgatagagtataagctaggcaactcacttatattgttacttgtttaaatggttatctattctgccggcatattcacatgccatattaatttcagaagaacaatttctaaaaaaaaaaaaaaaaaaaa

SEQ ID NO: 6737 - DNA, 579 bp, Triticum aestivum
  Clone ID: PAT_TA_6737
gacattgccttgcttggtggtggccatgtcaatgtttcggttattaggtctaacatcaatgtggaatttccctgcctaagaatgtgactttgatattaggaggtcaagtcaatttttttttcttcattattagttagagttgctaaaacaggtagaatcttggcagaacgatcacaacggaactgataaccaacgtaaggacaatataagcagcaccggcatgcagctggagggacttgttctttgttgttgctgctgctgctgtacggtgaagggtaggcagcaaaaaaggtttgtagagctgtagaaagaggtgagtggaagtcctaaatggtgctcatgtttggatcgccgaagtactgataatttgtgaaatcttgaatatgctgtatgatcttgaatactgagtcgacaattttctctgctgtatgatcttttgtccctttttcttcagatttgatggagctgtaatcagatcgccccagcgtaagttgacaatctaaacgcatgctcggctagttggctgcagactgaatcaacatgtacacagatatactaaaaaaaaaaaaaaaaaactcg

SEQ ID NO: 6738 - DNA, 706 bp, Triticum aestivum
  unsure (1)..(706): unsure at all n locations
  Clone ID: PAT_TA_6738
gggcatgcatgtctttgcccctcgtatgcgtctttgccttcccccccgtgcggtggctgggagccctgggtacatcccctgcttcgccggtaccactcacgccggccccaaggggtcgctgtccatctcatcccggccgggctttcttgtctctaatgctgtcatctacttgctgcttcagcgtcatccttgggccataatcaccagcgtgttatctgtggtggatgggatgctagtatattcgattggtgccgctgctcatcacttccatggatcaacttgactgctcgatgttgaggtcgacgcgtaatcagttgccaactcttgtgccttctcgttgagctgaagaatgtctccttcatgagcataatcgacacccttggctgcatcattactaagctgagacgcgacgaacttgtccagaactctccagtcggtggcagcttggtcgtcgacggcatggtcaataagttgaacatggtggtgctgggcatggtgcacattgatttggtgatcgtctggcgataccaaaagagagtggaaggaagaagggctctctagctcgtgaggaatggtgttgagaacatgatgatggtttggcatttggtattgcagcttcagctccctcttgtaggtgctgttgagcaccggnnntgttgttcttgcagtgccatgctgtggtgnnnnggcattcctctcatnnnnn

SEQ ID NO: 6739 - DNA, 598 bp, Triticum aestivum
  Clone ID: PAT_TA_6739
cccacgcgtccggccaaatatcgtggtcatggttggtgaaagtggtgattccgattacgaagagctgctagggggtctccacaggaccataatcctgaagggcgacttcaacattgctgcaaacagaatccacacagtccggagataccccttgcaggatgtcgttgcactggacagctccaacatcatcgaagtccagggttgcactacagaggacatcaagtctgccctgcgtcagattggtgtgccgacacaataacatctttgcgcgcaccacacgaaaaggaagaagaaaaggagaggaagaacgagccaaaccgagcgccactatttccatacctgatgggaatgtcgattttgtttgtagattgtagagtgtgggtgtggtatattctcgagctgtgaataacttccaccttttgtttgtactattcacaaattttgaagtggacaatatcgataaatgtagtgggaaaacaaatgtgagcagaaaagtcatttgggaactgagatgccccgaaaatacagacaaggcgggagcctaaatggattaactctgtctactcgttttactggccgtcttctgatttatgttctt

SEQ ID NO: 6740 - DNA, 1972 bp, Triticum aestivum
  unsure (1)..(1972): unsure at all n locations
  Clone ID: PAT_TA_6740
atttaaagcggggactccccgtcacgttcccacccaatagggttcttgtttgtacgttgggggccagtctcgccaatgttatgcgtcgtggttgctcagcgcgatcagtccgactgcaaataccagccatggggcacgcactcggccattatcgtgcagggcggcaccgtgggggccgcagacagaatatacccagtccggaggttccccttgcaggatgtcgctgcactggacggctcctgacatctgtgcttacacgaatggacgaatacgatttgtatggtcaagtggcataccccaagcatcacaagcactctgaagttcctgacatttactgtttagccacaagaactaagggggcttttgttaacgtggcttattttgaacaatttggtgttaccttgatagaggacgctatgaatggtttgcctgttattgctacaaaaaatggagctcctgttgaaattcatcaggtgctcaacaatggtctccttgtcgatccacatgatcagaatgccattgcagatgcactgtataaacttctttccgagaagcaactttggtcaaggtgcagagaaaatggactaaaaaatattcaccaattttcctggcctgaacattgcaagaatcacctgtcaaggatattgactcttggcatgagatctcctgctgtcggtagcgaagaggaaaggagtaaggcacctatatcaggaaggaagcatatcattgttatttctgtagactctgttaacaaggagaatctagtgcggatcatcagaaatgcgattgaggccgcacatacagaaaacacaccggcttcaactggtttcgtgctgtcaacttcgctaacaatatcagagatatgttcactgctagtatctgtaggcatgcatcctgctggttttgatgctttcatctgcaacagtgggagtagcatttactatccttcatattctgcgagggcgccaagcaattccaaggttacccatgtaatagatcgaaatcatcaatcacatattgagtatcgttggggaggagaaggtctaagaaagtatcttgtgaaatgggctacttcagtggttgaaagaaagggaagaattgaaaggcaaatgatttttgaagattcagaacactcttctacatattgtcttgcatttaaagtggtcaatccaaatcatctgcctcccctgaaggagttgaggaagttgatgagaatccagtcgctccgttgtaatgcgctgtataaccacagcgctaccagactgtctgtaactcctattcacgcgtcacgttctcaggcaataaggtacttgtttgtacggtgggggatagagttgccaaatgtcgtgttcacggggggtgattggggtgtgtgcctctacggagagctgctaggggctcgccacaggcccataatcctgaagggcgacttcaacattcccgcaaacagaatccacacagtccggagataccccttgcaggatgtcgttgcactggacagctccaacatcatcgaagtccagggttgcactacagaggacatcaagtctgccctgcgtcagattggtgtgccgacacaataacatctttgcgcggaccgcacagagaggaagaagaacgagccaaaccgagcaccactattttccatacctgatgggaatcccgattttgtttgtagattgtagagtgtgggtgtggtatattctcgagctgtgaataacttccaccttttgtttgtactattcacaaattttgaagtggacaatatcgataaatgtagtgtgaaaacaaacctgcccnccaggggcgcccgcgtactgcgttgccccaaaaatacagacaaggcggagcntaaatggatgaactgtcttctcgttttantgnccgtcttntganttatgttnttgaaaagaaccttcaagtgttctatacaaaatttgtantattcaaaaaaaaaaaaaaaaaaantnga

SEQ ID NO: 6741 - DNA, 1268 bp, Triticum aestivum
  unsure (1)..(1268): unsure at all n locations
  Clone ID: PAT_TA_6741
aagagatagaggagcagccccggcgcatctggatccgcgccgtaaagctgacttctttctccgccgcacgcatcctcctcccggcgaccaccccgggggcgctatatcacgcggccgccgcgaggaggagcgccccgtcccttcttcttcttcttcgtcgcagcagcttcagcagcaggaggaagatggcggcggcggcggcggcgaggaagaccgccggtgtgctcgcgctcttcgacgtcgacggcaccctcaccgcgccccgcaaggaggtgacgccggagatgctcgagttcatgaagcgcctgcgcgagaatgtgaccgtcggcgtggtggggggatccgatctggtcaagatctccgagcagctcggcaaatcagtcatcaccgactacgactacgtcttctccgagaacggcctggtcgcgcacaaggacggcaagctcatcgggacgcaaagcttgaaaacgtatcttggagatgaccagcttaaggaattcattaacttcactcttcattacattgcggacttggatatcccaattaaaaggggtacattcatagagttcaggagtggaatgatcaatgtgtcgcccatagggaggaactgtagtcaggaagaacgtgatgattttgagaagtatgataaggtacataacgttcggcctaaaatggtgtcagtgcttcgcgaaaagtttgcacacctgaacctgactttttccattggagggcagatcagttttgatgtattcccacaaggctgggacaaaacctactgcttgagatatctggaagaattcaaggaaatccatttctttggggacaaaacctacaagggtggcaatgatcatgagatatttgaatctgacagaacagttggtcatacagttaccagccccaatgacacggtgcagcagtgcaaatccatcttcctctcggagtgatcgccagactaccgtgccatttacactcatttgttcaccccgcacccctcgaacgctccccgtttcggaataattcccctatagatctccctttgaactcagtacgttttttgcgttcctccccgttgggagtagtttatcgctattgttattgtaaacagaactgtattggtatacatacgttcaccatacattcacaaacagcggattttgtatacgcgcatttggcgcaaatgtatgaaggcatgtttgatccaagataaaagggccgacatcccaangatnatacccccangcgtctttaantcgacggaaactgntaca

SEQ ID NO: 6742 - DNA, 745 bp, Triticum aestivum
  Clone ID: PAT_TA_6742
ggcccaaggagcctcccaaaatccggttttcagctgcggcggccgctgcttcccgccggcgacgaactaatggtggatgctggtctttgtttttgctggatgccatgacaggttcccactccgggaggagttcgccgacagcctagaacacccagatccggtccctctcgctgtgctgcggacgggagaagccagcgctattgtgctggaggagtcaaacgcgggatctagataagggcaacaagttgggtgtcgccggccggaggagtcgcagggtggcatgcgccggtggcgtgaggcatgctcggtcttcccagtcgtccgacaggttcaaccccaaggcgcccgattggacaaaaaggttgcgtctcggcagtgcaccacccgacaggatgccgtgcccctctaggatgagtgcacaagagaagtcgattcgcaaatactcggaggagccaacacaaagtgttattacaccagaactaggaattagtttcgactcacttggcgatggatatgatttctacaccttgtattcgtgcgagatcggcttgggagttaggtatggaaagaacaggctgaatgccgagaggaccaaatcagcgcgggagatcgtttgcggatgttgattgtgtactaagaaaatggacttcaaatttgttacctgcagatcagctgatttgcaagtttcatgctatactgagaagcaactatatgtaacatgcatgtatatgctgtttgttagata

SEQ ID NO: 6743 - DNA, 1002 bp, Triticum aestivum
  Clone ID: PAT_TA_6743
agagagcaccagcctcagcctggctggcgggctgtctcctctgccgctgccgccttcccctccgcctctaaatcctccgccccgccccgcctgaccttcgactcgaccggcgccgaatccgggacggcgcggggggatgggggtgtcgccggtgtcgccggggggcagcgccggctacgagtgctccttcaagatcctcctcatcggggactcgggcgtcggcaagagcagcctcctcgtcagcttcgtcgccgcagccaacctcgacgacgacatcgcgcccaccatcggagttgatttcaaaatcaagtttcttactgttggtggaaagaaactgaagctgactatatgggatactgctggccaggagaggtttaggacaatcactagttcttactatagaggtgctcaaggaattattctagtatatgatgtcgcgaagagagagagcttcacaaatttgggtgatgtatggactaaggagatagactcaaactcatcaaacaaagactgcataaaaatgcttgttggaaacaaagttgataaggatgatgagagaacagtcacaagagaagaaggtcttgcctttgcacaagaatctggatgtctgtttcttgagagcagtgcaaaaacacgagaaaacgtcgagaattgttttgaagaacttgtgctaaagatccttgaggttccaagtctcctggaggaaggctcgtcatcggttgtcaagaggaacattctgaaaaagcaacaggaaagtcatgcaaagtatggtggtagatgctgtcaatagattcgtgagtatgattgagctcgctatctgtggtcatcgcatcgcaggcaagttcgtgatacccaaactgtagatgttgtcgcgttctcgttgtacatgagttgtgtctaaacaatctgtgagtagaaaaggtggggaaattggggaaagtaagtacagtagtttgtaaggttttggcagagtggttaaaattggtttgtacaaagggaacg

SEQ ID NO: 6744 - DNA, 621 bp, Triticum aestivum
  unsure (1)..(621): unsure at all n locations
  Clone ID: PAT_TA_6744
actgtggtgtgccgccgccgccgctcactcgctcgccgccggtctgactcgactcacccgggnaagaacacaccaagcaagcgcgcacggccggctgctctctttctcctgcctgccagtgccagagtaagagcgccgcgccgcctttgctgaatgttcctcggagtttgacaagcctgcctgccgccatagcaactgagtataataatgagctggtgttgcctcccaagagccaagaaacagcaacaggagaagaatctctacttccataggcaacaggagaatctcaactctcaaaccagcataagcggcatttctgctgagaagaacataaggctcttctcctatgctcagttgaaattagcaaccaacaacttcgaccgcaacaacaaagtcggccgaggtggtttcgggacagtatataagggaaccctaccaaacaagcaagatgtcgcggtcaaagttctctctgccgaatccaggcagggcatcagagaattcttgacagaaatcgacgttatcagcaacgtgaagcaccctaaccttgttgaattgatcggctgttgcgtcgaagaagaaaatcgcattttggtgtatgagtacctggagaacagcagcctc

SEQ ID NO: 6745 - DNA, 965 bp, Triticum aestivum
  unsure (1)..(965): unsure at all n locations
  Clone ID: PAT_TA_6745
gcggggaggggcctcccggggaaatcgaggcgcccgtcccgccgccgagccgccccccgccccccccccccccgttcccccctcggccgccccccccggcgccgcccagcgccggcggccgccgtgggccgccgtgcgccgccgccccgtccggccctcccccgggctccgccgcggcgcccccccccagcccccccaagcgctcctcttccctctccactcactccggggaggttgcattgccaggcgggaaagctgacgaaggcgatgcagatgatgcagctacagcattgcgggaagcaaaggaggagattgggatggatccatgtctggtcactgttgttacctctctcgagcacttcttgtcaaagcatcttctggtagttgttcctattgttggcatactctcagatatagagggatttaaacctgttctcaacatcgacgaggtcgatgacattttcgatgtacccctggagatgtttctcaaggatgagaacaggagatccgaggagagagaacggatggggcaagtcttcacaattcagtacttcgactacgagaaagaaaaccggaagtacgttatctggggattgactgcccgcatcctgatccatgctgcttccattgtataccagcggccaccggactttgtagagcgaagattacagttcaaccttccaaagtactccatttctagttcaggatctgctacaagctaatgtttacaatattgtctcagtcaatatgatgttgggcgtacatcagagtacgccattcgtggaatgtaaaggacacgatatgcttctatatgatctatattctttttatagttcattcagtacatgatagtaatacagagagtaatatttaactgatgcaattcgattgttaaatctctactattaaaggtaagtttatgggttccgctttcaaaaaaaaaaaaaaaaaaaaaaaanaaaaac

SEQ ID NO: 6746 - DNA, 569 bp, Triticum aestivum
  Clone ID: PAT_TA_6746
ggccttagatctccagggagccaaaattcttagcgctagtaaaggtttacgtttctcacaacttatcaaattgaatcacatgacatccttgtgcctgctactcccaaagaaatcccatttggcattgcccctgctcttcttttggatatgctccacaaaaagagcttcctatgacttttcttaagttgctaaggtaggcagggacatgattagagatatgctggaataggaacgtgatttaaaactgtttgacgccaggtgcttttgcaaatctaatgttgttctagagcgcacacaccgtgacctccatgtgtttattacttcagggcatctagagtagtgctaagcagagttgtacttgtggtttgtgtttttggtgatttgggttttgctttctacttcaacaaattgactaggtggaatcattttgtttttgaagcatggtatccacggatttaacggtcagctggacacatagggttggtggactgctactctgctagcatgacagaggagacacactcttggtttccatgtaatttactctgcttattatgacaaaaaaaaaa

SEQ ID NO: 6747 - DNA, 3661 bp, Triticum aestivum
  Clone ID: PAT_TA_6747
gctcgagtggggtgagtacgttgattacaagcgggctaacgggtgccccggatgacgatttgcccggcgtcatgacatgtgccaattatctcatactacccccagattccacaaaagaagtcgtgcgcaagaagctgctctacgccgtcctagaaggccgtggatcttttgttcgatcctgagctaaccacgtccgtgacatcgctcccctcccgatgccctccactcatgtcctggattagtttatttctgcttggcaagtaataacggaggctgaatcactggtggataacataaaatttgatcatgggtttactgctaaaagtcctgccattataaatctactcgagatcatggcggaatttacccctgatcagcagcatgcattctgccagtttgtaactggtgcttctcggcttccaactggtggtttggctgcccttagtcccaagcttaccatagttcgaaagcacccctcgagtggggtgagtactttgaatacaagcggggtgacagacgctgcggatgacgatttgcccagtgtcatgacatgtgccaattatctcgtgctacccccgtattccacaaaagaagtcatgcgcaagaagctgctctacgccatcctagaaggccgtggatcttttgatctatcctgagctgataactaacggctcagcgctcacctgtcggtgcccctcgcattccatccccaactggtgctcgtcgtcgttgccggtaataacataggttgaggttaccagccgctctgcggaaagcttgaaagttgaacttgctgaagcggcgagcctcgcgagcaccaccgacaagctgcgggggcacccctccgtcctgctcccgcattgcatcaggagtctgcatcttgctcatctggttctgttcctcacttggtttcacttcttgatagcatcttacaaggggaacttccatgtgatgtggtagaaaacaaactcaacctacagcattttagcgttgttacgtgtattagaggggctgaatcagctatcccctcgtttaagagcacaggcagcatctgttgatttcgccgaggggaaaatcgctacgctggatgagctatatgaaactggaaccaaggtgccttcagaagagttcgtcaacagtaagttgacaccgaagcttacccggcaaatgcaggatgttcttgcactctgcagtggcagtttaccttcttggtgtaatcagatcactaaagcctgcccctttctgttccccttcgaaacaaggaggcagtacttccactccacagctttcgggttgtcccgagcgctgaaccgacttcagcagcagcagggcgataaccccaacaacaccggcagcgaaagagaggtccggtttggcaggctacagcgccagaaggtccgtgtttcccgtaaccgtattctggattctgccgctaaagttatggagatgttctctagtcagagagctgttcttgaggtggaatactttggtgaggttgggacagggctgggtcctacgttggagttctatactctcctgggccatgaactgcagagtgctcggttgggattatggagatctagttcgccttacgattattcagaaatggaaatcgataagaatggtgtgatccatgtggattctgacgatgatttgccagctcctcaagaactcaactcatccgaagatgcccggaatctgatacaagctcctcttggattatttcctcgcccttggccttctaatgctgatacctcggagggtagcagattcttcaaagtcgtagaatatttccgcttggtcggtcgagttgtggcgaaagtcttgcaggatggaaggcttttagatttgcctttatcaacagcattttataagctcatactcggacaagagcttgatttattcgacattatctcgtttgatgctgagcttggaaagacgctgcaagaactgcaagttcttgttgagcgtaagaggttccttgagtccacctgtggcaaggatcagctagaagttgcagacttgcgtttccggggagctcctatcgaggacttgtgtttagattttactcttccaggttttcctgattatattctcaaagaaggcgagcaaaacacaattgttaatatccacaacctagaggagtatgtttctttggtagtcgatgcgacagtgaagtcagggattatgaagcaggttgaagctttcagatcaggttttagccaggtctttgatatctcatccctccaaatattttcacctcaagagcttgactatctaatatgtggtcgtcaagaaatatgggaggctgaatcactggtagataacataaaatttgatcatgggtttactgctaaaagtcctgccattataaatctactcgagatcatgtcggaatttacccctgatcagcagcatgcattctgccagtttgtaaccggtgcttctcggcttccaactggtggtttggctgctcttagtcccaagcttaccatagttcgaaagcacccctcgagtggggtgagtactttgaatacaagcggggtaacggatgccgcggatgacgatttgcccagcgtcatgacatgtgccaattatctcaaactacccccatattccacaaaagaagtcatgcgcaagaagctgctctatgccatcctagaaggccgtggatcttttgatctatcctgagctgataactaacgatacagggctcaccattcgatgcccgtcaattttatcccgaattagttttcttcttcgttgcctgtaataacataggttgaggttaccagccgctctgcagaaagcttgaaagttgaacttgctgaagtggcgagcctcacgagcaccaccgacaagtatcaggagcacctttccctccagtacatgtaaataaaaaggagtatacatatttgtcgtaaggatttgttcgttcgttggcgataccctgtcctatgtatcgatttgagaatgttgctgtgtttgctttgacattgtgtacatgtgtaactcgataataaattcacgcgctctagtgtatttgagattattcttaaaaaaaaaaaaaaaaaaaaaaaaaaaaaaaaaaaaaaaaaaaaaaaaaaaaaaaggcaaattgtaaaaaaaaaaaaaaaggcccctacacaaggaatgctacccgcagaaaatctgccttggagaaagatttggacatgaagcaaacacatggtgacagtagttctgaggatgaggagctggacacatctcatattgagcttgatgatgctttaatgattgatgatgatgacatttcagaggatgaagatgatgatcatgaggttctgcaagagggctctcttcctatttgtgttcaagatggggtgcatgatgtgaagttgggtgacgctgatgactcaaatgttggttcagcaagtgatagccaggcgcagccatcatctggttctggttccagtgctagaaacattatgggcaggggagtaaatgctgctggatttcgaactgcaggtgcctttggatcgcaaggggcaatgtcatttgttgctgcgacaatggctgggctgacttctggtggtggtcgcggtgttagaggtggtccgtgatcggcgtggcctgtcacttataggcagcatgagtgagcacaacaaactgaattgagggg

SEQ ID NO: 6748 - DNA, 834 bp, Triticum aestivum
  unsure (1)..(834): unsure at all n locations
  Clone ID: PAT_TA_6748
tcggcacgaggtgaaagtggaacgtgcagcagtcgagnanagcaactgcagaagctcgagagagggcaattgaaaaggcaaaggctgctgcagatgctaaggagcgaatagaaaaggccagagtcccattcaaagatagttttaaggttactaatcaggacaatcaatttcagaagacagcttctaacgatcatggaagaagcacagattcttgtaatcaagcatctgagtttgaatcagctctaagacacaaagcaagatcggagaggcaccaacggacagctgaacgagcggaaaaagctctagccgaaaagaatatgcgggacatgctggctcagagggagcaaacagaaaaacacagattggctgaattccttgatcctgaaatcaagagatggtcaaatggaaaggaaggaaatctgcgagcattgctctctacgttgcaatatatacttggttcagacagtggctggcagtcagttcccctcacagatcttattacggctgctgccgtgaagaaagcatacaggaaggcaaccctttgtgtccatcctgataaattacaacaaaggggtgctacaatcagacaaaagtacatctgtgagaaggtgtttgatcttcttaaggaagcttggaacaagttcaattctgcagagcgctaaggggggagataggcagtggtgttcattcttttcttttcctgggagaacaggaaattaggttaatatctatatagccatatcatcaatcgtttatatagatgtaaatatgtggttctggggaacaatttttnaccatcattctaccagattaataattaaataatagagcatc

SEQ ID NO: 6749 - DNA, 743 bp, Triticum aestivum
  unsure (1)..(743): unsure at all n locations
  Clone ID: PAT_TA_6749
ggcaagatccaacgtgcgaaagcacataactgactggagagtatggaacagcagcaaagtagtcttccagtatctgaagacattgtcttcaaatgtggcgacattccagctaaagagaggcctgcagtggagccatttgacccatctaaagttgacccatgcaaaggacaaccatctggtggtggtgacaaagaaccaaagtcatctgggcaatctgatggtaatgatcaagaagcaaagacatctggaccatctgatggttatggttgtgatgacatcccggggaataatcatgatggtgaaaaagacaacgagaatgatcatgatagcaaccccgtaccaagttaaacttgttctcattggcccgagccgtgctatgtcagcttatgcggatggctggctcatcgaagttgatgtgccgccagaatcctctttgctgcctgaaaaccacgcaacaaagaaaatagctggtggagtattcaaaatgtcattagatctggatgatgacttcctcgacaaacctaggactagtatcatcttcgccagagggggatttgtgcatttcacctatgtggttttcaataatgcagtcaaagcttcagttacatttatgctccatgctcgttgccaagataatctccaatttgtttgtcactgtaaagtgcagggtgagctgacattacatgttggaaaccttcccatcggatgcactgttttcataaatcaagttagganaagccgtg

SEQ ID NO: 6750 - DNA, 983 bp, Triticum aestivum
  unsure (1)..(983): unsure at all n locations
  Clone ID: PAT_TA_6750
tcggcacgagggaacagcagnatgatacctaatngaagctacctgggtcaagcaaacaagctgggaaacatgccatgtccaatgttcgcaagaatctatttggaaaacgcaaacgctgttgcgaagaatagaaaggaagatgattatctaatattgattccccaagccagcatctttgcccttgtgctgcaggctctgaagttgccccctgcgatttaccgtcgcaaaatatgtctaggcaacatgcattgtgtgacggttactttcaattcatcgttagagttgtttgacggtctgcttgttccaacctcaatatctggtatgatttcaaataactatgaagatgcagaagacagtgtcgctatcgaagccattagatatatggagaatgcatatggcaaagagataacggactataactacaaccacgccaaaaaattgcagaatcaagtcacacacctgctaaggttaccagcaaacaaaacaataaagaagatacgcaggggatggcactatgctgtcaggtacatggattcatattctgctcagatacagaatacagcagctgctcgccgtttcagagggcaggacaacaccagaggggttatgaaaaaagcacttgcaagcataggaaaattggcaaagaggctgcgctacattggcatgaagtcggagcagcgcctggagaccacaaatagtatttggtgagttccagtcagcacgtcgcacaatgcatgtccacgtagttactaaagcatcgaccttttgttttgtgtcgccgaaggcagcgtttttacccttttgatgttcttctaaacgggaaatgaaccaaggcgtgcgtggacttcagatcttaattcctgtttctctgtcgtaagaactaatgtatggtcgtgtgtttcctatcagactatgactgtagttccctttgcaaacctttgggtcgtcacctgtaagccaccttgcgttctaatgtactttat

SEQ ID NO: 6751 - DNA, 486 bp, Triticum aestivum
  Clone ID: PAT_TA_6751
ggccgcatcggcgactcgcccctcatcggcgccggcacctacgcgggcgggcactgcgctgtgtcgtgcaccggcgagggcgaggccatcatccgctccacgctggcgcgggacgtggcggccgtcatggagtacaagggcctcccgctgcaggaggccgtggacttctgcgtcaaggagcggctggacgaggggttcgcggggctcatcgccgtgtccggcaccggcgaggtggcgtacgggttcaactgcaccggcatgttcaggggctgcgccaccgaggacggcttcatggaggtcggcatctgggattgaagtgcgcgagctcagccggagatgtgtccgcatgtagtgtgtgtacatacgtttggtcatcctgcgattgccatctggttttactctaagaatcctcggttactagcactggttacttcaaagccatgagctaccggataataaacatgggactgcctatgcaaaaaaaaa

SEQ ID NO: 6752 - DNA, 355 bp, Triticum aestivum
  Clone ID: PAT_TA_6752
ccgaggtgattaattagcgtgcgtgcatgtggtaattaagcggggcggtgtgggggcgggggctttgggaaaggcaaaggcgaaggacggaaacaaatgccagcctgtgctctggtctggtctggtctagtgtagcgtagcgtccttctggtctggtctggtcgtcttcctcgtcgtctacctctgtctctgtgtaactgtgtcactgtgcccatggctcgagctcgccgtcgacatggatgtgtgtgcgtgctgctactgctaccactgccaggtgaacgaatttgttcatgggttgtactacctttcttcaacaaaaagaaaagcttgttgattattgccaaaaaaaaaaaaa

SEQ ID NO: 6753 - DNA, 336 bp, Triticum aestivum
  unsure (1)..(336): unsure at all n locations
  Clone ID: PAT_TA_6753
ggaaactttgctcaaggnagggacttgctatgatagacgacgggcacagggacggcaagcgtagatactggttcccgtgcgtcaccctcagttccgatgcctccggttccgaagcaaagtcataatttacctgtgctgttgtactgttacgcttgtgttcatgatagctggaaccacctgtaccactggagcagttacattttttgtctcactagtacgtcctgtgtaagaaggaaaaacattaccgtagtactccctccgtaaagaaatatatttctttacagaggaagtacctgacaaagtaaattgtgtgcgattattacttcaaaaaaaaaa

SEQ ID NO: 6754 - DNA, 918 bp, Triticum aestivum
  Clone ID: PAT_TA_6754
ttccggtcccacgccgcaacccatacaccggatccacgcagcccagccgccgggcggcgaaagatctgagccgcgacgggctccaacgccggcgagcgctcgctcatctggcctataaaattcacccgcctcccccccccggcttcgcgtccctccggcggcccggtgacgtggcgcccctccacgcctccgccaccaccacctcactaagcccccccgagaccaccgtactccgaccgacgaacccccttttagcagcttccaaaccctagaaggggagcaggcggagcagcgcggaggggagcattcgaggagcgccgcgatggccaaggcgcggaagcagaagccggaagggggcgccggcggaggccccaccgtgctccaccagaagctgtgcctctccatcgacatggagaaccagctgatttacgggtacaccgagatgaaagttctactagctgagaacgatagtttcgctctacatgctgacagtatgacgattaggaacatattggtggatggtgaggctgctgagtttgagtactctcctcattggagaagtgttgatgatcagtcgagttggttgtcagtatcatgtttgaagactgctgctgatgctgcatgctcagcttacgtctcttctctaaccagtgaagctgtacctaatctcatcatttcatctgagagatcggtcaagtcaaccactgagctaccgggtaatgaaaattgtgaaaagcatgaaggaattggtggaaaacatgttcaattttctgatgacaaagcagttaaaatctgcaatggttctacggaggaaaatggtaaggaagaggaaaaggagaacaaaacagaagatggaaaagacaatgacaaggaagagaaaactgagatggaggtggagacagagaaggagaaggaaac

SEQ ID NO: 6755 - DNA, 911 bp, Triticum aestivum
  Clone ID: PAT_TA_6755
cagcgtgcttctctgcatagcaggaacaattatagttagccttgctgattcaggcagtacactgaatgctgttgccacaaatcctcttcttggagacttcctttctattgtttcagctggcttatatgccgtggtatatcaccttgatacggaaaaagttgcctgatgagaaagaaggtcaaggccaagtgagtatggctcagtttcttggattcctcggactgtccgctcgggggtttttccttcccgttgccttggtgctaaattttgccaagctggagccattccacacactgacatgggagcaagttggcctgattgttgggaaaggtttgttagataatgttctaagtgactacttatgggcaaaagcaatccttctcacaacaaccaccgttgctacagccggtctcacgatccaagttcctattgctgcccttgtggacacgctcactggtcatgctccccaactgctgaactacatcggagctgctgctgtattagtcggttttgctggcatcaacatcccatccaatgtgctacagccttctcaccaccagcaggaccagcaggaagcacccattgttagcattgttgatgactcgcatcattcgcccagtgataggaattctaccgatgctgtttcatagtagccgcctggcttgtttcaggttcttatccaagtgtaattaccaagcagtgtatgcctgggctcgccagactggttcagtcaggtttcccctgttctgcgacaccgcaatggaagggatggatattggcatccgcgtaacaaagtgtacagtctcatgcatgggaagggagaatcgtttgtataatttctgtcagtttgttgtgtagctaaattttgttgtacatgggaaacggtgtttttgggcaactgtactaagtac

SEQ ID NO: 6756 - DNA, 455 bp, Triticum aestivum
  Clone ID: PAT_TA_6756
gctgaaacctcgagccccgcgtccctccttccccgctctccccccccgcgcttccccgtgcagccaccgcctccccatccccgctctctccgccccgcccagagtctttcgcgccgcccttgaggagcggatcgacgacggccaccgcctccccatccccgctctctccgccccgcccagagtccttcgcgccgcccttgaggagcggatcgacgacggcgaggatgagagatcgaggagggaggggtgacgccggccagccgcacgcctcaccaccggctcgtgtggaagcgctggacagcggcaagaaggaaccatctctctgcttctttctctcttccccgcaagcggcacttctggatcgggcccgggattcatgatgtgtgcagatcgaatgaagaagacaagaggaagactgaagaacaagcaaatttgggcagagtaggggaaagcga

SEQ ID NO: 6757 - DNA, 2308 bp, Triticum aestivum
  Clone ID: PAT_TA_6757
gaggggtaccgtcctccaccccgtccttacccgtcgccgagtccccaatccgccgccgcccccgtcggtcgtcgctgacctcgaccccgcccctctcgcttcgtacgccggctacttcctcgacccggcccctccgttcctacgccggctactccctcgaccccgtcaaccgtcgccgttccgtgactaaaccatgaagccttctggtaagcgtaccagccaacacagggatcatgacagagaagacagggatcaaaagcggaggccggctcacacccaggaaacctccggtacggacgaattggttgtttagcggatactttgtccagacaaagtgattggcagtgtaattggcaagggtggcaaggtgataaattccatccggaaacagacgaatggcaaagtcaagattgtcgaaccataccaaggatggtaagctaaccgttgcttccactgaaccagtgtattcaagcagctttccggatgccagcattattaccgtacagtcaacaaaccactccattgcgctatgatcaaaggagtgaagttgagcgtggctcaaatgtatttcctcgtagcagcttgtatcatggatacagccccaggcaggctgtagatgatgggtttggagtacgctcctcgtacacttcaaagccatatggaagacgcgtcccggatatggaaatgtttattcctgctagtggcctttcaaaagtaatggggaagcatggtacaaacttggacaatattagaaagatttctggagctgacattgaaattattgaatcaaaatcatctcatcatgagcatgttgctcacatatttggcacccctgagcagacgcagtcggcagagaatttgatcaaagctttcataatgtctacttaaggacgtacttccggctgtagtttgaaaggatatatggggacacttcagtcagctctatcggactcttgctgtcctctgggcatccaagtctgtctatcttaggggcaatccctcgtggttctcatgttcctgaatttactgtacccactgatgcccatggttgattgcccatttatcagtctatggtcccagctattcctgcttataacaccccaaaatgttcaggagagctattggtgcgtgttgtatgccctggtgacaagattgggttagttattggtaaaggtgggatgaccataaggaatataaggaaagaaagtggtgcaagcgtagatgttgatgacgcaaagaatgataaggaggaaagcataatcactatttcgtccactgaggccaccgatgatgttaagtctgcagcagtggaagctgttcttctgcttcaagcaaagatcaatgatgaaactgaagatagaatgcatctccgccttcttgttccgggtaatgtcattggctgccttatcggcaagggtggttcaatcattaatgacatgcggagtaagtctaaggcaattatccacatatctaagggcactaagccccggaaggcatcttccagtgatgagctcgtcgaggtgtttggggaagtggacaaactgcgtgatgctcttgttcagatcgttctaaggctccgggaagaagttctgaaggacagcgtggggaggcaaaattctgccaaggatgggaagctaactgttgccaccactgaacccatgtattcaagcagctttccgatgccagcattattaccttacagtcaacaagtcactccattgcgccatgatcaaaggggtgaagctgagcgtggttcgaatgtacttcctcgtagcagcttgtatcatggatacagccccaggcaggctgtagatgatggatttggagtacgctcctcatacacttcaaagccatatggaagacgcgtcccggatatggaaatgtttattccttctagtggcctttcaaaagtaatggggaagcatggtacaaacttggacaacattagaaagatttctggagctgacattgaaattattgaatcaaaatcttctcgtcatgagcatgttgctaacatatttggcacccctgagcagaggcagtcggcagagaatttgatcaaagctttcataatgtctacttaaggaggttcctgctgtagttcgaaaggatatatgtcagctctatcggacttctcttgccatcccgtagatcaaaaactgtgttctccatcccttcagctctccaataaacctcatgcttatctgtctatcttcctcagactctcaaccatggctatacttgtgtggacttgtccgtgtttaatcgcatgttcagatattcccgtctaaaaaaaaaaaaaaaaaaa

SEQ ID NO: 6758 - DNA, 804 bp, Triticum aestivum
  unsure (1)..(804): unsure at all n locations
  Clone ID: PAT_TA_6758
gcaaagctgaagccgnacttggttgcatcggagaagagttttggttgcggcaatgcaaaagtaccggacaacatctcctcacagatggcacacaagaaacttgagcatggaggggctcagaagcacatttctctgcatgctgcccctcaaactatgctgaagcaaccgaacaaaaccagctccacagtgaaggcaccaaagcaacataagtttgaagactttcggaaagcaactgttcagcctgccgcccctcagagtaaactgaagcaaccaaaccgtgctgcgtcggagaggcaaaagacaaggagcaaaaccaagagttgtgctgggaaaaaagaatatgtttgctttagtctgtggcagaacttctatgaaccggaatgctcgagtggatcggacgagccgcttgtaaacaagagaagtgtgcggagaaaaagagagagggaacgtgcgattcagatcacatattcacggtcaaggaagcgaggcaccagtgggatcagctccatcaaggccaaactggatgaggaaatctcatctggacacttggaggtcattgttatcgatgatgaggtgatgactgaagcccctggagaacagtgcaaggcaacaagctccatgcatgaacgttcctgtcgtcccgccgactgatcaggtgacggctgaagcccctaaangtcagtccaagccaccagttccatccaagggacgttcctgctgtccctccccgctgattaaggtgacggctgaagcccctaaaggtatgtccaaagacaacanctccatccaaagggcgttcctgct

SEQ ID NO: 6759 - DNA, 503 bp, Triticum aestivum
  Clone ID: PAT_TA_6759
ggcacgaggcgaggcagtaataatcaatcaaccagccatgaagggaagcggcaccgccgtcgtgctgattctctcgctcgcagtcctcctcgtcctgggcgccgccgtcgccgacgacgccatcattcgcctccactccgatgcggtgacggaggagacgaggccgtgggactgctgcgaccaccccgtgtgcaccaagaggagctggtgcggctgcaaggacgtcgtcgatcagtgcttccccacctgcaagaactgcaagccggcgaagcgagcggacgagtcggccccttccggctacatgtgccgggagacctaccacggcagtcccgggcccaagtgcatgctctgattctgatatccgtttgttgttcaagagatgggctgtgctagctgctgtatgtgatgttgtagcactactacgctagctgctggtgagcctagctgtacggcagcgattgaataagatttggacacttaccttcttaaaaaaaaaaaaaaaa

SEQ ID NO: 6760 - DNA, 348 bp, Triticum aestivum
  unsure (1)..(348): unsure at all n locations
  Clone ID: PAT_TA_6760
cggcacgagggctctgttctccatagggatttgaatcacatttggtgtattatttgttgcttctctgttcaccagggatttgatttgatagcataggcatggaaggaaccaggaattatctatgaatagttggaattacaacatgcactcacttgttgcaaggccgttgggcctcaacatcttactccgctgaatcgcaccatcctcttactcaaatgctttgaaaggtgctcaccctcttcctctgctgctgacagagggtctcatctcgcctcatctatccgctaaacatcagatgtacatgacctnctctgtcctatacagcaaattctcctaccaaaaaaaaaa

SEQ ID NO: 6761 - DNA, 906 bp, Triticum aestivum
  unsure (1)..(906): unsure at all n locations
  Clone ID: PAT_TA_6761
gcacgaggatgtccagtacgtgctcctccacagcgccgcctacggccgctacctcggcgccacggacgcgccggcgccgcgaggccacagcgggcgccgcgtcgagcagcgcgactacgagccctgggaggagatggccatcaggtggcaggccgtcaggatcggctcgggggacgatgtcctgctccgccacgtcgccggccgcctccgcgccaacgggaggcacctcagcgtcgacgccttcaacagcgccggcccgatgatgcactgggtcgtggagcgcatacccgccagggaggacacgcctcgccttgcagctccgactgggctccgcctccccagaagcctcaccttcctgttgccgtggcgggtgatccagtacgagcaggccggcgccgacgagcccaacgccaacttcgcctggccctcactcctattcaggggcaggtccgtgttccacctgaggaagaagctggcccgacggctggatgccgccatggacgcctccaacctcgtcatgtgcgtccgagcgggtacgcacgggcggcctaccccactgctcgtcgatctgccccacagagacgagaccctcgacatcatcgtcgtcatggccgggacgccagcccacgcagagctgcggtacccggatgtcaatgcagaatagagaaagataagagcgggattcctgtccacctcttcagaaatgtcgctgcctcagacacgatgacatgagaattcagagacaaggtttaggaagcggatcttatgtctgctagcttagataaacttgattcattctccagacatggggaaactgtctattttgcctgtaacgattgcgttcttattcttgctactacttcagggttgcctctgtaatttctnctcagatgtcaacttggaacc

SEQ ID NO: 6762 - DNA, 584 bp, Triticum aestivum
  unsure (1)..(584): unsure at all n locations
  Clone ID: PAT_TA_6762
gctccttcttgtttctggttctgctgccatggaggtatgaggaaagggatgagaggggtaagatcaggtggcagacgaactatctttgttaatccttggagcaaaccgattgcaagctatgcttcctctacatgatgataagttgcagtatcttatggtcgaatggcgaccaatcggagttctggtgatggctggctcctttctttcctcccggctgttgtaccaaaagggaggcagttatgttgcttcaacctggcgattcaagactctacctccagcggctcgtcggtggtgctctagccatccctctgccctggtttcgtccccggcggcagcgggattgggccagagctgaagcttgcgacgaggactcgattgcattttagcttcgtcttctgggatcatgtttgcaaagtgtgtggaccgggttgtaacttttatttttctaatgggtccatctgtaaaatgtacttggttgtctgtctaatatgagtctgggttcttcgggaccctacctctgttaaaaaaaaggcgtcttgccgtgtgcacctaacacctgtttttttttgcgaattnaccacgcg

SEQ ID NO: 6763 - DNA, 814 bp, Triticum aestivum
  unsure (1)..(814): unsure at all n locations
  Clone ID: PAT_TA_6763
gcaacctcctccccctctttnaatctcctttgccgcgactgtggccacggacaaatctctggcatcgtcctcggatgcgttgttagggcgcaagcatggtcgggaggattcgttggaggcgggtccggcttcggatcttgagtatgaggcggctctatgcgagaagctggaggcagagcaggcctctcgggagcaggtggagcgcgaccgggcagcgtgggcggcggggccggcatggttgcagcgcgaggagcaggcgcgtgaggaggaggcggctaaggctgcggccatggatccctgggaggtcgcgatgccggatctggggctgcagggcttggccacggtgttgctgatggtcggggtggaggattcggtaacgcctccttcccctccaagtctcgccggacctcgcctctagagccggggtcctcctcgatggtggccagcgatggtatccctctcccccgcctccgctacctccgggatttgctccctctcgcgttgggggtccggcctctggtggtggctctggctctggttcgactactttgacgcgttttgcgtgccatcgtgcgggtcacttccagtcaagatgcaagtttcctcctttcagctttatatgtcgctcagagggccatctcactatgtattgggataaccgtacccaattcccagcctttaaatagttcggtcttggcctaccttcctgttctttcttcactgttgatggggatcacgggatgcctgtcgttactcccgtgtcttccaacgctgtggtnatctttgtcatttccaatcctgtttccagtcaagt

SEQ ID NO: 6764 - DNA, 654 bp, Triticum aestivum
  unsure (1)..(654): unsure at all n locations
  Clone ID: PAT_TA_6764
ggtccaccgccacctccgccaccacgtgaacgtgcacgattaccgtcgtttccaccaccaccaccaccacctccgcccccgcctcctcctccggcgaggcccactttcttcgacccaaagctctggctgccgtggcggcattcagatcacgctcgagacacccctcccgagcccgcattaacaaagccccccgccaccgccgaacggaagccctgggcacctccggcgatcgttcctggcccaaggacggccgagccggagcccgggccaccgccattgccacctccaaaacagagtacagccactctgcctcagcctaagtcacccccgctgtcagatataccaatcggcgtctcatctccatcgccgcctccaccgccaccaccaccacggccgcctagtcatcgtctcccggaagcaaaggcgaggacgaagaagaagcatcgcaaggtgcaagacgaagacggcaaggtcaggttgccattgctggaggagatgacgaagcaagaggagaagaagatggagggcaagaaagcgagggaggcggcgaacggtggaaggcagccggctgagcacagnaatatggaagtgtcaccaaagttgctgccggcgagcgaggatccagggacgacgcccgcgacggagctggtgacg

SEQ ID NO: 6765 - DNA, 558 bp, Triticum aestivum
  Clone ID: PAT_TA_6765
tcggcacgaggcttctcggctgtcggaaagagacaagcttgctatcaccctctacaacgagaagccacgctacagcacagatgttcctcgcctctgttatgccaactgggtcactgaagcgctgctcaaaagagaagaggagaaaggcagcgtgtccgtcttggaactagtcctacgtgtgtggatggattttctattctacactgccaatagatgcagcagggaatcccatgccaagaagctcagcagtggcggtgagttgacaaccatcttgtggctaatggcagactactttcacaaacataccgtcctcaatgcaccagaggaggtttgaatcatgtacacatggacataaccactattgtgtccccaattccccgtcaatgttatccacctagttcctttcaaattcaatattgacaaactacaactaatgagttggtctgctagatgtcatagcacatgcctaatttctcgccatctttgtacaacacttactgaaaaatggtgtttttcgcaaacttttatgaaaacggtgggtttctatgtaaaaaaaaa

SEQ ID NO: 6766 - DNA, 900 bp, Triticum aestivum
  Clone ID: PAT_TA_6766
ccacctacccctcatccccgacccccacttcagatccgggcggccgctctgcctcagatccggctgggctccaacgaggcaccgacagtggatccggccgatgccaccatcggtctccaccggactcctgcgagagcagtaccggactgcttccccatgcctcccagcctcccccaccaaccgcagcaacatgtgcggcgacatacttcacttccgtggccgccgacgatgagggcctccaccggtgtggcaccgaaccggcagatctcaggccttccctctctggccccgacgagctgccctccttcccttgcagtccatgcgtccctgacgcggaccgccccacctccttggccaagcatcgcccgcccgctccctcctctggccagatgcaccggactccacggatcaagtgccgcctgcatccgggcgcccggcggcctcccccaacaatggcggtcgcccctgcgccatcgacagggatccacccccctgctcgcacaccatcgagaaaagcctgatgcagccgtgccgctgctattttctttcgccgatctggttgcttctctcccaccagcgatttgggacttgtcgcctgtgaagtttgatggttcccccatgcagttcgtttttgcctctccgatgcggtggtgtcgagcggccatcccctgccacgccggtgccacctcggcatgtgggaggagcacgagagggaaaaaaatgaagtgatgcggttctattggatgccccataactcaattttgttgttgttgaaaattgcacttcattagctcattgtaacaactacagtttactactgcgatggtgggtttggcttcgcggagcctgcacttttgtcttgatgcaagagcccacaaaatttaataagtataaaagaag

SEQ ID NO: 6767 - DNA, 425 bp, Triticum aestivum
  unsure (1)..(425): unsure at all n locations
  Clone ID: PAT_TA_6767
gcacgggtttgaggcacaaggnaactaccagtggtagctacacactagggatttgaaatgataggtgtaggcatatgaggcaccaggaactaccgatgatcagcgaattacaagaatcgctacacgatatagctcgcgtgcctatccctcctactctaccacattggttattttcctggcggtcgttgttcagtgataaattgatgagctggatcaagttggtgcatcgtttaatgaccgtcagtcacggcgatgagaaagaaaggtatcagtgaaatctaagtatgtagacttgatgaatgttaactatagctttctcagagtagcataaccaaagggcctcttgcagcttaggcaggcggttgtcaaattcaaacaatctgcttttgaggttagttgttcatgtgtgtcacgtaaaaaaaaaa

SEQ ID NO: 6768 - DNA, 499 bp, Triticum aestivum
  Clone ID: PAT_TA_6768
aggaattcggcacgaggcggccgccatgagagccctcctctccctctcaagcttgcccgtcgtctccccacctccctggccgccgcccggggcgccccgcccctcctccagcggcaccttcacgccgactccgcacttcctcctcaagctccgcccccttttgcctcccgcatcctccaatccgaagagagcccggacccgagcactgatttggaacatgctcagcccgcccccgaccctgtcctcgatgagttcctcgcccgcttggtcaccgcgctccgtccgacacttgcggccgccttccccacccacacccgccccgtgctcgacgaaatgcttcgtcttatcgcggaggccgtcctcaaccgcctctccggagccgatccggggccagacaccgtcgagctcagcgacgacctctgggcggcggtgtgggaggtcagcgcctccgtgcgcgaggccatgcgccgggaccaggtccgcgccgacctccgtaact

SEQ ID NO: 6769 - DNA, 348 bp, Triticum aestivum
  Clone ID: PAT_TA_6769
ggggaagttcaccgcagccggtaagtgccgtcgaagggcggtgatctgcaacttcctctccttcctcgccttcgtcacctgtcgttgctttgacgccaccaccactcccgtctccggcgacccatcccgcatctcaggccggcgtccccgcgcccagccggagctcgcctgcctcgaagatgatctgcaggactagagcacaatatgctaaagagattgtaattgccgcacgtccaggaagcccttggctcaagcatcaaagagagaactagttgtttaggtagcggtggaggaatatgtgcatcgatgcatgatttgaagcaagaactttctttattaaaaaaaaaa

SEQ ID NO: 6770 - DNA, 286 bp, Triticum aestivum
  unsure (1)..(286): unsure at all n locations
  Clone ID: PAT_TA_6770
ggnctgcaggnaattcggcacgaggccgccgcctgcacccctacatggnaattctttttcgctgctgcctcctggtttccacagtttccagacgcgggagaaatcttacagagcagcactgtattctgctgcgatcagaggagcagaaaacgggcagtttcaggttccaaccatgcaggcttttactcgcaaagtcgttggtggaagagatacatatcggggaaaataccctttggaccatggtggtaattacacctgataaatgattttatttttaaaaaaaaaa

SEQ ID NO: 6771 - DNA, 449 bp, Triticum aestivum
  unsure (1)..(449): unsure at all n locations
  Clone ID: PAT_TA_6771
ttcggcacgaggctagnattagagcagtggcgacggcgcggatgggctcgcgcgctcctgctatctggcaaggatggagcgacgacgcgtggtgtatagtattaaatgtggtcgtatgtacacagcatcgttacgtatgggcacaaacgagttggcgaaacggtgatgtcaaacataatcggggagaatcggtccaggacagtaatgtgccatcggtacaggtgcgttatgactgttcatgttaaaagttaggtttgtattgataagctaaatgtaggtcccaccacgcctaggtggattgtagttgaccgtttgtgtaactttggatctagattgtgtttcactctcgcgtaaattatgattaacttttttagttggccataattattgtgtttcataaaatctatcgcacatctaaatgcatagccgttggaatttgaaaaaaaaaa

SEQ ID NO: 6772 - DNA, 385 bp, Triticum aestivum
  unsure (1)..(385): unsure at all n locations
  Clone ID: PAT_TA_6772
gctgaaaatgctggcagcgcggggcgtattccgcgactgtggcccatcgtcaccgccaggcgtaggaggccaaggctctgccgaggcaaagtacgccaagcggctgcaccgcgagcgagcaacaatggctaatgagggttgccgcgacgattggcagtgctcccgccactagaaagaggaggacggctcagacggcggtgacgatgacgccgaagaagatggaggtgtcggaggtctcaaaatccatgcgtatgaggtcatcctttggtatctcgcatagtttcagttttttacggtttagttgaaactttggtgattttcgtccttnccggttgtaatacatcaaaatttaacaaatatcaccgggcttccctgaaaaaaaaaa

SEQ ID NO: 6773 - DNA, 642 bp, Triticum aestivum
  unsure (1)..(642): unsure at all n locations
  Clone ID: PAT_TA_6773
cccacgcgtccgccaactctcattccttcattcctttatcttatcctatccccgacctctctccggcatggggaacttcgcgtcctgcacgctggccaggatccccggggcggccaagggcgccagggtcgtgctccccgacggcgggctcaggctggtcaggcccccggcgacggcggccgagctcatgctcgaggcgccgggccatttcctggccgacgcgcgcgcgctgcaggccgggcgccggatcgaggcgctcgcggctgacgacgacctcgagctccggggcgtctacgccgccttccccatgaagcggctcggctccaaggccgcgcccacggacttggcgcgcctggcccggcgttttcgcgagggaagctcatgggcggagaccgcttcggccaaggtggcggccatcgtcgtggcgccgcccgaggtggcttccgttgccgccgaagcggactcgccccggtggcgaaccggttggatgagatggcgttgacaactaagcagctgccgcggagtttgggaactaaacaacggattaccggggtcgctntccaagcggcaacgacttggagaacatacacnaggagagtacccgcatancatctaaagctaaagtcaagtggcaactaacaa

SEQ ID NO: 6774 - DNA, 607 bp, Triticum aestivum
  unsure (1)..(607): unsure at all n locations
  Clone ID: PAT_TA_6774
cagacatcagggacaagatgccacccagggcattcctgccgagagacattgccaggaagataccattcgagctgaatgccgtgtcagaggtcttcagggtgcccctggacacggcgatgggcaaggcagtggcatccacggtagccgagtgcgagcgcgcgcccagccagggcgagaccaagaggtgcgcgacctcagcggaggacattgtggactttgctgtggagatgctaggcagtgacattgttgtgcacagcacggcctccacggcgggcagcggcgcggacatcaggctgggcaatgtcaccggagtccacggtcgcaaggtgacacggcccgtatcatgccaccagagcctgttcccgtacctggtgtactactgccactcagtgcccaaggcgcgggtgtacgaggccgatatcaccgccgccgactctggtcagaacaccggtcgcgcggcgacttnaatntgatggncccaaccaaggacgtnaccccttggnggtaacccgaaaaaaagtttcaatgtttccgggnataatggnatccaattttcanaaaaatgttactcctgaatntttaaatcacttctcttnaactaggcaaa

SEQ ID NO: 6775 - DNA, 317 bp, Triticum aestivum
  unsure (1)..(317): unsure at all n locations
  Clone ID: PAT_TA_6775
ggctgcaggnaattcggcacgagggttgatgagggaggggaggattcagagnagatagtatcaagttgcttcaggctttgcttggcagttccgggaatttctcgaccaggtttgtactgaggcacgctgatgatgtgccagatgttgttaaggcatatgagggtaagatcagatttgaaggattcaaataggccggtcttcttctagattggtataattctagattaggcttatgtttctagtgccaatgttaaagatcaagacatgatccctgattctaacagtgcttcagggacaattttgccctaaaaaaaaaa

SEQ ID NO: 6776 - DNA, 692 bp, Triticum aestivum
  Clone ID: PAT_TA_6776
gcgccggcgtcctctacaccaccatccccgacgccggcggcttccgccaccacttggccggcgcctacgccgagggtcttgatctcgacacttcactcacgttcctgccacatacggagtacaggtacttcgggctggagcacgcctgcaatggtctcctcctctgctcctactacccggacgcgggatctcaagtccgttttgtcgtctgcaatccggccacccggaggtgggcggagctgccccccggcccgcagccgcggccaaacacatgcggctttcactgccagttccacctggcttttgatccagcagtctcatcccattttcacgtttttgatttcgagcgcactgacgacgtcggcctcacaggagtgagcatctactcatcgagaaccgggagcctggacccggagggatactggattgcttgacaatgttgtactggaacatcacagtgtcctgcttcatggtatgctgcatgttgtgggcaaccggcgtcggaccaacagcaacaacacttgggaagacactactgtgctggtggccgtggacatggagggcaaggtgtggaagaccatctccatgccacgcggacagttctattatagggttgggtggtcacagggttgcctgcactatgctactatatctccagttcctctcactgccagcaacgacgacgatgaaga

SEQ ID NO: 6777 - DNA, 1810 bp, Triticum aestivum
  Clone ID: PAT_TA_6777
ccccccgtccgcccgcgctcccccatgccagtttgcccatcgtgccccgatctcctcccttcctctcgctttttcggacccacaaaacagagacctaaacctaatgcgcccgcgccggcacccacgaccttcgtgccgccggccaagcccgcacgctggtcccctcatgccactgcatctcaaaccccgggcgttcctccctcagccagcatcagcagcagcgccgtccgcgacagaggagcatcctccgcccaccacccgccgttgaggagcagctgcgccgtccattctgaggagccgcccgccgttcttcttcctccaccggcgacacgtgtacctccagatctcaacaggtttaaggggcatggcatgttggcaccattcacagctggatggcagagcaatggtgtgcatctgttggttattgagagatctaagggttcttatgtttatgacatcaatgggaacaagtatccagattctctagcaggactgtggtgtacaactttagccgctgaataaaccaaggtaaagaacgacaagcacggaaaaggctagctgttggctgtgggttctgagctgacggacaatgtggaagaaggtgtgatcttggcagtggcccatgaagtacttttttctttacatgttgatcactactgcactgttcaagttcttaatcaagtgactgatcgactatgattgtgggtcacaaccaagggaatgctaaccgtggtggtggctggtgacttgaagagcccttaatcaattcggccctgtagattggagcaccaacatgggatattgcaccatctagctccgtctatctgattcatcttattttcttggtctatcaactagaggaatctacaagtatgtgctgcatgttttctgctaacaggagagcaacacatttgtgaagactttcatttcttgtttactttcagcctgtcataattttttaactgaagacatattattgttagttggatgagagctgatgctatactgccagtagatagactagggtgcaaactgtcttaatctgtgcaaataacagtgcaaaccaacctcgtattctttgaggaacaaactgatattatggttaccatttttaacagaagcaggaatattagtaaagcattatatattgatgttacatgttgtgctgcaccttaggatcgtcagctcggcatggccttacaaaatatgtgcattattcggccaaccattcttccttttgctacctgaactgacaacaagcattgtagtaacgtgttgtttatgagaattccagattcttgaatacgttcctgacctcatgcaatcaatagttggtctgatctcatcctccgacgaccaagagttccgagacgaaagcgtggtgcccctcgcgaaacatagggacatgacagaaagttgcaagtccacaagttgatctaagatgtctcggtcatcgcttttgttcataacatggtagacacattttgttcatatggaagttgatgccggcttggtgattgaaggattggtctctttcataatactccctctgtaccaaaatactcgtagttgggggaacttgaactaatttcccccaactacaagtacttcagcacagaggaagtattttgtagtagccaagtgatcgaacaattggtctcttaggagcttagcctttatattttgcagcaggacacatcttgtatgtcgacttatgtattaccttcatggttgtagaaaactcgagtgaagataacaaattttcaatatatgttgaataaatgtcctagtgaatggtgaatggtgtctt

SEQ ID NO: 6778 - DNA, 929 bp, Triticum aestivum
  unsure (1)..(929): unsure at all n locations
  Clone ID: PAT_TA_6778
gcccagnatctgtaacggaagggggccaccgtgatgggaagaaagggaagccgtggctcgaggcgtcaatgtcgttctgattcatggcacaggaattacacttttccttatgtgcggcagacgggaaataaatttggttagttgtgtatttccagtggtatggctttcgtcgtccacgtgcagtgcaaagcgaagaggagcaaggagctggagaggggagccgccattgccgcctatggagtttcgcaacccatattgtggtacgaatcaaggacctcgttctgtggattgagaatttgcgccgttttgttgactcctacccaatttctttcctccatgctggcctccagattccccttctggaaggggtcgatgagagcccaacccccattcacctggacgtgcacggcgcggtggttctgggagcggtcgccgactcacatccatcgccgttcagcagtggggaccaagccccgtcatcggcactcagcgcggaggctcagatctggaaggaagaaaggggcgaacgcgttagatgcgagggatcgccgcaggcttccgagttgttcactgggaagatgaacccacatgcccctggttgggccaagaggtgcgtccaataatcacatatgttttcagtgcgtgattttaggatgttgtaaccatgtagcatggcgagaaattgtggagatggtgatgtcaactgagaactgaattgtagagtttagtggatttagcatatgtagagcccataatttacggcttcgatttgcatgggcattgagcaggtttacataggctgctaagttgtgaacatgagaactcaacatggagttaggcatggagggggagccgtaaactccaagaattaccgtcatggatgtatcctaaaaaattgaggagataanagcacataatatgcagagaca

SEQ ID NO: 6779 - DNA, 587 bp, Triticum aestivum
  Clone ID: PAT_TA_6779
ggtcaaataaccactgaaccagatgaagtgtcgcttacctgcagttgtacatctaagcaaggtgcatcaggttcacctcttattttgccacggatagacagggtagttggggtgcttgccggagcttcacatgcatcggtatacgctgttcctgtcacacatataagggagttcttaatagagtggcttggtggagacgaagacctgaacgaagtacgaactgctgggttggttatgcttgtcgcaaagggccaatagtacgatgaggacttgaacactggacggaaacttggggaggaagaaccatgagaagttgtcagaatttatcctaaaaaaagttgacatgcgcgtggcgtagtgctaggtttcatagttagtatgctggaatgttttaatcctagactttgtagctagtcattggctgggctttgctcattttagattgtatactgatctactacttacttctttcttaactttgctaccttattgtcttgcggtttgaattatgtcaccgtattaatttctctgtgtgttagacaaacatgatatgattaaacgtgtgttaattcgttccaaaaaaaaaa

SEQ ID NO: 6780 - DNA, 942 bp, Triticum aestivum
  unsure (1)..(942): unsure at all n locations
  Clone ID: PAT_TA_6780
cgtccccgcgtccgccgcccccccccccgccccgcctcccctcctcgccctccggccgcctccgccccagccgctccgggcccctgccggccgctgccctcccgcctctcctgcccctccccgccggccgtagcgccgccgcccggcaggggcggccagttccgcccctccgtcgccctcctcttcctcctcgccggcccccgggccccgggcgcggagccccccgcggttgcggggccttctcaaagccctggttgcgccgggcgctttgggcctgcgtgccgccttgtgggcagcgggagcaacgccgcggtcgcgccgctggctgatgggcacatgttcagtgaattctgtgacactgcccaatgggaagtctttgtcgagtgtttgtcgagaagtgtaaatatttggaagagagcaaatgtcttggcatttgtatcaacacgtgcaaactgccaacccagaccttcttcaacgatcacatgggcgtcgatttgtatatggagccaaattttgaagactatagctgccagttcaactttggagtgccacccccacctatcgacacggacaaggccctgaaggaaccctgcttggacatatgcacaaatgcgagacggcgcagagagcttggcagcagcggtggcccagatggtctatgcccccaggtttgatctgctgtttcccgaaccaggcacgctccctccattccgcaatggtgcggccctggcttctccgggggctctaccagtctgatcatggttgtggacgcggcctttgccggctgcgccgccttcttccctagctgaactgtatagcatgatgtgcacatacacgccacatgctgcgtgcatgggtttaattgggatgtatgcaacctactataattagaataacgaagttgaatctcgtattgtctgcgtgnacaagcaaagcaaagaa

SEQ ID NO: 6781 - DNA, 420 bp, Triticum aestivum
  Clone ID: PAT_TA_6781
gctctgttactatgcgtaaggttctggtttacggagtggcactttggttatgttttctcttaccactgcttttgaccacatttgtctgacagaaacttggttgagatgcgaggaagattcagcgttctggtcatcttttgtcagcagttgctcttacatcatgttctggatctgaaacaaaatggtataaggctaatagtcgtctagcttcgtgctaaccatggttatgtgttcctctgcttacctgtggaatctgaccggtcggttctctgcattgtcacgtgaagtttctgaatattcggagtggcactctgatgtttttccagtgaccgtgcctttgcagttatgaattcctgtgtttacctgtggattgttctgactgaatcttaatcaattgatggtgatggtctaaaaaaaaaa

SEQ ID NO: 6782 - DNA, 867 bp, Triticum aestivum
  unsure (1)..(867): unsure at all n locations
  Clone ID: PAT_TA_6782
acgagacaaacctggccgccgcaagaagggagccacgcatcgccgtggaacgccactcgccgcaggggaagacccccacccaccaagacgaagacaggggaaaagttggaaagcaaccagcagcccgctccctccctccctccctccctcccgttgctcataaaaccctaacgcagtggcgcgcgccagccgcccatgcccttccagttgcatctcctcccgtcccgcattggcctcttctcgtcgatctccgccatgtccagctcgcggcgcgcctccaggctcacccgcgcatcccgcccggagctcagcccagctgaaagtgcaagggaagtgaagcgtgaacccggtgtttcttttgactactccaagtctgaaatgaattccgtcaagaggaaaaggctgaaccgtgtgcttgaagtaaaggaggaccttcctaagaagcaggttggtattgttcctgacatcgaagaatttcgatatgtgaagaccggggcaaaaatgtcagtaactgcaaagagggtaccagcatcattaaataagaacagttcaccaggtgtaaaggaagtgaagtgtgaacccagtgtttcttttgactactccaagtctgaaatgaattccgtggagaggaaaaggctgaaccgggtgcttgaagtaaaggaggagcatcctaaggaggttggtgctgttcctgacatcgatgattttcgatatgtaaagaccgaggcaagaacatcagtatctacaaagagggtaccagcatcatcaaataagaacagttcaccagtcaggttggagaaaaagatcagagtttcatctgttgtgaaagtggaagttgcagctncagaaaattgggaagcagttctt

SEQ ID NO: 6783 - DNA, 385 bp, Triticum aestivum
  unsure (1)..(385): unsure at all n locations
  Clone ID: PAT_TA_6783
gggaaagtgaaaggggatcccgggaaagaggcatcttggagcgaggagaggggcggccgggggnaatccggcggccacacaccccatgccatgccatgcatacggtggagatggagagatagagagagggtgggagagacagagctttgcttttaggcgggtcaagtaaagtgcgggtgcgacgcgaaaggggcttctcggtgtggtcctagcgggagggacgagggtttgatccaagtcttgcaaagcgatgctgcccattgcgagggggaggctagctnctgctgggtgtagtgcatgggaaatttnccatggggatgccaatgccgacgtgtaaatgcttggaaatagtatgtgcttctttttatttgtgtcaaaaaaaaaa

SEQ ID NO: 6784 - DNA, 1099 bp, Triticum aestivum
  unsure (1)..(1099): unsure at all n locations
  Clone ID: PAT_TA_6784
gctctcgttctgcgccgcctccgcccgacccccttctctcacccgcgatcccttcgccctctctcgaccccctcccctcgttcctccagtgcgagacccgcgctccacccttcgccgggagaaggagaacccggcggagcttccgccactgcgccatggatggccccgagcacctcgtcccgcgctcatctcgtggcgcccgagcacctcgtccccgccatctggcctccgtgcccgcaagacctcgtcgctccccggcgcctcaaccggagcaggaccccgtcgccctctccttcctgtgtccctctattttccctcctcttcaactcacctcgagctccctccctctctctgttcgaacagatgccgccatggatcccgcgcccgagcagaggaggttgcgtcctcgagctccttctggttcccgcgccttcggcaaccagtgaccgccggcgagcgccccatcccacaaaggagccccgccaggatctccgagccgctgcaacgccctcgtttcgtctccctctcctctcctgcacctcgttcccggcgccggaaaaactgcagtcacgccatggccttcctcctcccacgccctgcttctcgttggtgaccacgaccagccccgaccacctgcgaccctgccttcactaaacgtccccggacaggagcaattttgaactgccaagtaccattggattcatcaagaccgtcaagtaccacgacccgcaagaccaacgacgcccgaacgagtgctcccgaccgagacagttgtgctgctacgttttggacacgcccaagtccctcgggtcagatgcgtcaagaccgccccgacttttgtgaagttccacgacgccgggagtcctcggatccgtcaagttccactacgagatgtacaactaccgtcgaccccgaagacctcggattcaccaagttcccacgatgacttgagtgtaccccgtcggatcgccaagttcggttaccgtcgcaaccatgtacaactacttccacgacgatacgagaacgactaccgccgttgaaggccgttgagtgaacaaactaccgatgacatgtatgactactncgtgaacgtgtacca

SEQ ID NO: 6785 - DNA, 504 bp, Triticum aestivum
  unsure (1)..(504): unsure at all n locations
  Clone ID: PAT_TA_6785
gccgcaattacggnaataggagcacgatctagctctcggttacgggggattccggcggcgaccatgctcggcgaacgcggcggcggcgggtggcactgcagcggattaggtagcgagtgacacacccgcgacgcagacccaaaagcgacgagcttaatgcctctatgtgccaacgacagcgacgccggaagcaatgacgtcaggtcaggatcctggccgtattggttctaaaatttcgtacttcctgtgtccattttttcagtccatacactagtaaacatcaattcttttttataaattcgattagttgttttttaggggaattcgattagttgttgtgtgatctatgatcggtgaatttgtttttctgatctatgaagtaacttgtgttaaaaaaggaatctactatgtagtaactagagagattaataagcaattttagaaaaaaaatggaagaaagcttcaaagaacactcattcaacaccgacaaacgtttantttgca

SEQ ID NO: 6786 - DNA, 498 bp, Triticum aestivum
  unsure (1)..(498): unsure at all n locations
  Clone ID: PAT_TA_6786
gcttcagtgaaaataattcaccttgttcgcagcttgagtcagaatttataagaccagaaaaccaatctgcagcgaggcagcaaagcagtttatagtacgttttcaggttttggatttaacgtgtggagtccaagnagnatgatatggattagagacatgtcttgacccaccaaaccatagnaaacccagtgaaatctggaattcgctaggagatgtcaagcacatctattgacgaccctcagattgaagcacgggctcgttggaggttttgatggcgtggcgttacattgccgatggttcagcgaagaatatgagggagcaaccaacaaccatattttagtcattggacagctnctctgtaggcgtattacgttncttcagccgtncctgaggcttccttttgttcattnctcggaacagagcattgtttncttaatgnatggaaccatgcatgtttgttcaagatcatcaaatcagtagtttaccagaaaaaaaaaa

SEQ ID NO: 6787 - DNA, 179 bp, Triticum aestivum
  unsure (1)..(179): unsure at all n locations
  Clone ID: PAT_TA_6787
gataagaagagcaagagctccaacccatctaaggagcacatcaagaagactgtagcttccaaggnatagccccaaggccacctagnagggatgtgcattagggcataagtttctgttcttgtactaagtactcatgttatggatctttagtatgacactaggctttgctaaaaaaaaaa

SEQ ID NO: 6788 - DNA, 842 bp, Triticum aestivum
  unsure (1)..(842): unsure at all n locations
  Clone ID: PAT_TA_6788
cttcaaagaggggccctgctagctatgtggctcatgagagacaagtatgggttcaaaagtcaagttcaggatcgtgagtttgtccaccaatgatacttccatcaaaacagatgttgcaagttgtggagaattctctggattttgcggctcattctgaagtttgtgaatgaaatgactgttggtgagatggttctatgaagtgaaatctcagatttgtcaacgaaagtctcagctatagctgaaaaggcagctctttgatttgattcacagaatcacagcaatagtgaagtaacataacccaccagtaggtaggtctccatcactttgggtgagacttgattttggacccaagggtgctatatctggagcgacggatgggaaattaggctggcatcaatacctcgagacagcggtcgcatatttccaagacccctggaggctatacacagtgatggatgtacatatctctagagaaagaagaggtctggctctgtttgctgtttacaggttagaggtgccatgtatctacaaagagataagagttatgagactacccagtttgctaaataaaggcgaatttttagttagttgattatgagaacccctgtatcccggcggctgcagttgcagtcagtatgaccgaagttaatgtggagtgcaaagtgacatagcactatcatgtttatgctcacngtgaatggattnagctctttgcttgtgatgtgcngnntgtgtttcnaaaagggggggccggnncaattcncnatntgagtcntttacccngtnatgcggcgttaactcnatgggaaaccnggnaccactaacccnccagnaacccttcg

SEQ ID NO: 6789 - DNA, 930 bp, Triticum aestivum
  Clone ID: PAT_TA_6789
gccggcatgggccgcgcgcggagggcgtgcccgccgccccggccctgcccccggcggcgccccccaacacggagcacgacatgggcggcgacaacagctcccccgacgcgcaggccggcccccgccgccgcgaggccctccccctgcgcgccgtcggacgcctcccgcgagccggcctcccccccctacctcgccgccgccccgacgcccggcgacaccccgggcgtccaccgcgccccccacgggcgggcgctcggccgggtcggcgggcccagcgcctcgctctccgtgggacagggatcgacgccgccgttgctctcccccccccctgcccttgtggctcctggaagtaagatgcagctaggacagcatagtagagcacgggcctgggggagctcgcgctgggcttccttcgcgggggtccgtcggggggtggggcctccgccccgcgtcccccctgcccgccccgtgctaaactttatgcgctctgatgatgacggtgaccagaggcagagggggagatactactactgctactgctgtgacgatgatgatgggttgttggatcctgtgagcgcattgaattgtattgatcgaaccccatgccctgccgcatgatgcgtcgtcggcaaaggctgctgcggcggctaccgctgtggccccgtcgacgcgttcttggatcctgtgagcgcattgaattgaattgatcgaaccccatgccctgccgcgtgacgcgtcgccggcaaaggatagtgcgatgtaaatgggtgttgtccagtgagtctgctcctctgttttttttactgtatttatgagcttgctgctctgctgtggtttgctttctgcctctgaatctctgaacatcagtgtagggtggccgctgctgctgctgctgctgaactgtaggctgtagcagtgtatatcaattta

SEQ ID NO: 6790 - DNA, 968 bp, Triticum aestivum
  unsure (1)..(968): unsure at all n locations
  Clone ID: PAT_TA_6790
cnnncgtccgnnnaggggagaagaaagcagatcggcggcgccggcggcggccgtggccgcactgatcgactcggactgcgggtgtggtcttccgcccgagcacccataaacatgggtccggaggcgcctgagcttcaaccaaaccccgtcgatcccgctggacgccttgtgctagagcacagctcgatggcgatcgccgatgtcaacatgggtctacaggcgcctgaacttttgtcatatcacatcaatcgcgcacgacccttctatgatgaaaagtggaaaagtatgaatgtggggaagaagaagacgaagaagatgattttccgggttccgcagcatgagctggatgacatactgtcctatcaggtgccggcttggccgaaagtggataaacgctatccttcggccgccatagagatggaaaaaatgaaggaatactttttggccgggcgggagaagatgaggcgagagtatgaggcccatggctatgctacttttgaagcagaggtcacagatgatgagaaggaggaagacgcagcagcgactactcctcatgaggagaaggatgacaatgcagcagcgacatcttttcatgacaagaatgacgatgcagcagcgactcatattcacgaggagaaggatgatgtgccagcgacatcttttcacgacaagaatgatgatgcagcagcgactcctactcatgaggagaaggattatgcagcagagacatcttctccttggattattccacgaggaagaggccggagaagatttcgcccgggtgtcgtgaagcaagcgagtggtgttaagaaaataacttagatgtattactagttgttttcgttgttagttttcgctgttggattagttggttccagtttatgggactgtattgtgtcatctttatttataatttncttgtgtaaaacctacagcnataattcaaaagnagtacnagtagtatattc

SEQ ID NO: 6791 - DNA, 1127 bp, Triticum aestivum
  Clone ID: PAT_TA_6791
gccagatgaagttagaggtgaaatagggccgcactttaacgaccgttctgccataacagaggagcagggtgaaaagttggctaagccaaggaacaaagttgtggaccctgccaacaagcagttcataaggaaggggcttactcccaagtggggtgaccttgacgtgaaccaacatgtgaacaatgtgaagtatattgggtggatccttgagagtgccccgatttcaatactggaaaagcatgagcttgcaagcatgacactggattacaggaaggagtgttgccgtgacagcgtgctgcagtcactgaccaacgtttcgggcgaatgcgtggatggcagcccagactctgccatccagtgcgaccatttgctccagctggagtctggagctgatgtggtcaaggctcacacaacttggcggccaaagcgagcgcatggcgaaaggaaacctcgggctgttcccggtcgagagtgcgtaaccgcgtcaaatgttaaatacggcaatgcatgggttgttatgagatgcaaattctaatcttgccggggataaatggttgattgaaggaattattttgtgccggagataagccaagcgacacatattctgattcggggagtgcaacaaacatggtggcagcttgttcaaactgttttgggaggaaatggtggaatttgacagccttgggtggaacggggagcttgactggtgatactgaagtaatttggaggacagagaatgggtggaatttggattatgggacaaggcaggggcttgtgtgtggtgatagtgatttgagctgattggtgaagaaggaagaatgcagcggcgttggctgggattgtttgtgtttttgacatgtgtttggacgcggagcggaatggataaataatttgtgtactaagttagcccagatgtgtgtgtggaggcgaaatcctatcccttgtaacagcctgatgatttgtacattcctacctagtacccccctcttctcttctcttctcttctcctgttggttgaatcgaatcgaatcgcagctctcctgcgtttccttccttggaaacacatgcgttactggtgtcatgtgataaccccttatgcttgatagttctctcttccaaaaaaaaaa

SEQ ID NO: 6792 - DNA, 1211 bp, Triticum aestivum
  Clone ID: PAT_TA_6792
gtgcggctcggcgcgtggcttcgcccccacggcgcaaccctaggtacctcgaccgcatcgccgcctctcatcgtctcggcccagtcccccccgcccccaccccgtccatcacgccgccgccgtcgcctacagtgaagaagcaggatctcgcgacgtcatccaccaggacctcgccgccgcctcttccaatacttcagcgacggtacagcaaggtccagccgccgcctgcttccaggaattcgccgcctcctccaaagcctcagcgacgctacatcaaggtcgagccgccgcctggttccaccgcggcctccaataccctcttcaatccctccgctttgaaggcttgatcagctgagatgtcattaacccggagctcttcttcagcctcgagtggaaccgcttctcctcccagcgaacagggttcagtttctggtgaagaacatatcttcaactgggatggatttgctgagttggagacctgggaagaccccactcctaggccatcaccctttactctcaaggagctgggtgatgcctgggttgctgctgcaaagcgccagctcattcgcaggcccaagtcaccgaccccctgcggacctgctagggcgcggcctggagcatggccagctagtcgttgaggagggcgtgggtcgtctgcgccaagcaaaacaatatgcaacctactgacctcgaggtaatagaagtgaaagcaagaagcctccgcaccgtgggggggggggggttcggtctctttgccctcctcgcgaagctgctggctcgcccgtctggtttgggcgctgcggccgtgcatccgggctgctgcgtcccggtggcggtggctccttgcgcccccttgggggctttggtctccccttcctgtttggggggcgtggaccgtgcgaaggcgcggccgcatccctcctgcggcgcctacttgcgtgggcacatgggtgttggtcgccccgtcacgtgcgggtgggcgcgtgtgactgaaggcggggccgcttgtctctgggcgtctggctggaggcttcctccgctctgcgcgtcgggttgctctttttctcttgggcttggggcgctgcggtcctcctctgagcgtgtggggccggctcggggtcgcctcctgttgtgtggttgcctttgactttgttcccagttctttggtggattgtactctgagtagagcgagcggccttaggtaaggtgtt

SEQ ID NO: 6793 - DNA, 715 bp, Triticum aestivum
  unsure (1)..(715): unsure at all n locations
  Clone ID: PAT_TA_6793
gagtagagaccntctcccgcagaaagctcatttttgaatctgatgacttccccagtcaagaggttaagctttgagtttgatgattcggaggaggaagatctgtatctccagggcatctgcaagatgtttcttgatctgatcatctcaaaccaagcgctggaggcaactggagatggggaggctgttctgatagatgctgctatcccatctgaaagctacaagactcctgaatcgaagcctctgcttaccggcatcgcggacacctgcccggatgctcctctgcgaccatctctgaagatgatcaagctcagcccaggcatctgccggaagctcgacttcggttctgtgagtcccaagactcttttcgctgaagacaataagagctgagcctgttcctttgggaacatggtcttggtgcgtttctcttggcatcctacagaggcatgtctgtcagtggtaactttgctaactctgaagctgtacagagctagcagtgatgcttgagtaggaagcagccttaagttatacatgtaaaatctatgtttagttttcatttaattttagctaagcccagtcttactgccctgattgatcattgatgtagtagtaccagcacatgtgccttgtgggctttcggcctagcgttttgtaaatcttgaaaaatagtttgttgtctctctgtgcttgcctnaacttaaggaactgttgcagantc

SEQ ID NO: 6794 - DNA, 1493 bp, Triticum aestivum
  Clone ID: PAT_TA_6794
gtttggactcaaaaggggcataacattcattaatgagattaaattgtttggtacaaacgtgaaacgatttatttgctttggcaaacatacactcctgcatcgttcagttcaagcgactgatcagtacacacgatgggtatggtataatgttacagattcctgtagtagtctactcagattcactagtatacaaatagtccctattcatgattataggccttgaatccctgacatgcccgtccatactattatctacaaacaacaacttacatagcgatacaagaatttctgaactgatatatgcctttaatcaaaggggtcgattcgaggatcatgctcacttgccattgccatccctgtacagaggcatgtggggcacatcacctttcctgcgccagagcagtttggacatctctcggtttttggtgctgataaaggttgatcaccatcactgaatgtcgaaacaggctcagtaagcacaacagctcccgtgcttgaacagcgggtcacaagccagatacccagttcctaaacaatatttgcaccgtttatgctcctgttgcttgacattgtttatctcaacaaccattagggcggagataactccgactgctccacctgagaaggatgccacaataggatctacctggctcagttgcataggcaaatgaacatttcgaatgaaatctgcataagatgtgcctcctataccaagtttaagtcccagaattggcccacgaaatccaccaaagaccattattgcagcaatgagagagaaacatgtagcatagtagaccttcagattagctgcactcaggggaggcaaaaacggtatgaatgatggaaaatctgggagttctccttcaggctcttcatttgagattccaagttcagcattttttattctttgttgtattctcaatctgcgaatctcctccatatgcaagaatatcttgttccggcggctcctgatattatcaagaatctcctgcaaatctagcttatcaaaatcttgaactgtctcaggcccttcaatgatgcaaaaccctgaggaggaggagggggcggcagcggccgcggccgcggcctggtcgtccccggcgccaaacggcgggggtgtcgacgacgacgacggcaggtctggggaaccgccgggagccgcggcggaggcggcgacccgccacctgcgggcggggagcgggggacgcagccggtcagcgtaggcgcgcggcggccggagcctcccggggctcaggccgctgcaggctagcatgcggccggagcaaagcatcgccggcgatgctccccgttggagcttccaaatcagaggtgcttatccgtggatgaataggttgatggcgacggatcggaggtgagattgatggacggatacgttagattatatcgaagaaaattggggatttggagcggggaagaaaagcaagtggtggctctgagttctctcgtgccgaattcggcacgagctcgtgccg

SEQ ID NO: 6795 - DNA, 1094 bp, Triticum aestivum
  Clone ID: PAT_TA_6795
cccacgcgtccgcatcatatgcttcgtcgcgttggctcaacaattcacatatataatcttgcaaacattaacaatggactgtcaccttggaacacattttgaaatccctgcaggctctgttatatccatatccttaatcgccctaactgcattcctgccgatttatggccgaatattggtacctatagctagaagattcaccggagtggaaagtggaattacacttcttcagagacagggtataggattggtgatttctcccatttcaatggtggtagcagggcttgttgaacacaaaaggagaaactcagcattgtctaatggaggaaaatcacctatgtcagtcatgtggcttgccccccaattaatcttaatgggtattgctgaggccttcaatgcagttggacaaatagaattctataataagcagtttccagagcagatgctaaccctagcaggatccctctttttcgttacgttagctggagcaaactacttgagtactgctctggcaaacattacaaggaaagtgactaccagagatggccacacaagctggttgacagatgacattaatcttggcaagcttgattattacttctatttcattgccctcataggagtactgaaccttttctacttccttatatgctcacactactatcaatataaatccatgtcactccatgctgaagagtccatcaaagtacacaccaaggaagaggcagaagcagaggccgacgccaatactgcacctaaaaaataagtattgggagggaaatttgtcctgcagagagtatatacttggaaaattgtcaacagactttcctgtttcgcaatatggcacaggactttattatcttcttaatgtgacgaagaactaatgtagcgtagtttagccaggatgtatgactgttatccaaagagcatcaatgaagagctaaaaggtctattgtattccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaacacatattggat

SEQ ID NO: 6796 - DNA, 960 bp, Triticum aestivum
  Clone ID: PAT_TA_6796
ggggcccgcgccgacggtttctatggccctggcggtggtgaggagatccagccgtcggggcccaactctcggctgagccagatgctcttggctttctctccaaggtcatgcatcacctcgaacctcgacggcggcttgctggacttctccaacggcgcggcgccagcgcccgcaccggagctgtggaatcaacaatcggataactcgtctgagagtaacagcactgcaagctgcatcagctcccaagaaggctagggttcaagccgcatcttcttctgggacagtctattctgaaggtaaggaaggagaagctcggggatagaataacagcacttcaccaaatagtttccccatttggcaagaccgacactgcgtccgtgctgcaagagactattgggctatatcggattcctcctgggtcaaatagaggcgctcagctacccatacttggggacatggcactggtccatccggtacgtcaccaagctcagctgaaccatggcgatcacataaatgcctcggctagaagcagcccgtccccagcaggatgcacaagatggcgagggcaagaagtcagatctgaggagcagagggatgtgcctggtgccggtgtcgtgctttacctcgcggctgggcgccgacggcgccccagccgtgtcgccccccccgccccccctaaacgccgccatcccccccccggctcagcccccggtctactcaccgcgcgcttgcgtgcgtaaatatataccattgattagcattcatgtatccattgttgatatactacatatatagttgttgaggtatttggaaacacatatcatcaggagcagtcattctatgtgcaagagtgattgctcatgatgctatgcaatacatgcatgtatgcacacacaatatacacacagactgctgctctccacctgttgtgtatgcatgtagtacctttttctacggaat

SEQ ID NO: 6797 - DNA, 451 bp, Triticum aestivum
  Clone ID: PAT_TA_6797
cgagggggtgatacctgtgtaaatttttccagtaaaacgtgcactggcatgcttgatgaaccagcattcatcatttctcttactagcggatagaccacaccagcactggtcatctgaaaaggaagaaaaaagaaatgcaaattagaatagtcacttgtgtttttcctgcaaaatcataaatgtgcattgttcgaagtcacatatccagttcatttcttcttttaatattttttccgcttacatattatatatatttcctacagatagaaagaatcctcaagatcctggtgcattcttttttgctgtcgaaactaaagaaagaaagtgccagaacaacatcctgtgttcattttctttttaattttcttccacgagaatcatggttctgtaaacacagcagcagtttcaaaagggctcaaaaagtacaatgcattctttgtcaaaaaaaaaa

SEQ ID NO: 6798 - DNA, 474 bp, Triticum aestivum
  Clone ID: PAT_TA_6798
gagaaaatagcgattcattcatttccagttcttgtcactgcacaaccccaggtacgtccatttgttcgtgcctaagttgatctcgttaactctgcagcttacatgcacaaaaagaatcacatctagcagtagaacaaattgaattcacgaggaggaagtttcttctttgcatagtttccggctgagggtgctgaagttggcccgcgagaactggcgggtcctccagtccgccccggacttcatcatcagctcgaactcctggtagctgatgcgtccgtcccggtcggtgtcgacgtcgcggatgatctcgaggatggcctgctcgttgggccccagctcctgccggagctcgtcgatctcgatgaagccgctgccgtccttgtcgaagtagcggaacgccgccgccaggtacttctcgttggtcatcttcttgaggtgcagcgacaccgtcacgaactcgtcgcagtccagcgt

SEQ ID NO: 6799 - DNA, 1961 bp, Triticum aestivum
  Clone ID: PAT_TA_6799
ccggattccgccgcctccacgcgcgccggaggtgagccgcccccgggccgtactacctcctcttccccactcgctcggacgaccacctcgcctccccccaaatctcgccggattccgccgcctccacgcgcgccggaggtcctgacaaaaatcgcccggagctcgcgcgcgtctcccccggggtggtcgcgccgcgcggcgccgagccatgaactacgggccctcggacagcagcggaactgatgatgaccttccaccaccatatccgaataatccgaataataggagtataagaggcagcgggcgtgccagtggtaatggcagagctattgttcctgtcagtggtaatggaagggccattgctcctgccagctcgtaccctagagcccagaccgatatggaaacacaaattcaacagcttgagcaagaagcgtattgtgcagttctgcgtgcttttaaagctcagtctgatgccctcacatgggagaaggagggtctgattactgaacttaggaaggagctaagggtatccgacaaagaacacagggaggtgctaaacagggtcaatggtgatgatattatccgcagcataagggaatggagatcaacaggaggccttcaggcaagcttacccaataatcctcagcctatacatcatgacccggcgcctagccctaccacctctggccgtaaaaggcaaaagacatctcaatccgttcctcccctaccggtaccgtctcctcctgttatgcatccacagcagatggctacaccaacacaaccttcatcttcagcagctaaaaagggatttctgccaggcactaaaggcaaaaagacaaaaccaggccagaagataccagggggccctgcagtcaaatctatgccaccttcagcaggtcccagcggaaggggaccacatatgaacagaaactttcctggtcgccctgctgctcctgaaccttctcaaggacagcatcatcttaatcctttaattggccgtaaagtcatgtctcggtggcctgaagataataatttctatgaagccactataactgattacaatgcggaaaaggacgtttatgcgctagtttatgacataaatacagctaatgagacctgggagtgggttgattttaaagagataaaaccagaagacataatctggcaaggcgaggacccaggattataccaaggaggtcgtggtgctccaggtagcgggggtaagaagtcaactagccgtgttatgcccacaccaggtacaggtagggggagaggattcccaaagaatgtgtcgaagaaagactttccacgttcgcaaaatggcgttgggaagagaagttctgatgacattgatatacttcacactgaaagcctgataaaagaggtggagagggtcttcagtgttagtcatcctgatcctttggaggtagacaaggcaaagaaagcgctgaaggagcaagaacagtcgttgattgatgcgatagcaaggcttgctgaggcatctgatggcgaaagtgatgagcgcaaccgtggccgaaggatggggccatatggtgggcacccgcatcaaggaaactatgcggatgccatggctgttgatggcgaccacatggtcggaggcgccgccacataaacggatcgccggaacatgtatacacaaattcgattagaagcccgtcctgttgtaaaatcttatttgctaatgtttatttaaaacttagccataggttgaaaccatctggttttgagagacgatcagtttttgttctcttctttttcttttggggtagaactgcttaacgtgttgtaaagctgctgctctgcggagctattgtgcttcttgtcattgcacaagtgatagtgcaatggtgattgattagcaccaggacatttgacctcttcggggccgaacattgctacaccttttcattattccggaatcatgtctttttcaaaaaaaa

SEQ ID NO: 6800 - DNA, 971 bp, Triticum aestivum
  unsure (1)..(971): unsure at all n locations
  Clone ID: PAT_TA_6800
gnaaactctccgggnaaggaaactgctctatgatacagacaacaaagaagaagatgaagagggtaacagtagaagccggaacctaacaatcaccgctgcgaagtatgaggaggtgtttgaagaagctcaccccgccattcccaccaagcaggttgaaaacaaatgccccaagcaatacaccaactgatcgagctacacaaatttccccacacgtcacaagaggctgtgtacctcttcggtacaggctactggtaccagccagaacacctcgagatggtttgtgatgagtttctgctctaggaatggctgggcgctgctgctcgagagataggcgttgattgctgccatttagggcttgattgagctgctgctagaaagagagagagaacagagagggagagacagggttccaatgcttactgatctggttttggtgagcaaaaaaatgagaaataggagaggaacagagagagcagagagatagagagcacagagagagaggcacacatcactgaaccctttggattctaatccgtctgctcgtactcgaccgttcgctgcaactttgtctgacctgagcaaaaacaatggctcgctgtcgccaggtcgcagcaaaagttttggccggtcccataagaaaattagttccaacaaaaaaagattgttgtcgcggtcacagcaggattgagcgatctggcatgtaagcttagctcggtggttcagattatcactgttagtcttctggtcgtggcaatttttagacctcttgaggtagctcaacgaatctggtgtgaagctatgaagggatttttcttgaaaacaatactgaaaggataccttaacttcattttatcccctagattagtatacgtatattcagtccccatttattttagatgtatagcttgcatgacagttttgtttaaacagatttttggggcattttgcaattctcacatatgttgttatcc

SEQ ID NO: 6801 - DNA, 836 bp, Triticum aestivum
  Clone ID: PAT_TA_6801
ggaattcggcacgagggttgagtcgactaccgccagagtactctgtttcgccttttggtttttgagctgcgctctatgttctatctacaaaccctaggtgaatacgtggggcggatctgctcggacgcagactgtcagatagatactcggtctctcggcggcctgaaagctgtttgggggctttgggcgcgctagaatctgggcgacagttggttgtgatcttgccctccggaagagctaggcggtgggcaagggggcgatcgagcggtggtggctggtgggcgaggttgtgtcggtaagccctgagactctattttcacgttattatggagtataattgatcatatatatgggttgatgaacccccaagctgtcctgttcgataaggttaatcatgatgggcttccctcagaaaaaaaattaaagcgccctggattcgtttctgctggtgaaagctatattgtgaaggcaaaccattttaaactaacttataatgaaactctttgccgatatcatgtattaatagatcctaagcctacttcagctggtgatgtcatgatacaacttgcaaagctgtatgggcaatcacgtttgggtggtcgtcttcctgcatatgatggaaagaaaagcttatatacatctcgtccatttccatttacttgtgaggcttttaaagtaacactacctgaccaggaaaatattctttgtggcctcccaaggggtaagagacattttagggtccagataacattggataaagttttgttcggacgaattgatggtgaagaattctatcaagcatttaatactattctacatgaattgttccttggaag

SEQ ID NO: 6802 - DNA, 655 bp, Triticum aestivum
  Clone ID: PAT_TA_6802
gctatgcttgctggcttgtctgatctgaccttagactctagaccagaagttagacattgcgctcttgaagttctgtttgatctgctgaacgagagaggacataagttctcttctcccttctgggagagcattttccatcgtgtactctttcctatttttgatcatgtgaggcatgctggaagggatggcctttcttcttctggggatgattggcttcgtgatactagcattcattcgctgcagttaatctgcaaccttttcaatactttctataaggaggtgtcctttatgcttccacctcttctcggcttgctgcttgagtgtgccaagaaaacagaccaaactgtcgtctcaattgctcctgggcgctttagttcatccgattgaggttggtggtcaccagttcaagcgatggtgattggggaaacactactaaagagtattaagggatgcgtcatacacaactcaaccccttgaactcctcaattcactaggatttccatagtcaagcaaccagcaattactttcaagagaagctgccacccatgcgggtggttaccatgatatcagggaaggagaagcatcaataagtaataatggcgaacaggagggtcatcaggaaacaagtccacggattggattggaaaattcagaa

SEQ ID NO: 6803 - DNA, 702 bp, Triticum aestivum
  Clone ID: PAT_TA_6803
gccccaccatcccgaacgcgccatcccccccccccctctcccgaacccgccgccgccgcaaaccccgcacgcgccccccccggcgaggaccccgccggcgaagaccccgccggcgacgaagccgccgacggcgcagcggccgcccgcgagccccacggcgtccaccgccggccgccgcgcagcacggactccgggccggacgacggcgaggagaagacggggggccgggaggacggccgcgagccgaagaagaacgtggcgacgtacaagacccacatcttccaggtgctcatccaggtccacctccacatcgacctctcctaccaggccatgtccatcgtgacctccttcatcaacgacatctccgacacgctcgccgcagaggccgcccatctcgcccgctacaacacgaaccccaccctcccctcccgggagctgcaaactcccgtccgactcgttctccccggggagcacgccaagcacgccgtctccgaggtcaccaatgccgtcaccaaggtctcctcctcctagattgcctctgcagtgcttgtatctatctatctatctatctagtagcgactgtagctggttctgttacttcagtgcttgtcgactctggttatcgggaactacaaatgctgttagtgctgaatggggaattgattgatggtgggctgccaatgctctgttgcctctttggct

SEQ ID NO: 6804 - DNA, 767 bp, Triticum aestivum
  unsure (1)..(767): unsure at all n locations
  Clone ID: PAT_TA_6804
gcaggcaattcggcacgagggttccccgtcctccagnatggtggccccacatggcagcgaccagttgctgttaggcttgccgagcctccgagctgcaccgagcaagaggcaagctcgggccgagccccaatatctagctcgtctgactactgggctcggctcgagaagaggcgagctaaggcaggctcggggcggctcgcgtccaggtataatagtgccccaagcaggggcgacgaagctagtgcaacaggaggagaaagttaaggagaaggtccgggcgatcggatctgaattccctgtctttgtgaaggtgatgacggcatacgatgtttccaagatagcacatctggccttctgcagggagtatgcttcggcgtgtcgtctcccgctcgaacaaacacctctcctgcttaggctggagggtagcagtatgcggtggagtagcgcgctgatggtccagcaaaataacaatgtgaggcggatttgctcattctggcaggacattgtctcgcaagccgggacggaggactcctcgtggaactggcaggcaggagcagcaggaggctcaggatgacggtccatctgatccgcaagtcggaatgcagctctagctagctcttgctctcaagcatctagttagtggtctctttgtgtgtgtggtctcaagaatggtgggttttaactctgctggtgtatggattgcttcatgattattctgaacaacctgcaagtctctagtgtgtaatataatnctcgggaaattaata

SEQ ID NO: 6805 - DNA, 958 bp, Triticum aestivum
  Clone ID: PAT_TA_6805
gagcatcgtctctggcgcccttgaggggaatcagctttttgtcggctctgctccacacacccaagatgagcaggaggaatcccatgaaaatgaaccgatttcagctagtagcaatgccggacttagccatgatacacacgaagcaaccccaaacaggaacacggaagagggaacaattcaggaagcgaccgacactgccagccattcttcagtaagcaatgctacttccccctctgacgatagattgagaggccaagatgaggatggtaaagacacacagtagtgaacacggattggctggtgaatctaacgagttcatcgtcgtcggctggttccagcgtatccgctgtcccaccctccaccccctcgcgcaaacccgccaggcgggccgcctctgcttgccaccggcgccgaccgccattcctcgcggcgcgatgctgcttccccctccctctatgcttcgcgtggccgagccggggatggtgaggacgcggagctgggaccacggactggctggtgaatctatcgagttcatcgtccgagcggccgcccgggcaggtcgctgtgctaccctcgacgtgctcgtgcaaaaccgccatgcaggcggcctattctttccacaggaggataccataataccatgcggcaagattgatcaagatacaaactgtatgcttctcttgtcagaaccggagatgtagagtacgcgtagcttgtactgtcgagtagaggactgttgatcatcccccctctgatgtattttcggctgggaaattgggacgaatgtgtcctgtctaaggtttgctgtaatctatatatggacatcttccttgcctgaacgggaaactgggactatgtatcagggattcaggcgccacatctctttgtagggcttctttggatcacaggatttgcaaaacaaaggaataagaaaaatgggaggatttgttgccaaaca

SEQ ID NO: 6806 - DNA, 757 bp, Triticum aestivum
  Clone ID: PAT_TA_6806
ccccgtctcttcctcctcctttctccttgttcctggtccatttccttctccaagaccaagagtctccactctcccccaagccctttcaaaagaagaatctccagcaagcttcgttcttctcggcgacggggcggagaaatccagttacatctactatgacttcggttccggagcttcaagccacccaggccgaaatgggttcagctggggatgagttcaccccactgtctcagttacagtatggaatggacaactgtaaagtgcgggtgcgcatctcgtggctgtgggagtccttcaatccaaaagatgacactttgttcggccttgactgccttctgatcgacgatcagggtaacactatgcaggctcgtgtagaacctggtgatatagagcggtttgaacatcggctagttgaagggcaggtctatgtcttgtcagattttcatgttgattcgcagagggactactatatgtcctgtagcaatgagtggactatgtacattagaaggcagacggtggtcactgagatcgaaggagatattgattcgattcccctctacagctttgagggtgtcaaatttggggaacgccgctctcggtgcggcagcgtctgctcgtcgactgatgttctgggtcacatagtatatgttggggagctagaggaagtctcaaaaaaatcacgcgttatagaaatttgcaatgcaagaattcgggatttgagaggaagggcactgagtgtgacactgtttggagatgt

SEQ ID NO: 6807 - DNA, 674 bp, Triticum aestivum
  Clone ID: PAT_TA_6807
ttcggcacgagggtgtgatgttccatgcgaagcaagacatcattgtgtccaactcagaggacaaaagcattcgcatttgggatgccacaaagcgaactggtattcagacatttaggcgggaacatgaccgtttctggatccttgctgcccaccctgaaatgaatcttcttgctgctggtcatgacagtggcatgattgtgtttaaattagagagggaacgcccagctttcagcgtgagtgctgatactgtgttctatgtgaaggacagattcctccggttctttgagtactccacccagaaggaagttcaggtggctccaataagaagaccaggatctgtcagcttgaaccagtcacccaggacactatcttatagtccaactgaaaatgctgtgttgatctgctctgatgtggacgggggctcatatgatctgtacattgttcctaaagattctgctggcagggctgattatttgcaagaggcaaagaagggagctggtggctcggctgtttttgtggcacggaataggtttgctgtccttgagaagagtagcaatcaagttttggtgaagaatcttaagaacgaaattgtgaagaagagtcctcttcctattgcgactgatgcaatttattatgctgggactggtaatttgttgtgcaaagctgaagatcgt

SEQ ID NO: 6808 - DNA, 1180 bp, Triticum aestivum
  unsure (1)..(1180): unsure at all n locations
  Clone ID: PAT_TA_6808
caaacaagcaagcggacaaacgcccccgaccccgcccccctctcgctcctgccgtcgccctcaccaccgtgatccgatcatacacgcgcgcgcgcgcccgcctcggcgtcgtcagcgcttccttccctccccgcgagcaggccgaggagaggaggagggaggctagggcaggaggcggcatgtccgggggagaggaaggcgaagggcgcaaggtgtctcgcgaggacatacagctcgtccagaatctcatcgaacgttgtcttcagctttacatgaaccagaaagaagtggttgaaactctatctttccaggcgaaaatagaacccagctttactgagctcgtctggcagaaacttgaagaagagaaccctgagtttttcaaggcatattatgtgaggttgatgcttaagaatcaaataaatgtgttcaacaagctccttgcgcatcagtgtcgtcttatgaataaagatccttctggagcactttcaattacccctactgctcctaatggctctgactcgagcacattgaaccaaaatacatgttttttacaagacactactagcactgcaattccagatagcttcctacacaatggaaattctagtggtgtaataaatggcgctcctgctactgaccagtttatctatggtggtaaagttgtccatggtcttcctagtggtatggatgcttcagttagtctactatcagcgcataattcgactggtgcgacagtttaatggagacaatggcacaacaataaaggcagagtctagcttttcgagcaatccagagtttgcattctgcaacgagaacacttacctagagccttgccaatcaattggggatgcctctggtgggtcctttagtagctctgaactgaatgggcaaccacttggtgatacaattcttgacatggatacctcatcatatggttccgtgcgcctcctccctcgcagttccagtttcccgagattcatcagggcagttctgtcgtattcggagttcctgcacctagggcagtttccttctcccgcggggacaactctctcccctcgactgcccctgacgcccccaatgggaagatcgtttgccccttaacgaggtgttagttanaagatttggagngataancacttngttaaacgcctgaattggntatgatncccancntaaatcn

SEQ ID NO: 6809 - DNA, 608 bp, Triticum aestivum
  Clone ID: PAT_TA_6809
gcggctcgattccctcaacaatcaaacagggaaaacaaaagcagcggccggctcgatggcagaagaggattggattccagtcgggatggaacaggagtacttcccgttccagccgcagacagaagaggaacttctaaacgagatgcaaccggatgagttcccgttccagccgcgggcagcagaggattttttgatcgagctgcaacaagtgttcgagcagcgggcagaagaggattttccaatcgtgaagcaacaggacgagcgcccattcgagttcgagctcatgacgatggaggagctgccggagctgctgccgcaggaccagttggattcttacctggagcacatgatggaggggctaccccaggatgttatcgacagtttgcagcaggaattcccagcgctcttcggccaggccacggtggaaattccccagtgtcagcgggcggatcccgcggaggagccatgcccgccgctaatctagggttcttgtaatttgttaactagggttattgtattgtatttaacacgacagttggctcgctagtcttgtgagaaatcgattttttttataacgatcgatttgtttagttgcttcaaaaaaaaaa

SEQ ID NO: 6810 - DNA, 1353 bp, Triticum aestivum
  Clone ID: PAT_TA_6810
atgatttcatttacttccgtttgcagtccgttactctaatgtgtatcaaacagaaagcacaagggtgatcactagcaggctgcaaacggttgatagtttgtctgcatatctttcaagtgtgcaagaagatgtagcttcagtaatcattggtaagagaactgtcttgcgcgccaggactgcctccgatgctcttgatatgaggctcacaattgacgaaagaattaaggacatagctctcaaatttggtacccaggttccaaaatcaaagctttatcggttcccaaaagagctgtcatcactccctgagtgtttgtttcatttgagaagggggccactcttaggtagcataataggacatgaagatgaaagatcagttctgaggagtttgttcttgaatgcatcatttgacctctcgctccgtatgcttgcacctcgttgtataatgcatcgagaaggtggcacatttgaggagctgccagcatatgatctgaccatgcaatctaattgtgcagtggtactggatcatggaacagatattttcatctggttgggtgctgaactagcaacccaagaaggacaaactgcagcagctttggcagcatgtcgtacgctggcagaagagctaagtgaactccgttttccagctcccaggatactttcattcagagaagggagctctcaggctagatactttgtctcacgcctgatcccagctcacaaggaccctacttatgagcaggagtcgagatttcctcagctacggacccttgctcctgaactgagggccaggctaaagagcagcttcatccactttgatgaccctagcttttgcgagtggatgcgcagcctcaaattggtcccgccggaaccaagctaatgcaaataattggacgagtgcaatcagaaacgattgtggatagccgaggtttggtttcaaacagagttgccaaacgaaatctgaaaactttgcgaggtaacgcctaaggcccaaacacttgtttgggttgatgaagcggcaatttgtgtgaagtgaagctgtataattttgcctgattattttctctgatgtggtcgcgtaaatgcattatctcttgccacacaggcgcgcaaaattttagacaattagagcatcgcttatgttctcctgcctttgaagagtttgttgtatgtcacataatagaagtctgtcctggccattcatttgattccttttactcctcgaggcgaatctcaattctccatttgtacaacttttttgttttgcttcggggtcgcccatttatacaatcagagatactacatttcaacaaaaaaaaaacctcggccgcgaccacgctaatcactagtgaattc

SEQ ID NO: 6811 - DNA, 835 bp, Triticum aestivum
  Clone ID: PAT_TA_6811
acaaacacgcgagcagcgggcgagcatccagaggtcaagcatttccccagtgcctggctggaatcggagcttcaagctatctgcgtccacactcgtcgagtattccggccatggccgtggcggagccgtcaagaacagggccgccgcctcgcgtcttcctcctcgtcttcgccatccttctcacggccacagatgaggcggtggcagccggaggcctatcgatcgggatcaactacgggcagatcgcggacaacctcccttcgccgtcccgcgtgtccatgctcctccggtcgatgcaggtgagcaaagtgaagctctacgacgccgaccagaatgtgctgagcgcgttcctcgacacgggtgtggagttcgtcatcggcatcggcaacgagaacgtgtcggcgatggtggacccggcggccgcgcgggcgtgggtccagcagcacgtccggccgtacctcccgagcacgcgcatcacctgcatcaccgtcgggaacgaggtgttcaagggcaacgacaccgacctcaaggacagcctcctgccggcgatgaagtccgtgtaccaggcgctcggcgcgctgggcctgcaggggcaggtgaacgtcaccacggcgcactccctggacatcatgggcagctcctaccctccgtccgccggcgcgttccggccggacgtcgtcccgtacatccagccgctcctcgacttcctgtcggcggcgaggtccccgttcctcatcaactgctacccgtacttcgcctacaaggacgaccccaccggcgtgccgctggagtacgtgctcttccagcccaacgccggggtgacggacccgaccac

SEQ ID NO: 6812 - DNA, 630 bp, Triticum aestivum
  Clone ID: PAT_TA_6812
ctccaaccctagccgccccgctcccctccctctccacggcgccgccgccgccgcctcctccccttcttccctgctctccaccgtgccgcctcttcctcctcttcactgccctctccagcggcggcaaagaacggcggcgctcgatccgatctgctgaagagaaaagatgagagagggagagagacaacgaaggagaggagggagaaagatagaggaaagaggagaccgaggtgtgacggcggataagagagggtgaccgaaaggagcgtgacgacctgcagacaaagggcggtggcggcgccgctcgatttgatctgcgtgatagagaagatgagagggagagagagaaggaagaacatgagaggagggagaaagagagaggaaagaggagagggggtcgacggccgacaggagaggaccaccggaaggagtgccgccggctcgtcgtcttccaccgccggcgtcggcctgcaccagtgaggtcgggcgagaccttgcttccagggcggcttgaccacagtctacagaacagtaaaaatgaaggatttgggggctgctcagttttggagtagcaaaccatagaggatatggggctgcacgtgcttggagcagcaagccatggcaaagaag

SEQ ID NO: 6813 - DNA, 951 bp, Triticum aestivum
  unsure (1)..(951): unsure at all n locations
  Clone ID: PAT_TA_6813
gcacgagggcaaatncaggagcctccggcaatttgccgttgccacttcaccccagccatgcctgtaaccctccactagctgccccactccttcaatcccccgctcctgaaatcctaacattggaagaggctgcggcgatgatgaggagaaggaagatgcctaaagagcagaaggtggacgcgctgcattttgccccaaatcctaccttaaaagagcatggggaggaggccatgatagcgacgacgaagaagaaaaagggcaagtgcatacagcagatattgtcatctccttcaacatctattgctgctgaaactccaattcaggagcaggaggagaaggtgaccaagaaacaaaagcagaggatggggctggaagcatccagcaacatgccgttgccacttcacaccggcgatgtctccgagcccctactcgctgccccattccttcaagccgccgctcccgaaatcctaacgttgaaagaggcggcagtgatgatgagaaaaaggaagatgcataaagaggagaaggtggacgcactgccttttgcccaaaatcctaccttagaggaggagcagctggaggaggccatgatggtgacgaaaaagaaaaatcacaagcgcgtggagcagatattgtcacctccttcttcatctgttactgcagaaactccgattcaggagcaggaggtgaagaaacagaagcagaggagaaggcaggaaccatccggcaagtcagacctgccatctggcaactcgccattgccacttcaccctggccatgcctttaatcccctattcgctgcgccattccttcagtcacctgctnccgaaattcttacgttggggggaggccgcggtggccgtgaccattaattaaaagnanangccttagggaaagggggctgcnctgtctttttgcccnaaacctaccttggaggaanaacancgggag

SEQ ID NO: 6814 - DNA, 536 bp, Triticum aestivum
  Clone ID: PAT_TA_6814
tcggcacgagggatgaagtggatacatatattccctcacatattattacattatgtattgagttattggagcataccaaaatattgtttctcttgataggctggtcatagatgaacatggcatattatataaacccaagcatgactagtttagaagccccgaagtcagctctcgttagattcgttgacacaattttggatttgtcaacgcttcactccatttgagtaatgacttgaagcacagtgggaggggccagcacccgtttacatgccacaagacgagacacattgcccgggtctctgggcaaactgtccaagatgctacagtagcgtccatggaaggagttgcaatagtcaagtgatccaaggaagcctagagctcgagagatcggtcaagatttaaaagatgttgcaggtgttaagtgtcgtggcctgttctcttggccttgtccgttttgctttagtgcttgttgtctttagttgatgaggctgaaaggatacaacaatataggcttatctgccttcttaaaaaaaaaa

SEQ ID NO: 6815 - DNA, 656 bp, Triticum aestivum
  Clone ID: PAT_TA_6815
tttgtcgacccacgccggacgcgtggggatttccttcgcagcacagccaaacaaattgtaactcgtaaaacaaaggggaggaaaagaaaatataaaccctagccgcgccgatcgaagccagcgagacggctatgcggccggcgatcgccggagaccaggatcgccgcctctagccgcgccgaccccgcccgctcgcctccgccgccatgagggccgccgcggcgcagatcgatccgtccccgtccccgtcccccgccgcgctggccaagtcgcggctcaagcgcctgttcgagcgccaggtgctgcgggtctcgccggcggagcggctcccgcccgtctccgccggcggggagaaggacaaggagaaggatgacttggagcccagctcggtgtgcctggacggcatggtccgcagcttcctggaggacggcggcggcgccgtcggcgagcgggccccgaccgcgcgctgctgcaactgcttcaacggcggcgacgcctcggacgacgaggacgggcccgccgcggccgaggcgtctgccatctccgacgccgcggagaccatcaaggcctctagtgtgcgagtcgactgccgagcgctgaacctccttcctgatcgtggagcttcatcgcgcggcgaggccgcttgtcgccgttga

SEQ ID NO: 6816 - DNA, 542 bp, Triticum aestivum
  Clone ID: PAT_TA_6816
cgacccacgcgcccgagtaaatctttagcctgtgcttcaatcgcctccccttcctacatcatacgtctcccatggaaacaccagcagagaaaaaagatgaatccagcctgcagaacgagccaaaaaaatctcgaccgctgccatactcctcaccaggtcggtgtcatgcccatcctatgatcaagtcctcccatctcgcctcgcctccaccactgatctcgccgcccaactcacaaccatggtaatctggctcctggatgtagaagtatctgggagctctggcgacgtaggcaaagggttcttccaaggacgatgtttgttgttgtgctctacttctccatggcgcgcgatagccagccgatggttttggtggcgtgaaaccgtctgtcgatgtcgatcgccatggccagatctccattgattggttttcgtatatggacggacatgcttgatcttgtatttttataggcgcacgtacgcaaattggttttcccatatgaacgtcctcgataggagtagttgaatgaattaaccttcttgca

SEQ ID NO: 6817 - DNA, 455 bp, Triticum aestivum
  Clone ID: PAT_TA_6817
cgaccgttcatggtgaacgacgacggacacaaccgctcgcactgcatctccccatcgtaggcgagctctgctcatgtgtgaatctccatcgtctctggtactgcaagtgtttgcgtttccacagagacatactttgaaccctaaatttctccccgccacatgttgacggcgcgtgtttccctaacaccggttgcatcttcttgagcgtcatggccagatgccgcctcgtccccagccgccaccggcggcgtacaagcacttctgcagagtctgcaacaaggggttcacgtgcggcagcgcgctcggcgggcacatgagggcccacgccgtcgccgacgacagcccgggcgccgacgacgacgacgacgatcccgtgtcgtctgcgcgcggcggggaagatgggccgtccacggcaggagcagcgacgacgcacgtctacgcgctccgggcgaacc

SEQ ID NO: 6818 - DNA, 674 bp, Triticum aestivum
  Clone ID: PAT_TA_6818
tgcggcacagagagagagatgagaaggaaggccctgtgcaccctggggaggagcaagggggtggtggcatcgctgatgcacaggaggcccttccagcacatggtgctgaggaggctcagggagctcaagaagatagtccccgatgcccgggacgcggacgtcgacgtgctgctccggcagaccgccgagtacatctgcatcctggagctcaaggtggccgccctgcggaggctctccgccatctacggtgcgtgacggatgccgcacctccgtctcagtacggcccgcccaccgcaatgcccatggttagaggttttgagccccagagtggatgcaattgtacattagttgggtaggaagagcatttcttgcctgctcatctcttgcaccccccagaagtactacgtttgtgagctggctcctatgtgcggtcacatataggatcttgtttagcaagacaagccggtcattgttactgacaaggcaatgactggtgttggctacaagaacaattatctaagcccctccctgcatcttatcgaatatatagttgtttctattcagctttccttttcaactgtttcctggatgactacaactaatgcacaacaagaaatccactgtttagataaagtaattaatattatatttttatcaaaaaagaaaaaaaaaaa

SEQ ID NO: 6819 - DNA, 167 bp, Triticum aestivum
  unsure (1)..(167): unsure at all n locations
  Clone ID: PAT_TA_6819
gggttctctctccctagnacgcgtccttattttacgactatgttttaccggccgctcagcaattctcggcaggaaacaaaacagcgacccgaggtttgtattctttacgggtgtatttgaaaagaacacgacaatccaaacagggccaaaagttgttaaaaaaaaaa

SEQ ID NO: 6820 - DNA, 598 bp, Triticum aestivum
  unsure (1)..(598): unsure at all n locations
  Clone ID: PAT_TA_6820
gcccggcagtagtcgccgacctccccccttcccttgcagccgccgccgtcgtagtaccacgccgttgataaatagacttgacgaagcccctgccgccggctccatggagcacaccgcccaccggtagctgcgatggagcgccggtggacgccatgattgtgcgcgccgtcgccgccttcgtcgtcccttctccttcctgtttctaagctcgccctggagacgcgcttcctcgagctgccgtagcagccgcaaaagcacctcctctgccattgatggaacgacacggtggcgggacgaccgcggcaagatgtgctgcacgcaggagtgagaggcgggccngtggtggccgtggccagcagcatgctaccggcgccaactacctatgtgccattgacggtgctaccggggggatgagctttctggtgctgctgcatatgccgctccctcctgctccatcgagtaaacatccatctctcccccctatccatctcctatgatatatttctgcaattcatgccctgatttgtactcagttggtatggaatgtcattgatgttgcccagatctacaacatgacccaattgggaactgtcagttc

SEQ ID NO: 6821 - DNA, 834 bp, Triticum aestivum
  unsure (1)..(834): unsure at all n locations
  Clone ID: PAT_TA_6821
attcggcacgagggccaggtttctccaccccacccacctctccgcaccgaagcccaggcagtgcagtgcaagggatgaagcgcatagtggggagcccgggccccggggacatggagcggcatggcgctgcgggtgtcgccgccgcatccgtcttcgccatgttctctgcttatggcttctccaactacagcgcctacttctacctgaactttgcttcggtgctgcagtttctgtggagtttgccccttgcttgtctggatatcttttctctgaggaatgaaaaggatcttcaagcaccggctcgtctattgctcattgttatcattgactgggccgtggcggttctcatgttctcaggagtctgtgccgccgcctgcctgacgattttcttcatgaaggatgtgaacttctgtgaggggttctcgtggctgggatgcaatcagttcgcgctttcggtcaccctggcattcatcacgtggtcgctgcaagctgcgtcttctttctccgggttatggctactggtctcgttcttctagtgatctcaataggtgctttgaatcaccgtcgcgtcgtgctaattgccagttaatggttgcattatcttttattttaaagtgctaattgccagtcaagggatggtaaatcagttcagatgcaatgtgctcaggacacttgttcatcaccgtcgcgtcgtgctaattgccggttagatttcagttaccggcgttcttcatcacttattgatagactgcatgtctgatagcgtgtcttcagttaagggaatagttactgtttaggtaatgngaagggaatcactaatanggggcctattag

SEQ ID NO: 6822 - DNA, 664 bp, Triticum aestivum
  unsure (1)..(664): unsure at all n locations
  Clone ID: PAT_TA_6822
ggcttgacgcactgccgcggcatgctgcccgctgggctggcgctgacgtgctcatcctcaacacgggccactggtggaacctgcacaagaccataaaatcgggaaactatttcatggtgggcaatcggttcaacatgacaacggacattaaggaagcattccgacggtctctccacacggtgaaagattgggcactaaccaatccacgactctccaagagcagctacatcttctttaggagctattctccatcgcactatggcaacgggacatgggacacaggtggctcttgcgcggaccaatgggatccactaacgaggattaccagtgagagtgaccagcaggagcacttgtggatcaacacaatgatgtcaagtgtggcacggagcatgaggagacgacatgggatgaacaaggacgccgtcttcttgaacataacgtacatgacgggcttgaggagggacggacacccgtcgcggcaccgggagcccgagacgccatcggatgccccagaggattgcagccactggtgcctgccgggtgtgccggacatgtgganccagatgatgtatgggcacctcgtgtccatgggattcgacatgaggtcaattaaaagataggtagatgcatgctatatatgtggttgtgtgtgcatgtatattgt

SEQ ID NO: 6823 - DNA, 983 bp, Triticum aestivum
  unsure (1)..(983): unsure at all n locations
  Clone ID: PAT_TA_6823
gctacgtcgacggctactccaccttccgcaccgccaccgtcgctgtgggcggcaagggcggcaccgcgcgggacgtgacgttcgagnaacaccgcggggccggccaagcaccaggcggtggcgctgcggtgcgactcggacctctccgtcttctaccgctgcgccttcgagggccaccaggacacgctttacgcgcactcgctccgccagttctaccgcgactgcaacgtcgctggcactgtcgacttcgtcttcggcaacgccgccgccgtctttcagaactgccacctcctcgcccgcgcgccgctgccgggccagaagaactccgtcacggcgcagggtcgcttcaacgcctccatgaactccggcttcgccttccagttctgcaacgtctccgcgcacgacgacctccttcgagcccaggtaaaccagaccgacaaggccgtcgccacgcagaccttcctggggcggccgtggaaggcgtactcgcgggtggtgttcatgcagtcctacatcggcactgtggtccggcccgaggggtggctcgcgtgggacgacaaccagtccacgcttggcacgctntactacggggagtacatgaacacggggcccggcgccggcgtcggcggcagggtgaggtggccgggctaccacgtgacgatgagccccgccgaggccagcaacttcactgtagcgcagttcatcgagggcaacatgtggctgccgaccacgggtgtcaggttcacgtctgggctgcttgcgtcttgaactcttgatcatcatgtgagtctgcgtgctctgactcttgagcggtctagaagtactgggtgctgtcgttcctcatcacgtactaatagtactatggttggaacaaactttagggaattagtcgatgggttgttattcttgttccggaatgggacatattaaggttttgaatggatgaagtgttttttctccaaaaaaaaaaaaaaaaaaaaaaa

SEQ ID NO: 6824 - DNA, 413 bp, Triticum aestivum
  unsure (1)..(413): unsure at all n locations
  Clone ID: PAT_TA_6824
gggctagtgttctcttgctccacaggacagatgagttttgtattgatttcggatggttataggttttacggctaagatcaaacaaagccctagtcttgttccgtacataagtgaactatccatgcatactcaggtgagcacctcagctcgccaacgatgcggtgtcgtagcagagggggtcttctccggaggcggagacggacggcgtcacggcagtgtactagataggggagcagcattgctattggagaaggaaccccatagctgtcaacgtttatacatttagacccttattgttactcttgttttcaaatcnctatctgtaaccctcgggctatataaggggtggaggatttgtatcgatcaactattctgccaattatggtctttacatcaatanacacttatacata

SEQ ID NO: 6825 - DNA, 616 bp, Triticum aestivum
  Clone ID: PAT_TA_6825
ggagctgcccatgaatggatactgaaagccaaagccagtggagaaaatgctctcagtccaaagcatgaggccttcatgatcgggactacaaggagtcctaataataaaggatttgatctatttatcacgactgctccaattcctgacttgaatggcaagatcattttgtttgggagagttattaagggagaagatattgttcaggagattgaagaaatcgatactgatgagcattaccagcccaaaacccctatcggcataattaacatcagccttatacaggagctttgagctgatcctgctgctgtccttgtatcaaccgtcacctgtccgtatactctttaagaaggcaactcctggcacttcgtcccagttcatgcagcagctgtgtataaatttatacctttgttttattttcaagcggagttcatgtgttcagttgttccaatgtaaatttcaaccacttttataagcatgaatatggccgtgaccatatctaacttgtgcgttgaacactgaaatgagtctgctggtgatgggtgcgatgctaatgaacacgcacatatgtaatgtcactagaccataatagcgagcgatgccgggctcgtcaatttaa

SEQ ID NO: 6826 - DNA, 1145 bp, Triticum aestivum
  Clone ID: PAT_TA_6826
gcggaagcggggcatgtcccctccttttggctccaaggcccggtcttaccgggccgatccgggcggaagacattgtcaggtggggagtttggctggggcggcacatctgttaaaagataacgcaggtgtcctaagatgagctcaacgagaacagaaatctcgtgtggaacaaaagggtaaaagctcgtttgattctgatttccagtacgaatacgaaccgtgaaagcgtggcctatcgatcctttagatcttcggagtttgaagctagaggtgtcagaaaagttaccacagggataactggcttgtggcagccaagcgttcatagcgacgttgctttttgatccttcgatgtcggctcttcctatcattgtgaagcagaattcaccaagtgttggattgttcacccacatccgggtgatcaccaagatggccaacgtctcgtgcccgccaaggtcccgccccggcgacctcaactacccatccttctccgtcgtgttcaggaagaagccgacgcacgccgtgaggtacaggagggagctgaccaacgtcggcccggccatggccgtctacgacgtgaaggtgagcggccccgcgtccgccggcgtcacggtgacgccggcgaggctcgtgttcaagaaggtggggcagaagcagaggtactatgtcaccttcgaatccaaggccgccggcccgggccgcgccaagccggacttcgggtggatatcatgggcgagcgacgagcatgtcgtccgcagcccggttgcctacacatggaagatgtgaggagcagggcagcaacttcaggccctgctggtgtttgatttagtcgtgctcaggttcaggagaagatgaaatatagctagatagctttgatgtagtttgctggatatcatgggcgagcgacgagcatgtcgtccgcagcccggttgcctacacatgaacatgggggggggcgggccacacccccgggcccgttgccgtttatggtttcgtgctgcccgcgtccagcttgtgcgccgttaacgtgtgagagtttaagttttttttctttctagttctatgtttgcaagcaagaaataaccctgaactaaagggctcagtcgtttgatcccaatatgtcatctggtgtatttctatgcccatcc

SEQ ID NO: 6827 - DNA, 499 bp, Triticum aestivum
  Clone ID: PAT_TA_6827
gggtcgatctcattatggaacattgtgttctgatggcagtcctacaggacattgttgttcatcacaatgctagaatcaacctgatcccatagagccttatattagcaaggatatcatcactacccttccaatgtgaacatttccatctacatcgccaggagatgtgacggtctagacgatatccactaccacaaaattggctacaagtgcttgtgtttctagcaatgtttcttctaccaaaagaagcccattagtgatctagctatagctagtgggttgttgcattgatcttgccgaaacgtagtagaattgtgtacaaggtggacttgtcggttgttttcttggtccaaccgacacattatcatcctaccactgctggtatcttcttgttttctcacggggttaaaatcaccaccaacaataggaggccctgacctatttagaaacatctcatgtaattcagaaataaaaaggttgctttctttcttcaaaaaaaaaa

SEQ ID NO: 6828 - DNA, 643 bp, Triticum aestivum
  unsure (1)..(643): unsure at all n locations
  Clone ID: PAT_TA_6828
gcggcgcggacggacaaggagcaggcggaagaggagttgtgccaaggcacaatgggtatctcgcgtgactcgatgcacaagcgccgagccaccggtggaaagcagaaggcctggaggaagaagcgaaagtatgagcttgggtcgccagccagccaacaccaagttgtcaagcaataagacagttaggagggtccgtgttccgtggaggtaatgtgaaatggagggtcttccgccttggatactgggtaactacccatggggaaagtgaagctgttaccccgcaaagacccctatcctccgacgtgggtctacaatgcatcaaaacaatgacttngtgaggacacaaacccttgtggaagatgccatgtgcaagttngatgctgccccattcaaacaatgggactcactccactatggagttgacattggtaggaagaagaaaccctgctgcaaagaaggtatgctgaaggacaagaggtttaggaacaactgaggaaacgaanaaganacattcacgaaggaactgagaaaccaaggaggacnaaccttgaccacacatnaggggcaattgaatgacggtgctgnatgaattcttcccctgaattgcctctatgtaaaccctangtaaacntngttcaataaa

SEQ ID NO: 6829 - DNA, 716 bp, Triticum aestivum
  Clone ID: PAT_TA_6829
ggccaccggtgggaagcagaaggcttggaggaagaagcgaaagtatgagctcggccgccagccagccaacactaagctttcgagcaacaagacagtgaggagggtccgtgttcgcggaggtaacgtgaagtggagggctctccgtcttgacactggtaacttctcatggggtagtgaggctgtgacccgcaagacccgtctcctggatgtggtttacaattcgtcgaacaatgagcttgtgaggactcagacccttgtcaagaatgccattgtgcaagttgatgcagcccctttcaaacagtggtacctgactcattatggagttgaaatcggtaggaagaagaaagctgctgcagctgccaagaaggaagctgctgagggacaagaggctgaggttgctgctgctgccacagaggaagcaaagaagagccacaatgtccataggaagcttgagaaacgccagcagggacgtaccctggactcgcacattgaaggagcagttaatggtggaaggctgctggcctgcatttcgtctcgccctggacagtggggcagaactgatgggtacctcctggaaggcaaggagctggagttctacctgaggaagcttccgaaaaaaaagggcaagggtgctcctacttaagcccgaaaagctgtttcatgttacttgttgggattttttaaatgttgccgtcatgtttagtttcgccacctct

SEQ ID NO: 6830 - DNA, 734 bp, Triticum aestivum
  Clone ID: PAT_TA_6830
cggcggcgcgcgcataggaggcgaatcagcagcggaaccaagccgccgacgccaccatgggtatctcgcgtgactccatgcacaagcgccgggccaccggtgggaagcagaaggcttggaggaagaagcgaaagtatgagctcggccgccagccagccaacactaagctttcaagcaacaagacagtgaggagggtccgtgttcgcggaggtaacgtgaagtggagggctctccgtcttgacactggtaacttctcatggggtagtgaggctgtgacccgcaagacccgtctcctggatgtggtttacaattcgtcaaacaatgagcttgtgaggactcagacccttgtcaagaatgccattgtgcaagttgatgctgcccccttcaagcagtggtacctgactcattatggagtcgaaatcggtaggaagaaaaaagctgctgcagctgccaaaaaggaacctgctgaggggcaagaagctgagggtgctggttgtgccacagaggaaacaaagaagaaccacattgtccagaggaagcttggagaagcgccagcagggacgtaccctggaactctcccatttgggaaccattttaattggtgggaaggttgattgccctgcatttattttaccccctggaacagggtgggaataacctattggttatatgctaaggggtgcatggaatttggaattcttcattgtagaacgtatctacacataacaaggtcc

SEQ ID NO: 6831 - DNA, 678 bp, Triticum aestivum
  Clone ID: PAT_TA_6831
caaaccacagctgcggcggcgcgcgcataggaggcgaagcagcagcggagccaagccaccgacgccaccatgggtatctcgcgtgactccatgcacaagcgccgggccaccggtgggaagcagaaggcgtggaggaagaagcgaaagtatgagctcggccgccagccagccaacactaagctttcgagcaacaagacagtgaggagggtccgtgttcgtggaggtaacgtgaagtggagggctctccgtctggacactggtaacttctcatggggtagtgaggcggtgacccgcaagacccgtctcctggatgtggtttacaattcgtcaaacaatgagcttgtgaggactcagacccttgtcaagaatgccattgtgcaagttgatgctgcccctttcaagcagtggtacctgactcattatggagtggaaatcggtaggaagaagaaagctgctgcagctgccaagaaggatgctggtgagggacaagagtctgaaggtgctgctgctgccacaagggaagcaaagaagagcaacaatgtccagaggaagcttggagaacgccagcagggacgtacactggactctcacattgcagaaccgttcagggttgtaaagcttgctgtccccccccccggcccccggtcgcccaggccataccaattggatcagggctgg

SEQ ID NO: 6832 - DNA, 810 bp, Triticum aestivum
  unsure (1)..(810): unsure at all n locations
  Clone ID: PAT_TA_6832
cggcggcgcgcgcataggaggcgaagcagcagcggagccaagccaccgacgccaccatgggtatctcgcgtgactccatgcacaagcgccgggccaccggtgggaagcagaaggcgtggaggaagaagcgaaagtatgagctcggccgccagccagccaacactaagctttcgagcaacaagacagtgaggagggtccgtgttcgtggaggtaacgtgaagtggagggctctccgtctggacactggtaacttctcatggggtagtgaggcggtgacccgcaagacccgtctcctggatgtggtttacaattcgtcaaacaatgagcttgtgaggactcagacccttgtcaagaatgccattgtgcaagttgatgctgcccctttcaagcagtggtacctgactcattatggagtggaaatcggtaggaagaagaaagctgctgcagctgccaagaaagatgctgctgagggacaagagtctgaggttgctgctgctgccacagaggaagcaaagaagagcaacaatgtccagaggaagcttgagaagcgccagcaaggacgttcactggactctcacattgaggagcagntcancggtgggaagctgctggcctgcatttcgtctcgccctggacagtgtggcaaaactgatgggtacattctggaaggcaaggagctggagttctacatgaagaaacttcagaaaagaaaggcangggtgccacaacttaagcttaaaaacctctgcattgttacttgtgggaatttcttaaatgtggcgtccctgtcattgttgcagaactactgag

SEQ ID NO: 6833 - DNA, 719 bp, Triticum aestivum
  unsure (1)..(719): unsure at all n locations
  Clone ID: PAT_TA_6833
gacgccaccatgggtatctcgcgtgactccatgcacaagcgccgggccaccggtgggaagcagaaggcgtggaggaagaagcgaaagtatgagctcggccgccagccagccaacactaagctttcgagcaacaagacagtgaggagggtccgtgttcgtggaggtaacgtgaagtggagggctctccgtctggacactggtaacttctcatggggtagtgaggcggtgacccgcaagacccgtctcctggatgtggtttacaattcgtcaaacaatgagcttgtgaggactcagacccttgtcaagaatgccattgtgcaagttgatgctgcccctttcaagcagtggtacctgactcattatggagtggaaatcggtaggaagaagaaagctgctgcagctgccaagaaagatgctgctgagggacaagagtctgaggttgctgctgctgccacagaggaagcaaaaagagccacaatgtccagaggaagcttgagaagcgccgcagggacgaacactggactttcccatgaggagcaanttaccggtggaaggctgttggcttgcaatttcgctcggcctggaccagggggcaaaagctgatgggtacattcctggaggggcaaggagcttgaagtttttacctgaggaaactttcaaaagaagaaagggccagggttcccacactttaggcttgaaaagcttcttgcttggtactt

SEQ ID NO: 6834 - DNA, 568 bp, Triticum aestivum
  Clone ID: PAT_TA_6834
tccattttagatgacacgtattttactataccatcaacagtccaattcgagacacctgggattggagatgtcaatggtaaaagatgttcaacgacttcaaggttatcccttaaagcagcaacctctattggcttaaatccatcatcgtcagaggtatttgggtcacctccagcttgaagcaaacatttgatcatttcaagatttccactatctgcagcaatatgcaatggggttgctccaccagcagtgacatttgggtttgcacctgcctggattagaacctccaagcatgggagggaactagctgcaacagcagacaacagcgaagtgataccatcagcagtttcagtgtccggcttagcgttgtgttcaagcagaagcttgactgcgtctagctgtccatgtccagcagcccaaacaaggggagtaccggactcgctttcggattccacatcgactcccttaccaagcaaaatcttcataatctctatgtgtcctatccctgccgcatgatgcagtgccgtggctcccatgttagacgcgaccgaagcccacgcgtccgcggacg

SEQ ID NO: 6835 - DNA, 632 bp, Triticum aestivum
  Clone ID: PAT_TA_6835
gcggcggcgcgcgcataggaggcgaagcagcagcggagccaagccaccgacgccaccatgggtatctcgcgtgactccatgcacaagcgccgggccaccggtgggaagcagaaggcgtggaggaagaagcgaaagtatgagctcggccgccagccagccaacactaagctttcgagcaacaagacagtgaggagggtccgtgttcgtggaggtaacgtgaagtggagggctctccgtctggacactggtaacttctcatggggtagtgaggcggtgacccgcaagacccgtctcctggatgtggtttacaattcgtcaaacaatgagcttgtgaggactcagacccttgtcaagaatgccattgtgcaagttgatgctgcccctttcaagcagtggtacctgactcattatggagtggaaatcggtaggaagaagaaagctgctgcagctgccaagaaagatgctgctgagggacaagagtctgaggttgctgctgctgccacagaggaagcaaagaaggagcaaacaatgtccaaaaggaaagcttgagaaagcgcccagcaggggacgtaacaactggaacttctcacattgagggagcaagttcaaccggtgggaaggcctggctggcg

SEQ ID NO: 6836 - DNA, 856 bp, Triticum aestivum
  Clone ID: PAT_TA_6836
ccaaaccaaagctgcggcggcgcgcgcataggaggcgaatcagcagcggaaccaagccgccgacgccaccatgggtatctcgcgtgactccatgcacaagcgccgggccaccggtgggaagcagaaggcttggaggaagaagcgaaagtatgagctcggccgccagccagccaacactaagctttcaagcaacaagacagtgaggagggtccgtgttcgcggaggtaacgtgaagtggagggctctccgtcttgacactggtaacttctcatggggtagtgaggctgtgacccgcaagacccgtctcctggatgtggtttacaattcgtcaaacaatgagcttgtgaggactcagacccttgtcaagaatgccattgtgcaagttgatgctgcccccttcaagcagtggtacctgactcattatggagtcgaaatcggtaggaagaagaaagctgctgcagctgccaagaaggaacctgctgaggggcaagaggctgaggttgctgctgctgccacagaggaagcaaagaagagcaacaatgtccagaaggaaagcttgaagaaagcgcccagcagggacgtacactggactcgcacattgagggacaggtcaatggtggaagggctgctggcctgcaattcgtctcgccctggacagtgtggcaagaactgatgggtacaatctggagggcaaggaagctggagtttacatgaggaagcttcagaagaaaaaggccagggtgcccccacttaagctggaaaacttgctgcatgtaacttcgtggatttttttagaggttgggccatggcatggttggagacatactgtgacacattttttgggaaaccggttcgg

SEQ ID NO: 6837 - DNA, 694 bp, Triticum aestivum
  Clone ID: PAT_TA_6837
gcggcgcgggcggacaaggagcaggcggaggaggagttgtgccaagccacaatgggtatctcgcgtgactcgatgcacaagcgccgagccaccggtggaaagcagaaggcctggaggaagaagcgaaagtatgagcttggtcgccagccagccaacaccaagttgtcaagcaataagacggtgaggagggtccgtgttcggggaggtaatgtgaaatggagggctcttcgccttgatactgggtaactactcatggggaagtgaagctgttacccgcaagacccgtatcctcgacgtgggtctacaatgcatcaaacaatgagcttgtgaggacacaaacccttgtgaagagtgccattgtgcaagttgatgctgccccattcaagcagtgggtacctcactcactatggagttgacattggtaggaagaagaaaaccctgctgcaaagaaggataatgctgagggacaagaggttgaggcagcagctgaggaaacgaaaaagagcaaccatgtcacgaggaagcttgagaagcgcaaggagggacgcgagcttgatgcgcacattgaagagcaatttggcagtggaaggttgctggcgtgcatttcctcccgccctggacagtgtggccgagctgatgggtacattcttgagggtaaagagcttgagttctacatgaagaagcttcagcgcaa

SEQ ID NO: 6838 - DNA, 903 bp, Triticum aestivum
  Clone ID: PAT_TA_6838
gctggagctccaccgcggtggcggccgctctagaactagtggatcccccgggctgcaggaattcggcaccagctgcggcgggcgcgcgcataggaggcgaagcagcagcggagccaagccaccgacgccaccatgggtatctcgcgtgactccatgcacaagcgccgggccaccggtgggaagcagaaggcgtggaggaagaagcgaaagtatgagctcggccgccagccagccaacactaagctttcgagcaacaagacagtgaggagggtccgtgttcgtggaggtaacgtgaagtggagggctctccgtctggacactggtaacttctcatggggtagtgaggcggtgacccgcaagacccgtctcctggatgtggtttacaattcgtcaaacaatgagcttgtgaggactcagacccttgtcaagaatgccattgtgcaagttgatgctgcccctttcaagcagtggtaacctgactcaattatggagtgggaaatcggtaggaagaagaaagctgctgcagctgccaagaaggatgctgctgagggacaagagtctgaggttgctgctgctgccacagaggaagcaaagaagagcaacaatgtccagaggaagcttgagaagcgccagcagggacgtacactggactctcacaatggggagcagttcaccggtggaaggctgctggcctgcatttcgtctcgccctggacagtgtgccagacttgatgggtacaatccggaaggcaaggaactggaattttacatgaggaagctccagaagaagaaggggaagggtgccacaacttaagctgaagaactgcttgatggtacttgggtggattttcttaagatgtggcgtccattgtattgtggcaaacataatggaacaccaattttt

SEQ ID NO: 6839 - DNA, 1082 bp, Triticum aestivum
  Clone ID: PAT_TA_6839
aacacagctgcggcggcgcgcgcataggaggcgaagcagcagcggagccaagccaccgacgccaccatgggtatctcgcgtgactccatgcacaagcgccgggccaccggtgggaagcagaaggcgtggaggaagaagcgaaagtatgagctcggccgccagccagccaacactaagctttcgagcaacaagacagtgaggagggtccgtgttcgcggaggtaacgtgaagtggagggctctccgtctggacactggtaacttctcatggggtagtgaggctgtgacccgcaagacccgtctcctggatgtggtttacaattcgtcaaacaatgagcttgtgaggactcagacccttgtcaagaatgccattgtgcaagttgatgctgcccctttcaagcagtggtacctgactcattatggagtggaaatcggtaggaagaagaaagctgctgcagctgccaagaaggatgctgctgagggacaagagtctgaggttgctgctgctgccacagaggaagcaaagaagagcaacaatgtccagaggaagcttgagaagcgccagcagggacgtacactggactctcacattgaggagcagttcagcggtggaaggctgctggcctgcatttcgtctcgccctggacagtgtggcagagctgatgggtacatcctggagggcaaggagctggagttctacatgaggaagctccagaagaagaagggcaagggtgccacagcttaggctgaagagctgctgcatgttacttgttggattttcttagatgttgcgtccatgtcatgtttgcagacatactgaacaccattttctgtaaactgttcgagtcctaggttgaactgagaatgtttttcctgttttggttgtgatctaaagctatccagattctattatgtgttgttctaccttgcagtattttcatctgttcagtgaaattttgttctcgcatctccatgttgatttgatgcaagttttgccttccatgatgtagtttgatatgtgtggtttttgcagttgcaaatgaacttcatcgtatctgaattccttaattatggaagtatagt

SEQ ID NO: 6840 - DNA, 1216 bp, Triticum aestivum
  Clone ID: PAT_TA_6840
ttaaccctcactaaagggaacaaaagctggagctccaccgcggtggcggccgctctagaactagtggatcccccgggctgcaggaattcggcaccaggcggcggcgcgcgcataggaggcgaatcagcagcggaaccaagccgccgacgccaccatgggtatctcgcgtgactccatgcacaagcgccgggccaccggtgggaagcagaaggcttggaggaagaagcgaaagtatgagctcggccgccagccagccaacactaagctttcaagcaacaagacagtgaggagggtccgtgttcgcggaggtaacgtgaagtggagggctctccgtcttgacactggtaacttctcatggggtagtgaggctgtgacccgcaagacccgtctcctggatgtggtttacaattcgtcaaacaatgagcttgtgaggactcagacccttgtcaagaatgccattgtgcaagttgatgctgcccccttcaagcagtggtacctgactcattatggagtcgaaatcggtaggaagaagaaagctgctgcagctgccaagaaggaacctgctgaggggcaagaggctgaggttgctgctgctgccacagaggaagcaaagaagagcaacaatgtccagaggaagcttgagaagcgccagcagggacgtacactggactcgcacattgaggagcagttcagtggtggaaggctgctggcctgcatttcgtctcgccctggacagtgtggcagagctgatgggtacatcctggagggcaaggagctggagttctacatgaggaagctccagaagaagaagggcaagggtgccacagcttaggctgaagagctgctgcatgttactcgttggattttcttagatgttgcgtccatgtcatgtttgcagacatactgaacaccattttctgtaaacggttcgagtcctaggttgaactgagaatgttttgcctgttttggttgtgttgtgatctaaagctatccagattctattatgtgttctaccttgcagtattttcatctgttcagtgaagttttgatcttgagtctccatgttgatttgctgccagctttgcctttcaggcatgttagatttgtatggttcctgcagttgcaaaggacccatccagtgtgaaaacccgatcatgtatgcaaagcaattttgatcatggaatctgcacaattgttggctattttaaaaaaaaaa

SEQ ID NO: 6841 - DNA, 1087 bp, Triticum aestivum
  Clone ID: PAT_TA_6841
ggaggtggcggccgctctagaactagtggatcccccgggctgcaggaattcggcacgaggctgcggcggcgcgcaggcgaatcagcagcggagccaagcaaccgacgccaccatgggtatctcgcgtgactccatgcacaagcgccgggccaccggtgggaagcagaaggcttggaggaagaagcgaaagtatgagctcggccgccagccagccaacactaagctttcgagcaacaagacagtgaggagggtccgtgttcgcggaggtaacgtgaagtggagggctctccgtcttgacactggtaacttctcatggggtagtgaggctgtgacccgcaagacccgtctcctggatgtggtttacaattcgtcgaacaatgagcttgtgaggactcagacccttgtcaagaatgccattgtgcaagttgatgcagcccctttcaaacagtggtacctgactcattatggagttgaaatcggtaggaagaagaaagctgctgcagctgccaagaaggaagctgctgagggacaagaggctgaggttgctgctgctgccacagaggaagcaaagaagagcaacaatgtccagaggaagcttgagaagcgccagcagggacgtacactggactcgcacattgaggagcagttcagtggtggaaggctgctggcctgcatttcgtctcgccctggacagtgtggcagagctgatgggtacatcctggagggcaaggagctggagttctacatgaggaagctccagaagaagaagggcaagggtgccacagcttaggccgaagagctgctgcatgttactcgttggattttcttagatgttgcgtccatgtcatgtttgcagacatactgaacaccattttctgtaaactgttcgagtcctaggttgaactgagaatgttttgcctgttttggttgtgatctaaagctatccagattctattatgtgttgttctaccttgcagtattttcatctgttaagtgaaattttgttctcgcgtctccatgttgatttgatgcaagttttgccttccaggatgtagtttgggtttgtgtgggttttaaaaaaaaaaaa

SEQ ID NO: 6842 - DNA, 674 bp, Triticum aestivum
  Clone ID: PAT_TA_6842
gcagaatcttcttcataagcattgcctttattctacattttgttaagagtaaatatagatgtgacaatataagaaaaaatggagaatatttaagataatatgaagagtgatgctacataaccaagtagctataaatgtaagtacagcgatacaggcaaaaggtacagccaagagaagtgcagagctaaacttcttcagtaccatcggtgttatccaaccttatggtaagagtaaatatagatcttatgtgtagaaaatggagggcaaaggaaaataagctgcagagtgatggtagatgaacaactacctgtcaatataagtacactgataaaggacagcaggtacttacaagaacaatgcagagctaaaaaaattcattggcattggatatattctacactaatgtaaccattcatacagatcagatactttggagcgaacaattgataagcaagctatcatgcgtactgctgtcacataatgaaccaggtacgtatgcaagtacagtgatataggacaacatgtagtaacaagagcaaagcagtgggcagcatatttgagatatcctgtcgttcttgtcaaaccggaattcttcttcgagcagatttcctgcaaaaaatatccgtaaggcacatgcggaaaagtagaagttcaaattgtcctgtgatttccta

SEQ ID NO: 6843 - DNA, 931 bp, Triticum aestivum
  Clone ID: PAT_TA_6843
gctcccattccccattctcgcatcgccagctccctccctccatagccggcggtcccaggtcaggccgcccctcccctttgtcaccatagccggcccgagcttcgcagcaactgatcttccgcccctgcatgtcgaatctggccacggaagtgaccgaggaggccctcgagcttggcatgctcgcgccagctccaggcgccgtccgagaaggacgctgaggcgcgggcctcacacgcccctcctctgccatgctccttcttcgaatccagtcgtcgaactgctcgagaaggcgctcgagcttggcatgttcgccggcgacgcccgccccctccctcctcctgatgcccccgatgtcgcagccatgagcctctccatcctctcccgcgtgatcgtccgggtccagtgttccgaagaaaatgaatgtcaaatgaagtccaaacggaatgaaaccttcgggagcgatctttttggaacaaacgtgatccaggggatttggagtggacgtgaaccaacagaggaggcggccacgagggtgcccggcgcgccctttgagcgtccaccgacctatttcttcctcctatatatacccatgtgtcctgaaaccatcgaggagcaccatgaaaaactattttcaccatcgtaaccttctgtatctgcgagatcccatcttggagtctttgtcggtgctccgctgaagggggaatcgatcatggagggcctctacatcatctccaaggtccttttgatgagttgtgagtattttaccataaacctttgggttcatagttattagctagatggctttttctctttctttaaatctcaatacaaagttttccttgatcttcatgtagatttattcgatgtaattctttttgtgctctgtttgtcgagattcgataaattgtgggtttataatcaagtttattta

SEQ ID NO: 6844 - DNA, 520 bp, Triticum aestivum
  unsure (1)..(520): unsure at all n locations
  Clone ID: PAT_TA_6844
tcggcacgagggaacacattatggtccaagnaagaacttgtacagtacatgctaagctggtacaagaagaacttgtacgtgctatcatagagcgccggaccaccacatgcatgtgagagccatggttatgccatctggcctgccagtggctcgctgtcttcactactacatcgatcttcccatagtgcaatcaacttcttcatgaagctcttcccaatgcaggagggctgagcatctggctaggtttgtccatgctaagctcgcagggtgcggtcatgtagctcaagtggccgaggcatgtgagcaactgaacggtccgtcaagggcaaggctcagttagctacccccgttgatgtttagtttagaggggaacaaactaccacatccatcttcaagagattttgtgaatctcgtagatatttcagtttccccatagaaacttttttcagacgcaactcctttgttggtttcatttgttcagaaatatgcaaattttcctgtcgattcttcaaaaaaaaaa

SEQ ID NO: 6845 - DNA, 420 bp, Triticum aestivum
  unsure (1)..(420): unsure at all n locations
  Clone ID: PAT_TA_6845
ttcggcacgaggctgccggcgagggggatgaggctggacgccacactcggtgccgggctgctcgccgtgtacctctgcttcatcgccgtccgggtcgccgacgccgtcggcgtcctcagcctagattctctcctaccaagacagtgattgaggagtgttggatctgatttgatggtgcagcggaagatcgaacaagatcctgaggctataggacaacaaacacgaacaaattgaaaccggtggtactacgtaggttggtgcggaagtgattgatgctggcgcttggctgcttcttacacacactcgtgaatcacttcagttgtgagagggaaatgcatgtgcatgcatgcatgtgaatatgtaaagccagaaaacaaagtcattnctgtgttatnctgttgtaaattaagtaggagcacg

SEQ ID NO: 6846 - DNA, 376 bp, Triticum aestivum
  Clone ID: PAT_TA_6846
gtagtaattagcactctcagaaggcaaacatgtatatgggcactacacacgcttacaaaaatacaaatcaatcgatacatatatacttatatatatataacttaaaacaaaacagagcaactaaaaaaacagaggacaaaaaaacaaatggcacattctaattcatcaagtagggaccaaatggtgagaccatctgtccattgattagcaaactagcatccgacggtgaaccatttccggtcagccgacggccggttggcgcgctccgccttccttttctcctcctcgcaggcgcacttggcctccttcagctttttcaccttggctgggtggctggtcttgttgcggtagagctggcgggcgcccctttgcagga

SEQ ID NO: 6847 - DNA, 460 bp, Triticum aestivum
  Clone ID: PAT_TA_6847
gcctccatggacttcctcatcgagccgtcgccggagttccaagtccgctccgctcgaaaccatcttcaacctccgtcagcccttgttcatcgatgccccgccaagcacacgccaagccgtcgccgcgtcgatctccaccgcccaagtccgccgtcccgccgcccgccggacctccctggctttcttccttcactgcataccatcactcctcgaacgcatcaagtccccctgcatcaagcaccgcccttgccaagacacatcgagtgcactcacacacgtggtgtcaagggcgttgaccgcgcccctgcctggctagatcaccagcgcctcccagctcgatcccctgctcgactgctcgcatggttgggctccaacctcggctcaggttcccttctcccccctcagctcaggctgcactcccactaggagagggccactaatgctgctcctcggcctcgtg

SEQ ID NO: 6848 - DNA, 1159 bp, Triticum aestivum
  Clone ID: PAT_TA_6848
gcgggggagaaaataataagccgtgtggggctcagagaaagtggtcaaggccaacatcaaacatatgctcttggaattaaagaggtctgggagatagaagaaggaaagcataagccaggttctgtggttcatactgtagggtggcctttggacatgaagacatatggaggatcatttctataccaccttgatgatagacagttggcaattggtctggttgttgccttgaattatcgaaatccttttctcagcccatacgatgagttccagaaattcaagcagcaccctgcgatcagaacacttctggaaggtggaacggttcttcagtatggtgctcgtactttgaatgaaggtggttttcagtcaataccaaatccagttttccccggtggtgcaattattggatgctctgcagggttcctaaatgttcccaaaataaaaggatcacataccgctatgaaatcaggtatgcttgcggcagaagcaactttcaaggctctggttgaaggatcttccatggatctgtactgggagaatctcaagaagtcatggatatgggacgaactctatagagctcggaattatagaccagcatttgaatacggatttattcctggcatggccttgtcagcagtggaacgctacatattcaaagggaagtcaccttttacactgaagcatgggaagcctgaccatgaagctacagaaatggccaatctccatttgcctatttcatatccaaaaccagatgggcaggtgtcctttgacgttccgtcttctttatacaggagcaacacaaaccatgagcatgaccagcctcctcatctccgcttgagggatcctgcagtacctgaaagcgtaaatctcccacagtatgctggaccagagtcgcgttattgtccagctcgagtttacgaatatgtatctgacgagaatggtgacccgaagcttcacataaatgctcaaaattgtcttcattgcaaggcttgtgacataaaagatcccaagcaaaacatcgagtggactgtccccgaaggcggaggaggacctggttacacagtgatgtgaatattactgtagtagagaaattctgacgcccaaataagcctgtccaacactatctcatagtaatggtgtaaataaacattactgtacaatg

SEQ ID NO: 6849 - DNA, 398 bp, Triticum aestivum
  unsure (1)..(398): unsure at all n locations
  Clone ID: PAT_TA_6849
tcggcacgaggcccaagtccaagnaagactgtcgcaaactgaagcagcttgcttgctcgggtgctggagaacatatccagtgcttgctttcacccattagatagtacgtactggtactggatatgttctccttggtactctactaccatgccatgccatcatgtaggatttgcatttgtaaccgctagagggtctagctctgaatgttgggaatgtttgcttcgttttagctatggaactgcatgcctagtactgtcatgtagcagagtcctcctccttctgaatggatagatagatcagatcaactaggagtatataaagatggttgggtcaatgtgcgcgctacatggctgtggcattggaccagcttcttcctttnccagtncctgggtaatgtc

SEQ ID NO: 6850 - DNA, 625 bp, Triticum aestivum
  unsure (1)..(625): unsure at all n locations
  Clone ID: PAT_TA_6850
agcctcgtgccgaattcctcatccccaaccccaaccctccaaatcaaatcgctgcctgctgcttccaccacccaaccctaaccctaaccctagccgcgccaccaccatcgatccccaaatcccttctccctccaccaaaccctaatccaaagctagctagccgccatggcccgttccatggttctgctcgaccgcgagattgatttcaccccccacgatgaggcgctatccggccgcacagttccggtggggattctggggaaggaagaggactacaaacccgcgacgcgcggagtgatcaagtcatcaacgtacctcccctccctccacacccgcgcggccccccactccccgccgctcccccccatacgcctgcatctgggcgcggcccgcatcccctccccgcaccagccccccgtcgccctgtaccccggagggcccccccctcgctccgattcgcggggaggctatcccatctacccccccagcaacgcccccctccccgtccgcccccctcctccctccgacgacccgcgtggagctatggccccactcgccgccctccatgggcgacgccctccgccaaggggacggctaccttctcgccgagctcgtgattccagnn

SEQ ID NO: 6851 - DNA, 484 bp, Triticum aestivum
  Clone ID: PAT_TA_6851
gcatgaacggaaaatgacacaggggcaagatggcaacatgtcggggagttcctcgtgagtcaacaaatggtctttcgtccatggctagttcaatctctacccgaagaggccgaccatcccatagcttagtagcttagtttctgccgtcggactgggccaatggggcactgggcggccgccgccggtctttgcggcgttgtgaggcagccggagaagcaggagcgcagccgcgcagcacagggtagggcgcagaccggcaacacagggcagtgtggagggaccacgggaaggagaggcgggatcctcctcggcaagatggggggcacaagaagaatcgaaccagcgacatgttgtgctatagtagcatgagcaaaacgattcggccacttaggcggatgcgataccatccatctttttccttttattattgtttcttctttcgtcttttctgttttcttttctatttcttttcttcttctttata

SEQ ID NO: 6852 - DNA, 731 bp, Triticum aestivum
  unsure (1)..(731): unsure at all n locations
  Clone ID: PAT_TA_6852
ggcttcttccttganaggattgacctccagatcagggattaactctcgtctaaaacattatatctacaaattataaatagggctattatgcccaatttggcaaatctgatctgtcgaacacacaataagccatgcgtgtattactactctggctcctgtgtcccgatgcggcgcggttgtgcgttgcttcccctggtttgcgcttcgttccaggtgcctacgtgcgtgcttcccgtctggtggcgctgccgccgttcagtcagtgtcataaatggattcatcaatgatctttccagtgcagccacagaagttcagaaggaggcaaaggaactaaagctgctggatatacacgatggacgcggtcttataaggaggcggctgttgaacgaccgccttctgctagccgaaagaagcttcctgcacgcggaaggactccaaggaagaacatggtacaagcatctgatgtactcgccaccggaggactacgagagcgagctctcgttcttcccggggatcgcggacgccatctctcggcgagggaaccagagcacgagacaacggcaggcggcggtgcggcaggagctgtggagggtcgccatggcgatccagagggccgcaaatgtgctcagaggtgaatttggcgcacacaacaaacctataaatttcagtgtctccatggctccgtgaaatcagagtataaataaataaaatcgttctgtttctcgtagaaa

SEQ ID NO: 6853 - DNA, 980 bp, Triticum aestivum
  Clone ID: PAT_TA_6853
ttttccttattgatcttggtttagcatcacaagtggagagattcgtcaggtcaacatgttgattatgatcaaaggcctgatatcttcagggggacaattagatatgcaagtgctcatgctcatctaggtcgtacagcccacgcgtccgatgatttagagtcattggcatacacccttatatttttgataaaaggaggattgccttggcaaggctaccagggagataccaagagtttccttgtttgcaagaaaaaaatggttacctctccggatatgctatgcagtttctgcccacctccgttcaaacagtttcttgagtctgtcacaaatatgaaatttgatgaagagccaaattacgccaaacttatttctctctttgaaagtttgattgaatcacctgcatcaaggcccatcagaattgatggggcccttaaggtggggcaaaaacgtggaaggctacttgtaaatcatgaagaagatgatcagcctaagaagaaagttagattagggagcccagcatcacagtggatttcagtttacaatgccaggcgccctatgaagcagcggtatcattacaatgtggctgacaacaggctttaacagcatatagaaaagggtaatgaggatggtctatacatcagttgtgtggcttcttcagcaaaccatggccgtatggtgcttctctccgggatggagtagtagattacatggccgataaatgggccaagaatctgtacattgcttcgatctgctatgggagaactgtcagttgaccaacgtaacttcaagcccgcggccgccccggctggtactttggcaaatgagcatcagttgatgtgagatacaagagaattgccatgataggattcaaaagcagaagttgatgtgatggttaactcgacctaattgtaaaaccgaatgcatgttgtggaccttctccataagaagctaacataatccacccgaaatttgcatttata

SEQ ID NO: 6854 - DNA, 594 bp, Triticum aestivum
  Clone ID: PAT_TA_6854
cccagccagagagagcagagccgctccgttcccggcgagtcggcggcgacaccgctggagaagaagacgtccacgacagccggcgaccgcatcggcgtcgccgtctccttccccaccccgccccacccagtttgccatcagcagcacatcatgcagaggcccagcaaactgcctgccgcctctctccccggacgccctacctttttcggaccccaaggttgggctgacctcccagatggcttgcttcactccatcgttgatcggctgggctccttccgagaccttcttggcttcgccaccacatgcccctcgtggcgttctgccttctcctcgtacccatcaaaatccacgttcctcacaaaattaccacctctcctcatccagacccatattcgtgcacaaggtcctcttcttccttggaccagtggttgtcgtgagctatacccatgtaaggttgttgatccagccaaccgaaacgccgcccttcgctgttgggtccctcaagataccttggagaagatgacatttattggatcctcccacggtaagctcatctactacggcaacgggtactgtcgcatcatcgtggtgctc

SEQ ID NO: 6855 - DNA, 656 bp, Triticum aestivum
  unsure (1)..(656): unsure at all n locations
  Clone ID: PAT_TA_6855
ccccccccccgacggcccgtgccctcgcaaccgccccccgccctcggcaccgcccgcctacccccccccccgccacctccatcgccgtccgcgctccacctcaccgcgcccccgccgtcccccccccccccgcccgctcgctcggccgtccggtgcgaggtgcgtccccccccgcttcgggcgggccggcccgcgcccaccccgcccgccggctccgccccccgccggctgggcagtccgtgcgggctgcccgccccacgccctgccggaggggcgggcggctggccgcccgccccggcccgttcgctccccccgcaaactcgcgccaatctgggccgcggcgcacccccaaggacaccatgtacgacctccaccccgagatctcgatgctctatggagaggataatggtgcagttgctgcccccagcaaggagcagggtatcgggaaagccattgaaaccttaccgctagcagacgcttctatcgcctaccgctacaacgagccccggattaaagtcattggggtgtggaggcgccggctccaacgccgtgaacaggatgattgagagctccatgaagggggtggaattctggatcgtgaacactgatttccaggcggtgggcgcccctcccattgacccggcaaatnnnntgnn

SEQ ID NO: 6856 - DNA, 443 bp, Triticum aestivum
  unsure (1)..(443): unsure at all n locations
  Clone ID: PAT_TA_6856
attcggcacgaggaaaaagcttgtacacgtacctctatgtaaggaattgttcatgcgagcagtggacatcctatcctcctatgacccaaaaaccatagtagttgtctcaatgaggactcgaaggtagccatattgaagcttgtcggaattagtttagaaccttctagaagatcctgtcatggtacagctagagataaggcttgaaccgattgtgatatgattttgtcttctgtatctaggctgtaacctgcataacttgtaagccacggataaggctttcccatccctagattgtcttgtgtattaaggttgtaacctgctatggcaggtagagtggtagaccttgtttctttcagctttagaatcagaagctgaaacaaataacgacgtggaatcaacttttccagtgaagctgaatctggattcggaccacanaaaaaaaa

SEQ ID NO: 6857 - DNA, 1035 bp, Triticum aestivum
  unsure (1)..(1035): unsure at all n locations
  Clone ID: PAT_TA_6857
cctccgagccgatcccacagccccgtaacctcgccaccgccacccgcctcgcccccgcccacatccccgccaccggcgcccgccgcagggccggtccagcggccccggccccgcgccactcccccccgtccccccccgcagccgcggaggtggccccgcactccacgtcgcgcggcagcgccggggacgtgcagtccagcagccgcccgcggctccgccgacggccgcggcggcagccgcggaagtggcggcgcagttcaggtcactcgtcagcgccgaggacgtgggatccatcgagcaggcgcagcacttcatactggggcgtttgcaagacagtaatgcaggtcctcgcccatttcttccgggtgctctggagcaatgctttgcggaggtgtccaagtgaccctgccgcgctccctgcgcccgcgccggctcggaccatggaccatcgtccccatcttgtcactcctctcgaatggtccgtgtatcccctggtcttgccacgttcacaacgggatccgcagccccggtccggcccgcttggcaagggcagcggccaagcgaccttcatccattaactcctctggaatagtcagtttatcacctaaacttagcatgttagtgaccatgttctgccgtgtggacccatctttcctgagaagtgaaagcaacaagctatcttcatcctttgttttgctgaaaattgcagcatttatttttccagaagcttctgcatacacattttgtggcgtgtgtacataactggacttggtagatatatgccttttgcatctcctccttgtctataggtggagatggacaccacgcaattgttcggatgggcccctgttagggtttaaggttatatttgcaaatatgctccatgtttgtcagatttagtgtgacatgaccagctcgcgggggggccccgggccctacgtccgccccgccaccgcgtcagcttcgccgccgccaacgggccngtcggtttnaaaacntccggagcnggganaaaccctgggcgntcccaacttn

SEQ ID NO: 6858 - DNA, 1261 bp, Triticum aestivum
  unsure (1)..(1261): unsure at all n locations
  Clone ID: PAT_TA_6858
cagcacactgcttgtttggctgcaggacaatggttggtgggggctcggtttcgcgatcccaacagtgctcatggccttgggcctagcagtatttgttggtggctccagagtgtacaggttcaggaagctgagagcaagcccattcacgagtatctgtcaggtgctcgttgcggccgtcaggaagtggcatgtgcaactaccagatgatacatcgcccttgtacgagccgacccgttcgtcatctgcacctgaatcaagtcacaatattcagcatacgaatcagttcaggtttctagacaaggctgccgcggtgctgcccccgttagacaagacatgcacggcgttgccgatgtgttcatggagtctctgcacagtgacccaagttgaggagctgaagatactgctacggatgttccccgtctgggcctcgttcgtggtcttctactcagtcgctgggcagaccgcatcgacgtttatcgagcaggggatggtcatggacaaccacgtcggccagttcgcaatcccacctgcctccctctccattgtcagcgtgttcagcgtccttatcggggttttcatctacgaatccgtgctggtgccactcgcgcggcgttacaccggcaaggcgaagggcttctcgcagacgcagcgccttggaattggctttgcactgtccatgctgaccatggtgtactcagcaatgcttgagatgaaaaggctggccatcgcgcaagccagtggcctggcagaccagaatgtgcctgtgccagtgagcattctgtggcaagttcctgcatatgtaatgcaaggtacagctggggttttcgcaggaatcggcatggtggagttcttctacgatgaggccccttacaccgtgaagagcctttgtgcagcattctcgcagcttgcagttgcgtccgcggcttacttcaacgcactcgtatttaagtgttgttgcggtggccaccacgcacggtggtgcgcctggatggatcccggataatctgaatgaagggcacttggactatttcttctggatgatggctgctcctagcttactgaacctggcgcagttcgtgcactactccatgaggcatagagagaagacaacttcttgacacaaaatggtggacaccggacagaagcctattgactttcctatcatatcacaacaaagatggcttctatgcagtttctgtggatggcgcacagcattgcccacctcactgattgataataaacnaaacttcaatttttatca

SEQ ID NO: 6859 - DNA, 593 bp, Triticum aestivum
  Clone ID: PAT_TA_6859
ggagctttgaagcagatcgtcagccggcggagcggtcgctctctctctccgacgacgttgcgcagcccaggggtggacggtggccgttagataaaaccgggttctggttgagagacagagggaatctgatctccgtcgtcgtctcacggctcagacgtccaagcagcaagcagaaatacaaaggaacctaaagccggagctgaacaatggcttccagactcgctagctgcttcccctgcctgagcacgaggaagaaggaagtccccccatctcctccggcctatccacgcagccgcaacccttctgcgccacaaactttctccttcgaggagatcgcggcggcgacaagtaacttcagcgatgactgtcccgttgttggtttggagggtctttacaaaggctacctcaagagcatcaaccaggtcgttgctataaggctgcagcctgttattgatcctaatgcatcagcagatcaagagatcatggagtttcttggccatgtcctaaagatcagcgcgctgcgccacccgaacctcctgagtctgataggcttctgcgccgtcggtgatcacaggatcttggttcacgagtac

SEQ ID NO: 6860 - DNA, 1343 bp, Triticum aestivum
  unsure (1)..(1343): unsure at all n locations
  Clone ID: PAT_TA_6860
tcgacccgcccgcacggattgtacatcagagatgcgccggtcgcaccgccgccagccttgtgccgagctcctccgccgtcgccgcctcgccacccaagtggtcctcgtatgaggatcgggccgtgttccagtcggggcgaggaaataagcagctccaaagtttggagctgcaatttagaatcgagaagttcttttcggagcggcaatccgcaatccagtcggggggaggaaataagcagctccaaagtttggagctgcaatttagaatcgagaagctcttttcggagcggcaatctgcaatcaagcggctcctttcggagcggctgtccgcaatcaagcagctcatttttgagctgcaatccgcaatcaagcggctcctttcggagctgcagtccgctgtcaagcggctcctttccgtgccgccatcgacgcaatcaagcgtctccgaattcgactagatctcttattttctagaataagatcgactacatctcttttcggtctccgagttgccacggtcttccaggctgaacccaagccgctatatatatctgtccaggacgccccggcagtcatcagatctcgaagcagaaccgcaagtcccgagctcggttgacctagacgggagccatggagtgcgaaatcaactctgctttgttcccatgccaaatgcaaaaaaacaacggagatgatagnaatcagcaccttgcccagtgacattctggtcaacattcttgaccgacttgatgtccgtgaagctgtgagaaccagtatcctctccagacggtggagtcagctctcttgcaagctctcacgacttatcataaatgctcagcctggatggtgtgtctagctccaacatctctgatggtgacttggttcggatcaatgcagctgttgttgaagcgacaaagagcttactgacccgcagatgtccaggcgaagacaccatccgcctcctgtcctaccacgttctacttgagaggtgatgcccccatatccattggacatgctgttggcagcgccatgcacgacacacaagcttgaggaagctgaattcacagttttgacagtgaagaatcgccgacagtgcactcttgatgatgtgttgaactatgggacacagtttgtgtcattttttactgagtgtctgaatgcatttactggtttgacgcgcctctacatggagaatttgagatttgctgaatctgacttcgtctccaacatcttcgtcacttgcaagcgattaaaatatttgggttttctcaattgcgacacacagaagcatttaacactccaggtcgaacacgctcaactcagtgagctcagtatggtcaactgcc

SEQ ID NO: 6861 - DNA, 645 bp, Triticum aestivum
  unsure (1)..(645): unsure at all n locations
  Clone ID: PAT_TA_6861
gcaccgccggcatggcgacctcgacgggaggggctccggcgccgccaccttggagcggtcaaggaggtgggcgagggcgactccggcgacctgggagcggcttctgctccattgcgccaccaccccgagcaggaggtgcctcgctgctggctagctgctgctcttacggcggacgccggatctcagctgcggcaccggagccagtccgtgcgcgggaggcggccgacgcagatggggcggcgtcacacaccggctgcgggttcacttgatgcggctcctgcgcgatgcacagcttggggggattttgacctcgtcttggattcgggctggatccagcgacggcgctcgccggagctggagcggcgctgctcgccgctcgccgttgacctcgtctgcctccctcgtcgggcaccagcgtcctcgccgttgacctcgtcttggacccgtgagacgcatgagacactgacgagtgccccttctgctagtgtaacaggcaggtgcaacggtgtcatgttaattttgccacatcagcacttacagcgggccccatctgtcagaagcgatgtcaacatgcatttagcgacagatcagtgttttctgaaaactgtcagcacagtgttggcggtttttttaaaaaaaatcgna

SEQ ID NO: 6862 - DNA, 668 bp, Triticum aestivum
  Clone ID: PAT_TA_6862
caacgatatggcatagactacgaggatacatttagtcctatggtaaaagatgccactattcgtctccatggtaaaagtctcaggcagcttgatgtacataatgtgtttctccatggtgttctggaagaggatgtgtacacgagacaacctcctgggtttgaaagtaagaatactccttcttatgtgtgtaaacttgataaagctctatatggattaaaacaagctccaagggcatggtattctcgcctctgtcacaagatgcaaaaacttggatttgttccttctaaatcagacacatcattgtttatttataacaagtccaatacatgcatatttgttctcatctatgttgatgacataattgtgactagctcatctgatgaagcaatcagaggtctcttaaaggacctgagcgtagagtttgcattaaaggatattggagacctgcacttctttcttgggattgaggtaaagaaacatcataatggacttcatctctctcaagcaaaatatgcagctgatctggtaaaaagagcaggattgcaaggttgtaaaccctcactcactccattatccagctcagaaaatttttctcttgtagaaggtaaaattttgagtcaggaagatagcacaaaatatagaagtctcctaggagctcttcaatatct

SEQ ID NO: 6863 - DNA, 951 bp, Triticum aestivum
  Clone ID: PAT_TA_6863
gcacgccctcgtaggccgccccgagactttcctatccccacacgtctcgtctctctcgtctcgttggaagcgaagcggaagcgggagccgaggccgaggcgaggccccttctccacgcccgaggccgaggggcctaagctgcctgggcgcgatctgctcccccccacactcgtaagtatgctccgcagcaaagttttgcagaagactaaagagagcttgagcatatcgaagaagcacaaaagaagatttacccctcagtttttgaatcctgaattctctagcttgtagaagaagaaagccggaattatagataaaggacagaccacaagcaagtttcccaccaaaatacagtctttggcagtatgactccgaaaaatgtgatccgtttcattttggtgctgatccatgtgagcagctgtttgggtagatcagggaaaatgttttctcctagctttatctcagtggcgaagtcattgtcaagctggccaattttcagcgcagggatatctgtaactgttgcacttgttctgtccttgtttctaactttcgagcatctctgcgcgtaccatcaacctgaggagcagaagttcttgattggtctcattatgatggttccagtatatgctgttcaatcattcttctcattactgaattcaaaggttgctttcatctgtgagatgatgcgggattgttatgaggcattcgcaatgtattgctttgagagatatctgatagcatgcttaggtctgaggtagctttctatcagaatttcagttttcggtttattagaagaatatattctgatatgaaagatttcatacctccctgggctgcatttgttctaagttttcaactatctaccctgttcttttcgactgctgcactttcaatttcagctgtctactttgtccattgcaggagcagaagttcttgatcggtctcattatgatg

SEQ ID NO: 6864 - DNA, 772 bp, Triticum aestivum
  unsure (1)..(772): unsure at all n locations
  Clone ID: PAT_TA_6864
gcgataacgccgagggagagagctcgagcggcgaaggagagaggcggaggagagaggcgattccgagctattccaccattcgattttgattttgtcctccctattctctttgcccccggctgccgaggttggttcccctaatccccccgctggccccaggtgttttcgcttgtgctctcgtcgtgtagttccaaatctagctgagttctcgtcttcgtggatgttctgtttgttgttcttggtgaatccgcccaatttcgcccgcccccttttgtgctagcctgcgttgtgtaggagcttttgtagttgcgggttctagggtttccgttttcctgtgtagatgtggatgtaggcttttagatttgttttattttgtgatgtagatggtggaggtaggcgtactggttgttgcagcgggtgatttcctgctttctgctagcttggggtgtctgttcccttgccgttaggtgacagttggggatgatctgggcctgcttttnttgtagttgcaggtggctgcttatgattttcccctggtagatgaggcatgtctgaatgtgttccaggaagctctctgaatttgatgcttctattactgtgtaattttacccccgagacatgtaatgtagctcaaaagtacagtggatcatacccccagaattacagtgtaactactgtgtaataggtttgcagaacctcactgtcccaccttttgcagtgtaattctgccatttttacagtgaattaacagctttacagtgtaattctccca

SEQ ID NO: 6865 - DNA, 920 bp, Triticum aestivum
  Clone ID: PAT_TA_6865
cgccccggttccccttaccggccggtcgccgcagccgccgcagcactcgtcggccggtggccgccgcccgccgtaccggccttccgttcccttgagctcccaggaaccatggcatggggaggcctcttcctgagcctgagccgccccacaccggagcagcagaagtcgtgcctcgcggctgccggcggcttcaactacgacgcggacctccacggcgccacccacccgaaatcaccagccgcattaacaaccgctgaagactccgacagggcgctggcggaccgcggcttctccgtgaaccgctcgcgcgtcctcgtcggctccggcgccgacaccttccgccacgccaagtcggccctcctctcctggaagcatctggcgctggggtgggcggaggcggagccgggcacgccagtgaagatcggcgcgaggttctgcatctgctacaaggaggtggtcccctgggtgatgttcccgctgcagatcgcctacgtcaccgacgacaagtacaatggcggcaagcgcgggaaaggcggcgtgttcgcgttcggcagcggcaccctgcagggccatctgctggccggggaggagcggttctcggtggaggtggacgcggaggagcgggtgtggtacgaggtggtgtccttctccaagccggcgcacccgctgtcggcgctgtgctacccctacgtgcgcctccggcagaggcacttcgcgcgggagtccggcaaggcggtgctcaggcacgtcgccgccgcctgctcctcctccaggacgccgccgccgacgcagtgaagaggccctgcatcttcttctctgtagacttaagggagggatggagctgcttccattgggtgagtgtatgtacatgtggcagaacaaagagaaagatggcaggtccttttttcctttttcttttt

SEQ ID NO: 6866 - DNA, 839 bp, Triticum aestivum
  Clone ID: PAT_TA_6866
gccccttcccctcctgtctcgccgccgcgcaggtaacgtgcctcctcgcctcgccgacgccatggccgagccgagctaagtactgtagtcattggtcatcgccgcaccctcttcctgcggctgcgggctgcacagcagaaggtcgccgccgtctctctccggctcggacgcgtatccgcgagcacgggagtctcctcctcgacctcgccttctacttcccgaggaccaccgcccgggtcagggtctccacgccgtcgctccgcggcatctctcgcttccgcttcgtgtcctacaaagcccgtgctcggccgctgatggctaccaccggtgctagcagcagcagcaagtcgtctgcagcttgtcgcgagtgtcaccaagtgagccatggaaaacctgattgcccgagtctgccctgttacaactgtgggggagcttttcacaccagaggcaaatgcgttagcaccaaacgtgttcctcacactggaccgagatgtccaagatgcggtggttttcaacactcagaatctaactgccccgtgaccgaagccgattctcgcccccctgtgtgcccacggtgtgctacagaacatcgccagagagactgccctcaccctgaccgtccaatcatatattcggggtggacaggctatgggaaatgcacactgtgtggtgattcgaatcacgtttatcgtgattgtcccagtaagtactggtagtttctaagtatcttgtcactgtagttcgtgagtttgatgagtatttttaaggactattagctattgttttgctcattatggatattaaaatgttgaactttaggtgttattttatcaagtcac

SEQ ID NO: 6867 - DNA, 546 bp, Triticum aestivum
  Clone ID: PAT_TA_6867
tcggcacgaggcgctgtggaaatggcaaacaaccttgccgtggacgccatcttcgtttacacaaagcatggccacatggcgtcgctcccggcacgcggccggcccaaccctcccatctttgcgttcaccgatgactccaacacaagaaagagcatgaacctttactggggtgtgatcccgctccagctcccgctgtcgaacagcatggacgacaacttcaagcagaccatcaagctcctgaagtccaagggctcggtgaaacctggggactccgtcttggtcgttgccgactcggatctgaaccaaccttgtgctgctgccacatcatcagtgtaccaatccattcaggtccgcttggtggactaggctaggcatgattgaactcggatagctgtcactataccgaggttttacggcaaatgtgctatatagagtgaagaacagtttgtgtatttgtgcatgcattacgtgttttcgctgtccagtgtgtgagatatatgatcatgttgatctccgtgagaacggttacttgccttaaaaaaaaaa

SEQ ID NO: 6868 - DNA, 750 bp, Triticum aestivum
  Clone ID: PAT_TA_6868
ttcggctcgtggcgggcagggggtcgcaaggacgcgctcggaggcgggtggccgtcgggtgtgcctgttccctgttccttgcgtctccgatcgcgtgaccgtctccgagctccgtgcctcgtctgcgctctccggacttttcaaacttagcgaactgaaacatctgagtagctaaaggaaggaaaatcaaccgagaccccgttagtagcggcgagcgagagcggaacaagggttttcatcaaaagaaatccgaagcggcttcattcgatttgttgtggattggatgatggaaaaaccagcaagcagctcagatacattgccaagcaaactggccgtgaaattagcatttactttacctgcatcatcctatgctacaatggcaatcagggagttgctgaaggattcaacctcggttgcgtaccagaaaacacttgattgctaagtttctcactgacgtcagttgtcaagggaaactgatctgtcatctcaccagttgaggatgtgacatggctaaagcttgagcttcagttggatccatgaatccgcaaactaaccacgcggcgaggctcccgcctggtgcatgcaagcaatatgaccgttcaaaactatgtactgagcgcaaaatttatggtacctattctgtactagaatgtgcccgggccgtaataaagcttgtatgacctatcatgacacctctgtaacgaaatcgagcatataaaatcgtgctgtcgtgggttacctcgacgaagc

SEQ ID NO: 6869 - DNA, 1600 bp, Triticum aestivum
  unsure (1)..(1600): unsure at all n locations
  Clone ID: PAT_TA_6869
gagaaaagcaagcagaaatgatttggtgatgacaaaataacgtacgtctgccatccatccatccatccatacatctagtagttcatcatcatcaactcgactggaaataataaaagcaacagcggcagcatctctaatgtaatgatcaacaaaagacagccagcatatgcgagttcatgcctagaccgaaaatataaaacaagtagttcactaactagctagctagggagtagggagcagcaacacaagccccatccatggatccatccatccatcagttgggcagggaaggcctacgacgacggaggagccgagcccgaaggcccagggggcggctgcgtcttgtcgagcttggacaggagccgctgcatctcagcaaggaggctcgccgacacgggcgctgctcctgctccgggagcgggagcgggagcggccgggaatgccgccgctccaacgttgagcggcaaagaccgcccgttcttcagggacgagatcatgttctccacgttcttcctcatgtcagcacgagccagcgggggcttggcaggacgggcaggtgcaagcgtgatcgcctccaggtagttgagccccagggtggcccaggggggcccgaattgcccgaagatgcctgggatctccgccttggtgtaggccgcctccgcctcggtgctcttcccaaacaccacgcgcgcgtcgcggcgctcttctgatatgtcgcactccgactccaccaggacgccaaacctgcggaactccgagagcagctcctccttggtggggaccatggtgccgtccaagaatttcacccggagctctgctgggttggcaaagtatgctgctgcaggcttcttgtttctcctcttctgggcagagttgggcgcatcagggcaggggctcccattggtagcaccatttgccctttgcaggagaagaatggctagctccatcagcaactgccttcatctggctagtctcttcaaccttttgagcctcagcctcatcttgaggcgccgaacctgttccagcagcaacctcctccactttcttgtacatatccggcaccatcgccttaatcagagatgtgtaggattcttggactgcacgcccttccacacttgcattgtctttgtttccatcggcgggctgggatatgatatctccatgcataggtggaagccagccacttgtagcaggcacatcttccacggccgcaatttgttcatttatatctactacaggaatgctagcttccagctccattgcttccatctgggacacttgtgacaggcacatctacaacaccaacgcattccacattcatgtctacctgaatgccaccagtttcaggctttgttgcttcaagccaagggcaacatttttggcagcacgtctccgttaagagtatccacatccatacaacttcaggatcgtcactctagccaggaaaatctccgctaagagtaccacatcataggctgggactcaatcngggacacttccaaaggattctcacaagataccaatcattcanttccgggtgtntccncccatgtttggaaatggcaataactcaaacgatatgtccctggcngccnccaat

SEQ ID NO: 6870 - DNA, 530 bp, Triticum aestivum
  Clone ID: PAT_TA_6870
ttcggcacgaggcatcaatggaatccattgagaaatgtgaatggtaggcatatggaaacacataacttcgaaatatcatatgggacgtagaaccacaacaagaacttgtacagctgcagtccctttgctggcagcctttttgggggatggagggagagtgtgtatgattgccggctagcccccagtcatcatcatggctgaatcattggaggcgctaggaacatatggttttactaccatgcttcttttggacaactgaagggaaacaagccgatgtagctcgataccatgcctgttggctgatggcagagggaaatctccaaaaactgtggtaccagcaccaatagtccaagagagatcgtgagtgtgttcctcttgttgtggtagcaattgcaacagcctcaagctctgtcatggggtgccttaagctacatgagtcttttgccgttattaacctgtgggttccactcagttttcaaattcaactgaatgaaataatgagtatctagaaacaaggtagaaaaaaaaaa

SEQ ID NO: 6871 - DNA, 881 bp, Triticum aestivum
  Clone ID: PAT_TA_6871
ggtggagagatcggcctcttgtcctgaacaggaaggttcaattttctggatatgcagtacttggtgatgattccttcatagtctcggatgctgccacaagttcgtttcttttgtttgatctgcattctgaaagatggagcgttctgcaccgtgctttgcctggatctcaactcttaaatgggagatctgtgtttgttgatggttttatctacacatgtacaagtgggggaattctcgcttatgagcttgttgataagcaaggtaatcgtaagggcctcagggacccccccatctttctaccgttctcgtggcagttgtcagagtgtagggcttgggaggctgaaaggatgtgctttgattgtgtcgacaaagacaaaatctctgacgcgattatattttgtgtggtgcaaggtgaatattgttattcggccaatcttccaggcagcctttctcacagccatgatgtacacattactactgtccaggttaagactgaaagagcatgcaggggtaaaagaaaaccagagagaattgaccatgtggatattggcacctgtttcattgagcatgatgcagcactggtcttgacccaaaagttgttttgcagttgggtcttgacttctgacgccccactaagctgccttatgtgtttcgctatgctatttatattattcaaaactcactacatcacaaagctcagctgcactgcttgtggtgtttcgaatatgtgcatcatggagacgtctttctggagcagagagaggatctggattttaattgacagtcagtgaaacgatgcatcagaattctcttatgtcttttgcaattcttgttttgctgtgctactgaatagtcaagtggggtaaatgttcgaacgtctg

SEQ ID NO: 6872 - DNA, 639 bp, Triticum aestivum
  Clone ID: PAT_TA_6872
ttcggcacgaggatgaaatcggcaacgttccaaccctcattgggtctgctgcaggagccatctcaagcactgccacatttcctcttgaggttgcccgcaagcacatgcaagtcggagctgttggtggccggaaggtatacaagaacatgcttcacgctctcctgaccattctcgaggacgaaggggttgggggcctctacagaggactggggcctagttgcatgaagctggtgcctgctgctgggatttcgtttatgtgctacgaagcttgcaagaagatactgattgaggaagaggacgaatgaagcgttcctcgacagcggcgtcataaaggggtagtggcttgaattttgtttgccgatcctattaaggatctgaatctgatcctggggccttccccccaagatacgagggctcggtttcgcgacggacagcggggaaacttttggcctcctgtgaatgaagttacctgactaagctcaataattgttgctacaagatttcaaactctttctgtagtctcagcttgccctgacgaaaagttacataagtttccagtttgctttgggatactatatgcatgaatgaagcgtgtgtttttcagattgttagggggtatgaaaccagtgaaattaactc

SEQ ID NO: 6873 - DNA, 1522 bp, Triticum aestivum
  unsure (1)..(1522): unsure at all n locations
  Clone ID: PAT_TA_6873
gcacgaggctaaaaaataaataaaaatattgcggtttcccctgcctccagtgcccaccagaaccgagtccgccccaatgccgttgcctcgctcccactcctcacaaattcctccccctccctgaaaccaaaccctagcgctcctcaatcgcacatagcaccccggaaatccgcccagctcgagccagatttggctttgcgcggaccaattcggcacccaataaatccggggggtgtccccttgggcatgctcgcttgatcgcgtccgacccatgggaatgtcgggggccgccagtggcggtgccggatgcggacgcggcgagtacatgaggatcccggaggatgtggacgcgatcaaggaggccgtaaaggaggaaggggagtgcccaaggttgctgcgatgccgcgcgatccggtggtgggcgaaggtcgccgtactcgggatcttcctcgccggcgccgccgcggccgccgtcgttttcctgggcccactcgtcatcaagaaggtggttgtgccgattattgactggcaatcaagaactttcagccgaccagttattcttctaatatgttttggtgcaatcgctttattcccaagtgtcttgataccttcttctccctttatgtggattgcggggatgacctttggatatggttatggctttctgataattacaacggcgatgagcataggcatgtcattaccattttgtataggatctgcgttccattccagaatacacagatggttggaaaaatggccgaagaaagctgcttttgttagacttgctggtgaaggagattggttccatcaatttagggcagttgctttacttaggatttctccatttccatatatagtttttaactacgcttccgtggctacaaatgtcaaatattgtccatatatagctggttcaatggcgggaaccatacatgaaaccctccttgcaatttatagtgggaagctcgttcaaagcttggctgcggcgactagccaagggtctttcttgtcagtggatcagatcatctacaacggaattggctttacggttgctgcagtttccactgctgcaataactatttatgcgaaaaaggcgctccaaaaattgcaagccgaggatgagctatgttgatatccttgctccggatcaaatcttgatgctaggtcccctccaggtgtaaactacaaacgggcactactaatctggtttcaatcgtcaacaacctgcaacagttgtaaagaaaatagagatccagaatcacttcccttctctcttcttttggttttgttttaagtagagagagagaattgccaaaattaagaactccaatcaatgtacgaaccggggcctgtgcaatgtatatttcaagctgcttaaggtgaaattatctttgttttgtttattgatgaagaaaatacgagcaccatttttaccatctgtgatgcacatagtttgcctttcggttcaactttgttattcgaaccaaaatgcacacttagnaataatagtggatatttc

SEQ ID NO: 6874 - DNA, 792 bp, Triticum aestivum
  unsure (1)..(792): unsure at all n locations
  Clone ID: PAT_TA_6874
ggaattcggcacgaggcaataaggcaatnatgaacaatgtacaagacttggccaaggctttctcaaattacaaagacgaagtcctggtgaagcgtgaagagctacttgaatacacacggaatgtcatttcaggacttaagagaaatgctgatattatgaggatagatgctgaaacccttgaattgtggagaaaattagatgggaaggagaaatcacggtcccaatcaactgaaggtcaagataaagcatcagagaagattgctgttgccaatatcgaggccttaaaagaagcacttactgaagtccgcttttgctctagagcggaagaacttctactgaagaagaagtcgattgctcctggagattccatggagattcattctcagaaggttgataagttaaaggtcctgtcagattccctttctacctcatcctccaaagcagagcagcgtattatggaccacaggcgtcagaaagaagatgctctgaactttcgtgtgaaaaaagagaatgaggtgaatgcggctgagaagggattgcttgctgagattactgaattggagaagcaaagagatgatcttgaggctcagttgaaaaaggtcaatatatcaattaatgctgctgctgtgcggctcaagacaaccagggaagagagagaccaatttgatgaagcgaacaaccagatcatatttagtttaaaaacgaaggaggatgacctctcgaaatccattgccacgtgtaatgtggaagcaaatgtggtaaagacctggttaattcccccnaagggggggg

SEQ ID NO: 6875 - DNA, 599 bp, Triticum aestivum
  Clone ID: PAT_TA_6875
gaataagatgaaacgagccttccaatttaccaaaacaagcagagcagagcagagcaggtcatcctagcaacaacctctgcgtccccaaaacaggcagcgtttgttttttgtgttatggagactctcaaatctgttgacataaagtatgatgatgattctattgcgggctggcgggaaaaaacacggcgaatttcgactagttactagcacaaccggaccggacggaataaataacagcaaccgtcttcaaatttttctcaagctcactaaagctagggagacaaaacaaattctctcattccacctcccaggagatcggattcgtcatcacctctcctgactggctgtcaccctctgcatgatcatcgcctcggccgcctggatggcctctgatgttcccgttatcgtcactttcctgtcagatgtgccaggtatgaaatcgcccctatctgatatcttaatcctggcaccactagcctgaatgatctctgttatgttccttcctgcacgccctacaactgcaccgatgtgttcgtcagcaacacctatggtgtgcgattctgggcatcattattagcaggtatctaacaggtgtccag

SEQ ID NO: 6876 - DNA, 1884 bp, Triticum aestivum
  unsure (1)..(1884): unsure at all n locations
  Clone ID: PAT_TA_6876
cgatgtgagcgtcacctctaaatggacccccccttcacccaacacagcctggcgcttcggtccgcccgagaacaaccttttgctcccccaaaccggcagggtttgtttttgtgttatggggactgtctaatctgttgacataaagtatgatgatgattctattgcgggctggcgggaaaaaagcacggctaatttcgactagttactagcacaaccggaccggacgggataaataacagcaatcatcttcaaatttttctcaagctcactaaagctagggagacaaaacaaattctctcattccacctaacactcgcaagggcgcgtttccatctttccagcagatcggattcatcatcacctctcctgactggccgtcaccctctgcatgatcatcgcctcggccgcctggatggcctctgatgttccagttatcgtcactttcctgtcagatgtgccagctatgaaatcgcccctatctgatatcttaatcctggcaccactagcctgaatgatctctgttatgttccttcctgcacgccctacaactgcaccgatgtgttcgtcagcaacacctatggtgtgtgattcttgggcatcattattagcaggtgatctaaccggtgtaccaggcttgttgttttggtaccttccaccaccaccaccaccaccagcatacccattaggtccatagttcacagcattattatatggcacctgtggaatcatatagccaacaggaacagccgcagggtaactagggaaaccaaggcctgcatatggaaatggggaactcaaattaggtgggtagtgaacatcctcagacaacttgcttaatatcaaatgtatggctcgcatctgactgttcaagggtcctgtgatagtaacaagcctatcatgcaaaccaacaaagttgttgtcctgtggtgaaatcttgattccagcatgtgaatcttcaataaatgacttgattgttgctcctcctttaccaataattccaccacatgagctgttaggaactacaagtctaaagttaggcctggcttcacgcttcagtcgattcttccccctcaggataagagtttctccaacgaacccaactccctggccttgactaacttcgtcaaacagtgctagagaccatgatgtttcgctcatttgtacccagggaaaaactcgtagctgcgcgatggtagtaagggaacccaaggcctgcatatggaaatggggaacttaaatccaactcataatgacttccaacctcattctggggctcgtattcaagtattgcgcagctgtcagttccaccctggtatatccatcgggtgaagcacctaaaaatacctgctaggcagcctgacctgaggcttgttctgcccgaaccctggactccagggatccgtggaacaaatgacggatcatgcgccggattcaccgatgcatcccttgctgcgactccagctttcagagcgcgcccacatgctcggatccagaccgcaccaccaggccaacggcacccgcgccccccacgacccccgcgaccccgaagatgacaaggagaagccaacacatttgaggnttntggtgtctaatacagcaagcaggatgtattattggcaagggtggntcaactattaatgactttcaatctcantctggggctcgtattcaattatngngcagccatgagttttttcctggtncaaatgacagaatcatnatggtctntggactgtttgacgaagtaattaaaggcatggagttggttctttgagaaactnttatnagagggggaagaatctaatgaactgaactaggctaattanattgtagtctacagtatgtggnggattattgtaaggagagcacatcaatattatgaga

SEQ ID NO: 6877 - DNA, 954 bp, Triticum aestivum
  Clone ID: PAT_TA_6877
tctctggcgtacgtagcgcggccacacacgccccccggctcctctcgtccccgccaccggagccgggcgcgcacgagcgcgcgcgctctagctccaacctccacgaacacttcgccgatcgttatgatggcgagtccggcgttcttgctgctgctcttgctggccgtgtcgatcaggggatcagaggcggagtggtgcgtgtgcaggtcggacgcgaacgagacggcgctgcaggagacgctggactacgcgtgcgggcagggcgcggactgcgcgccggtggccacgggagggagctgccacagccccgactccgtggtggcgcactgctcctacgcggtcaacagctactaccagaggagcagccagaccaagggcgccacctgcgacttcggcggcaccgccaccctctcctccgccgatcccagctcgggaacctgcaagtaccctgcaaccgcaagtgctgcagggacgagcaccgggaacggcacggcgacaggcacgggcaccggcaccaactcttcttccccgggctcaacaaacccagctacccccggcatgggagggagcttcaccacgccgatcggcagcgcgtccggccctacggcgagcatcataggccccgagagcagcggtttaggtgccgccgcggccgcctttgctggcgtccgcggcctcctcggcgtagccgtggcctccgtcctcgctttctaggtgcggtgttgatcatgaagcagcgagaaacgtagtgcattctttttaatcatctccaatccgtagtgcgttgttgctttggtggagatgtggctgtcgttttgctttagtgtttgtacgcctttaatgctcttttagtccatgtatatggagtttaatttctttgcctcatgtcgatgtcgtacttgtgtcccgtcaaacaatttgcatcatggttgcggcgttactgcaaaaaaaaaa

SEQ ID NO: 6878 - DNA, 1404 bp, Triticum aestivum
  unsure (1)..(1404): unsure at all n locations
  Clone ID: PAT_TA_6878
tcgacccacgcgtccggtcagaatgtccatggcaaaataaaagcgatggagcagacgctgggtaggatcaagagaatgcatgatggttgctcaggtgctgtgaacaggctccgtacaagccttcactcaacagaggagcgtcttcaatctcacagaaaagatgccaactatctagctcaactaccggcccggtcttctcccgtcggcccccgcggccggccattgcggcttacaaatgaatattattccagcaactccaacaataaggattttccaaatacggagaagttggaagaccctgaactccatcactatgcagttttctcagataatgtattggctgctgcagtggttgttaactccactcttgttcatgctaagaaaccagcaaaccatgtcttccacattgtgacagatcggcttaactacgctgcaatgaagatgtggttcttggctaatcccttgggtgaagctgcggttcaggttcagaacattgaagagtttacctggctgaactcaagctacagcccagttctgaagcagttagaatccagttcgatgattgattactacttcgggagtgggaaggctaggccgggtgaaaatcccaaattccggaacccaaagtacctgtcgattctcaatcatctgaggttctatctccctgagatattcccgaagcttaacaaggtgttatttctagacgatgataccgtggtgcagcaggacctaagtgcgctttggtcgatggatctcaaaggcaaggtcaacggtgctgttgagacctgtggagagagcttccacaggtttgataaatacctcaacttctccaatcctctaattgccagcaattttaatccacacgcttgtggttgggcatatggcatgaacatgtttgatttgtccgagtggagaaagcaaaacatcaccgacgtctaccacacctggcagaacctgaatgaagacaggctactatggaagctaggcagcctccctgcaggccttgtgacgttttggaaccgcacgttcccgcttgatcgctcgtggcatcttctggggctcgggtacaacccaaacgtcaacgagaaggagatcaggcgggcatccgtcattcactacaacggaaacctgaaaccctggctcgagatcggattgtcgaaataccgaaaatactggtcgcggcatgtcaattacgatcaagtgtttatacgggagtgcaacataaacccctgagtggcaaacacactttgtgtatggtttccttattcttttttcgcttgctattggttaattctttatgctctaggttttgtaagatatctggagcatctactattgtttttcagtggtaaaggtgcccgttcctcctatgtatgactaactgtaaaggtgccagctgnttag

SEQ ID NO: 6879 - DNA, 563 bp, Triticum aestivum
  Clone ID: PAT_TA_6879
tgggaagacagtgactgtgcaacgcatttaacggaaggtcttgaactgatatacaaagtagacattaactacttttcagcggttcgaagaaaccggcatgaccactcctacttacaactcatagcgtaggttagcagggcaacgtttcaagctgcttcacgagaataggttgactgcgcctcttggtctgtgcctgttaccatccaatcaagctttgcaccctttccctgccgaataatggtaggataacttccagtcatgtcaacgacagtagatggatcagcaattctagcaccgccatcaacgatgaaatcgagtcccagtggctcataaatatcggcaatggttactggatcaagtatccattcatcctctgccagatatttgacacttgtgcagatcaacggttcttccagattttgcagtattgcttgacatatgggatcatctggcattcgaacaccaacctgcctcctttttgcgtatctagtagatgacccatgcttgatgcattgcttgggcaattccttagtcgcaggtagaataaaaggtgtaaggtcctg

SEQ ID NO: 6880 - DNA, 709 bp, Triticum aestivum
  Clone ID: PAT_TA_6880
ctcgctctccagctatctctttattatgttcttccatagaacaaactgaatgtgcagcacagggagttgcaacattaacagaaatacctacactcccatactttaccggtactgctcgtccacctaacgaaatgggtatactacgttcacataatttactggttggagagccaaggatgcaatgagatttctacagcaaaacctgtgctatttggcaaggcaatgtttactttcttttcctttttgatatctggcaaggcgacgagttcctactgcagcaagatgggcagttgctcggagaaatcctgaataggtgacaactctaggagctcgtaagctgcctggaagcagtcagcggcctcaagcaccgatccttcagatttcaggacgagtccgagccccatccaggcttgatggtttgttggctctaagcgggtggcgctgcgaaggaaagttctcgcgattgacgatgatttcgctcctagagttcttagaatgcttgccatagaaaccatgctagggacatagtctggattgatggagagggagaatgagaatgcctcgagggcttcttggtgcaaggactgggcctccaatatcaggcctttgacatgccagcactttggagataagaaatcgatggattttgctttgtcaaggcagatgtttgagtcattccatgcttcaagctttgtgtatattgatgcca

SEQ ID NO: 6881 - DNA, 556 bp, Triticum aestivum
  unsure (1)..(556): unsure at all n locations
  Clone ID: PAT_TA_6881
cccacgcgtccgagaaaatcccttccatccagccgccgccgcaacaatcccttccggcagatgtgcacgacctacccttccccggccagccgccaccaaccatgcttgcctctggccagccgcccctgctgaccctgccgccctcaccgccggcggtcctcgataagcaacctctccagagatgcgggatcaagccgccgccaccatggattcagccgccacgccccaatcgatggtcctcatggccagccatcgccggtgacttacaccgccatgcccaacggccccctgccagtcaccgccgctccacagatgagcattaattccatcatattccttcgtcttacccgcttttatgtcgcaaactcttccacctccatgccacaaatgcatatgaaacggctcacaacactaaatttacggtcgtcattatctcctgcttcattaccctgcaaatgcggaaaaggtgtgcttataacccttctgccatacacatagacaacaatgctgctaaatccatgtctgggaacaactatgccgtacaagtganacnccc

SEQ ID NO: 6882 - DNA, 540 bp, Triticum aestivum
  Clone ID: PAT_TA_6882
atctttaccaacccactcccgccaacacagcgcgctcccgcctcctcaaatcccaattccccatcgcccatcgccaaatctctccgcgcctccaccccgccagccgccatggaagcctcagccgccggcgccgtcgcgaaggcgaagaagtacgtggtggggcgcaagctcggcggcgggcccaggaagcaggcggtggcgcggtccgtcaaggccgggttgcagttccccgtcggccgcatcgggcggttcctcaagaagggccgctacgcgcagcgcgtcggcatgggcgcccccgtctacctcgcctccgtcctcgagtacctcgccgccgagctgctggagctcgccgggaacgccgccaaggacaacaagaagtcccgcatcatcccgcgccacctgctgctcgccatccggaacgaccaggagctcggcaggctgctcgccggcgtcaccatcgcccacggcggcgtgctgcccaacatcaaccccgtgctgctccccaagaaggcggccgacaaggagcccaagtcgcccaag

SEQ ID NO: 6883 - DNA, 1195 bp, Triticum aestivum
  Clone ID: PAT_TA_6883
agctccgtagtttttatatgctgtattttgtaggccaacataatcgggatgggcttttgttagatgatgttagaaatgcagcattatgtgcaggtgatgttagacttcaatttacataatagtcacattatgtactccagatgcaggagatcaagtacctgtacattcacggcgaaacccctgcacccggagactatgtacatgaactacgcaacctataccgctacgcacgaaagaatcaacaagtgtatcaccagccaagaatgccgcagtatgcctcactatacacgggtgctcaagccttcaaagcgttggcgttggatcagacacttgaacagtctgaccattcaaccggctccagcaaggttgtcccttcccgtcagtgtccatccttagggtatcgcctcgtttgtactgcccagagagaattgcttcgctgatgacatcctcaaccaactgaagtgacggcccttctaagtggcctgcgcaccatagctcttgtcgtatccttgctgagaaaccatgttcttcatggcatcagatactactaagccgataccaagcgccaacagcctacccttcacctcttccagaattatattaagaatagccagcatctcagtcttctccagtggacggaacacaaccacctcatccattctattgagcaattcaggtcgaaaaaatgccttcaactcttccattaccaaggatttcattacagcatatgtgttctcttctgtatcattctgcgtctggaaacccatgctcatcgttcctttggaaatcgatgtagaaccaacatttgatgtcatgacgattaatgtattcttgaaggaaactctgcggccctgtgagtccgtcaaatgaccatcttcaaacacttggagaagaatattgaaaatatcaggatgagctttctctatttcatcaaacaataccacagtgaatggttttcttctgactgcttctgtcaaagtaccaccttcaccaaatcccatgtaccctggaggagagcctatcagcttgctcacagcatgccgctccatgtactcactcatatccaatctacacatagccgactcagatccaaaataagttgatgctagagctttagttaattcagtctttccaactcctgttggaccacagaaaagtagagccgcaataggtctgtcctcgtgccgaattctta

SEQ ID NO: 6884 - DNA, 402 bp, Triticum aestivum
  Clone ID: PAT_TA_6884
cgtccgcaggcagcctcgggtcggttcgagcagccgacacctgccacccgcgccgccgccgccgccgccgctagggcttcctccctccacgccgcccgcgatcgccgccgccgccggcggcgggggagatggcggaccggctcacgcggatcgccatcgtcaacgacgaccgctgcaagcccaagaagtgccgccaggagtgcaagaagagctgccccgtcgtcaagaccgggaagttgtgcattgaagttggtccggcgtccaaggtttccttcatctctgaagagctgtgcattggttgtggtatttgtgtcaagaaatgcccatttgatgccatcgagatcatcaacctcccaaaagatctggaaaaggataccacccatcgctatgggcccaatacat

SEQ ID NO: 6885 - DNA, 510 bp, Triticum aestivum
  unsure (1)..(510): unsure at all n locations
  Clone ID: PAT_TA_6885
nagcatcttgacattacatttagaagagacccgaccaactataggccacgaatcaacaaactcgaatcaacgaaggacagagaacaaaagaatgcagggtcctactactacctagatgactaatgagaggggccagcgcaggttgctacaatttggtattggttaatggctccacgtatcctgttcttgattgtttagtgagtttgtttctttttgggctcctttgtagattcttgttggacgtcaataatgttccgaatcctttctggatcatgcgcaaggctaacgagaagttgccatgacgtgcgtccatgagacgtgcgaattggccacaggagtgaagcgcatcgagtgtggtgcttgggtttcaaagaagcgcatgtgttgaaactgtactttttgttggtttgagctgtggggagaacgattatcaattttcttgtatttgcattgctgtatcatggctttaccatctcatattgttctatcgtgaaatcttataatgcnnaa

SEQ ID NO: 6886 - DNA, 2344 bp, Triticum aestivum
  Clone ID: PAT_TA_6886
ggttccatccgttccacagcctccgctggtttgcgcactcgagcctgcggtcttcccgctggccaccccactgccacgcgaccacagtgatataccctcctccccgccgccgcttccacgcctaactctagtgccgccgccagtggtagcgctctgccccctccagcggaaatctctttggacggggcggcgaatacggggagtcgccgcagatggcggaccgtttgacccgtatcgcgatcgtgagcgaggataagtgcaagcccaagaagtgccgccaggagtgcaagaagagctgccccgttgtcaagaccggaaagctttgcattgaagttagtccagcggccaaacttgcattcatttctgaagagctgtgtattggttgtggtatttgtgttaagaaatgcccatttgatgccattgaaatcatcaatcttccaaaagatttggagaaagatactacccatcgctatggaccgaataccttcaaattgcacaggttgcctgttccaagacctggtcaagttttgggtcttgttggaaccaatggaattgggaagtcaacagcacttaaagtcttagctggcaagctgaagcccaatctgggacgattcaaaaatccacctgactggcaagagatccttacatatttccgtgggtctgaacttcagaactattttacgcgcatattggaggataacctgaaggcaatcatcaagccgcagtatgttgaccatattccaaaagctgttcaaggaaatgtagggcaagtacttgagcagaaagatgagcgggatatgaaaaatgagctgtgcgttgaccttgaattgaaccaagttattgacagaaatgtaggagatctgtctggtggcgagcttcagagatttgcaatagcagttgttgctgtacaaagtgcggaaatttacatgtttgatgagccatcaagttatttggacgttaaacagaggcttaaggctgcccgagtcattaggtctttgcttagatcaaacagctatgtcattgttgtcgaacatgacttgagtgtcttagattacttgtccgactttatttgctgcttatatgggaagccaggtgcttacggtgtagttacgttaccattttctgtccgagaaggtatcaatattttcctggctggatttgttccaacagaaaaccttcggtttcgagatgaatctcttacatttaagattgcggagacccaggaaagcgcagaggaagttgctacgtaccagcggtacaagtaccctaccatgagcaaaacacagggaaatttcaagctctctgttgttgagggtgaattcactgattctcagattgttgtgatgcttggtgagaacggcacagggaaaactacattcatcagaatgctggccgggttgttgaagccagataccatggaaggaagcgaggttgaaattcctgaattaaatgtgtcctacaagcctcaaaagatcagcccaaaattccagcatccagtgaggcacttgctccattcgaaaatacgcgaattcatatactcatcctcagtttgtatctgatgttatgaaaccactacaaattgagcaactcatggaccaggaagttattaatttatcaggtggagagctccagagagtagcattatgtttgtgccttggaaagcctgcagatatttatttaattgatgagccaagtgcatatctcgattcagagcagcgtattgttgcctcgaaggttatcaaaagattcatccttcatgcaaagaaaactgcatttattgtggagcatgatttcattatggcaacctacttagcggacaaggttattgtttatgagggacttgcttctattgactgtactgccaatgcaccacagtctttggtatctgggatgaataaattcttatcgcatcttgacattacatttagaagagacccgaccaactacaggccacgaatcaacaaactggaatctactaaggacagagaacaaaagaatgcagggtcctactactacctagatgactagtgagagggggcacacagattcttgttggacgtcaataatgttttgaacccttccggatcatgcgcgaggctaacgagaacttgccatgacgtgtgtccatgagacatgtgaattggccacaggagtgaagtgcatcgagtgtggtgcttgggtttcaaagaagtgcatgtgttgaaactgtattttttgttggtttgagctgtggggagaacgattatcagttttcttgtatttgcattgctgtatcatggctttaccatctcatattgttttatcgtgaaatcttataatgcatattcttttggagcttaaaacc

SEQ ID NO: 6887 - DNA, 1077 bp, Triticum aestivum
  Clone ID: PAT_TA_6887
ggccgtcccacccacaagccaccgatcgcaaccgccctctgtcctctccacctcctcgccaccaccttggcatcagtgcctctccctcccccctctccctgcaacttttcccctcatctcgttggaatccatggcgtccaagtccgcggtcaccccaggtgggcagcccaagggcaaggaggagccctcctccatggcggacgtgtacaaccacgagctgacgccgctgcagaagcacgtccgccttcttcgaccggaacaaggcacggcgtcatccacccctcccgagacctacgaagggttccgcgcggatcgggtgcggcgtcgcgctgtccgcctttcagcgcccgtcttcatcaaccggaactcgctcgggtcccaagaccataccggagaacatgaaggttggagctttcaagtttccgatctacgtaaagaacatccacaagggcaagcatgggagcgattcgggcgtgtacgatgccaatggaaggtttgttcctgaaaagtatgaagagatattcaaaaagcatgctcacaccaggcctgatgcgctgacaggcaaagaactgaatgagttgcttcaagcaaacagggagcctaacgatttgaaaggacgagtgggtggcttcacggagtggaaagttctctactcgctgtgcaaagataaggagggatttcttcacaaggagaccgtcagggcaggctacgatggcagcctgtttgtgaagttggagcaagagaggaagcaagctaaagaatatgccaagaagaaatgatgaaaactatcccaataccctcttatttgtgattatgcgcaagtatgcgtaaattatggtgtgcttgagagtatggttctgtaaattaatgttgtgatttgatttcgtgtgtttgtttgtttgttcttttatggaatgagaattcaaagccctgtttatctagatattgcagttgtttgcaaattaggatgtttccaattacttataatcttaatgttggtgtttgttttatgtctccacaaacatacttcatgcaagaagttgcacaacaatatgcagcgtgcagcagcatcccctc

SEQ ID NO: 6888 - DNA, 1547 bp, Triticum aestivum
  Clone ID: PAT_TA_6888
gggtcgggtttgcgggtggaccgtggccgccgcacgctgcctcattctcacccccaccatctcctccccctccgccgcgctccggctcccccggatcgcccgccgccgcccgctctcctgctcggcctcgccgctcgccgtgttcgccaccatggactcgccgcccgagggctaccgcaccaacgtcggcatctgcctcgccgacccctccctcaccaagatcttctccgcgtccaggatcgacatccccaccgcgtggcagatgcctcagggtgggatagacccaggggaagagccgcgagcagctgccgttagggaattgggggaaggaaaccggtgttagatctgccgagatcgtcgccgaggccgtctcagagcgccccaattgttccccgcggatgtcaaagacaagctgaatgctaggtggggaacaaactggaagggccaggctcagaagtggtttctatttaggcttaccgggggtaggctgagaggggggatgaggagatcaacctgaggcgatggatccgagaagccggagttctccgaatgggcatggatgacccctcagcaagtgattgagaaggctgttgatttcaagaaacctgtctacgaggagacactgaagcacttcgccccatatctacagtcagatccaacagcttcgtcgtagatttcgcagcctcccacaggcttttcacttatctggggctgtgtcaattaataatttgtcgaaaagcgtcttggagtcgtcgagttgtacctgaggacgtctggcgtgtcagaacaccgactgctactcccggcattggatcccgttagcctgatcatgcgcaacgagatgcgtacgttgttgtcatcatcaaaaggagtatacggggtacaatacccataacatcctggctacagttcccttctaaaaaaaaaaaatagcatgcaacatggacgcgagcagggcctgatactttttggccaggagaaaacagcatcgctgctgctgtcgccgtggctcagatcaacaggtagtagagccttccttcttgagctgttattaagcgccgatcccggtggcgatggaaatgatcttccgtgtccttggggaccaaatgcctgaactgaagcgtcctggctgttggccatggccttttgctttgctttgctgtggcttggtgtgggagcacggaggacaatcaaggcctccacgctttgtaccgggtggtctctctccggcatgatattgtctgtgagtttgtcccagtgtcccgtggccgtgggaggaggagggattgcagtaatggcatgcgatgtggttaggtgagggaggtggatggatggggatcggcggcggcggcgtgcgtggagcatgggagctgttaaatgccgcccgttataaaggttggttgggtctcctcgccggcgggaaggaaagcagctgggcggagtcaatgtttcgctgtgcggccgacggtcgttggtggcctccttccgcctttcctttcctcatgaactgcccgtgccatgccgtggcctttaatttgtgccctttg

SEQ ID NO: 6889 - DNA, 1359 bp, Triticum aestivum
  unsure (1)..(1359): unsure at all n locations
  Clone ID: PAT_TA_6889
gccggccgttccgggaaacccccaaacgcggacttcctccctgagacgcacgcaccgcacctcaccgccccgcgtcgcgagatctcaaatccccgatccgaccccaccggcggcgatggccggcaaggagctgagcgacgagcaggttgcgtcgatgcgggaggccttctccctcttcgacactgacggcgacggccgcatcgccccctcggagctcggcgtcctcatgcgctccctgggtgggaacccgacgcaggcgcagctccgcgacatcaccgcccaggagaagctcacggcgcccttcgacttcaagcgattcctcgaactcatgcgcgcccacctccgcccggagccgttcgaccgcccgctccgcgacgccttccgcgtcctcgacaaggacgcgtcgggcaccgtctccgtcgcggacctccgccacgtcctcacctccatcggcgagaagctcgagccccatgagttcgacgagtggatccgcgaggtcgacgtcgccgcggacggcaccatccgctacgacgacttcatccgccgcatcgtcgccaagtagtggattgatccgtctcccagcctgctcagacttcttcgtatttaataactcctccttcgcgtgattttatttcgtatcatctgatctgatctgctgcgcttctgttttgtgctttggtttcgttgtggttccccaactgccctagggtttggataaaaatggtgtgattatggattaatggatctgtccgatggtattgcaatgtaaagcgtggatcctgttactttctgtgattgattagtggggtaacccattaaacccagtgaaaatgcgcctactttatgcattcatgttaaaacacgccagtttatgcatttattgtaaatacagccttcttataatttctgatgctagcacaggagaactgcatttattatggagttgtaggacctctgccgttggcataatttgtttttgccaggagggtcattcttgtttcacgttgatcggttaatatcatggggctgttgaaaggcctctcttgaatttattgtcacacaacaataaggttgttccatgatatacccgatacatgttgaaattgatcatgccatccaatcctatgggtcagttaccctacactattaagaactccgtccagttttggccggggtccattgaattgatcttttggtttggctacactcacatccccccgctggccttgccctctcttcgtaccttagggtccccctatgggttccccacgttggcatgcctgcgtttggccttccccggcttggtatccttcccgttcggatggggacatgggcccnggattaaantttaaggaaann

SEQ ID NO: 6890 - DNA, 806 bp, Triticum aestivum
  Clone ID: PAT_TA_6890
ccctctgccggcgtggctcacgtgcttgcatcaattatgcacgtcgagggaaggctatcccctatgtgaaagctcccagggatttcaccattgccgctttctcgggcccgggtggcccccctcttggccccggcaagcgagccaggacctggtggtttcggaggaccccgaatctctgatagtctctccatatcttgaggggtaaccttggtgctataagatctattcgctacacatcagatggtcagttcctgtcgatggcggagccggcagactttgtccacatctttgatgtcaaaagtgattataacaagaggcaagagctggatttctttggtgagatatctggcatgtctttcagccctgacacggacacgctcttcgtcggtgtttgggacaggacctacggcagcctacttcagtatggccgcctctataactactcataccttgactcgctgttctaaggtcaatgcaaacaagtgttggttgggcctcttgtgtgtcacttctgccgattttcgtcggcgccgactattaggtactccataatcagatttatgttatagattggtcattctttaataattcatgtatcctgtgttatgtgtacaaaagaaatgtatacagatatagctttgctttgaggtaggagttgtaagttatgtttctagggctagtttgctccatgaatctggatgtaaacttttacctgagatgtgtaccttgaacatctcctgcactgaccgaaactggtatgctttcggtggtatgtgctaagccgcagttgtgtggagcagtttgga

SEQ ID NO: 6891 - DNA, 738 bp, Triticum aestivum
  Clone ID: PAT_TA_6891
cgaaattcttgataaacttattatatttatacatcacgtgagaaagaaaataatattccatcacagacaacacacaacaattataataccatcgacagaagcatcttgctgcatggcaactaataagatacaacaatagaaattgcgcatgtgtaggccccaacggcggtggtgtgcctctgatgcctccgaccgtgtggtgactatgggagaagctcgctcacctcatccactatgcgcttcatcacccggtgcacgtcgccaatgactcgccacatccttgccagcatttggaggagtcgcagatgacaactaccctccgggacacgtctttgacaaaggcgacggtgatgttgagcttggtccggagattcctgatggtagccctggtcctctcgatggtgaacggctctgcaccgttggcatcctaggtcctcagttgcgtgcactttttctcatacagcagcggaacgcactccccttcctgcgtacccatgcatatcttttccttgaagtaagtgcacgcattacccgagagacacccatctgataagcatatccattgggaaacctcactactgagacgtcaaagctctaatgtccagactgtgaaacttcacccaaagactcatgccggtcccccaatgtgcgcacgacaactagagcacacccaactccgccaaaaattcccccttcctccccataagcagttaagaactatcttagaactgacattgc

SEQ ID NO: 6892 - DNA, 1222 bp, Triticum aestivum
  Clone ID: PAT_TA_6892
tgctcctttggcaatccatttcgaacgcacacccccagcaagtcttgtcctctacgatgggttgcctacatgaaatgtgcttcccttgcccaacgtggatccatatggatacaacatagtacatacattctccatacatacgctggctggtctcaacctaacctgacctactacacaagaacatggtgcacaggatagctagcacaagacaagacaacctatggcatgcgtgcgtgtctccctcatggtctgcctaggaccgctccaccacagccttgagtgcatctccggctgtcacccccagcgccgcgaaagcggaacgcaacgtcaacctctgcggatcgtacaccgaaagagagaagtgttgttaattcagttacagctactcctgtggtagctcctaatgataagacttcttaacccatcaccaattcatctattaaagctgccttgtcaagcaaaaccactgttacggagtccaaacgcaatcccgatgctcgggcccgcgctcccaccggcgcatgtcgcacatcggcacttgcagctgcaccccccgttaacccaaactatatctcaaactcggtctctggagttccaactggtgtacctcgacgccccacacttccgcttcctggccgcctctgagccttcccgaccgccctgcatcatggtgcacgggataggtagcacaagacaagacaacctctgcgcatgcgtgcgtgtctccctcatggtctctccaggaccgacgccaggtctgcctaggaccgctccaccacagccttgagtgcatgtccggctgtcaccctcagcggcacgaaatctgatagaaacttgtgccggcgcgccctgctcacctccctcggccgccttccgggggtgggggtccccggccgcgccgcccggcctctcgctgggcctcccctcgcccgccccgcctggcgcctccccctgcccctgctggcgcgggggccgggcccggggcttgcccgcttcgccggccgcctcctcccgccccggccgccgcccccgcgccgccgcctcgccgcccttcttctccttcttctttggggccgccgccgtgtcccccttctccttctccttcttctggttcgccggcttgtcccccttctccttcttctccgggggcgccgcaatctcccccttctccttcttcttcttcttggtagcagctttctccccaagtccttctcggacgcgt

SEQ ID NO: 6893 - DNA, 449 bp, Triticum aestivum
  unsure (1)..(449): unsure at all n locations
  Clone ID: PAT_TA_6893
nnnacagcaagcatcacttctttttctctcaactttttcaaagatcacacacacattccttgtctctcctcctctccgcctaatccccggggcattcttacaacccagaattaaccagctacaacgtgagaagagaagacactggaaccggttcttcttcttcctcctcttcttcttcctcttacctctgaccctaattaataacaagacataattaagcaagcatggtagcacaaagcattacatatccttaattcggacgtaatcttctcttgcatgttgcatcttccagctccaaggagcttaagcaaggttcatgcccgcatggtcgcctatcgatcggtgtcgaagaagctcttgccttcgagcttcctctgcctcttcaccctagcgatgaagtcgtccaccctcttctccagctcctcctctccctgctcccccacgcgtgg

SEQ ID NO: 6894 - DNA, 539 bp, Triticum aestivum
  Clone ID: PAT_TA_6894
cgtccgggagcaaatacaagtggttaatttcaatgtggagtcactccaagcaattgcacaagagatgagggatggaaatgttgagctaaaggagactatcaagaatcatgatggcgtgaaagcgttgtatgttgagaatctgatgcagctggagagaacgatggagaaaaatgctcatttggagagatctttgtcagctgctaccaccgaggttgcaggattgagacagaataaggccacactggaagaatcttgcaaacagcttagctccaagattaatggctaccagtctgagcgagccatgttcattgcgcggattgagggaatttctcataccatggagaagctatcagagaagaacgtgtttttggaaaatttattatctgaaaactatactgagcttgaaaaccataggatgaagcttaaagacttggaagagtctgcacaggcactccgcaatcaaaattctttacttcgatctgacaagagaactcttgtgcaggaggtggatagcatcaatggtgccttacttgatttgg

SEQ ID NO: 6895 - DNA, 488 bp, Triticum aestivum
  Clone ID: PAT_TA_6895
gttttttttttttttttttagtctcaactcctgtttttttcttgagaattcgaccctacagggaacaaactccctcagttctcacatctcatacatcgccaaaagacacatagtgacactgatatttgacccgagagtcaaacaagaaggacactgacactaccggactaacttcaccttgacacgcagcgaccactaggactcactctcactcaccatggacagacactgctcatcttcttctcctcctgattggaatgaactgaaattcttcagtcgacctcctccatcttgctctcctcggcgccctcctcctccagcgcgggcatgtcagcatcctcctcctccgcatcggcctgatcatcgatgttgagcccgagcttgagcatgcggtggatcctggcggcgaaggtgttggggtcgtcgaggctgaacccggaggtgagcagcgccgtccacccgtactcgccggtcaccaggcagcacgg

SEQ ID NO: 6896 - DNA, 1044 bp, Triticum aestivum
  unsure (1)..(1044): unsure at all n locations
  Clone ID: PAT_TA_6896
ttttttttttttttttttttttttttggcaaaaccaatgttccactgggtacgagnagtgaattaatcaaaactgggatgtgaatcgaccacagttacaacacaggcgaatgccggcaggcatatgttacatgtccttcccacaggggaaggatgcaagacatacttgtttacaagtatactcctcagacctagctaggccgcaacgcaaaccgtatcgctgcaacccgtagaaaaaagaagttacaacgagacaagcatgctctccgttgcgccagatgacttctcttgcactcgtgctcccgacgggtctggcttgtgtacccggatgccgctcaagatatacccaccaaacgcgttcatctgcatgtgtgggtggctgcgcgatggaaggacctgatactctcgaagccagggttcagttatctgtaacccaatagccattttcgatacttgcaaactatgcatgcaagtcgcaagaggctgaagatactggtgataaatggcaaacggggccgagtaagacaagagtggaagcaaatcagcaaccacactctccacctcgtgccccggagcagcgacaatcaaactgctaaagccatgttctccccaatatttcatcctctccggtgagggtgcttttcctgctctcggtgctttgggagctattgaattgccattacttcctttgcaatccggcatagaaatgccaccttgattaaggtgctcatccgcaggctcaggggcctctatatcaattgggatgtcaccttgattaaggtgctcatccgttgcaggctcaggggcccctataacaattggctgcgctgtcgttgactgcgcattcccatctgatacttctgtatcagatggtttttccagggatgactgaagactctcgtctggtactccactaggttcgaccgcatcaccttgaacgctaccaggagcattgccagaacttttcaaggagcacaggtcgctaagtggtgcctggaaaatcctgctggtcatctcgctgtccaaattatacattcttattatg

SEQ ID NO: 6897 - DNA, 695 bp, Triticum aestivum
  unsure (1)..(695): unsure at all n locations
  Clone ID: PAT_TA_6897
gatttgcggcagctacggggtcactttcgccgccgtcggagggctctacatcggcgtggagcagattgtgcagagccagcgcaagaagcgcgacttcgtcaacggggccatcggcgccttcgtctccggcgccaccgtctatggctacagaggaaagagcattaagtctgccctcatcggtggttctagcctggcattcacatctgccattctggacgttggcggtaacactaccagagtggacaatggcaaagcgtaccatgcatacacaacggaaaagaagcccgagcctgcgcattgatcaaggttgtctacttgtagcacaaatcatgcaaaccagctcggtgaatttttgagctgatgtgtgctgttatgtctgttttgctgatgcacctagttcctttgcaaagctgtagtaacttgttttgctcgagggcaatacaacagacctggaataaatatcttgctttattttgcttcatcattggttacgataataatcacatgtgacacaatattgttaccccaacccttgattgaagttgcggttttacgaaatttgttctattgcttcaagcatcaaacaaagagtcagaaagtctatatttctgttttgtagttgctgaactaatgctgtgttcgaactttatgatgatttcacattcangcttgtgtaatattcatactttagtatc

SEQ ID NO: 6898 - DNA, 1045 bp, Triticum aestivum
  unsure (1)..(1045): unsure at all n locations
  Clone ID: PAT_TA_6898
attctagggtcgacgggcgcggctggacgccaggtcccacgacgcgatcccctctcccgtctccacccccaactcctcccttccgccccgaaaatcccaaccatttctccgcctccgcctcggcacgcggccgccggcacacgctgcgcaggaagtgggaaagggcgcgatggaggatgactcgccagcgacgaagacggtgaagggcgccgtaacgggcctggccgcgggcaccatctggggcaccatcgtcgccacctggtacgacgtgccccgggtggaagcgccacgtcgcgctcccgggcctcgtccggacgctcaagatgtgcggcagctacggggtcactttcgccgccgtcggagggctctacatcggcgtggagcagattgtgcagagccagcgcaagaagcgcgacttcgtcaacggagccatcggcgccttcgtctccggcgccaccgtttatggctacagaggaaagagcattaagtctgccctcatcggtggttctagcctggcattcacatctgccatcctggacgttggtggtaatactaccagagtggacaatggaaaagcgtaccatgcatacacaacggaaaagaagcccgagcctgcgcagtgcccaacggttcgtctacttgtagcacaaatcatgcaaaccagctcggtgaatttttgagctgatgcgtgctgttatgtctgttttgctgatgcacctagttcctttgcagaacctgtagtaacttgttttgctctgggcaatacaacagacctggaataaatatcttgcttaattttgctaattcatatgttactataataagctccataaaaagatactattttaatcacatgtgacacaatatttggttacccaaccccttggactcaagttgcggtcccaaaccctttgttcaagttgcggttttacgaaatttggtctattgcttcaagcatcaaaaaaagggacacgatgcacttccccctggagccgacttttaccccggaactttaatgatgaattttaccngtccancctttggg

SEQ ID NO: 6899 - DNA, 902 bp, Triticum aestivum
  Clone ID: PAT_TA_6899
tttttttttggaccccgaaggccctaccattggttaaggggggaaaggccaaccggaattcacaccagttaagggtccacctttctcttgatgatggctccttcctgttccacgggttacagattactgcataacaaggaaaaccaaatcctccccgctttctgggtgccggcgggaccgggggatggtgcagacccgctcctttgggtgcctcgggccgggggtggtgcagcctccctaacatggcatttgtaaaaaggggtgtacatcggattcgaccctgtgcatccaggtcgcagattattttcctccggatccttcagcttctccgtcgcagactattttcctccggctcagaaggattctgtaacttcttcatctttagatcataatcccacattcgccgctcaacttcagatcgtgacaccatactctcaccggtgccaataaattttgctaaatcatccgaaagtacaaggggcgcaagaagaccagaagtagacccagaggatccacctttttgcttgtttccttcacttctgtctctcttttgaggcttccctttgggtgtcgacttctctttgggtgtcgacttctctttgggtgagacgggaccatcagaatccaatggccaaatgtgcttggtcaaagctttattcatttggaacatatcaattgaattgacgttaaaaatcttcttcagattatcatcacacagaatcttcctcctattgcttgggtcttgcaaattattttctcgaatatatgcccaaagcttcttgacaacctctgtcctggcacactcagaggcaccgacaaactcttgaagtgctggggaaatgctgcataattttgtaaagccaccagcctttttcttgccatcacccaaccgccgcttcttc

SEQ ID NO: 6900 - DNA, 2343 bp, Triticum aestivum
  unsure (1)..(2343): unsure at all n locations
  Clone ID: PAT_TA_6900
gcacgaggatcgcgcggcggatcgaggcggaggagaccgggctggacacggcggagatggtggtcaccagcaccaagcaggagatcgaggagcagtggggcctctacgacggcttcgacctcatggtggagcgcaagctccgcgtccgccagcgccgcggcgtcagcagcctcggccgctacatgccgcgcatggccgtcatcccgcccggcatggacttcagcttcgtcgacacccaggacaccgccgacggggacggcgccgacctccagatgctcatcgaccccgtcaaggccaacaaggctctgccccccatttggtcagaggtgctgaggttcttcaccaacccgcacaagccgatgatcttggcgctgtcgcggccggaccccaagaagaatgtcaccacgctgctcaaggcgtacggcgagagccgaaagctccgggagctcgccaacctgacgctgatactggggaacagagatgacatcgacgacatggccggcggcggcggcacggtgctcacggcggtgctgaagctcatcgaccgctacgacctctacggccaggtggcttatcccaagcaccacaagcagacggacgtgcctcacatctaccgcctcgccgccaagaccaagggagtgttcatcaacccggctcttgtagagccgttcggcctcacaatcatcgaggccgccgcttatggtctgcccgtggtggccaccaagaacggcgggccggtggacatcctcaaggcgcttcacaacggcctgctggtggacccgcactccgccgaggcgatcaccggcgcgctgctcagcctgctggccgacaaggggcagtggctggagagccgacgcaacggcctgcgcaacatccaccgcttctcgtggccgcaccactgccgcctctacctctcccacgtcgccgcctactgcgaccacccgtcgccgcaccagcggctccgcgtccctggcgtcccgtctgcctcggcgagcatgggcggtgacgactccctctcggactcactccgtggcctctcgctccaaatctccgtggacgcctccaacgacctcaatgccggggactcggccgcgctgatcatggacgccctacgccgccgcccggcggccgacaagcgcgagggtccggcaaggcgttgggctccgcgccgggaaagagcaagaggctcctcgtcgtcgccgtcgactgctacggcgatgacggcaagcccgacgtcgagcaactgaagaaacccctcgccgcggcccgctccgccggcggcggcccgggggggcgcccgcgcggcgtcctcccggccgccaggcccatccccgggaccccggaggcgcccaaggcctgcggcgccgacccggccggcttcgacgcgctgatttgcagcagcggcgcggagatatgctacccgtggaaggagctcacggccgacgaggagtactcgggccacgtggcgttccggtggcccggcgaccacgtgaaaaccgtcgtgccgaggctcgggaaggctgaggacgcgcaggcgtccgacctcgccgtcgatgtgtccgccggctccgtgcactgccacgcctacgccgccaccgacgcgtccaaggtgaagaaggtggattcgatcaggcaggcgctgcggatgcgcgggttccggtgcaacctcgtctacacgcgcgcctgcacgcgcctcaacgtcatccctctctccgcttcccgcccacgcgccttgaggtacctgtcgatacagtggggcatcgatctcgccaaggtggcggtgctcgtcggcgagaccggggacaccgaccgggagaagctcctcccggggctgcacaggacgctgatcctgccggggatggtctcacgcggcagcgagcagctcgtccgcggcgaggacgggtacgccacgcaggacgtcgtggccatggactcccccaacatcgtcacgctcgctcaaggccaggctgtctccgaccttctcaaggccatgtgagagagcacaactcgtacgtaatgtaattttggcaggaagatgactgcagaatttgcatacaaggtagtataaatttatggatgtgcaagcatgagcaaacatgtggcaaataattttttatgtcttagcatgcctccctgaggtctgttgtacatatatatacactttataaatgaatagtatataagacttggaggatactaaatctcaaaaaaggctttggttaatatttgagcctctcacgtgttcgtgactcagtagacgacacggaaatttcctattgacaccgnacccccgccanccccctngccccggtgnctaaaagggggaatttgggcccgaatccg

SEQ ID NO: 6901 - DNA, 746 bp, Triticum aestivum
  Clone ID: PAT_TA_6901
tagctttacaaaaaggatggagtactcttgctactccatctagctaccatcctgccacatactccggcccctcgcctcctcgcacgccgccctctccacctcgcttacccggctctgcaacctccgcagccccagccccaaccccagcgccgcctcctccttgcctcaccgtgacccgcctcagcatcgtcatcgttgtcgacgaccaacaaggggtctggagctcgggcagaagctgcgacaacagatccttgcgtcgcttcagggtcagcttcttgtagttcaggcaccggcacatcgacccccgctccctggacaacatcagcatgaggtgtgccttccacaacaaacaatgggtttggagcttgggcgtccgctgccacaacgggtccttgcacacctccacggtcagcttctcgtacttcaggcaccaacacatcaccccccactccatggacgtcagcatggcgtgtgccttcgatgacaaacaaggggttcggagcttgggcggccgctgcaacaacaggtccttgcaagcctccagggtcagcctctcgtagttgagtctcccctgctccctgcgccgccgcctggcgtgtccccgcttgcgcatcggctcccccttcagggccgcgctcgccgtctgtggctgcctctcgctgtctccgcacctgctcgtctttccccctcacctgggcctcagcttgggcgtcacccgcagattggtaccacgattgctaattttt

SEQ ID NO: 6902 - DNA, 709 bp, Triticum aestivum
  unsure (1)..(709): unsure at all n locations
  Clone ID: PAT_TA_6902
ggagagccaagcacctgaggacccgcagacttcccggttcacctggacgatagagaacttcaccagggtcagcgggaagaagcactactcggatgtgtttgtcgttgggggatttaaatggcgtgtgctaatttgggggggggaaataatgtggaccatctctcgatgtacttggatgtggggggggggggggaacctcccttacggatggagccggtatgctcagttcagcctanccattgtaaaccagatccatcagaagtatacagcacgcaaagatactcaacatcagtttaatgcacgtgagagtgactggggtttcacatcttttatgcctctgagtgagttgtatgacccaagtaggggctatctcgtgaatgatactgttgttgttgaagctgaggttgctgttcgcaaaatgatcgactattggacttatgactcgaaaaaggaaacaggttatgttggtctcaagaatcagggtgctacctgttatatgaactctcttctgcaaaccctgtatcatataccttactttcggaaggctgtatatcacatgccaactactgagaatgacatgccatctgggagtattcctttagccctgcagagccttttttacaagctccagtatagcgacaatagtgtagctacaaaagagttgactaaatctttcgggtgggacacctatgattctttcatgcagcat

SEQ ID NO: 6903 - DNA, 570 bp, Triticum aestivum
  Clone ID: PAT_TA_6903
ccccggcggcgacccggccatgggcccccagccggcccccgtgctcgtggccctcagcccccccgccatcgccgtcggcaacctcgcggccgccggggcaatggtgaagcgcacggtgaagaacgttggctccccgtgcaagtacaaggcgatggtgcgccagccggctggcgtgcatgtgacggtgagccccgacgtgatggagtttgggaagaagggggaggagaagacgttcgaggtcaagttcgagaccaagaacgccaagctggccaagaactacgcgtttggcgcgctcatatggagcaacggtgtccagttcgtgaagagccccatcgttgtcaagacggcggcatgaaagggcaaccgggtaaaattatatcgatcgggtgttggcgtttgattagcttaggaatcaatcatatcgagcgttaggatttccattagcttaggaattaagccactgtagagagaaacagacacgcatatgttatttaggtctttattaggcctgtggaacaataatcaagtgaaggggaataaagtggttagtagttcttcgcaaaaaaaaaa

SEQ ID NO: 6904 - DNA, 720 bp, Triticum aestivum
  unsure (1)..(720): unsure at all n locations
  Clone ID: PAT_TA_6904
caaagcaccaggacactaggaacttcaaagcactagaaacaggagacctgatcaaatttggatgaaacaaataattagacaagcaagagtaactcatcaaagtacacaacaaccaaatgtcaacatcagcattcaaagggatcagctacagacaaatcccgcacatgcttgatgtcctcaagtttgcggagnacatttatcctttgtgaaaacaaattgagcacctctggaagccctgttcccaagctgaagcaacctatgctgcctttcaatgaacttttcacagcaccagccttgaacctcaaactgtaataactctagcattttagcattcaggacaaagagcatggcaaagttaacttctgacatgatgcctcgataatttgccaacactactttcttgagacggatgtcaaggcatctgatgtgactctggtgtttacgacaccacaaactctttctccctgacgaacgtatcaggatatacaacttctccaagcagggaaagcaactcatgagatcaataaccatatccacacagagaggaagaacagagatagataaagtcttgacagtgtgtaccaccattgggaacagagtaggaaatcccttaaagctgaggccgtaagagtcatcgtaacgatggcagcccatggtctncaggttgggcgctgatattatcgatatgtccaagcccgtagttatgttgagttggagcaa

SEQ ID NO: 6905 - DNA, 832 bp, Triticum aestivum
  Clone ID: PAT_TA_6905
tggaggtccggacgaacggcgcacgcgcacgaacggactcccccgagctctggactcgaccgcgcggggagaggggatgagtgccggggatcccgccggcgatgcggggcccagctcccgcggcggcggccgggccgcgcgtccgcggcggttcccgacggcggcgcagccggaggtcatgcgcgcggcggagaaggacgacagctacgccgcccacgtcaccgaggcctgccgcgacgccttccgccacctcttcggtaccagggttgccgttgcttaccagaacgagataaaattgcttgggcagtccctatattacttgctaacaactggttcaggccagcaaacactcggagaagaatattgtgatatatctcaggttgcaacctcacatgggcttccgccgacacctgctaggcggatgcttttcattttgtatcaaactactgtgccctatctcgctgaaagaatcagttcgagaattgtctcccgtggtatttacatggatgacactcagcttgataatcatcatgaaagtgacaatcctagtagaggcataacagaatcctctacaaatacgaatgagtcttcgagaagcttgagtttctctatgctctcgaggttgagaagcaaagcgcatgccttttggctatgggtagttcagaaatggccttcgatgctgccgcttggtcaagattttatacagttggctatacggacaaacctgatgttcttctactttgaaggattatattatcatttttcaaagcgaggagctggtattcattatgtgttcattggtaagccaatgaatcagaggcccaggtaccaa

SEQ ID NO: 6906 - DNA, 611 bp, Triticum aestivum
  Clone ID: PAT_TA_6906
caaccacaaaattaaaattttgtcatctcatctctcatggtcacgggtaacattgcgtcctcgccggtctacctgctttccaccccccccgcacgctcgtaccttacccccctcgccttcctccttccccaccgccccccgcagcgccccaccgcagcccacgcccctcccctcgtctcccctcctgcgttcccgagggttgcctctacccggtcgtaacgctctcgcgcctcacttcttcacctcctcgtactccgcctccggcgcctcgccgccaccaccaccaccctgctgcgaccccggctcaccgccgccagacatgtgctgcccgatcttggacacggcccggttggccgcgtccatcttggccttgatcttctcggcgtcgtccgaggccatctcggcgcggagctccgcgacggccgcctcgatctccgacaccacctccgcggggaccttgtcccggtactcgcccaggctcttctccacgctgtagacggtggtgtccgcggcgttccgcacgtcgatcagggccttgcgctcctggtccttgtgcgagtgcacctcagcctcctgcaccatcttctggatctccgccttcgacaggccgc

SEQ ID NO: 6907 - DNA, 666 bp, Triticum aestivum
  unsure (1)..(666): unsure at all n locations
  Clone ID: PAT_TA_6907
acataaccccttttcattcagccgtgtattattctctacaattttattctgcataccatggnacatggcacagtaaatcctgtaagaaacaaacaaattttactaaatggcaccgagtacgggtgcggttcatgccctaatcacaagctcatatacattgctattgttctctctgctaaggcgctttagtgcctcgaaacttctccggcttcccaaaaaatctattcttttgaatgctactacaaagcctcgttctgcgcattcagcgcttgcgtacagggaacgaagccgatcggcatgccgtgaatccgtgtgcagggctacattgatctcgtcggtagacatgttctcctgggtagaaattgtagatgtgatccaacacttgttcgcgtgtgaagccaccattgctgaagaatgtccttgaagaaggtccaagctcgccaaaacgatcgggagggaagagtatggtaaagaaatggttcttaaaaatcacctcacttctctcactttctcttagcgggcgagacaaattatcagctgagtggtctcgatcctttccatccccatctgcaccaaaataggtagtgctttgctgctcatcggcatcttcagaccatgaagaatccatataaatacttgcagatgaaaccggctcagatattgtcc

SEQ ID NO: 6908 - DNA, 403 bp, Triticum aestivum
  Clone ID: PAT_TA_6908
gatctaatgagcgacaagtctgtcatactgatggtgagcagagtgactccttcaacgggcgttccagctcatcgcgatccggcttctgctactgcacgccgtggaggtacacatggttctccgtcttctcgaagttccatggcacatgctccctcccgaatccctggaacgagttcatgtccacgtacagcccccgtccgacctcttttagcagattcttctatttgggcaagctccttctgtgcttctgctgccctctcctctccgtcttcgccctcaccttcggtgcgtttgcgccctggccggccgtggtgggcgcgtcttcccccgttgtgtcgacgtcctggccggtctcagctggcaacaagcccaggctgtggccgttgtagtggaagaagaggag

SEQ ID NO: 6909 - DNA, 692 bp, Triticum aestivum
  Clone ID: PAT_TA_6909
gctggtggcctctgacattgaaaatggtttgcaagttccggtgttcctctacgcagcagcacaccccaccagcaagagttgtcagtgcggtccggcgtgagctcggctactacgggccaaatcacaacggcatccaatggacaggacaagtgctccctgatactctaccagtgaagccagatgtgggcccagctcatgtttctagtaaaagaggcgccaccatggtcggagctaaacctttcgtcgagagctacaatgtgccgatattctgcaaggatgtcccgaccgtgagaaggatcacccgaagggtgaccggacggagcggagggttcccgacggtgcaggcgctcgctctcttccatggcgacaactgcacggagattgcgtgcttgctggatccagaccatgttggtgccgatcaggttcagtggctggtggagcagattgcagaagagcaagggcttgaggtcgacaagggttatttcaccgacctgtccaaggacatgatgctggaaaggtacttcgagatggtttctgcagctgattgacatgtgcataattttcttattgtgatcaggcatgtctgcacttccatgtatgctgctgtttaaactgtggcactaactggaccccagaccgaccaattccaatattttgtatatacttaataaaatcggcactggagatggtct

SEQ ID NO: 6910 - DNA, 741 bp, Triticum aestivum
  unsure (1)..(741): unsure at all n locations
  Clone ID: PAT_TA_6910
ggagagcagccaagcgagcgtcatgcatttattgaatatgcaggccaaaattccattcgcgttcactcacagatctcaacgtgcgccgccggcgcgctcacgccatgcgcgccgctcacctcaccaagaacgcaaactacagctctatcttctctgctaattagattctacagacagaacacgcggagaaaatcctaggagaaaatctgacgaccaaaattggccccgcgtcccgcagaggggacacgggtgcgcgcggcgccgcgccgcgcctacgacgcgtccgcgtttcgcggttcccccgcgtcggcgtttacggcggggaacgcgaacggcctggcgctggcgaggaaggacggcaagtcgtcaccggccatgatgacgacgaccttgggctccctgtcgagcggcgccatcccgcgcgccgacgcgtcctcgccggcgctcccccgccgcgacgacgacccggacggcttgctgtccgtgcagacgaggacgagcagcgccacggcgatgatccccatcatgagcgcgaagccgaggaggaggtacggcgtcggcgtcctccagaacgccgggtgcgcgccgtggccgaccgccaccatcgcctcgcctgctctgatcggcctcatgacgaacgatggagcacacggatcgatccctcttctcctgtctttctcttgtctgtttcgtcctctctgtgtgcgtacagcaagcagagcggtgtttnctcgctgttnc

SEQ ID NO: 6911 - DNA, 1600 bp, Triticum aestivum
  Clone ID: PAT_TA_6911
ttccgcgcgagggagagagagagagggagaggggagctgaaggcataggagagcaagcacaccgaccaggcaaacgtgaaggcgaagctcagcaccatgcactcgaaggtgatctgttgcaagctctacatctctgaaagccaaaatgcggcggttgtcgacgccatcagccgcataggccagaaagaccctgaggtggttctactcaacaagttcgaggatgagtactacaaccgtgtccgctacacgcttgtctcctacatcaccaacgaaagctcgactggtggagctgtatttagcccaatcaggaaggtactgctggcgatgatcgaggctgcattttcagccataaacctcgaagtgcactgtggaactcatccaaggattggtgtcgtcgatgacatttcattccaccccttgaatcaagcggacacaatagaggatgctgctcagctggctaagctggtagcctctgacattggcaatggcttgcaagttccggtgttcctatatgcggcagcacaccccaccagcaagagcgtcagtgcagtccggcgtgagctcggctacttccggccaaaccacaagggcgtccaatgggcaggccaggtgctccctgatactctaccgatgaagccagatgtgggcccagttcacgttcctcgtgaaagaggcgccaccatggtcggagctcaacctttggtcgagagctacaatgtgccgatattctgcaaggatgtcccaaccgtgagaagaatcacccggagggtgactggacggagcggagggctcccgtcagtacaggcacttgcacttttccatggcggcaattgcacggagatcggatgctttcggctggagccagaccacgtcggcgccggtcgggttcaatggctgggggaggagagtgcagaggagcaagggggtgaagttgacacggacgatgtctctggcctgttcaagaccatgttggtgcagatgcactccggggtgtggtctgccgctgtctgacacgtccacgggtttgagggcagaaagtgttacttcaacttgctgtccaagccacatgttgccacaaaggtacacatacatggttgcagcagcagattggcaggagcataatttgtggtaccgactatcacgccggaccgacctgccccgtatgctgctgtttacactgtgacactagctcgaccccagtccgaccaattccaagattttgtatacactgaaaaaactcggaacgcgtcgccgtctctggtcagggtcacgatcccggacggccgccacggatgcccctccctctccctcttgcccctcgccttctcttctccgcctcattctgtgcgctggctcacacgggtgtcggtccctctccctctttctttctcttcctctctctctgtgggcgtgcgtgcagagtggtttctcgcttgttctctgtggcttgcgaaaccacaagggtgtccaatgggcaggcccggtgctccctgacactctatcgatgaagccggatgtgggcccagtacacgttcctcatgaaagaggcgccaccatggtcggagctcaacctttggtcgagagctacaatgtgccgata

SEQ ID NO: 6912 - DNA, 766 bp, Triticum aestivum
  Clone ID: PAT_TA_6912
cttgtctagagcacaacaaacgcaaagcgtcagagatacgttttcttttacaaggttgtcacactttttccaaaatttattatgagctactaccagctacagcaagaggaacagccgggataaagacaagcataacataacacacagaagttgagagcagcatataacgattgtgaggagtagattccagagctatccattcccaagctagggggatcctctttctgaatgttgtggtagaggtgctgttgtgcacggatgctcatcagattgcacgcggatgagccctgttctgcatggcgaagcgtccgcaaactgcatgccatggtcgacggactacaggggaagagatggccctcgccggactacacaagcatgagccctgaaccgcacgacgagcgtctccgagctgcacaaccatggtcgacggaccacaggggaagagatggagatggcgctctcccgactgcacgcacacaagcccggaaccgcatggggagcatctccgagctgcacggccatggtccaccgaccaatgggaagagatggcgctcgccgttatgcatgcgcacaagctccgaacggcatcgcgagcatctccaagctgcatgaccacaacacccgcatactgtgaggcgcaatcctttttctgaactcttcggccatcaaggaggagcacctcatctcgcatggagtgaattgcacatgccgccagtggagccgccggactgctgtgtgaatgaacgcatgtggataagggggagag

SEQ ID NO: 6913 - DNA, 878 bp, Triticum aestivum
  unsure (1)..(878): unsure at all n locations
  Clone ID: PAT_TA_6913
tgcgccggtccttgcgctcgcaccgaccagatgtggcacgaacacatcatgacagagtccgcatcgactgcataggcgaacttctagtactaaatggttacgaatggagcaaaaacgacaccctgtctctgttctaacacgtcccagccgcccatgggcaaagctagtgccccatatccagctgggttcgtattgccgggctccccacccactgacgccgccatctccttccccaacacttgtgaagcaaatctcgtgcgcctaattgctggttcggtacttattgctttgccgccccagtgactgagccggcctatgtcctcaacccgctgcccaatttcaatagcatgcgtcgttcctctgtcagcttcaacaatgatctctccaaagccctcacggacagaccctcacaaaacgctcaccaccggacccaaatccaccttcgcaaggagtgcgcacaattccctccacaaggatctggccaaaaagatcccaggaattgcggccagagaagtgcccccacacatagggggcattcgtggcaccgtagacgttgaatccgagcgactcaaccgtgtcgacaatgattttggtgttctccttgtagaatccgacaacgtcttgcatagcctttagaccctctggagagaggcagcctaaaccaccggcctgagagtgcggccttgccccttggaagcttgtgcagccgatgcccctgcagtctttagcagctccttggccaccacagtccaacccagccggacaccagtgaatccagcatatttagagaaagatgctgtctccatggcaacctcttttgctncaggaatttcaaagatggatttcgggctgtcatctgatatgtacatggcataagc

SEQ ID NO: 6914 - DNA, 617 bp, Triticum aestivum
  Clone ID: PAT_TA_6914
tccagtaagtacaacatgggcagggtcctgccgacctcgactttacacgctccattactcaattggcgatggtcacgtgttgccaagcaagcactatcgtcgttgactcactgatccatcactaaatgtcgacaaccacatgaactccggcgagcctcctccactccaccaccaccgccgccgcgaccgttgggcccaagacctgaccgtggccaagatgaagcacacacgcacacacacttgtggtgtggaagaagagcacaactcacacaggttgctcctcttcttgaaaaaatcagcatcggctctcattggccatcctaatcgaaaacaacctcttgaccaaaagtacgcattgagatcatcatagtttctccgacgcatgtgttttgattttgttgtcccgctcctttcagcttcgtccatctctacgattttgcaaattggagtcacaactttcttcaggaaggcttcttcttcgccaccataggagggtctaacattttcaccagttgttgggctcacatttccggccaacacaccgtacaattcaaaagccatatgatgatagaggtagcaaagacactctggcataaatcgcaagttagccgcctcgc

SEQ ID NO: 6915 - DNA, 768 bp, Triticum aestivum
  Clone ID: PAT_TA_6915
agagctaaaagtagattaaatttggtttagtagcaatcatctgttttgctggttcttttgggaggggacgccagttttgatcatagcatacactttgtagatactgtccaaaaccggcataagaagcacactacatcgacgtatgtacgactctgacggccttaagaatcacactacattgagtatatataggtggcaatgacggtcagcaacgatctgtctacagggtggtgaatgatgaattctcaaaataaaggacattggagttgacccgacgatgcactccacgacgagcttgttgaggaagaggtcgtcagtaaggcggtgctccctgaggccttgaaagtgtagcgaacagcagagcagcagtgagcaggcctccatctcatcgccctggcgagatcgggtggcaagttctcaagcttcctcctggcctgcaaaaatatgttcctcgccaagaaagagttgataacattgtcctgttatcaattcaaacgatggctaacctaaaaataataagaacgatgcaatccaaatagcaagaagcatgcgcaatagaaccagcccaagtgtggcaacaacgtgatggcaataataggaagtggagtggagtgttgtgtctcctcctcccatcatattctctcaacacgtcacatagcacgcctgaatacacatcaatttttggaacataggaaaccagcaaggagggcgaggtggagattgaggcgggctatggagaagccctagtttccaacatggccgtcgacg

SEQ ID NO: 6916 - DNA, 705 bp, Triticum aestivum
  unsure (1)..(705): unsure at all n locations
  Clone ID: PAT_TA_6916
gccctagaagaggtagcgattatctttcaactttaatggagaaaacctctacatgaagccataaacatccaggtcataacagacattgaagcattaaatgctaactaaatcagaaaaactgttgccattacactnacaacttctaaattgacatgactgtatacagacaggacttcctacttcacagctgaagctcgaaataggcatgtaaattaagtccgggaaactgaacatggctacaagctacttctaaagacgtctacagattggcaagagcaggtacagagaataactcagaccaaactgcaggcgttggagcctacaaggcgatcaacatggcatgtctcttacctgattgttacaaacttgtttgtgccatgcttggcccagaaggtcttcaagtcaattggattattaaggttgtacccttcaccagctagcttctcaagaacctttttgaatgcaccttggctcatcttccttccagcaatacgtgcgccccggcgctttgtgttcattggcagcggatatgtcgaaatagaagttgtgcagcatgcagactgccagccacctgcaccccaccggtagcattgctggggagctccagtgcatgagcacacaggtgttggtatccttgaaatgtcaaaatcaataccattaattaccatttccacaggcttaagaggacccctgcttcggggtgcc

SEQ ID NO: 6917 - DNA, 1082 bp, Triticum aestivum
  unsure (1)..(1082): unsure at all n locations
  Clone ID: PAT_TA_6917
aactgaatntatgtatatataggaataaataaaatgtgaatttcgacagtggttgaaaaatcagagtctgcaagcggtgccaggacctttgtctacgctaaaaaggtcaatccccggataacttgggcacaaagctgtagcagagccccacaatgaacaagcaaacatgtatcaggatcatgcattggctagagaagaccgagttcatacttcctacactgacaattgtagggttttcatgaatgataaaagatctctattccgataccgatcagcgccttgtgtctctccttgtctctgatgctttcttctttccggcgataacaccggtgaccattcacttgtctaaagaaccatcttcctccggtcggcatcggtatgacgattgacgaagaggaggagcagaagatcatcaaatcttgagagattggtttgataagagcagtggcaatctgatcatcagaggtcatcttaggacaagctttcacatcggctgcttaaatcccagtgacgatcccgaaacccaacagagggagaaagacagtgcaatttgaatctgtgatactgctgctatgtgcacctttgctgctcatccaaaccacagggtcggttgcttctcactgtacaagcaatgtctgaaaatgccactaggaaactctgtcggtctcctgggcagggtcgagttctctcttcttcgcaacgaagatggagatccttgtacgcatttgcgcaggcggcggcgaagctctccatcgcttcgaaaaacttgttcatgcatgattgcagacccacttcagagggcggatcaccatcctgcacagcctgcgcagataaggacacgccgccctgattcgaaacaagcacgagcttcttattctgtgcttcgagggccttgcgcatcgacacttgatccctctccatcactctaagctccnctgtccatttctctgttggccatcatgccctgcctccactctaacctctgcttctcccacaggtgcagaacctgggaggcaaaagcctgcatggcgtctaccacccccgttctctccggggcgcctgggagcaccccccatcttcat

SEQ ID NO: 6918 - DNA, 373 bp, Triticum aestivum
  Clone ID: PAT_TA_6918
tgcattggtacccccatcatcgagcgcacggatgcaatagtggcaagaagatcatggtcgtgtgcatcatcaagcacaccatggcgagcatccacctcctcacagtggcaagaagagcaggtgcctagtttgtaatcgctgtcgaaggagctccatgctgaagaacataacacttgtagagcttgtaaagtaccatgttattgaacttgtggagcatgtaactatgacttccactattgtatgttagagttatttgtacaacttgctacacttgctgaagaacataacacttgtagagcttgcaaagtgtatgttagagttatttgtacaacagcaactctatattgacagtagcaacactggctggtatttg

SEQ ID NO: 6919 - DNA, 862 bp, Triticum aestivum
  unsure (1)..(862): unsure at all n locations
  Clone ID: PAT_TA_6919
aagaaaagcgcctctccaggagtgggaaatactagtgctccctctccttctcgtgttactgtttgtgctagcaaaacaacaaccgcgagagaccatggcgatgggtcacctccgtgccttgctggttttcctcctcgtgcaggtctgcctgttcttgatgatggccgcgtcggcgaaggtgcagggcagggctgtgcccggagttcccgcgtgctgctcctaccgccccgagtgctgcgagcgcctgacggcggaagccccgctcgccgccgccgttaatccctgacggactcgcctgcggcggcctgtgggggtcgctctcctccctagaaatgtgtccgtgacgtgagcatacatgatacattctactggatctgcaatctgcatacatctataattccgctgcttttcgtgtctctatatatatgtttcagaacttttcattccaagcatgttgttgtgatgtgaaaccttgtttaataaagtatgaggaaggagattgctgtcaatttgcatgacagggctgtgcccggagttcccgcgtgctgctcctaccgccccgagtgctgcgagtgcctgacggcggaggccccgctcgccgccgccgttactccctgatggcctcgcctgcggcggcctgtgggggtcgttctcctccctagaaatatgtccgtgacgtaggatctggaatctgcatacatgtatgattccgctgcttttcatgtctctctctatatatatgtttcagaactttacattccaagcatgttgttgtgatgtggaaccttgtttaataaagtgggaggaggatattgctgtcaaaaaaaaaaaannnnnnnnnnnnnnnnnnnnnnnnnnnnnn

SEQ ID NO: 6920 - DNA, 637 bp, Triticum aestivum
  unsure (1)..(637): unsure at all n locations
  Clone ID: PAT_TA_6920
gcacgaggcttctttataaccagtgcagcctgcggtgagtgtgaactgtgtagtagttgagtgaggagagaggagatggggcaccactcctgctgcaacaagcagaaggtcaggaggggcctgtggtcgccggaggaagacgagaagctcgtcaagtacatcaccgcgcatggccatggctgctggagctcagtcccaaggcaagctgggctgcagaggtgcggcaagagctgcaggctgaggtggatcaactacctgaggccggacctcaagagggggagcttctcgcaggaggaggaagccctcatcgtcgacctccacagggtgctagggaacaggtgggcccagatagccaagcacctgcctggcagaacnggacaatgagtgttgaaagaacttctggaactccaccatncatagaagaagctcatatcgcanggccgttgggcagccccccctacgccggcttcccttcccctgccctcctggcctgcttcttgcccgttggggcggggctaggcatcgcagctgcggggtgcgcgtcgctcaacgcgctggacaatgcggctcaagctgtggccacgcagtcccctccatcctccgcggcatggctcaatttcacctcccagccgctgct

SEQ ID NO: 6921 - DNA, 809 bp, Triticum aestivum
  Clone ID: PAT_TA_6921
ttgtgtcttctttgtctttgttttttgctgcctcctgccccggcccccatgatatggacttgagcctccccacccgttggttttatgccgtctgctgctactgccccgctcgggatgcagagtcgcgtctcctccagttcgttgttcggctcctagtaccactgggcccttcggcctccacggccgcgcagccccgccctcagcggtcgccgcgggcgagcaggtggccctggggccacctcggctgcactcttccaccccccgctggtacgccgcccgccctggggccgctggcgcgctctttggtgtactcttccatctccctcttgtacgccgccatcccttgggccgctttctcgctccacaccttcttctccgcgccgctcagatccttccacttcaccgagatgagcgcgctcagcgtcgcgttgttcaccccggggcgctcctccgccagctgcttcctcgcctccttgctgcaatagaaaagaaaatgcaacagtttgttagccatgtcacgatgttgtattaaattgcgttcagaggctgcggtgcctcctgcttgaggatgtgcttcccctccccgtcgtcctgctcggagctcgcgggcccctccggcctcttcggctcggcctcctcctgctgcttctgcttctcccgcttctctttggttttctgatcaaaaacaaaatcgacacatgaagcaatttacataacgggcatgctgatggatattccatctggaacttggggatagataccttgatgatgttgtctgccttctccttcttcctgagaagctgcagagc

SEQ ID NO: 6922 - DNA, 998 bp, Triticum aestivum
  unsure (1)..(998): unsure at all n locations
  Clone ID: PAT_TA_6922
acaagctacgcagcacacaaccctctccacccccagcaatccatccatccaccccacccccacccccctttcccctcccctccccggcggattccctccccgagctcggcaatggcaaacgcttcatcaggagctgggatccatgatgactgcaagctgaggttcgtggagctcaagtccaagaggatgcaccgcttcataacctacaggctggagaaccagaaggaggtcattgtggaccaaactggggagcgtgaggcaacctatgaggacttcaccaagaccctccctgagaacgactgccgattcgcagtgtttgacttcgacttcaccaccccggaggatgtgccaaagagcaggatcttctatatcttctggtcccccgacacggcaaaggtgaggagcaagatgacgtacgcgagcaccaacgagaagttcaagaggaccctggacggcatccagatcgagatgcaggccaccgaccccagcgaaatgagcctcgacgtgatcaaggagcgcgcgcactaaggcagatcatccaatgccctcgcaatatggatttatgtcaaatatagatggggcggtgggactctaaaaactttcttgatgtagagctccttatggaccgggtcagtaagccctccagatattgcgggagcccttgaaaccccccgcgcgcttggcgagcgaatcacatttgagcaggcacatgttttcagattcgccacagatctccttacctgtagaggttttgtagggaaggagcacagggctgatgtttggaggagcacaatgcanatggntgtggtgattgtttnttttggnaaaccccccccccccccaccngagagaaaattttgtaggtgtgctacccatgtctcgcagtacgcattggaccccttgacccctttgggcactttgtatcattctatggattgtttatgatgtcaaagccaccgctttgtttttgggcaaccccccccccccccccgcgcggg

SEQ ID NO: 6923 - DNA, 1194 bp, Triticum aestivum
  Clone ID: PAT_TA_6923
gcacgcatacccaccccggttatagcacccctcgaccgcggggcggcccaccctcaagctaggcagcacacaaccctctccacccccagcaatccacccctttcccctccccggcggattccctcccctcccgagctcggcaatggcacacaagcattctcccccacccgcaaccccccttgcctcccccctccggggggtaccccctcccctccgagagcgcgaaaagcgcaaacgcttcatcgggagctgggatccatgatgactgcaagctgaggtttgtggagctcaagtccaagaggagtatgcaccgcttcataacctacaggctggaagaaccaaaggaggtcattgtgtggaccaaactggggagcgcgaggccacctttgaggactccccacaaaccatccctccctatgactcctgcgcccccgttcccgaagttcggctaaggcaaccacgacgtcggaggctgagcaccaggataacttctatctaagtttcgtcgaggtcacctccaagaggaacacggcagacgtaacctacgggctggacaaccagaaaggacgacaagtgcaccgagcacgggagcgggatcccacctatgaggacttcacccaagaccctccctgagaaagactgccgattcgcagtgttcgacttcgacttcaccaccccggaggaatgtgccaaagagcaaggatcttctatatcttctggtctcctgacaccgcaaaggtgaggagcaagatgacgtacgcgagcaccaacgagaagttcaagaggaccctggacggcatccagattgagatgcaggccactgacccgagcgaaatcagcctggacgtgatcaaggagcgcgcgcactaaggcaaatcatcccaatgcctcgcaatatggatttatgtcaactatagatttggcggtgtgactcttgaaactttcttgatgatttgtggctttgttaccgtgtcgaaaggccctcctcccgtggtccgtgagaccacggagggcttgctctatcatgtaatctgttctttttcctctgcccatttatatgccgggccttatgctgctgcactgcactgttcttccaagttacggttataaataattaaatgttctgtttggattcgtcaaaaaaaaaaaaaaaaattcagccatggcagtctatctgcatatctgttggatatg

SEQ ID NO: 6924 - DNA, 548 bp, Triticum aestivum
  unsure (1)..(548): unsure at all n locations
  Clone ID: PAT_TA_6924
aagccggtgctggaggcgngcagccatgggcacgccatggtggcgttcgtcaacaagaagttagtcggctgcggccatggcacaaagatgaacaaggcctcccacgcgtccgagcccatcgaggtcaaggtcggcatcaaccacatctccatcctgtccagcacgctggggttgcaggacagcggctcctacctggagcgccggcaggccgggttgcactcggtcaccatccagggcctcaacacggggacgctggacctgaccagcaacgggtggggacacatcgtgggcctggacggcgagcgcaagcaggctttcacggacaagggcggcgaggtgcagtggaaaccggcggtgttcgaccagccgctcacgtggtaccggcggcgcttcgacatgcccaccggggaggaccccgtggtgatcgacatgaacccgatgggcaagggcatcctgttcgtcaacggcgaagggctggggcggtactggagctcgtacaagcacgcgctggggcggccgtcgcagtacctgtaccacgtgcccgcggt

SEQ ID NO: 6925 - DNA, 1499 bp, Triticum aestivum
  unsure (1)..(1499): unsure at all n locations
  Clone ID: PAT_TA_6925
atagaaatagaaatcttggggtccattcgtgcttgagacccctaacaggaggttttactggttcgcaacacatcatgcaaaagtacaaaacacgtcggattctcttcgaccttcagaaacacaagtcagggaaaactccagaccctacacatcgctctctgcattcagtctgcatgcaacgaaagtatcagcaaaaggaatactccttcctgtaagcgtcttggcggctagggcgaagaaggtgttccctcatcctgctgacccattgttagcatcatctacttgttgctgcgtcaacacccgtttcttgatctcgtcattggttcgccgctctcaccacgagcacccgtttcttgatctcctcactggttggcgctctcgttgcgggtgacagaaggtgttccctgatcctgctggctaccgctataactatctgcttgttgttctgtcaaaactagctttgtggcctcctcaccagtgatagacggtgctccctgattatgctggctgctgttaggaccatctccttgttcttctgttgacattgatttggtgctctcgtccccagagagagaagatgttccctgatcgctattgttaccaccatctacttgttggtctggtgatactagttttgtgatctcgtcaccggcaagaggtggtgttacctgattttgctggctgctgctacgatcatctccttgtcgtcctgtcgaaactcgtttcttgatctggtcaccagtgagagaaggtgttccctgattttgctggctgttgctacgaccatcttcttgtcgtcctgtcgaaactcgtttcttgatctggtcaccaatgagagaaggcgttccctgattttgctggctgctgctacgaccaactccttgtcgtcctgtcaaaactagtttcctgatctggtcaccagtgagagtttcatgctccaggagggcatttgctagcgcatggaactccttgttgtgctccgtgagaatctttttcgcgttcctgtaagcgttgtccaataatgctttcacctcctcatcaaccagacctatcgtccgcccgctcatggccatcgccttgccacgggcagcattgatgtcattgccataggaaacaaggccgacccgcttgctcataccatacctgacgaccatgtctttcgcatatcgagttgccttgcctaggtcagatgaggcaccagtggtgatccctgcttctccaaatataagctcatcggccacccgtcctcccatggcgacgtcgagcctcgccagcatctgcttccttgtgaggtggctgtcttcccctggcagctgcgtcaccttgccgagagcatttcccataggcacgatggtggccttgtggacagtgttagcaccgtccgtgaggatagcaacaagggcgtgcccagcctcgtggtatgcagtcctcttctttgacatatcggatatcaccatcgacttgcgctnccctgcccatgatatcccctcgtgccgaat

SEQ ID NO: 6926 - DNA, 713 bp, Triticum aestivum
  Clone ID: PAT_TA_6926
ccgaggtcttccgggacgtaaagcagtacccgcatgccaagagcgtccccaacatcctcgtcttgcagctgggctctcccatatatttcgtcaacgcgggctacttgcgagagaggattttgagatgggttgaagatgaggagcacatttgcaaggggcacgggcaagacttgcaatgcctggttcttgatcttggtggcgtgacttcaatcgacaacacggggatcgggatgctaggagaagttcacaagggcctggaccggaaggggatcatgatagctctgcgtcctcccagactgcaggtgacggagaagctggtggtgtcagggtacatcaaggacaccataggggaggagagcgtgttcctgaccatcacggacgccatcgcgtcgtgccggtacgggctgcggaggttcagaggcaaggagggatgcagcgaagtatagcggcgtttagacagtgtggatgtagatattgtggcgtggcacaagcgcaagaagaagaagaagatgcataagtagattgggcgcctggatggactctggatgtgctgaaagctgtatctcgaaaggattcaggggaggttcatggtcattgtaagggcttgggcctcgggggagaagatagcgaggcgggcgaaagaagtgctctcttcttgtgtatagaccaatttagatttctcggaggttaccgcgaacctcgcatatttgctc

SEQ ID NO: 6927 - DNA, 699 bp, Triticum aestivum
  Clone ID: PAT_TA_6927
ttttttttttaaatcagaaacgtgggttcccttgagatgcatatcacatcgtttactatttcagatcggtacatgacacggcaacatcagcaatcaaaccaaaaatcagcattccaccagttttagatacacggcagccaactacagttcctgagacgcaaacatggcaatctaagaggaggtgaacttggtgacggccttggtgccctcggagacggcgtgcttggcgagctcgccggggaggacgaggcggacggaggtctggatctcccgggaggtgatggtgggcttcttgttgtagcgggcgagcttggcggcctcgccggcgagcttctcgaagatgtcgttgatgaaggagttcatgatggacatggccttggaggagatgccgatgtcggggtgcacctgcttgagcaccttgaagatgtagatcttgtacgtctcgacgctcttcttgcccttcttccggcccctcttctcgccgccctccttggaggcggtcttgcccgccggcagccgcttctcggccttgggcttcttggccgccggggccttctcggccttctccgtcgtcggctcctcctccgcgggcttcttcgccgccagcttcttctccgccttgggggccatcgctgctgaggttgatttggtgtgggggattctccgcctgggtgggttgtgcgtgctggaactggagcc

SEQ ID NO: 6928 - DNA, 926 bp, Triticum aestivum
  Clone ID: PAT_TA_6928
aagacagctgggatgtgacatcaaggacatacttaatatttggctgatgttttcataaaaagaattggtggcctcctcaattcacaaagttaagctggccagccattacaaaattcaggaccagggcagatcacaatcggtgtgatctcctagttgagtacgtataccactgatctcttccagataataatacaacacaattttcctcccacatacataaatgcacgacgcatgtacagagacaaacacaaaatgaatgacaatgactactggctgacctatctatcctctaaagaaatctgaacagtatgatcgatgccgcaactcaaaccgtatgaaaggggaaaatattcagatggcgcacaccgacaccatcacgggctttcaactggtcttgtaaagaaaacatccagtcatcatgaatgccgcggagcaaccgtgaaggccaagtcatgaggctgcaaagcagcttgaactatatcctgcaccgctttgtttcgtctgcaaacctctgatatttcagcgaatctgtccgtcaaggaaccaagactagatcccgatgatgcatcggatataattgtcaagaatcttgagcgttctgaatctgttagggcttgtgggggtataagggcaatgcaatcccttgtccaattcaacatattcccaccaaaagctctgctaagggacagcagaacatatgagacctcctccaagcgaccagacggtagcgcccctgttaaggaagcaatcattagtcttgcaagtgttgcacctcgctggagtacctcggccgcgatcacgccccgcgacttcccccccgcggctgatttcgcaagatcaaaggtgtcagataggaaacacagtatggatttgcaggcctccctatgttgtatagttacaccagccattgcacaatcaaccaatct

SEQ ID NO: 6929 - DNA, 604 bp, Triticum aestivum
  unsure (1)..(604): unsure at all n locations
  Clone ID: PAT_TA_6929
cggagccgctgttggctgaaggttgatgatattactggacattcagtcgtctgaagcacataatcttctttcaacacttctctaaaggcaaaatcaatacgaccacatgaacacgggttggatggtgagcagaaatttacaatncaagcatgtaggctgggtcaggcaggactgtgccccgcattggtaggtggcggcaccaaagttggggcaggggagtgtgcgtctccactccgtcacgtgatatccatcggacatcaccaaacgatctccggggacaatgaagcgatggtggcttctggctttgccagttcaagagccccctgttatcggtctcgggccacccttattccttcaccagtgttgttggcaggccaccgacgaaactgactgttgtaggaggtgcagccccaattctcagcctcttggtccaaccaggagcttcatgatttactttgccagtcaattccaccgactacactggagtagctcccttccttgccgagtctattcctctgatttatttaagtgacctcaattgtagctcaaacatgtgttgatttgctgcatcaaggtgccaaataactcacatggtgcgcccact

SEQ ID NO: 6930 - DNA, 782 bp, Triticum aestivum
  unsure (1)..(782): unsure at all n locations
  Clone ID: PAT_TA_6930
gcgatcgcatccgcccgatgcgcccgctattcgggccctttggccctgccagttcccgttacacattacattagggtcgatatcaataatatacacacataacagcacaatggtccatagtccccatccaccgctctgccctcgcccctaggccttacctcatacctcacccctcctcccttcctctcccccccgcccgtcagccagccatgctcctccgggccgcgcctttggctctcgccctcaccagtgcaagagtagactgcgacggccaggctccgcctctgctgcattcccgtctgctgggctccagctggtgtgccggctggcgccgtcccgtccctccccgtcgctttccgtctgctgcctttccggctgccgcgccatttttaggtggctgcttcttagacgaatttggttgtacccgagagggctcgccctcttcaccacaacttctttgaggggacttgactctcttgcgtgcgaaacgtgcctccatctctggtctacggttgggaccaatcagctttacatggaatggattcacagcctgtgtagcaaaccaagtcatttgtagcttgtcctttgtccagatcaacacttctgccgttcaccagctggagaagggcagagaatgttcttgcaacctcgtacttttggtttgctgctaacaatctcactgaatgatgcaatccctgtatcagttcttgacgagnagtgtgtcaaggatctgctctccatataaaccaatatcaaagggtgggtttctatcctcgtgccga

SEQ ID NO: 6931 - DNA, 797 bp, Triticum aestivum
  unsure (1)..(797): unsure at all n locations
  Clone ID: PAT_TA_6931
tttncccgcccccnctttaancccccgccactgaattcactaagtgattagcgtgctcggagccgaggatatgcctgcgatggcaactttcttgacttatacgacacgtacgacgatagcagtttgagagacaaatatttcagtttcttttttcaccgagaacaagcacacggtgtggccgctcatgtgtcacaaaaagagaacactctcttccttgaagggcagtaagccagataaataggtcactgcgagtccttattcgggaaaaagtggagggggggaacatccatcagcagggccgggcctcctgcctctaaatacatatcctggctaacagacagtaaaaagcacaacaggttgaccacgaaaaggttaaaattgcaggttgcttgtaaagaggaagtttcttatcaagcgttctccttggcaatcttctcagccttggcaatgacctcctctattcctccaaccatgtagaatgcctgctctgaaaggtcatcgtatttcccatccagaacaccctggaaactttgaacaccctccttaagctcaacatactttccaggtgcgcctgtgaaaacttcagcaacatggaaaggttggctaaggaaccgctgaattttcctagcacgagcgactgttaacttgtcgtcctcactgagctcatccattcccaaaatggcaataatatcttgatgtaatgagtcttgttctgttgcctaaattaaagtgcacttgatgttgtgagacttgatcattgttgcagacctcttggtaatatgaaccgcgaatcgtct

SEQ ID NO: 6932 - DNA, 1167 bp, Triticum aestivum
  Clone ID: PAT_TA_6932
aggcggccttcatcgcgcaggtctccagccagtgggacaccaacccggacctcgccaccgtcggctcctgctgcctcgtcgccgcccggcacgaccgcaccctcttcgtcgccaacctgggggactcccgggccgtcctggggaagaaggtgggccgctccggccagatcgtcgccgagcagctctccaccgagcacaacgccaatcacgaggctgtccggcaggagctcatggcccagcaccccgatgacccgcagatcgtcgcgcttaagcatggggtctggagagtcaagggcatcatacaggtgtcgcggtcactcggtgatgcatacctgaaagacgcaaagtataacacggaacggatcaaaccaaagttcagagtctctgagccattcagcagacctataatgagtgccgaaccaacgatcgtctcgcgcagccttgaaccaagtgactgcttcgtcatatttgcttcagatggcttgtgggagcacttgactaaccaggaagctgtggagattgttcacaacaatcaacgcgctgggagcgcaaaaaggctcataaaagcagcactccaagaagcagcgcggaagcgtgagatgcggtactcagacctcatgaggatcgacaagaaagtccgccggcatttccacgacgacatcactgtcatcgtcctattcataaatcatgagctgctagccaaaggaaatgcgcaagtgccgcccctttccatcagatccgccttagaccactgatcatgaaccacttcacccatggatgctcagttcctgtgagcagaaatcgcctgtgagatagacggcttcttcaacaaccagcctctgtgaacagtgcagaaatcgcccgcctgcagcagttttcttttcctcgccttacttttctcttggttttgcacataaaatttgactacttgttaagttgccagttttccccaatgctgcggggttcccccctcgtatcgtatcgatgtcggataaatgtggatagtcttcaggcctggagatttgcctagagtttatgggggagcctcttcttccttcctagaaaagatgttgatgagggagccttgttaaggatgttgtaaccgtaaattgattggttctcgcagcttacaataatctgttgttatctcaaaaaaaaaaaaaaaaa

SEQ ID NO: 6933 - DNA, 396 bp, Triticum aestivum
  Clone ID: PAT_TA_6933
gcttctccatgcgctcctgctacttactccctctgccggctgctcttgcttcttctctgaaccccttcactactgctcctactcacggccctgacaagacaccatcacaggggagtctgatcccctgcgtgcctctcctctctgtcttgctgctgctatctctctttctccttctcttctctgaattttctgtaagctgagatgtgtaatgctttgtaatgttcagatttaagtagtgcttgaaacttgttcagtttcaaacttctgcttgattaatagtacttatgttgttcatctcagagtactagaattatgtcttgtaacctccccctgtttgcatatgtgtgatgtgtgttctgtagcgttggtgttaactttgttcatgtaaaacatata

SEQ ID NO: 6934 - DNA, 407 bp, Triticum aestivum
  Clone ID: PAT_TA_6934
ctcagacgcatgctgaagaagcctctctgctcaccattggcgctttccgtgggaagtgatagcaatggaagcggagctgtagctcttctgaaaattgcaaggatcttttcacaaatctattcaagccttaagaccagaagcaagtttaatcttctctttggattaacatctggctgaccctacaattaaaatggaactagcaaggttatcaattttttttacagcggcttgaagttttgaccaacatgtgcgtgatattattgactatgcaatttacttaagtatcattagttcctagagcaatgatctctggatgcatgtatcaaagcctccagagaagccttacatcaagcaaatctttgaggatttttcggatgtctccaaggaaatgggcatttcagtcgcac

SEQ ID NO: 6935 - DNA, 2191 bp, Triticum aestivum
  Clone ID: PAT_TA_6935
caactcctggagtagcatgggaacacggacagtgcgcgaggtttagagtgaccgcgcttgctcgttcagatctgcagcccccgccgcggttgctgctacgcctgcgtctccgccctgacaccagagcccctccagatcttgccgcaccagccagatctctctgctgagtggctgacggtctcgcctgccccacccttggagtcagactcggcattctcgacggcgttgaactcggtaacgccgtagccaccgcccccggctaccgcctcatccagcacggctttgccggcgccccgcccggctcccgcgacgccgccctcagccgcctcaccgccgccttcgtagcactcaaaaaggaactgtccgaccgcacaaccgtcgtcgcgccgcaaaacggccgcccgtgctcctatgtccgagagtaacggtccaagaaaaaacaacttggagggttgctcattctgctactgagaaacatcagctctaagtacgttgagggaaacaacgatgacaagggggaaccaaagaatgtgctggctgagctagaaaagttgctcatgcatgaagaagtgccgtttccagtgtacttcgctttccatgaagacaatttggataacctattggcaggatattcgtaaaattgcctcttcaggccaaccagcctttgcaacaacaggaggactacgatgtttgtaaagccattctgccgaaacctaaaaggcctggtcatctcagacctacccaaagttctctagggatggttagcctggtcacgttctcgagaggggagatagcttatcctgcacacaaggaattttgactgtaatttgttgtccgttttttgtttttttcatttctggctactgtgaagtagaaggcctatctgcataatcgtcgtgccagtgggttacgctgggatgtatggatagatagcaccactctgtacgcccagaggcgtgcttgggcaccgcgtgggacttccttctggaggcccccacaattacaatggaactagcaagtggcttagaagtttcgatcagcgtgtacgcgagagtattgactatgcaatttgcttgaatagcgttggttcctggagcaatgatctctggatgcatgtatcaaagcctccagagaacccttacatcaagcaaatctttgaagatttttcagatgtctccaaggaaatgggcatttcagtcggcatcaagcacaagaagattaacgtgtcaaattctagagtagcatgggaacatgagcaattctcgaggtttagggttactgcgctaactctttcggaattgtctacacctcctgaatttttggaaagcactggtggtctgtatgacactagagaatcagtggatgttgagtcagtaatgagaactgtcaaattagtttctgagattcttgcgagacaaatctacgggttgagaggaaggaacattgatgtttttgctgacaacagcagcttagccatcagtcctcactacatccggtcctggttggatcttttttcacggacaccacgggttgcaccttttcttcagaagaatgaccccttcattgtagcacttaaaaaggaactgtccgagcatactactgatgtgcatgttcaaaatgacgtccttgatggcatgttcactttctatgatgcaacaaaatcaactttaaacgtataccaggttgcaagtgttactttcgacctgttgttccttctggtgctcggttcctatctaattgttctcttcagtttcctagtaatcacaacacggggcctcgacgatctcattaacatattccggcggcctccatcacgtaaagtcaagggagcatagactagatcatcatgttttgtgtattagtaacgaggagaagtgcatgcctagttagaagagctagacaccaggatttacgaaaagctaagctttccacaacagatagacctgtaattttcagaattaccctttgttctctagccaatgtgagcggcatcagattctccagggcgaaaacattttcttctgcacacaaggaattttgactgtaatttgttgtctgttatatttttttttcatttacggctactgtgaagtagaaggcctatctgcataatcatcgtggcagtgtgttactatgttatgtatggatagagagcaccactctgcactcccaaaaaaaaaaaaaaaaaaaa

SEQ ID NO: 6936 - DNA, 785 bp, Triticum aestivum
  Clone ID: PAT_TA_6936
ggcgtctccttcttcgcctcctcggcggcggaaggcgaacagcgaggaaccctaaccctaacaaccagtagatccgatctgcaaggcctgcgacgatggcggcttcccttcgcgcggcggcgacgaggatcctccgtccggcgggccaggggcttcgccggctcgtccacacccaggagcattctggatccacccgtgccttggaggaagggtaccctgcagcgcaaatccagcagcagaaggaggagctgtacgatctcatcgccgacgcctatgccaattccgcgtcttcccctgctgacagatatgtgctcaaggttctctccacacaaatcaagccgagaccacgtgaccctcagtggtgtgagataattacaatcaagaaggcgggcaactgggctctgggaggtttttgttttgttggtggtagcataattcttgctggccttgctcagggtgtgcgtaagcgagcggagctcgagatgcccaagcctgtggagccatacagaatcaaaaggaaactgcagaagcaagtcgagtgacgacgaaatgcatcttgtttgatggagaagcaaggccgatattagttcttctccaacgcactcttattcaggcctcttaaactatggcaaattgttcgggtttatcatttctgtaaactatatatatgtctatgatctgccacctatgactgagtagtactattactggatgatctttgatcgcattgtaagatatttgtgatgttgctgacatcgtatgttgtcctttctgttaagtaaatt

SEQ ID NO: 6937 - DNA, 631 bp, Triticum aestivum
  unsure (1)..(631): unsure at all n locations
  Clone ID: PAT_TA_6937
gtcggagcttcaatctttaccggatctgccgtcctccctggaaacacttcatatctttcggtgccaccctgaattgtccaggcaatcaagaaacatgaaagggcattatgttgagaagcttgcagttgtgcctagtgtatcgattgaggaacagaatattgtgaaggatgctgaaacgctggaggcaacaagtttgaagtatcaactcgccttgtgatagtcaaagggatatcttcaccattgtactgaagtcccgaaatccaaatcagccgcgcagtctggcgaaaatttgtgaataaatggggggaaaaccaggccgatagagctgtgcagagcagcagttctcttccgcctttgtcgcaccctttccccctggttcttgcagttgtaatcgcctagcatgttcaactagcggactgtttctttaaaaaaaaaaatacaaaaactagtggactgttgagatcttgctttttatcagaacaatttgctgtacttttgcttttgttgtgttnctatgtaattcgtggattgtatttggatatttggaatcgtataaacctgtgtggttgtccggtgctgtgtgcgctagtttaggagcttgtattcaaccaatgtaatgttttggnacaag

SEQ ID NO: 6938 - DNA, 747 bp, Triticum aestivum
  Clone ID: PAT_TA_6938
gccccggcgagcggctccgtgctcggcgggagggggggggagcgcgggcgctcgcgacccgggcgctgcagcaaggggcggcacggcggcggggcggagttaccggctcgctgtcccagcttctcaccactttatcactcatggccccctgcgacctcgagagaaccaacaaacagctctcacgccttcgatagatgaatcaacgcgtgacagcggaatacagtaactccggagatgttgcatccggtctgccggtctgtggagatcagctgaatgggaaaaaccaacggttcgacgggttcacaacgcagatcgacgcgatagaccagcaggtgagtgggtttgtggcagtggtgccctggcttcataagctggtctccatgttggcatcgaaagtgaagtccgcatatccccttgctcctacactatgattcatctccaaggatcccatcatcgtcggttctcttcacattgagcatatctctagtagctaaacacgtttggatggggaaacttacactctggccctaatggttccaccattgttgtacttgtagtcttgtagtgcaactgcatggacgagttgcggtgttccttccaggcacttgtataatacagtactactacttgctattatggagacaaactgtcagccccagcgctgttcgcccctcccctcattcctgcgatgaacgctggggaatctttgaacgagatcattgttgctgcggatcatctgttgctgct

SEQ ID NO: 6939 - DNA, 802 bp, Triticum aestivum
  Clone ID: PAT_TA_6939
ctggttgatgctctagaccgttgctgccgctgcctacgcagccacttgggcttaacctgagcttccatggcttcggcggcgggggagttgctggtgaagatgccaagaacaacaccgcttctaactcctttgatcctcctccgttgctccaacaaccctcgcctgcctcctcctactcggtctactcctctccgccggcgacgacgatggcgagccaggacgtggcgtccgccaccgtcgagaacacttcaccatcgctacaccgggtgctggatgaggaggagatggcggcgatctactcggttggggagcggcacgacatcgagtggagcgacacactgaacctggccacgtcggcgtggtggagcacactcctcgacgacggcgctgcggtgggtcaccagacagactcagtggacatcccggggatgcatctgggtgatgtgtactacggcgaagacgtctccttcccacgcatggagataggagagatggggggatgggacgaggagtggctctcatgacatgtcgtccactctagtcgaacgactaggtctccaaagacagctgcatgcatgcatctgtgcagactaggattgatgatatccgatgaccatgtactgctactttactgagtccaagttatagtgtgtgtttttcagtctgaaatataaaacacgtattggtcgtagcctggggcatgccgcatgcatgctatgcttgaccagagaagtgtgagctgcagcatgcatgcagccatgcaacaccttaattgggtggtacgaggagaggtcaggttcat

SEQ ID NO: 6940 - DNA, 1207 bp, Triticum aestivum
  unsure (1)..(1207): unsure at all n locations
  Clone ID: PAT_TA_6940
tcctgttgagtcgtcccgtcgcggcgggctcgtcgcgtcgcccgcgtctctacggaccggcggtccccggttgcatcttctaatggtcatatcaaggatgtgagacattacagagctggtgaccaagcgcctgagagcgaattagcatatgattttggtgacgaatctgtatgggccccggcctctgcggggcgacgcgcccctgggggcccatgtctgccttctcgtcttggggtgcatgactcgtctcccacgaaaaaaggaacctacagtgaccagggtggctctgagtccgtttttggagataattatggtgatgacactacatggaactccgatgaccaagatactgagtcagtttggggacttaatgcaatgagtgagcctggactccttcggagcccctgtctccgccggcccacaggaaagccgcttttccaggttagactcggtaaccagctccaaaggcgagagcgctgcgggatttgactcgtcactctgctcgattccgttccgccggcccgtgtctactcgtctggcctctcaccgaagttcggtgaaacccgtgacgatagctcctcctataactttggcaaggttcgaatccttcatgatccctatgacggcgccgtccctcctgcgggcccgcttgtccatacttggctcgcagtgttcgactccaaaacgcgacagcgcagcgggatttgactcatccaagcagctcgagaagtttcggccggttcgattcttttgatgaagctgatcctttcggctcgactggtccttttaaagcatcaggagcgcggtcgccccccaaattctgatattcatttgtgggattacgaggatctgtctcttagcgggctcatctgtctgatacaaaggctcggattgttcgaggaaagtacaatacagcggatccattttttttggcttggcaagtctcttgtgttggccttgtgtgcatttgtcctgtcctccaccccccacgtacaaagtggacattttttggttgtgctctgtaaagtatcccgagattgttctctgtttatagtggcctgtatctttggaacaacagctactcatcgtttttttttatttttgtacaatacaaaagttaaatttgtactgcatcaagctgtaagaaaccgagagccgaagtatncttttgtgctgtctccatagtccatatgtaattcaagctagg

SEQ ID NO: 6941 - DNA, 726 bp, Triticum aestivum
  Clone ID: PAT_TA_6941
accggtccggaatttcgtgtatttctaaggggagggagcaactagttcatctttgtgacgcactgcttccagtagttccttccaagctatctctatcactgagaggacccgcttttgttgattatttatcttcgacttgtcagatttcgcagttagaaaacttgcgacttactgacagtgaagttgcaaacaagcaaagaaggtgtcgtcagtcaagacattacttaagttctgctgcactttcgatgtcacctgaaggcatcgaattgttagcacaaagcagccgttttggtgataggcgcgagaaggttatagaccagacgattgcctagaagtatagagttaaataatatggtttggatgagaggcggcagagtatttttgctatagcttgattagagttggccgaggcgacccatttttactcacagctcatatctgtagtagctcagtggtaagttatggtccatgattgggcaatgctgatgtttcccagacatcccactgtgtagtcctgtataatgtaaatgcatgctgtcatcttaatttatagtgtggtgtagctgatgattctaacaagtttatacatgttcatccaaataaaactagtgtgctcaggtgcctgtttttctctatcactctcacaatggtgatgcgcgcagtacactcagagattggaaagagtttgaactattcagttattttgagaaaaaaaaaaaaaaaaaa

SEQ ID NO: 6942 - DNA, 1350 bp, Triticum aestivum
  Clone ID: PAT_TA_6942
ccacgcgtccgcacgcacccacgtttcaaagagaagtagtagaaggaagaacaaggaagaccaaggtcgatggagcccattcctctcatgactccctaccaaatgggcccattcgagttttctcacagggtcgtgctggcgccgatgacaagatcgagatcatacggcaacttcccgcagccgcacgccattaggtactacacgcagagggccacggagggtgggctcctcatctcggaggccacgggcgtgtcggccgacgcgcaggggatgagcgccatcccgcacacccctgggatctggaccaaggatcaggtccaggcatggaggcccatcgtggacgccgtgcacgccaagggcgccactttcttctgccagatctggcacgttgggcgagcatccgacatgcagcaagaacccatctccagcaccgataagccgatagagaggactccacagaactactccatggacttctccacccccaggagcctaaccgaggaagagatccccgatgtcgtcaatcagttcagaattgctgcccgaaatgctcttgaagccgggttcgacggggtggagctgcacgccgggaacggctacctgctggaccagttcatgaaagacggcgtgaacgaccgcgccgacggctacgggggcagccttgagaaccgctgccgcttcaccctcgaggtggtggacgccgtgtcgaaccagatcgggccctactgcgtcggcgtgcgcctctcgccctactccgggctgcctcggctgccgcgactcggacccggacgagctggccgtgtacatggcccgggagctgaaccgccgagacatcctgtacctcaacgtggtggagcccgagatggcctgggagtacgacggcggggcgcttggggtgggccatcacaggctgcaggcgatgagggacaccttcgacgggacgctgatggtcggcggagggtacggcagggaggaggggaactgcgccatcgccgaagagtacgccgaccttgtcgcctacggccgcctcttcctcgccaaccccgacctgccggagaggttccggcggaacgcgccactgaacaagtacaaccgggcgacgttctacaccgacgatcccgtcgtcgggtacacagactacccgtttctcggccagacgtccaaggggaatggcgtgatatagcaaagatgcatgcatgatacctaaggaactgtgttgccgttccctcagtgtggcttcttcttttatttctactgtagtaccgtcgtatcaactatcaagagaacaattaccgtgcttaataaaaggcaacaccagtttggatgaactgccggcagcggatgcctcga

SEQ ID NO: 6943 - DNA, 1145 bp, Triticum aestivum
  unsure (1)..(1145): unsure at all n locations
  Clone ID: PAT_TA_6943
ggtgaagtttggtcagcattcagttgggggaagttaccccttagctagtacttacgagtataccaaatggctgcggatccaggtgtggtagaaacacgcatcatgcgggagctccctccatgcctttctcggttcgcgttctttattctgcgcaccctgaagcgctcgccggggcgttctgcgcaattgctgagtgagactgctaaagaaattcataggcaacagccggatgcctgtcttgaatgcctttcaagtggacttgtcatcccacatggtcaattaagaagtttgaagcttcgctcaatcaggtggattccgggattcgaatctggagccttccattcagctttttgactcaataatgctgggactgcttgcaaaatcacacagagttaccgacgatggggattcgctgaaaggtgattgcatgccaacactacatttggtccaatttatcctgaccagcatccttctaccaccgctgaagaacagcccggtaccttcccgggtggttaatctaacatctttcacacacagatgtgtgtcagaaattgacgtgtccgaggaggcactgcaaggagtgaagtttggtcagcattcagttgggggaagttaccccttagctagtacttacgagtatactaaattttgtttacttgtgttctcatatgaacttcatcgacaacttcacatctcttctggtatctctgtcatggccgcggatccaggtgtgatagaaacacgcatcatgcgggagctccctccatgcctttctcagttcgcgttctttattctacgcaccctgaacctcctacagcagccagatacggggattggtgctgtccttgacgcagccttggcaccgcctgaagcatctgggaagtatttttttggagggaagggaagaaccatcaggtcttctgtgctgtcctatgacatagaggtggccaagaagctgtgggcagcatcttcagcactgctccaggaactgcggcttagagactgtgaactgaggactggttgaaccagcttgtaaatttgacatggttagagcatctctagccgtcccttcggggacatccgataaaattggaatgatacagagcgcatctctagcagaccccccaagtcgcacttnaggaatt

SEQ ID NO: 6944 - DNA, 488 bp, Triticum aestivum
  unsure (1)..(488): unsure at all n locations
  Clone ID: PAT_TA_6944
gttttaaaaaaaagggaancgccttgacatanctattttggaaacctttccttagcttgtttgccccaaggggaatcaggaaaatagaagaaaccaagccggctaggggagcggccacagatatagtacctagtaagaagagcccgaaggatcctcaaaaaaaaaagtaagaagagcccgaaatatcctgacagctgaatgttactcttctgtctctaactcgaaccagccccaaatagacggacgatgagacgcttagcgacggccctaaccaactccaccgcctcggcggcctcctgaatcatacgcacgtctatgccggctctgatgaacggcccgaagaagagctccgatatggtgacgaccataaaggtggtgccaacaaggtacgccgccgccttgggcggtcgccacagcccggccaccctggcccaccgctcggcgacgtggaaagcggcctggagcgtgaagaagagcagcatctcgcc

SEQ ID NO: 6945 - DNA, 678 bp, Triticum aestivum
  Clone ID: PAT_TA_6945
ccggattcggcgagaaggttctcccggaggcggggccgaggtacgacgacgatggcctttctcctgctgatgacaatactgcagaagctgcagccgatgtaggcaaagaagagctagaggaggggcagcaggaagacctggagacagcagcagaagaagaatatgactacgaggcggccgacgatgcaaatgctgaaggcgaaaatgactaccaggagtatgaagacgacgatgatctggaggacgacgatgatttcgcgcgcaaggttggcgtgctgatctcctagtgtgctctaagcagggtgtgcccctatggcacacccacatagattgaagcaaagaggaggagctaccggttgctcctctgaaaatcttgatccgtatttttttcgcgctagatactttttagttcgccgcgccgaagacttgggctaataaagtctggagaaagatgaaattggggataaagttagctcatggggagttgggggagggcctgggtttctcgcagtggaagcaggcagctacctgttgttgtattctagtgtatgcgtgtgcgctcagtccctgcttgtgttgttgtaacattattattaactggtgatgaacaaacagatcacacattgtaccactattttgtatttcttcagtgcataagatggttacaggacaaaaaaa

SEQ ID NO: 6946 - DNA, 601 bp, Triticum aestivum
  Clone ID: PAT_TA_6946
gctccctcatcgtgatgtggaggcttgatttggtgacgacaggcttggtgatcaggatacctcggtgtggcatgggtgaggctccgagcgaaagctcagcacttcggtgccggcggcgtcgatgcctgtgggtatcgtctccttcctgggggcgtcgtcgaggtccctctttccgagtcaaggctccggatgaaaatccttgatcgttccttcgatcacggcgacggcggcgcattgcgtcgtcactctccttcgggcgtcgccgtggagtccaggttctctttgatcgtggcatgtcatcattggtgggcaagctcagatcttggctcgtagtccttcggctcttgtgtgaagtggtctcagttgcttcctatcttttaaacgtgacatcgtttggcatcgttctcggtccttggtgtctgctggcaggatcggcgctccatggcccggagcgagagggcagggggccctctccagcgacaacttggtgtgtacgttgtagcgatatccggtggtttcttttggaggcgtggtttcctccttagccagtagtcttgggtgcttcttgttggggtgtggctactcctgttttttttcttta

SEQ ID NO: 6947 - DNA, 1716 bp, Triticum aestivum
  Clone ID: PAT_TA_6947
tacccgccccgccccgcaccaatcccagggggaagacgcgccgccgccgctgtgcaccaagggaggagccgccgccgccacagcaggcgtgaccgggacctggtcccccctccgaccggcccttcgtccctccgctgccgccccctcgagcggcaccggtgcccctccgcccccctctctgcgccctcagcacgctgcggcccaccgtcagcctcgattgctcgctgcgcgatgatgccgacgacggagcccgagatgctcccaatgaacttaggttgggtgctcccggcgctgaccgacgccaagatcccggagaagggctgcctgctgaagctcgtctgcatgctcctcgggtactccggcgcagccgcccccgccgccgagaagctcccccagctcctcaggatactgctccgtgcctctgtccgaggccgccgcatcgcctccgttgcgcccgcgcccatccgcgagcccgttgcactggccttttgcagtcataaaggtctccccctttcagcttctgcagagctggctcttccggtggccgaagcaatgttcttgtttgcgattatttattattactcgccgccaatgggaagcataactttggtcagcgctttcctagattgtgcactcgccccgatccttgtgactggaagactggtcccccttgtttctaagctccttgactcctccctccttgccaccttctcctccgtcaagctcccgcagatactaaaaaatttgaagaatggaagtgttggcggactgagtttaccgtcctctgtcctggacttcgttggctcccctgttatactgtttacctgcatccatgaggagcttccgttaagagattttattgggttagctttgtagttggtctcagaaggtacgattgtttgtctgatcatctagcactttaccccaatgcgaagcaaaaaaaagaaataagattaggatgggaggagactacccgtgattgtactgttctattttgggccagctcttattgtggtgggtcgcacatctcatcccggtatttcataaatacttgaggcggcacagaatgccatctgattttgtgctagagtaaaacaatattgcatgatttgcactgttaagagcactggcaagatgagctgcctggctgttttcattagcctcgctggttcgcttgttcgaggtttttccatcatgcaggtggagactccgttaactgtacttatgggctctgtaatcggcatcgtgacaaacggtacgatcctgggtcagatagcgatgtaccaaaagcctgcgccgaagaaagggaagaaagaagagtaatagggcgcgcgcgagaaacgacatgaggttcttcctggtgggtttacagttttgatccagggctattctattcttggagcaacattgtgccacttacctgcagacctcacaccatgacggaaacagtaggcagaaattcatgcagacttgtgtgatgatgaaaacgataggatatttcttcctttgtaatttttccaagtatcgtaaaatgactgcttgtgtagtttcaattgcctccttggttagcttactctgtgtaaccgtttaatgatgctagaaagatgtatatccatttttttggttggatattattggtggttctccgctattctcgccgcggcccggttcaccggctatgtaccgttgtttccttttccaagtagtataaattca

SEQ ID NO: 6948 - DNA, 550 bp, Triticum aestivum
  Clone ID: PAT_TA_6948
ggctattcagtgagcttatgactaagaaatatctcactcaagagcacgttgtctccctgcataacttattccaggtctgcagaagacaggtctacgaggggagttgttcgaagtcgaagttgtcggagcaaaaggcagaagaaacggtggcaaggagccccgacgaagtgtgtgcattgctctttggcatcgtgctgaatcagcgtacagcctcgtgcacgttgcagatggagcggcagaatcttctgcgtgagatcgatctgttcttccaggagtcgcgccaaggagagtagcattaagaccagctaacttgttcagctctaccgatcttttcccactatgtatagtatagcctctagatggtgcgcggtagtgctcatgtcctctgaaccctgagaagttttgcaactgcttatatgagagtggtggtatgcaacctgtgcaaatttgtcatggatccagccttgcaatctgaactagcaaggaacacggttgagatatacggagtagaatggtgttaaagctgatgctccgacaagcaaaaaaaaaa

SEQ ID NO: 6949 - DNA, 675 bp, Triticum aestivum
  unsure (1)..(675): unsure at all n locations
  Clone ID: PAT_TA_6949
ccacgcgcccgggcgagtgcgactacctgcgttgcaccttggctagccctagccatggagaacgccggcgtccccaacggaccagcggcgccggcgcctacccaggcgaccccggtggtgcgggagcaggaccggctgatgccgatcgcgaacgtgatccgcatcatgcgccgtgcgctccctgcccacgccaagatctccgacgacgccaaggaggcgattcaggaatgcgtgtccgagttcatcagcttcgtcaccggcgaggccaacgaacggtgccgcatgcagcaccgcaagaccgtcaacgccgaagacatcgtgtgggccctaaaccgcctcggcttcgacgactacgtcgtgcccctcagcgtcttcctgcaccgcatgcgcgaccccgnaggcnggggcaacaggtggtgccgctgcaggcggcaggcccgctgtgacaagtgcacctccccgcgcggccccgcccgtgctccacgccatgccgctgcatgctcagatgcagcgtccgatgtacgcgcctccggctctagtgcaggttcagaatcagatgcagcggccaatttacgcgcccccagctccgatgcaggttcagaatcaggtgcagtggcccatgtacgctcccccgcctccggtgcaagttcagatgcagcggggcgtctacgcgcc

SEQ ID NO: 6950 - DNA, 979 bp, Triticum aestivum
  Clone ID: PAT_TA_6950
gacctcgccttcttcctccacgccggtcggcggatcgtcttcgtccccgccgttcagtcccacggccacctcgccttctacctccactctggtcggcgaatcgtcttcctcaccgccggtcaagttagtcgccattaacgaaaatacgtcggttttgacggaaaggccgaggacgtggtagcgacagaggaggaagggtcgacgaaatagaagagacactcccaccgccgtcatgttcccgccgggatctgttgagggcaggcagcagcctcaagagaggaggtcatccctgccggtaaagatcagatcttctaagacaaagcagaggatggcactctccctgtctcagccggtggatcaggtcggaggcagattctctgcacttgtggattgcctggtgaggaaaggtcatcttccgatctgtctgacgcttcggagtctgatgagggtccagagacttacgacacaaaccatgttttggcctggagagatcccggtttgcctacaccagtttatgtcagaatggatagttcaggagtttttttacacatatcctactctgggtgataagccgttgcagagccttgaagaagttggaagtgctgttgattcctatgcttgtcccaatggtcccaatagcaatgtcatgtctgataagatgctttcaaagaaggaacgtgctgtacaggaacatctttacttcccaaatggcaccagcaaggtctacacacaagggctcaagtagcgaagagggaacatgacaaagttcggagactggttgaagctttactggacaagcggaatgacgatgaggatcttgtggatgaactcgaagaaattgttcattggcaatcaatctgcgaaggtgtcgaatggtactattatctcaatatcactgtgaagaccaaagagggtgccgatgatgcgggcagcaccagtctattcttcgttgaagtcgcatgtgattcaaatgatatca

SEQ ID NO: 6951 - DNA, 808 bp, Triticum aestivum
  unsure (1)..(808): unsure at all n locations
  Clone ID: PAT_TA_6951
ccctgcccataatcattctgcatggcgaggctgatttggtcaccgacccaggcgtgagcaaagatctgtatgaaaaagcgaggccatccgacgggtcgcgccgtcgcttcgaagacgccctccacgccaccgtgagacggcgatcctgccgtgcgggtcgcccctgtgcgcgacgtttcagtcgccgggctgcctgctgcgcccctgcagctggttctccctccctccgcgagccgccctcctcatgtggtgcttggtccgcacatcgacttggcactggtggcgttctgccagttagaaaaacaagagcagtgttcttacaatgtgattgcctacaaggataaaccacgtctccgaacagctctgggagatgctgatggaccacacaagagatagaaagccgcctacaagaagtttccctgcccataatcattctgccatggcgaggctgatttggtcaccgacccaggcgtgagcaaagatctgtatgaaaaagcgaagacctcggacaagacgctgcgactttacaaagacgcctaccatgccatcttggaaggtgaaccggacgaggggatcttcaaagttctcgacgatataatctcctgggctggatcagcatgcggcaaaggaaacaccgtccgtcgtgagctgcacagatcattttttgtcatttgtccgagcaccacaggtcacggttggggattccattttgggtttcacacttngatacacacgcttatttcctgttgattgtgaatatgtacctagtaataaaaaaaaatcatcatctgtgggtgtgtgatagaaa

SEQ ID NO: 6952 - DNA, 435 bp, Triticum aestivum
  Clone ID: PAT_TA_6952
gggaaaaagaagagagaagcagatcgcatcatgccacctgcaggggatctctctaagaaggtgaatgcatcgtcaagccgtacgccgttgaaaaagccaacgtcgttcaagaagaagccagcgccgcctaagaagaagccagtgtttctgcctacgaagaagcttgagaaaaagtgagggcacagacgcccgtccagccgcgcgcgcatgtggtgatctccatcgatacctttcggccatggtgaagctaagggtgtttctgtcaagtagattagttagagttaattcgtaaagtcggtttgatcaaactcgtggagcccgtagctagttaaatgtttgggcgaggtattttttttgttgcaaagtcaagttgtgtatggcaggttgttgttgggcaactgaataaaagaagagagttggaaatgaaaaaaaaaa

SEQ ID NO: 6953 - DNA, 1027 bp, Triticum aestivum
  Clone ID: PAT_TA_6953
ccgatacctttactatgccgctctccaactctacgtcgtctgtgccggccgtcaccgtcccggcggccgaggagctcctccgacaagggctccggccggcagtcgctgccgcggcacgtggcgctggtgatggacgggaactcccgggggccggcgccccgggcccgccccccgccggccggccccggccccgggtgccccccccggaggaggccgggccgcccccccccccccgggggctcccccggccccccccccttcggtttctcgctcgagaaactggcaatcgccccaaggcggaggttgacttcttgatggccttgatcgagaggttcatcaaccgacaacctcgccgatttcttgagggaaacgggacccgtctacgtcataatccggtgaccgctcaaggctgccgatctctgtgcagaagactgcacgacgacgccgaggaggcaacaagaaacaactcgcagctcgatctagtcctagccatcagctacagcgggcgaatggacattgtgcaggcatgccggaatctcgcccagaaagtggacgccaagctgctcaggccggaggacatcgacgagtcgctgttcgccgacgagctccagacgagcgaaacatcttgcccggacctgctcatcaggaccagcggcgagctgaggctgagcaacttcctgctatggcagtcggcttactcggagctcttcttcaccgacacgctctggcctgatttcggggaggcccaatatctccaagccatgatggccttccagagcagagacaggcgctttggaagaagaaaaaacaatgcagcgctataaataaacggtgcgcgcgcgtgacccgatgctcgatcatcctctatctatctgtatctgcctttataatcagtttttattaccttcaaaataaagtgtttctctcaagatgcgtggtgtactataggagaggctactaaaactcctctccagtgattttactctatgctatatgctcattgtatttaatatagtttagcattcat

SEQ ID NO: 6954 - DNA, 1053 bp, Triticum aestivum
  unsure (1)..(1053): unsure at all n locations
  Clone ID: PAT_TA_6954
gccaggccaggccagagaggaccaaaccctagccagctcgccgcgcgcaaccctccccagatctcgccgtcgtccccccacccccccgggccgctcgcgcttcccccgctccccgcctcgccggcttctagctcgcgagctagccgcgcgcggatcggggtaacaaagcatggaggaggacgcggtcgcggctgctgcttctgcggtggcgcccgactcgtgggagacggccgacctcgacggggccatgagccgcctgctcctctcctcctcctcctcctcctccggtggcgcggcgcgaagggtctcctcctcgcccgacctcgccgacgaccgccaggccgacgcgcagcagggaggaggggcagcagcagcgggccgacgatccnggccgcgcaggtcgaccagttcctccgncgaggccctcgagaagccccgcgaagcgcctccaagtgctgcggatggagcaagacattctcaagttccttcgtgaccctggacagacgcagtttgagttccagggtcttcccacttcgtacctgcgtctcgctgcgcaccgtctggcacagcattatttcctgatatcaatcgccctgccggataacagcctgcctgatggaaccagttcgcggatcatccttcgcaaaacgtcggctgagtgccgattgcctgctgtccgcctagctgatattccagttaatctccctcaagaagagagcagcgctgtggccaccaaagtagctattaagcaaaggccgcagaagaatcagcatggcggcgcaggcgcaggtgccaactctaacagaggcaaccttcagaaaagcgtcgaggagaggaaagaggaatacaacagggcacgtgctcgcatatttaacagcagtagtggtagcactagtccggttgatggaagaccagctgatgaagtggttttgcccaacaccctacataggtccacttccttggagttgaactcaaacaccaggtttggtgaattgactgaagctacccttgaaaggagtttgactagcactgcatctagcagcagatcaaata

SEQ ID NO: 6955 - DNA, 643 bp, Triticum aestivum
  Clone ID: PAT_TA_6955
gctaccgcgtcgcgccgccgctccacaaaactcccgccgaaccacacctcctatcccctggcgaccccgccccccggcagaactctcgccacgagctgtatccggcggccgccacccctcatcgcccttggctaggcttccctcaatctccgatggtcccaccgcccccagcgctcctcccggcggcggatctgggccagcaactaatccctcctcccccgcgactgattgcctccagtaccctcccctattttctctatatcgccaaccatggcgcccatggcgaccacgaggctggaaggggtctcgtggacccgagattgcgagaggagcagcagtgccggcggtgacgccccaggaagaccgtagtgtggtgctctgctctatggattcttctaccatggagttcatagtttttgcatttttgtttcatattttttatgtgcaaaaatacaattcagtgcagttctttcttctctttgagttttggttctctggatgatgtttgcatccaggttgtaaaaatttgcctgcgtcaagtgcaattcagaacttacaagttcggctatcagtttcctctgcagttcattatagtagaatttttctgtgttgaattcagttatctttgctttgctctaggtcg

SEQ ID NO: 6956 - DNA, 1010 bp, Triticum aestivum
  unsure (1)..(1010): unsure at all n locations
  Clone ID: PAT_TA_6956
gctttgggtgggtaatacaatcaacatgatccgcattattcccactcaagcaattgagcttggaacatttgagtatgtcaaaaggggcatgaagtcagcacaagagaaatggaaagaggatggatgcccaaagatacagcttggtaatatgaaaatcgatattccactccacttgttatctccagttgctattgctggtgcggctgctggaattgctggtacattgatgtgccatcctcttgaagtaattaaggatcgcctgaccgtggatcgagtgacttatcctagcattagcattgccttcagcaagatatatcgaactgaaggtatcagaggtctctattctggcctcttcccgacactaattggcatgcttccttacagcacatgctactactttatgtacgacacaatcaagacctcatactgccgcctacataagaagaaatccttgagccgtcctgagctactaattattggagctctgacaggtctcacggcgagcacgatcagcttccccctggaggtggcgaggaagcggcttatggtgggtgccctgcaggggaagtgcccgcccaacatggtggcggccctgtcagaagtgatccaggaggagggcctcctggggatctaccgcgggtggggggcgagctgcctcaaggtgatgccgaattcgggcatcacctggatgttctacgaggcgtggaaggacatcctcctggccgagaaggacaagcaccttgactagccgacgatgatgaaacagcccttaggcgactgggccgaggacgatgagttactgaacaaacaaacagggctacgcgttgctgtggtagaataatgttgtgtggggggttcntgatcctttcccagttttcgaatcccccacctctgcctgtgccgaacggttagataggagggacgcgcggtgcgattgggagtggaagcatttgtgtttgctgctcctttgctaatttgggatgcatgagttgcgcaagagtactattcgt

SEQ ID NO: 6957 - DNA, 615 bp, Triticum aestivum
  Clone ID: PAT_TA_6957
gggcgatctctcctccgccgaccgcgccgccatgtcgtcgagctagtccgagagccaaggcgtggcaccggggggcgtctggccgtcgagccttacattagggcagacggaggatctcacccggttcggcctctacgttctgccgtctgcgatggtgccgcggccatggaggatttccgccgatggctaccccatgcagggccctccggcgaccaaagaggacctccgcgcgcaccccgggggcactacgacaagaagaaccgccgccatttttgtaacggcaagcggttcgacgacgtgatccacgccttcaaacacgccgcccaaggggtcatgctgcagtgctacgtgacagctgctgcactggtggcctcagttatctttctttttgcgaggttggtgggctcacttatcatcgaagaattccgccgtgtgagatattgcggtccaaacaccgtgagatatctgtcacagtggagaaattccaattttgaatgcaatatcctgccgatcctgtactcccgtggtctagtggtagaatacgacagggcggcttcgagttcccctctgttcttgctcttttcttattctgggattagcagtcaaaccgactag

SEQ ID NO: 6958 - DNA, 599 bp, Triticum aestivum
  Clone ID: PAT_TA_6958
gccatgtccatgccgatgccgtcggggtgctggtcggaggaatggccgggccgccgccggccggcgacttttacgtgaatttctccgcgggggacattggcagggacagcaagatatggaaggatcccgacgagttccttccggagaggttcctgaccggcggcgacggggagggcatcggcccgttgccggggcccaagcagataaggatgatgccatttggcgccgggcataggttctgccctggcgtgggcatggcgatggtgaacatgaagtgcttcttggcggcgctcgtgcgcgagttcgagtgggcgccgccgactggcaccatcgccattgacctcacggagctggattccttcttcaaggtgatgaagaagccgctttctgcgcgtgtcacgcgacgcaccaaatccatctaaagatctcgtgaacctacatgatatgtgtagaataaaattgttgtgtttgtaccattgttgcagccgagagtaagggtggattaacaagctgctcagctcgttaaactcgtactcttgaaggcttgacttgttaaactcattaagcttaaaaaaaaaaaaacctcctcggctttgttc

SEQ ID NO: 6959 - DNA, 625 bp, Triticum aestivum
  Clone ID: PAT_TA_6959
ttcggcacgaggtccccttcagcagtttgatactatccttgacatggaaaaggatgatttggctcctgagatagaagaggaagaagaaggtgagatagagtatgttgaaggcgatgatatccagatgggtgacatggacgatatggaagattttgaaggctttggtgatgaagatgatgatggagatgaagatgatgatttggatgagccagcaacaaagaagcccaagttaccaggctccgattcgaggtcaaagattgggcggaagtctacgaaggttatcacagaggtggaagaagacgaggacaggggtagcaggcaaaggacgcgaatgtgattcaccgggcgcggcttcagtaatatgctcggcgttgatgatggtgtactttagataattttgcctctatcttctgatggtaatctgtagaattcatatgttggttattttgcggcgaacatggaaggtgacatgagctgtgacttagaacaatgttgtacttggagcagtgttcagtgtctcagatcagaaccagttttgtgcgaagctgcggcgagtgtaaactgttaatgttaagttgtgtaatgggatgcttttgaatttacaattacacaggcaaaaaaaaaa

SEQ ID NO: 6960 - DNA, 823 bp, Triticum aestivum
  Clone ID: PAT_TA_6960
gttgacgtactttgtgaggctaacgtagctgatggtttagaagaatgtgaggaatggttaaaagcacatggtgccgttcttgcagtagatgaaaatagcggagaattacagatagacacaaaggtttcttctgcttctctatacatgccggagcctgataatgctgtttcacatggtgatgcatctcttgccgtagatgattttttggcgcgagcatcataaagaatgtcatggtgattgggtgagcaacttttacccttttggcaccgagctttgatgcactgcgatattacatattgccaatgccagtagaggaacactatattaatgcaggacatgcacatgaaattgaccgcggatgaagggtattgcaactaattggcttcacaaacagatgcagcatgtgagtaggcgacattttggtagcctcacaatgtgctctagtgccgttggatccactggcaagttctgataagcgactaatctccagctctgtgagtcccgtatcacaatcagaagtatgggcagcactaacagatatgaatcacccggtaaaatttatatataggtccgagcattgagcattgcctttgtaccgcctgtttttgtcataacccagttcagtgtattgtacaatttttgttcacaataggtgttgcccgatgtcagtttttgtcaaattcgacaatactgatgttctgaaattttgttccctcattttcctcaggagaagtcatgtttctcagggttagagcttgtggtaagagtgactaatgtttcattttctgttaccatgtagggaccgttgtaaactgcagaacaa

SEQ ID NO: 6961 - DNA, 1017 bp, Triticum aestivum
  unsure (1)..(1017): unsure at all n locations
  Clone ID: PAT_TA_6961
tcgccgacncggcatcaacgacgacagccacgtgttggcgtggatgatgggcctcgaccacatccacgtgaactccttccgccgcctcgcgagccttagggaggaggtcttcgacggcccccccgccgagtaccgagtcaccatcgacgccctccccgcctcccactcctccgccctcctcggcgtggtgtacttcgagggcggcgccagcgactggatcgttcgcaacgccgcccgcctcactgccctggcgaacgtcgacgtctccttccagctcatcggcctcggcctcctccccttcctccacgacaaccccaccagccagccagcgcttcggttcctcgtcgactacgtccgcgacgtcagggagaaggtcggagccatgggcggcgagttcgtcacgcacgccactgacatgtgtgacaacctcattgcgaacggcacgcgccccctcccgcccccggagatgaggatggttacggagcagctgcgccgggatctcgatgtcttcagatcccgcgacctgtccatccacgagtccgactccaccggcgagcccacctcaggttcgtctgacgcctcggactccaccggcgagcccgcctcaggttcgtctgacgcctcggactccaccggcgagcccacctcaggttcgtctgacgcctcggactccaccggcgagcccacctcaggttcgtctgacgcctcggactccaccggcgagcccacctcaggttcgtctgacgcctcggactccaccggcgagcccacctcaggttcgtctgacgcctcggactccaccggcgagcccacctcaggttcgtctgacgcctcggactccaccggcgagcccacctcaggttcgtctgatgcctcggactccaccggcgagcccacctcaggttcgtcttaggcacagatatatggtgtttgcctgcgttccttatgagagggagaattctggcttaacgagttgctgctaagactggccatagtagtttggatggcgagactact

SEQ ID NO: 6962 - DNA, 489 bp, Triticum aestivum
  Clone ID: PAT_TA_6962
gaagcgcaactgcatccccggcttcgccaaccagaggggcccggcggagtgcgcctcgttcctgagccagcccaagacgtgcgcggcggcgagcgctcgcgtggcgtgccccgccgcggacgccaagatgaacacggcggcgccggaggggaaggtggccaaggactactccagctacgtggtgtacgccactctgcatgagtgaggtgccagcgcatgcagtggggacgccgtgcctagctacgtcgtcggtatttgctcttgtattcttgtaatgtgtttggtgttgttgtgcacgtgattgctgtttgttttctttgtacgtgtggctgtcgggtctagatctcggctcttgtgtgtgttgtcctgctacgtcagttctgtggtggtaaattaatttgggattgtatcctgcatgtttcaactatatatttgttgggctgcatatttcaattatgtgatgttgggattaatgtgaaaaaaaaaaaa

SEQ ID NO: 6963 - DNA, 796 bp, Triticum aestivum
  Clone ID: PAT_TA_6963
ctgcgttggggcctccccgcggggagtggtcgcggcctcgcctaatccccgtatcccccggcccacaccgggcacaggacggacagcacccccagcacacgccattttgtggagccggcgggaggatcctgcgtgggcgaccaacagccgctccatctttcccacactcgcgattccctgcggattctgcgtgcgccctgcctggtgggcgtggcgaatgttgacgaatcgccctatcccccggatcaccgggcgcgcatcagcgtgaggacctacagaacagatgattttgtggagtcggagggaaaatgcttagtcgtctccaagcagtggatgcaggtttacaagatccgcgatttcatccggacactagatgcgccatgtctggttggtgtggtctacatatgagtactaagcctgacctgcggggtccgttcctggtgtgcctcttggcgtgtgtgtgcttctctttctgtctccagtgttgagcttgggagcctctggtgtctttgggagcttcaaacaggcctttctgatcgtgtattatatatttgtgctgaatatctcatatgcacacagcgcttaacggaacttcagacttagaaaggagttttttgtcgtttatttctaatttccttttccttgttttcaccatgctatctgtaacaattccatgtatgtctcttggcttgtgaaaactacataccgtttccttgtttgagtaatagactaaattctgataattgtgtaaaagaaaagggaaattaactaaaacttcattatatttcataacata

SEQ ID NO: 6964 - DNA, 598 bp, Triticum aestivum
  Clone ID: PAT_TA_6964
ccacgcgccccccccccgcgccctccagcgccccccgccccccccgccgccgccgccgccgccgctcgccatgtccgactccgacgaatacgtggacctgcccgtctcggacgaggaggaggatgagtgggagggtggagacgaagctgacgaggaggaggtgcagggaagctctaagaagaaggccaagcagcacgtcgaccaactcaagaggctgcaggaaaaggatcccgagttctttaaatatttggaagagtgtgataaagagctcttggaattcaatgatgatgacatcgctgatgatcaagaaagtgacgaggaacctaaatctgtccctaaggaggagccaaaagaaagtgttaaaccaattacgatggaaatggttgattcctggtgcaaaggggccgaagatgggaagataggttctatcaggtctattcttcaagccttcaggagagcctgccattatggcgaggacagtggggacaattcagcaccaaaattcagtgtcatgtccggtagtgtactcgacaaagtcatgcactacgttttgaagaacatggatagcatccttcgccaattactcggtgcccctagc

SEQ ID NO: 6965 - DNA, 756 bp, Triticum aestivum
  Clone ID: PAT_TA_6965
tttttttttttttttttttgggggcaggaaaaaaagggacaatatcacaagatcaataagtttacagctcatatatccggaaccagtgcattggtttccgataaatcaattgaataagtctatgatttgttacacccattaaattccgcttctggggatttgggaagagcctcctgtacaaggctcgttgtaagctacaagaaccagtctaatgtgcctatctactcttgcactaagatcgatcacaaccccattggagaggaatttctaaagaccagcaaagctactgaaccacctcctgattccatcatccaatggagaatattcctttcttgattccatcactggatgtactagaatggtgtttgctgtcgtcttccgacggaagtggcacaccgaatacccagtcgaggacattcaggtacttggaccggaaaacctccctttcctgggcatagcagtgcataatgatcgaggtggccatgctgaaaaccactacatcagctcgcttgatctgcaatattggagggcagagtccggcgtcggtcatgcatgtgaagaaactctcgatggctctggcaaggcagtacagggatatctcggttctcctgcttttcttctcgataaacagtgccagacccgccgggaacgtgccaagtacaacgagtggagtactgcacttctcgaaggttctaaaaaggaagcatgtccaagcccatgcagatgcgcaatacattgagaggaacaggctagatc

SEQ ID NO: 6966 - DNA, 1609 bp, Triticum aestivum
  Clone ID: PAT_TA_6966
ccgggttccggacttgcgccgccggcagcgcctgttactgccttctcgttcgggcttggggttctcttgcccgtggtggcctcctggtgtgcaatcgacggcggtgcgtcgcggcccgcgggctccgggggcctcctccctggtcagctcgcgccgggccatttgacgggtctgcgggatgcgttgtgcgctgctcatagcccgcccgggcggaccccaagtaccttgggtgttggccagagggctccaccgggctcgaagggcactgtggtgggcgcggctgggccactgcgcaggcccaaaggggagcctccattgccgggcagcttgctgtgccatggcttcattctcgacctccccgagccgttcccctcgcgggccgcgctccttggttcctgcagcttctgggggggacgggtgacaaggctggctcgcggccccctggaaaccggagccaatcttccgggccctccggcgttgctgttccgccgttcggttccacggttatttcaggggcagacagaagacagcttgaacaattgactggggaattctacaccgtgattcctcatgactttggttttaacaagatgtgtgaattccttatcgacactcctcagaaattaaaagctaagctggaaatggttgaagcccttggggagattgaaattgcaactaagcttctggaggatgattcaagtgaccaggaggatccactgtatgctcgatacaagcaacttcattgtgactttacgcctcttgaagttcattcaaaagagtactctatgataaaaacatatctgacgaatacacatggcaaaacacactcgggttatactattgacattttacaaatgtttaaggtgtcaagacatggtgaaacagagcggtttcagaagtttgctagtgcaggaaacaggatgcttttatggcatggttctcggctgtccaactgggctgggatattttctcagggtttgagaattgctcctcctgaagcgcctgttactggctacatgtttggaaaaggggtttactttgccgatatgttctccaagagtgcaaactactgctatgcttcacaaacatctagatctggggtgctgcttctatgtgaggttgcactgggcgatatgaatgaactactaaatgcgaaatacgatgctgataacctgcccaaggggaaattaagtaccaaaggagttggccagatggcaccagcggagtcgaaggtcactgaggatggcgttgttgttccactcggaaaaccgaaagaggaaccttcaaagaggggtagcttgctgtacaatgagtacattgtttacaacgtagagcagatcaggatgcggtacgtgctccatgtttcctttaacttcaagggaggacggtagaccaggcagtctctggaagcaggaggcaatgatgcgggacctccatcgtagcaaaccacttttgtgtagattgttagtgtaggtggtttttatcttcaggggactcgttttgttgagcaaatgtttaagcctttcctcccattttaatgcctttcctcgcattttaatgccggttccaggcttccagactctgaggctgatgctgcgtgtatatttaa

SEQ ID NO: 6967 - DNA, 571 bp, Triticum aestivum
  unsure (1)..(571): unsure at all n locations
  Clone ID: PAT_TA_6967
ggcgtgcngggagctggagcccctccaccccaccacgcctgctacggctgctgttggcgcgcgtggctgtagtccggtcaggcagtcgcgcccggcctctgcaaggcgcatatccagggaagcacgcactccaccggcgtcgccaccgctgtctccgacaacggtgctccgaaccccgccagcgccgaaacgtgacgaagcacatgcagcagcagtggcatcccaggtcctgagcccggtgctcatcgagctatgtttgccagccacgatgcagcgcccgctccttgacatctccccgctgcggcctccaggctttgaagcatccccaaccccgccactccagtgcaacggcaacctgcagcgaacccctacgccaccccgtgctcgcccccatgatgctgggcacgacctgccggcgggcctggctgagctcattgtgccctgcctcgagcttccggctacgctcttctgcccaaggcagccggcgctcctgccatctgcagccacgcaacctccccctgaggtgcccttggcatctccaaggccaagccctccagcggcccgtcgaaag

SEQ ID NO: 6968 - DNA, 1468 bp, Triticum aestivum
  Clone ID: PAT_TA_6968
gcggatgccctccaggcgctgcccgcggcccccgcggcacccgcggctgccgcccccgccgccgctgccgcggcgctccgcgagccccccctcccccgcgccacggccccccggcgccttgcggcgcccccggcctgcgtgcctgtccatgcccccgccggggtcggcgacgcccgcgtgcggcgcttacccccgcgcgacgaactcggcgccaacgatgatgttcgcccctactaccggggcctctccagggccgcctgggcggccgcgcaggctcggtcccgcgccgatggcaccgctgcccgccgagcccgccgcgtcccggcggccccgccttcctccgccctggaccttctcgaggagcccgtccccgaccaaggggcgggggcgggctaggcggaggcggagggcaacgcacgagccggaagccgccaccccgacggcctggcatccgccgacggcgcccgcggcgaccgggacggtgcgcgacaaccccaagttgatgaaggggagcaggaggcaggggatgaggcgccgggggtgccgcgcggaggagtggaaggacaggcagaggacagtggacatcaagaagaagcagaagcagaataagcggaaggagaacatccagggcccggcgcaggagaggaaggcgcgcaagagagagaagcgtgggaacaagcggatgcgcctatggatggaaagggtaaggatgggaagaagcacaagaaggaaggggaagagaaggcaccagatatcatgtatggcaatgtgttggttgatccaaaggaagcaaggcggaggaagaagaggaggatcaagaacaagaagaaggagctggagcaggctaagcggatgcagcgggcaaaggaggatcctaaaaaggcctccgagatggcctgggatgtggcaacaaggcgcgcggctggggagaaggtgcacgacaaccccaagttgattaaagagagcatgaagaaggataagaagcggcaggagaagcatgcggaggagtggaaggacaggcagaggacagtggacatcaagaagaagcagaagcagaataagcggaaggagaacatccagggccgggcgcaggagaagaaggcacgcaaaatagagaagcgcgagaagaagcttatgcgccctggttttgaggggcgcaaggaaggctatgtcaacgagtgacatctgcattgaagatgatgatgactgagtactgtctctgctttatgttttcaaggttgcatatgttggtgttggtactggaaataggtatccagattatgactaccatacttaattatagcttgaagatcgaatgtttggcaggtcatctggaaaagattttgagatattccttctgctgtattttcattgagcttagataaatttgtcgaaaaacaaactttcatgtctggcttcataattatctctagcactagaccaaggaaatattaatgttcttttatgc

SEQ ID NO: 6969 - DNA, 1052 bp, Triticum aestivum
  Clone ID: PAT_TA_6969
ggtcgatatctcctctcctcacccttcccttgtgttcttcaattcaattctggccagaagctgccccccttctcctcctcccttctccctcctggtgcgcaaagatcttcaagctcttcaagattcagcaggccggtagaaagagatcatgccgtgcgccgccgagcttgtcaacggtgaggggggcgccatcaaagtgggcacaaccggcaccatcggctcgctcatgacgagagaactggaggccatcaaagtcacgccgcaaggagctgccaccccgcgcctgagacgccaaagcagtccggtttcggtgccctgcggcgctagcccccggaagatcatcccaaggaagagctcgtccagtgtctccagcagcagcaatggcagagctgaccgtgtgagcgctgaagaagcctgcaagacaaggaggagctctcagcggaacaagtccagctccccaatgctgcactcggacggtgtgctggttgacaggagccccaacttcgagaaggccaagaagaaaggaaatgtgcatggcgtcgaggtggtggatgtcaggtgcggtaatccgatgagcagccgcctcaggaagctgggtttctccaagctgtcggagacctttgcctagccctaacggaagatgactgaaatcaaagctgctgctgttgttgctgccctttcctggagggcatcttgggtttctttgtgcaagcctttggagggcagtacgatgccatctttggtgagcacaatcatttcatccacctgactgcatccctctgtgtcgcgatcccgtttaggtcagctttcctgctcatgtgctctgatgcgtggaaaggtagtctatgaaaagcatttcccgtcagaagctagatgtcaaattgtcaatggatgatataatgtacttctcggaaaacctggcttctggagtactccctgcgttctgaaatagatagatgacccaacgttgtactaactttgtactaaagttagtataaagttggtcatctattttggaacggagagagtagcagataagcttcctagactct

SEQ ID NO: 6970 - DNA, 760 bp, Triticum aestivum
  unsure (1)..(760): unsure at all n locations
  Clone ID: PAT_TA_6970
ccacgcgtccgcaatcaagtagcatgaagttcagagttgtttgcaggaagttgtacgattacgtgaggtatgatcttaaagagatcgccttcccatcttctctgccagaccctccgggcaccaagaggcgtcctaagctcacactgaaagagaaatggtgtatcctcaaggaggcaaccaggctctatggggcttcctgggtcagggacatcggtcccgagctcaggccaaatgattacaagaaggtcaaagaggaatctgagcctaacagcaccaaggacgggaaaactaaaagtgagcctagtttgcttgaggatcttgcagtggcagcaaagggcggggcggagaccctgaagcctgcgctgcggcgcatatacatgacacgcgcctctacctacacaagtgcagtgaagaactatgtggagacctaccaggaagggctgaaggatgtcttggacgagaaggttgctggaaaggatcaccagcaaggcaatgagccaaggggaccatcgacaccacctccaccaccgccaccgccatcatcgtcatgaccttgtatcgacgccacctccaccaccgccaccgccaccgccatcatcgtcatgagcttgtgtcattttgggggaaatattatcattagaacttgcagcttcttgtttatatattctctnatcagcaagttgggtagaacagctaacgatgtgctgctcatttcctaaaaaaagatcttcatgagtaggtcttggaccntgtccatctg

SEQ ID NO: 6971 - DNA, 291 bp, Triticum aestivum
  Clone ID: PAT_TA_6971
attctaggagtcgacgggtctgatgggattgtccgggtggaaagtccgcttgacatgaaaatagtagacctggtgattttgggtaaactagcaacgtgagatagctgttcacctgttaggtgttatctgaactgtcctaggccgcaaaattagaaggaaaaatacatgtttttggtcaacttagcaattttagatcgctctaaccggtcagattggttgttcttaatcccacttgctcagtatcatgtgaattattggaccatgatgtagatattcccagatgctgcccgg

SEQ ID NO: 6972 - DNA, 2118 bp, Triticum aestivum
  Clone ID: PAT_TA_6972
ccctctctgtctcctccccgtgccggacggcgaggtccccctctccctccggccgcctctcccctccgtccccgtcgcgtctcggttccgcgggcgccggtctccgacgctatggggttcctcgaggactttcaggccagtgttgaaacattgccagctatgctgcacaagaactattcattaatgcgagagctcgataaaagcttgcaaggtgtgcagctggaaaatgagcagcgatgtcaacaagaaatagaggacattaagcatggacttgaatctggaagtattacaacatatgagccagcaaaacttaaattttctgatgaggcaatcgaggagcagaaacattgtgttaggattgctgatgagaaggtggctttagccacacaaacatatgacctggtcgacgctcatatccaacagcttgatcaatacatgaggaagcttgaagaacttcgactagaaaaggaggcagcagcagctgcagctgcagctgcggcagatacagctgttgctgctacttcagctgctcctgctggtgctggtagcttaaggtctgcagctgctgatcctgctccaaaaactggaagagctggcgaaagaagcagaggagggcggaagaaggccaaggtgcccatggagatgcccacagagatgcccgtggaacagccagctatagatttagaattgcctgtcgatcctaatgaaccgacatactgcttctgcaaccaagtcagctacggtgagatggtcgcgtgcgacaaccctgattgcaagatagagtggttccactttggatgcgtgggcttgaaagagcagccgagggggaagtggtattgcctgagttgcagcgcgttccaaaagaagcgcaagggcaggtgagatacatatggcccttgtgctaggaggtatgcactcggtcatccgtgatcgtctgataccattgtgctgagcagcgcctcgcttgtttggaaagcaactgttgaatgtagcttgagtgatcttgcacatgttgtgacagtctttaggagtgttgtacatgtgtggccccgtttagaacatgggaatttcttcttttggtgtgggtgatgaactggggactgaaatgcttgcaatattccaacaatttgttatgccgttagcggctaggagaatgagcaaaggcggctatgtatgcgcatcgaaaccaacctagttcagtaggtgtcccgaaaccccgtcgagcccaacgaccccccagccggcttccgcttccttgccacctacggtgagatggtcgcgtgcgacaaccctgattgcaagatagagtggttccactttggatgcgtgggcttgaaagagcagccgagggggaagtggtattgcctgagttgcagcgcgttccaaaagaagcgcaagggcaggtgagatacatatggcccttgtgctaggaggtatgcactcggtcatccgtgatcgtctgataccattgtgctgagcagcgcctcgcttgtttggaaagcaactgttgaggggagctccccgcttcctccgctcccggtgagactcccgcccactcttctcccggcgtgcccccgttccagccaccggacgcccccccctgctacccgcccccggacgccgacgacagtcccgccccctcgccaccccgcgcgcctcaggaccatttattagcgcggctgcccgagaaccactcaccaggcgccgagctcgataacggcctgcaaggtctccaagccagagatgacacgcggcctgcactggaacccgagaacattacaccagggcgggaacccgaaagtagcttgccagatgagccactcgaacatcagcagccttgtgagccaatcgcggaggagaagcagcctgtacccacacctgcagataacctggcctacgccccaccaaaacatcaccttcccgacgcgccgatccaggagcagcatcaatgcgtgaggaaggctgaagaacctgcagctgcagccgcggcagcagctgccccggccgccgctcccacccacccccgcggtcgctgcgtcgccaaccgtccccacctgctgctcgtaccccaagcactggaagcgccggccgcaccccccacaggggcgcggcgtggct

SEQ ID NO: 6973 - DNA, 568 bp, Triticum aestivum
  Clone ID: PAT_TA_6973
gcgccgccgattccctttaatgtggcgatcgatcggtgccttcctccgcctcttcgttgccgtcttgccgacggatctgacgaagaaacgcggcgcaccggtagcggtaggcacgcagactggcgtgccgcgaccatgcagccaccgctggagctctcgccgccggcacccgcccctagagaagtggtcgtcgcagagtggccatctaagaaaatctgccactgcttggtctctacctcagcctcatctgaacaacgtgtttgggcagacctaccggacagcctgcttcacctaatcattgctctcttaagctcattccatgacctccttgcttttactgggcacctgtcactcttggcgtgctgcggtcttttccttcccatcatcccatatatgccttcgtcttcccacctctccatctcaaagcaggtttgcgtagggctaatcggcattgcgacacatggtactatctcttaatcgaactacaaatggcgtccttgtgatcctgtgaggacagacttatctcttcgcccctccgccccccggctcactccaatgccctgcgcta

SEQ ID NO: 6974 - DNA, 713 bp, Triticum aestivum
  Clone ID: PAT_TA_6974
ggcctccaggtgattccgcgcgtggccgttatggagctcgcgcctttgaaagctcgggacgtgaaggtgcgagaattttggggaagatggcgggaagagtgcggggagtttgctggcgagaggaaaggaggtactgtgtttgggtcggttgtggttacatataagcccaagtgagcggcggctgttgtagccattccatcatcgcagcagcctctcgccactggaagcacatacctcacgttagtgagggttgggctaattgcgtgactagcgcggtcgaagaggacggctgccgaaagacaactcttctaaaggcttctggggacaggaaggaaatcactgctgctgggatagagcgcccgtacagggaagtcgggtgttttgctctgggtgtagatgcgtcaagcccttgtatccaaggaggacaacgtgaaatgattgttttgattccatgtggacactgccgatggatactatctcaagtcacatggggctcctgttgggaactttcccgcttattgcttgagatgcgcattgcaaactaaattctagtgcaagagttctcgtgaacaggcgcccatgaattggaaggaaaagactccccgtgagcctgagctcagagaacacgtgaatatttctcgtgttgcagatgcttaagttacttgagctcataatttataatgctatatgccatgtgggctctaaaaaaaaaa

SEQ ID NO: 6975 - DNA, 466 bp, Triticum aestivum
  Clone ID: PAT_TA_6975
attcggcacgaggctggtgtccacgggcgagctgaggatccccaagttcgacgtgtcggtacgtctcgaggccacgcagatcctccgtgatctcgggctggacctgccgttccgtctcactccggccggtgaatccttctcggagatgctggccttggacgagcacgattccaagatgccgatggcggtgtcgtccgtcgtccaccagtgctctgtcaacatcaacgagcacggtaccgtggccgccgcagccaccgagatggagattctggggttttgcctgccggaggagaaggtcgtagacttcgtggccgatcacccgttcctttttttcatcatcaaagaggaggacaacaatggcgtgattcttttcgccggccaagtagtcaatcctctctcttagagcaattaatatgatgaatttgttgcaataagtattgtgaggcgttactcgttaaaaaaaaaa

SEQ ID NO: 6976 - DNA, 1261 bp, Triticum aestivum
  Clone ID: PAT_TA_6976
gaacattctgggtcggaggcccgtccgcgtcgtaaccccctccgcctccgccccggccaatctcccaaccgacacgcgaagcagagccagcagccccgccagactctccctccggcgaccccggcgatctacttccccggcgacggccgccgcgtctccagccgccgcgctctcttcccaccgtgcctttattggctatcaactataaagtttgtagtggtttctggtgttcttcgcaaaatggtgaagctgacaatgatagcgcgtgtcactgatggccttccgctggcagaagggctggatgacgggcgtgatcagaaggattctgatttctacaagcagcaagctaaacttcttttcaagaacttgtcaaaggggcaacatgaagcctcacggatgtcaattgagaccggatcatactttttccattacatcattgaaggccgagtatgctatctaacaatgtgcgaccgttcttatccgaagaaacttgcattccagtacttggaagatctgaaaaatgaattcgagagggtcaatgggagtcaaattgaaactgctgcaaggccttacgctttcattaagttcgatacatacatacagaagactaagaaactgtatttggataccagaacccagaggaacattgcgaaattgaacgatgagctctatgaggtgcatcaaatcatgactcgcaatgttcaagaagttcttggtgtcggtgaaaagctagatcaggttagtgaaatgtcaagtaggttgacatctgacacgagaatctatgctgataaggcaaaggatctcaatcgccaggccttcattcggaagtatgctcccgttgccattgtgattggggttgtaataatactgttctgggccaagaacaagatatggtgattccactaaacaaggaaggccggcctgtgttataacactggagaaagaaattgtggatcaagcgatgcttcgatgacttgtatcccgtatctgcccgttcaagcgagtaatttgaagctacctttacacctccttacaagcagctattgaagtgaacgaattcgttggttgtagtatagaccatatggcggacttgattttgtgaaccctgggaaccgtacatacaagagctctgtagagtcgagttttggatatcgggatcgatttatatttgtcgtgtcaactcatgtaagaattcaggctgatgaaactatacagtactccatcgctccccttgactgcataatatggcatgttcgacagc

SEQ ID NO: 6977 - DNA, 1682 bp, Triticum aestivum
  unsure (1)..(1682): unsure at all n locations
  Clone ID: PAT_TA_6977
ggcccgtccgcgtcgtagcgtgcgcccataaccccctcaatcgccgaaccgcctccgccccggccaatctcccaaccgacacgcgaagccagcatggtggccccgccaaactctccctccggcgaccccggcgatctactcccccggcggacggccgccgcgtctccagctgccgcgctctcttcccaccgtgcctttattggctatcaactgtatagtttgtagtggtttctggggttcttcgcaaaatggtgaagctgacaatgatagcacgtgtcaccgatggccttccgctggcagaagggctggatgacgggcgggatcagaaggattctgatttctacaagcagcaagctaaacttcttttcaagtaacttgtcaaaggggcaaaaatgaagcctcacgggatgtcaattgagaccggatcatactttttccattacagcattgaaaggtcgaactatgctatctaacaatgttctaacgaactttgatccaaagaaacttgcattccagtaacttggtaaggactgaagaacgaattggacagggccaattggaatcatattgtcaacggcttcaacgagattatgcttcgaaatatttatgaatacatacatgcaggtgaactaagaaactggatttgtcaaatcactagcagataggaaccttagccgaaattggatgcatgaaatctatgaggtgcatctaaatcgatgtctctgcaatggtcaagaagttctcggtgtcggtgagaagctagatcagtttacttatgtgtcaagtaggttgtcatctgacacgagaatctatgctgataaggccaatgatctcgatcgccaggccttcattcggaagtatgctgcgtttgccatattcatttgtgttgtaataatactgttttgggccaacaacaatgatatggtgactctactaaacaagaaagccggcctgttattacactggagagagaagttctggttcaagtgatgcttcgatgacttgtatcccgtatctgcccgttcaagggagtagtttgaagccacctttacatctcgttacaagcaaatatgtaagtgattgaataggccagttggagtattgaccatatggaggacttggttttgtgaaccctgggaaccgtgcatacaagagttctgtagagtcgagttttcgatatcgggatcgatttatattttgttgtgtcaactcatgtaagaattcaggctgatgaaactatacagtactccatcgcgcccacacggaaaagcatcacgtgccttgttcgactgccttgtttcctgtaaaatcctgccttaataatttcttacagttgaacccccaaaccccgagctagtagaggctgcgggtcagcaccggaagccaagcaccctgccgtcgataggcgagacgccgacgcggcacaccttggacgcctgcacccggtgcgtcagcacccgcangcaccatcaccttgcccttcaccaccagcagcgagtccacctccatcatggcagccgcggccgccggctgctgcgcggtcgtgtccagcggcggtcgtgtggccgcngggaatgcnggacngcnaatgngtggccaaanccttgggctnccgccgttcatnaagcccccgggaactanangagccanttncccgccggtnaagcaanccggacncactt

SEQ ID NO: 6978 - DNA, 393 bp, Triticum aestivum
  Clone ID: PAT_TA_6978
ggccgagggagccggagaggtacaggctgcggtggtcggacctgttccacaccgcgctgtccctggtggccttcgtgaccttcgccgcctcccaccacgacatcgtccggtgctactaccccggcgcgcccaggaaggtggtgaacaccgtgcccctcgtcgtcggcttcgtcgtcagcctcctcttcgtcatgttcccttccaagaggagggggatcggctacccgttcctgctccggaccgacctcgtgtacctacggcgctgaacattttggcgacctgtgtagtggacctgaaccctgaggtcgaggcctctctgactctgtctgtatcggagccgcatgtaagctttgcatatatgatttgatttgttggagatgtgtaaaaaaaaaa

SEQ ID NO: 6979 - DNA, 1027 bp, Triticum aestivum
  Clone ID: PAT_TA_6979
ttcggcacgacgctgctctccggtgctcctcccgcgagacgaggacggccgccgctaaaccctaaccctagattggattacggggggctgggagagggagagggtcggagcggcggcggcggcggcggcgagatgtcggcgaagaaggggctctcgagcacgctgcggaacctcaagtttatgcagcgggcggcggtggcgcagaagattgaggacaaggccgatgtggaggtggaggagccggcggccgaggtggtgatgacgccggcggccaacggtggaggggtcggctcgtcggtccaggtcgccaggaagtgtgtagttgtcatggagggtaatccgcttccaggagctgtaaagggtcgaatgtcattccaaaatttcaatccatccattgataaactaaatgacgaggcaagtggtcgcccaacacaatcagcttcacctagtaattctcaacaagacagtgcaaataccagcagagtggatgatatatcagcatcaagatttagaagcttcaatgttgatagttcagaaagcatatctctgaatgagttgaagagaaaagagcctgagctggagatggaaacaccaccatcgcgtaagctgccaaagacgactggccagaacgtggatggccagccgtcttcgcagagcaatggtcgtgggtctggcaagtcgaacaagcatgaaaagcttgactttaatcttctcagaaaacggaaatcaaaatgaggcccaggttagcattagccaagagagctctgtgtactccatatgtcaccatttgtactctgtatctgatcagccttgtgcgttgttcactgaattatttctgtagtagcaggtagccaggttaaacctgcagtggtatatctgttattaacttattgagaagcctactgggtaacatggtatcttacattgggcgctttttttttgtttttgatggtgctgtactccattatcacttgtaagatgtaagattttacagcagctgtgagaatttaaagttttggggtaaaac

SEQ ID NO: 6980 - DNA, 567 bp, Triticum aestivum
  unsure (1)..(567): unsure at all n locations
  Clone ID: PAT_TA_6980
ggcaccgccagcgacatctgcaagnatcattcttgccatcatcctcccgcccgtcggtgtcttcctcgagcgcggctgcggtgccgacttctgcatcaacattctcctcaccattctcggttacattcccggcatcatccacgctctgtacatcatccttaagtactaagctcccagtaaccctgcactcatgtccagtgccggttccgggacccctgtcgcacgccacccccaaagcgttgcaagtggatcccagccagcccgcccattcacggcggcagacatgaacacgagtcgagcctgcaagccccagcgacgacaccacacaccatgatacccagtctccattttgtcgccattgctggcaggaatccgacgactcaccacactctggtgcgacagcctcgctatcgcatcaacaccgccaacacatcttctctgattacgaccagttcagcgcacgcatgacaaacatgctgagccatcggtggagttttgggaaagtcgcatctggcattgcatcgcccggttggccagctttatgagcatttttataattgtcgcaat

SEQ ID NO: 6981 - DNA, 2005 bp, Triticum aestivum
  unsure (1)..(2005): unsure at all n locations
  Clone ID: PAT_TA_6981
tatagaactgatttttcatgnttccttttttcttgtcttgccgccaccgcttctacgtgtgctttagcaacacatttccttcatatacaatacgatcaacactaatcacaaacaattacacatgatatataccggatcaccagcgctacaatttctccctgttttcttatagcaatttcatcgctacaccatcatcatcatcacaccaaaacatgtatttacacatccttgatcccttgacccggccacctgatcgaccttaattaccctgttttactctgtcatcgtccggaaaacatgcaagcacgcacgcacctacggcgcggctctgaatgcctacctcttctcccttggacccagcgagatggatctcttcgtcctccgctggccagcagatggatggattactacgtacgtacgtactaacttcttctgcgccatcatcgatctctctctgcttccgccattgctacgtgatcgagcacagtttagcttatggcggactcgcgcgggcgggccgcccagagcgtgctgagcgcgcgaaggcgctggaagtagtcccccagcacgagcaggcccttggccgcctgccgcgtcgtcaggatcctgtgcatgttctgcagcgtctccagccggagatggtccgcctgctgcacgaagccgacgaggcccttgagcttctcgacggcgccggcccatgtaggcgtcgggggcggcgaaggggtccgtgagggactcggccagcgtctgctgcagcttctgcatgccctgcgacagcgcgtcctccgcctgcgccgacgtcagctgcagcgcgtacaccgccaccgactgcggctccgacatcggctgcagctgcgggctcaagatcttgaggacctcggagggccggaagccgccgatccagaggaagaagcgctcggcgggggacctccagagccccgacatgacgcagaagacgtcggcctgcgcggcggcgcccttgatccggaagaggttgtcgtagttggcgagcccggtctgcaccatcacctccagctccagctccgacgtgccctgccccggctgcagcgcgctccgcagctcctccgtgttccgcttctgatcgtccacccagtggccgtacgcgatctcgaaccggacgcgtggggggtccatcatcatctgccccgcggccgcgaacccgaagtggccggccgagcccccgccgtgatgacgctgcaggctcgcccccgggttgctcccaacgtacatgccttgctgctgcctggtgcgctgcagctcttgctccagctgcgccagctttatccggctcgactctagctgctggatgtaggccttctttcttaggcgacttttccgggcagcttctctgttctgcgcaagtcttctcatgaccttttccttgggcttgctcgctccctgatcggcgtcccccgccgtctccagctcgtccatgtgcggatcatcgtctagccctgcgtggtcgaacttggcgtcgggctccatgatgctggacccgctggtggcctggccgccgctgtccaccttgtagggctcgctgctccacatgcccagcgccggctgcagctggggctgctgctgctgctgctgctggtggtggtggtggtggtggtgctgctgctgcggggcgcgctcgtacatggccatcctgaggggcgccggcgcgtactgcgtcgccgcggccgacgtcatgtactccggcggggaggcgccgccggtgccgctgagcttgtggatgttgaagtggtcttccaggtacccagggtagagctccattgtgcccttatatcatgctacttggtttgatctcccttttagatgatatacctgaattgatcaccagctcatatccggctgcggtcttctcgtcgtcgacagaggaggatggcttcctccaaacccgcagcgaaaaactcgaacggcgagcttcggaacacaagagggagacagactcctccacagatgggtctagccgagcctcgtg

SEQ ID NO: 6982 - DNA, 927 bp, Triticum aestivum
  Clone ID: PAT_TA_6982
cgtccgcggacccgtcgacggccctcccgaccggatccagcgcagccaccccccctcggatccagcgacgccgcctggcctcccccggtcccgccaccgcaagacttctctcggtcctcagcgaccttgagcacagagatgcggggagtcggaggcccactgctcactgtcagcgatctcttgagcgacctcgccgtcgaaggaggcgacgaccacctcgacggcggaggcgacgcctctgttccctcttcccccttggcagcgcatcaggtggaggaagccgacccctccgagctccagcggctcttcgcggaagactatgacaatttgatgaagtcgctacaggagaatgacccttcgtggccttccctgatgctgaagttgtgcaggacgttgaagacttcagataagctgctgagctacgcgaatatgaaagcagagcagctgctagagaaggcggagaaactggagcatgtcttagagagaggagatcgtgaggtgggatcaattatagaggttcttcagagcatgcagctcaccgaggatcatcagatctccaaaacgaacccacccagcaagtagtgagctgtggtggcgtagatgttgtgtttgattatccaaatcaggaggcatgcctttcctgccagcattctagcacaaatccagttactagttcctttgtttcctgaactgaacgaaaagcctgagaagtgttgtggcagtccgttggataatactaaagacgtgcatgttttctaaagatggacagacaaatatttgtaggaatttaagcctcaatgatttagaagaatttcatagaaattttgggagattctatttcgtaggattttttctgcgagagcttgttggtttgtaggattgagaactatatatgaatttttaggtctagtttgtatgactccacta

SEQ ID NO: 6983 - DNA, 887 bp, Triticum aestivum
  Clone ID: PAT_TA_6983
ccccccccgcccgcccccggagctgatcaacctcaacaaggagacggaggcgtcctgcagcaaccgcagcgagaacagctccgagatcaacctcgacatctcgcgcacgccgccgtccgacgggcccaggcgcgcccgttctggccgtgggcggatcaccagcagttcaactgatcgtccggtccttcgatcggcacgctatatcccttgttgcagtcaatgacttctgctttgcttgcatggtcagcaatgagcgtgcataaatatccgaggcggcccggttctggccggggtcggacgcacggtgggcgcggttgtacatccgccgccgttgtggccctggtccagtcaccccctgtggaacttatcgacggcgctggcgatgcggttggtgtcttggttcgttccagtcgatcgtggactggcggggttcgtcttggggaataagtccggtgtgtgtgaagcgtgtgtaggtagattttcgagttgaatagtacctttggtattcttgttttcttttttttcctcttccttttgttcccatacataaatttgtgaatttgtgaggcagtgttggcccgttgttgtataggtgaataggtgaatttggtgcttgttccccctgttttatagatgggttgtggggggggctacgtgtaggggaataagtccggtgtgtgtgaagcgtgtgtaggtagattttggagttgaatagtacctacctttggtattcttattattttttcttgttttttcatttttcctcttccttttgttcccatacataaatttgtgaattgtgaggcggtgttgatccgttgttgtataggttaatggtgcatgtggtgcttattccccctatttatatatggattatgtgaagactg

SEQ ID NO: 6984 - DNA, 1439 bp, Triticum aestivum
  Clone ID: PAT_TA_6984
tcggcaccagcagcagtcagaggttcacaagccctcccccgaagcgtgtgggatctgataaaagcgtctatggcaaatcgttgggcagggaagggtgtgatatgggtccaagccctgattggtgttcgactccggtggtctctgataagcacaattctcagaaggatagctcatggaccagaagatactttgacaatgggggaaggaggagggttagtgcagtagagactgtgaggagccgtacagttagcatggctcaagcggtgcaatcgacagttgattgggaacttgatccaaccaagctgcttgttggccataggtttgcttctggggcacatagtaggctatacagaggactttacgatgataagccggttgcccttaaatttatccgccggcctaagaatgacgctggtgggataatagctgcaaagcttgacaaacaatataacactgaggtcaatgcattgtctcatctgcatcataagcatgtgatcaagcttgtagcagctcatagagttggaccggtttattacattattacggagcttcttcctggaggttccttgaggtcatacctgcacaacccagagcactgccccctccctctggagaggaccatatccatcgctctggagattgcccgcgggttggagtacatccactctcagggagttgtccaccgcgacattaagccggagaacatcctttttgatgagaagttcgaggtgaagattgctgatttcggcattgcctgtgaggagacgttatgtgatctgctagtggacgatgagggcacgtaccgctggatggcccctgagatgctaaagcgcaagccgtacaaccggaaggtggatgtatatagctttggactgctgctgtgggagatggtgaccggaagaattcctttcgagaacctctccccagtccaggtggcttatgccgttgcgaataacaacaagaaagcgatggagcctgaagattattgcccggcagtagtgagacccctgattgagcagtgctgcgcattgcagcccgagaagaggccagatttctggcagattgtgaaaaccctggagaaaatccagtctgttatgtcgcagggcggccgcctggacgcgctgaggagcagtgaccacaagaaggggcttaagcactggattcagaaactgaaaccatcacacggcgcctgagctcagtcttctagcatcgtttcgaccgttattttatccggttgggtatgctcccctagtctagcctagcgtaagatgataagcttttcgatttcgtgtttaaagattctaggatggatgcggatgtttattaggtgagctacaatttgcttttttattacattattagtagttgtataccatatatcaaacttatatatgttttctcattcgctcttgctaaaaaaaaaaaaaaaaaaaaaaaac

SEQ ID NO: 6985 - DNA, 696 bp, Triticum aestivum
  unsure (1)..(696): unsure at all n locations
  Clone ID: PAT_TA_6985
actgtccgattttgtattattatttccgggagaaacaccaaaatagaacaattacagaaagcacggcacaatcaggtatggtctatttcaaaggctatggtcatgcgagtgaaaagtgggtactctaaagctttaactgttggatctgatcaccagtgctgaagcagcatataaacatatatccatacccttcaggtaactgaaggatggtggtgcatgaccccagctgttctgaatcatatatctggtataactcgggtatcttcgaaaggtttcgtagtctccctgcttcatttccggggttcgaagtcatcgtcaacatcatatgcggggttgcataagcatctaaatagcctgccaattccctgagtaagcgcgcggagtccgatatgtcactgtccgtgatgcctcctcgtctgaactttcatcagagctgctgtcatcgtcgagaatggttggctttgatggccctggtaatgcctccttttccctctgaaatatttttccgagatttctcaaggccattgcacgggccttgagatcctctttcttgacattattttcatgcagcaccatttcacagacatgtaggagcgtgacttcaatatccacaacgttgagcttccaaattgaactcatcatcaggtccttgntcattctcatctgcatgtcgacgtccttctcggtggcagcgcc

SEQ ID NO: 6986 - DNA, 363 bp, Triticum aestivum
  Clone ID: PAT_TA_6986
ttttgcaaggcgaaaataaagaacataaatacatagtaaccatgggaggcaccggataatagtcatcagattacactgggtggccagttagtcatgcactactgaagcaatcatacggcctccccaattacaacaatcctactgtaatacatactagaaccgaacagctcaattcataagctcaggggaggcccataaatcttattacgccgcagcaacaacagcaccaaggacagtcacagaacaacaacacattctccgattagaaatgcgcaagattagatcgatgatacattactgctgggggacatagtagtatgccatactcgggtcggtggtaggcacgccggcggcagggcgcgg

SEQ ID NO: 6987 - DNA, 669 bp, Triticum aestivum
  Clone ID: PAT_TA_6987
ttattactagtatatcttaaatagaattcaaggtagttccttcagtctgcgagtaagtttgccaaatttgtccttgcaaaagaaaatggtctgctcaaagtagtatcaatcctgactgaacactaatcctaattactactccagcgggatacaaatcagctctaaccataaggggcaaaatgaagttgattccctgttagccacggtgcttttcggtgaaaagggttccgttctcaacccgccgaataaaataaagtctcccaagcggccacctgttgaatccaccagtaggattaaacctgctgacgtcgattgttctggttgtggcttcagatctgcgacctctcactgttttcacatcaaacttgaggcttatcactgtttccatctggtttccgccttttgttgggtccaatttctgtctctgcagcatgtgctgagcgcacgtatccagcagtatgccccccagctctgcagcgctggagaaaggtacatcattaacatgagtgatgatatccccgacctttatctcagaatgttcagctgaaggtacttcaaccttctccacgatcacaccacggacctcagggaacccatgatgtatcttttcaagtgcagtaagctgttcatcttcgtgaagagttctaactcgcagtccatgcaatggtc

SEQ ID NO: 6988 - DNA, 738 bp, Triticum aestivum
  Clone ID: PAT_TA_6988
gcggcgctcttgttctgtggtccccgggccgctgcctgctctgtgtcgtgccttctcggtttgttggttggcggactgttcatggctgcccgtccctgtctgctcttttcgggggctgggctccttcgtccacttcgctcttccttcgcttctccacggcctgtgcacgccccacgcctgcgccgcatcgtctcggcgtgggtcccagccttgcaccagccccccgggctggcctccggctggggcctctcaggagccgccggcgggctgccgctccccggccgcgccccaagcgtgggcgtctgagtggtgtcccggtagggttccggtggccctctggtgcccccgtgtggctccctactggggggtgcaccgaggtgtgcagggaaatcgccgcacctcgctccgcccccttcactccccgtctcctcgggtggtctcccgttctcgcccgatcttgctacctgcgtgttccgctcaattgaccactttactctactatacaagtagtttcctcacaattcctgggcaatcccttccactcctcttcttccagcgtggagacctgcgctccgttctcaccggcggatctatttaccgtgtccccgatggactccctcccctcgtcggtgccccccgagcccgaaatgttcgccccgatctcgagcggatgggtctcctcccgctactctcccaacaacggggggcctctcccccccagtgcctgccggacgcgtg

SEQ ID NO: 6989 - DNA, 1266 bp, Triticum aestivum
  Clone ID: PAT_TA_6989
ttttttttgacaaacaacaaaccagctttgaatctttttctctgtcctgttttgctagttctcctttcttaaaacctccatgtttcacggatgcaaaactgcagcatgtcttacatatctgaaacaatacttgcaaaacgaggcaaagtctggcataatggggtctggacaaactacgaagagatcagtctagcaaaatgaggcttccaaatcaaggtctggcaaaaagtacctacgcctggcatgatggggggtctggcaagctaagaagggctctggactgttctagcaaaaggatcaaactgaagtctaccgaaggcaagtcttctaccagaagaagtcttcaggcagttcagtcatgggatagctcgtgttccactgacgtagggtccatatggctccaccagcagaacccgcagtactgaccacgccagagacgctgttgatgtttcccgtgcaggcctttatcagcttccacgtcttcaggtcattaggatgcaggcccgagacatcggcctcagccttcaggaccctggccacgtcaactggggacaggaccttgtcacccaggatagcagtcttcttgagctccctgtaaacttgcattgccagagaatccacattcctcgtctccagccgcaggtgctgcctggttgcccgctgaagagctcgacgctgagcgagagtacccctgtagagacctggagcgattaacctgcttctgtccccgcgttcgggttgccgccctgtgcgtatcgtcggtcttcggggacacccgctctggctccggcaggtaggagatctggcgcgccgcagcgaagcgacccgcagcagtgaaggggtccgaggcttctcgcagcttgatgatcgccaggtcgagcgacgcctcctcgagcgccttgagctggtaagacgtgatctccaagcggctcctcctcggtcagagatctgcgtcgcgtcggtcccgaccccggcgccgaccggagccgcctccatcttcccggtcccgaccccggcgccgatcagatctgcctccatcttgccggtgccgatctccgccttggcgacctggtcccgcaggcgcgccgcccgaacggggaagggccgcggcggcggcggaatggcggcggagagcggacggcacccgcgtccgcttttatagggcggaaaccctacctggtcacggaggtgcgccgtccgatcgaggaagggacggtgtggatgctgcgtgccgtcgcagggctggatggctggagcctggtgcgc

SEQ ID NO: 6990 - DNA, 715 bp, Triticum aestivum
  unsure (1)..(715): unsure at all n locations
  Clone ID: PAT_TA_6990
cttttaaagttnagaaacctacattnagtaagcttgtcttaacttgattcgttctttctcgtactacttagaacaaaactcttcaacctgggagctattgccaaattagtagtcaaccgagctgttgcacagcgatgaaacgaagtaaaacaacctacacctgctgctgaaaatcatcagtcagagtcgtcatcaacccaatcacatatatccggggggccccagtaatacactgttggcgggggcagtgtccacctgttgttcaataaagtatcacattcgccggggggacgctcagccactattaactttgcagcaaccgttgccccgtccttgggtctctgtatgagtgccttgaggatgactggtctacgctcatgcattgcaacctccattttgtccaggagcaacgaagtaagctgtgctatagagtgcaaaacaaccccatcaagttgattaaggatatcaccaacctcaacgcccccacaatttgcagatgatgcttcaggaatcatgtccacaaaaactccagaaggtggcttagagaacttatggcatatttcctccagtctggctgattccaacaagtgaagggaacgaccccttattccaagccaaggttgtttgacttccccatatgctttgaagtgtctcaggcatctcccaacaatctgaactggcaagaangggggtggttctctcatctatgaaattc

SEQ ID NO: 6991 - DNA, 696 bp, Triticum aestivum
  Clone ID: PAT_TA_6991
cggcagatacaacgacaaaggagcagcatgggcttgtacgaagccgaccgcgtgggatgcgctaacacgcacgccactgcgaacgctgtgaccgatgaggacctggatgagctcaagggatccatggagcttggcttcgggttcaacgaggagaacggaggccagaacctctgcgacacgctccctgccctcgacttgtattttgccgtcaaccggcagctctccgagccgaagatgcgggtgtgcagccgctcattgccttccctttctgtggtgacctcctcatcatccatgcactccggcacgcccagcccagccggcagtcctaccgctcagccctccctccttgactcgttgaaaattagcagtccagctggcgagaacccacagcttatcaagacaaggctaaggcagtgggctcaggtagtggcttgttcagtgaagcactccagttgagagcgttggctgcaatgaaccacccatcctacaaaaccgttgtacatccgagtgttccattaaacgacgagggagaggacatgactggtggtgcaattaacacaacgtctaaccttgttgctctgtagacgcccatggttgttgtgcatagtttagtctgtatgtatgtgttggcaacattaatgcaccgccccttgtattgacaggacaacatttgatgcaaggacgttcttcttgttc

SEQ ID NO: 6992 - DNA, 1317 bp, Triticum aestivum
  unsure (1)..(1317): unsure at all n locations
  Clone ID: PAT_TA_6992
cggacgcgtgggcggacgcgtgggttccaacattcccgctctccttcctcctgccgcagctgtcgtgattcggcagctgctgggagccaactcggcaatccgccatccattcggaggagggaaggcaacgttagccgcggcacattcgatagccaacacacattacaccgttacagaaaaaccattgcacaaacaatggccaacagctgcagagaacacaagcgcggcgttccacgtccaccaccattgtcactcttcatcggtagggagcaagagccagcggtcgcgcggacacacccggctgctgccgacaacagcaacaagaagaggatgttgtccaagcagctgtccatgaaggagaccacccgggaggtcaagtgggagaagcggcggcggcagatacaacggcaaaggagtagcatgggcctgtacgacgccgaccgtgtgggatgcgctaacacgcacgccacttcgaacggtgtgaccgacgaggacctggatgagctcaagggatccatggagcttggcttcgggttcaacgaggagaacggaggccagaacctctgcgacacgctccccgccctcgacctgtatttcgctgtcaaccggcagctgtccgagccgaagatgcgggcgtgcagtcgctcgttgccttccctttctgtggtgacctcctcatcatccatgcactccggcacgcccagcccggcgggcagtcctaccgctcagccctccctccttgactcgttgaaaattagcagtccagcaggcgcgaacccacagcttatcaagactaaggctaagggagtaggctcagggagtggcttgttcagtgatgcagtctagctctccggctgagatggatggttccaccgaaccacccgtcctgcagaacagttgtacattcaattagacgatgagggagaggacatgaggggtggtccagtgaacccatcatcgtaacgttgttgccctggtgatgcccttggttcttgggtttatttgaatctgtatgtatgtatgggtgaacagtcaacgctccgcccccgacccctacatgacaggacatgatgtaagcatggtcttcttgctcaccaacttctttagacacactaactcttgctgaaacatttccataaaaaactaggcatgcacactggcaagatatattgcgactaaaacacactcatccaaggagacaaatatcctccgaaaaccaccactaactgttttgtacagattgtaggggagaaaagttgggccgataaaatttcagtttnaatcagagattttagatgggcatatgtaatacaacac

SEQ ID NO: 6993 - DNA, 2111 bp, Triticum aestivum
  Clone ID: PAT_TA_6993
tgtcctccgcgtaggccctgtgggggtttttacttaaacataggtgatatatcagtatcacgcataatcgaattaatacaggaccgtgataaccagctttcccaagtcaccgagaaataggataagtaaatatcaattgcaaaaccaaattataaaaaaggccacatgagatgaagccactttatttgcaaacacccacagttctgggccatcacttggtcccgatgaacagcccccacctctgctcaccagcagagctcctctgaagtttctgcgttccacccagtcacaatatcgtcatagtcctcctgaccaaagtcggccagaaattcatctttgttcttttcaacttcagctagctccctctgtaaaacttttaggaactgatcagtgcgctcttcagcaatgacatcatggaaaccagcattctgtagcatctgtccataagcttctacatcatgaaggtcgtaacctctctgcttaatgtatgccgcaaactcttcagatggttttcctggactcctacagtaatcactgatgtgcggtcttcagcaacggacatcatggaaaccagcattctgtagcatctgtccataagtctctacgttatgaaggtcgtaacccctctgcttaatgtatgccgcaaactcttcagatggttttcctggactcctacagtaatcactgattaggaccttacccccaggttttagccatttgaagaaacttctaaacaaagcaggtttatcttgtatgtgaaggatagtgtcacggctgtagataacgtcaaatgtattgtctgggtatgtctttgtggtgcaatcagcaacttcaaactcgactgcgcacttgcgtccaatagcatgctcaagtgcaaatgaaaccatgtttatggaaagatcaataccaacaacatgaacatcatagttttcggccatataaaaatcaccaccaccgattccacatccaacatcaagcaccttctgcccaggtttaagatcgagcaagtccacaaattcttttgtagtctcaattccaccagtgctcacaaaaccttgcccaaaaacacgctcatagcataatattccactgattttgtactgcacattatccaagaatctttggaaatcccgatcttctgttgagttgactttttgccatagccaacatatctggttttgattcttcttgttcttcacataagctccaacgcacttgcacgtgagtagagaaagttcagaggagctcccactctgatcaatggcatggccctctttaaataccttagtataaaaccttggttcacgataatgtgtcggattcactctcctttttgagtctccagattgatggaaacatgattctctaaagaagatatggccaccaacttttagccatttaaccattctttctacaagcttctcgacctccgcgtccgaaagatacatcagtaaccagtttgaaaatatgagatcgatggagttatcctcaatcaccaggtccggagatgtaacatcagcacacatgaaggatgcatttttgtaatggccatttatgctttcattcttttttatcacactttcaatgaaatccattgcgaggacatgcccagctgtcttagccagttcaccagtaaagcgacctattccagcaccaagctccagcactgattttccttcatacgaaggaagtaaagacagtatctcggggcgctcctccttgtccagatcggcggcgcgggagtcgagcatcatggcctcgacggtgaggtccctggagtgctcctcccagtacctcttctgcgcctccctctcctcctccagcttcgccagcaccccgttggcagcgatttccgcggcggcggcggcggaggcgtccatcttcgttcgcgtggccgttaacggcgagctgtcccgcgtgaattcagaggggatggttcgttacgggaggcgggcgggattaggagccctcgacggcgaggcgggcgcgggagaagctgcgggagcggcggttgaaggatctcccgcgcggctgcatccacgacgggatcggctgcggggaggaggagcacggacgagtggagcgggtgtgaacgccctccccgtgccctc

SEQ ID NO: 6994 - DNA, 1209 bp, Triticum aestivum
  unsure (1)..(1209): unsure at all n locations
  Clone ID: PAT_TA_6994
gtgcttgcatacgatnttgatagaacacaggaacattttttacgacatagagataggaactaaaacttaaagtctatacatgccttgtgtagagcaaagcgagagtagcaacatgttaccagggggtacgttccattacaaagataacaacaagaatccataggatatgtatttcttgttcagaagaacatcaaaagggtaaagataatgctccgtaaacatgctgggtacgatgtaccgaccgaagctcaccagatactatccgtggtttccaggcgttgctccgatttcatgccaatataacgtagcctttttgccaactttcctgtgcttgcgagtgccgttttcatagcccctttggtgttgtcctgcccttttaggcgccgagcagctgtcgtattctgtatctgagtagaatacgagctcatgtatctgacagcatagtaccatcctttgcggaccttctttattgtcttgtttgctgcaaccagcaacttgaccaggtgtgtcacttgattttccagcttctttacgtgggtgcagtgatagtccctgatttctttgccacatgcatcctccataaacctaatggctgcgatagcagcactgtcttctgcttcatcatagttgtttgagaccacaccagatatcgaggttgggacaagcaaaccatcgaacaactgtaacgacgaattaaaagtaaccgtcacacgagactcgttgcccggatatgtcttgtgatggtaaatcgcagggggcaacttgagagcttgcagcatgagggcaaagatgcgggaatggggaatcagtattacatagtcatcttcccgtgcaagcgcccgcagacagctgtcggtggaacgggtggaaggcggcgagtcaggaacagggagctcctcggcggccatcgcgatctgaacagggagctcctcggccgccatcgcgatctggtcgatggaattgagctgcgtagggctaatcgaagaggcgctgcggagcttggttcaagatggcgctgccgcgccaagaagacgatgcagctgagccatctgtaaggcctctccgccggcctcgaagacggatcctccgccccgccaccgacccagcaaggaggacgaacggcggctagaggaggtggacgagctccagagcaagagcgcagggggancgaggaagggggagcggcagagacgaagcggagcagggcga

SEQ ID NO: 6995 - DNA, 887 bp, Triticum aestivum
  Clone ID: PAT_TA_6995
cagccttctatcagctttgccttaagcgttatagaagtcttcctaataaaagcattaaccaaaataatctctcacgcagccacgccacttccaagcaaaattgcacgcataagctcatgtacaccaacaattaagcactatacgagtctttctaacaaaagcattaactaaaactaatgccaaataagctctctgcaaagctaggcattatctattaatcttagcagaaaggagccgcatcagcagtcaccggtatcactattataagattatccttatccataacttggagttacacagcttgcccttccatcataccctcatacattccggcacaccaaatcttacggcacggcgtacaaacaccacatcgtttagtgtgttgtccctactcactgtggcaaaggagtgtactaatcccacaaaaagtccatgcatatcaaatactggagcacctccgagcttctcgcaacctcgcccagggcgaccgcgggagcccgcgctgggactggcttcccttagagcaacagaaggtggcctacccccgtcgaatgcacaagcatcattctgtgggataattactgttgtactgtaagtattccactcgtcggctttgtctgtgcatacgagcatttgctccgagcctctgacaacatccccccctccccccgctggtgcgtgctctccaaagcccaccctgtatctgtattctggtgctccaggtgtcccgctaggtgtgatggacacaacttgagcgagagaagcactgaaaccagcaacagcagtgtctaactccgcccttttatcaataaccggagccattaagaaaggagggctgcgaaagaggggccgtgaggagagcgggctgccactggatcagtcaaaat

SEQ ID NO: 6996 - DNA, 875 bp, Triticum aestivum
  Clone ID: PAT_TA_6996
gagatttctgagctctcttcttgcaagcctttgtctccacgcacactggtaagtaagaactgctcgctgcatattcttgtaatgtgaatagtctctgtggcagcgccatcgagcttggatatggacagctgctttggtttcctttctgaatctgaattctttgcgagcagacattgcccttaagccagtttgcagcgtgactgtagctgcttgcagtagtaaataagattcgcgtgctttgtgacgacgcacatttttttgtattttgactgctgctgcttctcgcctcatgcattcgtacaaattacgaaccaaggtccctctaacaaaagattgtagatgtgttgttgatcttctaaccaaaacaaactgtttccgtgcaatatatgtacgcattagtctctgtataattcttgctgctttccctaacacttctgccctccgtgcatccaaatcagccatttgtccagctctcaggaatacctttgtttttcctatctggtagttctccaacttcattttttccagaatcttttggcatgcaatcttatcgtcgttacttccttctagaagttcagggccaagaacaccaaagcgattaacaaattcatagaatgtttttcttgtggggtatccagcacagcttatcctgatagcttcaagaacacctgcacatcgtagttgttgaataacatttgtgttctcaaaaatggctggcttgaggagattgtttggcttcacacatctaatataatgggggtcagtagagctcaaggtctccatgagagactgaagttgcagcttaaaacgtgacccaatagaagaaaattttgaagactttgatgattctttcaggagtgaagggataagctagc

SEQ ID NO: 6997 - DNA, 654 bp, Triticum aestivum
  Clone ID: PAT_TA_6997
ccacggtgaaatcccaatctccgatcaccacagcgcagcagcagccagatccccagcccctccatcccaatggcccgcaccaagcagacggcgcgcaagtccaccggcggcaaggcgccgcggaagcagctggccaccaaggcggcgcgcaagtcagccccggccaccggcggcgtcaagaagccccaccgtttccgccccggcaccgtcgcgctccgggagatccgcaagtaccagaagagcacggagctgctcatccgcaagctccccttccagcgcctcgtccgggagatcgcgcaggacttcaagaccgacctccgcttccagtcctccgccgtctccgccctgcaggaggccgccgaggcgtacctcgtcgggctcttcgaggacaccaacctgtgcgccatccacgccaagcgcgtcaccatcatgcccaaggacatccagctcgcccgccgcatccgcggggagcgcgcctaggttcgtcgtggtcgccggtgatgctgggtagtagctgttcttgtcatgtgatctggatgtgtgtgtgcctgtcgggtgcttctgtttgtcggtgtttatatatttttcctctggtcccatacatcgtgatgctcgaatgaaatggcaatggaaagttcagtattaaaaaaaaaa

SEQ ID NO: 6998 - DNA, 889 bp, Triticum aestivum
  unsure (1)..(889): unsure at all n locations
  Clone ID: PAT_TA_6998
atggtgaagatgaagatgattacctttttcagactgtgcgtcctggtgagaagacattaaaatgggattatgtacctgaactgaggggggtgcaaatcacaaataattcagctgatacttttgagccactgcccatcaagataagtgcaaagaaaatgggaaacatctcacgtttcatgaaccatagttgttcccctaacgccttctggcagccagttcagtttgaccatggagatgatggtcacccacatatcatgttctttgcactgaagcacatccctcccatgacagagctgacgtacgactatggtgatattggagctgattctagtggtataggttctcctggagctaagagatgcctttgtggatcctcaaattgccggggctatttctgctgattatggaagatgtgcattctgcttatcaacatgccaatctatctgttagatcattttttggccgttctggtggtacctagaagaagggaagtgtgctgaagtctgacagaggtaggagcgtctcaaatggctcccctcatgactgcgccgtagtggggagatagtagacttatgtcaagctccgcaatgcccattgtcacacaaggacaaagtagcttcttgtgattctgtgaccgtaggccttgtgaggtcaattttgtatgataaccttagtattttggtcaagtcgaaccaaaactcttagcggccaatatgcctattgcgccgttgccaagtactccctccgtccggaaatacttgtcggagaaatgggtgtatctagacgtattttagttctagttgcatccatttttatctatttaggtgacgagtaatttggacggagggagtatattcagaccaggggcggcttnaagtctnaatttcct

SEQ ID NO: 6999 - DNA, 520 bp, Triticum aestivum
  Clone ID: PAT_TA_6999
gcaatctcaaaggcccgcaaaacgagcacggcagtcagttaagggaacctcctctgtgtcagatggaaatcgaacagatgcagccccaaatgctgcaccgagtggaccatccacagcacacactcaggcggacgcacggagaaaaaggaggaacagaaatgatagtgagcagaagagagataaggcttcgaaaagggcgaggaaagatgcaagtggggtgggcggcgtggacaagtcgctggcggagcagtaccgctccaagtttctgcagcacggcgtgaacaaaaccaaggctagttaagtaagtggggatcgccatggacaggcagagaccagcagcttctccaagctgaagttgcctgagaagcccctccgcaaacccttcagccccgttgttgatcggggtacgattttgcttgtagtgctactatgattaattgttttgcccttgtagcttctacctgtgagacagcgactgaccctcttttcgtcgagcttttcacttcccaagttctctatt

SEQ ID NO: 7000 - DNA, 1031 bp, Triticum aestivum
  Clone ID: PAT_TA_7000
attcggcacgaggctttcttcttgctcgttatcctgaacaaaaaaccttggtacccagccagaccaaccatggaacacacggctagctctacccactcccagttccagctcccgagcacctaaatccagataactctaaccccctctccgcttcttgaaccctcctccagcttcttcatcctcctcgatttcgggccccgcggtcaccaccaaccgcagcgtccggcgaagaaccatggcgtcttgctcccacccttggctcttcccaggcatgtcgccgccgccggttgcctccaccgccgtgccggttccgagcttctgcaagtcctcgaaggtgtttgctagtttgcgtcagcggagaaaggcagggtcagtcgcgccggccaggacgcggagatgcacgatcaggtgcgtcaaggatgagtctatccattttgatccgtcgaagatcgaagcgccgccgtactccagttacttcgactccacgtctggtcagctcgagccggcgtcaggcgcccgggcaagcatacctgggcaggagtactggccggagggcactgcagcccgtgtccgtgctgcccgtgcacctgcgccggtcggggagtcggccgggactccgtctcttggcaagaaacccgggagtaggaggaaagggtacaaggggcaggtagcgtcagcatcagcggcgggcggtgcggacaccggtggagatgacggcgagttcattgtggccactgaggttccactagatgatacattggaggaaacaaatgattcgctggatgaatatgttatttacgaggcgcccaaggaggagagtttgagcgagtatgagatggacaagatgatggggcggccacacccatttgttgacccagcaaaggcgatgttggcagaggaaccgaaatcgagcgaggagctctggtggaattggaggaggaagtccgaggcagaaatgtggtcaagatggcagaggaggcgcccagatgttgacacggtctttgcaaaggcaatggctgaaactgggcaga

SEQ ID NO: 7001 - DNA, 647 bp, Triticum aestivum
  unsure (1)..(647): unsure at all n locations
  Clone ID: PAT_TA_7001
gccgtttcctcgttactgcgcagccgccgttcttttcttccccgcacctcttttgtcctcgccgccgacccagcgccgccgcccccgattgaggcgagttcgctgaaggtcgcagcgaagaaagacggtggctgccatggacgggggtggtgaacgggggatcaccaagaaagaggcggaggccgagtaccattgccacgacttcgagtgggaggacctccgggcggatgtggaagccaacccttccttctcctaccacctgtcccctttccccacgaccaccgcctcgccgcagccaccgtcatcggaggcctggagaagcttccaccgccgccacgcctccggcaagttcttcaaggaaagaaggtatttgctgaaggaatttcctgaactgcttaacagcaaaggatgtgcaaaggttttagaggtggggtgtgnggaatggaagcactgttgtccccattctacgatgtagtccaagcatcactgtctatgcttgtgattgtagtgaagacactctagagaaagcaaatgagattgtgtgtaatacacagggggttgatgccaaggataggttccacccttttttgctggatgtttctaaagaaaattttccaggttggttgttctgcaaatgctgtcaaagt

SEQ ID NO: 7002 - DNA, 2151 bp, Triticum aestivum
  Clone ID: PAT_TA_7002
cgcctcgcacgaggctcccagccaaatcaaaactcctaccaccgtcagtcaagcggccagcggacccagcacaggacgtatgtccggggcccggccggggcggccggcgaaacggagcacacaggaagcagcctcgcgaccccgcaagcatacctccaagccgccgccgctgtcgcccccacacccgctcgtcgcgcgccgccgttgccccagcagccggccccaccgccaccgcgtaccgatgggtggagatacgcgactacgtactactcaggcgagggagtacgggcaatgaggtggtcggtcgcctagggggcaggcagtcagggagcgagtcgagggcggggagcgggagccggcggtacgcgcactccgggtacttccagcagccggcggcgccctcctgcgtgccgacgggcgccggaaggtgcccgttccctgccggacagcacacacagggcggcttccacggcccgctgccgctgcaggggggctgcgccgcgccctacccgtcgtgaaccccaaagacatggcttttggcgccgcacaccaggcctgctgggaatgtggacagactttggagtcatgtccaatctgtcggagtccaattaccaccagaataaagctatattagcaagtggtggtttggatcattgcgaatgggtggcgttactggagaccaccacccctgcgtcacactggacgacgatggattgcaagctctccaaagctcggtccatgaagggctcgatcggctctcggagattacgccaggcatcggtctgtgtctgtgtcgagttctgcagggccgatgaatccgccgccgctccaaagacgggagcaggggccggtctcgagtatctacacccaccaaggaatgatctgtttttaccctgatgagagaccttgcaatggattctcagaagctcttgagcgatacagggagcttgttccgcatttgcgcttggctggaccgacatcttttgcaccaataattgagatggctatgaccatcgtggagcaaagtggtgggcagtaccatgttctgctgataattgctgacggacaggtcacaaggagtgtagatactgcatctgggcagctgagttcccaagagcaaaagactgttgatgccattgtgagggccagtgaactgccgctatctattgtgttagtaggagttggtgatggcccatgggacatgatgaaggaatttgatgataacattcctgcccgggcttttgataattttcaatttgtgaacttctcggagataatgtccaaaaacatgccacaatcaagaaaagaggcagcgtttgcactttcagccttgatggagataccacaacagtacaaagcaactgtggaattaggaatattaggtcgtcgctctatgaaggctccagaaagggttcctctgcctcctcctggtggaagccatgatgcttattcctatggaactaaaagctttagtaaacctcagcctagtacatcttcatcagcgtatcctccctatgaaactgcacatactgcggcccctgctgcaccgtcttctgcttatgataatcaggtttgccctatctgccttgtgaacccgaaagacatggcttttggctgtggacaccagacctgctgtgaatgtggacagactttggagtcatgcccaatctgccggagcccaatcaccaccagaataaagctatattagcaagtggtggtttggatcactgctgatgggtggcgttactggagaccacccctgcgtcacactggacgatggactgcaggctctccaagctcagtccatgaagggctcgatcggctctcggagattacgccaggcatcggtctgcgtcgagttctgcagggccgatgaatccgccgctccaaagatgggagcaggggccggtctcgagtatctacacccaaccaggaatgatccaaactccagccggaggaaacagccattggcatgcgaaaacaacaaaaaaaaaagggaaaaagaagagaaaaacgagaaactgctgctgatggatccagcaaaccgtgtgtggtacttgcaagtgtgtacatatggatgtggttctgagctgccgtttgtttcacccgggatatgtttgttttttgattgattgattgattcgtctgtac

SEQ ID NO: 7003 - DNA, 1066 bp, Triticum aestivum
  unsure (1)..(1066): unsure at all n locations
  Clone ID: PAT_TA_7003
tgtgcacggcctgagcgagctgagtcgattcgagcagcaggatgggcggcggcggcggcagcagcggcagcccgacggcgagcagcagcagcgacgataacggagacgcctcgtggagggcggccatcgactctgtagctgtagggggcttcggctacccgtcgtccaacggcgcggcggcgcccgcccaccgccggcggcggcggcgtcgaggaggacagcaacgggctggagcagccgccgcaggatgaggggaaggcgcaaacgcctgggctcaagctgtaccagatcaaggtaagaaatatgttggacgatatgttagagaaaaatctcgaaatagtgaggaatccttgcttgaacttggctgaccccgaggaaacagggggagggataaagttatttaaaaaggcacctccntggcatcagaatggatgccgtagataaataccatgtgcaactcaagagaccaaagattcttcctgggccagaggtcgacgagaaatcaaagaagttcagacatatgcttcagtctgttgttgttgatggtaacgacgtacttgtttccgcgaaagaagcatcccaaatatcattggctagaatggaagctagagaaactgcagcaaagaccaaagccaagagggaggaagaaagggtgaaccagctgaagaaggtcaggggagagaaatggcttccttccattgctagtaaaatgaagaaagaaaaatcttgggagcaatggcaggaaaaaaagctcaagagcaatggcagtgatggtggatcatttcagctgggccgcatatgctaatcttttaggccatctatgggggcacccttttccggatgccacaagcccacaattgctttgataacttctattttgccatttatccatttggcgatgatggtcgacaagaggattgaattggatgaaaagatagaatgttggactgacgattttgttctaatctagagaacgtagcttatcagtaccatctcatggaatttttgtagcaaaattatgttatgttccaggattggatatacttgagccagtcactgcctcgca

SEQ ID NO: 7004 - DNA, 975 bp, Triticum aestivum
  unsure (1)..(975): unsure at all n locations
  Clone ID: PAT_TA_7004
aagaacgtgatcngtnaacngcancggccgggggaacggtgcggcccggcacgtggggcccagcaatggcgctggtgctgcggcgatgttcccctcccccgtccatgccgccggcaacggaggcaacaacggcacggcgacgaacaaagtggaatccaagcctgaaggcattgcgaaggagacggcgccggtgcagccggccgtggccatgaaccacagctacgggcgcaacgacaggagggacgtgtacgacctggacagcgacagcatggaggaggacgaggaggacgacttcgacgacgacgacgaggaggaagaccaagacggcgtccccggcggctgcaacattaacatgccgccggcgcagtacgacgcccacttcctccaaaggcagcatcagcaacaacaacagcagaaccacaaccacggcaacaaccacaacgtcgtccggcccaacgcggtgaacggcagcggcaacccgccggcgggcaacgccacaccttcatctgccccggcgacaagcgggacgccattcctgggcatggtccagtgaggatcgagcaagacgacgacgaagacaagctagcgctacaaaccaagaaatcccaggtggtaccgatcgatctccttccccgctctcatgtgcccatacggatctacttttgcacatgcccacttggtgggcttggatacccctgccggtgcgttgccagctatggtaatagactccacaccacccaagtcccttcgctctttactccggccacttcccgtccgacctcccctgtaatttttcccgttattgttattataatcctggtgcacatatatatatgggcgggttatacatgatgtncatgtcacatttcctcaacaacaatgtncntngaaggatggtaaattaaaggngtgggaaatttttttctaatttgaggntacnttacanttttgtcaaaanattacggtcaagtccgg

SEQ ID NO: 7005 - DNA, 530 bp, Triticum aestivum
  Clone ID: PAT_TA_7005
attcggcacgaggtattaattgggctggtgggctgcatcatgcaaagaagtgtgaggcgtcaggcttctgctacattaatgacctagttttgggaattctcgagcttctcaagtatcatgctagggcgcgctcgcggcccagggcggcccagcttggagatggagttgaagaagccttctatttcactgacagggtaatgactgtaagtttccacaagtatggtgacatgttctttcctggcacaggtgatattaaggatataggagacagggaaggaaaatattatgccatcaacatcccacttaaagatggcatagacgacaccagctttactcggctttttaaaacgattattgccaaagttgttgagacatatctgccaggtgctattgttcttcaatgtggggctgattcattggcgcgagaccgcctagggtgtttcaatctttcaattgaaggccatgctgaatgtgtaaagtttgttaagaaatttaaaattcctctgctggtgacaggaggtggtgggtcc

SEQ ID NO: 7006 - DNA, 916 bp, Triticum aestivum
  unsure (1)..(916): unsure at all n locations
  Clone ID: PAT_TA_7006
gggtgatgttgctaggcatgctgctggcgaccggtccccaccaacagcacctcgatccacccggtggcgcgcggcggtgcaacgacaaaggggaagaagcaggcacggcgcaagtacctgatactagtaggcatcgtggtggcgcgcgtagcctaccaggccgccctcgaaccgccccggcgggccgtggcagagccatgtcaacgcggacgaggcaggcaatccagtaaggcacggcatgaggaggccctggtccctggccttcttctacagcaactccacctcatttgtgtcttcccttgttgtcatcatcatcgtgctacgccagtggctgcaacagacgtgggaatgagagattggtgaattattcgctgccggtgttgtattggaccattagactggtatcagttcgcgctccttgtggcctatgcagccggctcccatctgggggtggaagacatctttttatgtcgtcgcactcgtttttcgccgttgctgagctactttgcaatccatacggtactggcatgtactgtatgtcgccgtgagaggcacccaaagcagctctggtagtgtagctctactatgtgagggtgattgctcatctgagctccgtagtgtagatctctagtcagcacgccctactctagctacatgttcctccttgctcaagggcttaatcgaaaagcttcccagtttttagattcgtagtctaattgatgtaatcagatattcagattaacctgcatcccagttggggcatgctgacattgtttggcgacccactgggcaggtctgtctgtatcttaaccctgcctggcagggggcagttcctgaccctatgtgtactttctatctcaaaaaaaaaaaaaaactggagacctcggccgngnccacgttaatcattagtgaattc

SEQ ID NO: 7007 - DNA, 995 bp, Triticum aestivum
  Clone ID: PAT_TA_7007
aagcgcggtacgcggtctgcagtgggccctctccccctctgcccagactgtgccgcggccatcgcactgcgcagctacctcccaccctatctggcctcgcagccaccgccgacgccgccgcgacgccgtaccccaccccggtgccccccatagcttctcccgtccgcttcgttgggggaaggaatggtgcgaggctatggggcacagtgatgggatcctgagatcgaagcgcaacctagcggggaggtcgtggaaggtgatgtggtctatcgtgcggttgtgcggtacgcattcatcaaagggagtcagtgacagcaccatggcactgttacacgacaacgctaccaacaacggcgatcatccaagatgagaagcatcctcaacgtgtctgccaactctggagccaaggaggtcatggaagaacaggcctttaagggggaagaaagtagctgagcttagggtcatgatacttagctcgcttaaggatgcgcaaccttaagtcaaggtcaataaaggtaatgtggtctacggtgtggttgtccttccccctttgaagtgggaacttagtttcggcagcgtggtccatgattgatgacagcgctatcgtcaacgtgtacaactcaggcgagatgattcgcactcgcgtcttcggtcctgttcctcatgagctcaagaagaagaagcatctcaagatcttggcgttggctgaacacatagtttgagaccttaccctgcttagtcatatctcctttatttccacatggagcggaattaacattgctccagagatatttggttgcccctgctgccattccacctttcctttggtaatttgtgtttggaagaatgatgtaccctaaaaggagaatgtgtaccaaactatagggagccctcggcagatcaagtttcgcagcactcggaatctgttgctcttccggcaacggcgaaaatatgttccttatttgctctgttttacctggatcaaaaaaaaaaaa

SEQ ID NO: 7008 - DNA, 241 bp, Triticum aestivum
  unsure (1)..(241): unsure at all n locations
  Clone ID: PAT_TA_7008
gcaggaattcggcacgagggtgggctgcaggggtacgagccaaggctgatcgagatggcgtatgcattcgagcaagctaccaaagtgaggaagccacccatgttcaagccctagctggaatgcacaatcaagagttaagtataaccctagtatgtgcatcagtcattcagaaacttggtgtgtggtncatgatgctttgtattgccttcaagctcaataatatgagttaataaaaaaaaaa

SEQ ID NO: 7009 - DNA, 453 bp, Triticum aestivum
  Clone ID: PAT_TA_7009
ttccccgcccccccccttcccgaaacggcggcctcctcgcccctccggcgacccttctccgacctctctggcggggaaggctcggcgtttcttggcttcccggcggagagatcccgcctctcttgtcctccgtccgcaagatcacggtattacggcctggaaagaaccccaagaaacaaaccgcgatctctggaggccagtcccgagctaccggcggttgattcgcggtcgatgcgatcgcttgacgtggcgggggcggagaggtcggatcagtacaaccgcaagaagccgcgccgcgagacggagatgcccctagccggctccatcgtcgccggtagcagcggtgactgcggaggcattgaggaatccggtgggtgtctcagcatgcgggtggaggatatcgtgcagcaccccctgcctggctacggggcgccggtggcgctcagctttagc

SEQ ID NO: 7010 - DNA, 715 bp, Triticum aestivum
  Clone ID: PAT_TA_7010
gcggcccatgggccgcgccgacgtgcccgcccgggtggcgcgcggcagcctcaagctgtggacggtcccgtcctggggccgctccgcccgcggcgtcggcagcctcctcaacgccagcagccggacgaagtgcacgccctgctccgcgccggcctgcccgcgcctgtgaggccgccctgccccgacctgttcgcgcgtggtgccggggtgcgctgcgacctcgtcgtccacggcctcctcagcgccagcagccgagctccagaccgaggccgtgccgctgcaagtccgggttgaagctctggtgggccttggtccttccttcctcgtgtagtgtacttttttgggtgggtcgttctggggatcgatcgatcgagttcttcgccttgtcggcccggtggattcttttggcagcagaggagccgtgccgtgtttgcatcggtgcgatccgccctcctcgctcgtttcgtccagtagctccgggcattcactgcttgtttcgttcaggggataggaccttcctgttagtcaccaggaagactcgccgtcccttgttgtcagcagagagccgtgccgtgtttgcatcggtgcactcccgccccctagcatatcttttctagtagctccgtgcatgtacatcttgtgtagagttgatattacccttgctgttagagaggagtaataatatgcattcctagatttttcatgaaaaaaaaaa

SEQ ID NO: 7011 - DNA, 736 bp, Triticum aestivum
  Clone ID: PAT_TA_7011
gagcgcacaagtacgttcgtgcatagtacatctcgcgaggacagtaacaatggccatgtcctccaatctcgcccgctccctcccggacagccctgccggggacttccgtccggcgtcgctgctctcgaagatggcgagccgtggccgacgcccgtctcagctagtcacctccgcggtgtcggccgacgaagcgccggccaacatgtcgcccggctccgtggtcggagacatggagcgcggcactctcgccgagaagacaggccgctccgacggccagctgacgtcgcggtggcgggagctccacggcagcaacgactggcaggggctactggaccccatcgacacggtgctccggggagagctcatccggtacggcgagttcgcgcaggcctgctacgactcctttgactacgaccgcttctcccgctactccggcagctgcaagtacccgacgcgcaccttcttccaggacgtgggtcttgccggcgtcggctacgaggtcacccggtacctctacgccacatgtcacccaagctacccaaacttcagcatctggaagcacaacccgggcgacgacaagctgtggagcgagtccgccactttcgtcggcttcgtcgccgtgtccacggatgaggagacggcgcgcattggacgtcgggacatcgccgtcgcctggcgcggcaccgtgacccggcctggagtgggtgtccgacctgacggcgatgctgaagccgct

SEQ ID NO: 7012 - DNA, 566 bp, Triticum aestivum
  unsure (1)..(566): unsure at all n locations
  Clone ID: PAT_TA_7012
aggaattcggcacgaggctgtnttccctcgtcttcccccgccccctcccccacccgcgtcaaccaaaccctaactcgccccacccccaaatccctccccgcccctcgatctcgccgccgccgccgccgccgccgccaaaaccctacgcccctcccgccgccgcctccggtaaacaacctttcggctgttcgttttggaaatgccgtctgcatccaaatccaaggcaaaggatagggcagctgctttcaaagcagcaaaagagcaacctaaggtggctgtcaagccagtggggaatggcaccggtgcaagtacttttaataacctctctggaaaatttcatcttttggagccatcatcctctttgctgggtagccagggtaacgaaaagttgaggaatacagatgaaatagacgagcattctcgtagctcgcatggtacaggggactttgattgcacctcaaataatggtagctgttctggagagtcagaagatacaaaggaaaaatcaaccagcaccgcacctcgagtggactctattcctggatgtgatcttgataaacgtgaga

SEQ ID NO: 7013 - DNA, 934 bp, Triticum aestivum
  Clone ID: PAT_TA_7013
gcacggggggaaatcatcgctgcccccgtctctggcgacagcccaaccggagcgccgccgcccgccagctccggcggcggaggactctccgccgtacggatccgtggtcctaggaggcaccttcgaccgcctccacgacggccaccgacgcctcctcaaggcctcggcagatttggcgagggatcggatcgtggtgggcgtctgcacgggccccatgcttgccaagaaggagtacgctgagcttatcgaacccgtggagaagcgcatcaaggccgtggaggattacatcaagtctattaaaccagaactgatagtacaagtggagcctattgaggatccatatggcccatcctttattgtccattattggtgttccgttgcttgcagttattgtcagttaggtgacactgatcggtggactctctagtgagtcgggaaagagctgccattgttgaaggttgaggttgttgatcttttatctggagataccgagggagaaaaattgagttcatctgctttaaggaaacttgaggctgcacaagctcaacaacagaaagcaaccatagctaatcagaaaggtgtttagagaggaaacatactggtatcttgagctgcatacataaatctgaagtggtccgcgaaggcgtcctgccgacgcttggtatctagaaatggcattttgccttcgtatttgaacgaaaatggtcttcgaacggcctcctaacgccctcctacgtccctgtaacactatattgctctactctgaatggtataaacttacaaagtcaatgttggtaagctagactaaccaaatgtacacaggctttgccctcgcattgccatctcgctgtaaagtcaccttcaggtcgtttggaataatggtaaccaactaaatgaatttggtgcctcttttgtgacgtgtttatgtgatgtg

SEQ ID NO: 7014 - DNA, 753 bp, Triticum aestivum
  Clone ID: PAT_TA_7014
ggtggctggcggacgcggaatcgttgggttgcctgctgcatgcggatcgccgagtggcacgtctacgtcatggggtcggccagcactgacccgatatggaggaggccagcgaggcccgcgggcaaaggcggttccggcggtctcatgccgcagccagtgccggcggcctcatccgtcagaccagggcggcggcctgatcgttcacacccggtcttggtgagggtgtgaacgaacaccgagaaagcgagaagttgtttagttgtgattgtgtcatggaatgtgatgcttgtgcgagtaaagtggttgagttagctgagcaaatcctttgtattattattgttctttttttgttggtggagtgtgtgtgtgtgtgtgtgtgtgtgtgtgtgttgtttcacagttttgtacgcagatgtctatatagcagaggcgtttggtgtcgatcgagcgtcttacctactatgcggagagagttttgttaaccgtgttctctgtaggctgtatcttctgtaatgagagaaaagaagttgcgccgttttttgtgcttaccccatcacaaaacggagcacggagtaagaacaaacaccgaaaaagtgagaatttgctatagttgtgctttgtgtcatggaatgtgatgcttatgcgtgtaaagtggttgagttggctgagccaaacctttgtattattgttttttttgctggtgaacaacaaatagagcaatgtcagtgcatactacaaaaaaaaaaaaaaaaa

SEQ ID NO: 7015 - DNA, 815 bp, Triticum aestivum
  Clone ID: PAT_TA_7015
ggttgcagggcgtctggtcgcggtgttcgagctcggcccccgcgtttcaggctcgcgcccccatgctccgggatctgctggcccgcaattgctgtcatgctttatcccacaaaggtcgcggaggcccgagggcgtccggcaccggccccaccacaagacatcactgtgctctcaccacattcgaaacaagttcttaggaaattctggaatttggtcagaaaatttcagctgcctatcggtttgattctcttgattgtgtatggttggcggaaaccaatggttcttgccatcaacacattgcttcttctctactctacaaggcctgacccctattccatatacttgtttcttcaggagattcatcaagggaaggtgcagcaaaatcctgtattgtggaaggaggaggtcatccagacaagaaaagttgataccgaagactacaagttcttttctattgggacggtcgaattaaaggacagaacagtactgcatgtgattggaattctgggcaattggtggatctatcatgtgtcgtatgacaagagagtggagcagttgtacttgtaacttctcattctgaagagctggttaataacagtagttacttgtagtttttgacatctgtattaggggatactgattctcaatgtttcggagctctgcttttgcatgtaatgctaaaatgcgttaacatcacaagtttgtccggaagatctagctctactggtcatccatggaatttgtttgatggatgcatcgattaacttgtatccggcttgaagtgtgaacttacatcaatttgagttgcgtttctc

SEQ ID NO: 7016 - DNA, 1118 bp, Triticum aestivum
  unsure (1)..(1118): unsure at all n locations
  Clone ID: PAT_TA_7016
gcggagggctctccccgcaagccagagtgtcgcgattgactgggtgaatgagaacgtgcagccttacatttctcagacacgcattgttggaatcactgtggggaatgaggtgctgggaggcgatccgagcttggccgctccgctcgttggagctgttaagaatatgtacgatggtctcaagaaactgcatctggatgacaaaattgagctttttacacctcactctgatgcggttttcgctacttcctatccgccctctgcatgtgttttcaaggaagaaatcatggtgtatatgaaaccgctgctggacttgttttcacggatcggctcacctttctatgtcaatgcatatccctttttggcgtacttaactgatccggggcagatcgacattaattatgctctctttcagcccaaccctggaatagttgatccgaatactagtctgcactatgacaacatgtttgatgctcagatagatgcagcttacgctgctctgcaggctgctggttataatgacatggaagtccgggtggcagagactggctgggcttctagtggagatcaaaatcaagcaggaccatcagttgagaatgcaaggacttacaattacaacctccgtaagaggctctttttgaggaagggaactcctctcaagccaaagataccagtcaaagcatacatctttgccttgtttaatgagaacttgaagaatggagatcctactgagaagcactatgggctcttcaatccagatggaaggatttcatatgatatcggttactcaggtctattaccttcatcagcacccgcatccttgctgtcaattaaggagatgcgagcctggggttggattgcacactattcggctgcggttatcctagctattttcttgtcttaggcttagtgacttgatgattatagaatagcacatctgttaagggtacaatgaagatgaggagttagaatgcctgcttgtactgggaaactcagaatggaaattcaaataatggttccctgcacaccaaccagtttcgtctgtgttcccctcacccccttttctacctgatgaaaaagaacatgggntttgaatttttaacngtataataataanttan

SEQ ID NO: 7017 - DNA, 1180 bp, Triticum aestivum
  Clone ID: PAT_TA_7017
ccccgcccccctttgccccgtaccgcggcgcattgctccatgggggccggcccccccaggtcatcctgaatgtgttctcagcttctaaagtcagagcgctttcccctgtgttttacattgggggcaccatgctgcgtgcgctgcctcatgcatacgatgcatacaggacccatcactttgtgcgcagcatgaggccatcctacatctacgcaagctctcgcgacgacctcttcagcctcgcgtgggacatcgtcataccttgtggggtggtcctgctggccacgctcctcttctttcagcagtggcttgggggcgccttcttcctctgctccaagagacggaagccgtcgagcgaatacgaaatggtttccacggtcagctcttagcaagttcctacagctttattcatcgcgagataagtggaagtagaggagggggtttgcatatggtctgagagatagttttttctgtttccataggtggagtcgtaactgcggcttgtccacatgagaaccaaccatagcagaaggatgttgaggcaaattgctcgcctcatgccgtcacgacatacattctgggaggacattgtcccttacgggggcttattgctcgatgggttcctgctcccccaggtcatcctgaatgtgttctcagcctctaaagtcagagcgctttccccagtgttttacatcgggggcaccatgctgcgtgcgctgcctcatgcatatgatgcatacaggacccatcactttgtgcgcagcatgaggccatcctacatctacgcgagctctcgcgacgacctcttcagcctcgcgtgggacatcgtcataccttgtggggtggtcctgctggccacgcttctcttctttcagcagtggcttgggggcgccttcttcctctgctccaagagacggaagccgtcgagcgaatacgaaatggtttccacggtcagctcttagcaagttcctacagctttattcatcgcgagataagtggaagtagcggaggggtttacatatagtctgggagttagttttttctgtttcctgatggatgaatatttaccccacattggcgcttgtttgcggcgaaaacttatacatgcatgtatacaatagaaggaaaccagatcaggcaaggttcggttcttattcacagttctttctcctataaaaaaaaa

SEQ ID NO: 7018 - DNA, 822 bp, Triticum aestivum
  Clone ID: PAT_TA_7018
gggcgtggcagcccaccgacgcggcggcggcgcgggccgagcagccccgccacttcgcctggcaatggagtacaccccaaggcgctggctggccgcggtggcggtcatcgtcctgctctcgtgcgccccggccccggcggcggcggccggccggaagctcctgcagatccagatcagcgaggcgcagcagttcgtggtgccgcagagccacatgcgcgcgatccacggccagcgcccgctcaagtggagcagcgagctggcggaccaggcggagcgctgggcggcgcggttcaagggcaactgcgcggccgcgtcggcggcgatgcccggcggcgtcaacgtgttccgcggcttcggcgaggccgggaaggcgtggcagcccagcgacgcggtggcggcgtgggcggagcaggcgaactacttcgacttcaagtccggcggctgcgccgccgggaagctgtgcgcgcagttcaagcaggtgatgtccaagggcaacacggacgtcgggtgcgcctccgtgcagtgcgccgacggcaccacgctcatgacctgccactactcgccgctgggcaacgtctttggcgagaggcccttctgatcccgtcgatctcgcccgtcaagccggccgtctcgtgccgcgtgtgtttctggttgagtgtagtcgtcttgccatgttttgcaagtttattacgtactcactttttatattttatttggttattccgacgtgctagttgatttactacatcatgttatggtgagagtaaagaggttaatgctttgtcatgagttttgtgcatgacatttggtaaaaaaaaaaaa

SEQ ID NO: 7019 - DNA, 239 bp, Triticum aestivum
  unsure (1)..(239): unsure at all n locations
  Clone ID: PAT_TA_7019
nnaaaannaggcaagcattagcctagccaacccaacccagcccggcagctcgtctggtgcacattcgtacacacacgttggctcgtacacagaaaagtccacacactccagtagccaccactaggtggtagcactagctaatactctaccaacgatcgacccgtgctctgtacgtaaaactagtcattgctgcatgcatccagtgagctcatctcatctctctctctccaaaaaaaaaa

SEQ ID NO: 7020 - DNA, 879 bp, Triticum aestivum
  Clone ID: PAT_TA_7020
gggtgtccgacccccccagccccccccccccccgcccccgccccccccccactcctagccgcgctccgccccgccacgccccggatctcgccgccaggaccgccgtcgacccgcacccaccgcaggcccgccgccatggccaccttccgcctgtaccggcggtccaccatcggcatgggcctcaccgggacgctcgaccagctgggctccagcggcgccctcgcccccgtgctcccgttccggcggtccacccctggcacgtgcctcaccgtgacgctcgacgagatggtctccatgcggcaccctcatgccctgagctcgccatccaagtgcttgatccacgttcgaataagtctatgacggacgcactgggaacccaagtgaaagaagcaaggattactgtcaagcgggccatctgcatcacctacagggttctgccgacaaagtgtggatattcaccctgacgcacgtcgcgctccaagaacgaggagacgaccgagcaggtgggcaaggtgaagatcgtggcctgccgactccaagctactcagccaataagcagctcgctgccgactcccggcggcggggctcattcgatccccgcctccgctagagaacaccaccaccaccacaccaccctcttcataatccatgggtacctgtagaaggatctcatgcgatgcgaccctagagcatcgcatcgcatcgcagccacagaactttttccgatccttgccgtgtaatgttgtttccctgaacttttgatataactgggacggaatagtaagtagcaatcaaaactttgtttggaaatgtgatgagacatttagcacatcttgtgtgacgacggcgtttttccccgaacttatgccggattttccc

SEQ ID NO: 7021 - DNA, 955 bp, Triticum aestivum
  unsure (1)..(955): unsure at all n locations
  Clone ID: PAT_TA_7021
tggagaaaccgcgaagaaggcatatggacagaaatatctcaaacaacttaatgctagttgtcctggtggtcacatgggtagcaagaacacgcggaaggccaatagtgatgatagcaggagcagcagccttgaagatgaagctacaagcaaaaggtatgaagaaaagagcagacaagatgacaacagctttgaggctcagggcgttaataagagatacgacaactgcaacaaggaaggttataacaatgactttggattcgatagcattactaagacatgtgaagaagagagcgtacaagatgactatgcgaaatcactgtcctcgaactgtgaaaatgccaagggagtagccaaaaatgagtcatcagtcagtgagcgaacaaatactagctcgcatgtctcttctgatgctgggctagatgaaattcaatcttcagctggtaagagtggggattcatcattttttggtggtttcttaaagaaaggtttcaaggatctttctttattcaaccagtctatggacagtgtcaaggtttccatcaacggtcatccaatctctgagcgtgctcttcgtaaggcggagaaaaaagctggtcctgttagccctggttcatattggtatgaccaacgtgctggattttggggtgtcatggggcacgagtgcagcggcattatccctccatttataaaagaattcagttattcaatgcccaaggaatttgtgctggtgggactactggagtgcttgtaaatggaagagaattcatcaagaaaattcaattgcttggtaaagagaggcttcaacgtttccnctgaaaaacataacgnttgatacccaaggaactgtgacggatgctacaactggngacaattaccanccttggaaacttgcccctacaaccnaaaaataaccngttttggaagcactccctnaaagaatantagcatccatgan

SEQ ID NO: 7022 - DNA, 808 bp, Triticum aestivum
  Clone ID: PAT_TA_7022
cgccagtctcctccattcccctccccacctctcccaaatccaatccccaaatcctcatctccctccccatctctctcgtcggcggcgaggcggggaaggagggcgaagatgctgtgggtggacaagcaccggccgaaaaccctagacaaggtcatcgtccatgagcaggtcgcgcagaacctcaagaaattcgtggcggagcaggactgcccgcacctcctcttctatggcccgccggggtccggcaagaaaaccctaatcatggcgctcatcaagcagatgttcggcgccggtgtggagaaggtgaagatggagaataagacgtggaagatcgatactgggacgaggacatttgatcttgagctggcgatgttgtcaagttcccaccatgtggagatgaaccccagcgatgctggctttcaggacaggtatgttgttcaggaggtcatcaaagagatggccaagagtaggcccattgatgccaagggcaagagagcatttaaagtgcttgtcctaaatgaagttgacaagctgtcacgagaagcacaacattccctccgtaggacaatggagaaatacagtgcatcgtgtagactcatattatgctgtaatagctcctcaaaggtgacagaagctgtaaggtcccgttgcttgaatgtgcgagtgaatgcacctaccgaagatcagattgtacaagtactggaattcattgggaagaaagagaatctgcaacttccatttggatttgctgctcggatagcagctcaatcaaaccgcaacttgaggcgagcaatattattttttgaga

SEQ ID NO: 7023 - DNA, 1551 bp, Triticum aestivum
  Clone ID: PAT_TA_7023
cctccccgctcccccgttcccccccgtctcctccattcccctccccacctctcccaaatccaatccccaaatcctcatctccctccccatctctctcgtcggcgccccggcgccccaagaccatgccgccggtgccccatctccctccccatctctctcgtcggcggcgaggcggcccgcagggcggaaggagggcgaagatgctgtgggtggacaagcaccggccgaaaaccctagacaaggtcatcgtccatgagcaggtcgcgcagaacctcaagaaattcgtggcggagcaggactgcccgcacctgctcttctatggcccgccggggtccggcaagaaaaccctaatcatggcgctcatcaagcagatgttcggcgccggtgtggagaaggtgaagatggagaataagacttggaagatcgatactgggacgaggccatttgatctagagctggcgatgttggcaagttcccaccatgtggacatgaaccccagccctgctggcttccagggcgggtatgttgttcaatttgtcagcgcagagatggccatgtcttttaggacaagtactacaaataaacaaagaatttttaagtctatgttaaaagaagttgacaagctgtcacgagaagcacaacattccctccgtaggacaatggagaaatacagtgcatcgtgtagactcatattatgctgtaatagctcctcaaaggtgacagaagctgtaaggtcccgttgcttgaatgtgcgagtgaatgcacctaccgaagatcagattgtacaagtactggaattcattgggaagaaagagaatctgcaacttccatttggatttgctgctcggatagcagctcaatcaaaccgcaacttgaggcgagcaatattattttttgagacatgcaaagtccagcaatatccattttcagcaaatcaagtggcacctcctcttgactgggagcagtatgtgtctgaaatagcaactgaaatcttgagtgaacaaagccctaaaaggctatattctgtacgccagaaattctatgagttacttgtgaattgtatcccacctgaaagcatcttgaagaagttgttaaccgagttaatgaagaagttagactctgatttgaagcatgaagtttgtcactgggctgcacactatgaacacaagatgcgacttgggtccaaggccatttttcatctggaagctttcgtggccaagttcatgagcatttacaaggagttcctttgcgccgcatttggttgagcaaaaccagagcatacggatgtttgccgctgcaagaagatgctcccagttcgcagtctctgtcgtcgcaatcgctttggtctgatgtgtgggcgcttacattttgtatgttactcagtcagtgtagtttgtactgaattcatgtgagcaagtacttatttactttgaatcatttgctactgaaaggtggagtcgcccatctatgattgtcttgattttgttctgccttgtgcttggacgtcaaacgaatttcagcatctcatcctataaatgccaacagggtgct

SEQ ID NO: 7024 - DNA, 1713 bp, Triticum aestivum
  unsure (1)..(1713): unsure at all n locations
  Clone ID: PAT_TA_7024
ggcgccgccggagagcccgggcacgttccctaggcgcgggtacgataacacccaaagcccctctccacggcttcttctccgccgtcccataccggcgcggtaccgtcggcgctcggtgcgctacctctccgcatcgccggctgcgcggtttcggctcaaccccatcgcgtccctgctgcctcgaccccgtccgcagttctcgtgattggtttctaagctgcagcagagacagtgcatggccgcggcaccacatcacctgctctatgaattcgccaaggctgcactcatcaagatatttgcatttccttatgccacggtctgcgacatgtactgcaacggtgtcggcgcgagggaagagtgggctgatgcccaagctggtcgctacataggaattgacgcttctgcgtcggctgtcagtagtgacgaccgtgaactgtgggagaacaaatggaaacctttcaccactgagttcatcgagttgaatccttccgctgatgactttgaagctcagttgcaagaaaagggcatccaagcagatatagtttgctgcatgcagaatttacagatagttatgctttgaaagtgaggaacacgcaaagaagcttctcaataacgtgtcatcattgctcaaacctggaggctatttctttggcataattcctgattcatctacattatggactaaatatcaaaagaatgttgaggcttcacataataagggtctgaaggttgttccaaatagcatccgctctgacaactatacaattaccttcgaaatcgaggaagaaaagtttcccttcttcggaaagaagtaccaactcaaatttgcaaatgaagcaatgtttgagaatcattgcctcgttcactttcccagccttatgagattagcaagggaggctggacttgaatatgtggagatccagaacttaactgagttttatgatgacaacagaactcagtttgctccaatgcttggtagttgtggtgccaatttggttgaccctcgtggaaagctcattgctcgttcctatgatattttaggcctgtattcgacttttgtgttccagaagcctgatccagatgcaataccacctgttgtaacacctgacccagatgaagaggagaggctctggaggcagcaggcggcagcggatgatttgagacggccacaggcagaggtgatgccaatagaccctgatcagaaagggatcctgggcccaggacctgcagatatgaggcttaattagtttgccagaaaattcagatgtagatatagacttgggggtaattgtgctctctcagttgatggtgcatggccatgcttgtgacctcccctgtgtcgctagttgatctgaagctcatgtcaaaagggaaaaaggttgatctgaagctcacgcgggtggttgatgcaagtttgggcattcgttgaagtccaccaggccaatttccatgtgtgctgtcatcaccagtagtctatttcaagtcatgttgcattaggtcctaactagtagtacaaggtattttgtgtgtgtgtgtagaggtacacttaagttgcgtgctttgtatagcatggcttttcagaattttgtgctagtgtgactgtgaaggacttatctttctactactccctctgtcccataatgtaatgtcaaaaaagtcttatattatgggaattatggaaggagggagtaganatacaactatggtaaaaca

SEQ ID NO: 7025 - DNA, 633 bp, Triticum aestivum
  Clone ID: PAT_TA_7025
ggaactatgaacaatgacgaagaaacaaatggtctggtatcgcctctaatgtctgagagagaagacagtgacattctgaatggtttcgaggggcatgatctttccatgtacccaataaaccggagcttccacatgccaaagcagaaattcgactttgcacaatactatgcatttgacatcacaatattcgcgctcacgatgatctactcactgtttgctccgcttgtggttcctgtcggtgcagtatactttggctaccgttaccttgtggacaagtacaatttcctgttcgtgtacagagtcagaggatttcctgcaggcaatgatgggaagctgatggatagggtgctgtgcatcatgcaattctgtgtcatcttctttcttgctgctatgttgctcttcttcgcagtccagggtgattccatgaagctacaggctatatgtactcttgggctgttagtgttctataagttgctgccgtctggaagtgatcgcttccagccgtccttgttagaagggatgcagacagttaatagctttgtagatggtccaacggattatgaagttttttcacaacctgaccggattggaatctgtatcaatcctaagaaaactcaaggtcaatacacactt

SEQ ID NO: 7026 - DNA, 561 bp, Triticum aestivum
  Clone ID: PAT_TA_7026
gcttgccggtagtccaccacgaggcatctcctccctgatggcatgctcatcttcaacaacgccgacctgctgcacttcctcgtcaccatcctcaagaaacggagatcctactcctctcgaacgcctgctgttgcgatctccctctccaacgcccgctgctgatcttctccaactccgacgaccatcgctgcaacatctcctcgacatcaacaatggggcgtcgagctcctggtggtgctctgctccaggtggttggctgaccttccgccaaggccaccacggttcttccccaaggccgggtccttcgctgtctatcttcgtccctgctgctcttcttcgattgcaacatctacgacctcgaattgaagatcatcacgacccataggctatgaacctctgccttctcgtgtttctgttctctgaatatatgcactgttgggtctgaaatttactttgttatctgtgtatctttgctgaacccccatgtatccttgctgaattgttgtgaccctttgctggatattgagttagtagttattttcttgtgagctactagcaatt

SEQ ID NO: 7027 - DNA, 728 bp, Triticum aestivum
  Clone ID: PAT_TA_7027
acctttcgacgtggcattcgacgacgccttcgtccgctgtctccctccctcacttccctcgcctggctctgccgcccaccgccatcttgaccgccggcgaagagagagggagggagggagggaggatggggacccgggagctgccgctgccgacgtgcttcgagctcctcctcggcaaagagcgtgaccggtggccgctggaggccacgctcatctgcgccgcctacgacggcagcatccgcaaaatcaagaagatcgcgaaggagctggacgtgcacgggcacggcatcccggcgacggtggccaacaccacctacatgggaatgaacgtgcttgatgccgccggtggctgtggcagcttgccggtctaccggtacctcgtcgaggaggtcaagatggacgtcggaaaccccgacagcgctcagggttttacgcccttggagtatgctgcccagaatggacacctccctgctgtcaggtaccttcttgaccacggcgccgatctgcaccaggaacgttccagcctcactcttcttcatacagctgcagttcatgggcggtctgaaatagtaaagtttcttctttctaaaggagctgatgttgatgcactatcagatcttgggacaccactcactcttgcttctcttagaggacatgctagcattctgaagatccttttgcagcacaatgcagatcccagcaagggtaatggtgcgtttgtaccttta

SEQ ID NO: 7028 - DNA, 643 bp, Triticum aestivum
  unsure (1)..(643): unsure at all n locations
  Clone ID: PAT_TA_7028
gcgcaaggcgagaggtcgtttcccactttgcagaatggcagccccaaacaatactagcactccaaagaagctgattgtcatctactctccgccggggatgccgggccacctgttcccagccgtggagctgggcaagctactcgtggtgcagggcctcgaggtcaccgtcgtcctcggcggggaggataaccacggcgccggtggttccttcctcgccggcatcgaggctgccagcccgtcattgtccttccactgtctcccccgtgccacgctcccctccgacgttgcccgccgggagtttcgaggcgcagcttttcgggctcgcgcgcgcctccaacccggacctccgtgacttcctccggtccgcctccccnggccccggaagcactcctcatcgatttcttctgcagcagcgcgctgggcgccgccggcgtcctccgcccgccgacccccttctttctctcctcttgcaccgcctgcgtcgccttctgtcccctcctgcttgccacccaggagctgccccctctgagcttccccgcccccggcggtgcccttttcctcggcccgggtttaccaccgataccagcagatcacctgcctgcgtttatcctcgatcgcgacagcttgagcagtaagttcttcc

SEQ ID NO: 7029 - DNA, 1148 bp, Triticum aestivum
  Clone ID: PAT_TA_7029
tcggcacgaggcgctcgccatggccactcccaccgccaccgccgccgcccatctcgcctcgcccctcctcttctcctcatccccggacccccgcagccgccgaaccctgagggccccgttccgacgcgcccgccttgccgtcgtcgcctccgtccccgaccccgccgacaagccggtggagtacacgccctggctcatcgccggcctcggcaaccccggcagcaagtaccacggcactcgccacaacgtggggttcgagatggtggatcgcatcgcgcgggacgaagggatcacgatgaacaccatccagtccaagtctctgctcggagtaggtttaattggggaggtaccagtgctgctgataaagccacaatcatacatgaattactgtggtgaagcaattggaccgcttgctgcctattaccaagtacctctgcggcacattcttgtgatttatgatgacatgagtctgcccaatggtgtattgcgacttcaacggaaaggtggccgcgcccgccataacggcctacagaatgtaattgagcatttggatggctgccgggagtttcctcgtttatctataggcattggtagcccacctggcaaaatggatacacgagcttttcttctgcagaagtttagttcagaggaacgaattcagattgacaccgcgttggagcaaggggtggatgctgtgaggacccttgtgctgaagggttttagtggaagtattgagagatttaatctggtgcagaagtacaagttcaacagggcttgatgattctttagatgcttggatctgcctacctttggaagatacatgaatgcacacgaaaatgtttttggaagcgtttgatgtgataatttgcataaccttaggtgcactaagttgggtgtcctatagttttgaggatgttaaaaacttagcagggtgtagataaggtagagttcttctgcacatcttcctaaagataactcatggtttactcaaattggaaataaaataggtccatttgatgaaggtcatgtaaaaacactttgtacctccccgggcggccgccacattagtccgatgtaaaagaggaatgtagaccatttcattccacctttcctaattctgtgatttggggtaagataaaaaaaaaaaa

SEQ ID NO: 7030 - DNA, 697 bp, Triticum aestivum
  Clone ID: PAT_TA_7030
gccggcaacaccctcgcctcctacgcctccgtcgccgccggcgccttcgtggtcccgcgcccccggctccactccctgggcgtctccggcgcccgccccgcctccgcccccgccgccctcaacgccccgctcccccgcccgcgcgcccccgccatggccctcgtccccgccgccccccccgtccccggcctcgtgcccaccgccgccttcctcgtcgccacgaccgtcggcgccggcgtcgtctccgggctcccccccggcctggcccgtctccacaaggccgacggcgccggccccgcctccgccgtctcgcccgtcttctgcctcttcccccgctcgctgtcccgcgccgtgtccctcttcgcggccacccccccggtgccgggccacgcgccccccccgccgttccagctcggcaccgaggggctgcgctgcttcaagtccaggctccccccgaaaaaggcctgactaaacaatgcttacgtactgctcctgagatgtttccttcgagtgatgacatgattcattcaatccctgatttgtatttctactcacttttacttacctgcgttgttttcttgatttgttggatcctcattgtgtaatgctgccctggagcagcaagtacaaaagtggtaggtctgtgctgcttgtaataataagaccaagtcatttgttggttctaaatctaatcatt

SEQ ID NO: 7031 - DNA, 430 bp, Triticum aestivum
  unsure (1)..(430): unsure at all n locations
  Clone ID: PAT_TA_7031
attttttctgaatcttcacttgggctctctttttttctttaagantagcctaaatggcaaattagctgcaaccattctcctctgtaagctgggcagctagtgctgctattttttttattcacggtagtggtggcaaagaggcggaggaggtcccggccaggggaggcacatacggcggcgaagagaagggccgccgggagtgggcacgcgtgaaccacttgcagtcgccggggatctggaggctggccggcggagatcgccacctctgttttttatcaggcggcggaggtgttgaggaagaggaagacgggatcgtgggttgaattactacaaatgcagggtcttttttgtaaaaacaaaacgttttctcatatccccttaagaagggactgcgggttgaattcttgaaaatagaggggcttttttgtna

SEQ ID NO: 7032 - DNA, 931 bp, Triticum aestivum
  Clone ID: PAT_TA_7032
ttttttttttttttttttcaaggaaaaagggatatggatatgaattttctcagcaaggaccatcgtttcgtttgtcaaacaagcccacacgcagaaattgcagcctacaggaggctaactgggctcttaaatacctcatgtgtaaaataggggcacaaagttgccagcatcaaccacaacagttaaatgtttacacccactgaaacaccactatcttagatgggtctgcttaatgttcttctatcttcttcaggtccttcatatttgttgtgtccacagtggttccataaagcgcgatcttctgaatttttgtgatgtcagctccgctttgattgtcttcgataaacatagtcaggctgcgaacattctggaacttcacatactttagcgtgacaggcttactttccagtaaatggctggatgacaggtcaacactgtcacttggagggaagtcattgacgttgctgaaacccatatgctctctgttggagaagagtttaactgtctttgggccttcttcctcggggcctttgaagagcgcggaatgcagcttgatgacctgcatgaaggggatgtagatcagcagctgctcgtccgagtcgctggcgaggtgcagcccctcatcctccctgtaaccctgcttgagggcgttggcgatgccgtgggcggggtcctggttgaggcactcgacgccggtccagtcgatgaagtcgaccagatccacctgcccgcgcggcaccgacgcggacgggacggccgcggcggcggcggcgggcgcgggggcggctgcggtcggcgcgggcgcggtggccatggatggctcccggaagcttctggaaggtcggagcaggggcggacgcgagagagacggcgggcttgcgctcgggcgacttggacctcgactcgtctcgtcccgtgacgacggtgccga

SEQ ID NO: 7033 - DNA, 507 bp, Triticum aestivum
  Clone ID: PAT_TA_7033
ggataactcgacggatcgcacggccttcgtgccggcgacgcatcattcaaatttctgccctatcaactttcgatggtaggataggggcctaccatggtggtgacgggtgacggagaattagggttcgattccggagagggagcctgagaaacggctaccaccccgtccctcctacgcccacctacggcggcggcggtggcggtggataccacggacaccactgagtccggtccaccaccgtcctaaccagcgatgaaatctcatcagcgggttggtgatcagtgagtgatagaccttgttatttatgatcgctttgcatgcgtgggtacgttgtttggttttctgcctcgttttagtatctgcactacagaattgagagttcagaataacagtcatgtactacgagtgtatcaggcgagtgtgagggggtggtttgtgtgttgcttgccttatcaagactttgtaatttcagtgtgtgttttgtataacaagtttttatgaatgcat

SEQ ID NO: 7034 - DNA, 1633 bp, Triticum aestivum
  Clone ID: PAT_TA_7034
gtcacatgtcaatactaaagagttttctcaactcagaggcaatgtaccatttcaaattcagcttgtaggataggtgatacataaaaatttctccaaaccactgccatgagttcaccgatctgttgtcgaatgcgcggggaacaaccattcatggccagatataaccagttcaccccgccatattgatgagcaaagttgcggtgagtcagctcaatgagactgcgcgacctttggtctgttttttgtgtgtgtattatgatttctttctcgcgctgcaaaacaattttacactatgattgaaatgtttatgtatcacctatcatacaagctgaatttgaaatggtacattgcctctgagttgagaaaactctttagtattgacatgtgaccacactaactgcagcaaatgtttcccggcttcctaagctgtcaactaggaaggaacatgttcaacttctccaaaccactaccatgagttcaccgatctgttgtcgaatgcgcggggaacaaccattcatggccagatataaccagttcagcccgccatatttatcagcaaagttgcggtgagtcagctcaatgagactgcgcttcaagcaggatgtttgtggctacattgatatcatttctggctcgcacgagggcctgtctcgcagcattgctgtcaaagcccatcgataccagcatagcaatggaggactctgggggctccacaacaggagcaaacccagtagacggctggttctgaacagtacggcctgtatgcgaaggcacatttccaacaagacttcttgacggccgagatgagcttgctgaaggaggtacaaaaactcttgcgaaaaatgatgcaacaatctgtggaagcttcctccggcggatgccaaacacattgagacgatagagcgaaccggcaatcaggccacaaataccaggaataagggaacgcttccaagaagatacaagaagctgcaggccagctaggtatatgaatgatttatcactgaaattaacgccaaaaatacgaaatcgtgaagtgatgggaatgtcgaggaaaaaaggaataaacgaggcaaatataaggccataaggtccagatgcaagagcagtgatgtagtttgtatctttcaggagaaccaaagatagaatctcaagaggtaatgatactgcgatagagaataaactaaaaacagagtatttgttagagcccatctgcctctcaaacacacggaaataatacagaaggtagagtccaaacatcaactctggtgttgactgaaaggcaaatacagatgcaaatatcctccaaactcgaaagttctttatgatgtcctggtaggagaggccgagggcgcgggctcggcggttcacactgaagacgacagagaggaggccgctggcgaggacgatcgcccgcgtcaccggcgcgttatggaatccggagacgcctccgccctgcatcgttatcccgccgggaacacggccgccgggctgggaggcagatgcgctgttcgtccgatgaggcgaggaggccgtgggcagccggccagccggccagtacgcacccgcggccgccgcctcctcttctcggcgggctctcgtttacccgcgcccccgggtccgccccccctcgtgc

SEQ ID NO: 7035 - DNA, 756 bp, Triticum aestivum
  Clone ID: PAT_TA_7035
aagaacgtcaggtgggtgaatgcagacactgcggcccgacggccctatgatattatcatcacccggggagataatcggatagagtatgtggaggtgaaggcaaccacaacttcaaacaaaaactggttctacatcacagcgagggaatggcagtttgcattggaaaagggggacgattttagcatcgcccgtgtcatggtgtctggcgaaaagatggcaaatattaaaatgttgaaaaacccacacaaactttgtcagaagaaaatgttgcatcttgctctcttgattgcccgccggtagtgaagcaagcgctgacggactatgtgcacgagattgaagtgattgcgggaacttgtcggtggtaatcactgagatctccatctccgctgaagccttaataggagagacaggtgcgttggctgatccgacctgtcagtctacgatgccaaccttctgtatggagagtgagatgagatgagccaaggttgcgagattatcaagcaggtcctgatccctgtctgcatgtagcgaatatgtcttctttctgggaaacgatcttggtgatgtctctggatccgtgttacacatgacatcgtcatctcgtgcctggagctctgctccactgacttgtaaccggttgtaatagttggctacataaccataactgttggtttgtttgattggtgatgtcgaaactgtatttgatcataacgatagtcaagaatttaaacaccatagcaatagtaagaaattaaa

SEQ ID NO: 7036 - DNA, 966 bp, Triticum aestivum
  unsure (1)..(966): unsure at all n locations
  Clone ID: PAT_TA_7036
attcggcacgaggcgcctcctcgccgacgacctcttcctcgccaagnctcgccatggagatgggcgtcggcatgatcgccaagaccgctgcggagtatgagaagagacgggagaacttcgtcaaggagattgacatcgtcatcgctgatgtggtcatggcaatagttgcagatttcatgcttgtctatcttccagcaccaactgtgtctttgcagccaccacttgcgagaaatgctggacttattactagttttttccacaattgcccagacaatgctttccaaattgctttggctggaagatcattctcgcttctgcagaggctaggagctattgtgaaaaatggtgcgaagcttttcgctgttggaactggtgcttctctggttggtactggtgtcaccaatgcactgatcaaagcaaggaaggctgttgacaaggacctcgacgacgaagttgacgatattccagtggtgtcaactagtattgcctatggtatatatatggcagtttctagtaatctcaggtaccagattttgtcccctcgcgtccggcagaggatgctggagcccgtattgcataaccacaagctgctgctgagcgcactctgcttcgctgttaggacagggaacacattcttgggttctttactatgggtggactatgccaggatggtgggtgttcaaaaggccgaggaggagatctaaagttgcagccttttttgttactgagctttgccggaattcggaagtcactaccatatcttgcctgaaccctagaatgctgttcttctcttcgtatagggaatgcttcaggagagagttcattttattttcctgaaagcaagaagatagatatatacctgtcgaattatcgtgaatgtcattgtacttgtcgtcgtgttatcatatcttgcagcttgcaaggccatatagcatgaattctttaaaagaaaaaaaaaaaaaaaaa

SEQ ID NO: 7037 - DNA, 456 bp, Triticum aestivum
  unsure (1)..(456): unsure at all n locations
  Clone ID: PAT_TA_7037
ttcggcacgagggaatgactggggaagttgtgttggaatagttcacagccgcgattgtaccaagatggactcgcctcttctttcaatggcgaggccaccactgtgcgtgccttgttcaacctcgctggagcacgtgattgatctcctcctcagagagaagtgcgagatggtgatcgtggtgaagagcggcaacatgtatgaaggcagctacacatccagctcaaggccactgggcgttttctccctcggtatcctgtcggaggctaccaccaacacggcaaacacccacgacgagtgcgtctccggggcagcacccggccaggaccctgaagcccgcggccgtggctgagtacacgtagctattgttgtgttgttgtctaccattctaccataactcgtcatcagtnttgcttactagcgagaagtcattttaccgctgtgtggcaaaatttagtg

SEQ ID NO: 7038 - DNA, 910 bp, Triticum aestivum
  Clone ID: PAT_TA_7038
gattaagcctgcatgtgcaagtatgaaccaatttgaactgtgaaactgcgaatggctcattaaatcagttatagtttgtttgatggtacgtgctactcggataaccgtagtaattctagagctaatacgtgcaacaaaccccgacttctgggaggggcgcatttattagataaaaggctgacgcgggctctgctcgctgatccgatgattcatgataactcgacggatcgcacggccttcgtgccggcgacgcatcattcaaatttctgccctatcaactttcgatggtaggataggggcctaccatggtggtgacgggtgacggagaattagggttctgacagggaaaagtgcatattctcttttgatggatgatgggacaggtggacctttgacagacttcgcactccccatcattgaagtcggtaatattgaggagttgttggacaggcgacctgtaccggagccaacgccttggcagctgcaggcgatgaaacgggtggcgcagattgcatgctgctgcgggaagttggatgcgaaggaccggccggccatatcagacattgttgccaacctcgagatggcgtatgagttaatctgcagagacgagcacggttcagttgacgagccatgtttgtggcccttcgtcgaacaagttgacctgccatcggactcgccacactccaggagctcgtcatcggcaggctaccattccgagctggaatctgaggtgttggaggaggggcgttgacaacaatcgttgaaggcgtcctcagaaggtggttctcttaatacactgatgtaggtgcatcataacgcttgttgttgctggcagtttaggaagagcttgggatggacccgccccagtgtattttcagtttgcttcctcaccacccaccctactatgttt

SEQ ID NO: 7039 - DNA, 473 bp, Triticum aestivum
  Clone ID: PAT_TA_7039
attcggcacgaggcccaaaccttatcttcttccttccagcgcaaacatctcgcgatctctggacggcggagagctctctctctctagctcgttgttttatttgcagctgaaggccgatgagaatcaatccccccgcctcccacctcctgccgcccctctgattttttgggcacccgccgatgatgcaaactagaggagccaacctgtgagtggatgcaggcggggcggcgagcgcaagtccgtcagcggcgagggggctgctgctgggctagcgcggcgaccacctgttgccgagcacaccctgctcggacatcatgcggatgcaacattactttcctcctatggcttttgttttttgatttagctggttgcagctttttgatttgtcggttccagcttttttttggttgattgtagcaatttttatcctccagtaagcaacttctgattcgtcggttctaacaaaaaaaaaa

SEQ ID NO: 7040 - DNA, 1465 bp, Triticum aestivum
  Clone ID: PAT_TA_7040
gaggaattcggcacgaggctgcctccgagcgaccgagaccccgttcgtccgcacccccttcctccttcccacccttcctccttcgttcacaaatcttctcttctccgcgccgcgccctccccctcccggcccggcgagaggccacccaagcggctccgcctctcacgctcccgcgcccacaaacccccaggaacctcgtcctcccgaggttcccgcttcggcgcgcttccgagccgccacaatgccgctccggttggatatcaagaggaagctcgcgcagaggtcggagagggtcaagtccgcggatctgcatccgacagagccatggattttgtcgagtctttactcggggagtgtctgcatctggaactaccaaacgcagacaatggtgaaatcatttgaagtcacagagttaccagttcgttcggctaaatttattgcacggaagcaatgggttgttgctggtgccgatgatatgtttatccgcgtgtacaattacaatacaatggataaggtcaaggtatttgaagctcatactgattacatcaggtgtgtggctgttcatccaacccagccttttgtgctgtcatcatccgatgacatgttaattaagctttgggattgggataagggttgggcatgcactcacatatttgaggggcattctcactatgtgatgcaagtcacatttaacccaaaggataccaatacttttgctagtgcttcccttgatcgcacgataaagacccgcgcgtccggttctcctgatcctaacttcacattagatggccactcaaaaggcgtgaactgtgttgattacttcaccggtggtgatcggccatttttaattactggatctgatgatcagactgcaaaggtttgggattaccaaaccaagagctgtgttcaaacactcgaaggacatgcacacaatgtgtccgctgtctgtttccatccagaactacctattataattactggctcagaggatggcacagttcgattgtggcactctacaacctacaggcttgagaacactcttaattatggtcttgagcgagtttgggctttaggatacatgaaggggtcaagaaggattgtgattggatatgatgaagggacaattatgataaaaattggccgtgaagttccggttgctagcatggacaacagtggaaaaatcatatgggcaaaacataacgaaatccaaactgttaatatcaagactgttggtgcaggcaatgagattgcggatggtgagcgattaccgttggctgtgaaggagctgggcagctgtgatctttatccacagaacttaaggcacaatcccaacgggagatttgttgttgtatgtggagatggagaatacataatttatacagcactagcatggagaaatagatcatttgggtctgcacttgaattcgcttggtcatctgatggcgaatacgctgtaagggaaagc

SEQ ID NO: 7041 - DNA, 1019 bp, Triticum aestivum
  Clone ID: PAT_TA_7041
gcatgtgcaagtatgaaccaatttgaactgtgaaactgcgaatggctcattaaatcagttatagtttgtttgatggtacgtgctactcggataaccgtagtaattctagagctaatacgtgcaacaaaccccgacttctgggaggggcgcatttattagataaaaggctgacgcgggctctgctcgctgatccgatgattcatgataactcgacggatcgcacggccttcgtgccggcgacgcatcattcaaatttctgccctatcaactttcgatggtaggataggggcctaccatggtggtgacgggtgacggagaattagggttcgattccggagagggagcctgagaaacggctaccacatccaaggaaggcagcaggcgcgcagccggcccttccctggtggacgacggctactcccacggcacctgctcccggcctcgtcccctcctaccccggcatccatgtctcttggggccgtccccagggcacccaacatcacgttgcgcatcgtcgtcagcgaccgggccgccgctgccgccacggtctcctcctccctggtggtcgcgggcggtccgcccgctcagctgcatattctagatctggaggcaacctggtactggtctagtccgccgtgatgctgccacggtctcctccccggtgctcctagatccaataatatctcaccggaggcaagccggtggtgctcgatctcctcgcctccttcacctcgcaggatcagcagcaaggtttgatctctcccagcacaagaagcttgatgagcaataagcagtagtaatggaggcagatgcaatagcttttctgttgtgtgccgtcaagtagcaaaagttgatgcaatgcgattattttggtccttcataattagttttgcatgagatgtaccgcaaacgatcctcgcttgctatattacacttgataagttatgtatgtgtctctcttctgttgtctttggtccgcgttcgtgctactgggttgggttcttgaggtagctttcaag

SEQ ID NO: 7042 - DNA, 1018 bp, Triticum aestivum
  Clone ID: PAT_TA_7042
aggttcctcggcactacacaaagcggccggcagggatagctagctagccatggcgccagcattgccgtgtaggccaaagctgcggctcctgtgcgtagccttggccttcctcctggccgtcgatgtgggcagggcggacatctacgaggacctcgagatcatatggagcgccgaccatacctactacttcatggacggcgagagcgaggcgctggcgctctcgctggactataaccggggctccgccttcaagtccaaggaaatgtaccatttcgtccgcgtcgacatcgacatcaagctcatcgaaggcaactccgccggcaccgtctgcaccgtctacaccatctcggaagggccgtgggaggttcacgacgagatcgacctggagttcctgggcaactccaccggcgagccttacaccctccacaccaacatcttcgccaacggcgtcggcggccgggagcagcagttcaagctctggttcgaccccagctccgactaccacacctactccatcgtctggaaccccaagcgcatcacgatcgaggtggacggcgtgacggtccggacgttcgacaacaaccgaggaccagggcgtgccgttcccgtcgtaccagcggcagcgcgtgtatgggagcctgtggagcgcggaggactgggcgacgcagggcgggcgcgtcaagacggactggtcgcaggcgcccttcgtctcctactaccgcaactacaacgtcacctggtgccagccgtcgcctggcgtgctgtggtgcggcaccgagcccgccgagtccacgcacttcaacctctcccccaaggcgctggccgacctgcagtgggtgcgcgacaaccactacgtcatctacgactactgcctcgacaggagcgaccggtacaccgacgccaccaggcccaaggagtgctcgctcccgccccgcccgtagtcgctactgtcacacgtcggggcatccgacacggcgcagcgacagcaagcgagcgacgcccgctagtcgttcattcg

SEQ ID NO: 7043 - DNA, 741 bp, Triticum aestivum
  Clone ID: PAT_TA_7043
gctaactaagtatccaagggagtaatagggaagctctaccgggaaattaagaagcagaaccctcacattggacacttcacaaaggatgtggcaaggcggtcctatgacactgatttgatagttgatggctaccaagactacattaccgaagctgtgtggttcaaggaacagtatgacttcaagctgggtaatctgatggagcactacggaataaatagcgaggctgagataataagtggatgcattcttaagatggcaaataattttaccaagaagaacgacgccgatgctatcaggctggcggtgaaatctttgcggaaggaagcaaggtcatggttcagcgagatgggttcagatgagggcggaggtggtcactgaagcctcggacgccaaggcatccgcttggtatcatgttacctatcaccccgagtactggggttgttacaatgaaggatatggccggccacatctcatcagctttccatggtgtgtctatgacaagctgcttctcatcaagcagagaaagaaatttcgaaggaggatgcagcctcatgtgcttgatctccagaatagcatgaggcgaaacacgatattcggttgagtgctaccatcgggctgtggtttgcgttgtatatatatttgaacatgtcgattctcgtgctagaatgttcgtcgaaggaattataattgcaaactatatgatatgtggtgaggatatgtgtctacgaacctggggtcttt

SEQ ID NO: 7044 - DNA, 1701 bp, Triticum aestivum
  Clone ID: PAT_TA_7044
gctggagaggcgtccctccgccgccgccgcgcgccggcgcgactgttggtcgccgtggcggcgctcgtcacttgcactatctggctctggtcctcctccaccgacctcacccttacctcctacaaggcccaggatgttgatgtaaataagttgtggagaactgcaaattcaaatggctggagagcttcttctgcaccacgatcatattggcctcccccaccaactgagtctgagactaatgggtacttgcgtgtccgatgcaatggtggcttgaaccaacaacgtaccgcgatatgtaatgctgttgttgctgcacgaataatgaatgctacactagtgctgccagaattagatacaaactctttctggcgtgacgagagtggtttcataggtatttatgatgttccccacttcatcaagacattaaaatatgatgtccgtattgctacgagcgttccagatatcattacaaacggaaaaactaagaagctgaaagcctaccagatccggccacctcgagatgcaccggtaacttggtacacgacagttgctttagagaagatgaagagttatggggctatctatttaactccattttcacatcgcttggcagaagatataaatgatccagagatccagagacttcgatgccgggtgcattgatatatttacacctcaggaacagaaaattctgatcaagtaccgcaaggaaaattttgcagaaaaagaacttgtctatagggaaagacggctcattggaaagtgccctttaactccagaagaggtaggtcttattcttcgtgcactgggctttgataatacaacacacatttaccttgcttctggagagctctttggtgggaaacgcttcatgaggcccttcaaggatatgttttcgcgcctagaaaaccatagctccgttggacctggaaagctggaagaaaatacccgtggactggcaggttctgcagttgattacatggtctgtctcctatcagacatttttatgcccacatatgatggcccaagcaactttgcaaacaacctcattggtcaccgcctatactatggtttccgtaccaccatcacaccgactaggaaggcccttgctccgatattcatggacagggaagtaggcttgacagctggttttgaggagcgagtgaggcaggtcatgacaaagacatatgttggtggcccccataagcgcattcatcccgaacctttctatacaaactcatggccagagtgcttttgccaggagaaccctaggaatcatgcagacaaatgcccaccagacaatatatacgaggttctggagaatcaatttcggagtgaagagaatgaagaaagtatagaagtgaaagccactagtcagactgtttcaatcagccaaaccgaagagactgtgatttaactgaggaaccaaactgttattgtcttaagaggacgagactggatcatttatgcccgtagcagattattgctttttcgaatggattgactatcgagggtacggtcgggcctaataaactgggatggaggtagtatttcatcacaaaaaaatcacaaaaaattacacatgtagtgtacatccatatgtgcatctagtttttttggaacttcagaataccattttggcactattgaaaatatagtgctcacggagcgggtgcaccaaagtgttcttttgtggctccc

SEQ ID NO: 7045 - DNA, 827 bp, Triticum aestivum
  unsure (1)..(827): unsure at all n locations
  Clone ID: PAT_TA_7045
gggctgcaggnaattcggcgcccgggccgtcgcccgctcgcggccctccatcgcctggtcgcgaaccatggcgccgctggcaatgctgctcgtctccaccctcttcgtctcctccccgagcaagtccacgtccgactacgtccggcgggccatctccagggacgtgtgggcgcggatcttctccgactggctggcgaggcgggacgcggggctgatgatcctggacccctacggcgggagcatcgccagcgtggcggagtcggcgacgcccttctcgcaccgcgccggcgtgctgtacaacgtgcagtacatgaacttctggggcgtgggcggcgacggcgcggcgcacaccaggtggatcagggacatgtacgcgttcatggagccgcacgtgagcaagaacccgagggaggcatacgtgaattacagggaccttgacctcggcgagaacgtcgtcggcgccggcggcgtgacgagcttcgaggccggcagggtgtggggggagaagtactactccaagggcaacttcaggaggctcgccatggccaagggtcagatcgatccccgcgactacttcaggagtgagcagagcatcccgccacttgttggcgagcagctggagctggagctgacctcctcgaggaacgtgccgcacgttcatggcgtgaatgctcctgcttggtggccagtgggactgtgggacagcaggcagtcgtgggttcagtccttagctctgccttatctaggctcatgcctactttctcttagacgtagtagctcattttgttttaccacgtgtatttgttgtcttattatcaatggtgttt

SEQ ID NO: 7046 - DNA, 646 bp, Triticum aestivum
  Clone ID: PAT_TA_7046
gcacgagggagacgcgagacgagagagaccacaccagacgaggcgagcgagacccaggctccgccgagggaggcgaggcgacgcgatgcggcgcgcgaggccgccgccggggccggggctggagggcgaggaggtgaggtaccgcggggtgcggcggcgcccgtcgggccggtacgcggccgagatccgcgacccggcgaagaagaccccgatctggctcggcaccttcgactccgccgaggccgccgcgcgcgcctacgacgccgccgccaggaacctccgcggcgccgccgcgcgcaccaacttccccgcctcccccgccgcggcgccgccgcgcgcggcgccccccgcccccgtcgccgcgccggcggcgatggccgcggcggccacgtctagccacagcagcacgatcgagtcctggagcggcgggaacgtcccgcccaccagcgtcctcttccgcgccgccgcagccgcgatcggcgccccggccgtcgaggaggactgccgcagctactgcggctcctcctcgtccgcggtgtgcgaggacggcgcgtcggggggcgccgccgccgccgcagacgaggccgccgcgccgccgcgcccctcctcgtcctcgctgcccttcgatctgaacctgccggacccc

SEQ ID NO: 7047 - DNA, 1353 bp, Triticum aestivum
  Clone ID: PAT_TA_7047
aagattttagcattgcaagatttgcacagatgatgtggaggctaaatttcttgtggcttgctgttgcatggcccttgacaatgattttatgttgtactatatctgcccaatgcacaccctatttacacttatggtgtccgcatcacttggcctgtttaacaagtataatgagataccatcagttatggctattaagattgctggctgcttcttggctgtcatcttgatatgggaagttcctggggtattcgaaattttgtgggccccctttacgttcctgcttggctataaagatccagagccttctaagtcacacttacccttattgcatgagtggcatttccgatctgggcttgatcggtacatatggattgttggaatgatctatgcttactttcaccctaatgtggaaagatggatggagaagctggaagaatctgagactaaggttaggttgtcgatcaagggtaccattgtgactctttcagtcctggctggctatctgtggtatgaatatatctacaggctggacaaaattacgtacaacaagtaccatccgtacacgtcatggattcctatcactgtatatatttgcctacgcaattgcacccaacagttgaggggcgcttctttggctctttttgcttggcttggcaaggtcactctggagacttatatttcccagatccacatttggctcaggtctagtgtaccaaacgggcagcccaaatggcttctgtctttcataccgggctacccgatgcttaacttcatgctaacgacatcaatctatcttttgctatcataccgggtatttgagatcacaaacgtgctgagggcagccttcattcccagcagagacaacaaccgcctgtaccagaatttcgttgccggggttgccatctccgtatgtctgtattgctgctcactcgttcttctaaaaattccggctgtatagatgaatagttcttatggatgtagaattgccaagtaaatgataccggtggaaggctggctgcttcttccacacgcacaaaagaggtttgcttggcggggatgctcggttccatttgcatctaggggatcccctaaggagctgcccttgggaacttgatcgctgtggagggagacgcaaatttttgatcatttttcttcttgttgtaaaagccaacccattcttctgggagttgtaacagctgtcggccgtgtaactgtcaactttggtgtgcaccttgttgttttgtaacatgtcttagatattcttcttctatacatacaaggaaagcgtttccctcctgtaaaaaagaaatagcgagttgaactgtgacgcaaacaagatgatagactgacaag

SEQ ID NO: 7048 - DNA, 581 bp, Triticum aestivum
  unsure (1)..(581): unsure at all n locations
  Clone ID: PAT_TA_7048
ggccgccgccggngnatactccgccgctgcaggcgaactacgtcttcgggagggcatggccggatctcaacgaaggactctcctacaccgatacgttccgcggcgctgatgcggaaaccaccgccaccttgaccaatttctactctgagaactacaagagctcggcgccattgccagggtggattcataggattcgcaatggacagataacggttgatggccaagttgtcactgatccagatatgattctcagggagggttctaagttggtatatcatcgcctcgcatggaaggagccatttgcaccacatttgcttcaagtgctttatgaagatgacgacatggtagcccttaataagccttccggtttgcaagttctgccaaaaggactcttccagcagcgcactgttctagcacaacttcagtggaaagagtggaagatgcccccatcaagctgctctaagagaaaaaatgtgcagttacatcctgtacctgttcatcgattaggaaggggcacgtcaggtctactgctttgtgccaagacaaagcttgccaaagttcaacttgcatcttattttgca

SEQ ID NO: 7049 - DNA, 876 bp, Triticum aestivum
  Clone ID: PAT_TA_7049
ctcgtgccgaattcggcacgagcctccaaagcagcaggtactccgtaggcgatagcttaccattccttcctccacggagcgatggaagacacgacgccgcccgctgacgagaggccgctggtgctcctggggcagccgctcttcccggagttcgccaccgcgctggccggccgcttccggttcgtcctggtcgcggacgccgacgccgcgaccctggcccaggggagggcgctgctcatcgggctcaacccggtcacggacgaccacctggccgcgctcccggcgctcgggctcgtggcgggcatctccgtgggcgtcaaccacgtcgacctcgccgcctgccggcgccgcgggatcgccgtcaccaacgcaggcgccgccttcgcggtcgacacggccgactacggcgtcgggctcgtcgtcgccgtggctccgccggttggccgccgccgaggcccacgtccgggccggcaggtgggcggccgacggcgactatcctctcaccaccaaggtgagcggcaggcgggtggggatcgtggggctgggcaacatcggctcccgcatcgcgcggcggctcgccgccttcggctgcgccgtgtcctacaactcgaggtcgcccaagccgtcggcggcgtacgagttcgtccccaccgtgcgcgacctcgccgcagccagcgacgtgctggtgctctcctgcgcgctgacggaggagacgaggcacgtggtgaaccgggaggtgatggaggcgctggggaaggacggcgtgctggtgaacgtcggccgcggcggcctcgtggacgagccggagctggtcaggtgcctgcaggagggcgtcatcggcggggccggcctggacgtgttccagagcgagccgga

SEQ ID NO: 7050 - DNA, 766 bp, Triticum aestivum
  unsure (1)..(766): unsure at all n locations
  Clone ID: PAT_TA_7050
tgcaggnaattcggcacgaggctacagtacttgcccgcgcgtcgctcttgccttccttgccctcgccccccaccgttcgagatgtcgagccctaggtaggagtagatggcgagcttcaagggccttgtcggcgaggggagcgcggcgctgccgcacgtcctcgccgtggacgacagctcggtggaccgcgccgtcatctccggcatcctccgcagctccaagttccgcgtgaccgccgtggacagcgggaagagggccctggagcttctgggctccgaggccaatgtgagcatgataatcaccgactactggatgccggagatgacgggctacgagctcctcaagaaggtcaaggggtcatccaagctgagggagatccccgtggtgatcatgtcctcagagaacgtgcctacaaggatcaacaggtgcctggaggagggagccgaggatttcctgctgaagcccgtccagccatccgatgtgtcgcgcctctgcagccgcgtcctccgctgagcgccgagtggtccggttgcaccgtcggacgcccctgcttgcatggcgtgcggattcagtgttttggccttctgggacatggacgcatgggtagcagtagagtggtaggatggctgtgagcctgtgagtgttcatgcatgcatgcagtctgtgttttgcttccgcaagtaggatgtgccctgtttccctctgttatgtagcagtcgacgtatatnccctgtcagtgtnctcgngatcagtattcagtaaaaag

SEQ ID NO: 7051 - DNA, 1106 bp, Triticum aestivum
  unsure (1)..(1106): unsure at all n locations
  Clone ID: PAT_TA_7051
cgccttctgcacgggggaagcatgcctctggatcacttgctccttgtgacagggatgccaactattgtggtaagtcaggattgctaggcgacaacacaatgtgagctgacttaaggagcaccctacatcattgagaagcaactggtgaaccaggacgatctgccggatgaacccgtgcccaacaccccaactctgaaagctgcaacccttcagccacaagccaaagctacgtagcgggttaacaacatccctcaggctgccatcggagaacctccagtcctactgttccactcggggccggttctagcaatgcgccgacccatgcatagcattgtcaccgggctcccccttggcatcaatttctcctattaccagacacctaagcaccatcaacacatgatccgtctgcgtgggggactaattatagtgatgagtcactattgccagccgacaattcgttgtaagctgattccagcggcggcccacatatgagagctgcaactgggcacccacgcggatctgccagatcaacccgtgcccaaagccacaactttgcaagctctaaccctttaccgacaagccaaagctacggagcgggtcagcaacttcactcacggactcccatgggaggggcacccgtcctactgttccaatcaattacggtggtttcaaccctccgaactatcctcaggcaaagtctccgaggtcagccatcaatttcttcaataccgagatacaaccatgccaactaacagtcatatgcggccaaccgatggggagtcaccaaagcgggcagcctgcatggcctccctatggcatgggtgagggagtgccctggggaggatcaggcgtgcatccgtttacgacgggcgggctaccctcgtcccttcccagaaaagattatgggagcatattttagcgtggactcggaggaatgccattcattgccgggataaattatttgtactggcgaaaccggagttgcgatggttctggctattggtttcctttttctttcctgcaatgttgctgcatttgcgttgctccattgggtnccctgattgtcaagacagtctcgaactctatnatatataatagaatcgatc

SEQ ID NO: 7052 - DNA, 2434 bp, Triticum aestivum
  Clone ID: PAT_TA_7052
aattcggcccgagggtacccttccgcttcctccccgcccccaagctccgatcccacccagtgcggctctaaaatctccccggcagtctaccgccgccggctcgccgcacagcgagcttcgcgtcgccgccgacgtctaacccctccgcctatcacgcgcgcgcgtcgcttctacatcaccttgtccctgctgtctctcgacccgcgatctcggagcattggtttctgagcatccagatccgccccttttgggtcggaggtgctcgcagtgatggtgaggacggaggcggcgggcgctgctcttgcggtggccctgttggcttgtatggtgggggctggagctgatggctctgatcacaagtacaaggagggagatcgtgtcccgctctacgcgaacaaggtcggccctttccacaatccaagtgagacataccggtactatgatctacccttttgtgcaccagaacacccaaaggacaaaagagaggctcttggggaggttctaaatggtgatcggttggttgatgcaccatatgagttgaactttaaggaagatacgaactccaagactctctgcaagaaaacattgtccaaggagcaagtcgccaagctccgggatgcagttgccaaggattactacttccagatgtattatgatgacctgcctttatggggattccttggtaaactggacaggaacaaggagcacggcggtggaaagtgccttctgtttaagcacatccactttgacatcatgtacaacaatgaccgtgtcatagaaatcaatgttcagacagatccgaatgtcgctgtggatatcacagaggacaaggaagtgccggtagagttctcttattcagtaacatggaaaaagaccagacattccttttgagaaaagaatggagaagtactccaagtcttcctctatgccgcagcacctagagatccattggttttcgataattaactcatgtgtaacagtgcttcttttgactggctttctggcaacaatcctcatgcgtgtgctcaagaatgatttcatcaaatattcccatgaagacgagtcccttgaagaccaagaagagactggatggaagtatatacatggcgacgtcttccgtttcccgcagcaaaaatctctttttgcagcaatcattggatctggatctcagcttcttgcccttgcaattttcatcttcctcctcgcgattgttggggtcttctatccatacaacaggggagcccttttcactgcccttgtagtcatctatgctcttacgtctggtattgctggctacacatccacttccttctatcttcagctggagggaacaaactgggtgagaaatctgatattgactggctgcttgttctgtgggccacttttcttgacattctccttcttaaacactgttgcgatagcgtacagtgctacagcagctttgccttttggtactatcattgtcattattctcatctgggcacttgtaacctctcctctcctagtgctgggtggtgtagctgggaaaaatagcaatacagaattccaagctccttgccgcacaaccaaatatccaagggaaatccctcagctgccctggtaccgaagcaccattcctcagatggcaatggcagggtttctccctttcagtgctatttacatcgagctgtactacatatttgccagtatctgggggcataagatatacaccatctacagcatcctcttcattgtgttcattatcctaatcatcgtcacagcgtttgtcacagtggcgctcacgtacttccagcttgctgttgaggatcacaagtggtggtggagatctgtcctttgtggaggctccactggtattttcatcttcttctactgcatctactactaccatgcccggtcagacatgtcaggcttcatgcaaacatccttcttcttcggctacatgacctgcgtctgctacggttttttcctcatgctgggaactgttggtttccgtgcatcgctgctatttgtgcgacatatttaccgttccatcaagtgcgagtaatctacaccagagtggtgacatcagacatggcacccgggaagctcaagagaagcaaaccgacagagattgcttctgaattttgtgtccaagcaagttgcatgtcctcaatatgaacctcttctcaaattacattatcgtgcaagttctattacgaatgatgatgtaatgtgtagaacagattagagtcaacactatgatgttacacttgtatctactgtgttatttagtccaatgtgatacattagtttgttcctggatcctgtgtttgcttggttgcttgttagaattgtgcttacctggtggagagcacagtttgtgaaaggtttttttttgcgagtgggggcaaattgggggccatatttttatggaaggcaaaaaaagtcattgtcc

SEQ ID NO: 7053 - DNA, 543 bp, Triticum aestivum
  Clone ID: PAT_TA_7053
aggaattcggcacgagcccaatctcgacctcccacatattattatgtcaaggtgccaaaagttcttcttccccaaactgaaggaatgcgacattgtcaacactttgcagtggatttgtactagtgatggcctagatgtcgatagagatgccttgaagcttattgcttcccggtcagatgggtcactgagggatgcagagatgaccttggatcaattgagtttgcttgggcagagaattacaatgccacttgttcaagaacttgctggcttggtttctgacgataaattggtaaatttgcttgatttggcactatctgctgacactgcaaacacggtgaaagctttgcgtgatattactgaaacaggtgttgaacctttgtccctaatgtctcaagtcgccacaataataactgatatccttgctggcacctacacattcacacaggaaagaattcgaagaaggttcttcaaacgtccaacattatcaaaggaggatatggaaagactgcgccaggccttgaaaacactctctgaagctgaaaa

SEQ ID NO: 7054 - DNA, 1586 bp, Triticum aestivum
  unsure (1)..(1586): unsure at all n locations
  Clone ID: PAT_TA_7054
cggacggggggacttgggatcgcgctccgcggtcagttgctgctccggtcgtgctactgtccgccccgtcggaggacgggcctcctgccccgatttccatggctcaggcacggctggctgaactacctgggcagttcatgacttacatgagaactagagaaattcaagcaattagttaatacaagattacatctggcggcaagtctttagaagatatccttctaacgttctttgttactactatgatttagcgattcagccacatcattgtgcaaaatttaagccttggctgtgaaaagaaggaacaagatggattctgaagatgttgaagacaaaagagatcgatctcatgtgattatagcctggatcaaatatcaatggcatattctccatgctggttgctgcttatctggagatcctagcctggatcaaatatcatttttcatactctccatgctattttgttgcttgccaagtctaccatgcccatgcgggttcagggtggtttgtgtcgaggcaagaactgcaaggtactgcagcttgaagattgttgtttcagaagacccatctaaaattctgatttgtgtatgatctgcatacaggctcaaacaagatgttcaatgtttagttcccgtttttgttctggttatgagttgagattctacaagctccgtttggtcctgtttgtattgtaatatactgtgtgttaatatagtttgtgccgtttattacccttgtggacttaagcatttccaaaaaaaaaaaaaaaaaaaatagcaaaaaaaaaaaatacaaaaaaccaaaagaaatactttattttgttaatagtgacggatggtgtagtgactgattttcaggagactattgatgcaatcataaaggcatccgattttcctttgtccatcattgttgttggagttggtggggctgacttcaaggaaatggagtttctggatccaaataaagggggaagattggaaagctcaacggggagagttgcatcaagggatgtgatacagttcgccccaatgaaagatgtgcatggtaccgggatatccatagttcagtcacttcttgctgaaatacctgggcagttcatgacttacatgagaacaagagaaattcaagcaattagttaatacaagattacatctggcggcaagtctttagaagatatccttcgaatgttctttgttactactataatttagcgattcagccacatcattgtgcaaattttaagccttggttgtgaaaagaagcaacaagatggattctgaagatgttgaagacaaaagagatcgatctcatgtgattatagcctggatcaaatatcaatgggcatattctccatgctggttgctgcttatctggagatcctaacctggatcaaatatcatttttcacactctccatgctattttattgcttgtcaagtctaccatgcccatgcgggttcaaggtggtttgtgtcgaagcaagtaactgccaaggtactgcagcttgaagattgttgttcaagaaacccctcctaaaaatccgaantgtgtatgatcgcatacaaggccaaacaagattcaaggttn

SEQ ID NO: 7055 - DNA, 698 bp, Triticum aestivum
  Clone ID: PAT_TA_7055
tcctcaccttccccgtcccgtttcccccctcctttctctgccgtgcggatcaaggcatccatccatccatccaacgagacctgcgggctgcggccatggagatggaggtgccgtcggcgcaggcggaccgcgacggcgcccggcgacggctccgggactacctgctcgcgctcgaggaggagcgccgcaagatccacgtcttccagcgcgagctccccctctgcctcgacctcgtcacccagacaatcgaggggatgaagagccagatgggcggcgccgccagcgaggagacggtgagcgaccacgacgggcccgtgctcgaggagttcatcccgctcaagcccagcctatccttgtcctcttccgatgacgagactagcacccacgccgcggcgccggtctcaaacgctaaggccgagacgccgccgcccacgccggagaccaagaaggcgatgccggactggctccagtccgcgcaagctttcgacctggagtgagccccagcaatcatcatctcttcgaaaggtgctgccatgcagaccgggtggcgctgaacgccaccaaggaaccgggggggcgtgcctcccccccgtcttggaggggcagcccgagccccagcggccggccgcgtcccccgccgccccgccaacctccgcgttgcccggggacagcggcgacaaagccaccagtgatatccc

SEQ ID NO: 7056 - DNA, 1043 bp, Triticum aestivum
  Clone ID: PAT_TA_7056
ttcggcacgagggcttcctcctaccccgccgcctcattgattttcctcctcttcccctccaccgcccgcccttgccgccgccgcgtaacccaacaacgccggggcaagagaaggagcagctatccaagcttacaagggctcggagagccatgtcgtcgtcgtcggcggcgccgatcggcctgtcgtgggcgccccagctgccatcccttgcggcggccggcggcagcaagaagggctcggcgccgacaccgagcattgacgcgcaggagtccctctggaagcccagcaacgagctcgtggacgggctctacgtgcccccgagggaccccaggaaggtcaacaagatggcgaggaagaacgtcaaggacaccaccggcaagggctggttcgacatgccggcgccgagcatcactcccgagttgaagaaagaccttgagattttgcagctgaggcatgtaatggaccctaaaaggcatttcaagaggtctggtaaatccaaggctcttccgaagtatttccaagttggaacggttattgagcctgcatctgagttctactcaagtaggttgacaaagcatgaacggaagcagaccttggttgatgagctgttatctgaccaaaaactcaagaactacaggatgcgtaaggtaagggaaattcaggtggcccggacacccggaggcaaccagaagtggaagaacaagggcaagcaaacgttcaaaagggccaaggacaggcggaaataggatcaatgtaaaacaaggaagaacagaagaacggagccaaggagaaatgggcgagcacggctataggttgtgcactccactgtaatgtgttgaattcatgtaactgaacgtatggaacttttctccccgcacttagagagatcagatcagtgtttgaggggatgatggtcaaagcattgtagtatctgaacttgagtttggcaggatgcttttgcgcaaaaagaggaactgatcttgtgaatgttcatctactgatctgcaacaaaagagcaggggcaagtgtgtaacatttgcaca

SEQ ID NO: 7057 - DNA, 828 bp, Triticum aestivum
  unsure (1)..(828): unsure at all n locations
  Clone ID: PAT_TA_7057
gctcctcccccccccccggccgctctcccccccgcacccgtccccagctagggtttctcgtcctctcccgcccctcttcccaacgccgccatcttctcctacgccgccgccgggccgtccaagccaccatgtttgagctgaagatggtgaagggaagcaccttacagggtgtcctggaggcgatcctcgacctggtcaatgtggccaacgtcgactgctccagcgagggcttctcgctccaggccctggacaccgaacacgtcgtcgtccccccgctcgtcttcccctccgggccctgcctgtccggccgctgcaccgcagacccctccgccgccatcgcccgcgccggcagggtcgggtgccgccgctcctgccccgttgctgcctgcccccccaggtgtttatgttgaactgcaagtccctcagcgtcatcgacgacgatgttgtcatcaaggtgaatgagaaggtcatcagcttctttacttcaggagaaagaaggtgcatgaacatttcccatgtgctgaacaaaactgacaagcgtgttacccttacacatgcgcgagggccagtttcattggccttgaacctgaggtacatgaagtcctgcgccaggctgtcttctaccccgcggggtctggggaggtccgctccctccaccacgctacctttgatggtcgagtgcataattgcagagaagggctacatcaggtatttcgcggcaccactaaggaagaagaagggcggccgcgaaggacactttcattgaccttgaactggaggtacatgaagtcctgcgccaaggtgtctaagctgnntgatcaagngaag

SEQ ID NO: 7058 - DNA, 757 bp, Triticum aestivum
  Clone ID: PAT_TA_7058
gctggacgccatgggcgccaaccgcgtcccgcctaaccgggagtgcttcaacactgtcatcggcgggctctgcaaggagggagaggtgggcgctgcggtggcgctgttcaagaggatgccggaggtgcccagactcaacgggaaaggtgtgtcgcccaacttcgagacctatatcatgttgatcgaggcgctggtcgaaagcaacgcgtttgtccctgccctggaggtgtgcaaggagtgcctggccaagcaagcgggcccccccgttcaggaggctgtcgggtgctgatccaaggggtgggggagagcaggaaggtgaagcatgccaagggagctgcggcatggcgatgaggaagcccgccaagggtagatgcacaaggaggagtgggagaaggttgaggcggacgccttccagctcggcgctgcgccgagatgaaatgcgtgaacgcttgcgaccgcacgttgtcacctgctagcgggtgttcacctatcgttttcttcttgcacttgaaatctatttcgccgttcgtgtttgctattcatgtgcttgtggccggttgcaccacctgcagttccgccgcttgagctctagcaattccttttcggtttccaggtcacaagatagatcttcttttctcatataaggtatttgcatttcatatctactgggagctttgctgtcgcctcccctgtaggtgggcattattcaacttcagttaccagatgcactttgttccacttgtttatcaaaaaaaaa

SEQ ID NO: 7059 - DNA, 651 bp, Triticum aestivum
  unsure (1)..(651): unsure at all n locations
  Clone ID: PAT_TA_7059
acccacacaaccattggtcagtcttcttcctcatttcctctcctctccattccagtgaatactcaacagatattctcagcttcggaagcgtgcacacaggcagggaagcaagtacaggtgggtgactgctcgcatcgacaccatggcaaacaccacggccaacgctcgcgagatccggcgcttgcaacgtgcggatggacccgcggccatgctggccatcggcacggcaaacccaccaaactgcgtgtcccaggacgagtaccccgagtactacttccgtgtcaccaagagcgagcacctcgcggagaagctgactgacacactcaagataatatgcgcgctaacggggaacgagaggcgtttcatttacaacacggagaaaatgttgagcgccccccccgggttccacgcccccggccgtccgcgcacccagcaaccctcccccccccgtccgccaaactcttgtaatggcgcgacataggcttcgctttgggggacagcaacgtcagtaccactcggcgctcccgtcccgcagcgcggcccatcgtctgctctgggatcctggcctctcatactcgccacggcgcacgtaggtggtcacggtggtcgcctacgcgtggtactgctatatgacgcggggtctngcngtag

SEQ ID NO: 7060 - DNA, 623 bp, Triticum aestivum
  Clone ID: PAT_TA_7060
gatcaggctgtggaggtggattcagcagctaagcttcctgtcatgctcgcactaactagtctatggataaggaaaaactatgctggcagttttatggttaattttatcgactcgctgccggagatgtatcctgtagttgaggaatgggtggaagatgttctgatggatgaagggaacgcaacaatattgactctatttgcttgccttgtaactgtcctgtacttgagagagcgtcagaggcgtcaagtggttgcagacaacccccaacagcctgacggtgcacccaactaatgccaagatgaggggcccctatgcagatgcgattggttgaggtacatatggctgtttattctcagttttagcgtcaagtttttgttgaaaagcgagaagcgatgaaatgaatgctcatactggactggagtcctacaagcgtggaatgctaatggctttcgtaggacaaagcgtgtaaaacggtggccaagcctagacaacatttgtataccaaactgactaggatatgaactgggtcgtagatgtatgatattgagagatgttgttccaggtgaaaattcaccatttctgacgtagacatgtgcctgtaaaagtgttgaagtgtttttaac

SEQ ID NO: 7061 - DNA, 1019 bp, Triticum aestivum
  Clone ID: PAT_TA_7061
gacccgacccgacccgaccccccaccaccagcctcgcctcccccgccgccgccaccaccggcgaccaccggagcccttgaagaaaagcgcgagcgccccgcgaatcgaagcggaggagatggtgggcgcctcgacgtcgtcggtggtgaacgtgtacccgctcgccaactacacgttcggcaccaaggagcccaagatggagaaggacaccgcggtcgccgaccgcctcgcccgcatgaaggtcaactacatgaaagaaggaatgcggacaagtgttgaagcaatcctgctggtgcaagagcacaatcacccccacatactgttattgcaaattgggaacacattttgcaaacttcctgggggacgtttgaagcctggggaaaatgaaattgagggcctgaaaagaaagttgggcggcaaacttgcagtgaactcaccttcctttccacctaactggcagggtggtgagtgtgttgctgtttggtggaggccaaactttgaaaccgtgatgtatccttattgccctccacatataaccaagcccaaggaatgcaagaagcttttcattgttcatctaactgaaagagagtatttcgctgttccaaggaacttgaagctacttgctgttccactgtttgaactctatgacaatgttcagcggtatggacctgtaatttccaccatcccgcacagctgtctaggttccaattcaacatggtgagctcataagggtgatgagatagtgttcccaaggcctctttcggcagcccactccgagcgtctcttcgacatcaaactggctaatcaacttagcatgacttgttttctcagtaaccatgtttccatgaattatgcggcattcgcactattagtctaaaaactagacatgtacctatgtttgttctttcattttgcgattccgttagtacatctcaactgtgttgtatgtgtggtgtattttgtggttgttgttccgtgttctaatttatttgtgtatatgtaccaatgtatgtatttat

SEQ ID NO: 7062 - DNA, 1225 bp, Triticum aestivum
  unsure (1)..(1225): unsure at all n locations
  Clone ID: PAT_TA_7062
ccccccgcgcccaccacctcaccccacccacagcccgccccacctctcctcccccgccgcccccgccggcgaccacccgatcgcgggacgaagcacgaggggcccgccgaaggaaccgcgggagacgaagcggtgggcgctctggccgccccggtggtgaacgtggaccccctcgaccacttcacgtacggcaccaacgacgccaagaaggagaaggacacctccgtcgccgaccgcctccctcgcatgaaagtcaacgacatgcaaagaaggaatgcgaacaagtgttgaagcaatcctattggtgcaagagcacaaccacccccacatactgcttgttgcaaattggaaacacattttgcaaacttcctggatggacggttgaagcctggagaaagtgaaattgagggactgaaaaggaagctgagcagcatgctcacagaaatctcaccttcctttccacctaactggccaggttggtggagtgtgttgcatgaatggtggtatgtcagactttagaaacaatttatgtatccttactgcactccaacttcctaacaaaacctaacggagtgcaagaagtttttcattgtttacactgtactgcaaggtagtatttcgctgttccaaggaacttaaaaccttcttgctgatgcactgtttgaactatataacaatgttcagcggttcaggggcagggatttccaccatcccgcatcagcagtccaggttctagtttgacatggtgagctcagtaatcaagagtggtaatgagatgtgaagattagtccagttagatgtagttcgatcgatcttgggcgctgcaccaaactccatgctgatcaacttaggatgactctttatttagttgtcaatttgcatagcatgaattctcattccgtctggcttttattttacgaggtgtactgttaattgaggtctggtctgtttatatacgtgtgcgataatactttcgttggtatgtggttattgatgtggctatcgaagttgttcttgcgtgttctcattgtcttatgtatgtgtaactatgcttctattgtttatttgtcagatcctcctctagtatcttgtcagactcgctttctattgtccgccgatgaattgggaatgttttgtaaggagctaccccttcaaattacaagcttccttattattttcggcagtgtaccataatcttttaagctaaaaaaaanaaanaaaaaan

SEQ ID NO: 7063 - DNA, 498 bp, Triticum aestivum
  Clone ID: PAT_TA_7063
tttcggtcgagtcgtcgaggcaacaaggtcccaagggggacgccaactccaactccatggctgccgcctccgaggtctctgtggactggaggggcaggccttgcaggcctcaaaggcatggaggcatgaaagctgctgtgtttgtcctagggatccaggcgtttgagatcatggcgattgcggcggtggggaacaacctcatcacctacgtgttcaacgagatgcacttcccgctgtccaagtcggccaacatcgtcaccaacttcatcggcaccatgttcctcctctccctgctcggcggcttcctctccgactcctacctcggcagcttctggaccatgctcatcttcggcttcgtcgagctctccgtaagccaccgtaaaaccagcaaaaaaaaggatcatttcttttgtttttctaccaaaactatcaaaggcacgggaaaaaattcaggcagggaaaggctagtgcgtgcgactttaaagttttaactgactg

SEQ ID NO: 7064 - DNA, 775 bp, Triticum aestivum
  Clone ID: PAT_TA_7064
attcggcacgaggccgattcgaaatactcctcctcctcccctagggttttgctgcccccctccacacccgtgccgccgccgccgtcgccgcccgcgtccccccatggcgctgccgaaccagaacaccgtcgattaccccaagcttcaagctcgtcatcgtcggcgatggcgggactggcaaaaccacttttgtgaagaggcatctcactggagagtttgagaagaaatacgagcccaccattggtgttgaagttcacccattggatttcaccactaactgcggaaagatccgtttctactgctgggacactgctgggcaagagaagtttggtggccttagagatggatactatatccatggtcagtgtgcgattatcatgtttgatgtcacttcaaggctgacctacaagaatgttcctacgtggcacagggacctgtgcagggtttgtgagaacatccccattgtcctgtgcggcaacaaggttgatgtgaagaacagccactgcccgacgacgatgacgatctgatcgagtagagagaggatgatgagtctgtctgtcttatcaatcaatactttgagagccagagactgtgcgagtcggttttaggttgaaggcttgatttggagtagtcaagccggatgtttttcctgtctgccttgccttgtctggtgggctgcaaactgtttgtgtgacattgatctacatgatgttgcttgccaggatttgttgttggccaccttgaggttcatcagtattattagcctgtggctcaa

SEQ ID NO: 7065 - DNA, 492 bp, Triticum aestivum
  Clone ID: PAT_TA_7065
ggctgcccccctccacacccgtgccgccgccgccgtcgccgcccgcgtccccccatggcgctgccgaaccagaacaccgtcgattaccccagcttcaagctcgtcatcgtcggcgatggcgggactggcaaaaccacttttgtgaagaggcatctcactggagagtttgagaagaaatacgagcttgcggctgcagcggcacagccactgcccgacgacgatgacgatctgatcgagtagagagaggatgatgagtctgtctgtcttatcaatcaatactttgagagccagagactgtgcgagtcggttttaggttgaaggcttgatttggagtagtcaagccggatgtttttcctgtctgccttgccttgtctggtgggctgcaaactgtttgtgtgacattgatctacatgatgttgcttgccatggatttgttgttggccaccttgatggttcatcagtattattatgcctgttggctcaaaaaaaaaa

SEQ ID NO: 7066 - DNA, 813 bp, Triticum aestivum
  unsure (1)..(813): unsure at all n locations
  Clone ID: PAT_TA_7066
tagcgtggtcgcggccgaggttccacctagggttttgctgcctccctcccccaccgccgccgtcgccgcccgcgtccaccatggcgctgccgaaccagaacaccgtcgattaccccagcttcaagctcgtcatcgtcggcgatggcgggactggcaaaaccacatttgtgaagaggcatctcactggagagtttgagaagaaatacgaacccaccattggtgttgaagttcacccgttggatttcaccactaactgtggaaagatccgtttctcttgcccagcagtgtcccagcagtagaagtttggtggccttagggatggatactatatccatggtcagtgtgcgattatcatgtttgatgtcacttcaaggctgacctacaagaatgttcctacgtggcacagggacttgtgcagggtttgtgagaacatccccattgtgctgtgtggcaacaaggttgatgtgaagaacaggcaggttaaggccaagcaggtgacattccacaggaagaagaacctccagtactatgaaatctctgccaagagcaactacaactttgagaagcccttcctttaccttgctaggaagctggctggtgatcccaacatccacttcgtcgaagcagtgggccttaagcctccggaagtgaccttcgacttggccatgcaacaacaacacgangctgaacttgcggctgcaacggnacanccactgcctgatgacgatgacgatctgatcgaatanaagaggtcatgatccgtctaacaatcnatacttnganaagcaaagactatcnaatccggtttaggtt

SEQ ID NO: 7067 - DNA, 790 bp, Triticum aestivum
  Clone ID: PAT_TA_7067
tctcgtcccgcactcccaggcgcgcgccgccgccatggggatcatgccccctccaagtccaagcagcgggcagcgccgaggaaacgacgcaatggttctccccaacaccccgcccgtggactaccccaccttcaagctcatcctcgtcggcgacggcggcaccggcaagacgacgttcgtgaagaggcacgtcaccggggagttcgagaagaagtacgaatcgacgatcggcgtggaggtgcggccgctggacttccagacgagccacggcaagatcaggtgatcattggtttcgctgctgccgatgtgccagtcggaggtgccgctgctacatttggcggagctagtgctaccgctccaaagggcaaccttcatcagacactacctcataacagtgcctcaaaatccttcggtggaggtgacccatgtgatggtgattcgctctagcagttctggttccggcagtggtggtgctacactgctactgctcctatgatggctacgcattggtaggctcggctgcctcccttggctgtcgctgtcatcagcctagtctacaaccacttccgatgactcaggagttcctaggccaaagaaattttaagaagctcgaaaccccagtcatcgactcgctttatatgttattgaacttgtaatgcagaatttgcttgaaattttgatgtaatgctgatcttgctgggaattgggtgtatatttacttgttgtacatgtaattcaatgttgggtgtacttgttattcaaatgatgggaatttgaattaaaaaaaaaa

SEQ ID NO: 7068 - DNA, 1055 bp, Triticum aestivum
  unsure (1)..(1055): unsure at all n locations
  Clone ID: PAT_TA_7068
gaaatactccttccccagctagggttttgctgcctccgccgccgcctcccgccagcgtcgtccccccatggcgctgccgaaccagaacaccgtcgattaccccagcttcaagctcgtcatcgtcggcgatggcgggactggcaaaaccacttttgtgaagaggcatctcactggagagtttgagaagaaatatgagcccactattggtgttgaagttcacccattggatttcaccactaactgtggaaagatccgtttctactgctgggacactgctgggcaagagaagtttggtggccttagggatggatactatatccatggtcagtgtgcgataatcatgtttgatgtcacttcaaggctgacatacaagaatgttcctacgtggcacagggacttgtgcagggtgtgtgagaacatccccattgtcctgtgcgggaacaaggttgatgtgaagaacaggcaggttaaggccaagcaggtgacattccacaggaagaagaacctgcagtactatgaaatctctgccaagagcaactacaactttgagaagcccttcctttaccttgcaagggaagctgggttgtgatccccacatatcacttcgtcgaagcagtggcccttaagcctccggaagtgacctttgacttggccatgcagcaacagccacgaggctgagcttgcggctgcagcgggcacagccactgcctgatgacgatgacgatctgatcgagtagagagaggatcatgagtctgtcttatcaatcaatactttgagagccagagactgtgcgagtcggttttaggttgaaggcttgatttggagtagtcaagccggatgtttttcctgtctgccttgccttgtctggtgggctgcaaactgtttgtgtgacattgatctacatcatgttgcttgccatggatttgttgttggccaccttgatggttcatcagtattattatgcctgttggctcaatgtgtggatcatataaaaaaaaaaaaaaaaaactcgagggggggcccggtacccanttcgccctctagtgagtcgtat

SEQ ID NO: 7069 - DNA, 1080 bp, Triticum aestivum
  Clone ID: PAT_TA_7069
cacgcgcgctcgcatcgccgccgaagcccgtcgctctccctctccgaacccctccgccccgccgattcgctccgccccgccccgccgacgccagcgcaggttcctgctccggaggcttcggccgcaatggctctccccaacaccccgcccgtggactaccccagcttcaagctcgtcctcgtcggcgacggcggcaccggcaagacgacgttcgtgaagaggcacgtcaccggggagttcgagaagaagtacgaaccgacgatcggcgtggaggtgcggccgctggacttccagacgagccacggcaagatcaggttctactgctgggacacggccggacaggagaagttcggtggcctccgtgacgggatactacatccatggccagtgtgcaatcatcatgttcgatgtcacctcccgactcacctacaagaacgtccccacctgggcacagagacatctgcagggtgtgcgagaacatcccgatcgtcctgtgcggcaacaaggtggacgtgaagaaccggcaggtgaaagccaagatggtgaccttccacaggaagaagaacctccagtactacgagatctctgccaagagcaactacaacttcgagaagcctttcctctaccttgcaaggaagctctcaggggacatgaccctccggttcgtcgaggagacggccctcctccccgccgacgtgaccgtcgacctcgccgcgcagcaacagattgaggcagagatagcagctgcggcggcaatgcccctcccggatgacgatgatgacaacatcatggactgagctgatcaattggaggctgtgcctagtttagtagcagcatatatagtttcaatcaaactcttataagaagtgagacttctgtatccgtatcagacattcagtaggcatctgatgacgatggtttgtgcgatagttccatgtttttctcagtggtagttgatctgagatttctttgtctgagtgcttgtcaataaccgaacgactgcgaaggttaatcggtttctttaccattctggagtgtggtgttcattagaaaaatctaaagaaaaatccactttttgct

SEQ ID NO: 7070 - DNA, 855 bp, Triticum aestivum
  unsure (1)..(855): unsure at all n locations
  Clone ID: PAT_TA_7070
cgtccgcccacgcgttcgaaatactcctgctccacctagggtttagctgcctccctcccccaccgccgccgtcgccgcccgcgtccaccatggcgctgccgaaccagaacaccgtcgattaccccagcttcaagctcgtcatcgtcggcgatggcgggactggcaaaaccacatttgtgaagaggcatctcactggagagtttgagaagaaatacgaacccaccattggtgttgaagttcacccgttggatttcaccactaactgtggaaagatccgtttctactgctgggacactgctgggcaagagaagtttggtggccttagggatggatactatatccatggtcagtgtgcgattatcatgtttgatgtcacttcaaggctgacctacaagaatgttcctacgtggcaacagggacttgtgcagggtttgtgagaacatccccattgtgctgtgtggcaacaaggttgatgtgaagaacaggcaggttaaggccaagcaggtgacattccacaggaagaagaacctccagtactatgaaatctctgccaagagcaactacaactttgagaagcccttcctttaccttgctaggaagctggctggtgatcccaacatccacttcgtcgaagcagtggcccttaaccctncggaagtgaccttcgacttggccatgcagcaacagcacgaggctgagcttgcggctgcagcggcacagccactggccgatgacgatgaccaactgatcgagtggagagaagatcatgagtctgtcttatcaataattacttggagagccagagactatgccgagtcggtttagggttgaaggcttgtaatggaagtatcaact

SEQ ID NO: 7071 - DNA, 749 bp, Triticum aestivum
  unsure (1)..(749): unsure at all n locations
  Clone ID: PAT_TA_7071
gggggaaaaaaactggtaaaacaggaacacacttcaaaataccagcaggagcaaaatccaaagggctgcagaaatcgctgagctaccactgggggctccacaaccacaacacagcaactacccggaagcagggaatatccacaatctcaatgaagcagatatttagaagccatcaaccatcacatatatagcaagccatcaaacatcacatggttctttcaataagaggtaattgacgatgtcctctgaattatggacgcaacaacattactgaatgcttgaaataggtttgcacttgaccacaacagttactaattgcgagtcacagacagactaaagtgcttcattttgggctggtgaagaacttgttgattcctggcatgatctcgggggtcttgtcctgcacataggctctgaggccgtgctcggcgtagcgcctgccctcctcatggttctcaagcactcccgctgccctccccatcttgttgaccctgacttctgggttgccggtgatgttgcgaaggaggctaaaggcgcagatgccgatggccacgcccgtcgccgcgaacagcgggtacacctcgggcctgacccacttgctggccatcggagtcgcggggaggacgctgcgccggcggcggagggagagagtgagtgagatggagaggaaagtggagacgcgctctctctctctctctctctctctctctctctctctctctntctctctntctntctctctctcnctc

SEQ ID NO: 7072 - DNA, 706 bp, Triticum aestivum
  Clone ID: PAT_TA_7072
gaattgggaccgggccccccctcgagttttttttttttttttttgcagtaatcgcaacacatcaactaaatggaagcatggaatatccacaatttcaatgaaacagatatttagaagccatcaaccatcacatatatagcaagccatcaaacatcacatggttctttcaataagaggcacttgatgatatcctctgaattatggacgcgacaacattactgaatgcttgaaataggtttgcacttgaccacaacagttactaatagcgagccactgacaggctaaagtgcttcatttcgggctggtgaagaacttgttgattcctggcatgatctcgggggtcttgtcctgcacataggctctgaggccatgctcggcgtagcgcctgccctcctcatggttctcaagcactcccgctgccctccccatcttgttgaccctgacttctgggttgccggtgatgttgcggaggaggctgaaggcgcagatgccgatggcgacgcccgtcgccgcgaacagcgggtacacctcgggcctgacccacttgctggccatcggagtcgcggggaggacgctgcgccggcggcggagggggagagtgagtgagagagacgaaagtggagaggcgacggcggttgcgggtgagagggagtgggcggagtgcgtgagccggctttattgtgcgggtgtggttgctcagtcgctc

SEQ ID NO: 7073 - DNA, 728 bp, Triticum aestivum
  Clone ID: PAT_TA_7073
accagcaatagcaatatccaaatgtctgcagtaatcgccgagctaccactgaggtctccacaaccacaacacagcaactaaacggaagcatggaatatccacaatctcaatgaaacagatattttgaagccatcaaccatcacatatatagcaagccatcaaacatcacatggttctttcaataagaggtactttatgatatcctctgaattatggacgcgacaacattactgaatgcttgaaataggtttgcacttgaccacaacagttgctaatagcgagtcacagagagactaaagtgcttcatttcgggctggtgaagaacttgttgattcctggcatgatctcgggggtcttgtcctgcacataggctctgagaccgtgctcggcgtagcgcctgccctcctcatggttctcaagcactcctgctgccctccccatcttgttgaccctgacttctgggttgccggtgatgttgcggaggaggctgaaggcgcagatgccgatggccacgcccgtcgccgcgaacagcgggtacacctcgggcctgacccacttgctggccatcggagtcgcggggaggacgctgcgccggcggcggagggggagagtgagtgagagagacgaaagtggagaggcgacggcggttgcgggtgagagggagtgggcggagtgcgtgagccggctttattgtgcgggtgtggttgctcagtcgctgggacttgctt

SEQ ID NO: 7074 - DNA, 1069 bp, Triticum aestivum
  Clone ID: PAT_TA_7074
cgggtcgacggggacggccacgcccaactccgattcgaaatactccttccccagctagggttttgctgcctccgccgccgcctcccgccagcgtcgtccccccatggcgctgccgaaccagaacaccgtcgattaccccagcttcaagctcgtcatcgtcggcgatggcgggactggcaaaaccacttttgtgaagaggcatctcactggagagtttgagaagaaatatgagcccactattggtgttgaagttcacccattggatttcaccactaactgtggaaagatccgtttctactgctgggacactgctgggcaagagaagtttggtggccttagggatggatactatatccatggtcagtgtgcgataatcatgtttgatgtcacttcaaggctgacatacaagaatgttcctacgtggcacagggacttgtgcagggtgtgtgagaacatccccattgtcctgtgcgggaacaaggttgatgtgaagaacaggcaggttaaggccaagcaggtgacattccacaggaagaagaacctgcagtactatgaaatctctgccaagagcaactacaactttgagaagcccttcctttaccttgcaaggaagctggctggtgatcccaacattcacttcgtcgaagctgtggcccttaagcccccggaagtgaccttcgacctggccatgcagcaacagcacgaggctgagcttgcggctgcagcggcacagccactgcctgatgacgatgacgatctgatcgagtagagagaggatcatgagtcttgtctgtcttatcaatcaatactttgagagccagagactgtgcgagtcggttttaggttgaaggcttgatttggagtagtcaagccggatgtttttcctgtctgccttgccttgtctggtgggctgcaaactgtttgtgtgacattgatctacatcatgttgcttgccatggatttgttgttggccaccttgatggttcatcagtattattatgcctgttggctcaatgtgtggatcatatatttatcttgaacaaaaaaaaaaaaaaaaaaaaaaaaaaaa

SEQ ID NO: 7075 - DNA, 1057 bp, Triticum aestivum
  Clone ID: PAT_TA_7075
gccggccgggccgggaactccgattcgaatactcctcctccacctagggttttgctgcctccctcccccaccgccgccgtcgccgcccgcgtccaccatggcgctgccgaaccagaacaccgtcgattaccccagcttcaagctcgtcatcgtcggcgatggcgggactggcaaaaccacatttgtgaagaggcatctcactggagagtttgagaagaaatacgaacccaccattggtgttgaagttcacccgttggatttcaccactaactgtggaaagatccgtttctactgctgggacactgctgggcaagagaagtttggtggccttagggatggatactatatccatggtcagtgtgcgattatcatgtttgatgtcacttcaaggctgacctacaagaatgttcctacgtggcacagggacttgtgcagggtttgtgagaacatccccattgtgctgtgtggcaacaaggttgatgtgaagaacaggcaggttaaggccaagcaggtgacattccacaggaagaagaacctccagtactatgaaatctctgccaagagcaactacaactttgagaagcccttcctttaccttgctaggaagctggctggtgatcccaacatccacttcgtcgaagcagtggcccttaagcctccggaagtgaccttcgacttggccatgcagcaacagcacgaggctgagcttgcggctgcagcggcacagccactgcctgatgacgatgacgatctgatcgagtagagagaggatcatgagtctgtcttatcaatcaatactttgagagccagagactatgcgagtcggttttaggttgaaggcttgatatggagtagtcaagccggatgtttttcctgtctgccttgccttgtctggtgggctgcaaactgtttgtgtgacattgatctacatcatgttgcttgccatggatttgttgttcgccaccttgatggttcatcagtattattatgcctgttggctcaatgtgtggatcatatatttatcttgagcatctgtgtgcttgctaaaaaaaaaaaa

SEQ ID NO: 7076 - DNA, 1448 bp, Triticum aestivum
  Clone ID: PAT_TA_7076
gaattcactagtgattagcgtggtcgcggccgaggtctcgagttttttttttttttttttttagccatcaaccatcacatatatagcaagccatcaaacatcacatggttctttcaataagaggtactttatgatatcctctgaattatggacgcgacaacattactgaatgcttgaaataggtttgcacttgaccacaacagttgctaatagcgagtcactgacaggctaaagtgcttcatttcgggctggtgaagaacttgttgattcctggcatgatctcgggggtcttgtcctgcacataggctctgaggccatgctcggcgtagcgcctgccctcctcatggttctcaagcactcccctgcccccctccacacccgtgccgccgccgccgtcgccgcccgcgtccccccatggcgctgccgaaccagaacaccgtcgattaccccagcttcaagctcgtcatcgtcggcgatggcgggactggcaaaaccacttttgtgaagaggcatctcactggagagtttgagaagaaatacgagcccaccattggtgttgaagttcacccattggatttcaccactaactgcggaaagatccgtttctactgctgggacactgctgggcaagagaagtttggtggccttagagatggatactatatccatggtcagtgtgcgattatcatgtttgatgtcacttcaaggctgacctacaagaatgttcctacgtggcacagggacctgtgcagggtttgtgagaacatccccattgtcctgtgcggcaacaaggttgatgtgaagaacaggcaggttaaggccaagcaggtgacattccacaggaagaagaacctgcagtactatgagatctctgccaagagcaactacaactttgagaagcccttcctttaccttgcaaggaagctggctggtgatcccaacatccacttcgttgaagcagtggcccttaagcccccggaagtgaccttcgacctggccatgcagcaacagcacgaggctgagcttgcggctgcagcggcacagccactgcccgacgacgatgacgatctgatcgagtagagagaggatgatgagtctgtctgtcttatcaatcaatactttgagagccagagactgtgcgagtcggttttaggttgaaggcttgatttggagtagtcaagccggatgtttttcctgtctgccttgccttgtctggtgggctgcaaactgtttgtgtgacattgatctacatgatgttgcttgccatggatttgttgttggccaccttgatggttcatcagtattattatgcctgttggctcaaatgtgtggatcatatatttatcttgagcatctgtgtgcttgctatgcgtttggggctaaataggttcgctgctggacatttcaatgaaagcagcaaaagggatttatttctctttttttgagct

SEQ ID NO: 7077 - DNA, 610 bp, Triticum aestivum
  Clone ID: PAT_TA_7077
attggataaactcttgatgatcttaagggcattagtcccactctatgtaagcacaagatcaaattggagaaatatgctaaaccggttgttgatcaccaacgacggttaaatcctaagatgaaagaagtggtaagaaaagaaatactaaagcttccggaggcaggtataatttatcccgttgatgatagtcagtgggtaagtcctgtccattgtgtccctaagaagggaggtattactgttgttcctaatgataaagatgaattgatcccacaaagaattattaccggttatagaatggtaattgatttccgcaaattaaataaagctactaaaaagaacattaccctttaccttttattgatcaaatgctagaaagattatccaaacatacacatttttgctttctagatggttattctggtttctctcaaatacctgtgtcagctgaggatcaagaaaagaccacttttacttgcccttttggtacttttgcttatagacatatgccttctggtttatgtaatgcacctgctaccaacaaagatgcatgatcgctatattctctgacttctgtgaaaagatttgtgaggtattcatggatgatttctcc

SEQ ID NO: 7078 - DNA, 1586 bp, Triticum aestivum
  Clone ID: PAT_TA_7078
cctggcctgctcaatcctcgagatattgcagaaacgacctctccattttgtcgcggcggcgacggcgagggcgacaacgcagatctcctctcgtcctaaggctccggcgatctctctggctgtgtgagcgggagagatggagctgtggagcaagctgaggagcctcgacgcctaccccaaggtgaacgaggacttctacagccgcaccctctccggcggactcatcaccatcgtctcctccctcgctatcctcctcctcttcttctcagagatccggttgtatctatatgctgctacagagagtaagctcacagttgatacctcaagaggggaaaggttacatatcaattttgatgttacattccccgctcttccctgttctcttgttgctattgatactatggatgtcagtggagagcaacattatgatataagacatgacataatgaagaaaagaattgatcatcttggtaatgtaattgaatcgagaaaagatggagttggttcccctaagattgaaagaccattgcagaatcatggtggaaggcttgaccacaatgaggtttactgtgggtcttgttatggttccgaagagtcagatgaccagtgttgtaactcctgtgaagaagttcgtgattcctatcggaagaaaggttgggcactcactaacgtagaatcaattgatcagtgcaagagagagggcttcgttcaaaggttaaaagatgaacaaggcgaaggttgcaacattcatgggtttgtagatgtcaataaagttgctggaaattttcactttgccccaggaaaaagcttggaccatgcattcaacttccttcaagatatgttgaacttccagccagaaaattacaatataagccacaagataaacaaactgtcctttgggaaagagtttcctggtgttgtcaatcctcttgatggtgtagagtggaaacaggagcagacaactggattaacagggatgtaccagtattttgtgaaggttgttcctactatctatacagatattagggggcgaaagattcactcaaatcagttttctgtgacggagcacttcagagaagcaattggcctcccgaggcccccgcccggtgtatatttcttctacgaattttcaccaattcaggttgattttactgaagagaacacatcgcttcttcacttcctgacaaacatatgtgccattgttggaggcatattcaccgtggcaggcatcatagattcttttgtgtaccatggtcatcgtgcgatcaagaagaagatggagatcggaaagctggggtaaatccaagttgagcagcatctaggcaggcaggcagccagtaggacggtagccagaagctgagctgccctggaaaggcgagcagagagctcaggaggaattttggtcaatattatattattgtaatacagttcctagttggtcgacttttgctaattatttgatcccagaacatagaggtttcttgtttctttcttgtgtaagcagtcggatcgcagtgtttgtgttataggtcatcaaagtcttgtgtaacaacattttacatactcaaaaccctcaactcaacgtg

SEQ ID NO: 7079 - DNA, 1079 bp, Triticum aestivum
  Clone ID: PAT_TA_7079
cgcgccgcgccaccctgccattcgcagcgcctgcttggcgacgcggcagttgctgacccgggccctccggatgaggcggcgaggataaatgttcggagaactaaagattgctatgaagtctatgcattggttcctggccttcttcgtgaagaggtacatgttcagtcagatcctgctggccgcttgatagttacgggagagcctgagcaactagataatccttggggtgttactccattcaagaaggtcattagtttgccctcccgcatcgatcctcaccaaacctcagcagttgtcactctccatgggcaattatttgttcgtgcaccgtttgagcagtcaaaatcatgacactctacttgactaagcagaataatacatgttgccttgctggtgggatcgtaggatggttgcaggttgcccaccctgatctttgttcgtctagttcattgctgcttcaaggctcttcagctggtgctgtatgttctgtgtattggttaacctaactaattagattgcttagtactgtgcattgcctgtgacatttagcgtaagttccatcctccaagcctgtagcctaggttcctgatgctcaaatgttcatgttctattccttcccttttctgtttagccatgaaaggatgactgtttatacagtagaagatttattattcttaagatttgggtttgtcattcatccgaacttagatgcgcataaatttgttcgtatatcatgtaactgcttctaaggtacttcagtggtgctgtatgttctgtgtattgattaattctaactaattagatggcttagtactgtgcattgcctgtgacatttagcgtaagttccaccctccaagcttgtagcctaggttcctgatgctcaaatgttcatggtttattcgttcccttttccgtttagccatcaaaggataatgatttgtagcgttgtagctttattattcctaatacttgagtttgtcatcatacttccggacatagatgcggatgaaattctgggtatgtcatgtaactgttgctgttatacaaaaccattgcattcgcttgactgaaaaaaaaaa

SEQ ID NO: 7080 - DNA, 712 bp, Triticum aestivum
  unsure (1)..(712): unsure at all n locations
  Clone ID: PAT_TA_7080
tgcaggnaattcggcacgaggggcggccgccgccgccgccaccaccaccaccaccgtatcctccctccccgtccagatccagccgccacctcccctccccacctcgccccgtcacccgcacgggatccaggcccaaacccctcgcccctcctctcctctccccattcgaatccggatctagactcacactccacctccgccggagcgcgctcgcggcgacggacaccggcgatggaggagtatctagctgcctacacggcgaaagaagatcccgtaactccggcgcagccgactgttcagacggccagtgcgctgccggcccgggcagcaggcggtcacgcgcaccaggcgccagcagctgctgctgctcctccgaccagttccagagtggttgcgaaatcgaccaacaacagttcggcgaaaacccccgggagctccgcgaacaagagagtgatatacattgtggctggggatgatggctcccatgtgccgatcctgcgcaaagtgcaggtgtatggagaagaggctagtaagggatatgagaagacgccagcacctgcgtgcaacgtcgttaagcaagctcgtctggatgctggcaaacaaccggtgagacgaccaaggatacaactgctcagccacaaccgtgaggaacgatcagcagagctcatggatgacgatgaacaagcggcaatcgcattgtctgttaaactgg

SEQ ID NO: 7081 - DNA, 1103 bp, Triticum aestivum
  unsure (1)..(1103): unsure at all n locations
  Clone ID: PAT_TA_7081
cctgccagtgagctgcgccgccggctgccggcgattgccccaccccctgccgctcgacttccccccacccccaggcccccaagttctccagacagccggcagtccccgcctcccgcctccccgctgctcaggacagccggtgctgctctagcctctaggcctaggcggaccccgccgccgctctacagcctctactccgccctttcctcgacttcccgtctccccgcgcaaccagcagtccgtccgtccaggggacagggcactcgagcacggcgctgccgcccacacactgtcatacgctcatcctcctccgccgccgaagccctccactacaacaccgctctccgctgccgaccacaccctgcaatctcgcacgcctccgacgcttcaaacaacttaactaccggctgcccttttccgcaaccctctccccttccgcctttttatcttcactcttctcttggcctgattccaacaaggaaattctaaaacctaatcaatctgcatcgcttctgatccttcagccatgcatctcactcttgaattcgggggcggtctggagcttctcctagagaaatccaccaaggtacacaaggtggatgtccagcccagggacggtgaagacaaggccactatgaagggattgctctcttgggtgaagtccaatttgatcaaggagcggccagagatgttcatcaaggatgactctgtgaggcctggggttcttgtccttataaatgactgcgactgggagttgtgtggaggccttgatgcagagttggaagataaggacgtggttgtcttcatctccacactgcacggtggttaattttacttctactgtaggctaccgatggtattgcgatctgtggaaaagaaactaaatgcactgtaattttcaatgtcactgtaaccttctccttgtttcactatctaagtgaaggatcaactggttattatggacctactcattactactgtaaccaggatggtcctcaccctttntgatggttttggaacagttcaaggtacctgaagatgtgtaaaaaacaaatcttcatttgattcgtagctaactagcattgcgtgagctaaaagggctg

SEQ ID NO: 7082 - DNA, 836 bp, Triticum aestivum
  Clone ID: PAT_TA_7082
ctgccagctccctccccaacccctggaaacgctctggtccgtcgcgggagaggcggagatggagaacgcggtggtgctccgggagtggttcgaccgcgtcgacgccgccggcaccggcaacatcacggctcctcagctccagagcgcgctcgccgtgggcaacctcgacttccccctctccgtcgtgcagcagatgatcaggatgtacgacttcgatcggaacggcaccatgagcttccaagagtttttggctcttaacaagttccttcagaaggtgcagggtgtcttctccaccctagaaaggggtcgtggatttctcagccttgaggatgtgtatgaggcgttgatcaaactcggtttctctttggattcacctgccttctacactgtctgtgagagcttcgacaagagcaagaaggggatggttcgtttggatgagttcatatcgatctgcatctttgtgcagtcagcccgtaacttgttcagttcatttgacacaaccaagcaagggaaagtgacgttggatttcaaccagttcgtctactgcacggcgaactgcaggatatagccgtattgcctgaaacttgtagtacatggaagaccaaaaaagaaatgccaccctacaccggaaccacatgtgaaagaatgttctggtggcacatacatttggaagtccaaattccaagtcatcatttggtttatattcgtagtgttcatcagatattatgtgattttatttaataccatccagggctgtatacagaaacaagaaaaatcacagggtgcttatgcgtgacgctttggctttggattactgctgctctcccccggggggg

SEQ ID NO: 7083 - DNA, 714 bp, Triticum aestivum
  unsure (1)..(714): unsure at all n locations
  Clone ID: PAT_TA_7083
cgtcgtcccaaccccgcctctcaccaaaccattcctccttgatgtcctcgtctcaatctctcatcctccgccgcacctcccccccccccccgcctcctcgtgtcgtcgccgccatcccaccatcctcgcgccccaccaccgctagccgcttccgccacctcccgcgcctcaccgccaatctctgccttccgccacccgcgacctccgcttccggcggattcggagatggcaatttccccggtggggatgggggtggcggaggaggagggggggggtggcaaggcgggagaggagaccctcccgacaagccgggagacgggtggcgacggtggcttcagtccctccaccccgagctcttcctcctgttcttgctcctccagtcggacgccttcgcttccatcccatccgccctcgccgatgccctaggagcaaccggcggcgacggcggtagcgtttgggagatgaggggcagtgcgcgtacgctgctcgtgcccaacccgaacggaacctcatacctcgntgcgggagacgataagcggaagcaagaagaggggatggaaaagacggnggctggccctgctaatttggccgactgnggaggcaactnnaacggncatggnggnggngcactgatgttgctcttnanntgctgntgnctgatggatacccgnacagngtgagcannnactatntgcactactnnntgnggcngng

SEQ ID NO: 7084 - DNA, 1112 bp, Triticum aestivum
  unsure (1)..(1112): unsure at all n locations
  Clone ID: PAT_TA_7084
aattcggcacgaggctcgagcggcgacacgcttcttgcccttccgccgcggcaaggnacgacgacggcgatccgagcgatgcgacggtgcggaggttcgagaggctagcgcgtgtcgccgacgagttcttccggtacgtccagcttgggggccgtccgaagagcttgacggcgtccatggaagttcctgcagagccgctgcttgcagggaagacgctggagttctccctccggagcggcagccgggacgccctcctgctgctccatccgtgcaacagggagatcgttctcttcctctcctgcgacgacagcgcggcgtgggagaggaacgtgaagctctgcgttgtcttccgactgctcgagcacactgacgtcttggacatcgtcatgtcttccttgcagctgctgcctccccagttcggcgccgcctgtgcgacggcaagggagttcgtcagggaggcgcgggcgcaggaaacgagctataccagcgcgtcgtccatgtcgatgcggtgcgtctcgtcggcatggaggtgtcaccgcaactccacggacgggggatgcgcggcgaccgacggtatgccgcggcttgccgtggccgatcgttcgagtcgacgccgtgtacttcgccatgccgcagaacgattcgccggatgcgcctgcggaccagaacaagcttctgaaattggcatgccatatcactccccatcttgtgcccgagacgtactcccggcactaccggcagatcgggacggaaacactacaagagctgtcccccaaggtggcggacgaaggagcttccgcttgtggacggacagctgcgtggtggtgtcctcgcagctcaacgtatttgtcggcggaaccagaggtttcggtgccgccgccgacgctgcagcagttgttcctggtgcaaagcttgaagggggcaatgtagttcttcttggcttctcgcagtagtagcagaagcgatgcaaactttcacttttattaagcaataagggggcaatgtagatcatggctaagtgacatcttgtaatttcctcactttcttgttttcttcttctttttggcttatctcacgnccttggtgtcatactctgctttatgttataaaaa

SEQ ID NO: 7085 - DNA, 633 bp, Triticum aestivum
  Clone ID: PAT_TA_7085
attttgcccggcggagcctcaagtcgtccgacaatgagacatggaataggagccattctgaaggaggagccggaagaagttaggaggtggggacactttccaggaattgatccacatttggggttctcagagttcatggaaaggttctttgagcatggcaagtgctccctgagggtgttcatggtatggaacagccctcagtgggcgtatggtgttcggcaccagcgtgggctcgagagcttgctcctgcagcatcctgatgcctgtgtggtcatgctgtcggagatgctggagctggaggccttccatgagtttgtgaaggaaggacacaaggttgcagttgcagtgccgaatcttgatgaacttttggagggcacaccaacccacatttttgcatcggtgtggtatgaatggcggaaaacagtaaattaccccttgcattacagtgagctagtacgccttgctgctctgtacagatatggtggtatataccttgactctgatattattgtactcaaaccattgaaatccctccgaaattctattggtactgtaaaagaagtttctagaggttccagtttcagtggtgctgtattggcatttgaaaaacagagcccattcttgctcgagtgc

SEQ ID NO: 7086 - DNA, 599 bp, Triticum aestivum
  Clone ID: PAT_TA_7086
ccacgcgtccgggttttcttcactcattgaatctacagctgctaacctcagaagtcctcatgtttcttacctagttgaaggcccgactgcaacatttgacgaatcacaccattcagttatcttacatggcaataatttgaattctgtttcccaactacccatcaacacaaacacaaacaagtgcagtgccaaaattgtatcctgttcagaattcttaccgacaaagaggcatgacctctcctcaataagggagaatgcagatgcaattcagataactgtcctatccaatcaatcattgaacatctcaaaggctggctcccctgcccctatgttaaagtactttccagcaccagcaccagcaccagctagcctgagagtaatcgacctgaagctagatatattatgctacagttctatggatcttcctgtagccgttgctgtatctgagctagttattccgggattagctgatcagctaagcattatgaagaaggctatcgtctcagagctcttaactcaacagcctaagctttgtccgtaccattttattcctcctttgctgcttattcctctaacagctatatacgacacaagatacg

SEQ ID NO: 7087 - DNA, 762 bp, Triticum aestivum
  unsure (1)..(762): unsure at all n locations
  Clone ID: PAT_TA_7087
cccacgcgtccgcggacgcgtgggcggacgcgtgggcggcgagcagggtgagacctccaaggcccccctgagcaggggggtcagtagaggagtgtccatactggacctcatacttcgcgtcattgcggtcatcagcaccctcgcgagcgccattgccatggggactaccaatgagacgcttcctctgttcacgccgttcatccagttcaaggcccgatacagcgatctcccggctctcacgttcttcgtggtggcaaattctgttgtgagcgcctatctcatcctttcgctcccagtgtcaattgcgcacataattaggagcggggctaaatatagcaggctggtcttgatcatttttgacgcggcaatgctagctctggtcaccgcagcgtcatctgcagcaacagctattgtctacttggcacacaagggcaatgtcagggcaaactggcttgctatttgccagcaattggattctttctgcgagcgtatctctggctccctggttggctcgtttggagccatggttttgctgatactgctcatcatactctcagncattgccctggccaggcgctagaccaaattgtccatcatttgctcccttgagtataagtgtgatatggggtggttcttgtacttgcgtgcttaatgtaataatctgtgagcctatattgtgcaccggccttgtggtggggtacttcttctggatcggcttttgacttcttatcgggtggtccgaaataaatatatggttagggt

SEQ ID NO: 7088 - DNA, 1572 bp, Triticum aestivum
  unsure (1)..(1572): unsure at all n locations
  Clone ID: PAT_TA_7088
cggacgcgtgggattaaaactccggaaaacaatttccctctcccaaatcctccggatatagcccccctaccacaccccagcaaactctcacgcgcgcgcgaagcatcggctctgctggatccccccctttgcctgggcatttgatttccccccgaatttcccatcattttgggtttatcggccatctgcggcggcagctcgggatagggctcgcggggatgaggctgcatggggatgtgtcggatgatgaagaggagggtgcggtgatggatccggcactgctgtcgccgtcatcgccgcccgccggtgcggcggcggcggctgcgtcgaggctggtggtgggctacgccctcacgaagaagaaggttaagagcttcctccagcccaagctgctcctgctggcgaggaagaaaggaattagtttcataccaattgatgagactcgtcctctctccgaacaaggcccatttgatatcatcttgcacaagaaaactagcaaggagtggcagcggtttctggaggattatcatgaagtgcatccagnaagtcactgtcctcgacccacccaatgccattgagcatctgaacaatcgacaatcgatgcttgaagaagtagcagatttgaacctgtccagtttctatgaagaagtttgcactccacgccaactggtcattatgaaagatccgtcctctataccaactgcagttgccatggctgggctaaccttgccattggttgccaagccattggttgttgatggaacatctaaatctcatgagctatctctggcatacgatgaggcgtccttgccaatgcttgatcctcctctggtactccaggaatttgtgaatcatggtgggatcctctttaaggtgtacatcattggtgaagctatacaggttgtccgcaggttttctcttcctgatgttaatacctatgacttactaaacaatgttggcatctatcgacttccaagagtttcatgcgctgcagcaagtgcagatcatgcagaccttgatcctcgtattgcagagcttcctccgagaccacttctagagaaactaggcagggagcttcgtggtcgtctgggtctaagattgttcaacatagatatgattagagagcttggagcaaatgaccggtactatataattgatatcaactacttcccaggatatgggaaaatgcctggctatgagcacatattcaccgatttcttgcaaagtcttgggcaaaacaaataccaaaggtgcttgagcggaggctgaagcgctggtagccatacttgttcactaatgtgcatatcttggatacataagctggagcccaaggcttgaagtcccaaacttacatgttttgtcagaagtggcgccacatacacagggtcgggagtagggggagagaaagaagaactcgaatggccttgtgcccatcttgtataaatcacggttgttttgatcatagtttggtctcaaatgctttcatcaaacaggatcagcaccatcaacccaccatgtatgatatgatcagttaagctacatacggtggcatcacagtaagcaaattcaaaa

SEQ ID NO: 7089 - DNA, 1156 bp, Triticum aestivum
  unsure (1)..(1156): unsure at all n locations
  Clone ID: PAT_TA_7089
gcaggnaattcggcacgagggtgagctcgtcaggctatggctgcttctctgctggtatatacttctctgttgttcatcttagtagatgttaaaaaaagaatccttaacaattgggtctgcatctgcattaaagagagtcccttcagagttttgattcgttagttcatttcatatcatttaaaaagaattaaccgtgtagaatgtgaggaattgagattagagttcatttttttcctgaaaaaataggacattttttatctcagcatgcttaccatatttacagagaatagacaatgttttaccatgtttcttggttatcaaaataagtgttctccatcgttttcatgaatggcttaaatgatgaaaaacatgttgtactcccttccggtgctatgtgtgtggaagatcatctctgtgcctcacctgtcttgttcttctgctctctaagatactatcttaagcttgtatagcttgtcagaccaaataaaaaacgtactaatctgaagttcaaagatgataaaaaaagaagatgtggggatctaggatctagtggtttccagtaaggtaagttgaagcaaaaattctgctttgatttcaaagttgtgaagtatcagactagaacatttgttatctcataatgcatagttgcatacagtaagttacaacacgcctctgaacattactttctcagccgcagccatgggcctttgccctgatgtacagactcggatgacctcccggcactgtacctccggcctgcgacctccccttctaccacgtctccaccgcccaccaccgctgctacctcccggtcatatgaaacgggggtgccgcagtctaaattgtgccacaccagcaggacggctcgtccaggttgtgccattcgcccttcttccagcagtagttagcatggctagcaaggtaatgctagcacaactcatcttccactatcatggcgagatgtctgtgcgtgtgcacacatcttaatcaaatcttactctgtgatttatatggcgccactacataatcagttgagattagatgtaacattatttgtggaaaatggcagcggatggataggctcattgtgtgtgtctctggatgtatcactgggagtgtaatatattacagtccaaatgttnattttcagcaggcc

SEQ ID NO: 7090 - DNA, 147 bp, Triticum aestivum
  Clone ID: PAT_TA_7090
tcggcacgagggatttgttccatatagacatcacattgattattttcacccaatctattggaattggctcgagaaactgaatctactcgccatcatgggttcatagaaaggctagaactgctgatttgatttgtactaaaaaaaaaa

SEQ ID NO: 7091 - DNA, 735 bp, Triticum aestivum
  unsure (1)..(735): unsure at all n locations
  Clone ID: PAT_TA_7091
tgggttntcttgtgttgcataaagatcaaccaataatgatgttcatcaattatttatttaggccaaatgaataataacaacaaaatggtagtacattgcttgctagtcaatttccaaccgtcccgtgtcaaatagacagccaccgcgaaaaacacatcctcaaaggcagaatattagttatttcctctcttgtatcgcggctttcgccacaaaaacctagtatcgttcttcgcaagcgtcgccgccaacctcgttctttctcatgagcttccctttttaggtttactgaatatcccgaagcttttggccgggccggtatcggcaggcttaccggcaccaccagacagaccgccgtccgccgtcttcttcggctcggatgccgtgcctggctttcggctgctgaatacgcccacgcttctggctgctgtcgaagcagggttccctgctgatggctcggcgttcggattcgattgctggaactgcggccgctggctgctatacggcgggacatggcctcctctctcgtttcccctcgggtcctgctgcgggggtctgctgccttggctgaaccttgggggcggcgggccaggctgttgcagaggtggcctttggttgtcctggggacggcaatacctgtcttcgttgttctcgtttcttctcaggtcttgctgcgggggtcttccttggttgaaccttggcnggtggtgggctcggctgntncaaaggangcctttg

SEQ ID NO: 7092 - DNA, 630 bp, Triticum aestivum
  unsure (1)..(630): unsure at all n locations
  Clone ID: PAT_TA_7092
gcaccctcaaggtcggcccagtgatgacggtaacacatctgaggttgcagatgctacaaccagcagccgtggtatggtaatggcggagaacacgtgcactgaactcccttttggggatcttgaagggctactgatggaaatatcggatgatcaacgggccactaaatcgttccaagaattctcagattccgttccccagctgcagcttcagcatgatgatcatgaggtttggctcaatgccaacatggaggagattagtgttgccgattataccactactagtggcgtcatggacgcttcagaatgtactggcaccgagcttccctatggggatcttgaagggcttttgttgcaattagagaatggccatgaaaatatcgaactagcagatttctccgcaccagttactcatcatgaagttccatcaggttggcgctggagatttccatggatgccacggtgctacattcaactcctgtagatccttcttccngcaagtgcaaagaaaacaagagattcttgattcancgaccaaggggcccaagttaatcaaaattaacaaaagtncttgctnctcanccaacnatgcccaaatngatttggggaaaacaagaattgcacctggnanaa

SEQ ID NO: 7093 - DNA, 350 bp, Triticum aestivum
  Clone ID: PAT_TA_7093
gctcgctcgtccgttcctctctcgcccgcctgctcggttccggtgcgcgagccaccgccggcgcagcgagccagggcggcactggaaggagtacaagatggagctagcaaacacgtttatgagcaaggatccctgtggtggagccgctcgtggcgcagagggcgacggtcttcgcgggcaacgaccagcagtgtgggaggccacaagatagcctctactccgatgcttccacccccgccatgtatcctccgtacgggacgacaaaatcgcccccggcccttgcggcaatatccttgtcaaaatataaaacacatcggtgctgtcgccatgctaagaaaacaaaaaaaaaa

SEQ ID NO: 7094 - DNA, 473 bp, Triticum aestivum
  Clone ID: PAT_TA_7094
gaacacattcgacaataattactaccgcaacctcctggcgggtaaggcggtgctcggttccgacacggagctcctcctcgacagggtgaccaaagatttggttgagaagtttgctaaggaccagggcttgttcttttcacagttcggcaaatccatgtcgaaggtagcacatatttccgtgggagcaaactatggcgagtaccgccgcaactgcttcaggcccaactttataaggaacctcacagacgagggttttgtggccagagattgattattcgatcgatgtatcaaaccatatgttttgtttgattgacattagctttatgcatgcccacatagtctagagccactcggcgggccacttgtatgattgtatcgtctcagatctgcaactattcctgctctctgttgttgggaattgctggtccatatcgtccttcaaaattctccatccttcagctaaaaaaaaaaaa

SEQ ID NO: 7095 - DNA, 704 bp, Triticum aestivum
  Clone ID: PAT_TA_7095
gggcctgcgtcaatctggggcttgtgtttgtcgcggagggccgttgggaggatgctgtaagctgtttcgagaaggctgtcaagtctgacgacttgcttgatgctgccgaatcgaactcggcagcaccccttgcgtgggcttgcaagcaggagggcatccggggctgtgcggtgttgtcctggcttccctcccgccggcgcctccctcgggctggtcctggccgcgcaggccccgtggctggatgctctacgctcttgcggccagcccggcagctctgccggctggctcgatgccgcctccccgccctgggcagcggccctgcccccggcctccgcacttgcgcgcgtgggttgtcggtcgccggtcacccggcaagcgttgcgctggagcttcgtccggggtgggcctggcctggcagtccgcggctcgcgtgcgtcatcttcctgggccccctctccctggccccgcttcgtgactcctcggcggctgccatccgtgcagcggatcagcccccaggctccgcagttgctgtgctggtaggttttctctggccggtcattcggaaagggcagagttcgaagaaattctggagtagaatttgactgtaagtttgtaacaggcatgtgacatgaacatgaacgactgtacctgtaccccggccgcgaccccgctaagttttagctacaaacacaactcgctttcac

SEQ ID NO: 7096 - DNA, 676 bp, Triticum aestivum
  Clone ID: PAT_TA_7096
ccggtccggaatcccgggtcgacccacgcgtccgagaaaggaataggcgaaaaccctaaacctcgccaccggccacggccatggcggccaccaccgctacccccgccttcctccgtgcgaccgagctccgcctccttcgctgcaccctcccctccccgatctcccaaccagctcccccctcacctcccccagctcacccgctcggtcctgtcgcggcctccgccctcgccgccgtcgaggccggggactacgcggctgctatcgcctccgccgtcccccacatcttccactcctccgcctttgccgaggttgcccatggctccccagcgcaagtgtacgccgacctcactgccgctgccgaggcgttcctccggggggatggcggaggggccgcgggcgaggggttccagtgcaggtgcgcgcttgttctctccgcggcggtggccgcgctgctcgcattcacgcagcagaacgtgacgggaccgtcggggaagtgttcacccttccctttccagtcttcgcctttggatgaaggggggcatagtgatcctggaagcgaatgggttgattgggcttcggatcagttagcttcttttggttcccatgttcatgggaaattcgccctcttgcccttcattgtctttgcagaactactcttcacaagcataaagggtct

SEQ ID NO: 7097 - DNA, 649 bp, Triticum aestivum
  unsure (1)..(649): unsure at all n locations
  Clone ID: PAT_TA_7097
gcttaagcttggcctcaaatttgttgactggcacattgcctgcttccctgtcgggacaagnatcgccattgacttccgtttactgccaaggttaaacattctggatgcagggcaccaatagcattgagtggtcctatacctcgagatctcatgtggggcactaagttgaggacactgaaccttggaaggaacctgcttgatggggagataccagagagctttaagcatttgcgatccctattattcctctcgcttgctggtaatgacttaacggacttgtcatcggcattacgagtcttgcagcacctgcccaaactgacaacgttggtgcttacccggagcttccgtggtggtcagacaatgccaatggacagcatcagtgggttcaagagcttgcaggtgcttgttcttgcaaactgtgcactctcaggcatgatccagccttggctgcagaactcaaaaaacctgagagtgctggacatttcgtggaacaaattgagtggaccgatcccaccatggttaggcaatctgaataatctcttctatatcgatctgtcaagaaactcgtttagtggggagcttcctgagagctttacacagatgaagggtttaatttcgagtgcttattcaagtgagcatgcatcaatag

SEQ ID NO: 7098 - DNA, 981 bp, Triticum aestivum
  unsure (1)..(981): unsure at all n locations
  Clone ID: PAT_TA_7098
gtgtaaattggatgatggccgacataggcagcagggactacggaatggttgactgtttgttcaaggtggtcatcaaggatgacaactacattgcagtcctatcccatggcaacggcaaattttgcaggagggtaaccatcgacgacaagatagattacttccatgcttcttccgacgatggcaatacgaaagaagcaacgttccagattgaagaaccggtccgttctcgagaaatctatgatgtcgagtaccgcgttgggggaaagaagaccagcaccaacaaaaatgtctccaggacccttgtgcttgctaccaacagaacacatgaaacccacaacgcccaaaccaccatcgaactgtatgacagaatagagagtacctgggatgccaagttaacactcgacgtaggtatcaaggccaagttgtcagccggcttgccattcctgatggaaggcgatgttgaaagtcatcttgactttcatggagagtataattggggtgaaaccaagatacaagaaactaagcgctccatagaatactcatatcctgtgcctcccatgactaaggtgacatgcagcatattttcaagagaggacgtcgttgatgttcccttctcgtacatgcagaaggatgttctgctcagtggggaagtagttccccctcgccagttgcatgatggcgtctatcggggtgccaagtccactgatgtcgacatcgacaccagcgaagaaaagatcacataagtaatgcatgcatatggctgccgctatatgcgtactaaataaacaaagtccatcgtctatgttatgatttactttgtactagatacatccattttgacgataagtattttcgaatggaggaagtaataagcaatgaatgcttcgggatcggaggggcatccacggccatgcatggttttctgttagtgcaccacgcacgtactgtatctctttttctgttccnactanaatagacaag

SEQ ID NO: 7099 - DNA, 806 bp, Triticum aestivum
  unsure (1)..(806): unsure at all n locations
  Clone ID: PAT_TA_7099
cggnctgaggaattcggcacgaggatattaatgaccggaaatggaaaggaacaacagagtccacatcagttctaattatgaccgttctcatgaagattgtttggataactcaatgaaacacatgcagttgaagccaaataccgcggagacaacatacacgggtcaacatgctgcaagtgccccactctaccaaatgaataagactggggcaactggcgctccagaccctggaactgaaggaagtcatcctgatcaaacaagtgatcgagtgggaggagctaatggaagcatggactgcatccatccaacacttccggtggatccaaaaattggcagcagctccacagcacagtcctttccccacaactatgcaggctttgcaccaacgatgcaatgccattgcaaccaagatgcctacaggtcttctcttaatatgtcatccaccttctctaacatgctcgtttccacgttgttatcaaaccccacagtacatgcagccgcaaggcttgcagcatcatactggccagcagcagacagcaacattcctgttggtccaaatcaagaagtttttgctgagaatgctcaaggaagacatattggttctcctccaagcatggcttctgtggtagcagctacagttgctgcggcttcggcctggtgggcgacacaaggtcttctccctctttttgctccccccatcccacggtgttanggctcaaaacgcccgggcacnccnaaggatgcagtntngcaggaccnanttnagtgnngntttgacccaaaggaaggagggnncccnccntaat

SEQ ID NO: 7100 - DNA, 175 bp, Triticum aestivum
  Clone ID: PAT_TA_7100
gcacatctgtgttggatcgcttctgaagcggctccgtcgatcggagcgtgtccgtgtacattttcagggtttctcgtcagggtctgttagtgagagtgagactgcctttttttctttctttctcttgatacgtttgcacctgattaagatgcatgaaagaagttcaaaaaaaaaa

SEQ ID NO: 7101 - DNA, 856 bp, Triticum aestivum
  Clone ID: PAT_TA_7101
ctcattccccaatccctttccccaatctcttagtttcaatctcatcccaccgcaactactgcttgccaccatggccacccatgccacggcaatctttcccggcgagctgcccgaccactcattccccaatcccttccccaatctctctaatttcaatctcatcccaccgcaaccattgcttgccaccatacccaaccatgccacgtgcaatcttccccggcgagttgtcctgcggcagtgctcacgcagctctccctcatccatggaaagcgagaggggcggtgtggtggggcctgcatggagagcgccgacggtcatgggcacagctggaacagccatgcgcggtgaccggactacagtccatcgacactacaaaagcagaagccgccggtgatggacatgacacactccgatgctgcaaccggtcggctttttgctggaaccatgccgtcgaaaagctagaaccattccggcgaaaagctgcaagcagcgttgccggcgatggagatgacaggcttcagtgctgcaaccggccggccaaaagctggaactatgtcggccaaaagctggaaccatggcggcaaaaagtttcaagcagtgttgctggtgatgaagatgagggctccggtgctacaactggttggcattttttgctggaaccatgccggcgaaaagctagaaccacgccgacaaaaagttgcaaccagcattgccggtgatggagatgttgggctaccatgttttttgtttgatgaaaccagtgtatcaaacttttgttaccagggccttcgatttttgttaccaccatcttcgaattttgttaaaaaaaaaaaaaaaaaaaaaaaaaaaaaaaaaa

SEQ ID NO: 7102 - DNA, 652 bp, Triticum aestivum
  Clone ID: PAT_TA_7102
cggacttgtcatccgtgggtgggcgccgcagatgaccatcctgtcgcacccggcggtgggcggctttctgacgcactgcgggtggaactgcacgttggagtcgctcacccacggcgtgccgctgctgacatggccgcacatcgccgaccagttcttgaacgagacgctggtcgtggacgtgctcggcgccggcgtccgcatcggcgttaaggtgccgaccatgcacgtgttcctgaaccccgagctatatgcgaaacaggtcgtgagagacgacatcaagaaagcgttgagggagctgatggaggagggggcggaaatacgaacgacggcgaagaagctcgcgacggtggcaagggaggcgatggcggagggcgggtcgtcggaccgggatgtggcggatatggttcgccatgtcggggacctagcgcacaggaaggagaagggcgtgcccgagcttgaaaacaaccagaagacagatggtcaagtcaaacattcctctgtaggataattaagacatgtactgctccctccgtctcaaattatttatgaaaaaaagatatatttagacgtattttagttttaaatgatatattcattttatttatttatttattagtatgacaagttatttcatacgacatgaaaaaaaaaa

SEQ ID NO: 7103 - DNA, 1010 bp, Triticum aestivum
  Clone ID: PAT_TA_7103
gtccgcgccgccgcacacccgcctggcgtccgccgccgccgccatggacgccgacacgtcgcgccaggtgcgcccgcgcgtccgcacgaagctgccgcctccgctccgcgcgccgcccaccgccatcgcggtccccgccgagctctcccgcatgggcctctccgagatcgtcaacagcctcctcctctccgccgagccggaccaccaggcgcagcccttcgacttcatcgtggatggcgagctcgtgcggatgccgctccatcagttcctgctcgccaagggcatctcggcggagcgggtgcttgagctcgagtacataaaggccgtggcgccgaggaagcaggagccaccattaccacacgatgactgggttagcgcggttgatgggtccaacccaagcttcatattaacaggttgctatgatggtcttgcaagaatatggaaagatgcagctgaatgtactcaagttttggagggacacagtggtgcaattacttctgccagcttcatcaataaaggagttgaaactgatggcagtttgcatgttgtgactggctcaaaggataggtcattgcgcctgttcaagtttgatacttcagtcaccatcggctcctcgaagcgaattggagcttacaaaattcttcctggtcatacatcatctattcccacgcgtccggttgacccttccagaaatatgatatgttctgcttcctgggataccactatgaagctatgggcagtcgaaggatctgaagaagatggcgacaccgtctctgtgaaaaagagaaggatgaactctgatgaatctggacctgaagagtctcagttagagggttcagcatcttcaacacttctgggacatacacaatgtgtttcttctgttgcttggcctgagcagcgaacaatatattcggcatcttgggatcattctattcggcagtgggatgctcaaacagggagagaaacatggaatatgttttgtgggaaggccttgaattgtttggactgtg

SEQ ID NO: 7104 - DNA, 1179 bp, Triticum aestivum
  unsure (1)..(1179): unsure at all n locations
  Clone ID: PAT_TA_7104
gaaaacagcaaattatgatcggcctatccaaccacccaagaagcggcctggaatgtcgaggagaaaatcggtctattcttacaattttagtgtgggcacggatacctcagatggtactgaagcacccgattcccagatgggaactttaccagaatctcagtccactcaagacgacatgcctccttcagttcctgaaagaaccaagccaccggtcccttcaagttctagccaatgtgatatacaagatgtctcaacgagagaagattcctttgctaagaaggataaaggcgccactctggattccctaatgtcagcattcaaaaatttggatgcatctaaagaggaaagcctgttgcgagagaagttacagatcaaagaaataaacataggggaagcttgtatccctgacctattcaatgttcctggtgataggcctgtaagaagaactaagcagaagtatctgacgagtgatcgtactccagaaagacctgtatcagggagccaccatgctccaatttcgaaatgggagaaacacatacttggtcgagacattctgaacgataaagcagatctttcagaagacgatgaatctgataattctccagaaactgttgtggataaacaatcgcaggtgcacagttcttacaatgatgttgttttgacgaacggtgaggcctctactgcaagggagaccccaacttcaatcataaaatttccagaccatgttcttgaaccagtaagttctccacttggtgcgtgcatagatagtgacgttgccaaagaaaaggatgcatctagcgggcaaaatgtttcattagaggaagagcacatgccagtgaattcacccatttaccgagaggccaaataatgaaccagaaacttcttctcatcatttggaaggtgaaacaacaaaagtgctgggtagtgcaccaggtaggaatgcgtcagtgttgcatggtgaagatgacaatatcggatatcagggagtgcttggaggggacatgcttgtgcaagatgaaccaatccatccaccggaaatacctccagatgcgcataatcagtctcatattcaggatgaagatgttgagaaacaggcagttgatataagccatgtaactccctcctgagcaaaggtgggtaagncaaattgcagtcccaacaagaggnaaanatnacggc

SEQ ID NO: 7105 - DNA, 1011 bp, Triticum aestivum
  unsure (1)..(1011): unsure at all n locations
  Clone ID: PAT_TA_7105
ggcggcaccgggcaggcgcgacccttgcatctccggccgcgcctccagcacctacaactcgccatcgaggccccgctccaacacgagcatttcccgagtttctgtctctccttgacagctagcacagcagcaagcaatgaagcaaaagattgtcatccagttgagcatatcatgcgacaagagccggtccaaagccctgacgctggccgccagagcagccggggtgacatccatggggataacccggcgacgccagggaccagctgggaggcggtccggcgacggcgtcgaccctgtgtgcctcgtcagctgcctccgaaagaagctcggccacgcccaaatcatcaaggtggaggaagtgaagaagccggaggagaagaagaaggatgagccgaagccggcgccggccctcgcggtgcacccgccgccctactaccacccccccacctactacaaccagcaatgcccgccgccgcaaacggccgtctgcggcaaccgccacagcacctgccggaccttgtaactgccatggttccattctgacgtcacaaaaaccatagctagccctcagaccgctgcacgacacaaaggaaacaacacgagtcgaccacatccatgacaaatgggtggcacattcacgaataaaaatgccggatcctccacaatgaccaaaaatttgatggcagataactatctttgctcaattccaaggcataaaatctgatatttgtgcccgaagccatggagaaggagacgtggagaaagagatttagatgagccggtgattcaggagaggatttctcgggaggggagagagattcaagtagaaggacatccttaccatagttctcactccatgccgatttcgcaataagatttgagaaataaatatgattcagtttccttaagtttgagatggagcctttccctctttccttcaanggaatatggagccnttcccaaccggggaagatgggtgacaaggatagaaccaaattaattaccattagg

SEQ ID NO: 7106 - DNA, 678 bp, Triticum aestivum
  unsure (1)..(678): unsure at all n locations
  Clone ID: PAT_TA_7106
atcccattcatccccacagccagaggagagtacccatggcgagcaccaccaaagcagctagaaaaacagcaggggctgccgccggcggctagcttgctgcatcctccgcccaacccagtcaatgttgaaaacaaagaggacgatggtgcgcatggtgtggggcggcggcgcggaatcccgcggggctgcgtggtagtggccaccggagctgcagatgacgacggtgttggagatgggttgccactcgtcgcacatgctacaatcgggaagctgaggagaggagcagggcaacatcgggctgccggcggcaccgcgtgctgcgtcgcaacatcttcgtcgccaccgccttattcgtcgcagcacctcgccgccgtcgcgttgtgctgcagtgaagcttcgccggctcccatcgggtgcggcgaggttgtaatgaagcgtcgtcgaagctgcagtgaagcgccgcggcggtcgtcggagctccggcgaggttgcaatgaagcgccgtcgaagctgcagtgaagcgccgcgggcggtcgtcgctcgccnaggccaggttgacttgaactcatnaaccctcgngtctcgagctcgcagtttaanaaactgaactcatnacccncgcgtttgaanccgtagtgataanatcgggctgacnccgtagtnataacccgaggttat

SEQ ID NO: 7107 - DNA, 1126 bp, Triticum aestivum
  unsure (1)..(1126): unsure at all n locations
  Clone ID: PAT_TA_7107
gcacaatgatagtcctcctgaagatggcgatgaagcggccgaatcatctattttcccaagagcagagttcataccgggccttggtagcatcaactctttcacacatgatccaaagagggctgagcttatttcaaaattttgggcggagagcacagctgaaagtgatgccagtaaagagcgggacttatatggacttcctgacatccaagaacccaaaacaatgccacgttcaactggaacagttaagcatcacaagggtgtagaagggactgtgctgcgccatgatatcactgcatcaccgggtgttgctagcacaatgaacaaattaagcagcagcccaagccgtaaagcattttcggttcaggataagctctggtcaatctatgcggccggaaacacagtgcctattccatttcttaaggctattgacatttcaccactagctctagtatcggatagcgtagcaggcaatggccctgctggttcaagtacaactgatgccttggaggcagtcagggagcttttcagtggcgatgggcaggcaaagaaagggcgcaaagggcaaaatgaggcccctcttcctcctggtgtgcacgacagattgacgacaagccctacattgatgaacctggcccaggctctcgcttaccataagacgtgctacgaggacatgcctctgcaagattcacaggcgacagaggagcagcagacgatacagaacctttgtgatacgcttcggaccatactgaggttgtagacggatccatgagtgaaggctacaactacatacatctttggaaggattcggcacgcaatggggctgcacggaggcaagggctggctgacattggccttagttttttcatggcgggcattgcgattcggctcagcctggggtcatgtgggatcaaaagcatggtgcagactgcaggtggacgctgatggagcgtatgaccagttttctgaatttatagacgctgggtgggtggaagttggatggaattctttgtgtggcggagatgggaaattttgccttgtgtttatagcctctaggtctttttcagcggtcggtgcatgtacagattgtgtagctaagtttnggttagcaattttgtggcgcaaatgg

SEQ ID NO: 7108 - DNA, 1516 bp, Triticum aestivum
  Clone ID: PAT_TA_7108
ttcggcacgaggctctcccgctgccacggccgccgaccaatagggggaggagatgcccccgaccaagacaagtcgagtagaagaggagcatcaagacgaagaccaagctccctgtgacccgtggacgtactgctgccaaagtgactcggagtcctgcccaacccccgccgcagccgccgcagccgccaacgactccgaggacgacccggaggatttaactgaggagggactgaaagcgagaacgctgtcctggcggtgtccaagtccgtcgtcgccctagccgcgtccatagatggggatcccccgtccaccttggcctgcacgggcacggtggtctctcacgaggactctgcgacctggatcttaacctctgcaactctcatcaggaagcagggaatcaacaccgaggtacatgaagcatccattgccaagattgaggtgctcctgcataacaagaaggttgtcaacgggcagttgctcatgtatgatttgcagtataatgtcgctgttgtttccattgatattcaagccaatctccctgtagtggtgctcagtgacctccctgaatcctacttcttgacacctagtccggtggttgccattgcccggaaatttgagtctcaaagtttgcagatgaaacgcggtaacacatgccgcacagttagcgacttagactgtaatgaacttatgatcagcacttgccaaattgagcaggttttcattggagggcttctgatagatttagaggaaaaaattgttgggatgaatttcatagacgatgaaactactcctttcttgccagttcaggtcgttcggggatgcctgacacactttaaaaaatttcgggaaatcaaacaaccttggcttggaatacggggacgagcccttcacgtgttggaattagccaagctggagaaaatatgccatcgatgccctaagccacattccggtattcttgtggatatgattcctgaagcatcacgtgcaaattgtgagggcgttgaggttggtgatatccttaatcagcttgatggagttgttttacactctccggacgcgtgggctgcgatgctcctagacaaaatggtggttgcgatggatacacggaaaccagtcgtcatcaaggcgttcgtccggagacccagggatggtatgacatttgatgcagacttgaaagtgatggagcgcccccctggtgaatgcgatcttttatttaaaaacaggtggacattgccccagccagagatgtattattgggtccccgcggagacaggtgaatgggttgacgaatcagactaattttcagcagcgggtgtatgtcgttttttctgtataatgtcgcatgatcagaaggcgatagtgatactaatcttccatcgctgtacaatgattcagttgactggggaggcatgtccgccagatcgaagagatgttgttctaagtacctgctgtcttgatcttttgatgtgggtttttttagttctgtgtactcacgcctaacctaacgctatgtaac

SEQ ID NO: 7109 - DNA, 616 bp, Triticum aestivum
  Clone ID: PAT_TA_7109
ggcgagaagctcaacgctatggcgatgcggcgctcgaagcttagcgctatggcgatggcggaggcggcagacgacggatttcagttcctattagatccaaccggcagcggcagtaaatcattactggatggcgaagcaattcaaactttggtgtgcacagccactgaatccagcattggtgatgtgggcgatacagaagagacaatacaagtagatgtcaacagcacttgcaatggagtggccctgtccctggcaaactcagaacattcaacaagcaaagataacccgcaagcacctggctggacaaagaggtatacaagtgtcaatgcgtgtttctatttcgaacatatgccaactttgactggcatgtatgttccctcaaaaaatacaaaagtgtagttaaagtgttgaacatttgtattgtttgtgggagtcaacaatcactttcaaagtgtgattttcggtgggggtcttagtaagggatgagacagtggaaacatttacattggtgttcactggatttatccgcatgatgggcggcaaacatccacagaactgctcacaggtgggcaaaaacaagcatttgtattttcaagttttattatcttgtgtttcc

SEQ ID NO: 7110 - DNA, 948 bp, Triticum aestivum
  unsure (1)..(948): unsure at all n locations
  Clone ID: PAT_TA_7110
attcggcacgaggcctactagnaaacaaacacacgccccgatctctctctctctctctctctcttgcagcagccaagaaaaatggcgccggtgaaggtgttcgggccggcggcgtttgctaacgtggcccgggtgctagtgtgcctggaggaggtcggcgccgactacgaggtcgtcgacatagatttcatggccctggagcacaagagccccgagcacctcaccagaaacccgttcgggcaaatccctgctttccaggatggcgatctgatcctcttcgagtcacgcgcaatttcaaagtacgtgatccacaagtacaagatgaatgaagccaatctgatgagggaaggtaacctgaaaagaagccacaatggtggacatatggaccgaggtcgaggcacacacctacaacccagccctctcgccggtcgtgtatgagtgcctctttaacccgctcttgcaaggcatacccaccaaccaaaaggtggtggatgaaagcctggagaagctgaaaaaggtgctggagatatacgaggagcatttgtccaaacacaagtacttggcgggggatttcattagttttgcggatctcaaccatttcccctacactttctatttcatggcaactcctcacgcagtcctattcgactcatacccacacgtgaaggcgtggtgggagagcctcgtggcaaggccgtcgatcaagaagcttggcgcaagcatggctgcacttacgacatgatttgcagggcagatttcacattatgggatcacatcactgatttgtatggtgttcttattcatggtattggaagtcaataagcttgtatccctagaattgcatgagtgtgtattttttgtgtgcttgcctatgtgttatatgttnggatttatttaaatggnacaatgctttcagattaanannaccaaanaaaaaccgaggggggg

SEQ ID NO: 7111 - DNA, 1241 bp, Triticum aestivum
  unsure (1)..(1241): unsure at all n locations
  Clone ID: PAT_TA_7111
attcggcacgaggcgacaacgccgccgccgccgccgccgcctctgctgcaagaaagaaccagcagcagcaagtcggcgacacgttgcagtcgtgcttgccttgcgagatcaatagtctgctggccaggagaggagaatggaggcggccccaacgccggcggcagcggagacgcagcaccgccacggcggatgcttgtctgccaggacgttcatgccgcccgggccggtggcgcgatgctccggtggctcctctcaggcagccggatctcccgatgaggcgtcatgtggatcaccaagatggatagggaaaagtctctcttgtgtatgcatcaaaaggaaaggggcatatgagcgaatatgcgtgaaccttacaccggtgcaggaacagaggcttcagaggttgaggcaccgcatgaaggtttattttgatcactcaaggcgagatcatcaggaagccttgagagctctttggtatgcaacataccctgatcaagaacttgaaggtttggtctctgaacagtggaaggacatgggctggcaaggaagagatccatcaactgacttcagaggcgcaggattcatatctctagagaatcttctattctttgcaaagacattctctgcatcatttcagaggctactacagaaacaaagcggcaatcaagccacttgggagtacccgtttgcagttgctggtgtaaatatcacattcatgatcatgcagatgttggatctccagtccactaaaccgagaacgttcgtcaaagctgtttttgtccaaatgctttcagaggatgaatgggcatttgatctgctctactgtgttgctttccttgtgatggacaagcagtgggtagagaagaacgcttcttacatggacttcaacgagatactgaagtcaactcgagcgcaggtgcagaaggagcttctgctggaggatgtgatgaggattgaagatatgccatcatacagactgctttgctagcggccatatctgttggaaacgatgaccgagctcatgatgcgtgtgcatagacccctttctttccttgttcagaggatataaagagacacgttttgtaagcgactaatgtcggtttaacagaggcaatgcataatgcgtaagcatcccttctgagctcgagctcaaatgagctcagatgaacaatatcgtgatgcggatgacatatgtaagtttcagcaattttgggagcccggagtataagctcccgcngcgcagg

SEQ ID NO: 7112 - DNA, 809 bp, Triticum aestivum
  Clone ID: PAT_TA_7112
cgcacccgagcgcgagagaatccgaggagaggagcggcgcaaggaggcggcgatggagtcggatcagggcaagctcttcatcggcggcatctcctgggagacgacggaggagaagctgtaggagcacttctccaacttcggcgaggtctcccaggccgccgccatgctccagctccagctccagccccctcgcttcctgccgctccctcgctcccgcctccaacttcggcggcggcggcggcggcgatgccggcggtgctaggacaaagaagatttttgtgggcggactgccctccagtctgacagatgaggagttccggcagcacttccagaccttcggggctgtcaccgatgttgtggtgatgtatgaccagacaacacagcgtccccggggcttcggcttcattacctttgactcggaggatgcggatgaccgtgtgctgcacaaaaccttccacgatcttggagggaagatggtagaggtgaagcgtgctctgccccgagaggcgaatcctggctcgggtggcggcggacgttccatgggaggtgggggttttcatagtaacaatggacccaactccaatgctagcagctatgatggcagaggcgatgctagcagatatgggcaggtgcagcaaggcagtggtggctacccaggttatggtgctggagcttatggcagtgctccaactgggtatggatatgggcacaccaatcctggaactacatatggaaattatgggtctgcagggcatggagctgcttctgctgcgtatgctgggggctatggcaatccagtgctgatgctt

SEQ ID NO: 7113 - DNA, 1926 bp, Triticum aestivum
  Clone ID: PAT_TA_7113
aatcccccaattcccctctctctctcccctcggacgcgtgggccccatcgcccccctcccgcacccgagcacgagagaatccgaggagaggagcggcgcaaggaggcggagatggagtcggatcagggcaagctcttcatcggcggcatctcctgggagacgacggaggagaagctgcaggagcacttctccaacttcggcgaggtctcccaggccgccgtcatgcgcgacaagctcactggccgcccgcggggcttcggcttcgtagtctacgccgaccccgccgccgtcgacgccgccctccacgacccccacacccccgacggccgcacggccgatgtgaatcgggcgctctcccgggggtagcaacaggctaccaaggcggtgaaccctaccgcaggaaggaacgctggaggtggtggcggcggcggcggcggcggcggcgatgccggtggtgctaggacaaagaaaatttttgtgggcggactgccctccaatctgacagatgaggagttccgccagtccgtccggtgaggagttccggcagtacttccagaccttcggtgctgtcactgatgttgtggtgatgtatgaccagacaacacagcgcccccggggcttcggcttcattacctttgactcggaggatgcggttgaccgtgtgctgcacaaaaccttccacgatcttggagggaagatggtagaggtgaagcgtgctctgcctcgagaggccgttcctggcgaggggggcggcggccgttccacggggggcggggctccaatgctagcagctatgatggcagaggcgatgctagcagatatgggcaggcgcagcaaggcagtggtggctacccaggttatggtgctggagcttatggcagtgctccaactgggtatggatatgggcacaccaatcctggaactacatatggaaattatgggtctgcagggtatggagctgttcctgctgcgtatgctggggcttatggcaatccaagtgctgctgcttccggttaccagggtggccctccaggcgctaatagaggaccctggggcagtcaagctccgtctggttatggcactgggggttatgctggcaatgcaggctatggtgcatggaatagctcttctgctggtgggaatgcacccactagtcaggcacctggtgcagctgcaggttatggaaaccagggctatggttatggtggatatggaggagatgcatcatatggtaatcatggagggtatggtgcttatggtggccggggagatggtgctggaaatcctgctactggtgcagcctctgggtatggtgctgctggatatggaagtgggaatggaaactctggatatccaaatgcgtggactgatccttcacaaggcgggggatttggtggtgcagtcaatggagcttctgagggccaatcaaattatggcagtggttatggtggtatgcagcctagggttgctcagtagaagaggctgttataatgttcatggtgtgaaccagtgcatttgggcagcatatgtattattgcggtattctggctttgctctcgtcttcctgaaggccatccattctgccggttaaatcagtatttctcctggttggaatgcttgatcctttcgtggcttaactagaacttaagtcaataagtagctattatgtcgagtagctgtatcttcataatgctttatttatgtttagcttatccttcggtgtgctttgtcatgagtggagtttcaggttgctttatctctagtttaaagctagagtagcttcactgcttatggaccaaattatctagttgtatctctattctacagaatcatatattcgtgtttgactgtagtatcccaatgttcaaacctaaaaaatgtctccatctgagtcttgtccgaaactttaatgctaaaaaaaaaaaa

SEQ ID NO: 7114 - DNA, 687 bp, Triticum aestivum
  Clone ID: PAT_TA_7114
atcatcaccacacatgcgattcagtaaacagattcactgcactgcaccatttgttttgctgccccctgcctctccctccccttcagttcgagtcttctttctccttccctcttctttgattgcttccactgttgctcatcctctccttcttcttcttctcctctccgtatgtccatgtgtctcctgccctgattgactccttgcctccgactccccactcactcttcttggtggcagagcttcttctttctgtgtggtgtcagcttcttccgttcatcggtccgagctttctagattcaacatcgcttctgctcgtctgagtgggaggagtatcgatgctttgcttggcctcccaccaatggtgaatccgagttagtttgccgacttgccgtggaagaaaggaagagaaaccgccggcgaggggcagaaaaagatgcggggtttgagtaggcttggcgtcgggctcacggtggtgtccgcgctcctcctcctcgcgctcgccgcggagctctactacctcctcgtgcacaagcgccgccagcgacgacgcgccgccgccgtctgcgacgcggcctcctcgccctcctcctcctcccgcgagctgctccagctcttctgcttcaagaagccgcccccactcgcctccacctactcgcaggagccgaccgaaaccgtggccgaggtcgt

SEQ ID NO: 7115 - DNA, 286 bp, Triticum aestivum
  unsure (1)..(286): unsure at all n locations
  Clone ID: PAT_TA_7115
gcccctctgcacttcgacatggnaatgtcttgcactggcttgcgggtcggccgttcgcgccgcgttaccaaacacacccgcaaagcctcggtgctcgcatcgttcctatcggaggaggaatggaaggagacaaggaaagagggaggagcaagagcggggatcacagcagggcgcatcctaccccttctctgagcgtagagcaaccggcaatcagattgcgagcaaacctgttcagttcaaccaacacatacacaaaataaacatcgaaataatttcaaaaaaaaaa

SEQ ID NO: 7116 - DNA, 1109 bp, Triticum aestivum
  unsure (1)..(1109): unsure at all n locations
  Clone ID: PAT_TA_7116
cacgacctctttagaaagaccagcgtgccgccgtccgccgtcggcgctgtcgtcgtcaactgcagcggcttctgcccggcgccctcgctcgccgccatcatcgccgaccactaccggatgcgcgccgacgtcaagatcttcaacctctcaggcatgggctgcagcgccggctccatcggcgtcgacgtcgcggccggcctcctacgggcgcacgccttgacgtacgccgtggtggtcagcgccgagatcctcacggtgggatggtactgcggcaaggaccacgggaagctcctcctcaactgcaacttccgcaccggctgctccgccgcgctcctgaccaacagcacggccgtgccggtgaagtaccggctcgtcaacgtgacgcgcacgaacaccacggccaacgaccggagctaccgcgcggggtaccgggaggaggacgacgagggcatcaccggcttcacgctcggccagggcgtcggccgcatggtcagcgagctgctccgcgcgcacctcctcacactcagcctctccatcctgccgtggcgcgagaaggcacgcttcgctgccgcgctgctcctgtcgatgcgccaacgagggcaggacaagctcgccggcagcagctccggcgcctccgcgcccatgccaaacttccgcgcggcgtcggaccacttctgcctgccttcctcggggaagccgatgatactgcggctggggaaggggctggggctgggggagagggagatggaggcggcgttgatgacgttccaccggttcgggaaccagtcggcggcgtcgctgtggtaccagatggcgtacctggaggccaaggcgcgggtccgcaagggcgacacggtgtggcacctcggcatcgggagcgggctcaaggccaacagcctcgtgtgggagcgtgtcgcagtcgccgacgacgtcgccgccggcgggctcgacgcgctgggcccgtggatggagtgcatccaccagtacccccagtgggaggaataaatgtacgagacccaagagcatgcatgctagcttcctcaggcaccgtatgcgtgcatgcatgcgccatgctgccaanttcgaccattccacgagcttccaccata

SEQ ID NO: 7117 - DNA, 1365 bp, Triticum aestivum
  Clone ID: PAT_TA_7117
aggaatgcccccccacggcctattcccccctgaaccaccaccccgccttcccttgtcacgcccctggcaagcttgccctgcccctgcctccctcccttcctcggcaatggaggcgcctccttccccgcggcggctggtggcggtggtgctggcggcggtggcgctgctcgtctcctccccttgcagcgcgctcctctccgccaagggcgtcaacattgaagtgcaagcgctgattgggatcaagaaccagctcaaggacccccacggcgtgctcaagaactgggaccagtactccgtcgacccctgcagcttcaccatgatcacctgctcgtccgacaacttcgtcaccggcctggaggctccaagccagaatctctccggcctgctcgccccaagcataggaaacctgaccagccttgagactattcttctgcagaacaacatcataaccgggccaatcccagccgagattggcaacctggcaagtctcaagacacttgacctctctggcaacaatttctatggtgaaatcccaccgtccgtgggccaccttgagagcctccagtacctgaggctcaacaacaatacactgtctggtccattccctaccgcatcgactaatctgtcgcaccttgttttcctagatttgtcatacaataacctaagtggcccgataccgggatctttggcaagaacatacaacatagttggaaatcctctcatatgcgctgcaaatacggagaaagatggttacgggactgcgccgatgccaatgacctacaacctttcacaaggcactccgccgacgaaagctaaaagccacaagttcgcagttgcatttggtgctgtaactggttgcatgggcttcctctttcttgctgccggattcttgttctggtggagacagcgtcggaaccggcagatacttttcgatgacgaagatcaacacatggataacgttagccttggaaatgtgaggaggttccagttcagggagctgcaggttgcaacagaaaaattcagcagcaagaacatactcggaaaaggcggcttcggacacgtttacaggggccagcttcccgatgggactcttgtggctgtcaaacgactcaaggacggtaatgctgcgggtggtgagtcacagttcaagactgaagttgaaatgatcagcttggcagtgcaccggaacctccttaggattctggggttctgtatgactgccacagagaggttactagtttatccatacatgtcaaatggaagcgtcgcttcgcgcctgaaaggaaagccacctttggactggatcactaggaagaggatagcccttggagcagcaagaggtctactttaccttcatgagcagtg

SEQ ID NO: 7118 - DNA, 844 bp, Triticum aestivum
  unsure (1)..(844): unsure at all n locations
  Clone ID: PAT_TA_7118
gaaaatcncactcccttccgttgcgcttcatcgtggatcttgggcgtctctggtttctgcttccgctagcccggcataaccatccattgatgtgcttcagaccgctctggctgatcagaccgagttgcttcagggttggcagacacgtattgagagcttcctggaacgggctgaggctgctttgagcaggctctcctttttgccggctacgtttccacgcagacaccactccctcatgttggctccacggaggacgaaggggcagatccttatggttgtttctcccctcgtgttcgggacaattcatcattgatgtctacttcgtctgttgtgcatgtcgatgtgggcgagtccatcgctgtgcttgcgactccgggtgctacagctcatgcccgagcttcgggacatatgttcgagccctgcttcgcctctgtccttggagcggttggaagtggactcgtcgacaaccttgtgtgaggggcatgttttgcctctgtcgtgtgagcaactggaggcgccgaagtccattgtgtcgatggttccttgtggtggaggatgatgtgttgggggttcctcgggccgatgatgtcgatgcggccggtttgttggtgcctgcccctagtaggagccccttggttgatgacaactacatcaagaagcacaatgagttctatgattttcttgacaaatgggtggcggatcagtctggacccggcatcacaagtggttgcctccccaaaaagaaacccaatagggagaaagcaaagagaaacaaaagcaagaagggcggtgttattcggaagacgcccacgatttcacgatggagggtgctccgtttttatcg

SEQ ID NO: 7119 - DNA, 646 bp, Triticum aestivum
  unsure (1)..(646): unsure at all n locations
  Clone ID: PAT_TA_7119
ccacgcgtccgccacacactctactagctaccaatgataatgggcgtggggcgtgcaacaagaaggatgcaaggcaggagttccatgtcggtcttgctggtgtcgttgctgctgctggcggcggcggccggtgtttccagccgagccacgtacacgggcagcagcaccgcaggtgccggtgcaagtgtgacgacgacggcgccgccgaagaagcatgttgatgggaagaagcagcaggtgccggcgctggtggtgttcggcgactcgatcgtcgacccgggcaacaacaacgccatcagcaccatcgtcaaggccaacttcgcgccctacggccacgacttcggcgccgaccaccgccccacgggccgcttctgcaacggcaggatccccaccgacttcatcgcctccaggctcggcctcaagcagctcctcccggcgtacctggccccgaacctgacgacgcacgacctgctcaccggcgtcagcttcgcgtcgggcggcacggggtacgacccgctcacggcgcagctcgcctccgtcatctccatgacggaccagctccgcatgttccacgagtacaaggccagggtccgcgccgcggccggcgacgccgcgctctcggagatcctcgcgaagggcgtgtnnn

SEQ ID NO: 7120 - DNA, 696 bp, Triticum aestivum
  Clone ID: PAT_TA_7120
gctggtttttgccgttccattggagtagaagaaagtcgacgagttggatcagttggacgtctttcacagggcgctgaggcgaagattattgatcctggaacaggggatgctctgcctccgggtgtgccaggcgagctttgggtccgaggaccttttgtaatggaaggttaccttggtgacaaggaatccacctctgagattttagattccgaagggtggttgagaaccggggatgtttgtcttatcgacaaagagggattcctcttcgtggttgaccggctgaaagagataattaagtgcaacggctaccaggttgctcctgcagaactggaggatctgcttcaaacacacccaggtatcgacgaagccgcagttgttgggtacccggatgatcaggctggcgagttgccggtagcatttgtcgtaggacgctccggaagcaaagtgcacgaggcgcagatcaaagactttgttgctaaacaggtcgtgcactataagcgaatacaccgtgttttccttgtggattccataccaaaaaatgccgcgggcaagatcttgcggaaggacttggctaagttagcattgcatcagattaacgccaaattataacatgtttggcaggaagaaaaaatagctacaacatgcatgtatggtatgtgaggaacatttaaagtcattcctgcttgataaatagat

SEQ ID NO: 7121 - DNA, 855 bp, Triticum aestivum
  unsure (1)..(855): unsure at all n locations
  Clone ID: PAT_TA_7121
ttcggcacgagggtggaatctcactcgggnagnagttcccgtcgctgaagggcctctccatcgggctctgcgagaccctgtcatccctaccggatggcccgcgagtgtacccgtctctcagagtgctcaaggtctatgactgtcctggtatgaagagactccctgcttgcctgcagcaacgcctaggcagcctcgagggggtaactctagatgcccatcatcaaggacctattctgtcgaagcccaagacatggataaatggcatctgcagaggttagttgagctgccgacatgtgtgtgacaccatcaccgtgtgaagctatcaaacagtggcaggagatgatgatgccccatacatatattttgagttacggtggaactgtttcctcacacacaacctaggtggagtaggactcatgtctggataaagttggagtatttcgcgctttatggcaagaattccgtgacacttggtttagggcatccatcatgtcgtcatctctgttacaagagatatccatttgctgggatgctacatgatttctgttttgctaggagaaatttgtgagaatgtcactggtctcctgtcgaactctggcacgtgcctcctgtgacgacccatggccggggatggccggcctgagctccacctctgcccccctccgatgtgctgtttgtcagtggtttcctccttgatatttggccatgacaagcgtatcattcaattatgttgctcacctatgaaatattggcaaggactttgggcttctagtgtaaggttacagccccacaaaaaaaaatccccttcccagaatcattttttctgaatgcggtaaggttgtcgcaaggcacatt

SEQ ID NO: 7122 - DNA, 1055 bp, Triticum aestivum
  unsure (1)..(1055): unsure at all n locations
  Clone ID: PAT_TA_7122
gcttgtctcaaagnattaagcctgcatgtgcaagtatgaaccaatttgaactgtgaaactgcgaatggctcattaaatcagttatagtttgtttgatggtacgtgctactcggataaccgtagtaattctagagctaatacgtgcaacaaaccccgacttctgggaggggcgcatttattagataaaaggctgacgcgggctctgctcgctgatccgatgattcatgataactcgacggatcgcacggccttcgtgccggcgacgcatcattcaaatttctgccctatcaactttcgatggtaggataggggcctaccatggtggtgacgggtgacggagaattagggttcgattccggagagggagcctgagaaacggctaccacatccaaggaaggcagcaggcgcgcaaattacccaatcctctttttcgcgtacctgttgttcaccatggatgaatctgggctctccggcttggtgtatgacattccaggtgtcatgtggcgtctcagggatcctgacatactaccttgtgttcatgctaaaccactggacgaggcaacaagttgcagctgctggcaaggaggatggggcttccggtatgcctcaagttatgggcctatgctttgctgatagcgtgggcctgcgtctctgctgctcaggtgtctggtttctctccggcttgggctgcaactaccactgcatgcaacggctgtgtatgccggtaatatttctggttttagctactcaaattaatactatattgtgttttctacaccctcggtttttaaatataagacgttttggcagttcaaattgaactaccaaaacatcttatactcaggaacggagataataatttgtactatatgtaatgttgtagcgtgtttgtgaaaatacgcggtgctgtgagtcttgcgtgcacatgcatcagtgtgctagttagttgtaaagaaacccaaacaatttggagctaactagcaagctagtgtattgtactactagtgttgcacgtgtgcatgctactgtgcagcacccagagtgtacaggttccg

SEQ ID NO: 7123 - DNA, 557 bp, Triticum aestivum
  Clone ID: PAT_TA_7123
ttgcatccgtctagctcccaccttgtctctggcgttttcctgtctccctccccatagcccttgtgccgcacccctttcaactctcttgcaattttaccccactcttcccatatcttgaatcctcacctgtcctgcaatttgactccagatgcccacctggtccgtaaatgttttgagcggtgcggcggcgcgggaccgtggctgcgcatcccgcataccttgcatgtggcctcctcgtcccggctccgtcggacctgatgtcccgcctcccgtcccacgagctgccttgggtagggctctcctgcctcaggtggcatctacaggtgtcctgcgttgcgcctgcagttgtccggcggtcctgtctgtgatggggtggttgtactagaaatccttagaggttagtaatatcgatcggtgtgttgtagatgcatctgttgccgctctcagcgtcgtcttacagcacctccttgtttgaaaaaacgtgaggcgccagttcagataaaaaaaaaaaaaaaaaaaacgctttgggtaatgttcaactgtttcaggaaacatgt

SEQ ID NO: 7124 - DNA, 767 bp, Triticum aestivum
  Clone ID: PAT_TA_7124
attcggcacgaggctggagctcgccggtacgccgttcctgtgggctctgaggaaggtcggcgaccaagacgttcttcctccgggcttcgaggagcgcatcaagggccgcggcctcgtggcgatggggatggttccgcagaccagggtgctagcgcacggctcccgtgggcgcgttcctcacgcacagcgggccgggctccgccatcgaggggatccagtatgggcatcccctcgtcatgctgcccttcttcggagaccaacagacgggggctcagttcatggagaggaagaaggtcggtctgctggtgccgaggaacggggaggatggactgtcttttgaccggcaaggcgtcgcgtccacggtccgggccgtcgtggtggacgagcaagcaggacgcgtcttcgccgccaatgccaagaagtggcagcaggttgtcgcggacactgcctgccatgagaggtacatcgatgagttcgttcagcaactccgattctacaaggaccagtgaagtgactccatggctaatggaggcgacaatgcatgactcgtgcgtacgtgcatcaccctccgtcgagtcggagattcgttccacgttttatggtttcggcaaagtttggcttcttccgtaatgttgctgttagcacggtgtgtcatgtgtgcgtgttcatgctcaccgtgcacgttctcttgagtacgtctttcgagttatgctgtgaaaataaactcatgtgaaaatcggtcctaccccaagttaataagccaacaa

SEQ ID NO: 7125 - DNA, 493 bp, Triticum aestivum
  Clone ID: PAT_TA_7125
ggcagccgtggagctcgcccgtcacggcgtccgcgtcaactgcatttcgccacacgccatcgccacacctatggtggtgcagcagttctcgcagatgctccagggcgccgacgaggccacggtgacggcaatcatccggagcctcggcgagctcaagggcgctgcgtgcgaggccgtggacgtggccagggctgccgtctacctcgcctccgacgacggcaagtacgtgtccggacacaacctggtggtggacggtgggttcaccacctacaagtatatgaacgtgccgttccccaagccgcaggacagcgagtaattattactggtcagttacaaagggttggtttggctttgtgctcatgtggatgtggttctgtacaaaactgcacctaattattcaaaggggagaggagagtgagggcttttgttctttggtgtagaggtgttggtggtttttgtggtttcaactgtggagtgacgattaaaaaaaaaa

SEQ ID NO: 7126 - DNA, 347 bp, Triticum aestivum
  unsure (1)..(347): unsure at all n locations
  Clone ID: PAT_TA_7126
ttcggcacgaggacgagnaagaagccttcgccggagacggagacgggcgggggcgacgacggtgagcggaggatgatggatccgtcgaaagatggcgatttctccgtgtttttctgaggtttttttttagattttagcactttgtccttgccagaaaaatgggcttggccaggtttattttgttaatacgatattctcttttcttttctttgggaactcgtagcacagtacagtacagtactactactcctatatggtgggatttggtggagggatgagtacataattaaggaggtaatcgtgtgtttagcggnagtagagtacgtttttgcttcagaaaaaaaaaa

SEQ ID NO: 7127 - DNA, 628 bp, Triticum aestivum
  Clone ID: PAT_TA_7127
cggacgcgtggggtgatgtgatcgcggaggagagagagagagagagagcaagggggacgagacgacgcaagaatgagcagtgccaccacctacgcggagagcatcgcttcctgccgcactccagctcccatccgctccccatccctcgcagccacggcggcggcggtacccgacgcagcccccctccccgtgaggcggcagctcgatttccccagcggcgacggcaacacggatgacgatgatgacttcttctttctcgtcgcagaggagatggagcgaaacctagaccaggtcacgcgccgcgccgcgcagagcttgacgccgccgacggttgcgctggcacgcccgactttccgtgagaagctgtgcatttgcgggcgcgggccgtgtgccgttgagtggaaggagggaggatgggcatacgtctgctcggcgccgccgaagtgcagacattcttcttattgcatggaatctgatgtcaatccaagttcacagcctgcctttttgagtcatcatgaacccgacaatcatatgactaatggtacaactcaagttaatgttagtccccaaggtgctggtgctacaactccagtaaatgttactacccaacgtgatggtgctagaactc

SEQ ID NO: 7128 - DNA, 1920 bp, Triticum aestivum
  Clone ID: PAT_TA_7128
cctcgggttctcctgactcggctgccttctgttgggcgttgtcgcgttggtggtctgcggcttggtgagatggagcgtgattgtttaattgcatacggtgccagcatgctaatctttgaacgtctcctactatccagtgatccatatcaagtccaggtttgcaggaaatgcggtctgttaggtctactacaattacaagctgaagacttccttctgctcgatgtgcaaaaacggagaaaacatggccaagatgaggatgccgtatgcttgcaagcttttgtttcaggagctgcagtcgatgaacgtcgtcccacgcttgacgctgacagaaggataaatacaaaactcggacggataaatggacctatattatgggcagagggcgacaattgctgtcatgagttagagtggatatgatattgaagatgcaattgtcatgaacaaatcatctcttgatcgcggttttggtcgcggcatagcaataaaaaagtacagagtcacggcggagaatttttttatggatttattatagatgattctcaggctctcggcagggtttctgcatagaagagatatatgagagtagggggcattggatgattgatattttatgacgcctggtcaaataatcgtcgatcatgatatctatgtgaacaagcaaacacccaaggttaccaatagaactcctggtactgcattaacagacagggactatagggactcaccagctgtttacaaaggtgtcgatggtgagactaccgttgtagatcgtgtaatgctttgttcggatacaaatgacaaattgaccattaagtgtattatccgtcacactaagaggccggaggttggtgacaagtttagtagcagacatggacaaaaaggtgtttgtggcaccagggttctcggcaagggcttccccttctctgagaaaggaatatgccctgatttaattatgaatccccatggatttccaagtcgtatgacaatcggtaaaatgattgaacttcttgggggaaaggctggtgtttcttgtggccgattccattatggcagtatatttggtgaaccaagtggtaatgctgataaagttgaagacataagccatacgcttgtcaagcacgggttcagctatagtggaaaagatttcttgtactcaggcattttaggccatcctctgcaggcatatgtcttcatggggccaatctattaccagaaactgaagcacatggttcttgataagatgcatgctcgggctagtggaccacgagtactactgaccaggcaacctactgaagggcgaagtcgtgatggaggtctgcgtcttggtgagatggagcgtgattgtttaattgcatacggtgccagcatgctaatctttgaacgtctcctactatccagtgatccatatcaagtccaggtttgcaggaaatgcggtctgttaggctactacaattacaagctgaagacttccttctgctcgatgtgcaaaaacggagaaaacatggccaagatgaggatgccgtacgcttgcaagcttttgtttcaggagctgcaatcgatgaacgttgtcccacgcttgacgctgacagaaggataaatacagaattcgacaaagctatgccctgatgttaggaccgtcagaggcgaatcagtctccattttcctggcagaactgtagcagcaacgcggtcgcctcgtcgtgctgtaacctgtggatgacagaagcatcggcacggggagattgttacaagggatgcaaggccgagtgtgtttttatggatttattatagaaagatctcaggctctcggcatagtttctgcatagaagagatatatgagagtaggttttgttgccctcttgatttattacgagggagagatgatcagagattcagaggagtcgtgaaataatagttggat

SEQ ID NO: 7129 - DNA, 453 bp, Triticum aestivum
  unsure (1)..(453): unsure at all n locations
  Clone ID: PAT_TA_7129
gcgttctttccttttggagggggtcctcggatatgcatcggccagaactttgcattgctggaagcaaagatggctctgagcatcatcctccagcgcttctcgttcgagctctcgccgtcctacgtccatgcaccgtacacggtgataaccctgcagccgcagcacggtgctcagattaggctgaagaagatatgagcatgctttatcatggggcagtgaatgttagcttttggctgaataaacatagcaattagttcatgttgtagtcgcaaaaaaaaaacacaggtttacttttatgtactcttttttgaaataactgagcgaattgaaatagtagtttcagttgaattagtcgtttgcttcagttcataatagtactgcaggtctgtaacttttttccattcaatggaactcctatcatgatactcgcagagaaaaaatattcttttaana

SEQ ID NO: 7130 - DNA, 772 bp, Triticum aestivum
  unsure (1)..(772): unsure at all n locations
  Clone ID: PAT_TA_7130
gcatgcacccagagtggcaggagcaggcaaggnagaaagttttgcatcagtttggaagaaccagaccagattttgagaacttgagtcgcctgaagattgtaacaatgattttgtatgaggttcttaggttgtacccgccagcaatcttccttgcgagaagaacttacaaggcaatggagcttggtggcatcagatatccggcaggggtgaaccttatgttgccccttatctttatccaccatgatcccgatatttggggaaaagacgcaaaggaattcaatccacagcggtttgctgatggcatctcgaatgcggcaaagcatccggcggcgttcttcccgtttggagggggtcctcgtatctgcatcggccagaactttgcgttgctggaagcaaagatggctttgagcaccatcctccagcgcttctcgttcgagctctcgccgtcctacatccacgcaccgtacaccgtgttaatcctgcagccgcagcacggtgctcaaattaggctgaagaagatatgagcatgctttctcatggggcagagaatttacttacgtgctgtgtatagtttaaatgtttagctttcggctgaataaaaatgcaaccaggtttacatgctgtgtaatttttattttgaaacacctgaatgaatgtaaatgtagtttcagttgaactgtcgtttgcatcagttcatgctgcccaggcccaggcgatgcccatggtggcgacgccgtcccgggtctaaacgggcaacaagcttacagtaaaa

SEQ ID NO: 7131 - DNA, 2583 bp, Triticum aestivum
  unsure (1)..(2583): unsure at all n locations
  Clone ID: PAT_TA_7131
cccacgcgtccgcccacgcgtccgcccacgcgtccgggttgcgctgcgcctggttttcctctccttcactgaactgatggcgaccgaaagcctccggatgctgctgggggacgcctcgccgtggagcgtcgccggcgccgcggcggccgtggcgctgctgtggctgggggcgtgggtcctggagtgggcgtggtggacgccgcggcggctgggccgggctctgcgggcccagggcctccggggcacccggtaccggctcttcaccggcgacgtgccggagaacgcccggctcagcagggaggcccggctgcagcccttgccgcgcggctcccacgacatcacccctcgcgtgcagcccatgtcctgcaacgtcatcaaggagcacgggaagatgtcgntcacttggtttggtccaacgccgagggtgacgattcctgacccggaattggtgcgagaaattctgtccaacaagtttggacactacgggaagcaaaagagtagccgtttcgggaagctgctagccgacggagttgcaaatcatgaaggcgacaaatgggcaaagcaccgaagaatgctcaatcccgcctttcaccatgagaagataaagaggatgctgcctgttttttctgcgtgtcgcgaagaaatgattacaagatgggctttcctctcatcgctcgcgctggcgaccgaaagcttctggcggttggcgctggctgccagtcgttctccggcaggggtgcgccggacgttgccccttatctttatgcagcatgatcccggtagtggggggaaagacgcaagggggttcaagccacggaggtgcggggatggcatctcgaaggcggcaaagcatcccgcggcgctcttcccggtctggagggggcccgcggatctgcatcggaccgaactttgccttgctcggaagcaaagatggctctcgagcaccatcctccaccgcttctcgcccgagctctcgccgtcgtacagccacgcaccgtacaccgtgttaatcctgcagccgcagcacggtgctcaaattaggctgaagaagatatgagtatgctttctcatggggcagagaattgacttacgtgctgtgtatagtttaaatttttagctttcggctgaataaaaatgcaaccaggtttacatgttgtgtaattttttattttgccacacctgcatcaatctacatgtggagacagagaagatacagacagttctttcagcttgctgtgaagactggattacaagatgggagaattcgatgtccgctgacggatcgtgtgagattgacttctgtcctgagttccagaatcttaccggcagatgtcatctcgcagaacagcatttggtagcaattttcaaggaggggatgaaaatattccagctgcaaggggagttaggtgaacggctgatacaggcagctcagacgctttttatcccaggccactggtacttcccaacaaggctcaacagaatccttctggcacttgtccgcccatgccaatggatcctaccaacgaatactcacaaaaaaagaagagctattaaaaatggtgaagctagcagtgatgacttgttaggattgctgttggagtcaaatatgcaacaatcaaatgggaaggccgatcacgggctgggtttgctggtggtgtcaaagatgcgacaagcatttggcatagcaaatctaggaatgagtattgaagatataattcaggaatgcaagctattttcactaatctagcatgcacccagagtggcaagagcaggcaagagaggaagtgttgcatcactttggaagaaccacaccagattttgagaacttgggtcgccttaagattgttacaatgattttttatgaggttcttaggttgtacccgccaataaccttccttacgagaagaacttacaaggcaatggagcttggcggcatcaaatatccggcaggcgtgaaccttatgctgcccattctctttatccaccatgaccctgatatttggggaaaagacgcaagggaattcaatccacagaggtttgctgatggcatctcaaatgcagcgaaacatccggcggcattctttccttttggagggggtcctcggatatgcatcggccagaactttgcattgctggaagcaaagatggctctgagcatcatcctccagcgcttctcgttcgagctctcgccgtcctacattcacgcaccgtacaccgtgataaccctgcagccgcagcacggtgcgcaaattaggctgaagaagatatgagcatgctttctcatggggcagtgaatgactgaatgttagcttttggctgaataaacatagcaattagttcatgttgtagtcgcaaaaaaataggtttacttttgtgtactcttttttgaaataactgagcgaattgaaatagtagtttcagttgtgctgtgtaatttttatattgaaaaacatgaatgaatgtaaatgtagtttcagttgaactgtcgtttgcttcagttcataatagtactgcaagtcttgaactgttcattcaaaaaaaaaaacctcggccgcgaccatgataatcacttagtgaaaattc

SEQ ID NO: 7132 - DNA, 581 bp, Triticum aestivum
  Clone ID: PAT_TA_7132
tcggcacgaggccgacaccgtgtcctgagttggggctgcaagctcactgattctcagaaatacagaaaaggaaagagaagggagaagatgatccagtcaactggctaaaggcataaaaggaatgctagggataaatgtcggggagggaggctgagggggttgccactgattactgtggcagggtggcagcaaatgtccatgctgctggggctcgatagcgccacaatggcaggccaggcgcggaggtaaccactggaatgttttgtttgcatgtatgtttgcaagcatgtatgtcttgtatgtaaggtaaggggcttacctgatgatgatcgccggtccttgggtgaattctgttcagcactaggtaggatgaatgaaatgagcatgggtctggcatggggtgtggtaagaggtacttcgggtagcccagggtgacttgcccatggaaccgccggacgccgctctctgtggcagagagctcggctgccaagggagtttcacaggcaaatcatccttggctatcgaagatggcctcttacccccatccaagacctcgactcacccggggtccaaaaaaaaaa

SEQ ID NO: 7133 - DNA, 623 bp, Triticum aestivum
  Clone ID: PAT_TA_7133
cggacgcgtgggcggacgcgtgggcacacatgtgcgagtggagggcaagatctgcagctatcgccaaggccgccatattcctgcgacactgcgagcttctccggccgccgcctgcgttgctctctctctcgttctcatctctcaatccacccatggtcatggggaatcataagctcactctgaagaccgaggaggactccaatcctcgtgataagtacataacttggactgacgaggtgacaaggtttatgcttgagtggtatatcgaccttcgtaaggacaaacctgcaactttcaagttcaagaaacaacaccacttgcaatgtgttgatgctctaaatgccaagtttttgcttggtgtcactcaaacccaagtggatcgacactatcgtcaatgcaaggagaagtggggttgggtgcgtcgtgcccttgacagaaccactttcacattcacactttccgggtcataaaagcaaagactcaataaaactgcagtcaattatcttactagacccattaggttctttcatcaattggaagagttattcttggatcaatctcatgctgatggctcactcgcacttgaccaaaccactgtcaatgtggatgatggtagtgatgac

SEQ ID NO: 7134 - DNA, 625 bp, Triticum aestivum
  Clone ID: PAT_TA_7134
gccaagcagaggcatgcagaggagatggagaagcagcggatcaagttcctcaaggatctggaactcaagcggatgcaggctttcgtggacatgcagcttcaactttcgagggtaaagcaagccaagaacggtacctcggagatgctcatgtctcttgctgcactgccgttcctcagcaaccctgcttacctctgatataagagcttggtttgctgcggctcttggatgaagatcaatctaggttcattggtagtttggtgtataggctctggagtccggatgtgtaaaacagatgctttctgctccagccaagagctttggtgtcgcctgcgttttctggactatggccgttggcgttttgtctcttttcttccgctgggatgttaacagacaattccgttgtttagtttttctttcagttgacatgatttacaaggtctgtaacagaaaatactgaatatgaatcaactcaagccagctgctttgaaatgtactccctccgttcctaaatataagtctttctagtggttccactaggtggactacatacggaacaaattgaatgaatctacacttaaaatacatctatatacatccgtatgtggttcatagtggaaaaaaaaaa

SEQ ID NO: 7135 - DNA, 711 bp, Triticum aestivum
  unsure (1)..(711): unsure at all n locations
  Clone ID: PAT_TA_7135
agtttctgcactaaggatggnngtgaagtagatgttggcctcgataaggtctttgttaagccaaccaatagactggagatggaaaagagaaaagcactggagcaaggacagaccgacgtgcagaagcagaaagatccacagaagtgttgtgataacacaccagtgagtttagatgagattttagtgaagcgtgtatcaagactggaaagggagaaaatggagtatgagaagaggaatgcctcgggacaaggacagaccattgtgtcgcgtgatcagcggaagcatggcaacattgccacagcatccgagagcttggatcaagtcctagtaaaacgtgtcagtcggctagaaagggagaagatggaatatgagaagaggaatgcatcaaggaggagcaagaactgggtgtgcaagactgggtagcgatgacaaagcatcctggatagtttagaccagttcttgggtaaacatgtctcccaggcctngaaaaggagaagatggaccatgaaaagaanggtggtaagtgacacaccactggctgnagaagattgatacacaatgtgcaaatgggaccacccgggggtccnggtgacatctttgtcaaacgtcccgacnaacttttancaaccaaacaggtgctgctgctgctnaaggattcccacaagancttgaccctgctnaanacccaagaaaccaggaaaaanactctgg

SEQ ID NO: 7136 - DNA, 655 bp, Triticum aestivum
  Clone ID: PAT_TA_7136
ggaaaaggaaaccctaagctcgaggaaaaggttacccttagctcgtcgttgatggggagacgactcaaaagcaaacgcggcggcgtcgtgcagaatcccaggacacatgaggaggatcgctcagtcgcgttggcggcggcagaggcggcggcggatgaggcccgttctgcggcggacttgtgcccctactgccgaacctgccggtctcgcgttgggcctggcggcggcggcccctgcccctgttccgacaccacctccgcccaaccgtctgccccctcgcgcggtagcgccgtccccgcccaaccgtgccaggatcatgtggccgagcctccatccgcacgggctcagccgcaaccgtctgtctcgtacttgagcatcttgctcggcactacaacactcaaggacactgccacttcctcatcctccccacaggctgtagctgagaccccgccacccaagccaaccatttatgtcaacgaccctcctgattggtacttcagtatttacatcaggatcgatcgttcaggatctttccacacatatcctcatcttggtggaccattcaagagcttgcaggaagttgaaaaggctattgagagctatcttcatgacaagcggcataaaacactgtggaacgagcaagctggggattctg

SEQ ID NO: 7137 - DNA, 604 bp, Triticum aestivum
  Clone ID: PAT_TA_7137
ccacgcgtccgcagagcgtgcagggaaggtgatcgacaggcccaagccgcctgtcgggaagaagatcaagcaggactgccaaggagaagcttctcgacagcgatttatgggctgcacgcattgagagtttaaggagggagccagatggagcattctgggcaaaggtgaggtggtacactatccctgaagagaccgcagcaggaaggcagccacataatttgcggagagagctctatcgtactaatgctcttggagacattgagatggaaagtatcgttagacgttgttttgtcatgagccccaaagagtatagggatgccactaatgacggagatgatgtattttattgtgaatacgagtatgatgtacattggcataattttaagcgtctggcagatattgatgatgaacctgagacaaaagaagatcccagtgacgagccttacaatgctgctaatgattataacagtgatactgatgaagattcagaatacgatgaggaggatgaaccggctgcacgttgctcagccagaaagaaccaatctaatgagaaaattttggctgctaattcatggaaagggaggatatatggcctgcaaaagat

SEQ ID NO: 7138 - DNA, 1074 bp, Triticum aestivum
  unsure (1)..(1074): unsure at all n locations
  Clone ID: PAT_TA_7138
gncgcagtgtgtacgctgtccctgctgcggctacagccgctgtctggaggagctcgagcagccgagcgcccagtagtagcactagacccctgcctgctgctgctgctaccactaccacctacaggcctactcattcaagaatctcctagctttccccaaactcccatacggcctcctgatccgccggcctctgctctgaatccggagatcgctgccaatccatttgcctgctttcctgcatccggcgctcttcacctctgctgggcctggagaaatgggatgcggtgcaagagacgcttcctgagccagatgcttctttgatgcaagatttctagatcgaggttttagcggtcaaaaatcttgcttccaataagctaccagacgagcagaagcagctgcatcaagcagttgagcttcgatttttttttcccaagtaatttcccaatacagctatagaaaaggcactgctggattggatcaatgggcaggggaagaggcaggggaaggaagcccatcgccaatggcaggagccatgaagacaagatgagcagcggcgaagaggtcgtgcctgccaggaagaggagaggaaggccccaaaagcagcgcgccccggacaaagtcgatataccagcagaacccaagaactcggcagcgggcgttcatggcgatgcagaaggaggcgacgcaaagctcaaggagaacgacgaccctgaaggcaatggcaacaagaggaacagggcgcccaaggaggagagctcgaacctcgacatggaggagaacagctcgagcacccggtccagcaacgacgagtcgacgacgacgaccaggtccagcggcttccggcagaacgggagccgccggaagagcacgccccggcgagccgcggaggcgggcctgtagctgccggaggaattaatggagcggcggcaacacgcgctcttggatggatatctgttaggcatgctgctgctcttcagttttgtcaactttataaatttagtagcaaccttcgtcttcgtcatgtttacaggctctagctacatgggngatgtaacatatactcattcaaactat

SEQ ID NO: 7139 - DNA, 684 bp, Triticum aestivum
  unsure (1)..(684): unsure at all n locations
  Clone ID: PAT_TA_7139
cccccaancaggccacccgctcccatggcgcgctcgagctccgtcaccgnaggccgaggtcggcatcgcctgcttcacctccgccctcccgggcttccgcggcgtcctcaagcaccgctactccgacttcatcgtccacgaggtcgcccgcgacggctccgtcgtccgcctcacctccctcgatctccccgaccagtgcgtggatgccaaggaggaggagaaggcggcgccggcggccgacgccgaccactccaaggccctcgagtcgttcagcgggctctgcggtgaggcggactgccgtgcgctgagggggcttctggagaaggtcgcggccggtggcgagggtgaattctcgccggttatgctctcgcccgatgccgacaagggtcatcgatcggaggtgcacaactttttcaaaaaaaacttcaagttcttggtcacagacacagtggaacacagcgatggggttcagaaatacatcagggtgcgcgtggggtctgaagccggaggagggcggggccgtggcggtggagggaggggcggcggtggggggggtgctggtggcagaggaaggaacaggaagaacatgaatggttctgattggggagacgacaggccatttgacagtagagggtcgtctagttggccagctcatgctgggaagttcctgaggtttcacctttg

SEQ ID NO: 7140 - DNA, 462 bp, Triticum aestivum
  Clone ID: PAT_TA_7140
gtgataatcctccaatgcttcttccatgtgggcatgttcttgtgcgaagcagtcgaccgcaaaattatcaaagtagcagctcccggtctttcaaatgcccatattgcccgtttgaagcattggcatctgagtgtaagcggctttatatctgaggagctcccggtctttcaaatgcccatattgcccgttcgaagcattggcatctgagtgtaagcggctttatatctgaggatttgttactctatgattagccatttgtgtgcaccagcctttgctatctcttttcctgtcaacgatgctacgttcttttatcacctccctgataatgtcaaatcttcgttgacacttgcaaaggtaatacgttatactcagggtgctcaactctgctcatgtcttgtatatagagtatgaaagagatgtaataagaacacattggatgatttattctcttgaaaaaaaaaa

SEQ ID NO: 7141 - DNA, 1324 bp, Triticum aestivum
  Clone ID: PAT_TA_7141
ctcgtgccgaattcggcacgaggcaccgcgcgccacgcccgcctgtctctcggctctcagcaggcacgcggcggagaggaggctagctcgcgtcacggctcacctcctgccctcctccttcccgctcgcctctgcccctctcctcgcgccgtcccccgctgctgcgtcgtcgtcgcccgccggagacagctaccggcgcgtacacggcgatgtctcgtcggagcctccggagtggcgcgccgcgacggacgaggatggaaagggattcgtcgacatcatctacgagaagtccgtcggagagggcatcgccaagatcacaatcaaccgtcctgataggagaaacgcattcagaccactgactgtcaaagagctgatgcgtgccttcagcgatgctagagatgatagtgcgattggagttgtcatattgacagggaagggatccaaagcattctgtagcggtggcgaccaagccttgagggattctgatgggtatgttgactttgatagctttggccggctcaacgttctagacctccaggtacaaattaggcgccttccaaagccagttatagcaatggttgctggttatgcagttggtggtggacatgttctgcacatggtgtgtgatctaacaattgcagctgacaacgcgatatttgggcagactggtccaaaggttggaagctttgatgctggctatggctcttccatcatgtctcgattggttggaccaaagaaagcccgcgagatgtggtttctgtcacggttctatgccgctgaagaagcagagagaatgggactcgtcaatgtagttgtaccacttgctgatttggaacccgaaactgtgaaatggtgccggcaaatcttaaggaacagtcccacagccattcgggtgttgaaatctgcactcaatgcagctgatgatggtcatgctggtcttcaggagctcggcgggaatgcgacattgatcttctacggtactgaagaggccaaagaaggaaagaatgcgtacatggaacgacgacgccctgatttctcaaagttcccccggaaaccatgacttccactcgatggtttcgtcgtcttgtagtaaatgttattggatctcttcccctcctcgatttgtaggaagaacccacacatttgccatctcccgtggatagtgcggacattgttatcatctacaaagtgccaaaattttgttgacaatctgttgccggaaatgcagtttgtgtacacgaaagaaaatgccatatttgtgaatatccttgcaatgtaatatatacttactattgaggtaaaaaaaaaaaaaaaaaaaaaaaaa

SEQ ID NO: 7142 - DNA, 755 bp, Triticum aestivum
  unsure (1)..(755): unsure at all n locations
  Clone ID: PAT_TA_7142
ccgccgccctcatactacccgctccgccaccganagagttgcccttcaccgccgctgagatcctgtgcctctttgcagatccctctcgccctcctcttcgcccatccacctagatcgaaagtcgaaacccgccgcccctctgtccctgctggtgctcgacggaagacgagggcggctcctcctggcgatttcccatggtcctcggcggcgacgacgggctagctgcagcgaaaagacaatgggatgatgggcgccagggcgggcgctggcgatcggcggaaggcgctggcggctacccggctccactactggccgccacagctccaccggccgtgcgcaagtccttttttacttgcgctcctctcttactatgcagctgcgatggcagcggacgaggccgcgaggaaagacgccaacaacatgcagcagtagcagcgtcttagcagcagcttgtgtggtggcactcacatgtaccaaattgcacgttttctgtgatgtggtataacaccatggtgaagaaaccattcagactccacagacaaaatcattcggacatggcagtgaaccattcatttgttacatggagtgcggtcgacaaattaggtttgggtcatacttcaccatcacttgcgtccgacaaactacctgagctgcaattgtctccaaactggacgtagaaatagtcagaatcttaatttcaagttcttcacgtacactttgctcttagtgccaggctctaggaactgttcccatat

SEQ ID NO: 7143 - DNA, 548 bp, Triticum aestivum
  unsure (1)..(548): unsure at all n locations
  Clone ID: PAT_TA_7143
ctcgcgtctcgttcttttcttcccccgactggtggctagggttcccatcggcagtaccgcagccgccgccactggagaaggcggcaaggcgcccttctgagatgctcttctcctccaaactttttgtcttcgcagcaaggtgtcattccatcccatcaccatggtggttgcagaggaggggaggaaggggatggcatcgaggtgccgacggagcacataggtcgaggcggcaagatgcagaggtgcgggtggtgcgaacggagaggcaactccatacccgcgcgcagtcgcctgccctctccttcctcctctgccttccctctcctccagtcagcgccgccaccactgccacacctcgccgctacactattcctgcagcggtgaccccgtggaggagcagatcgaccacaacggtttaaagttctctgctaggtttggagctactactccatcttcgatcccagccatctcgcacccccctgaaaatttctgggtaggtacaaggngccctccccatctnctgngngnatgtnggattcnattcnaat

SEQ ID NO: 7144 - DNA, 1031 bp, Triticum aestivum
  Clone ID: PAT_TA_7144
gtcgacccacgcgtccggcagaaggcttcgaacaacatttatttcagctggtagccctcttgttagagccgaggtttctgtagctcttactcgctttgcgctgggccacaacaaacatctcaaatctgttgctgcggagtactggagacctcaaaccaattcactgctgaagtcactaccatcattggctaatattaataacccaagcaatgtttacagtcccagtaactttttgcaaggcagcagtggcctttcttctcatattggtcctgtgttaagggttggtagtgataccagtgccacaggtcgtgatggaagaatttctacaagcagcccgattgcgacaaatagcattatgcatgggtctccccagtcagatgattcttctcagcactctgattcaggcatattgctgagagataatgcaagtaacggtggtctcagctacaccaggtcaaggcctattattgacagtggaatttattccctatttatttcgacgatgtgctctattgctaaagatccttaccctagaattgcaaatattggccggagagcactgtcccttgtaggggttgagcaagtggtcatgagaaatactagatttggcagtgggggtgcaggagagtcatctgctccttcatcaaacataggaatggcacgttcttcttcctggtttgacatgaattctggaatctcaatggcatttaggacccctcctgttagtcctcctcagcatgattaccttacagggttgcgccgcgtgcctgcgctggtcgtcccccctcatctcttgaactcacctgatggcttagctgatccgctcttaagctctgctgcagcccccagtaccagtgagcttaatatacttccccaatcaacaatttacaactggagttgtggccacttctctaggcctcttctaaccgggtctgatgataatggggaagtaagtgctagaagagaagagagggaacgaactgcactggattgcatcgctaagtgccagcgttcctcagcatgcaaaatga

SEQ ID NO: 7145 - DNA, 609 bp, Triticum aestivum
  unsure (1)..(609): unsure at all n locations
  Clone ID: PAT_TA_7145
gccgcacctccagccagcgaccgccaccgtcgctcagctcgacagaggcgggcgccagggtcatctccacgtctggattggagtagaacccagagagattccggagctcctgttcccattctgtgtgtcggcctgcggtgtgtactagcccctacccctgagttgtgttttcccaagtagtggtaaactgctgggcctttgaagccccattggtcgcaataagctggtgtgatgtagtcgaatagagcgccatgccgcctgcccgtcggccggctagctgtgtgcgcccgcccccggcgcgctgctcgtcggggccggcgcccgggtcatctccacgtctggattggagtataaatggttccggtgctctgttctgtgtatcggcctgacggtgtgtactagcccctcccctgagtttgtgttttccaatgtaatagtaaactgctgggcttgatcgcaataaattggtgtgatctangttgaatagagcaccattcggcatggtcattggcaagaacaacaatgtgtgccaagtcttggcttgttgtattttgggttcccttctcacactggatgaataaaatgctgttgatttgaggtaaaaaaaaa

SEQ ID NO: 7146 - DNA, 1590 bp, Triticum aestivum
  Clone ID: PAT_TA_7146
gcggcggtgcgcgtcgtccaggtcgcctgcacgctgtgccagcgggtgcaggactcgctcctccttgcggaccccggctccggctctggcggctgtccactccaagctcgaccgttctccggtcaccgtcgccgattggggcgtgcaagcgacagtgagctggctactctcagattgctttggtgatgaaaatgtgtcaatcgtagcagaggaagatgataagacactgtctagtagcgacggcacggctttgcttgagtctgttgtcgctgcaggcaatggttgcctggttgaagctccaaagtatgggctgagatccccggagaaagacctcgggcctcacgatgttcttcaagctatacggaagtgcagctctaccgggggtccaaaaggaagattttgggtgcttgatcctgtggatggcacacttggttttgtgcgtggggaccaatacgccattgccctcgccttaattgaagacggggaagttgtgcttggtgttctcgggtgcccaaattatccaatgaagaaggaatggctcaactaccaccaacggtactacaggttgatgtctaaggttgctccccctacatcaggatcctggaacaagggttgcgtgatgtatgctcacaaaggatgtggccaggcttggatgcagccattggttcatgacttcggtatgcttagttggcataactcaagggaggttcaagtatcatccgtcagtgatccagtttcagcaacattctgtgaacctgttgagaaagccaactcgagccattctttcactgccggacttgcccatagtgtaggcttaagaaaccagcctctgcgtgtgtacagcatggtgaaatatgctgcaatagcacgaggtgatgcagaaatcttcatgaaatttgctagagctggatacaaggagaagatatgggatcatgccgcaggggtggtcatcattcaagaggctggtggagtggtaacggatgccggaggttgcccgttggacttctccaggggtgtttacttggagggtttggacagaggcataatagcttgttccggagcgttgcttcattggagaattttgcaagctgttgatgcaagttggaactcatcaacgctgtaatgcaagcaacccaaacccttgcagtcagacagatggcctgatgctggtcatagcatgcaagagtaacccgactcattttggtatgaagaattagtctccagtattcaattaacgttgaaatagtggagcgtgtagtaaccatagcttgtctgctcataaacaatctgcagcacaagatcgacgaacaccgtcatttgttcgccaagagcatctgtaaagatgtttactggctattttgatggtttgtatcatccgtttttccctcgggcataactcatacgctccttgggttgatggcacgtcgactaaatcatcagtcatgagcagtttgctgaacctgataactggaatctctgaaccttcgataaactgatctcatgatgcattttctgcaattttcgcctctatattattattatgccttcagttcttctcaaaaaaaataaaaaaaaaaaaaaaaaaaaaaa

SEQ ID NO: 7147 - DNA, 1167 bp, Triticum aestivum
  unsure (1)..(1167): unsure at all n locations
  Clone ID: PAT_TA_7147
attcggcacgaggcgtttatatactaggcgcacacacgcgggcgcggcagagggtaaaaatctagccagccggtgctcctgggtttgtttgtttgttcgttcgtgcggctgagcaggaggagggaggaggaggacggcggcgccggggcggccgggagcggttcaggcagggcggatcgagatggcgcgggagaggcgggcgatacggcggatagagagcgcggcggcgcggcaggtgaccttctccaagcggaggcgcgggctgttcaagaaggccgaggagctcgccgtgctctgcgacgccgacgtcgcgctcgtcgtcttctcctccaccggcaagctctcccagttcgccagctccagcatgaacgagatcattgacaagtatagtactcattcaaagaacctggggaaatctgatcagcagccggctattgacttaaatttagagcactgcaagtatgacagtttgaatgaacaactcgcagaagcaagtcttcgacttagacacatgagaggtgaggaacttgacggactgagtgtcggtgagttgcagcagatggaaaagaatctcgaaacaggattgcagagggtgctttgtacaaaggaccggcaattcatgcaacaaattagtgacctccaacacaagggaacacagctggcagaggaaaatatgcgcttgaaaaaccaaatgcatgaggtgccaactgctagcaccgtggccgttgccgaagccgaaaatgttgtccctgaagatgctcattcatctgactctgtgatgacggcagtacattcgggaagctcacaggacaatgatgacggttctgatatatccctgaaactagcgttaccttggaagtaaggaccgtggggaggccaccatgagttgccttggtagagagaagatgtgaaatgctatggggaatcactccaagataggctggctggaatgatcccatagtagaagccagatcagtttaacccgatcgagttgtcgttttatgtctccgtttgcacggcgcagttgtccacctttgtgcctgggaattcagtcactgaacttgtagcgtatcttcttgtcttgctctgtagcgacatgtatcattcgtgcaaactatgtatgtgcctgccacggctatgtgactattttannataagcgtaagcgt

SEQ ID NO: 7148 - DNA, 374 bp, Triticum aestivum
  unsure (1)..(374): unsure at all n locations
  Clone ID: PAT_TA_7148
gggacggtggtgctcgtgttggcctctgcctcctcttgaggcgcttctccggagcatttgctgctccggctcggagctgctccgagcccagcggctgtgggagcggttggcggcggaggggcgtcgatctcggccggatctcggcgaatgcccgccgcggcgcgctccggtggaccggggcaggccaacattatgatggggaggaggaagttgcaagtggtgaccttggcgatcttgtgtttctggtcatctgctggggtctgcaaagcacaaacagtcgatttcaagcctgcagacagctacctggttgactgtgggtctaccaagggcacgacggttctcgggagggacttcgctgncgatggggcatntnc

SEQ ID NO: 7149 - DNA, 610 bp, Triticum aestivum
  Clone ID: PAT_TA_7149
gcacgcggtgggctcgtcacctcacgtcaaattcctcatgatggtgagccgacttgtcgtggacaacttctttggggtctttgcggtggccgtcgctgccgccgtggtcgggagggcgtggctcattcgccccgaagagatcctagaccagatgctcaccttgccgcgtgtctacgtcttcttggcggtgatcctggcggcggccctggagaagatgcggcgcatgcggcggctgcgggatgtgtacctcgtggagtacggatgcttccggcccaagccctgctaccgcacgccgttcgccacgtgtctggagcatgcgcacctcatgccgtacctcgtcgacgaggagagcgtcgccttcgcgatgcggctgctcgagcgctccgggctcggcgaggagacatgcgtgccggacgcgtaccactacatgcccccggaccgcagcctcaaggcgtcccgggacgaggccgagctggtcatgttcgcccgccgtcgacgatgtgttcgccaagacggccgtgatcaagccagccgacattcgacgtgctcatcgtcaactgcagcatcttcacgccggttccggtgtttgctgacatggtcgtcaacaagt

SEQ ID NO: 7150 - DNA, 1001 bp, Triticum aestivum
  Clone ID: PAT_TA_7150
cgtccgcccacgcgtgggttgttgaggcaccgtgctatttacagaaggaggggacccggttcacgcttgattcgttcatgcaacaaggagggtgcgcgtacaagctcctgctcggctcctctccttccatctctcgccgccggccaccgagaaccctcccgtccgtcgtcgcaatggccgccaccaacggcgctggcgccgaccccgtgcacgagcctccccacaagatcaccaagatggcgcccctgctcaaggtcaagaagctctccgacaaggccatcctgccgtcccgcggctccgccctcgccgccggctacgacctctccagcgcggtggagacggtcgtgccggcgaggggcaaggcgctggtggccaccgacctgagcatcgccatcccggagggcacctacgcgcgcatcgcgccgaggtcgggcctggcgctgaagcacgccatcgacgtgggcgccggggtgatcgacgccgactaccgcggcccggtgggcgtcgtgctcttcaaccactcggaggtggacttcgccgtgaagcccggcgaccgcgttgcgcagatgatcgtccaggtgatcgcgacgccggaggtcgccgaggtggaggacctcgacgccaccctccgcggggagggaggggttcgggtccaccggcgtctgagctccgagccctggtagatagaatctagagaagtggtctgtgttaaggtttaggttgatggtggaaccctagggaaggtacccacctttgatggtctgtgtgttatgttaaatggaatcccgaggtatcctacaatggagatgtgtaatgttgcatcgagaagtgctctagttgtgtgcatctgatgttaaatggaatctcgtgatctcttgcagttgagatgttcaatgttgcatccatgaatgctgcaagtgttaagatggtcctgtgaccttaatttattttgcactgggtgtcaaaaaaaaaaaaaaaaaaaaaaaaaaaaaaaagcccct

SEQ ID NO: 7151 - DNA, 902 bp, Triticum aestivum
  unsure (1)..(902): unsure at all n locations
  Clone ID: PAT_TA_7151
ccctggctcgtcctagtcgtgccacgcccgtttatggatatgaagttgtccctgatgccttcgcggatgcccaaaagaatgctcagttgaatggtattagtaatgctacatttgttcagggagaccttaacaaaatcaacgaaacatttggcaaggaatttccaaagcctgacataatcatatcagatcctaatcgtccagggatgcacatgaagttaatcaagtggctgctggaagtcaaagcccctcgaatagtgtacgtctcgtgtaatccagctacttgtgcacgggatctggactatctatgtcatggcgtggacgagaaaggcctgagcgggtgctacgagctgaagcgtgtaatacctgtcgatatgtttccccacactcctcatattgagtgtgtgtgcttattggagcggtgctgattttcagttccgttcagctagagccaccagaaggtttcctcttgcctcattgtgcttaataatacgttctgcttctgtcctgatttgttgtgatcgtccttctcaaccagctggagcgattcatattcggaaatggggtacaccgactcttgaaatagagtagaatatccacgcggcttagcttgcactgtcgtttactgaagccatctggacgccctgagtgctgaatgggttgttctggtcgcatctctccagcaggggggccacacttcccgccggggccgcgctgcgccgctcgtagccccggaactgggaagcgccctatagaaggactctgggaaancctcgacagttgttgaggtttgctcattgtttgcacgcaagcgatacatcctgtaagcagtaagaaaagaatggatgaattgtccgatctctcaacnatgggtgtcaaaattaaattgcttccgggacaaaaaa

SEQ ID NO: 7152 - DNA, 1064 bp, Triticum aestivum
  Clone ID: PAT_TA_7152
cagttcctcacttgccactctcaagcttgatgacaaccatctcgttggcgagataccggcctctcttgccaacctgtcgaagctgcagacgcttgacctgtcatccaacaacatcacaggcagcatccctgtttcattggcccagattccaagccttctgtcattcaatgtgtcacacaatgatcttgccggagagataccaccagtgctcggctcccgctttggcacgcccacggcctttgctgccaaccgagacttgtgtggtccgccattgcagagcgaatgccgcgcgtcccggcggcgccggaagcgacagagactgcagcgcctggctctgctggttggcgccgtggctgctgcatcactgctcctcctgttgctgtgctgctgctgtgcgttcagcttgctgcggtggaggcgccggtttgttgagcggcgtgatggcgtcaagaagaggcggcgcagccctggacggggcagtgggtcgagcggcacaagcacggagagccagacgaagctggtcatgttcaactccaggatcacctatgccgacacggtggaggcgacgcggcagtttgacgaggagaatgtgcttagccgtggcccgccatggactcatgttcaaggcctgttacagtgaaggaaccgtgctggccatcttacggctcccttcaacctcagccgatggcgccgtggtggtggaggagggctcgttcaggaaagaggccgagtctctaggcagggtgaagcacagaaacctcaccgtcctccgtggctactacgccgggccgccgccggatgtccgtctgctggtgtacgactacatgccgaatggcaacctcgccacattgctccaggaagcgtctcaccaagacggccacatcctcaactggccgatgaggcacctcatcgccctcggcgtctcccgcggcctcgcgttcctccaccagtccggcgtcatccacggagatgtcaagccacagaacatactcttcgacgccgactttgagccacacctgtctgattttgggctggagccaatggtggtgaccgcgggcgccgcc

SEQ ID NO: 7153 - DNA, 654 bp, Triticum aestivum
  Clone ID: PAT_TA_7153
gcgcaccgtctgtcttgtctcgccgcggacgcgtgggaagcgcagcgctttcgtctccgtcgctagggtttcggtctccgcaaactcgatcttccgggagggcacgagccggtgctattggttttggtgcggcggcctgagagagatgccgcccaagtcggttaagaggggcggcgccgcggcggcgaggaaggggtcggctacgaaggccagaccggcgaagccccagccggtcgcggaggaggcgcccgtcgaggtggtcaaggcagcggaggaggctccccctaaggtggaggagcagaagccacagccgtcgccgccaccacagcagccggccgccgaggagaaggccaaggcggatgccgctgagaacggcgcaagccacgctgaagatgatggagctgcaaaagaaacatatgaagaagaggacaaaggtgaacgactggagttcgaggatgagccagaatatgaagaggaggctgctgtcgactacgacgagaaggatttggagcagtatgaggagcaatatgaagacggcgatgaagggttggagtacactgaagatgtagtcgaagaggagactgagatggtggatgaggaggaactggataatggtggggatgatggcgagtgtgaggaatatgaaaatgcaga

SEQ ID NO: 7154 - DNA, 793 bp, Triticum aestivum
  unsure (1)..(793): unsure at all n locations
  Clone ID: PAT_TA_7154
ggccgctcgaggcnncggccgggcttgcgaaaaanagtcaggcggaaagcaaaccaaagcaaacctcccccgactcctaaaaccttaaaccctagctccggtcacccccccatggcggccgtccgggtcatcctccctcatccccacctccccatcccctcgtggagaccccagctcaagccctcctcatcctatccccgccgcgcggtcgccgccccagcttcgctgtctccgtcgcccctcacggcttccctgcaactcggagatgtgatcgaggcgcagcagttcgatcggcaggtgcttaatgagatctttgaggtggcgcgggagatggaggccgtggagcgcggctcccacgggttccggagccgcgtccttgaggggtacctcatggccacgctcttctacgagccctccactcgcacgcgcctctccttcgaggccgccatgcgccgtcttggcggggaggtgctcaccaccgagaacgctcgcgagttctcgtccgctgccaagggcgagaccctagaagataccataagaaccgttgaaggttattctgatattatcgttctgagacattttgaaagtggagctgccagaagagcagcggctactgcagaaattccggttattaatgcaggtgatgggccagggcaacatcctactcaggctctgttggatgtatatacaataacgagagaaattggtaggctagatggaatcaaacttggtttggttggagaccttgccaatgggagaactgttcgttntctggcctatttgatcgctaagt

SEQ ID NO: 7155 - DNA, 448 bp, Triticum aestivum
  Clone ID: PAT_TA_7155
gctaccgtgctgcaatcggcgagatgcaggcaaccagctgcgcggcgaggtgccgggtcctgcaaccgccaatgcgtggagctgggaccgacacgcggccgtgctgcgacccgcgcattgcggcgcgggggccgacgcggcgtggtgctacgaccagcgcggcggcgacagccaccgtcggccaaaaagctacaaccatctatgtcgatggatgcaaccggtggttaccaatgctacaaccccgtcctcggcactgtggtgacacgcacaccggcgatgctacaacggcaagacgaagtgctactaccggcaagttttttttgctggatccggcttcgttttttgctggaatcgactaattttttttgcttcaacagattactggactttttgttgcctaaatttgttttgctgaaatcgatgttaatttttgctgtgaaaaaaaaaa

SEQ ID NO: 7156 - DNA, 597 bp, Triticum aestivum
  Clone ID: PAT_TA_7156
ggaaacatcgaaggaaaatggtgaagagacataccgttctcctactacttgtctttgtaattatgttctcctacaatgtcctggagggtggtgcataccagaaccaagtggcattctctcgcaaagagctgaaagcacagcagaaagtatcctttactggaatggatccatcgcttggcgggcaggtttccggcgcaaccgatgcaggaggtgcaagcaataatgctgaaatatcaaatgctaaaactactgctgccacggagtcccaccgtgacgtctcatgggatcagttccgtggtatcatcatccacacccaccaggtcaagaaaccataatgatgaactaagacaaacgaccatgggcaccaatctgatatatatccatggatgaacaaattatcaagttggcaatttctacactaagatgtgggttctctgttatatatgtgtgtgtaatataatatggaactgatatattctaagacttggatggtatgtttggattatcaagctacttattgctgtactaattattgtacatggtattgtactatacactgcagaataaacatgcccacggtccatggtaatgcccact

SEQ ID NO: 7157 - DNA, 505 bp, Triticum aestivum
  Clone ID: PAT_TA_7157
ccacgccgccccggtcggcttcccttgtcctccccgtcccctggccgcacctctcctggcgtcgtcctcaacgtccgcaagccaggtccatgccggcgtcatcctcctgcaaaattctgccacatcaagccagcgcaccctcaaatcccatctgctctatcaagcaggtcaaaaagacaaagctgaccactccaacacaacctaagacatttgtgctccaagaaaacatcaagacatttgtagaattggaatgcattgcaggagcaaggagcaaccacacaagaattagtctttaaatgaacacatattatgtataatgtatggaaagcttagttctagtttgtagtatcttttaattatttacatatttcatatgaatgttggatctgatgcagctgtgaactccatgtctccatacacttttagtgtatgtatttgttcatatacttgttacaaaggatgctaattctgagaatggattgcttgcaaatgcccaaaaaaaaaa

SEQ ID NO: 7158 - DNA, 594 bp, Triticum aestivum
  Clone ID: PAT_TA_7158
cgcccggcagaccaaggcaaaagctcgctctctctctccctctccctctccctctcacacggctttccctctctctcctcccgttcgaactaggaatccgaggtgagcacgggcaaagcgatggccgcggccaggccgcaccacagggcgccgccggggcgcgtgcccacgaggtgcgtcgccgcgctctgcgccgcctgcttcctcctcggcgtctgcgtcgtcaaccgctactgggcggtccccgagccacccgattgcccaagcaaggcgaattctggccgttcgagggccatgctgagccaagcacaaacccgcgaagtcgtcatcgcgttggacagaacgatatcggacatcgagatgcgcctggccgccgccagagccgcgcagatgaggaaccaaggcgtgtcgccgagtgattcagccgctgaccacggaaacatgcgacctagattgcttttcgtcatgggtatcatgaccacgttcggtaatcggaggcgcagagactctatcaggaagacgtggatgccacaaggtgagcgtttgcgaaggctggagaaggacaagggcatttggcatgcgttttggtattgg

SEQ ID NO: 7159 - DNA, 695 bp, Triticum aestivum
  unsure (1)..(695): unsure at all n locations
  Clone ID: PAT_TA_7159
acggtggcattaaagttgtcttgatgggagaattatcccttgacgtacgagcggataaaatatgctgccctcgatgcccgtgtgagtttcgagaaagctgcaaggtccaaagagcttgctgcgaagccgtctcgcacagagaatgagaacaagaagaagaagaagaagaagaagaagaaaacgctgcaccagcaggagggcattatggatggatgaactatttcctctcttgtaaaaaaaattattccctctcggtgtatattgatatagatggactatttcgatggtgtgcatgtctttgaaacagagtagtagcgtgggtcctcttgactataagaaactacttatccacatatatagctttactactactccttctagtgaccggtatgcaatgcatgtgttcatagacatgacaacttgtccatggaagttcaactacgacgaccatcacgtttcatccactgccactcgcgatcgatgtcgctccaacccacgacaccacgtcccccgacatgcgcctcacccctctcagccgcaccgcccctctgcctttgtgtgcttgacatgtgggccacctgaaatgcgacgagcatcaagtttctaccacagccacacgtaattcccacaatggccgctcgaacccatgatacaacacgtcccccaacctgcggctcaccctctnggcctcactg

SEQ ID NO: 7160 - DNA, 814 bp, Triticum aestivum
  unsure (1)..(814): unsure at all n locations
  Clone ID: PAT_TA_7160
cggacgcgtggggtgtggctgaaataattatgtctggagcaatcaagacagccgtggcgtatgggtactaaatagggcccgaatgggtgcgcccacgttggagatgcccttaagagcccacccttacctctcttgcagcctggtcacttcatcgctaatgttggatgttctgcgcctcggacggtcattctgatgagtgataaccaggtcagttctcttacaccgcgatgggtagatcatgcagcaagacttgtgagtgttgggcttcaagatgacacgcatactgagccctcttacctacgctacaaatactcttatatttgggaacggatggaggatctatctatctatctatctttctaactagctatccatatcacgggtgatgatgatcaaacatggctgacaatgacgtgtctgatgttattgttggagttgaagatataaaacacaacagagcctctcttttgggacctttctagtctcaccgaacattgacgcttctgtcctggatgatcattcagtttagtaataactcacacctctctcaccctgcgtccggcggcctgccatgtcggctcccggtctctacggggcggccccccgccccctctccattgccgtcgctttggttgcggcgtggctgggagccgttaggcgttggctgatgcgccccccacaccannnngtttggtcggtcaannccangtatgagcagctcctgnnanngtctaagttactcaccactatggctagtctgatggatgaatggatggatggatgatggatgttatggtcatgttgcttggggggn

SEQ ID NO: 7161 - DNA, 753 bp, Triticum aestivum
  unsure (1)..(753): unsure at all n locations
  Clone ID: PAT_TA_7161
cacccacagggaaggatcacaaacaatgatgcaggcccaactcgataattgagttgtcaaatgacacccacaggtaaggatcacaaacaacggtgcagatccaagtctttgatgatttagcaccctagtagtaaggaaatatacacatcacagcacgccattactacaactagtagtttcacacatccatgtgctgatgacacgtggcttctcattgcatcctctcctttctgagcctctcaagctccttcaccatctgccagtgctccagggaaaaggctcttctcaccaaagcttgaggctgtcatctgagccattgtcagccatctgctaagttcagtgcaacccaagctcctgtcgttgcgcatggcgctgaccatttcatcttggatcgtctggtaaatctcaggttcagaagactgagggagagacctcactgtggccaagtaccacctccagctctcaagttcctccgaagttgcattcaccgcagaaacagttgatggacgaaaaggcacttccaagtctgaaggcagtatgtttgattttcccccagctggggctccttcctgctcttcggccgccctctcctccctgcacctctagatgccaaagatccagattgcaagagagtttcatcaaatgtcaagtgagcgccttgaggtagctgcagaactcctgtaaccaaccttcctgactggctgtcctttnctaggttgaagtgtggctgtgttgagataccctcgtgccgaa

SEQ ID NO: 7162 - DNA, 590 bp, Triticum aestivum
  unsure (1)..(590): unsure at all n locations
  Clone ID: PAT_TA_7162
tgggatcccagnaccgcagtacatggcccatggccaaatttgaaaaacaaacacacacccgtgggggacacagccccagttacataacccatggagtgtagggaagaggtacaaactagacgcatacaaactagtagcagcaacagaacccttgtaagcatcagattggtttactaacatgacaaccattgaggctctaacacaggcactacaggtagtatccactcaagcgatcgccggctccgatccctggccgtcttgctccagccccacagagtctaatgccgcagcaccaccatggtctatcagcgcatcctcagcagcgctaatagaactgtcatcaagcttgaagaagtccctcatggccacaatcacttcaggagggagctgctccttgaatctctctgtgaacgcctccaggatcgaagcagttacatcttgaccatctttggttatgcccaggctgcggcaaaccaggcgctcggccacctttgccaccggagcagccagcgtgcggctggaaggtcgccgggtccgttgcagagagatgccgncctncttggagattctcatgcccgccaaagtctttc

SEQ ID NO: 7163 - DNA, 768 bp, Triticum aestivum
  unsure (1)..(768): unsure at all n locations
  Clone ID: PAT_TA_7163
gnggcacaaacttaatgcttattgtgccattgatggcaatttcttggttgctatgtacaaggccttcttttctcttgcgcactcgtcctcccttttttttttctcctctcttttttgcgactttctactaagtagatcagtaagctagtgctccacgggaatacagacagcggttcttagttttgcagtcatgctggcctgatgggatgggttatatacactgtatcaatgtgatttcttggagaataaagccagctatccagtaaatgaccagatttagaattcccaaatcagtctcatgcaggaagtgatggcatgaatatagattgaatatctgtccggatgaaatgccctggctagattaatttgatattctggcagcaggttcagaggcggaacttagtgtagctgatgacttcatgctgatctcaagctcttgttgcttcttcagataactctgtgctgtggaagtgattatctgaatgatgaaattcacgatcatgagccacaccacggtattccagatcaaagagaacgacagattccacttcttccccttcgcagcactagaagctgatgtagcaacacttgccattaaaaacttatccttagctgtcttcaacttggtgactaaagagggaaggatggatgatactccaggggaattgctaaacacccatacaagcctttcctccaccaattcaagaagttggttgttgcagagagtaattaccaatgttgtctgcatataaaccttgataatggcct

SEQ ID NO: 7164 - DNA, 300 bp, Triticum aestivum
  unsure (1)..(300): unsure at all n locations
  Clone ID: PAT_TA_7164
acatacttnacatnaacaagtacatatgtatgacaagaacttgctaacacatggactacaatctagaaccagtttctacagtaagagaagcacaagagtgacaatacaaatatgaattggtttaagcaaactacgtactcgtactaacaggatcaacataataggaaatactaaaccacattaattctgggcaattcaccaattcttacaatgcaacgtacaatatttagagagagagagagagagagagagagagagagagagagagagagagagagagagagagagagtgtgtaanag

SEQ ID NO: 7165 - DNA, 634 bp, Triticum aestivum
  Clone ID: PAT_TA_7165
ttacttcccagcgccctccgtttacatagtggacccgacaaatggtggcacagccgcatcctctttcgctcccgcgccgacccgacccgacagctggcggccccgccgcaggctacacactccatcatccaacccaaagctacagtcttgctgacactgaagagaccgcactaattgggcacagagagagactgcacttaccaaagcccatagcggggctacagccacactcattaacacggagggactactaccacgctaatactactgatactacggccatccaccaccttccggactgccgcaccccgtgggcccgttccgcctggcgggcggccgcagcgcccgcgccggggcgggcgggctgccgtgcagcttcgccccgcccgggcccggcggccccccggcagtaccggccagcgcctgcccggcggcccagcggctggtccagccgagccccgcgccgcggcccgccgcctgtggcgatcggggtcctcgggcccccgccgccccgggcggcggtgcagggggcgcaggcccccgctcgccgggcacgggggccggaccggacgtggacatcgcccgcggtcggagcgcgggccgggggggctctgcactggcggtgtgcggcgcc

SEQ ID NO: 7166 - DNA, 998 bp, Triticum aestivum
  Clone ID: PAT_TA_7166
acgggcacggccgcgggcgtcgctagtccgtgaccttcacctccaaccaccccgcccccgccccccccctaagcctatctctactccaatacattacgggacaccaagccctgagactactgttctggaggattttggacatgctgctctagctgcctgcccgtgctagctactggtcgccaacctcaaaggctcatggctcagttcggtaccgcctcgcctgctggaaccattctcacgctggaaggggcctgctgatccttacttcttggtcgccttcttgcctcaccgctggtgcttgcatccccgacgcggcttctagcctgggacagaagttgcttccttcgctgcttcgggctggtgtgaccgtctctttctattgctcgcagaacagctttccggagcctggactccaccatttcccatgagacgagcttctctagaactgcagagacatactcagcccttcgattctcataatccaagtagtaggcatgctcccaaacatcaatcgcaaggagtggagagtggccccagacaagagggttgatagcatttggagactttgagatgaccagcctaccataattgtcagatgggattgggctttttgacttcacatggggtaacttgctccccttgtaagaaagccagacccatccagaaccgaactgagttagtgcgacatccatgaattgcttgatcatgccgtcataggatccgaagtccctgtttataaacttcagaagacgttccgggggcttgcctccaccgccaggttttatcgagcgccaatagaaatcatggttccatacctgtgcggcatggaagaagggagcatggggtggctccctgccctcattgaatgaggcgagcatcatctgcccaatcgacatccgctcccactcgctgccgccgatcatgccgttgagcctgtccacgtgcccgcgctggtgaactccccagtgctgctccaccgtctccttgcttatgtacgg

SEQ ID NO: 7167 - DNA, 781 bp, Triticum aestivum
  unsure (1)..(781): unsure at all n locations
  Clone ID: PAT_TA_7167
gcccgagtcgccgagatggcttgtgagcaaaggaagaatggccgaggccaagcgacccacgcgagggctgcggggaagggaagatgtctcaggagaaatggcccttcttgttgaaggattgggtgttgggaaagacacacattttgaggaatacataattgggcctgatgatgagcttgctgatgacgggctggctccagatgaagagaagttgaagctgtacggagctgaagaaggggtatcttggatcgcccgtcctgttaggggcggcggccaaagtgcacttggaagcgccttgggtctcatgtctcgtcatgggagtatggttagtcagggtaaatctctcgtggacccacttgtcactctcttcggaagtgtccatgagaagatgcctgaggtaatggggagcatgcgcagcacattgtttcctaactttggcagcatgtttagcgtggcggaacagcagcaggctaaagctgactgggatgctgagagtcatagggatgatgaagattatgcatcggatcatggtgctgatgacattgaggatagcctcaatagcccgcttatttctcgtcaagcgacaagcgtggagggtaaggagattgctgcacctcatggaagtataatgggtggtgtggnaaagaaagtagcagcatgcagggnaggggaggcagtaagcagcatgggcattggtgggggggtgggagttagcttgggaagtggacttgatagaaaaggtgcttatgggcaaaaggaagggggggtttcagcgtattta

SEQ ID NO: 7168 - DNA, 541 bp, Triticum aestivum
  Clone ID: PAT_TA_7168
tatggaataattccttaaatatcccacacatatatggaatactagattatcaagatataccactccatacacttctttttttttccaagcaaactgaatggatcattgctcacgaggatgttgacagggaccaaatgaacagaagaaacgaactatgggcatggcagatctggattctgctgccattccttgatcttgcaccaaccgatgccacgagatccagatcatgcggcgctcgtcatgacctcgtctactcgtggaccagcgtcccctgaccatcgcgggatccagtcgcgacgagcctccggtagtcgctcgacgcgggatccagcaaaaaggaacggcggcggccaagacgaggaggcgacggcggcggcaaagacaaggagcctgcggcggtggcgaggacgaggagtcggcgtctgcggcggcggtgacgaggacgaggagccgtcggcggtggcgaatctgaggccaggcggaggggatgggaggaggagcgatggaccctcgggccgttaatgcgaggggatcctcgtgc

SEQ ID NO: 7169 - DNA, 2941 bp, Triticum aestivum
  Clone ID: PAT_TA_7169
cgaaaatgcgatcgccactcctactataatcctaaaaagactctcgcagctttcgtcccgacccactctcgattcccctccccaatctacaggaacgccgctccaggattcagccgcgattcgatcgccgaggcgaccgcgccgcgctgtcccgcccactcgattcggtcgtgcgcgcgctaggaagttcgtccgtcacgcgcctcgcggttttgtgttcgttttcccgttctggttttcctgtggctcgctcggttaccgcttttaatcttatagctagttcgatcgatctcggttactgtgtaggtatgtgttgcatgtatatgctgattattatgactaactgcttgattgattgcttgattttgttgtggtgaccaattttcctggttcggttcaaccatgctcgtcaattggttcgttgactgctgcttgattgatgttattgatcatttaaattagatgatgtgcatccagaaaattcgatccagttcgctttaaacccgtggtgtatccgcctatacaaggggtttgggttgcgtttcatcttcttggtaccaagtgtgttcgatctatttactggctacaactatttgggcgtgtaggataatggctgcacaaatcattatcagtaattcacattaccatgtatatatacatacggccgatgaagcggcatgagctagctgtgcaaatggactcctgttatttcagaaaatttgaacttcatagatccctgacctcacgtcctctatgtttggtttgaactggcaacttatatcgttcttcatcacactcgtgctgttctggctaaaccaagcttccatgacactgggcacactgcatttttcttgctctccctgtacctggccgggcgcccctggagtgggtcctccttcaactctgatttctgccagaaccattctgttcaataaaaacatgcaccgaagttactagataacacgtcaaaaccttatcatgaaaccatcccatccccttcacttgtatttccctggcatttgatgctcttgcgtgttcctcttgatgcaaaacggggggccagcaccaccgtaacactgatgcaaatggatcactgtgtacgaattgcttgggaattcttctctggatggatatctgggcttcatagagatgttattttaggactaaaaatatttgtttaatcgtatgcaactcttttcccagcaatcctcacgaggctcctgcatcgtcctgcccgacctcgctctggtctcgtctcgacatgcctcgccttcaccactactgatcaaccagaactacatgccgcggcttcctccatattctcgacatgtgactgcattctgtattgagagccatcctgctaaatgcataatacttgcaggtatttgtgttgtgtttgcaacgcgatagcttttgcgctaccaaacagccgacatgggtgccgtgcagctcgagtctgttgctgctcaacatgcacaagctaagctaaatgtggaatcacttcctcaaggcccttcgttgtttgatggaaatgacactgccaggatcaatggttccgagtctgatgagtatgaaaaatttgacaagggattaatgcagtatggatgtgcacattaccgaaggagatgccgcatacgagcaccatgctgcaatgagatttttgattgccggcactgccacaatgaatcaaagaattcgatcaaaattgatactcctacgcgacatgaacttccacgccatgaactgcagcaggtcatatgcacattgtgtggcactgaacaagaggtacgacaagtatgcatcaactgtggtgtatgcatgggaaagtatttctgtgaagtgtgcaagctctttgatgatgatgtctcaaaacagcagtatcactgccatgcgtgtggaatatgtagaattggtggcagggagaatttctttcactgctcaaaatgcggatgttgttattccaaagtgttgaagaacagtcatgcatgtgttgaaggagccatgcatcatgactgtccaatctgcttcgagtacttgtttgagtcaagaaacgatgtctctgttttgccatgtggtcatacaattcatgaaaaatgcttgagagagatgaaggagcattgccaatttgcatgcccgctctgctccaagtcagtatgtgacatgtcgaaggcatgggaaagactggacgcggaactagcgactctgtcaaactccttcgatgataaaatggttcgcatattgtgcaatgattgtggggcagtatcagaggtgcagttccacttaattgcacataagtgccataattgcaagtcgtacaacacccggcagatttgaagtagtgaagccctggagggattctacattcttcctggaagttggtgagagtgctccggcagtggagattagttcgtctacgtgatgtttgccgtgaaggcacatcactagacaatttatcagcgtcctctgcagttagctgccctgcatcgtttctgctagttcaaaaaagtgtgtaacagtttccgcgcgtccgttcaagccttgcatatttcagcactgggcagactggtagaattgtgctctactcgattggtatcatttcctcaccattggccaggcctgcaacggataggatctcctctccagggagagtgttgtgtgcatgcagcaggctgtgtggcatagggtttaatggttgcaaaatgtcttgatcaacaatttccatttcagcgatcaccaagttgggctgtcatttccgggcctacattgtttgcagctttttcattcagtttattgcatgccttgccggttaatgttcctggcacctctttgggaggattgttatctgagcaatgccgttgatgcaaaaaatcggcagaggcaactcctcgttaggcgtggagtcgtataagttcctcaaatgacggtactgccaatactagtt

SEQ ID NO: 7170 - DNA, 348 bp, Triticum aestivum
  Clone ID: PAT_TA_7170
gcactctactgccgggacaaattaatgcggcattaatcttgacacttgacagggcacgatgattagtcactcactgcagctactacactagtctagcactggtggtagtactaaggattaaagcaagacaagaaagataatgaaccttcaaacagcggcgcctagctagaattagagtgggggtacaaatatgccctcggtccggtaccacgatgtacggcacggccgctgcgggggaggcatgcgggggatcaggggggtcgtttacaccacctgcttgctcacaactggctgacagtgcattaattaaatctaaagccctggcgattattagaactcggtactcat

SEQ ID NO: 7171 - DNA, 532 bp, Triticum aestivum
  Clone ID: PAT_TA_7171
gcgtgctttattttcagaccgatcgggcgtgagtgcgtcacgcaggcggacggagaaggctagtcagccctctaatcccccaacccatccgccgccgccggcggcgaccaccaccggagctctccaatccctaccgccagccgcccgcaccggcctcgatctctcctcagaggcaatctcttgcagaacctatggacagttctaaatctccccaaccattgaagaagagccgtactagtttgtctggtacggatggccaccaatttgagaatgacgagcttccgtctgaaactgcatcagataaaacgcctggtttgaagtttgaaacagtagataaagcgcaagatgaatttggagaagacagttccccattgcagcaatcagctgcttccaacgtgtcataccgtggatcgccatgtattggggcattcactatccaatgtgctaggtgcttcaaatggagacttattccaacgaaagagaagtatgaagaaatacgcgagcatattatacaggaaccttttgactgcga

SEQ ID NO: 7172 - DNA, 1591 bp, Triticum aestivum
  Clone ID: PAT_TA_7172
ctcgggccccgcgtcacgcagccggccggctccagggcgacacagacgtctagggaccccgctagtccgccctctactcccccaacccacccccggccgccggcggcgacctcccccgagcctcccaaaccccccccgcactctccccgaacgggcttcgacccttctaatgaggaagttgctgcaggaactttggtacagtaccaattgtccccaccaattcaaaaaaaccggtactggtttgcctggctagggatgcccagcactgatggacacaagttctcgagtcaaagaactgcatcataaaatgactcgtggttagacggttgcagtagataaagaaagagcagaatgagcttggagaagatagtgccaacatccatgcacttagctgcacgcaatctggcatagagggggctgacatgtggaggggcattcacctatgccatgtactatgcactttaaactgacccactcattcgagacgaatgagaaatataaagagaatattgaacataaattataggaacgattagactgcgacagttcgagtggttggaaacctcatgaaacgtgcgatgatgaagaagacattgatcacgatggaagctgactcgaggctatcgacaaacccgatattgcacagcctcctgctggaatgggaaacgcagattttggaaaagaggataaggaggcaccgtgtttgcggatgtgaacttcacttctccgactgcgaggaatctgagttcactggtttgaagttgatcggtacctccgaagagaatcctgagtatggtgcgcagggtgtaacattagctcagttttccttccagattcctagacctctgcggcagaactatgtcaaaaagcgccctaagaacgcaagtccaagtgatgaagcaacaactaagcctcttcaaccagtggaagttaaccccatatcctgggctgcccctcttgcaagtgaggctaaggcaagtgaaccagcttctcatgccgacgaaaagccagttggatcagcagatgtggagctggtccggaagaggaaagcagaaccaggagagtcaaatgctaacaaccatgtgtctgatgggccggaaaccaagctagaggatgctcagaatggagatgctaccaccactgcctgaaaagctgcagtctgacgtacccagtgctccgcatcgatgatttcctcgactctctattccttctccattgtatgcgggagctggttttttctgtaatgcgagtccgtaatggccttatatgtgtaccgaggcacgaaccttcgaggtcgaccaaaattcgacgatttgggacagtaagttgactgaatgttgtagtatcggggaagccctgtcgaaccctttcggagcatgtatgttcccctacgtgcttatgtaggagaccttgtcgtgcaagattagatgccttttattttctgctttgtaagatacagagatgtcggtagggaactgttgtgttgtgctgtatgtcggagtcgactcttctattatctatcgagacatgccagttgtagcaaaaaaaacaaaaaaaaaaaaaaaaaaaaactcgagactagcggcacgag

SEQ ID NO: 7173 - DNA, 769 bp, Triticum aestivum
  unsure (1)..(769): unsure at all n locations
  Clone ID: PAT_TA_7173
cgactttattgtngctattgtcaggaatgtttctgttgcctttctgcatacaatcaccaaatgatttgcaagatcattaacatccgtaggatggatagtgtttgctagcggagacctatagaccattttagatctactctgataaccaatacagccttcaagtccactagaagaagcaacttgtgaagcatccaagtggttagcctctggaccaagggggtcttctgggtgtctttttctgcgtacaggtgaatatttatacccagaggatccaatggcaccattcagagtgacgttagctgcttgctgaatgttatttttatcagatgcattatccccttgaattatagcctgtagctcctcacttccttcgaagttcttgcaatccatacaatttacaattcttggaacaaaggatatttgcttgaaagcattcacagtacttcttgagacaccctgattttttgcagtgacaacctttattatgttttggaactgaaggtgctccagcatcctttcgaacactaagagcacttggaacgttttcaatcttaggttgaaaagcctttggattccgtagcttagtactgttaatagcctcctgcctagcatgttcattctcaactttatttccacattgtttacaattgcagccgtcgcaataaagtcctgctgcaaaacactcacagtacagctttagacagtgtgagtttttgcaattgcgctcccgcggtctctttggtggagtaacactcttaatttcgaccag

SEQ ID NO: 7174 - DNA, 462 bp, Triticum aestivum
  Clone ID: PAT_TA_7174
ttttttttttctctcgccatggctaacaggctatcatccttcacgactccttcataacatggtaggaaccagttggactaactacttctcattcgatgccgatcctctgctcgagaattcggcaaattcgtctgctcaggccggtgatcacacgagtctgaatctaaatgctagtgcgaatacaatacgatgctggctgcggcacctacatgttctgaaactcggacagattcaagaacatctcgacgaactcagcgtcgtactccgtgtcatccccgccggcagcgtagccgtagctgccggcaagctggcaccaggggctccccggcgtgtagcagctggccggcgaggaggggaaggggggcggcgtcacgggctctaccggccactgaatcccttcctctggtgaagtctcctgctgctggtgctccagggcgaaggcagcaggaggctgctgctccc

SEQ ID NO: 7175 - DNA, 318 bp, Triticum aestivum
  Clone ID: PAT_TA_7175
ttttttttttttttttttttttttttttttggaaaagaacaatctggttaaatacgagcgaatacagctaataatgcggatcaatttgctaacgctcaatcgattcatagtgcacagtgatcaatttgctaatgcttaacatctggtcaaatacgagaggatacagcttcacgcggatctttgcataactggagatacatattaaaaccaaaatcagatctcgcgaaattagactcagacttgaaatgaactcgttgatgcaagaaggctaccaaatctcgcgcaggctcaaacaccaaatccgggcgacgcgaggaa

SEQ ID NO: 7176 - DNA, 577 bp, Triticum aestivum
  Clone ID: PAT_TA_7176
tttaggataaggataaatttttttttttatctgcccgcaccaagagctacaaaaacagcatctgttttcagcagcacagctataaaatacagcatctaacatgtctaaacaaatataacatcacaccaagaagaccacatttgctctaacaaatgaacagaaaaaagaagactggttcttttaaagtaatcatactttcgtatcttcccacacaaatacatatgttctttcttctgttcccagcagaggactgtgtttattcatcgttcctaataggtgctcctctccctatcccaagctccacaaagtaagcctccctcttcttcaagaaacaatctcagtttcatccctgccagtttaaagaaactcacctcagttggatgtccttcaccaacagtaagctcaggaggaaagatttcagcttttggctgctagtcacaggaggatggccccttgcatttcgttgcttctctcccatggatggccccacacatttctgggccatacttataagcccttggcccctcattctcaatgccatgaaacgcgttcagttcagcaaactgaggatgtaatg

SEQ ID NO: 7177 - DNA, 1121 bp, Triticum aestivum
  Clone ID: PAT_TA_7177
cggacgcgtgggcggacgcatgggttttttttttttttttttttttttttttttttacatgttatttttttattttgaacattttttggggatgcatatttttaattgaacaaccagaaattgaaacttatgaaacaaacggaaaagaggaacacgcttaacaaatatgaactctgaaagatcccagggacaaactaaaatgtcagtgagttacagttgctactaggaaaaggctgaaacatcaagcaattctaggttgcttccaacactagatttatttggatgaagcaatagtgtgcaacggcgttcgtggatttcatactctcttacccatgcatcccggcaaaagggcggcttaggattccttggcgtagtcaaagacggcaatgaagggcatgagaacagatcctatccagagcttgccatccttctcctccacctcgctaacagctctcaccacctgccctttagtgtcctccaagatgtcaagcacctcgccttcagggctgtacttgatgatgagcgcgtgcaggttgccgccgatttgcatcaggtagtgatacttggcggggatcgggaggctgagcaagaactttctgagctggacgcggcgactcaagagccgggcgtatgcgctgcgtcggcaatggattgctacccagaattcgcccttgtcgttggtcctcacgttgtctgggaacccaggcaggatggcgaagagatcgacggttcctgccttctcacctttcagccagtacctgctcaaccttccacgagacccttcacagaagacgaagaacgacccgtccttgcttaagctcaccccattgggaaattggaggttgcggtgaagaaccgtcgtctcctttgtttggggattgtatttcaagagcctcccagaggcatctccagagaaaaccaactgcatgaaatgccttctctggtagaggacgctgctgtcggtgaagtagacgttgccgtcggcgtcgaggtcgaggtcgttggtgaagttgaagcgcacgccctcggcctccgtggcgagcggcgttgccagcccgccgtcgggcccgacctggagaggccgaagtaggcgtggagcgatgtagaggtctcgtgccgaa

SEQ ID NO: 7178 - DNA, 323 bp, Triticum aestivum
  Clone ID: PAT_TA_7178
ccaaacagaatgacaaacttggattacccaaagcagctcatacattaagaaacattcatccttttctaccagtgttgccagagtacataggtgaaaaagatagctcgcggcttcgtaattagtagcgctcgtaaataatatcaataataatacaattacaacgtataactgtctgatcagacgacaagctaaaaacaaaacttgcagggcctagtggtgcttgttcagatcaattgttgaggggtttcctcaacacgtttgcagggtgacgctccatgtttggggaagcccaggcgtgctggatgatgtgcgggctgtctttc

SEQ ID NO: 7179 - DNA, 1183 bp, Triticum aestivum
  Clone ID: PAT_TA_7179
tttttttttaagtatgccttggattaccaaaagcagctcgtgcgttacggggaaaacatgatatggaatacatccttttctactagtgttgccagagtacatgagtgaaaaagatatctcatgtcttcgtaatgagtagcgctcgtaaataaacaatacaattacagatgtataactgagtcaacaagctaaaaacaaaacttgcagggctacagaggtgcaagttatagttaattgtttcgtaattactacaactcctaaataagattaataataaaacatttacaaagcctaactgtgttggatgatgacgagcctaactttatatgtgctcaacctcattgctggagtaaagcccattccaccacccgattgccatcctcttttgggcatcatcagcaccattttctgcaccaaggatgcaagtgaaaagatccctcgacccaaattaattgaggaagtaccatgaacggctgctaacatagctcacatcaacagtactcaggtctatcccattttgcagcattcccctgaatcgttgagtcaatgggaaggggattttggctgcaacaaaaccggaaaagaagaagttcacccatgcaaatgtaagtgtctgtggaactatcatggagagattcttcttcatcatatccatggccatgtttgggtccgaaaacatagccgcctgagccttctgggcatcctctttaggaacatgaagcaatccggcttccccgttggtgtaataaagcttgcgagccttgaaggccttggccgggatgaactgcgcgccgttcctcaggttcctcgccctgatgacgacctgcccctccttgacggtcttggggtcgggggagggggaggccgacggcggggagcgcatgagcttggagacgaagtagcggagcacgccgatgagcaccatgaccacggagagcgggatgaggacccagtcccggatcgccgtgtccagcaccagctcctcagccatcggggccgggcggggtgactagctacgtcctacctggggcggcgagccggcgaccggcgacgcggcggtggcgtcgcgagggggaggacacgggacgagaggggagagctcgtcgtcgacgtgggtggatgggccgaggcggaggaaccgaagggcccacgcgtccggacgcgcgtgggcgcacgcgtgggt

SEQ ID NO: 7180 - DNA, 744 bp, Triticum aestivum
  unsure (1)..(744): unsure at all n locations
  Clone ID: PAT_TA_7180
taaacattagnaaaaaattgagcaaaccccacaatagaaagcctgtatactacattctcgcttactacttgcacttgcattcaacgtacatccaagttcagaataccaccgctgaaacaatacttttgaaaattatcttcagcgaggacgagccaaccatgttgtccctaagttgctgggctattgtttcttgctcatttttggtccttggaaacaagcctcctaccagattaggcagtgcgtccattgcctcgcaatccttgcatggctcatcatcttctttcaaaataacagttttcaagtttggtgctcgatccatcacctcacgtacaaataacatatgttgctccatgaggggactaaagttggtcacatgaagctctctgagtttccacttgttacagcttgtgaacccagccaccttccaagaaggtttcactctttgaatgccaacgcgctcccaatatagtaccangacatggatgttcaaacacctcaatatcaaatatctcaacacttggagcagcttcaaggagatttattgtccataacaggtcaaactcaacatatatgccatgaatagacagcttccttaggttgctgaatgcggcccggagttgcttgctttccggcaggatccaaagcttttctccttggaaatttaaggtcagggtatgaatttctgtggcaccatctaaaagctggcttaaactaaaccccttggctcaaggtctgctcgtgccg

SEQ ID NO: 7181 - DNA, 781 bp, Triticum aestivum
  Clone ID: PAT_TA_7181
cggccgctcaggctgcgagaaaacgacagaagggcgcccaagcgtcggcaagcaaaagcagtagcaacaatggagagacgtaacggcgtgagcgtgagccttgttcttggcacatgctcacccgcagcggcgtgagcctgagccctgggcttgcctcctgctcgccaccaccgttgcttgccatggtgcgagggacatcccagcaactgagcccgagtcctaccgtccccagaacgtctttgggttcggtggtttctaccctggcccgtccgtcaactgggtgtttccggggccaaacggcgtcacgccacgggctctgcactagtggctcgtccggcagcagtggcgtggtcggcattcatggtgctgccaatccctgatcgtgttgttgtctgtcttggtgtcttgatgtttaagattgctctttagagccatgcaggtgcagcattctaccgtggtggtagagagtaagcttcttgcttgctctagtttagcagtattgtgttatggcttatgtgtgtgttgttttcaagtgatctgtgtcccgtgtctttgtaaaagacttgttcttggctgttatttaaccttgtgtacttcttagatgttgtattgctgtcgtgggttcgaagtccctttgctgtatctttgatttggagagtgagggtttgaacccatgagctggatctccgcagcctgggcctgtcttccctggcgcggctcctctaagtatttccatcattcttctcaaaaaaaaaaaaaaaaaaaaaaaaaaaaaaaaaaa

SEQ ID NO: 7182 - DNA, 914 bp, Triticum aestivum
  unsure (1)..(914): unsure at all n locations
  Clone ID: PAT_TA_7182
catataatagttnacatttcattacaaataattttagcaacttaaatagtcattacaaatacaatatttcattacaaataagttccagcacacaaactagttcaacaaagtacaataattcatcacgacgagctaaatgacatagtagttactacatattttgaccttgcaaatggttttgtcggtcttcccacatttgatcagcaactccttgcctaaaattaaccatgtatgcatgttcatgtgcttgaccacttgatgatgaagcatgagtaatatttggcacccattcatcctcgggtatgatatattcatctatcccatcatttataacccaattgtgaataatgcaacaagccacaacaatgtcaacttgtgttggaaacagaaagaatggagtggcatcatcaagtatcttgaatcttctcttcaatgacccaaatgcacgttctacagtcacgcgaagagaagaatgccctaaggttgaacagctccctctcattttgcacaggggttgtttccccactcattgcaagtggtacctcacaccacgaaaaggaggcaaaaaaccacgtttagctccatatccagcatcaactagataaaatttcccttgtgggacacgtagaccgtttcctcgttctatagctgcacgccccactggtgcgtcatgtgttgttagttcatctattaccttgtgggacacgtagaccattttcacgttctaaagcgtcacgtaaaactagagcatcatgtgctgtcccctcccacccggccaacacatatgtgaatcgaagatcaaaatctacagccgccatcacattttgagtggcataagtctttctaccacgaaaggaagcctccatatccggtgtaacagaggctcgcacatgtgtacctgcccgggcggccgc

SEQ ID NO: 7183 - DNA, 559 bp, Triticum aestivum
  Clone ID: PAT_TA_7183
tcgtagtaataaattagagatgcagcacactacattatacagttatttgacatacaaatacagttagcaatagcagctaccatatccaatccaagaccatcactacaaacttgacacacatcacgacaatactaataaacgtccttgtgaattctgaagcgataaggcgtcccagctgcagcagtgaatcccctcacgcttaatagcatagggaatagttttactgaaattcctaacactggatatcgctactgcagctgcgatctgaaattgggaggaaattaggaggactggtccgctctgaaaattacagtccagaaacaaataccaagatgaacatcacactgaaacaacagatctcacacatccggcagcctttcctgactttagttttgcttggtaggatgctgcctgcacattccctctgcagcttcattttctggagaggcctaaagctcttgaactataatcccatcagggtcaccgagtcttcctctaaggttgctgggttgccaacccattaattggggatgtgtatattgggggatgtgctgaatct

SEQ ID NO: 7184 - DNA, 775 bp, Triticum aestivum
  unsure (1)..(775): unsure at all n locations
  Clone ID: PAT_TA_7184
ttgcatccgagccgtgtggtgttcggctcgtgtgcggcttggttggtttctacagtacctatccacacgacctactctggcggcctacgtggcttggctatgtgccctgagcatatgccctgccattttttttcctggccgttccttacctggctcctccatatgtcgctcctaccccagtctctcttaccccagaaactcgtacagaagcaacccgaacgaccacgacccaagccgccgtggcccaagcccacggcccccgcccccccagcccagcgccccctacctcgccgccgagtaccatgccgcggagacccccaactgtggttccgccgaaggccggtgcggagaagcccagacctgcggcgctgtctccggccgctgggtcctggtacgctgggtcctggtacgctgtgttgttctaccccgggtcgcccgtccccgcgtctccgttccctgcgttgctgctcgcggtgttgccgcttgcggtgtcggcagttgctgggcccgcggcagcttgccgcccggcggctagctcccgcccggcgggtcccgcccccggcgctccggctgccagcgctgtgggggctagtcctgtggcgctgcgtcccgggtctctgcttttcgggtccccattcgcggtgccccctttggcgatcccacttatgaagatcagagagaaaataaaagcaatccatccatgtgcgatttgatacgggggcacaagagcaaacaacaatttccaaggtgcgatgattgagttncaacatattaa

SEQ ID NO: 7185 - DNA, 677 bp, Triticum aestivum
  Clone ID: PAT_TA_7185
tatcttgtgcttagccccttgctgcccgggtgctcacttcggttctgagcctgacggtggatcaagtatccaagcataaaaaacgcactactaacatctgaacttaaacaataataacaagaaagacaagcaaaatgtttcagccatgttgccaatttcgttgagtcgagtgctgtccaaaagacgccattgccacctgataacttgatatattactcccctactctggttctagtttcctctggttctcgttcctcaatctcgtctcacagctggagttgctgcagctcttctttcacgccatcttcagtctcctttgcagaacctgagcagagagcttgtggcagctgccaagcgtgaacgaaacgggtggtgacgtgttccctaggtggctgaaccagctcgtagacctcacactccacaaccttgcgagcacgcacgtccacgccgaacaggtgctcgtccagaaagaagtagaccacgtcggggttcgtaggatggatgagcgcaagcacggggatcttccttggcaggccagtcgccttgtagctcgcgtcgtcccagatctccgcaaaggtggcctcagactccagcgtccactccgtggagtccggatcagcgagcgtccagacgctgatctgaacagagccgccgctgttaaggttcctgtacatatc

SEQ ID NO: 7186 - DNA, 1711 bp, Triticum aestivum
  Clone ID: PAT_TA_7186
attccaccatcgtcttctgccgtccctctccctcccggggactctgccctccccctccctcccgggggttttgcccggcggcctcccccaccccctctgctctcgcccttgccgtggcctggcccccgctcgaaaatggcggaggtggacgacgtcaggcaacaggatggaagcgcagctgcgcgtccacgcgggggaggacgacgccgatctcccgctccccgccctctttgacagagcgtcccacctccactcgctcgcctccacgctcctccctcgaccaggaagggatccggaagggggtcgacctgctgcggcgctgcgacgacatggtcagcaagctcggcgctcttctcctccaacgaggacccaaggaagacgtctccacccggcaaatctcaagtacctgctccgtgtccgtacctaccttggggaaatgactgagcaagtggagcaggaggaccggattccggtcctcaaggcatcgcaggaccatttgaaggagttcatttctgtatgtgaagcattggagcttattccagaggacgagcttcaattatataggcaggggcagtctgaaacaggggcaaaccgaagagcacaaaaggttgccaggttcaagcggcaaaaggctgcagaaacgaagctccaagagatcaaagagagaaaggaaaggcgcgggcgttcattgagagcaacggctttatcagcacctattgaagccggggaagaagatgatttggaggccgatggagaggaagaaagggaggcttggcttgctactatctccttggctctctgcaaggcttttgatctcgttgacatgttaaagaaggaagaagagatgcttctggctgtaaaagaaagaaaagaaaaggatggaaatgcatttgctcgagaaatgctagatgagcgcaggcaaaaggctgaagcatggcaccagaatgctgccagccgtgcaccatattccaaaccagctgctccaatcacttgtgcaacttttgctcaagatgtcattgaaggcagagcaagtgtttcacaagctcatgaccacaaacaccaacccctgatatttggacctgcaagtcttgttggtgggggactcaccagtgagagggaaagaatggcagcacaagtttttcagcctagtttcaggatgccgacaatgagcatcgaacaagccggcttagctgaaatgaaaatgatggagcaatggcaagaaagaactgccaagatgattcaagaggcaagctcctcttggcacaaggatgacactagtttggcgcaggacgacgaggacgcagaagaggagaaagcaagggcatttgatgactggaaggatgaaaacccacgcggtgcaggcaacaagaagctcactccctgcggctaaattgaaagctattgacactgctgaagataccacatgtagctgatgttcatatactattataacgtttctgttatttcccctcacgtttgcaagagtgatcaccagagtacattatttgtagaaatgttgtgcaagtgcactatttcatccatatccccctttttcaggtgccaaaaaaaaaaaaaaactcgtgcccgtgcccatcatgaatcaactacttcctccgttcccgaatatttgtctttttagagatttcaaatggactaccatatacggatgtatttagacatatttttagaatgtagattcactatttgctcc

SEQ ID NO: 7187 - DNA, 670 bp, Triticum aestivum
  Clone ID: PAT_TA_7187
tcggcacgaggcttgctcagtactactatcaccatctcaaatctcggcttgtccccctcgctccccggcctcggccgcccgcccgctcgcccccccccccatccctgccccgcccgcccccggatccaggagccggccgccaacagcaatggcgtccctcctggagatcttcgtgggatcctgttcctcctcggcgccgccggtggactgggaggcggaggcctacccggagtacgccgactacgccgtcctccccctgctcctcgccttcttccccgccctgcgcctcctcctcaaccagttcctcttcgaggtgttagcaagacgacttatatttggaaagggatatgacaagcttgctgaaacagatgaaaggagaaagaaaatcaataaatttaaggaatcggcatggaaatttgtttattatctttctgcagaactcttttcactatctgtaacatacaatgaatcgtggtttacaaatacaagatacttttgggtagggcctggcgagcagctgtggcctgaccaaaagatgaagctgaagcttaaggctgtatacatgtatgccgctggattttacgtatattctatctttgatcttctgttctgggaaacaagacgcaaggacttcggagtcatgatgtctcaccatgtggcaactattgtt

SEQ ID NO: 7188 - DNA, 672 bp, Triticum aestivum
  Clone ID: PAT_TA_7188
cctatgtccaaatcgcacatttgttagcaagacaacaataagtcatgcacaaccagtactaggtattaaattattaacactgacatctatacctctaagaaatcacattgaactcatgaggcaaatgtcccttccgatccctcattttttggaattgtatcatgatctggtcatcatgaatgcttctaaatatctctttatcacagtagcaaaccatgaaattccaacatatcaaccaaagcttctttaattccagcagatgtacaatctgtgatgtgcttaatggcaaggaatctctcttggagcaccccgtgatcatctagaaatctcacaatcaccgccatttgctcctttattgagcaatctctagcctcatcaataagtattgagaatttcttatctccaatgtcattcttaataactttggttacctccattgcacaagcagcagcaaggtccttttggatgtcagaacaaatcatttgtgcatttccagcccccttatcaaatgcccccttcacatcttccggctggtgctggtaccagtccaacaactctctaaaattgcccttattgatggaagtggaggattcatcatgcccacgaaaagcttcaccttgtgctatgagataccttgcacaatccaatgatgcagttaggcggattttataa

SEQ ID NO: 7189 - DNA, 710 bp, Triticum aestivum
  unsure (1)..(710): unsure at all n locations
  Clone ID: PAT_TA_7189
cacgttgtctttctattgactcgagnagaagagaaagcatgcaaggagagataccgacgattatgttcgaaaccctatgaagcgataaccaaagagtacactttgggcgctacctttgcctcggcctgggcggcataagtgatgtcgcgacatgaccctttgcgtctcggccggggtacaactgccttccacgcgattccagtctcccgcccggcattggtcccggcaggccccctcatcctttcccattcccatgcatgttccgggagaggaccttgctgggtgagatcagacgtcggccttgtgctcccgggcggtgcgtgaactcgaagtcgacgtgcacggaaggcgcgctccacctccggcagctgctccagcttctcctgcagcgcctccccgatgtcgtgcgcctggcttgagcggcatgtcgcccggggagcaccacgtcccacctccacgaagtagtgcgtcccgaaggtgtatgccctcaccgtgtcgatgtgccggatctcctcgtggtggttccagatcaggtaggtgagcttggtcaggtactccgccggcgccgacctcccgatcagcgtgcccacgttctccagcaccgtccgcgcccacgtcgtgatcgtgtacagcgcgatcagtatggcgccgacggggtccatccaccacttgtacttgacggcgagcagcgcgctgacgaggccgacgga

SEQ ID NO: 7190 - DNA, 634 bp, Triticum aestivum
  Clone ID: PAT_TA_7190
caaagatgacgtggtcactcatatcttgtctggtttgggcgctggcttctttgctgtttgtgttggttctccggtcgatgtggttaagtcaagaatgatgggtgactctgcctacaagaacactattgattgttttgtgaagaccctgaagaatgatggacctctggcattttacaaaggcttccttccaaactttgctagactgggatcatggaatgtgatcatgttcttgacactggagcaggttcagaaggcctttgtgagaaagcctgcaaattaaagatgagatgatatgggttttgtagaaggtggtatacaacaagaatgtgcgcgcatttgttttctcctacataagacgttaacccttgggagttgtggtacaaaggacaaatttgacacctcaactgtgagaaactataataaatttttgtcggtcttgacaggaccttaaacaaatgctgaggtagttcggagatgtcaaaagtgttgttaaatttgtgttggatggatgaacattagctgcagtagatcttgtctgtgacgagccaggaaggcaacaatgtctttgcttggtattctaaaagttgatggtgaaaaaaaaaaaacagaaaaaaaaaaaaaaaaaaggccccta

SEQ ID NO: 7191 - DNA, 588 bp, Triticum aestivum
  Clone ID: PAT_TA_7191
aggctcataggaactgctttgtatacctgttgaatgcaaacgaaagtccaagcaggttgctgattaataggattttttttgtgtgcagggacctctggcattttacaaaggcttccttccaaactttgctagactgggatcatggaatgtgatcatgttcttgacactggagcaggttcagaaggcctttgtgagaaagcctgcaaattaaagatgagatgatatgggttttgtagaaggtggtatacaacaagaatgtgcgcgcatttgttttctcctacataagacgttaacccttgggagttgtggtacaaaggacaaatttgacacctcaactgtgagaaactataataaaattttgtcggtcttgacaggaccttaaacaaatgctgaggtagttcggagatgtcaaaagtgttgttaaatttgtgttggatggatgaacattagctgcagtagatcttgtgtgtgacgatggccaggaaggcaacaatgtctttgcttggtattctaattgttgatggtgtcctgtgttgtctccatcttcgttgcaataagcacactgcctttgtttggttttttaattgt

SEQ ID NO: 7192 - DNA, 1722 bp, Triticum aestivum
  unsure (1)..(1722): unsure at all n locations
  Clone ID: PAT_TA_7192
agtgtgtgacagcacttgtgacagaagaagcgtggacgccgtcgtcttgctcgcggtggtgccggtggtgggcggttgcatccacccgtcagccaagccaagcatggcgccggaccacggctccaaggtcgacatctccttcgccggccgcttcaccgccagcgccatcgccgcctgcttcgccgagatcaccacgatccccctcgacacggccaaggtcaggctgcagctgcagaagaaggccatcgccggggatctcgctgggcccaagtaccgtggcctgctcggcaccgccgccaccatcgccaaggaggaaggcgccgccgcgctctgggcgggccatcgtgccgtggcgccggcgccgggcggttgcatccacccgtcagccaagccaagccaagcatggcgccggaccacggctccaaggtcgacatctccttcgccggccgcttcaccgccagcgccatcgccgcctgcttcgccgagatcaccacgatccccctcgacacggccaaggtcaggctgcagctgcagaagaaggccgtcgccggggatctcgctgggcccaagtaccgtggcctgctcggcaccgccgccaccatcgccaaggaggaaggcgccgccgcgctctggaagggcatcgtccctggcctccaccgccagtgcatctacggcggtctccgcattggtctctatgagccagtcaaatccttctatgttggtgagaaccatgttactgatgtacctttaagaagaaagatacactcatatcttgtcacttttgggcgctggcttctttgctgtctgtgtgggttctccggttgatgtggttaagtcaagaatgatgggtgactctgcctacaagaacactattgattgttttgtgaagaccctaaagaatgatggacctctggcgttttacaaaggcttccttccaaactttgctagactgggatcatggaatgtgatcatgttcttgacactggagcaggttcagaaggcctttgtgagaaagcctgcaaattaaagatgagatgatatgggttttgtagagggtggtatacaacaagaatgtgcgcatttgttttctcctacataagacgttaacccttgggagtttgaggtacaaaggacaaatttgagaccccaactgtgagaaactataataaatttttgtcggtcttgacaggaccttaaacaaatgctgaggtagttcggatatgtcaaagtgttgttaaatttgtgttggatggatgaacattagctgcagtacatcttatctgtgatgatgagccaggaaggcgcactgcctttgcttggtcttctaattagtgatggtgtcctgtgtggcctccatcttcgtggcaatatgcacactccccttccttggtcgtttacccgtcggcgcggccgcgacttcggacaaatttgagacctcaactgtgagaaactataataaaattttgtcggtcttgacaggaccttaaacaaatgctgaagtagttcggagatctcaaagtgttgttaaatttgtgttggatggatgaacattagctgcagtnagatcttgtgtggtgatgatgagccgggaaggcaacaatgtctttgcttggtcttctaattattgatggtgtcctgtgttgcctccttcgttgcaacaagcacactgcctttgcttggttttttagttgtaaaaaaaaaaaaaaaaaaactcgagactac

SEQ ID NO: 7193 - DNA, 834 bp, Triticum aestivum
  unsure (1)..(834): unsure at all n locations
  Clone ID: PAT_TA_7193
cccgcccccgcccccccccgcgtctggcgcccgcccccctggcgaggcccgcgctttcgcgccccgtcccgcagaagttaggcacgggagccccccggaccccgacgttcctcacctcgccacacctcccatccacagttcctcatggtgaaacgccggctctggtggtgctgctggtctttgacttggaggatgcagattcgatcatttcaaaagattcttcaacaccccttttagttgtcgtccctggattaaccagtgattctgatgctgcttatggacaacacttggttcattccatggcaagaaaagggtggaatgttgttgtaagtaaccacaggggtcttggtggtgtgtccattacatcagattgcctctacaatggtggatggacagaggatgtccgagaagttattaattatctccatcgcaagtatccaaaggctccgatgttctgtgttggtacaagcataggtgccaatatcctggtcaagtaccttggagaagaaggtgagagtactcctctggctggtgctgcatctatttgttctccatgggatctggtggtatgtgacagatttatttcccgtaagcttgtgcaacggttttatgacaaagcccttgcgtttggtctaaagggctatgcaaagctacatcaacctgtcttggctcgccttgcaaattgggaaggtattaaaaagtcacgctcctatccgggagtttgacaacaatgcaacttcaattgttgcaaaatatgagactggnggatanctactaccgccngtgcaacaattgccaatttttgttgggaangttcaattcccctgccttgtn

SEQ ID NO: 7194 - DNA, 584 bp, Triticum aestivum
  unsure (1)..(584): unsure at all n locations
  Clone ID: PAT_TA_7194
tcggcacgagggacaaaccctagcctcaccaagccccacagccgcgtcccctccctcctcctccatcctcgttagcagccgccgccattctgcctccctcctctctgtcctacgaccatgctgccgggaggaagctattgttcgtggtgccataccgcagccggggtgctgcacaagaggccaggggccgccgccaccgcgagccatgggacgcccgtcgatgagccttcgggcaggaagcccgcatcgagcacgccatcaacaagccgccaggacgacctactggccggtcccgcgtcgtcgagcaagggccctggttgcaccgtcgtggaggaggcgcaccattaaggagtagcaatgccgtcgaactccctcttcccttctgtctgcaccttccctatgagcttttcttccattcccttgctttgcctctcctcctgctcactctcccttccgtgctcctcagctttctttcgatttgcttgtgcctgcaggtccatggacattgttagaatggttaatttattccagtgtattattttcagagnatcatgtttgtttaagactccatggcaaaaaaaaaa

SEQ ID NO: 7195 - DNA, 589 bp, Triticum aestivum
  Clone ID: PAT_TA_7195
agtcgtatatctctcgctcacagtttacattagcctcgatgggcttatatcgagggagtacagagggagagagagagagtacaacggcacccatggcatgcagggcgtgcgggcgcacgtaggcgcatgaagtgcgtggacagtttggcctagctagagacccggcgaagtgggttagccacctgggagctgctgtagacgtgcggtcgaacagtacccgcgtcttatggtcctttcaggtttggtggctcagtgctctgctgacttgattgatcttccattgcttcctcgcattccttcagaaatctctcaacaccaggatcataagcagtagccgcccgcaggtatttcgcagcctcagatttccgaccttcatttgacagtatacttcctagagcaataaagccttggaaatagcatgctttgttcatcacttgttctggttccttgagctctgttagtctttgcaggagcttgattgccgtctccttatcgccctgatttttgcgcgaaagacccgcactaaagtatgcaagcacaagaagaggatcttgttcttcaatctttggtatagcatgttcaaaacaca

SEQ ID NO: 7196 - DNA, 707 bp, Triticum aestivum
  Clone ID: PAT_TA_7196
acacaacaatagctcaagagtagaagacaatacaaccaacatgaaattaactggaatcgactacatgtttagtgaagctagtaataattcagttcacagtggggatcgacagatggttgatacattactccatgaatacacactcttccaggtcaaatatggccccattttctcagtaccaacttcaacttccgtcggataaaatactagtcagtattacgttgttgatgctaagtaaaacctttctctgacgagcatgtttatctgtctttcttcttactgtcaacgtacggatacttctggtaaatgaatatgcttgtcataacaagtggcagtgccaccaggcaatgcagtgatggcggcttcccatcaaatataaactggagtaatgcagttacgaggagagccgagacaatcacaaaaccctttttaatacctcctgcatatgatgtgacaagaccaacaagaatcccaccgacagcattcattaacactggtatcactgtccataaagtccattcatggaaaaaaccatatattctcagggcttctccgtctggtgactgaaaggtacttgccaacaagcacatactcccaataaatgacatctcgatagtcatcatgtaagatgtatgctttttaacctgagatgcccactgacataacgaagaggccaaaccagacaacccgcacgcgcccgtgccagg

SEQ ID NO: 7197 - DNA, 2702 bp, Triticum aestivum
  Clone ID: PAT_TA_7197
cgtccgcacccgaccacgccttggtcgcgatctccgttcccccgtccccccgcgcccacctctcccaccgttccgccgagctcctccctcccgcccgcctcgattcggaggaggccaaggcgcctagggcggcggcgcgcgggcggccggccggcgccagcgggtcatggaggatctgggcatcgaggccaaggaggccgcggtgcgcgaggtggccaagctgctcccgtcccaggacctcctctcctccatcgcctccatcaaggccgactacctctcgcggcagcagacaaatgatactcaactgagttcaatggtggcagaacaggtcgagcaagctcatgctggcatcgacgctcttgcgatatcccaacaaacaataaacagtctacgtgagaacttcatagatatagacaagttgtgtcaggagtgtcaaacattaatcgagaatcacgacaggatcaagctccttagcaatgcaagaaacaacctgaacacaactttaaaggatgtaggaggtatgatgtctatttctgttgaagcagctgcagcacgtgactccttgagcgatgacaaagagttgattcacacttatgagagattaacagctcttgatggaaagaggcgttttgctttagctgctgctggatctcataaggaagaagttggccgattgagagaatactttgaagatgttgatcgatcatgggaaacatttgaaaagacattatggggacatattgctaacttctttaaactttcaaaagagagccctcagacgttggtccgagctctaagggttgttgaaatgcaagagatcatagaccaacaagttgcagaggaagcagctgaggctgagggtgcaggtgctatggcgacgatagcaaaccaacgtagaacgacaaaaaaaggtgcaggggcagcatctaccccaagaaatagcacccaagagaaatcaaagacccagggaaagggctacaaggataaatgctatgagtgcatagggaaggctgttgaggctcgcttcgacaaattgctcactgagcttgttttctcagaagatatgatggaagctctggaggaagctaaggcaattggagaagagcttggcgatatctatgactatgttgcaccatgttttcctcctagatatgaaattttccagctcctggtaaatctatatactgaaaggttcattcatatgctaagactgctcagtgaaagagcaaatgatattcaaaatataaatatactgaaggtaacaggttgggttgtgcaatatcaagataatcttattggccttggtgtggacgagtctcttgcccaagtttgttcagaaagtggtgcattggatcccctcatgaatatgtatgtagagcgtatgcaggcaacaactaagaaatggtacactaacattttggaggctgataaaacacaaccaccaaagagtacagaggatggaaaactatatacacctgcagctgtagatctattcagaatattgacagagcaagtgcagatagtaagagaaaatagcacagatgtcatgctatatcgtattgctctcgcagttattcaggttatgcttgattttcaagcagctgagaggcaaagccttgaggagccagcttctgatgtcggtctggaaactctgtgcgcattgattaacaacaacctgcgttgctacgaactttcatcagagctaagtagcagcacattggaagcgcttcctccgaactatgctgaacaggttaattttgaagacacttgcaaaggatttcttgaggttgccaaggaggcggtccttcaaactgtcagtgttattttcgaagacccaggtgtgcaggatcttcttgcgaaggtttaccaaaaagactggatggatggaatggtgaccgaatatctggtcgccacgtttgctgattattttggcgatgtgaaactatatattgaagatagatcgttccgaagatttgtggagtcttgcctagaggaaacaattgttgtatatgttgaccatcttctcagtcagaaaaattatataaaagaagaaacggttgagaggatgaggctagatgaagaagtgcttatggatttcttcagagagtacactagtgtgactaaagttgaaaacagagtacgaattctggctgatctgagggagcttgcttcagctgagagtctggatagtttcactctgatttacacaaatattctggaacatcaaccagattgcccgtcggaggttgttgagaagctcgttgcactgcgagaaggcattccacggaaagaagccaaggaggtcgtacaagaatgcaaggagatatacgagaactccctcatagatggcaatcctccaaagtcagggttcgtgtttggtaaattgaagtgcctaacagtaaagaaaggcatatgggggaagcttggacagtgagaatatgctagtactgaacatagtaaatgcacccacaaagaaggatttgttttctattttgctcattcttttgttcatcttttaagcctattggtgttagtctgcgaagcatgagaagttctagaatgtattgtttctatttggttagcaacagggagttttttgtgtaaagatggaaccccaaccccttgttattttcattgcccttgaataaaatgtctagtgatgtacagtgttgaattgttgagtgacatcagctgtgcattat

SEQ ID NO: 7198 - DNA, 1319 bp, Triticum aestivum
  unsure (1)..(1319): unsure at all n locations
  Clone ID: PAT_TA_7198
ggaaccctagccgccgccctctcccactcatcctcctccccgctccccttcctagcggctggcccgaccgccacgcgacgtgggctcctccccaccgtcgaactcaagccgccgctcatcccccgtccccatcgcacctcccctgaagccgccggctggcgctctcccttcaccggaggagttgggtgagaggagcgtgggccgtcgccgtcctcgtgcaccccatgtcgctgccgtcgcctccgcccagtcgggcgccgctcctctgcgccgctttcctcctcctcctcctcgaggccggccaggttcaagcgtgggccgcgtagatagcaaagtggagagctatccgcggcataatcgtgggcgggatgagcgaggaggtctagccatctgcggcgccgtccctgccgtgcctcaatccaggacgagaagctcgtcctcctgctccaccatatgcccgtgtgcagcttgcagatgcagactggggtgttcgtgctgcctctccatcccacaaagtgtttccgcctcagggattggttggacattgctgacccaatatgattctaacttcgcctacatctgtttaggagaagaaatagaggcacgtggacatgtgcaggtttgcttctgaataaatcatgtttgttgcaggttattgtgctttggagttctgatgtatgtatactaactcttgcatggtgtgtgagaacattcccgtggttgtctgcagtaacaaggttgatgtgaagaatgggaaggtttagtagtatgtaatttctgccaaaagcgactacaactttgagaagcccatcctttaccttgcaagcaaactggctaggagtgaatctgccgagcaccggagctgtccctcagatccaaccacaacagttggttgatttatcccgatctacttagccaatttcattgcagggttacttttgcctttgatatttcgaccttctttgtgcttcaattatccaggagtcacggcgggggcggggaaggaacaacagtgacttgcccaaaccccgcatcggnaatggattggcgcggccggcggtaggaagcggccgcgtacaggagcaagacgacgaggaggcgcgcgtcagccatggaggagctgcctgtcgaagcggttgccacggaggagcagaagctacagatcagacggcagtagtgggtcgtcgcgccgtcgacgagaggaagccgggctcctccccaatcctctcctgccgccgagctcgctgccggcgctgctctctccgtcgcgctgccttctactgctgttccaggtccggcggctccggcggcaaggtgtc

SEQ ID NO: 7199 - DNA, 1581 bp, Triticum aestivum
  Clone ID: PAT_TA_7199
attcggcacgagggttgtcctcagtgcaagactagatacaagaggccgaaaggtagcccccgagttccgggagatgaggaggaagaagatgttcctcgcctccgcaatgagttcaactacaagcaagggaatggcaaaggtccagagtggcagccgcaggggcaaggagaagacattgatttgtcttcatcctctcgccatgaacctcatcatcgtattcctcggctcacaagtgggcaacagatgtccggggaaatccctgatgcttcccctgatcgccactctatccgcagcccaacatcaagctatgtcgatccaagtgtcccagttcctgtgaggattgtggacccttcgaaggacttgaactcctatgggcttaacagtgttgactggaaggaaagagttgaaagctggagggttaagcaggacaaaaacatgatgcaggtgaccaataaatatccagatgcaagaggaggaggaggagacatggaaggaactggctcaaatggtgaagatatgcaaatggttgatgatgcacgtctacctctgagccgtatagtgcctattcctgcaaaccagctcaacctttaccggatagtgatcattctccgacttatcatcctgtgcttcttcttccagtatcgtgtcagtcatccagtgcgtgatgcttatggattatggctagtgtctgttatctgtgaaatttggtttgccttgtcttggcttctcgatcagtttccaaaatggtacccaatcaaccgtgaaacataccttgacaggcttgcattgaggtatgatagggagggagagccatgtgggctgtgtcccattgatatctttgtcagtacagtggatccactgaaagaacctccactgatcacatcaaatactgtcctgtccattcttgctgtggattaccctgtcgacaaagtgtcatgctatgtttctgatgatggttcggctatgttgacgtttgagtcactctccgaaactgcagaatttgctaggaagtgggttccattttgcaagaagcacaacattgaaccaagggccccagagttttactttcagcaaaaaatagattacctcaaggacaagatccagccttcttttgtgaaggaaagacgagcaatgaagagagagtatgaagaatttaaaatacgaatcaatgcacttgttgccaaagcccaaaaagtgcctgaagaggggtggaccatggctgatggcaccgcttggcctgggaacaaccctagggaccatcctggcatgattcaggtgttcttggggcacagtggtggccttgacactgatggtaatgagttgccacggcttgtgtatgtctctcgtgaaaagaggccaggtttccagcatcacaagaaggctggtgcaatgaatgcattgattcgtgtgtctgccgtgttgacaaatggtgcctatctttttaatgtggattggatcactacttcaatagcagcaaagctcttaaagaagcaatgtgcttcatgatggatcccgctctaagaaggaaaacttgctatgtccaatttccacaaagatttgatggcattgatttgcacgatc

SEQ ID NO: 7200 - DNA, 1035 bp, Triticum aestivum
  Clone ID: PAT_TA_7200
tggtgtgttcttgtcgcgtgtttttttgcttctgctctgcgcgatggccgcagcactgctcgttggccgttgtaatgtacatgtccttatgttccttttctgcccgcacgctccttctcgcctaccactctgctggccccacacagccgaacgcgcacaacagaacccgaggagcccgcagcaaccttctgcccaacggaaatctacagggtaaatacatcatccgtgtgatgtgcctgcctgctgccacaatgtagcgtgctcgcggccgaggtacaaaacttacaggagacatgggctcctattgtcctagccatcaccttctgaataaagccaggaaagttaagcatttgccttccgacaatcaccattgttgttcctttatatatggttagtgtgatctctactggataagtagattgccatgaacaaaacaactgtgctgaagcagtaggttccgcattcagacataagaggtcaagcgcacctgcagcaggttcgagtgtgggatgctcatcgacacaatcgccctgcggcagttgacctgcccgggcggccgctcgaagtttatgatcaacttcttgaagaaccacgagtccttcctggctttgacgatggggttgtcgatgagatacacggctccagattccttcgcctgcttgatgaatgcgagctccagctcaaggttctgtgtgtaatccaacccgggatcttgaggcgttgagcaactgggtgtttcaggaatcgtgtctactgaaggcgtaaagtccaccaggagaggggcatcgagtgagtagaggctgccgtttggtgcagtgattatctgtccaggggttgaaggctcctcatcggagtcgacatcatcttcactctgtagggacaactctacagcctcccgctgtatgaacttttcaaggccttctatcagaaggcgctcaaatgtgttatggtgctcctgtttcttgtctttgtatccgtatctggcaatacagcgaaacatgtgatagccccttgtacaaacacgctggaaaagaa

SEQ ID NO: 7201 - DNA, 992 bp, Triticum aestivum
  Clone ID: PAT_TA_7201
cgtggaactccatctatccatctatccgcgccgggaagggacgagatcccgccattaaaaaacagcgcgggaccgcgctcccgcgacctcgaggatctcgaatcccgggagaaccatccctgcgccgagctctgatccggcaacaagtggccggcttgattcgattcgactggctgtttgttttacccgccaccactgcctctgcagctcagctcctcggttgttttcttgacgctgccgacgggcggaccgaccgtccatccacccccacctcggggcttaccgtccccccgctgtcgcgtttagattaatcaatgcgggcggggctaatggcgtgcgccagtggacactgactgacctccgcaccacacccacatggcccgtcgtgggagggaaggtgaccaggtgaggtgagcagcgcagaggtgcgtgcgtgcgagaccgccaagggcaacccgccaagaacgagggctccttcctgctccctcctgcatgcactgtgggagaagctgagagactgaggagaggaggagacggtgccggcgagggtctgcggcagcggcggcggccaccatgagctggaggaaagccggaggcgatggaggcgtgtccaagcggtgggccgtgctcctctgcctcgggagcttctgcctcggcctgctcttcaccaacagaatgtggacactgcctgaggcactgaggttccactaccgaatcaaagcgtcgaggaaggcaaagctctagttgctgcagattgtggttcaaaaaaggttcaagaactgcaaaaatataaagatgtgttaccagatcaagatactcatcatgatgtacagacactagataagacaatagcgaccttggagacggaactctcggctgctagaaccctgcaagagtcattgctcaacggttcccctgtttcagaagacttcaaagtttctgagtcgattgggaggagaaagtaccgtatggtcattggcatcaataccgct

SEQ ID NO: 7202 - DNA, 635 bp, Triticum aestivum
  unsure (1)..(635): unsure at all n locations
  Clone ID: PAT_TA_7202
cttgcctttctgtgntnatacttttacaggctactagttagatntacttctgcgtccaataaccacaangtgntctctatatctttcaatcggncaaatgtaattaatcatttcgagcggccgcccgggcaggtacaagattgtgggttttccaaatctatccagatatgagcaagaacattagtattaaccttgtcagcaagtaaccaaccatccactagctccgcccacgctgaactcacttgtcctcctcttcactctcaccagaccagagggagaaagctcacttgcagtcttccacaaggcagtggcgagctggcaaccaatagtcggcgattgtgccttactctggatagcctgaattagcagctcatctagcctaaaatagtgtagtttgttcttcatcacagggtaagaaactgtaatctccccaaaacagcatgttccaccatcctgtacctcggccgcgaccacgctataataagcttgacttcttagttcattgatccacggnacctttgggaaccacagtggcatggtatcttcttttcctccaatggaaatttgtaattgtacgtcaattcttcgccagcatatatacncctctttgcgtaaatgaaaatcttcttgtggnc

SEQ ID NO: 7203 - DNA, 545 bp, Triticum aestivum
  unsure (1)..(545): unsure at all n locations
  Clone ID: PAT_TA_7203
cggacgcgtgggagaacccccaagaccccctcttctcgccccctcaaacctgctagggatggcacgcgccgctgccgccaacctgcgtggcctggtcggcattgcagcggcgggccggaggcgggtgacagcctccgtcgcgacaccccgcgcgtcgcccggcgggcgcggattccgggccgtggcctcaggctccgggggcaggacgactcctgaatcctcctcttcgtcctcgccggctctaccacagctgcagccgcggcgcggcttggagacgagacgagcggtgctgcgtgacttgattagcggcggcttagagagtgaggatggtaagctgagctgtggatattcaagttttaagggaaggagacctactatggaggatcgctacgacgtaaagttcgctaaaatcaagggacagtcagttagtctgtttgctgtatttgatggtcatgcaggaccacttgccgctgaatatctaaaggaatatctgcttgacaaccttatcaagcatcctcagttcctgagnaacccaaagcttgctc

SEQ ID NO: 7204 - DNA, 654 bp, Triticum aestivum
  unsure (1)..(654): unsure at all n locations
  Clone ID: PAT_TA_7204
tcgcaacaagcaaaactacgaatgaaagatcngcacaaattgatgcgtcttcagaacatcatctagtccaaaagatgctcagaccccgcggccgcgacattgcttataacagtctcatagagaaaataaggtagccttcgattcgtgctgaatggaagggggacatcacagtggcgcggtggtgagcagtcaccagaaatggaagcatgtgagctggcttcgaacaaaatctcggaacgtggccaccgccaaatggccgaaattcgtcaagtcctttacgcttcagcctggcggccaggcgccccccccagcccgtaggcgttgatggcgcccccggtccccgcgccgtcctccatcctccggccccccagcccgcgtcgcctgcgttcgtgcgtgtggcgcccacggccccgcatcggcttcgaccccccccctgtccggccggcgtcctggtcgctgccctggctgctccccgccctggccctcctctccctgggctcccccggctgcgcctcggactacgtgctacggttccccccccccgcccctcgccaccctttctccctccccctgggccccccccgcacccccggctgcccgtgctgttatcccatgctaatgtatccagagcgatggcttgctttgagcactcta

SEQ ID NO: 7205 - DNA, 417 bp, Triticum aestivum
  Clone ID: PAT_TA_7205
cgggtgtgtggccacccttactgcccctacaagttctaccacatccggtgcctgaggacgagccagatcgcgctggagaagcagaagaatctggagtgctggtactgcccctcctgcctctgcaggggctgcttcaagaacaaggacgacgaggagatcaccctgtgcgacggctgcgacgaggcctaccacgtgtactgcatgacgcccaagcgcacctgcgtccccaagggccactggtactgcccgctgtgcagcgtgcggcgggcaagggaggggatgcagaggtacgagaagtcgatcctgaagaaacaacaacatataagcgccaagcgtgcgagccagtcggacgacgcttagcctagttgatgatgctattgcttggccaagaagggagtaataagcagagcaacgttt

SEQ ID NO: 7206 - DNA, 857 bp, Triticum aestivum
  Clone ID: PAT_TA_7206
ggttgacccggcccgcaccccccgcgtcgccccgcgcgtccggttgaatggcgagaaggtggcagtaaaaagcttctcggattacgtgcaactgtatatcgactctgcttccaaagaaggaatcaagcttccaagaatttaccaaaaggtaaatgatcgctgggaggtgtgtgtgagtctaagtgaaggccagttccagcaggtcagttttgtaaatggaattgcgaccataaaaggtggaactcacgttgactacgttgcaagccaaattgccagccatgtgatgggtgttgtgaacaagaagaacaagcaggctaacatgaagttgcatatagtgaagggctacctatgggtatttgttaatgcgctcattgacaaccctgcatttgactcacagaccaaagagaccttgacgactcgtcaaggaagctttgggtccacgtgcgagctccctgacgacttccttaagaaggtctctagctcgggtgttgttaccaatcttctttcttgggccgagttcaaactaagcaaggaacttaaaaagactgatggaaccaagaagacaagtattgttggcatccctaagctggaggatgcaaatgacgctggtgggaagaactctgacaagtgcaccttgatccttactgaaggagattcagcaaaggctctagctatggctggcataggtgtagtaggaagggaccactatggcgtgtttcctctcaggggtaaattattaaatgtgagggaagcgagccataagcaattaatggagaatgcagagatccaaaatataaagaaaatattaggtctgcagcatgaaaaaaagtttgatagcacgaaaggcttgagatatg

SEQ ID NO: 7207 - DNA, 727 bp, Triticum aestivum
  Clone ID: PAT_TA_7207
attcggcggacgcgtgggttccaatccgacgatctcgagccccccacatcccgatcgatcccaacccaagcggacgcagccggccatccagccaaccaatcgcgatggccgccgacgaggccaaggcgaagggcaacgcggcgttctcggcgggccgcttcgaggaggcggcgggccacttcggcgacgccgtcgcgctcgcccccgacaaccacgtcctcttctccaaccgctcggcggcctacgcctcgctccaccgctacaaggaggcgctcgccgacgccgagcggaccgtcgcgctcaggcccgactgggccaagggctactcccgcctcggcgccgcgcgcctcgggtcgggggacgccgcgggcgccgtcgaggcctacgagaagggcctcgccctcgacccctccaacgccgccctcaaggacgggctcgcccaaggccgggtcggcggccctcccccgccgcccggcctccggcgccgacgccattggcaagattttccagggccccgacctctggagcaagatcgccgccgaccccaccacgcgcgcctacctcgaccagcccgacttcatgcagatgctgcgcgatctgcagcggaaccccggcaacctcaacaactacctctccgacccccgcatgatgcaggtgctcagcctcatgctcaacgtcaaggtccacaaccagaacaatgacgcctccgagccggcgccggcgccga

SEQ ID NO: 7208 - DNA, 618 bp, Triticum aestivum
  Clone ID: PAT_TA_7208
ttgtttgttctcttgtttgtgtccgttcacgcctgacccaaaagacaaacagaaagaattacatggctttcaagcaaaaaaaaactgggctatcatcgccttctgacatctgtcgtactaatgggccgtctgtctgctgttgctcttacggactgtacagttattatttgcatggcaaaactatgaaatcaaacactgccatgactatttgcaaagcttcgcccgagagacaaacatcttgaatctggtgtaggataggaccaagtgttcgagacgtcagagcccttgtttttttcttaattcagcagatgaaatgtctatgcggaacttctcctctggtatagagataaacatgtccttcaactctgttggaatatttaattcttcaaggaccttgaatactccttcaatctctcgaccaccaaccagaaccgtcgtgcccgcgctctcccacccaagatgttgcgccagcgctctgtcgttctcacctccataatacttaggatttacaagcctagctgcagtgtctgcaccaattataaaagcactgcctgggaaaagttctgctttcttataaaagtatggttggttagatatgatcacattcttccctgcttt

SEQ ID NO: 7209 - DNA, 751 bp, Triticum aestivum
  Clone ID: PAT_TA_7209
atgttgtcacttgttgttaccaaaaggtcaagaaaagaatatttgttctgacatgacagtaggcccagctagtacatacataaaattatatctgtctgactacatacacatatgacatgataatcaccgtctgttttcatagccgattagttagaggtagcagttgagacgacacgccacgcacacaagacagagcacttgcgtcaggtcgggagacgaaggacgacctcggctatgttggtggagttttgggctgcgcttggttggagttaagggcaggacatccgttcagtgcgatgcggccgttgaccttgagccttttggtggcctcaacagcagcatcgggatttggatgcttcctgctgccctctcttcctgcaatgccgatgctgctgcttttgttcctcaaacttgctcgcagtcgcaggcctgaaaacttcggagcagtttcgaggtgcggctgaggtagtagcgttgttcctccaagacgaagaggcacaagaacccaggatatctgagagcctcttggtcttgggaaactctcgctcctccgagctgtcatccgactccacttccacgttcacctgcttatcatgcttgatatccttttcatttgcttttccaattggtggtgttttctccgtagccttaaagaatgctggtaacccaggctcttttttcacctcagccaatttagcaaatccaggaggccttgtaatgttgagagagaacttgattggggactttttct

SEQ ID NO: 7210 - DNA, 690 bp, Triticum aestivum
  Clone ID: PAT_TA_7210
gccggccgggccgggctcacccaatcccttcctccattcccagatcccccaagaactccctctccccgccccacgaagcgcctcccttcccgatggcccgcacgaagcagacggcgaggaagtccaccggcggcaaggcgccgcggaagcagctggcgaccaaggcggcgcgcaagtccgccccggccaccggcggcgtgaagaagccccaccgcttccgccccggcaccgtcgcgctccgcgagatccgcaagtaccagaagagcaccgagctgctcatccgcaagctccccttccagcgcctggtgcgggagatcgcgcaggacttcaagaccgacctccgcttccagagctccgccgtctccgcgctgcaggaggccgccgagtcctacctcgtcgggctcttcgaggacaccaacctttgcgccatccacgccaagcgcgtcaccatcatgcccaaggacatccagctcgctcgccgcatccgtggtgagagggcctagagcgtgtcgagcttcttcggaggtgtagagaatgttagcttctgaacctgtgttgcgtggtggaaacctggtgtcgtggtagtaggattcctcgtttgtgccatggtggctgtgttgtgttcttgtgctgtgcctgatgtaaccatcttgttaccatcagcaatgaaaagttggctatctgttcccg

SEQ ID NO: 7211 - DNA, 798 bp, Triticum aestivum
  Clone ID: PAT_TA_7211
tgtggcggccgctttcgaggccggggcccaggcaccacccccagatcccccaagagctccctctcccccccccacgcccagatcccccaagagatcgcactcccgcaccccaccccaggcactcgccccggtggcacgcagcaagcaaaccggcaggaggtccaggcggcgcgaagcgccgccgcagcagccggcgacgaaggggggccccaagtccgcgccgcccacacccggcgtgaacaagcccccccgcttccgccccggcacccccgcgctccgcgaggtaagctgcccccagaagagcacggggctgctgatccgcaagcccccctgccagcgcctggcgcgggggatcccgcaggacccccggagcgacctccgcgtccagagctccgccgtctccgcgctgcaggaggcggaccaggcctacctcgtcgggctctttgaggacaccaacctctgcgccatccacgccaagcgcgtcaccatcatgcccaaggacatccagctcgcccgccgcatccgtggcgagagggcctagagcgcttcgagcttggttggaggtgtagaggtgttagcttctgaatctgtgttgcgtggtggaaatctggcgttgtggtagtaggattcctctgttcgtgccatcgtggctgtgttatgttcctgttctgtgtctgatgtaaccatcttgttaccatcagcaatgaaaagttggctatcggatctgaaaaaaaaaaaaaaaaaaaaatatacaattcactggccgtcgttttacaacgtcgtgactgggaaaaccct

SEQ ID NO: 7212 - DNA, 840 bp, Triticum aestivum
  Clone ID: PAT_TA_7212
gtagtagaaagcattccaaagtatactactagtagtagtcatacatacatgttgcatgacagtgcaaacaggcaaagagttgactccatattctgtaattacttacacatcaccaagagcaaaaaacgaaggaaagggctgtaatccacacacggtgcaaactagcgacactcggatcgacatacttttgacagattaagtacatacgacatgtagatcgaccggcgcaaccattttcagcatgttctcgggcacccccactccacacatagcctgaggtaggaagaggatgcaacccaaggaaccttctacctggtcaggtagtacactagcatgaagagcgcgacgaatgacgccacgagtgtccccatccatcctcgtgcgacttggtctcgaacaccgtcttgaatttgtccactgttccagagagaaacccccttgaacgaatcgtcattcaccaccccattctgtctcagcatccggttatgagcctccatcctcttcatttatatcacctgatatcctcttgagaatgctgactcccatcttgcaatccatccatagctcgctcattctcatgttcatctatctcatgtgaagaataagctgatgctcggacttccaccttcttcaatgccatcaaagagagcagttctggtgcttcggtagcccctccgcgttcatggcgcccgcacgtcgcggctcggctccctccacggcccccgcggatctccggcggctctgcctctcgatttcgcgccggatcggcggctggctggcgtcggcgtcggcgtcgggggaggaggaggacgggggaactcgtgccgaattcggcacgag

SEQ ID NO: 7213 - DNA, 381 bp, Triticum aestivum
  Clone ID: PAT_TA_7213
tttaaaatattcaattcatgttcactttgcaatagatacaccaacaattacactcttttattcatcacaaaatgccgttgaccaacgcatttattcaacatatatagaagacccattagttttccttgctacaaccattgaaaaaaatactcaagtcaacatacaagttgtggcatgttataaaatatgggcctagttcataagagacttaagttcgatcactctacaaaacactatggaagagcccaagtcttcgatcaccaaaccgacatcaacttccatttaaagaaaatacaatatgtacaaaagccataatatcttcgacttgatacttcccaccatttgaccctagagcttagctcgtgccgaattcggcacgag

SEQ ID NO: 7214 - DNA, 431 bp, Triticum aestivum
  unsure (1)..(431): unsure at all n locations
  Clone ID: PAT_TA_7214
ccccccctttttttttttttttttgatttctttagctcaanttttcatatcaaccaaacccgcgccgactctgcccagctgggagaaccttctctggttgtggctcccagcaaagtttacacaggattgaaggaatggagaactgtatatgttcaggcaatctgggctacacaaaattttgctttgcggaaacttctatcgacatcgcaaagacggacggcactatccctaacagtgcatgcgctctctatcagattaaggctgacagagatcaaataacagacacctcgacagtttaatttctgtgcccaaccccaaagtgaaatcgtcttgcttgtttgtcattgaaagcgtattcaagtctcaaaggtcccagcggggagtccacacggatgccaacaccatacccgcaaccgcttcctggcttccca

SEQ ID NO: 7215 - DNA, 747 bp, Triticum aestivum
  unsure (1)..(747): unsure at all n locations
  Clone ID: PAT_TA_7215
ttttttttttttctaancggagtaatttntnaccgtatcattatatctaaataatntatcatnaatagggatccaaaatgtaggattgaaacctgttgatcattggacagatcaggtggtnncantcttcggaaaaatgtaccttcngcagtttgtttggccgtcataatnggatgttagtcgttcaaatctgcgtcgttgccccccggtgtgcgcgtccgatccggccaacctagcatgtaaggctctagctcaaaagtaaatacgcggccctcggaagcccataacataaatctgtacagaaacctagccctaggccctcgcttgaaatgcggactagtactatgtcaaagcgccttacaaagtttacctttcagagtagccgaggcctttcactccctccagttgcacacttcattgggagtttcaagcgaacatcaacggccagggttgtgtgttgcttgaagtgcgcaagtgtgtttccaccgctttgttgcccggcctcgacatgtgttgatgcataatagttgtttgttggcaaggaagaacgctcgaggaaacatatggtcagcaaagaaacatggcaatcacggccattcagatactctcatcctgtaacttgctcaacggatcattcaaacaagctcaaggactttgatgcttccactagagttggcagccaccaccatattcgaccttcctctccagcaaacgctcgacacaaactgctgattatcatcattggtc

SEQ ID NO: 7216 - DNA, 931 bp, Triticum aestivum
  Clone ID: PAT_TA_7216
gacgctgatggagcttcttaatcagttagatggatttgatgagcttggcaaggtcaagatgatcatggcaacaaaccggcctgatgttcttgacccacgcgtccgcggacgcgtgggtgcgctcctgcgccctggtcgtctcgacagaaagattgagatcccgctaccaaacgagcaatcaagaacagaagtacttaaaattcatgcagccggtatcgccaagcatggagaaatagattatgaagcggttgtgaaactggctgaaggattcaacggggctgatcttcgcaatgtctgcaccgaagctggcatgtctgcaattcgcgcagagcgggactacgtagtccacgaggacttcatgaaggccgtcaggaagctgaatgacgccaagaagctggaatccagcgcccactacagcgcagactttggcaaagactaaggcgtcgtggtcactgatgcaatagcagatcttgcagcaatggagatgccccttctctgtaagcgtgccggagttcagcttcgctgtaggcatcgaagcaactggctgggaagctgaagctgttgctcccttcatgctgtgcagtcaaagtcaaaagaggaccattcaagaattttaaatcagatgctctttgctcgtgcgttcacacctttgttagtacttggtttgggctgtaccattccatgtactttggacaatgtgcttcggaaaaaggttattcttttgttaacctttgagttgtggtttactttgcatacgacatgcgaccatgattgttgggtttaccatctgtgctctatgttgttcattgtcatttgtcaatcaatctctttgcatccaggaattctgaagagatccaaattgtaaaatttctacagttttcctttaaaagtgggatcaaaagaaatttctcttcaaaaaaaaaaaaaaaaa

SEQ ID NO: 7217 - DNA, 552 bp, Triticum aestivum
  unsure (1)..(552): unsure at all n locations
  Clone ID: PAT_TA_7217
gcacgaggctgcgattgcatcatcagatcagattcagaccacatccgccgcacacgcacacgcgcctagagatggagtgagaagcatcaggttgcttccgccgccggccattgccgcctgcccatccatctccaccgccacctccacctccgtcccccgtccgttcgtcatgcgtacaagccatccccacacctgacaacaaccacactccacaaaaccacccccgacccccctccctccctgcattcattcccattcatcttcgatctcccccgagacctcgctttcttgaccgctcgctccgacgcgccgcgccgccccgccgataaagctcgcagcttctccctctctctctctctcgtccccgctcgaatccgcttctccggctcccggattttcttgcaaggattctgtgggctcctgccaatgctcgccggtctgatccgtcctgcttgctgaggcgctcctcgattcggtcctggaacgcgtcgtgctcctgatctgctgctgattcctcgaaatccggtgaaagtccgtccgtccatcctnnnt

SEQ ID NO: 7218 - DNA, 653 bp, Triticum aestivum
  Clone ID: PAT_TA_7218
aatttccttaatatacatacaacaaggggcggaaacaagcagaaaccttggaacaaaatggtttctgtactcgtgactgacattcctaattcacggggatcaaatttgttcccttccctgatttctacaagtcaggctgtcaaatgtactcctctatgaatttctaacgaggaatatgtagtccaaaataggagctcgattactggaagcctgaacttctcaccagattaactagccaactaaacttctactttgtcaatttgacatcactgagtgaatctggttttgtttcagggccaaagcaatcacgggtagtcgaccctattcgaccaggcggccagtaccgggaaatagatcttcccaatatgtcctttgcagggaggggaccccacacatgggaatcataactgttatttcgggttatctccccattacaaaaactgcattttcaggcacttgcactgggttcatgtcataagaaggtggcccaagaatgaattctttcatccctagcctcaccattcacaactagttttcctttatgcacctcaacagtatctccagccctggcaactattcttttgatgaaaacatcattatcagtatacccaacatcctgtagcaccggcgggcttttgaatattacaatatca

SEQ ID NO: 7219 - DNA, 702 bp, Triticum aestivum
  Clone ID: PAT_TA_7219
tccgttgctctccggccccgtgtctggaccttcctgcattgtgcagccacccgccctccccgttcgacgtggaagaagcattttcaaagctcattgctggagaacagctggaggcttaatcctccagctgcagatatctggctcaacccaaagcacatgcttgaaaccatatgtgggtggcattgtttgagcaacctgagtaactgctaagaatatccctcacagcatggagaaaagtatcccggtcatcaatagacccttcttcgatcatgctagacgcggcttcgccaattagatgatattggtccatcaccaggcgactattgacagctaatacgtagctctgcagctccatttctgtagctttcaacaatgaataggcactcgaaatttttgtccgtctttcaagctggcaggctatcgccagagaccgatgagcagcaagctgattcaccaaatgattgatgaaccttttttgctggcttatgtagcattcctggcgatgaacaatcaagttatgatcccctagaagcccattgggcgctccgcgttgcgcctggcgcctccccgcgagcctgttccatttgcgctccgaggcacggcttgttccctcctgccagtactgttgcacccccctgtcgtgccacctcagaacgccggcgcgcttcggaatctccccttggcatgtcttctttggcaaca

SEQ ID NO: 7220 - DNA, 834 bp, Triticum aestivum
  Clone ID: PAT_TA_7220
ttctttttcttgcggaggatcccccccccaggagccccccccgttcccaccgagacccaggatccacacgaaagacgacctctgtcgcaacgggcggatacatgtgcgagcctcgcccagttgtttgctaggcttcaaccaagccacacggctcccgaaaactgggaatagaggcatgaaggtcttctatttgtttgttagctacaaccaagcacagggctaccaaaccttaggtcatcacatctaacaatgagctgctaagctacagatacaggtagcccttacaccagcctctacgggcaacacaataggtcgttcccttgtgaaaccttaagctccatgagaagctcctgcgtgctgccgccccagctccccctgctgggctgcacaccagactccgcgctggctcaggcgtcgaagcttgttgagaatctcaaggtgctgcattccaggttcctcaagttgagcatgacagcgattccactctcacaaaatcttggaatgctgattagcctgacctgctgcttttcccttcctctcaacaaccgagtctcgtatctctcttgattcccgacgaagtaaacatgggggcaggtttcgacctggccagggtccccgtccgtgcttgggcaaccgcctacccggttcggtgcagtcggagcaagatggcgccatttcaatgtcctttccatgaactccagccgatctttggcatccgagtacctgtagaggtcatctatgttctgcccagatgttccaatgaacttgacattgtcaagatcgaattgatgtggattcggacatgatgaaaatgtattataggtggatgctcca

SEQ ID NO: 7221 - DNA, 658 bp, Triticum aestivum
  unsure (1)..(658): unsure at all n locations
  Clone ID: PAT_TA_7221
nngatttctgttctctttttttccagccaaacttaagtagctattgttgtacaatgagaacagtagaacgatatcttcttgtttgagcatcatcatcagacaagtaaaacgtcccatgcgacgaccacacccgatatttacagccatctgaatcaagtcagctcccattacaacacaaaaggatgataaaccacaccctcacctcgtcccgttttacattcccttcactttcccaagaatcaaggatcgacagccagcagccgaagcaattagttcgcaccaaaaaaggaaacaacacatccctcgaaggcatcattacttattccatgccgccttggtcagtataacatctaattctacattgtaggtcttcttcgtggcatttgtacagatcaggcaaaagctcatgtcatctttttcgctacaggatggttatgtctcatcgcccccaatttatcttacattaacttcatgcttcatccttcatatgagtgttatgtagtatatcgccataagaggcaaccactctatccagttgaagaagtgaatttagttggccttcatttacaggttctggcaagggacgcatctgacccatgacaccaggcgtctcactcattcttttcaaaattgttcgaatattgttattcgtgcgtag

SEQ ID NO: 7222 - DNA, 757 bp, Triticum aestivum
  Clone ID: PAT_TA_7222
catagataagcatagattgtttagtcatgaaccaaagacatcctcctccaacaagcgcttaacctgagagcgctaaaaaaactacctctacggctctaccaaccaagcaagttctacaaagaaattaactcggaagcccgcggctataatcatgtaaaccacccgcacatcagcatgatagttttgacttttgatccaactatcaacgacagaatccaacttggaagagtacatttctccagagggcaaaaaaaaaaaagatacacattatgataaagctctgtgccttcagcatgccatcaatcaggacacctttaccttgcatgttggacagtctgcattcctgggaaaaacttctctaacttggcactggagagaaccttgttagggtccagctccatgcgcgccttgttatacgcgtcaacggggaagcgtttccgcaacctagcctgcagttgagcaagttcatccttgtccttcggaacctcaattttagcccagtgttcatatgcagaataatcatcccagagactagtttgcgtcagacttctgtagttgaagaactcctcggtaatatccttcctttggcgaggatccgatgttggtaaatacattattataccaacccatgaaaatatgtcatcttcctcagagcttgaggccggactcatggggctcctgctgtgggcagtccaacgctgctcaataggtgcaggtgcaggtatatcctcctcctcaatcaactgtagcaactcct

SEQ ID NO: 7223 - DNA, 596 bp, Triticum aestivum
  Clone ID: PAT_TA_7223
tttttttttttttttttttttagcagacgatcagaatttagtgaggatatgtacagcatcgtttctgtttacttgcactaacaaaaggaaaggatcctcccaagttgacgcgcagtaacaaaagggtcagagatccattccactcagaggaactgctgcagccagggattactggctgcgtcgttctcgaagtctgatttcagtttggccaccatctccgtagccttgctcccatccacctcatctagaggcaatgcagaaaaatcctccaacaaaaggcgagcccgagcagctcccctcgtcacatcatctgggctaaacaccctcttgcgtttcgatccaacctcgtcactgggttcaccactcaagttaggtgcactggtaaagtcttctaactcttcagctttgctttttgcaagagcaatgacagcttctggaaaattagcaaattccgcaacatggataccaaaactttggtcgcaggaaccaggttcaaccttataaagcatagtcaacttccgacttgatgggtctatatgtgcacccacatgataatttgcaattcccaaatctggaacatgttggcggccgcgtgg

SEQ ID NO: 7224 - DNA, 896 bp, Triticum aestivum
  unsure (1)..(896): unsure at all n locations
  Clone ID: PAT_TA_7224
ttttttttttttggagatgcaacgggtacagcttgcagcattatgctcattggtaaaagattgagaagggcatcgccctggctcttgtaatgtagagcgccgctgtccatcgtaatatacaagggagaataatagtacacttgaagaatctgcaatgacaacgccacacacggacggtcggtcggtgaagagaaacgcgtccttggccctctgatctgatgcttacaaggtgtacaacatactactgccactaaccctttcctcccaagggagcgcgaggcggtgacggcgtcatcagatgttgcatctgtcgtatccggagaaccacgagttgaggtcagtgctcttggtgacctccagtgatccctgctggtgtatggcgtccaactcccccctccattgctgatcatcgccagggctaccaccaaccgagtcatatctgggtgcagagtcgagattgctggatgcggcaggcagaggtgtagcatcgttgtgcttggagtactctgtcaggcgttgatttagcgcgacgatttcatggtcgggggtctccttcaagttctccagctccggtgttgcttccgccctcccctgctctgccatcccggcgcggctctgggcgcctcctcgccctccttcagtcgtaccagcaattcaccagcagcttgaacagcctcagctgtatccttccgctggtcgtgaaggcttttattttctgctctcagaaaagagatttcggcaccaagggagttgaggaaccgtagttcgactcctttgacaccagcttttgcagccctcatcttcacatcttcaaccccatcaaggatctttctgtgcattgcatgcaaaccaatatgcctctcttcannntcagcatattgttccangnnnctagt

SEQ ID NO: 7225 - DNA, 670 bp, Triticum aestivum
  Clone ID: PAT_TA_7225
gttcggttcctacaaggtacatttcaaaacagcaaggaggagtcttgccgttgcttcctgaaacatttttaagctagtaatttcactttacaggctaaggtacagagaaaaacctagtgctgaatttcagggagctatcttctcagagcaaatggaaatttcatcaccgctcttgatagacaacaagcttgttagcggcccaatttgttcagttcaggccagaacacagttagtttcacccaaataattcttcgatccagtgacaaacagtttattctctcctcttttcacatagagcagaaaaactgaaccagaatactagttctcatggacgagcaccagtcagtgctattggtactttcaagtgcatgcagtcgagcgattagatcttttaccttccattgcatccttcttttttctacagccggaacaaagataaggacagctcgatggtgttgacggggcagagcagtaacctcccccattatctgttattaaatcttcgaatggcacttggtccacttgacagattgcacagcgaaatgggggcaaatttgcttttgacagggaattcctaccaaacctttcttccaacgatgcagagccttcttcaaataattcctccacaaatccaaatgaagcagacttttttttgttaccaagctttcca

SEQ ID NO: 7226 - DNA, 1017 bp, Triticum aestivum
  Clone ID: PAT_TA_7226
gttaaggactgttcggtcatgtttgctctacgtgtcacttgtgtgcgcgtgcacaggggaactcaacccacccggcgtaccttgaccattctttcgactcggccagcccagcgtgggcttatcgcctgctggctccctgctgggatctgcgaccttgccttctgtctgagcgccgccggctgctcgcgcgtcagcgcctggaggactcgtccgcccccctcgcttctgtcttggcctttttttatggcgaccccgtctatcctgctgctgctccatccacaccctctcccacttcccgcccgttcgtcctcttcttgtctagtaccgagccaatgtcatcaaatatcatccctactttgggcttcagttcctcgtcacactggggtttgtacaaagaaccctcttgagagaaggattgtttcttcttcggtgtactagattcattaatgagaagcattggggaattaatctctgcaaatgaggtggcatcgctgaaatcttgattttgagcactgttgaccgattccacggctgataatgttggtacacagtttgcgattattggaactgtagactgccctaaaggcgacgttgcactacttccatccatttaagatcgagatgcaatagcagaacaacgggagccgagcttagcactagtcgacaagctccgatctatccatcacaccgagaacgggattaatcttaagacccgagttttcttctctagcgtcggtgggtggccgagctagccgcacatgagtagggggaaactgtggagaatgacggattggggtaggaaaaagtacgaggcgaggtcgacctctgaatgccgagcagagtaccctcaagtgcggcttggaacagggcgagacccgccggggcagcaccgaccgcgtcgagacgaccaagagctggaacggcacctctactggtcgtactcgcccagctaggcaccggatctggacctccgccacggtcggcgaacgataagcgagcggattgcctcgtgccgaa

SEQ ID NO: 7227 - DNA, 1157 bp, Triticum aestivum
  unsure (1)..(1157): unsure at all n locations
  Clone ID: PAT_TA_7227
ttttttttttttaaatactcgagagtacatgcctttggttttttgtgctcgtgtcttcgaagtgtccattgcaagtttgaacattctgtctctatataactatttcttacaacactcatccaaaactgctctctactcatgttttgatacattaaaattacatagttcctgtcaatatctgtttgacccaatcgacagaaggaggtatacaaactttctacaatgtttgtcagctttcaagcccaaataaattagccaaaattagtttcaccgcagccaaaagtcaagcttcatgctatctcgagcacagctttcttagtcctaaaatcaattatctcgggcttcttttgggaagcatttctcgtctccataaccgtaaaggaaaaactnccaagctcgaggtcttcgggagaaaaatttcaacacctcatcaagcaaaattacagggaaggataggtaaagaacaactttccactcagccaaagttaatggggacactgagaaaagagctgacaggggttcaatatacacgacggatacgtgaagaagcatcgtcaggacgatcgacccaacaagccacaggttactccatgggtgaatggcaaggagagattgattttcacttaggttattcagggcattaaacatctcgtcaacaacaagaacagtcattgaaacagttgatggatggcgatcctcaaagatgctgcaaggatatgatgtttgcctggttgaacatgaatcaaaattgaccaattctgagtatggcaacctaggaccatcttcagaataaacaaaccaccaaacgaaccccgctatggtagcaagaccaacgtaggcaccaatgatcaaataacggaaaaagagccatccgttaaccacagcttcattaaccttacgaggcttcactgtcatgatgttgctatcaggcttgttgaaaccaatcgcagttgcaggcaacccatcggtaaccaggtttacccagagtagctggacaggtacaagtgtgtcaggcatcccaagcacagctgccacaaaaatgcatactacctccccaatatttgatgaaatcatgtaccgaatgaactgcttggtgttattatatatggcccttccctctgaaacagctgcaacaatggtagcgaagttgtcatcag

SEQ ID NO: 7228 - DNA, 641 bp, Triticum aestivum
  unsure (1)..(641): unsure at all n locations
  Clone ID: PAT_TA_7228
cttatttggacttattagctccttagtntgcaaatngtacgcagttgcgctattaccacctctactatactctagaggtgcttacagaatccagcagagcaggggcaattaggtccggatgctttgttgttctcatctgaaataacattctgtctcttctgcactaaactcagcagtcaaaaagtctttatcctctatatactccctccgtcccaaaataagcgtctcaactttgcactaactttagtacaaagttgtactaaggttgagacacttattttgggacggaggagtacttaacaccaggaagtggttcaccaatgtccctctccaacaccaaaaggacaatgtctttggatcctcggatctgacatgtccctatgaagaaatcatctccctctggcaaaatcatctccctctggagaaatcatctctcagcgtaggtctcgaacattttgttgaactgcgtgatatgacggaagaacctccctaagtcgacaagtttgggcaaggcgaatggaaaaaagaactctatcaaatagactatatcagtcatgtcatctatttcaagcaccttctcaatgtcaacaagtaactcaggggcatgcacaaagaagttcctgagctcgtaaagtagatca

SEQ ID NO: 7229 - DNA, 768 bp, Triticum aestivum
  Clone ID: PAT_TA_7229
agccagcgccactcgcaccacagtcatccactcacaagctaagctagcggcgcagtagctcacttcagtccagtcggcatggcggctccgaggggcgcggcagtggtgctggcgatggtgctcgcggccatggtggtggcgccgccggcgacggtgcacgcggccatatcctgctccacggtgtacagcacgctgatgccgtgcctgcagtacgtgcagcagggcggttcgccggcccggggctgctgcaccggcatccagaacctgctggcggaggccaacaacagccccgaccgccgcaccatctgcggctgcctcaagaacgtcgccaacggcgcctccggcgggccctacatcacccgcgccgccgcgctcccctccaagtgcaacgtcgccctcccctacaagatcagccccagcgtcgactgcaactcgatccactgaacgaactgaagcgccttggcccgtgtgtcgacgtacgtctgccgtgcgaggagtcccatgtccggagaataaattgctgctactagtactgaagcttagctaggccttggcggccagatccgtgtcgttctacctagtcgtcgtgtgtggttttagggtcgatggatctgtgtgcatgcagtccatggtgttctggcctgggtgtcggtaggctccgcaagcagagcagagtggtgaactgatattgtgtgcgtcgtactatgcgcgtgcctatgtaatgtgcgtgctttatctataaactatccctcgttaagtatctaaaaa

SEQ ID NO: 7230 - DNA, 811 bp, Triticum aestivum
  Clone ID: PAT_TA_7230
gcccacgcgtccggccagcgccactcacacaaactacactcatccactcaagcaaaagctagcggcgtagtagctcacttcagtccagtcggcatggcggctccgaggggtgcggcactggtgctggcgatggtgctcgcggccatggtggtggcgccgccggcgactgtgcacgccatatcctgctccacggtgtacagcacgctgatgccgtgcctgcagtacgtgcagcagggcgggtcgccggcccggggctgctgcaccggcatccagaacctgctggccgaggccaacaacagccccgaccgccgcaccatctgcggctgcctcaagaacgtcgccaacggcgcctccggcgggccctacatcacccgcgccgccgcgctcccctccaagtgcaacgtcgccctcccctacaagatcagccccagcgtcgactgcaactcgatccactgaacgaacctgtcgacgtacgtctgccgtgtgaggagtcccatgtccggagaataaattgctgctactactagtactgaagcttagctaggccttggcggccagatccgtgtcgttctacctagtcgtgtggtgtgtggttttagggtcgatggatctgtgtgtgcacgcagtccatggtgttgtggccggggtgccggtaggttccacgagcagagcagagtggtgaactgatattgtgtgcgccgtactatgtgcgtctctatgtaatgtgcgtgctttatctataaactatccatcgttaaatatcaaaaaaaaaaaaaaaaaaaaataaaaaaaaaaaaaaaaaaggccccta

SEQ ID NO: 7231 - DNA, 1406 bp, Triticum aestivum
  Clone ID: PAT_TA_7231
gcgctcttcccgtgccagcgccactcacccaaacaccccacctacacccatcgactccggcactcacactacactcatccactcacaagctaatctagcggcgtagctcacttcagtccagtcggcatggcggctcccagtggcgcgccacgggtgcgggcgagggtccccgcggagttgctggtgccgccgccggcgacggtgcacgcccagatcctgctccacgggtgttcaggacgctgatgccggggcctgcagtaccggcaccagggcggctcacccgccccgggctgctgcaccggccgtccatggacttgctggcccacgcccacgtccagccctgcccgccgccccgtgtggggctgccggaagaacgaggccaactgcgcgcccggcgggccctagatcagccgcgcagccgcccgcccctccccgtgcaacgtcgccctcccctacaaggtcagccccagcgtcgcctgcaacgcgatccactgaacgaactgcaagcgcccctgggcccgcggcgtctgtctacgaaagtctgccgggtgcggagtcccatgtcctaggaagaagaacttgctggctacctcaagtactgtacgcctaggatagaggcctgagcgccccagatcccttggtggtccaccctaaggtcttgtgcgggggttgagggtcgtatcgtgtccaattatccgctatgcatttccgcggtttagtactcagggttagctgtaggctttcacgagcagagccagagtggtgaactgaagtattgctgggcgttctgtactagcgttcggtgttctagtgggtaatgtgcgtgctttatcttataaagttatgcctcggttcacaaagcaagagcagagtggtgaactgaatattgtgtgcgttcgtactatgcgcgtgtcgtatgtaatgtgcgttgctttatacatataaactatccctcgttgagtaagtccccaggagcatcaattgcaactgggtcagcagcgaccttgccctccgccatgaacgccttggcggtcgtctgcaggttccgcttgagcaagtagtcgtagatatacacatcgagcatcttatccgcttcccaattgctctgcgacctgcccgggcggccgctcccgcggcccggggccccggaaatcccgcggaaatcgggcgacggggcggccggcgggagggccggtaatgctcgatcggcggcggcgcgctggcgggggcaggcgcgccgaattcggagcgggcggccggcgggcgcgcgccccgagcgctggcgagcgggcgggcgagcgagcgagcgggtggctggcctcgggtagcaccaccgcctcggagcaagagaggagaggagtagagtagatgggacaggggagggagacaggcggacgcgtgggtcg

SEQ ID NO: 7232 - DNA, 797 bp, Triticum aestivum
  Clone ID: PAT_TA_7232
ttttttttttttgatcaggaacgagctacgcatttttcgttttattgatgacccaatatacattcagaaactatcaagacacctctctattttctcataacagtttacaccgagatctgcaggattcagaactcggaggcacaaaaaatcatcagggaggacaacagcattcacatcgcaagaagctacttccctagaggcgaggactaatcaatcgtgtgtcgtttccgttctctcttcagaagcatggatcagaaggaggggaagaacttgttgaggttgaagggcagggagtagaactcctcgcttcgcgggtctgtcttgaaagacctgaacctgtcccagaaatggtggccccggtccttcctggcggtgctgtcgtgcctgtgcagggtgctgtccaggagaagggcggtggcgcctccgacgaacgctttcgacgagaacaccacgttgatcatgtcgttgaaccatcttgcgtgcgtgtgtaccgggccaaagcctgcgacggaggtgtactcattgaaatactgtggaactgatatgcccatgaacaaggagaatcccaggatgaattttgttcggaagctgttgaggttgcaaaactgaaggaacccaacccctgccataccaacatatgcaaagagaagacagtatattgctgcaattcttccgcctggaactgagccggagccagcccctacttgcccctgcagaatacataccaacatatgcaaagagaagacagtatatagctgcgattattgggcccggaattgatgcgaaaacagctccaa

SEQ ID NO: 7233 - DNA, 898 bp, Triticum aestivum
  Clone ID: PAT_TA_7233
ccacgcgtccgattttgtatcaaagtgatcaatttttatagaacagttaaagataaagaaatgctcttgaactagagaaatgtatatttcttgtttccgctgcaataaagttgatgatgatgattatttctgagcaaagttgtttaatagaaatactatcatcacattgtttatgagttatatgcattatttccatttccgcccaacggtgatatggaattaatgtagaagaatgagttttattctaattctaccacaacgatgatttagagtataaaaaggaagttttgcaaaagtttaatgtgcatattttttaaccagaccaacgtagggttatttttatgctcattattgttgattattggctaagttttctcagactaaaagttttccatgctttcattcatgaaagcgaatggttggggtactagtgacccgaaagatgaccaagaaaggtcataacgtgagatagtatattctctctaaagaatggtttcaaaagaaaagagatagatcattgagagtcttggttgacgaatgtttttcatgtactctctatgatgtgggtttttccgtccacctggtttgagatgaaacaagcaacatgcgtgtttaatttgaccaacgtcggatcaagcatgtgcgtcaaagagcattcggatttattcctaaatttgatgattgaatatgcaggcaaaagagccaattctgacatttatgttcccttacagggaattacccgcatggagggaaaagatgattatgataaaacccgcatggcgggaaatgtttgggaaaatacctgcgtaacggggtaaagctgacataatattatgtaaaaaatcccgtatggcgggagaaattctggcaagagaaagatacgataactcatgtgctc

SEQ ID NO: 7234 - DNA, 742 bp, Triticum aestivum
  Clone ID: PAT_TA_7234
gtttgaaatgaacggactatattaatttctgaagtgctgtaaaagagctcaattttgaacaaacaatctccacacgcacacgacagcgcacaccacaacgagcggtgcatcactggtttcaaacataagctgcttatttcgcaaaagaagaatgggaaaggacgggggagtgagtacacgaaaagggaaaaacgcactgaagatcggtttgggccggtcacttctgatttttcggtgaggcgccattaccttgggcggcattgtttgagctcggcttgtcttgggctggcgtgttctgggccgtgcttttcttcccaaacccgactggtttttttatgccacggttgtcggctttgccgatggtaatctccagcatcccggccttgagctccgcggtgacgtcctcgctgttgtattccttggtcatgagaagcctgacgtggaaggagcccaccccgtgcacctccaccggcggttcctcgcggccgccggccccggtgcgaggcttcctcttgatttcgagcatgtcctcgccggcggtgatctcgaggtcgtcctccgagagcccgggcacctggagccatatcttgacgtgcttctcctcctccttgatgtcccaccgctccttgctgtccggcggttgcacagggtacagcagggcggtggggggaatgctgaacgccggcagctgtttctccgggtgagcgcggagtaccacagacgtcggccggcagcacttgac

SEQ ID NO: 7235 - DNA, 918 bp, Triticum aestivum
  Clone ID: PAT_TA_7235
ggtcttccttggccaatttcgaggttcggggcagcgctttcccccccaaaacccagagcgggaacatgcaaataacggtagcaccaaactgacttcttacagttcatttgtatagttatggttatgtctgcaacatcctttacaccaccaaactgacttcttacagttcatttgtatagttatggttatgtctgcaacatcctttacatcatcaaccaaataagtatgaaccggaacaaatagaatgcacacatggtgttggtcaaagaaccaatcaccttgctgtaatgacaaacacactggtgacaacaagggctggcgccttgctcaagtcaaaacttcaaagttctaactcaaactttcagagttcccgatcactgcaaccggaataaatcctcagatggaggggccaatggacatggcttcatccaccatttgcttcacactgggcctagcaatgctgaacagtgccaggccattatttgtaatctttccacagccatgtatatgcaagacctcaaggcgcacacatccgtccttgagagcctgcaatccttggtcgcatatgtttctgcaacggttcacatgaagaattcttagcttgttgcagttcaatccaatcgccgaccaaccaggtaagcggacgccatgacagacagcaaggctccactcctcaatcaacggacacccgctagctattgccaccacagaatcatcagtaagattgcggcacatcctcagattcagaactcggagtttcttcatactgccaactccacctaggcaatccagcccagctgaactccttagattatacaaatttatgtactggagtcctccgccaccccttatgcctacccctccctctcctctgcgcttgcaggtctcagctgctcggttggctcggcccgtcctaaa

SEQ ID NO: 7236 - DNA, 862 bp, Triticum aestivum
  unsure (1)..(862): unsure at all n locations
  Clone ID: PAT_TA_7236
gaatcatcggatcagcgagcagagcccgcgttagccttttatctaataaatgcncccgggccagaagtcggggttgccctctgaaaatgagaggacaagtggaggagtttccgtgagaggggaaagcggcggagcagctcagtccctctgaccaccaccatccttcctgcacaatttcttcctcctcgcaccgctactttaccgtagcccggaaagaaagctaaccaaatcccacacctttgctttcccctttcccctccccttttcccctctccccctcggctcccaattgtctcgccctctctcctcgcctctccttcaccacctaccagtccgtgtgcttgaccagagggagggagggagcttgaggttgtctagatccttcttgtttctccaatccggggctgcttagctttcaagctggccgtcgactccaagattgcggaccggcgggcgtttcttcctttccaatactgatataggagcgggctatctgcgaggatgtgagagtttcttttcttgtttcggtggagttgctaggaatcaacagtccgagtgttgcggatgatctggaatcttgactgaggcccccgatttgggatttccttacagccggtgctgcaatctgcattcttcaaggctgttggcggcagatgggttgcaggcactccaaagtggaggacgaggaggcggtgaggagatccagggacaggaggaacctcatgaagcaacttgtgcgccgccgtgtcgaccttgcagccgcacacattacctacctgcatgcactccgcaacacaggagccactctccggcaattcgccgaggtggagactgcatcgtcacaccagtcccttccagccgc

SEQ ID NO: 7237 - DNA, 599 bp, Triticum aestivum
  unsure (1)..(599): unsure at all n locations
  Clone ID: PAT_TA_7237
atgtagcggtattttttgcgttcgcgccaattatcnactcnccctgctgatggacgagttgatgtgacttctgacaacaacctccgaacgaacttgggggatttctcacgctcactgcctgcctctatacacaacacgcaacaacttacaaaagacaatactcgcatagtatttctgttttgttcgtttattactaatactatttttttaaattaaccggcaacagtagcaatggccattatttaagctcttgttttgctctctgcttttccatatttttgggggatttctggagtgcttctttacttttaccgggagaagacggggctgagggttttcgagaacccgcggagcgcgccgtagccgcgggagctgaagccgaggcagccgagcacgccctgccggtacggcaggaacgtccgccgccgcatctcctccgcctgcgccctgttcggcgccgcgtaaagcctctcgtgcgcggccgccaccgtcgttgagcgccgccgacccttggacctgccctggctccgcgtcgtccgggattcgtcgccctcaccggcgccgccgctggccgccgctcccgtctccgattgcggcct

SEQ ID NO: 7238 - DNA, 995 bp, Triticum aestivum
  Clone ID: PAT_TA_7238
gtcggcctgcagcgccggtggtgctcggttcgcttagcacttcctgccttgatggtctccttgctccctcgcgcaccctaccttgcctccctcggcaaacccacctcccgcgcttccacctcctcgctgcgactgccggccatgtcttcctccgcccccgcccccgcggccacggcggcggcagagccggaggcgtcccgcccaaggaagatgccggtgctcttatttgacgtcatggacaccgtcgtccgcgaccccttctacgaccacatcccctccttcttccaaatgtccatgaaggaactcctagaaagcaagcatccaacatcatggtccgaatttgagatggggttgattaatgagggccagctggccgaaaaattcttcaatgatggcagatcttttgatttggaaggtctgaaagcatgcatggtgagagcatacgagtatgttgatggtgttgaagatattctttgcagtttaaagcaaaacaactatgaagtgcatgcttttacaaattatccagtgtggtaccagttgatcgaggaaaagttaaagctgtcgaagtatttgtcatggacattctgttcttgtcacatcggaatacgcaaaccttcaccggatttttaccttcatgccgtggatcatctcaatatcgatccaggaaactgcattttcattgatgacaggatggtaaacattgaagcggcccttagtgtaggaatggtcggtttgcattttaaaatgctgaggccctaaagaatgatttgtgctcattgggagttgaattggcacctcttgtgcttgaagatgaaactgaagttcagtaacatggcttcctgtttggtcttctgctcatgtaagattcatgcgtatgaataatccttctgtctctttatgaactactccgtatgttaaaagcttgacgtgctgtttttgtcccaaaaaaaaaaaaaaaaaaaaaaaaaaaaaaaaaaaaaaaaaaaaaaaaaaaa

SEQ ID NO: 7239 - DNA, 917 bp, Triticum aestivum
  unsure (1)..(917): unsure at all n locations
  Clone ID: PAT_TA_7239
gcacgactattatctccccaccatccgcgtccttctccgactaacaanttcccccaaatttcttcgcaggtgttcggaagaggggtagggcgagatggggctcgcgttcgggaagctcttcagccggctcttcgccaagaaggagatgcggatcctcatggtcggtcttgatgccgccggaaagaccaccatcctctacaagctgaagctcggcgagatcgttaccactatcccaaccatagggttcaatgttgaaactgtcgagtacaagaacattagcttcactgtttgggatgttgggggtcaggacaagatcagacctctctggaagcattacttccagaacacgcagggtcttatctttgttgtggacagcaatgatagggaccgtgttgttgaagccagagatgagctccacaggatgctgaatgaggatgagttgcgcgatgctgtgttgcttgtctttgccaacaagcaagatcttccaaatgctatgaatgctgctgaaattactgataagcttggattacattcccttcgtcaacgtcactggtacatccagagcacatgtgctacatccggtgagggtctgtatgagggcctggactggctatccagtaacattgccagcaaggcttgaggcttggaattttgactgcggagctggctattagctgtggatctgttatgtgcctttcgcaagctcagtgtttttgtaatgatgtcccagttaaatgcctcctggatgctctttctacttgttgatactttgcacaatgatttcaaatatcatacgttttggactagttatcatgtccacttagttatataaataaggccaaaatattatttctttgatatgatgagcagcaatttattgtattgacgttaaaaaaaaaaaaaaaaaaaaagggcgg

SEQ ID NO: 7240 - DNA, 1169 bp, Triticum aestivum
  Clone ID: PAT_TA_7240
cgcgcgaggtcgctgcccccgcacggcgtcctcccagtcctcagcatgccgcttaggcacgactattatctccccaccatccgcgtccttctccgactaacaattcccccaaatttcttcgcaggtgttcggaagaggggtagggcgagatggggctcgcgttcgggaagctcttcagccggctcttcgccaagaaggagatgcgactcctcatggtcagtccttagcaggtgttcggaacagggatcgggtgagatggggctcgcgttcgggaagctcttcagccggctcttcgccaagaaggagatgcggatcctcatggtcggtcttgatgccgccggaaagaccaccatcctctacaagctgaagctcggcgagatcgttaccactatcccaaccatagggttcaatgttgaaactgtcgagtacaagaacattagcttcactgtttgggatgttgggggtcaggacaagatcagacctctctggaggcattacttccagaacacgcagggtcttatctttgttgtggacagcaatgatagggaccgtgttgttgaagccagagatgagctccacaggatgctgaatgaggatgagttgcgcgattctgtgttgcttgtctttgccaacaagcaagatcttccaaatgctatgaatgctgctgaaattactgataagcttggattacattcccttcgtcaacgtcactggtacatccagagcacatgtgctacatccggtgagggtctgtatgagggcctggactggctatctagtaacattgccagcaaggcttgaggcttggaattttgactgcggagctggctagtagctgtggatctgttatgtgcctttcgcaagctcagtgtttttgtaatgatgtcccagttaaatgcttccttatggatgctctttctacttgttgatactttgcacaatgatttcaaatatcatacgtttttgactagttatcatgtccacttagttatataaatgaggccaaaatattatttctttgatatgatgagcagcaattaaattttttttgaactgatgagcagcaatttattgtattgacgttaggcttggtttcttggaaaatatgggtgacttgtatccctttgtttttttgacaaaaaaaaaaaaaactcgagactagacctcgg

SEQ ID NO: 7241 - DNA, 1691 bp, Triticum aestivum
  unsure (1)..(1691): unsure at all n locations
  Clone ID: PAT_TA_7241
cccttttatattagtcctacagnaacatgacaccaattcagtatcaacgagacatcagctccctctgcaacccaagggcacaacaaccctacaaactggagtacaaaattactcgcccctgtacactacacgcagcaaattttggcccctcgtgtttgtatagtcatcttcaatgacatgaacaaatagcgtcttccactacgagtagattcatccctccaaatatccaatgcatgagctcccggaggtgaagcagctgataacatcaaaccaattgatggcgtatcttgtttgtgcactgaagaacagacaatggtgatgtccatagtctccgccgctgtcagtcgatagagcagatgtagagaactcgagttaagggtgatggacacccggtctggtgggtgtcagtcatgctggcctggtccctggtgttcttctaaaatgacactacggcagtgggactgacggatgccgcctagttaagccatcagttgctctggtgaagcagccatggatgagcgtcgtgttatctgtagttgcagcactgcgcgcggcctaacgacagtttgtcccagaggcacagcatctgcctgggggactggtagtgcgccgtgaagtagttgtccacgcacccgtactggcagaacttccagctgtgaatgtactgcaccggggcggtgatggtggtagtgttgtaatcttcgacccacatgcccatgctcacatcctccatcttgaacagccttagtgactgatttgcgtgacgggacacgatgtttctggcaataccaatcgaaattacgtagccgggtccgttggcataggggggatacaccaattctggccattcctcgaacgtcacggcccatttaccgctccggagaggcctgtgtaaaagatttaggttgccaagataaagaggcaaggttctgttgaaggtagagacctgttgcaacactacatccagcctcacaaaggtatcatcgtcgcacttcatgatatactctgcggtaacattttgccccccgtactgacatatcgcaaactgttttgagaaccaccaactcataccggtcgataaatggcagaatgacaacgtctccaaaatattctgcttccttctttagtgctgcatttatctcttttctatggctcagtgcgacaaagaatcgagcaaccacatttcccaattggattgcaggaaactgcatccaagtttttctaatagccatccgctcagcaaaatggtttgtagcagagagaatgccgataaaaagctgaatcggttcctnctggcacagggcgagccttccacttatcagacatttccaagacattttgcagagaaaaactaggatgtgccttcggaagagaggttgcatacaccgagtggacatctatgccgcctgttacagctaaaccagttgcatcttcgagagtgaatcccatcctatgaggaaatgaggcaacatgacgaccccctacattaatatggtatccttcaacaccagcttggatagtgagaacaaacatcttcccctctaaaaatgggtatggccaggtcatttctggtttctttgctcggccgatgaacctgttgaaccatgagcttgtttttgtttcttttgaatcagccatgtccctccgttcccatttctcacatctgagaaacccatcgacatggtcgtcgt

SEQ ID NO: 7242 - DNA, 539 bp, Triticum aestivum
  Clone ID: PAT_TA_7242
aagcttcttgcacatatatatgttcgaacagtacatatcgtatacgggtaagtgacaccgtcttcttcgatagtggcaagaaagtgtgtcgcatatcgggagtgatatatgctactctcgagcactccctttgatcacacagctttatttacaatccacaatagcaaaacaccagcttccactacagtaagttatctgattcaccaagcagaagggctacggcgcataggaaaacaatgggggcatccatgactgcatctagtcccatcaaccgcgccatcatctctgtgatgggttcgcgcccatgcatctctacaagattcttcagtttcatagagaacttctgctcagcatgttggatacagtaacgcaacatatccaacacagctatatcagtttcatagtcatcagaacctggtatatcaaaaatttgttggggtggaatggcaagtgtctctgctaactcattctgaacttgggaacgctgttgtaacgatagtctatccccgtgagtaaccacaacagcaggcttgtcatct

SEQ ID NO: 7243 - DNA, 677 bp, Triticum aestivum
  Clone ID: PAT_TA_7243
tttcccttttgccactttttaatttggagcatttgcattgaccagattttttatacccagtgaatgttacggcaacagttctgagtacaggtaaacctactccatccccaatggcctgtcacacgtccgacgattcggggaccatctaaacttctccatccccaatgccctgccacatttacctcaactcttagtccatctccactttcagggattggattatgaacagtaacccttctccaatcttgggcacccaagcccgatgatgggaccaaaaaacggaaaagaaaagaaaaaacagagctcctaggtgactcatcccaacttatggtcaaggatgtttcaccgacgatgacaccacaattgtttccaaccgcaaaactgccctccgctggatgtccatgccgcactttcatatgtacaagatccacaccacccgagcgccttgtaaactgttttgattacctcaaataaatcaaacctcggtataaacagacagctacgtttcaggtttcattggaggctcgtccttcaatcctttcgttagcagatcatagttgatggatgcaagttgtgaaagattcttaaacgagaagttgctgaaagagtaattgacatttgggccggattcaaagtcagtggggccacctccatgctcatcccccatgtcatcttgg

SEQ ID NO: 7244 - DNA, 747 bp, Triticum aestivum
  Clone ID: PAT_TA_7244
gttgcatatggtgaaatgttgaattttgagatttctattggtttttatgaacttgctggggacttcaaccgtgggtgggcggaggcatgcaacaacctgggagtaatatacaaggatagggataatctcgacaaagctgttgaatgttatcaaatggccttgtcaattaagccaaatttctcccagtcattgaataaccttggagttgtctatacagttcagggcaagatggatgctgctgcaagcatgattgagaaggccatacttgcaaatcccacttatgctgaagcatacaataacttaggtgttctttacagagatgctggaagtattacgttatctgtacaggcatatgaaagatgcctgcaaattgatcctgattcacgaaatgccggtcagaaccgtttgcttgccatgaactatattgacgagggctcagatgacaggctttatgatgctcacagggaatggggaaagcgctttatgaaattgtatgcacagtatactagttgggataacataagagtcgctgatcgtccactggtcattggttatgtgtctcctgatttttttactcactccgtgtcttacttcgttgaagccccccttacacaccatgattacacaaattgcaaggtggtcgtctattctggtgttgtgaaggcagatgccaagacccttcgattcaaggataaggtgttaaaaaagggcggggtctggagagatatatatggtattgatgaaaag

SEQ ID NO: 7245 - DNA, 822 bp, Triticum aestivum
  Clone ID: PAT_TA_7245
tgagagtccagaaggctcaggagacgactattgataggccagcggtgcaaacaggaaaagctgcacacgcacttataaacagtggcaaacgccaaaagagctacaggaaaggtcagccctacaggctgcgagggaaatacgaaagccgagaaatgaggtctccacactaggaaataagggggtcgaaacagagcaaagtcgccccatattctcccaggaaagtgcagtcatggaagctgagggggataaaacaagggtaaaaaatgaggtcgttgtgatggggaagactctgaaaatgctggaggaaagtctgggaaagctgacggacgccttgcgtccgatgctgaaggtaatgagtgctagtggcgtgctgattggaaccggggcttaaccagataggcacccttgatgccttcgcgcacgcaagtttgcaaccgattggaccttattggcgcattcttttgttacataactgccactgtttccgccttctagctatctgatcctgcaatcgtatctatggatcctagttatagatgtgcaatctcttatcatgcttttttgtttgtcgtgacacgggagcttggtcttacccccaacatgtagggctgcgctcgggtgcttgtgctccctttgcacccgtgtggtcgctggctcgtgtcccgtttcttgccctttcgtaccggggcttccaggtgtctatcctgtatgtaggactgagaagagaactaatcatattttgctgatgtatgtgatgacaaaggagtgttgcccgaacataagcaaaatttaccaatgtcgttaaggaactttgttttcaaa

SEQ ID NO: 7246 - DNA, 641 bp, Triticum aestivum
  Clone ID: PAT_TA_7246
gaggagcctccatcacatgcattttacaaaagcctacccttccccaaaagatcaccggaaactatttactgagaagccaactttcatcttacggggttatgcgtcaactaaacaacctattcaactattcataagctaaacatggatgaacgtactaaattttgcgggacctttttgccctctcgaagacatctatgacaatagaagggcaggatcttttgaggtgagcatacccttggcttgccatgacatcatccattctatccggagaagtgataaactcaaggcaagcatctctgaggttgctgcagtgatgctggtcagctagagccaatgtagcagtgacattctcaacatcaagacttttgcaaaggatgctctcacacataaccttcatcctttccatcgcatacctatccgcagccacaagcaagtgcttaaccatttctttgccctcatctccatcaagttcttccatcgaaggcaacgaatctgtgtagatgaagtgaagcaacgccttgaaaacagcaggctgcatatcttcaactgttatgcgttgctttgccctgtcgctcatcggtccaaagagctgcgctttgaagaccggcgagcgccctgcaaccacaatcttatgcgcgggg

SEQ ID NO: 7247 - DNA, 625 bp, Triticum aestivum
  Clone ID: PAT_TA_7247
cttgatcctttcgattctttctcgcttcctttttttttttttggcagcatcaaaaagtgtggcaatcacattgaattttcaaacatcctacaaaagcaaatggatcttcgatttaccgacattctacaaacgaaaaaaataaagaaagaaatactatagttaatatccccagggtcctcaacttgtatcgcacaaacagaacgttctcaagtccttgtgggttttggttgtggtatcgtgctgcactgcactgcactgcactgctgtagttatcgcctaccacaccgacacaaaggaataacgctagtttacaacaccaatatgtaccaaccgtgaatcacttcatcatggcatgtacaaccttgtatatatcatactgccgagagactgccgatctttcccatctcataggtatcagcgtagtagtacagcttgatcttatttgacaaagacaatccagaagccagaggaagattccgcaagcttaacccatcaatctcagcaatatcatcaacaaaggcagtgacatctccaagtaatctaaagataacacaacgggcatcttgctgcaaatccgaaaaatcaaaatacagtggtgtatttgctttaacttccggcagacggt

SEQ ID NO: 7248 - DNA, 668 bp, Triticum aestivum
  Clone ID: PAT_TA_7248
ggaaataggattgggcatatgccacttttcagtactcagcattatagaaaacaacaagtcttaacaaagtgaagtaggaaattagaaaagaggattgtagcaaaatgccaggaaaacccgctgtcctgatcatgaccatagacacagactacggggcaaaaaacctggttcaccatatcctactacaattacaaaccaagtatcattcaggaaagtcttaagaaaagtagttatgcggtttaactgatcaatgagcatagcaacattatcactcagggctgagcagcctcactatcatcctctgcttcctgacgacccatcccctgccctgaaccgccacattgctttgaacctgctgtggaaggtgcagcggaattgctgctgcctgagttgaggcaagcgaaccacgcccaccgcctccacgtctgtcgctgcgcgggcaccggaggagatgtgctggcgatgtcaacgctgctttctgttaggtgaggtccaggacggttctcatcttcgtggtcggacttttgttcggtcttcacagagtccgattcttcttcctcgtcgttgttgtcgttgattagctgagcagacgtaccaacgctggtagtatgatccaaacagggggctactagcaaccttctgtttggtctgttccaagtctgattttt

SEQ ID NO: 7249 - DNA, 712 bp, Triticum aestivum
  Clone ID: PAT_TA_7249
gtgttttttttgaaaaaaaaagcatatcctaactattcttaacttttggaacctcatttattcaaaattatccaactaacagctccgggctgtgaaaaaaaaactgctgttcgctccttcaaaaggggattcaaccctatcatgatgaactgcctaactctataatctttttgagatctcatctatcatactcactttacttttccattacctccttataacaggtcattgctgcatcctcaccttctctatagaagaaaacaccgctgaatctattaaatcctttttcagttttttccgatgtaaccttttttcccccatacgaccaaaaggccgggtttgatccggtgtaacttcatggatgactacaaagatctacagtcttaaaaccacaggtcaaataccatctcctccagtaagtcgtcaagcataccatcccacacatcaatgacagcgtcttcagcatcgcatcgaaggtccatccacggtccactttccaagtctttcagcaccacctcatctaatgcttttggagttccagtatcatcgacaagacaatcgatgcacttggccacctctctaacgagttccatccccagcggtgctggtctcacgttgttcttcagaaaagctacccatgggtcagcgccgaagaaatcatcgcttatcttgagaaggaccccctcaacacaatcaaaaagcggacgcgtgg

SEQ ID NO: 7250 - DNA, 1183 bp, Triticum aestivum
  unsure (1)..(1183): unsure at all n locations
  Clone ID: PAT_TA_7250
gggnaaaagcaaanagtttgctgcagtacatctttagtgttgctgcggatgcaagatgtgaagtaagggaaaaagaaattgagatcaaggaaatgaaggagcaaatgacggaaatgaagtggggagcaaatgacggagcttgtgggcatccttcgacacagtgaatcacgcaggagggaacttgaaaagcagagcaagcagaaagagcagacagctcccatggctactactcctccgggaagtgtaaatggctccgcgaagcacactgcggatgactccaacacaccactatccccggttgcagttcctgcacagaagcagctgaagtactctgctggaattgtaaatagccccagcaaaggcgtagctgcatcgaacaaacaactcaagatggttcctattgcgcagttgcctgtcggcaagaaggcttcgatatcagggcaatcaggaaaactctggagatggaaaaggagccaccaccagtggctactgcagttcaagtggaagtggcaaaagccctggaaactgtcggaaatgatccgccacagcgacgaaacgatcacgagggccaggcccagaccccagctacttatcactcataaacctcggaaagtgatgtgaaacaggcttctctttttttctccggcttcacattgactgacacggttggttcacggacctacacagctaacaatgcagctaaaggcttgatgggatctccttcgtgcttcgtttttacctagccacgggatcgacaagtatatgttcttcatagggtgacttgtctttgggtgtaaatttcctgtgcctataaagtgagatgtgaatgtagaggtggtggagttagtgagtgagtgagtggccaccattcttcctggaagaagtgagcgcgaggtttcatgtttcagccgtccttggtctgactggagagatgccaacggttggtgtgttcttctacataaagatttgcaagaaggatggtggaagttggatgccttgtgcttgtttcctttatagtattattttctgtatgttggtactgaaagtggcaagtcgaatgactctggtttggtttgttaggaattatatattggtctgacacagcaacttgcgcccctgtatttgtcaactcttgcgtttgctgtgcatcagtgatgttgcgagttaaaaaaaaaaaaaaaaa

SEQ ID NO: 7251 - DNA, 815 bp, Triticum aestivum
  Clone ID: PAT_TA_7251
gcgcagctggggcactgccgtgcacaaatcggtcaacgggttggttggctatgaagggcttgaagttatcaatccagatggaggcacagatgatgcggaagcagaggctatgaaggggcgatggaaacaggaggatcgcgacagttactggaagatgatgaacaagtacataggatcagatgtaacgtcacttgttacacttccagtcatcatctttgagccgatgtcaatgcttcagaaaatggcagactcacacgtatactgtgacctgttagacaaagcagatgaatgtgaggatccgcacatgcggatggtatatgcttctacatgggctttgtcagcctacctagcctaccaccgtacgtggaagcctttcaatcccatccttggagagacgtatgagatggttaaccaccagggtattacatttattgctgagcaggtaagtcatcatcctccgatgggtgtagctcactgtgagaacgatcattttacttacgacatcacatcgaagttgaagacgaagttcttgggaaactcagtggaagtgtatccagttggaaggactagagtaacacttaagaagtccggtgtcgtgttggaattggtaccaccactgaccaaggtcaacaacttaatatttgggcgcacatgggtagactcttttggagagatggtcctgacaaatctgacaactggagacaaagccgtgctgtatttccagccatgcggctggtttggggctgggcgattcgaggtggatgggtatgtatatactgcagctgaagaaccgaaaataatgatgacaggaaaat

SEQ ID NO: 7252 - DNA, 2183 bp, Triticum aestivum
  Clone ID: PAT_TA_7252
gcaagcttgccggctcccactagggtcgacgtcgccatcgccatcgctgccgctctcctcaccagcgctcctctaccaccatctctaggcaggggttagcgggcgccccctcctcgtgcggcttcccaaacccctccttctccccctccccgacccctctgcccgcgagcccccctccgtccgcgccgatcgcccccgatgagcgcccaggtcccggaccttgccgtggcgtggggcggtcgcggacgcctcctctgctcgatggccgcgggcctgcgcagctggcgccccggcctgcacaaatcgggcaactgcctggtacgctacggagcgctggaagttaggaccccagatggaggaactgatcatgccgtagggggggcgaggagggggcgacgcaaagaggaggatcgggccatgcacagctgaggtgcccgacatgtacaaatcggtcaacgggatgtatttggtatcaaatggattcgaagttattaacccagatgtcaggcactgagaatgcggaagaataggttataaagtggcgatgtaaacgggagaatcgcgacagttactgaaagatgatgaacgagtgcataggctcatacgtaacgtctcttgttctacttcgagtcatcaccttcgagccagcctcacagcttcagaaaatggcagacttgatggaatattgagactcgtgggataacgtttattagctgggcaggtcaagcaatcatcctcccgatgggtgtagctcactgtgagaacgatcattttacttacgacatcacatcgaagttgaagacaaagttcttgggaaactcagtggaagtgtatccagttggaaggactagagtgacacttaaaaagtccggtgtcgtgttgggattggctaccaccactgaaccaaggtcaacaacttgatatttgggccgaattggggacaaaactcttttggaagagatggtcctggtcaaatctggtacaactggtagacaaagacgtgctgtatttccatgccatgcggctggtttggggctgggcggttcgaggtggatgggtatgttatatcgcacatgggtaaacactgaaaaaaatgatgactggaaaatggaaaaagcccgtgagttaacagctgttgtgatcaaagaggtgctcctcttctggggcccgagcaaaaaggggtgttgaaaaggcgcatactccacccgaagaaccaagattaaagataaaaagtacttggaacaaataaataagttgcctgcattgtgataaataaggtgatcttcttccacggacggagctaaaaggggcctgaaaagcttgtcctggagcagcgtgtcataagtaccagtataccaacctttgcgcagaaaataaataccatagatagagcagaaaagaagctcttgccttcaggggccgaatttggcccgaaaatggttcaaaagagacgggcgaaattccccaatctcggggcagagaacagcaggcgtaagggtaaaaatagagatgagaagaaaatccgggacaccaaggcggcgcaattgactccacaagtggttcaagatgacggaagacctctccccagcacccccgggtgcgacctggaggtctatgaatataatggcagttacgacgagcaccgggatgcgatatacagcctctaacgtcgctgccaaggagaaggacgtcagctccatcgagttcaacccgtggcagtatggcgacttgccttcccaatgatttcaatgcgtctgaaaccacccatatattattttctcatcgaaaaagctttcaggccttgtgctgatgcataccggtggtttccgtgccttgtagtattacatgactttccaccttctctcttcgtgctgtgatacagttcaggatgtgattgtgtatttgatgtagtccatattctgttgtcgtaagtctagaagaagctggtgaaatttatttaagatcaatttcagtgggaaattaggaagattattatcgcgtcgcaactggggggctattcggttcctgtattgtattgagacacttgagtcaaatccacacatggacccttgcattttttgatgaaataagaacccaactataattatatagaatggagatttaggatgacaattgtaaagacctaataggacatgttaaaagaacataagaataggataagg

SEQ ID NO: 7253 - DNA, 837 bp, Triticum aestivum
  Clone ID: PAT_TA_7253
ccccacccctgcacttagcccaacgaacgaactcagacccagccagcctcgtggctccggttggactggccggtaccgttgccgctcctgatggggaactgcgccggcgtgcaggggaacgccgagatcaacccgaccttcagtgctcccaacacctcaggtaacaattccaagagcagcaacagcagcaatgcgactgatacaagcacttttggcaagagttcttcgtcgtcggtgccgccgactcctcggaccgagaaggagatcttgcagtcgtccaacctccgcaagttcaccttcagtgagctgagaagctccacaaggaacttccggactgacagcctgctcggggaggggggcttcggctccgtgttcaaggggtggatcgacgagcgcacgtttacgccggtcaagcccggcaccgggatgatcgtcgcggtgaagaagctcaagctggacagtttccaggggcacaaagaatggctggctgaggtcaattacctggggcagctatcacaccccaatcttgtgaagctcatcgggtattgcttggaggacgagcagcggcttctcgtctacgaattcatgccgaagggtagcttggagcaccatcttttcaggagagctccacatttccagcccctctcatggaatttacggatgaaggttgctcttgaggcacccaggggacttgctttcctgcatagtgatgaggctaaagttatataccgtgatttcaagacctctaatgttcttcttgactcggaatataatgcaaaactctctgattttggcttggcaaaagatggcccgagtggcgataaaaagtcatgtttt

SEQ ID NO: 7254 - DNA, 995 bp, Triticum aestivum
  Clone ID: PAT_TA_7254
agcgtggtcgcggccgaggttttttttttatagaattcctttctggtccacaatattggtatagaacaaaatagtacaagtttacatgctatcttgaatcttacatgattaaaaaggagttaaatgcaagtgaggtcctaattcttttgccgaaatgttgagtgagtttcatactatgaaagtgcacattccaatctaaaagtactctctccgtcccagagtaaacaaaatgttttgccccttattactttttatttttttgctcttatgaagctgggcaatagcctaaagggaccatttcttttgagcgtatgtattggtagtcgtgacaagtcagctagctagagagtgtaggcgacgattgctggtatcggttcaggtcatcccagaccaagtgctcgacctcctcccacgacgttgcatccctcagctccttccacaggccaaatatagctgccaagacgttgtcgtcgtgcagtatgcagtagcacatcgcgcgatatgatgcggtgctgaacttcgaattttgcaccgacttgtagatgtcattgtttgatttccctctgaggaaaggaagctgatagcttctaaggtactccctcagaagatcaatatcaccacggaaaacatccaagtgcagcggaattaagtcgcatagaggatccccaatggacagatcactgaagtcaatgatatggatttcattcagtttctccagatctccgtcaccagtgcttttggtatcagtgagggaacccatttcgggagccctctgagtaagaatgttatcgtccataatatctgaatgtatccaagaagggaatgtgtacaccgagtcaccatcgtcatccttaacaaacttgattagagaactcatatcaggagggagatattcttcagccttctcaattaaaactgtcgggacagtacccccccagtagctaggtgcttctttatattattccttcttccgtttaaagtagaatactgtttcc

SEQ ID NO: 7255 - DNA, 748 bp, Triticum aestivum
  Clone ID: PAT_TA_7255
tgggcaagataaaccagcaccacactgtttcaccgttagggacaggtaacgagtaacgtacattattggaaaacaaacatactacaagctttattacaatagttaccctgttacagctacagcatcaagatctcagcatcgttggactacaactaggcgaagcatcccacagttccaaccacgagatgacgcatcagggtcccacctccacaaaatgcaccgtcactgtctatcagcaagaagaagccagtttgcggagactgtttgaacgcccaggagtcggtgaagcttcgaactcctcttcttcgccctcgtggagtctccttctttctcgccttctcttgccctgcccttcccgtttcctccttggccgctgcgcgtctgcacttggtccgcattctgtcacatcccttctgcacccttcccccacgcctcctcttacacatggattccggcaccgcgacgtgtccagcattctgaattgagtctctgacagacccccgtcttgtgctatctgcatcgacaaatgagaactctccgagcaactgaaccaccggtggctttgatctgctcagtatctttatgatccacagtactgccatctgaaggcctttcaacgctaccatcctcttgctgaactttctgatcatgatccctacgaccaattgacggaacatcgaggcacacagattgtcccgccggcggtcgcctcgggtgcgcccaccagccggtgcactgcttgctcggg

SEQ ID NO: 7256 - DNA, 769 bp, Triticum aestivum
  Clone ID: PAT_TA_7256
tgtttttgctggtcgtgtttggggggcctgtgaaccacatgccccatgttcacagcagttatctacccatggggttcatggttacatcagatccatcaaagttcgggcataggtgcaccgctattatgcgctttcggcaccatgagagggctctctgttcagctaccattaggtcttggacatacgcatgaaaagcttatgctcacacaggcaaaaacacgctgaccatgttgcagcgttcgggtcgcaagagtttgtcatgagaaagcttcagaacactcgttatgcggtgacatatctgattttccgctcttctcagcggcgggctgggaatggctggaacggcagacgcataccaaaagttggctgagttggtagtgatggatgttcggcaggtggaagcttgccgagcacattcagagatttcatcttctgcagctccttcccttcttcaattaagagattgactgctcgtttctccagctcaatggcatgcttgctccggccaacagatgacaaagactggagcatgcggatgtattcttcctgtcctgattgctcattatttctcaggaatgcctgcagccgaagaaaccttgctttccaatcttgatcccctgatctttgcgaatcagttggattacgtgtcgtagcagtagccacagcatcacgaggtgctgcactagtagccacagcattacaagggcgatgtattgacagccgtatagttctgaggcatggcagtagacacaacactgcagtgcggcgg

SEQ ID NO: 7257 - DNA, 729 bp, Triticum aestivum
  unsure (1)..(729): unsure at all n locations
  Clone ID: PAT_TA_7257
gngtgacaaattgttgtgggncttccttgggcccttggtcccgctactttcggagtcccgtcgtagctcctggtgctccagtgttgtaggtggggtgcatggaggactctacttcacaaggtgttgaatgggaagaaagttcagatttattggatgtggcatccaggtgtgatgtaatttaccaaacacgcattcaaaaggaaagattcggggagaggatcgatcactatgaggcttgctcgtgggaaatatattgtggataagaaggttttaggtgtgctgccaaagcatgctgttatcatgcatccccttccaaggctggatgagatcacagtagatgttgatagtgatccaagggctgcatattttaggcaggctaagaatggcctctacataaggatggcactgctcaaacttctgcttgttggccattgacattatttttcctggtgcgtgagctttgtgatgtcaaaggatcagaaatgtagtcttaatcgttggctcccaagttcaactgtttggtgctgtgcaaggtataagaaagttggatccttgcaagaataaagcaatgattgtatgataaatgctccataggaatattctctgttattatgtggaacatccttttccccaggatggaatgcaatgttggaaaagaaaattatattttacccacgaaattcacttgatgattccgcgcccgcgaccacgctaatcactagtgaattc

SEQ ID NO: 7258 - DNA, 1060 bp, Triticum aestivum
  Clone ID: PAT_TA_7258
caaaacaccactccccactcttgctgctgctccccgtgctcacctccacagcttcctgcatcttcgtgcgtacgcgcccctggctgtcccaccctggatgatattgatgttgcaagtgctagcagctctatgctatgccactaccgcccagccactggctgaacacgccctactcaagtaatcaagctcacacactgacgcacagacaacttagatattgaagaggacaactgggtcaggatgctgcggctgggcttctagtgcatggggatcctcaacgccgacctcgggacatcgctgctctacgtcttctccaacaccttcaagtacgacgtcgggcacgaggacgacgtgtcgggtgtcctcttcctcatcatctacagcttcctgctcttcgccatggtcaatatcatcttcatcgcgctcttatatttaggaacggagggcatggaggatccgctggaaacaagtttcggatgtcgatgggtctgccggtggcagccactgttaattgtgctgacaaaactggtgccaagaacttgtacatcatctccgtcaagggaatcaaggggcgcctgaataggcttcctttgcttgtgttggtgacatggttatggccattgtcaagaagggaaagtctgactggaggaagaagctcatgcctgttgtcattgtcaggcagcacaagcgatggcgtcgaaaggacggtgtcttcatgtactttgaaggtgaatggagcttgtgttgttggtagaactccattgatgacttcttcctatgttgaagagcatgttccgtgttatccaagagtagctagctttacattggcagggagtttgttatccaagagtagctagctttacattggcagagagttttatttgtcgatcgcaatatttgtgattgtgtggaatattgtatggttatctacgtgaagtttgaagttcctaggcatgcaatatttgacggttaaactagtggttgtgatgccccgagtgtatggagtttcccctgttttgttctgtacagaatatataataataaacctattttggttgtt

SEQ ID NO: 7259 - DNA, 456 bp, Triticum aestivum
  Clone ID: PAT_TA_7259
tacagcaacgagaagacgacagaagcctgcctgtctacttagtttaacagctgtagctttgttgccagataaaatggtgaactttgcgtaaaaaaaaaaaaaaaaaaaaaaaaaaaaaaaaaaaaaaaaaaaaaaaaaaaaaaaaaccaaaaaaaaaaaaaaaaaaaaaaaaaaaaaaggggccgcccaaaaggatcaaagctaacttacccttgaaggcaacgtaaaaccccttcaaaagggtcaccaaaattcaattcacgggccgtcgtttaaaaacgtcttaacgggaaaaaccctggggtaaccaaacttaatccccttgaaaaaaatccccctttcgcaaactggcgtaataccaaaaaggcccgcaccattcgcccttccaaaaatttgcccaccctaaatggcaaatggaaccccccctgtaccggcgaataaaccccgccggttttg

SEQ ID NO: 7260 - DNA, 767 bp, Triticum aestivum
  unsure (1)..(767): unsure at all n locations
  Clone ID: PAT_TA_7260
ttcggcacgaggctctcctcatactctaccctgggtacaatcctatttgcttactacaccaccacattagccatcaaatttgtgacaagaaaacggaaaccctcttcctttcttccgagaggagaggtcaggtccttgactgctagagtcgatctatttatctgcattgtgaagtaacaacggttctttggtccatgttaatatgtcaagaaactgtttgtttgttgaaacaacccatcagtcactctccagatactgctgactgctttctgttgctagtatagttcaagcttctttgccatgtatttcattaggatgtgaacaatctactacatgctcacaaagctattgacttaaattttttgtttctttgctgtcaatgtttgccaagctatttaaacgatgatgacaaactgaaatcatgaatactcatatagaaatttgaacaaccatcttgtttaatttggtgatgttcctccatctaagtgctaatctgctgcattcttattcaactttcattgacagttttagtttcgctgaaatcatgtttttattttctatgcttatgtatgtggacaaacactactagctctagaaggaccgacattaccatcaagtacgccatcgaggtgaatggtgcttgtgttgttggtagaactccgttgatgacttcttcctatgttgaaagcatgttccgtggtatccaagagtagctagctttacactcgcagagcgttttatttgtcgatcacaatatttgnattgta

SEQ ID NO: 7261 - DNA, 570 bp, Triticum aestivum
  unsure (1)..(570): unsure at all n locations
  Clone ID: PAT_TA_7261
caacaccagccgccgccatgtcgaagcgaggcaggggaggttcggcggggaacaagttccgcatgtcgctgggtctgccagtggccgcgacggtgaactgcgcggacaacaccggcgccaagaacctctacatcatctccgtcaagggcatcaagggccgcctcaatcgcctcccgtccgcctgcgttggcgacatggtcatggccaccgtcaagaaggggaagcccgacctcaggaagaaggtgatgcccgccgtcatcgtccggccagcgcaagccgtgggcgcccgcaaggacggggctacatgtacttccaagataatgctggagtgattgtgaatcccaaggggggagatgaaaggtcccgctatcactggacctatcggcaangactgtgctgatcttggcctaagattgctaacgcaacaaacgcattgttngaganttggttggatatgttcaaattccatatgatnancttattacaattgctanactgcatgggnttaagttggtcatcaatttggtnggaaacagattgggatacaaggggtctatntacaatgttgca

SEQ ID NO: 7262 - DNA, 612 bp, Triticum aestivum
  Clone ID: PAT_TA_7262
gtcatgtcgaagcgaggtaggggaggttcggctgggaacaagttccgcatgtcactgggtctaccggtggcggccacggtgaactgcgcggacaacacgggcgcgaagaacctctacatcatctccgtcaagggaatcaagggccgcctcaaccgcctcccgtccgcctgcgtcggcgacatggtcatggccaccgtcaagaagggaaagcccgacctcaggaagaaagtgatgcctgccgtcatcgtccgccagcgcaagccgtggcgtcgcaaggacggtgtctacatgtacttcgaagataatgctggagtgattgtgaatcccaagggtgagatgaaaggttctgcaatcactggacctatcggcaaggagtgtgctgacctttggcctaggatcgctagtgcagcaaatgccatcgtttgagagcttgttggaatgtgtttagacttgagtatgatcatctcaattgtgtgttgcagctgttgctaagagtgctattggacttgatggctcttttatgtttggtcactcaattttgtagtgaacagaaatttgtctaccatgtggatctatataacaatgtggttaccttaaaaaaaaaaaaaaaaa

SEQ ID NO: 7263 - DNA, 1003 bp, Triticum aestivum
  Clone ID: PAT_TA_7263
ggcttatagcgagctgttcggtacttctgcagatggcttttcacatgatatattgtcaaaccgtcaactttcataagcttcagcacacccttgggagtagctttttcactaccaccaagcttatttacagagtctacgaagcactcatggagttctggagtccacctcatccgttgtttggctgcagagttgctattgggaggactagctacattgcaaatctctccaccatgagatgaagctggctggttgacagcaggctgtgatgcagccgaattggaaggctgaaccatggactttgactggggatcagcagccgttgcatctagaatatctctccaatcatcattcattatttctgcccaccattcattttgtttagcaaccacatcagatgtcacagcaggaccgccgttctggatctgactaccagaagcagggatgttatccctgtaatctgataaaccatcagccgaacctgggaaccaagttgccccagtgtgacctccagggatattattagataaggtctgaaatacttcgatatctgatggctgaggagcaaaaggagcaaccatagactgcctctcatggttaggcgcagaatccagaggattaggtgagtatcctaatgaggctgcatatgatgatctcatagcaccagctcttgggtgcaaagtagcagatggaagtgcactctgatgtaagggcacaagatcactcgtcagttgcctttgcatcggagtgagctgcggattgtaaggcccatggaaggtttctttcagagaatttggcagaataggtaaagaggatgacattcctccagaaaccctgctgttgtgagactgtctcagatcacacctcctcatcaagaattgtgcacaagcgttgtgtctttcccataaattgattttgatatgttcctacagaataacctgggttgggttgtgaggaagctgctggatcggtgtgcttttgggggaggagatgacagcaaggggga

SEQ ID NO: 7264 - DNA, 723 bp, Triticum aestivum
  Clone ID: PAT_TA_7264
gccggcatcgcgctcctagccttaattggccgggtcgtgtttccggcatcgttactttgaagaaattagagtgctcaaagcaagccatcgctctggatacattagcatgggataacatcataggattccggtcctattgtgttggccttcgggatcggagtaatgattaatagggacagtcgggggcattcgtatttcatagtcagaggtgaaattcttggatttatgaaagacgaacaactgcgaaagcatttgccaaggatgttttcattaatcaagaacgaaagttgggggctcgaagacgatcagataccgtcctagtctcaaccataaacgatgccgaccttgctcgttgctccttcgaccacacgctccgccgcgaggtgaatggagcttgtgttgttggtagaacatcattgatgacttcttcctatgttgaagagcatgttccgtggtatccaagagtacatagatttacactggtagagcgttttatttgtcgatcacaatatttgtgattgtatggaatattgtatggttatctacgtgacgtttgaagttcctgggcatgcaatatttgaaggttaaactggttgttgtgatgtgaacgagtgtatggagtttcacatgttctgttctgtacaaaatatattgtaataaacctattttggttgttattcgaagatttcatttcttctcttcaaaaaaaaaaaaaaaaaaaaa

SEQ ID NO: 7265 - DNA, 680 bp, Triticum aestivum
  Clone ID: PAT_TA_7265
aaatccgccgccgccgccgggttcaacccactcttccagatgtcgaagcgagggcgcggaggttccgctggaaacaagttccggatgtcgctgggtctgccggtggcagccactgtcaactgcgccgacaacactggtgccaagaacctctacatcatctctgtgaagggaatcaaggggcgcctcaacaggcttccttctgcctgcgttggtgacatggttatggccactgtcaagaagggaaagcctgacctcaggaagaaggtcatgccggctgtcatagtcaggcagcgcaagccatggcgccgaaaggacggtgtcttcatgtactttgaagacaatgctggagtcatcgtgaacccaaagggagagatgaaaggttctgccatcactggaccgattgggaaggagtgcgccgacctgtggcccaggatcgccagcgcagcgaacgccatcgtctgatctgatcgccggagcagctagatgatcaaagctttgatagcgtgtccctcttttcttctagcttattacttgtggcacttgaggacgagtttcctggattatgtaatgctgctggattatggtctgttagctttcttaagattttgcactgtggtttggctactgagatgagatttggtgagtttgaacctgaaagagcttttgatcggatttatctc

SEQ ID NO: 7266 - DNA, 519 bp, Triticum aestivum
  Clone ID: PAT_TA_7266
gttaccaccccctcttccaagtatgtcgaagcgagggcgcggaggttctgctggtaacaagttccggatgtcgctgggtctgccggtggcagccactgtcaactgtgctgacaacactggtgccaagaacctgtacatcatctccgtgaagggaatcaaggggcgcctcaacaggcttccttctgcctgcgttggtgacatggttatggccactgtcaagaagggaaagcctgacctcaggaagaaggtcatgccggctgtcatcgtcaggcagcgcaagccgtggcgccgacctgtggcccaggattgccagcgccgcgaatgccatcgtctgatctgatcgccggagcagctagatgatcaaagcttttgatagcatgtccctcttttgttctagtttacttgtggcccttgaggatgagtttcctggattatgtaatgctgctggattattgactgttaggtttaagattttgcactgtggtttggctgctaaaatttgttacagttctgaacctg

SEQ ID NO: 7267 - DNA, 801 bp, Triticum aestivum
  unsure (1)..(801): unsure at all n locations
  Clone ID: PAT_TA_7267
cggcacgaggtaccaccccctcttccaagatgtcgaagcgagggcgcggaggttccgctggtaacaagttccggatgtcgctgggtctgccagtggcagccactgtcaactgtgctgacaacactggtgccaagaacctgtacatcatctccgtcaagggaatcaaggggcgcctcaacaggcttccttctgcctgcgttggtgacatggttatggccactgtcaagaagggaaagcctgacctcaggaagaaggtcatgccgggctgtcatcgtcaggcagcgcaagccgtggcgccgaaaggacggtgtcttcatgtactttgaagacaatgctggagtcattgtgaacccaaagggagagatgaaaggnatcgatcatgtcacttggtagattccatacttttctgcatgttgcatcaacaggcagttgaaacttgaaagtaacaatcgttgaacctgtagtatacaagctgtctgtatatcaaagattaagctaaataaagcagatcagcacaagctatcaacactctttagcagatgtcatagctgttggnacagcctgattgattgacacattcttctatcgcgcaggttctgccatcactggaccgatcgggaaggagtgcgccgacctgtgggccangattgccagcgccgcgaatgccatcgtctgatctgatcgctggngcagctagatgatcaaagctttgatagcatgtccctcctttcttctaacttaatacntgtggnacttttcctggattaagtnatgctgctgggntaagggccgttagctttc

SEQ ID NO: 7268 - DNA, 720 bp, Triticum aestivum
  Clone ID: PAT_TA_7268
ggagcaagcgccgcaggggacgccgccatgtcgaagcgcgggaggggaggatcggcggggaacaagttcaggatgtcgctgggtctgccggtggcagcgacggtgaactgcgccgacaacacgggcgccaagaacctgtacatcatctccgtgaagggcatcaagggaaggctcaaccgcctgccgtcggcctgcgtcggcgacatggtcatggccaccgtcaagaaggggaagcccgacctcaggaagaaggtcatgccggcggtcatcgtgcgccagcgcaagccatggcgccgaaaggacggtgtcttcatgtacttcgaagataatgctggggtgattgtgaatcctaagggtgagatgaaaggatctgctatcacaggacccattggtaaggagtgtgctgacctctggcctaggatcgctagcgcagcaaatgccattgtctgaggagcttgattgggataatgatatgtttccttagtttcagatttgtcctggatgatgaatgtacctgaattatttgtttgccagatatttatccgaatgaggctcaacctcttaactcttttgttctctgggttaaaagatctctttatcccttatcagcttctttgctataactgtttgtgcacatgctccaaaggttgtgatatcgacatcataagaaatgctcttcccacctgcccggggcggccgctcgaaatcgaattcccgcgg

SEQ ID NO: 7269 - DNA, 696 bp, Triticum aestivum
  Clone ID: PAT_TA_7269
gaattcggcacgaggagatgtcgaagcgagggcgtggaggttccgctggaaacaagttccggatgtcgctgggtctgccggtggcagccactgtcaactgcgctgacaacactggtgccaagaacctgtacatcatctccgtcaagggaatcaaggggcgcctcaacaggcttccttccgcctgcgttggtgacatggttatggccactgtcaagaagggaaagcctgacctcaggaagaaggtcatgccggctgtcatcgtcaggcagcgcaagccatggcgccgaaagggacggtgtcttcatgtactttgaagacaatgctggagctcattgtgaacccaaaggggagagatgaaaggttctgccatcactggaccgatcgggaaggagtgcgccgacctgtggcccaggattgccagcgcccgccaaatgccatcgtctgatctgatcgctggagcagctagatgatcaaagctttgatagcatgtccctcttttcttctagcttattacttgtggcacttttcctggattatgtaatgctgctggattatggtctgttagctttcttaagattttgcactgtggtttggctactgagatttggtgagtttgaacctgaaagagcttttgatcggatttatctctgttgtggcccctaaaaaaaaaaaaaaaaaaagtcgacgcggccgcga

SEQ ID NO: 7270 - DNA, 804 bp, Triticum aestivum
  Clone ID: PAT_TA_7270
ctgtgcggcgctcgggccggggtttcggtgaactatagaaggccggccgtgccggggaaacttactcttcgcgccgccgctcggagcaagcgccgcaggggacgccgccatgtcgaagcgcgggaggggaggatcggcggggaacaagttccggatgtccctgggtctgccggtggcagcgacggtgaactgcgccgacaacacgggcgccaagaacctgtacatcatctccgtgaagggcatcaagggaaggctcaaccgcctgccgtcggcctgcgtcggcgacatggtcatggccaccgtcaagaaggggaagcccgacctcaggaagaaggtcatgccggcggtcatcgtgcgccagcgcaagccatggcgccgaaaggacggtgtcttcatgtacttcgaagataatgctggggtgattgtgaatcctaagggtgagatgaaaggatctgctatcacaggacccattggtaaggagtgtgctgacctctggcctaggatcgccagcgcagcgaatgccattgtctgaggagcttgtttgggataatgatatgtttccttagtttcagatttgtactggatgatgaatgtacctgaattatttgtttgccagatatttatccgaatgaggctcaacctcttaacttttccgctctctgggttaaaagatctctttatcacttatcagcttctttgctagaactttatttttcacgagctccaaaggttgtgatatcgacgtaataagaaattgtcttgcctttaaacttgtgatgaaaaaaaaaaaaaaaaaaactcgag

SEQ ID NO: 7271 - DNA, 697 bp, Triticum aestivum
  Clone ID: PAT_TA_7271
tcggagcaagcgccgcaggggacgcagccatgtcgaagcgcgggaggggaggatcggcggggaacaagttccggatgtcgcttggtctgccggtggcagcgacggtgaactgcgccgacaacacgggcgccaagaacctgtacatcatctccgtgaagggcatcaagggaaggctcaaccgcctgccgtcggcctgcgtcggcgacatggtcatggccaccgtcaagaaggggaagcccgacctcaggaagaaggtcatgccggcggtcatcgtgcgccagcgcaagccatggcgccgaaaggacggtgtcttcatgtacttcgaagataatgctggggtgattgtgaatccgaagggtgagatgaaaggatctgctatcacaggacccattggtaaggagtgtgctgatctctggcctaggatcgctagcgcagcaaatgccattgtctgaggagcttgttggggataatgatatgtttccttagtttcagattcgtactggatgatgaatgtacctgagttatttgtttgccagatatttatccgaatgaggctcaacctcttaacttttttgctctgtgggttaaaagatctcttttatcacttatcagcttcttcgctagaactttatattcacaagctccaaaggttgtgataccgacataataagaaatggtcttaactttaaaaaaaaaa

SEQ ID NO: 7272 - DNA, 719 bp, Triticum aestivum
  Clone ID: PAT_TA_7272
gccggccgggtcgggccagccgcagccgccgccatgtcgaagcgagggaggggaggctccgcggggaacaagttccggatgtcgctggggctgcctgtggcggcgacggtgaactgcgccgacaacacgggcgccaagaacctctacatcatctccgtcaagggcatcaagggccgcctcaaccgcctcccgtccgcctgcgtcggcgacatggtcatggccaccgtcaagaagggcaagcccgacctccggaagaaggtcatgcccgccgtcatcatccgccaacgcaagccctggcgccgcaaggacggcgtcttcatgtacttcgaagacaatgctggagtgatcgtgaaccccaagggtgagatgaaaggatctgccatcaccggacctgtgggaaaggagtgtgctgacctttggcccaggatcgccagcaacgccaatgccatcgtttgagagcctgtttcaagttgtgagactgcttatataatgccagtgtgggttgcagctgttttgcctgggaaatagtggaactctgcgttgctctgttttgtttggcatctcagtttcttagtgaacagaagcctgcctgtctgcttagtttaacaactgtaacttcgttgccagagaaaatggtgaactttgcgtatctctgttttggtttggcatgatgagtttatggggagtattcatacagaagccttgcatcacataacaat

SEQ ID NO: 7273 - DNA, 745 bp, Triticum aestivum
  Clone ID: PAT_TA_7273
aggaattcggacgagggcgccgccgccatgtcgaagcgagggaggggaggctccgcggggaacaagttccggatgtcgctggggctgccggtggcagcgacggtgaactgcgccgacaacacgggcgccaagaacctctacatcatctccgtcaagggcatcaagggccgcctcaaccgcctcccgtccgcctgcgtcggcgacatggtcatggccaccgtcaagaaggggaagcccgacctccggaagaaggtcatgcccgccgtcatcatccgccagcgcaagccctggcgccgcaaggacggcgtcttcatgtacttcgaagacaatgctggagtgatcgtgaatcccaagggtgagatgaaaggatctgcgatcactggacccgtcggaaaggagtgtgctgacctttggcccaggatcgccagcaacgccaatgccatcgtttgagagcttgtttcaagctgtgagactggttatataatgtcagtgtgggttttaactgttttgcctgggaaatagtggaactttgcgttgctctgtttgtttggcatcccagttcttagtgaacagaagcctgcctgtctacttagtttaacaactgtaacttcgttgccagggaaaatggtgagccttgcgtatctctgttttggtttgcagagtttgtggtgagtatttatacagaagccttgcatcccataaaaaaaaaaaaaaaaaagaaaaaaaaaaaaaaaaaaggccccta

SEQ ID NO: 7274 - DNA, 955 bp, Triticum aestivum
  Clone ID: PAT_TA_7274
gccggccgggtcgggctctccgccgccgccgccgggtaccgcccccctcttcttccaagatgtcgaagcgagggcgcggaggttccgctggaaacaagttccggatgtcgctgggtctgccggtggcagccactgtcaactgtgctgacaacactggtgccaagaacctgtacatcatctccgtgaagggaatcaaggggcgcctcaacaggcttccttctgcctgtgttggtgacatggttatggccactgtcaagaagggaaagcctgacctcaggaagaaggtcatgccggctgtcatcgtcaggcagcgcaagccgtggcgccgaaaggacggtgtcttcatgtacttcgaagacaatgctggagtcattgtgaacccaaagggagagatgaaaggttctgccatcactggaccgatcgggaaggagtgcgccgacctgtggcccaggattgccagcgcagcgaacgccatcgtctgatctgatcgccggagcagctagatgatcaaggctttgatagcatgtccctcttttattctagtttacttgtggcccttgaggatgagtttcctggattatgtaatgctgctggattatggtctgttagctttcttaagattttgcactgtggtttggctactgaaaaaaaaaaaaaaaaaaagctaacttaaaattaagaactgaaggataggctactgaaaaaaaaaaaaaaaaataaaaaaaaaaaaaaaaaaaaaaaaaaaaaaaaaaaaaaaaaaaaaaaaaaaaaaaaaaaaaaaggggggccgttttaaaaaaacaaaatttaaaaaaccccgtaaagaaaaaaaaaaaaaattttttttgggggcaaaaaaaaaaaaattacctggccgcggttttaaaaccttgcgctttggaaaaaccccgggttaacccaataaaaagcccgggagaaaaaacccctttttccc

SEQ ID NO: 7275 - DNA, 1716 bp, Triticum aestivum
  Clone ID: PAT_TA_7275
ttttttttaatcatcatgagttcagccaatacgtagctaactctaaaaattgcaacacccaaaccaaaacggggtcaggtatttaatattttgagcatcaagacaaagaccagctttctagcagttcagtcttctgccgcttgaaacctcaaataacaacaactatatatctagaaagatagctagacctcaaggcatacttatttaccaattaccatgcgtcaggagataatttgatttattgctagcagtttatacaagcggccaccaaaagattccatttagataattaagggggctggctcaatagacttgcagatcagcatcgacacagggttttaatggaaccatttttttacctattatacgttgactgaactgctatcatctgaattaccagactgatggttaactatcatgcacccttcggcgcttctcttgtggggccttagaaccatcattagtatttgcaagggggtcagaagactcgctttctgccatctcctggttgccacctgcatgcatcaaagtttctcctatttcggcactcacggggttctctcctgttctatttaggtcatcagctgcatcatcacccctatttctggttgcaggatggctcggttcagatgatagggttgttgtagctcccgaggatagatcctgcaccttctccgtattggatttagactgcttttcaaacatcatctgaagatacttcccttgttcttcaattcgcaattgcaactttctctgggtctcaagttgttcatgaagacgtttctgaacttccatctgaaggcgcagcgcttcagtaagatccatgctcgatttcaggtctagagtcaactcttcggtggtagtccttttctctgctgtaccttccattaggtctggcttatagcgagctgttcggtacttctgcagatggcttttcacatgatatattgtcaaaccgtcaactttcataagcttcagcacacccttgggagtagctttttcccgccatgtcgaagcgagggaggggaggctccgcggggaacaagttccggatgtcgctggggctgcctgtggcggcgacggtgaactgcgccgacaacacgggcgccaagaacctctacatcatctccgtgaagggcatcaagggccgcctcaatcgcctcccgtccgcctgcgtcggcgacatggtcatggccaccgtcaagaagggcaagcccgacctccgcaagaaggtcatgcccgccgtcatcatccgccagcgcaagccgtggcgccgcaaggacggcgtcttcatgtacttcgaagacaatgctggagtgatcgtaaatcccaagggtgagatgaaaggatctgctatcactggacctgtgggaaaggagtgtgctgacctttggcccaggatcgccagcaacgccaatgccatcgtttgagagcttgtttcaagttgtggtactgcttatataatgtcagtgtgggttgcaactgttttgccctggaaaataggagtggaacttcgcgttgctctgttgtttggcatctcagttagttggtgaacagaagcctgcctgtctacttagtttaacagctgtagctttgttgccagataaaatggtgaactttgcgtatctctgttttggtttggcatgctgagagtattcatgcagcatcacataacaatgtttagggcgttacctctgatttatgtgcgttgttttc

SEQ ID NO: 7276 - DNA, 837 bp, Triticum aestivum
  Clone ID: PAT_TA_7276
gccggccggttcgggctccgccgccgccgggtaccacccccctcttccaagatgtcgaagcgagggcgcggaggttctgctggtaacaagttccggatgtcgctgggtctgccggtggcagccactgtcaactgtgctgacaacactggtgccaagaacctgtacatcatctccgtgaagggaatcaaggggcgcctcaacaggcttccttctgcctgcgttggtgacatggttatggccactgtcaagaagggaaagcctgacctcaggaagaaggtcatgccggctgtcatcgtcaggcagcgcaagccgtggcgccgaaaggacggtgtcttcatgtactttgaagacaatgctggagtcattgtgaacccaaagggagagatgaaaggttctgccatcactggaccgatcgggaaggagtgcgccgacctgtggcccaggattgccagcgccgcgaatgccatcgtctgatctgatcgccggagcagctagatgatcaaagcttttgatagcatgtccctcttttcttctagtttacttgtggcccttgaggatgagtttcctggattatgtaatgctgctggattattgtctgttaggtttaagattttgcactgtggtttggctgctaagatttgttcagtttgaacctgaaagagcttttgatcggatttatctctgttgtgtcaagtattcacctgagaagtctggcttgaatgttaattagtctgttgctaagtgtgagcttgtgatgaactggtgcgtgtttgccattttttttctaagcattgctgagaggccaaactgagctgcaaatatgcagttgccatgaac

SEQ ID NO: 7277 - DNA, 794 bp, Triticum aestivum
  Clone ID: PAT_TA_7277
tttttcctcgaaccaaccctcactaaagggaacaaaagctggagctccccgcggtggcggccgctctagaactagtggatcccccgggctgcaggaattcggcacgagggtcgaagcgagggcgcggaggatccgctggaaacaagttccggatgtcgctgggtctgccggtggcagccactgtcaactgcgctgacaacactggtgccaagaacctgtacatcatctccgtcaagggaatcaaggggcgcctgaacaggcttccttccgcctgtgttggtgacatggttatggccactgtcaagaagggaaagcctgacctgaggaagaaggtcatgccggctgtcatcgtcaggcagcgcaagccatggcgccgaaaggacggtgtcttcatgtactttgaagacaatgctggagtcattgtgaacccaaagggagagatgaaaggttctgccatcactggaccgatcgggaaggagtgtgccgacctgtggcccaggattgccagcgcagcgaacgccatcgtctgatctgatcgccggagcagctagatgatcaaagctttgatagcatgtcccttttttcttctagtttattacttgtggcccttgaggatgagtttcctggattatgtaatgctgctggattatggtctgttagctttaagattttgcactgtggtttggctactgagatttggtgagtctgaacctgaaaaagcttttgatcggatttatctctgttgtggcaagtaaaaaaaaaaaaaaaaaaaaaaaaaaaacaccccccccccc

SEQ ID NO: 7278 - DNA, 680 bp, Triticum aestivum
  Clone ID: PAT_TA_7278
ccacgcgcccacgcgtccggagtgactggtgagtgaatttttagggggaagaggaatggcgcgaggcgtggcggcggcggtgtcggcgttgggggtcgtggcggtgctcttgaccgccgccgcggcgaaggtctgcacgaacacgttcccgtcgtcggattcggtggcgacccacgcggagcgcgccgcggggcagctgcggctgcctgccgggctcgccggccgtggccacggtcacgggcacgcccacgagcagcacctcaccccgaccgacgagtccgcctggatggagctcatgccgcggaggctcctaggcggcggcggcggcggcaccccgccacgcgtggcgttcgactggctgatgctctatcgcaagctccggggcggcgccgccgccgtggacggccccgcgggtccgttcctctgggaggcgtctctgcacgacgtgcggctccagccggggaccgtgtactggcaggcccagcagaccaacctggagtacctgctcctcctggacgccgaccgcctcgtctggagcttccgcacgcaggccggcctcacggcgaccgggacgccctacggcgggtgggaggggcccaacgtcaagctccggggacacttcgtcgggcactacctgagcgccacagccaagatgtgggcgagcacacacaatgacaccc

SEQ ID NO: 7279 - DNA, 747 bp, Triticum aestivum
  unsure (1)..(747): unsure at all n locations
  Clone ID: PAT_TA_7279
ttaagatgtttgcaactattagcacatactaaggtccaatttacacaagtcaccccgcacgactcgctcaatgcactactccatcctcattgtcgggtgcaacatatcggctcggtgggtaatagtaccttttgatccaccttcgaagggtttgaatcaacaagcaagaaatacctatttttttcttctcaatgtcttgttttaagttcaccgaacagattttgctacacacggggaaggaagcgaaatacattgagcagctcccaagtatcagctcagcagccatcatcccatccggactccatgtttagcagcgagatagtaagcattaattgggcctttatccccagcctcgtaagagctcaaggagcaacactcttccgggtcgatctcatggagtataggtgccaatacgctccatgcagcagctaattcgtcactgcgcatgaagagatgactatcgccatctacaacacccaaaagaagatgctcatatgaatctggaacttcaacgtcgtacctgtncctgtaaggtgggtcccgctcttcagcggncccctggcccccccgtcccgcgtccttaggctcgccgtgtacgtaacagncantggcagntangtagcaaaggggncgacaatcccaaggtcataccncangggcnttagtcgaggaaccggttcatanccnnaaaccttncggaacaggcccttcctcaatgncanggaggccctggnaacggggggggcg

SEQ ID NO: 7280 - DNA, 992 bp, Triticum aestivum
  Clone ID: PAT_TA_7280
ccgcccgcccgtccgcagagcacaaaggcacttcctcctcgccttgcgcgaatgggcctccgcttcgcccacctcgccggcggggtcgcccgagccgcgatctctcgccgtgggccacacctctccccagcgtgcgcccgccgcgtgctcgcccctctcgcctcgccgggtgagccaagcggcggcaactggctcgtcccttcccgcggccacggtggccactccaaccaccacggcgaggtaatcaaggtgccgacgttttcattcacatactcccctcttactcaatgggtgctaccctggacaaggaaaggattttcgggaacttggacaggagaaatgcagacgttagcccacgccaaccaagtgcagaagctatcgtgtccgatataatttcctctcattttccgaagaaaatgtgtcttgaacatctgatgctcattacttacgaggacgggtgtgcttcaggtccagttcaatgtccagaaatttgattcgggatgcgatggacttgcaaaaaaagccgaggaggagatcatgaaggctgacgccagcatatgtcaagtcagcgtacagctgagattggggcaacgaattgagcaacttcagctggccgcaagcaaaagcggagcaaaaaagcgtcgaggcatctgagaagatcttccgcttgggcctcgctgctgacgtcgtcctcaccgtagggaaagccatcaccggttacctctccggcagcacggccatcaccggcgacgccgctcactccctctctgacatcgtgctgagcggggtggctctgctgtcgtacaaggcggccaaggttcctagagacaaggatcatccgtatggtcatggaaagttcgagagtttaggagctcttggaatttcaagtatgctgttgattactgcaggtgggattgcctggcattcttttgaagttcttcagggagttatgtcttctgctcctgatataattggcagcacatcgcacatga

SEQ ID NO: 7281 - DNA, 1094 bp, Triticum aestivum
  Clone ID: PAT_TA_7281
catagcctcacgaaaatccttagcgagggacgcacgcctttctctccgacgcaggacgcgcgggcggggaggcgagggggagagagagagagagggagggaggtcgaggcgagcgtcgaccggtcgttcggtgtgaggaggaagaggaagagatcgccggagaagaggaggcggacgagaagagatgtttctggtggattggttctacggggtgctggcgtcgctggggctgtggcagaaggaggccaagatcctcttcctcggcctggacaacgccggcaagaccaccctcctccacatgctcaaggacgagcggctggtgcagcaccagccgacgcagtacccgacgtccgaggagctgagcatcggccagatcaagttcaagaccttcgatctcggtggccaccagatcgcccgccgagtctggaaggactactacgccaaggtggatgcggttgtttacttggtggacgctgctgacaaggaacggtttgcagagtcgaagaaggagctggacggccttctttcagatgactcccttgcgaatgtgcctttcctcgtactgggtaacaagatcgacatacctatcgcagcatccgaggaggagctgcgctactaccttgggctgagcaacttcaccactgggaagggcaacgtgaacttgtcggattcaaatgtgcggcccctggaggtgttcatgtgcagcatcgtccgcaagatgggctatggcgaaggtttcaaatggatgtcccagtacatcaagtgaagggccttcctgctgtccaccgtggcaatattcaggtcctggttcttttgcccgtctcatcatccttgatgctctggggaaaactgcagctgcaagaaaaggtttatcttagtgatagggaaaacttgtaagttgacgataatcctagatatatggttgcgtaaatttgtttgactgttcgtgtgtaatgtgattttactagttacaatgtggttgctgggatcatttgtagactatgggaagtgtctcagctattgtaatctgtcatctcagtcggtgaaatgtttgttaccaccagcttagattatgttggtgaaacttttgagcc

SEQ ID NO: 7282 - DNA, 1059 bp, Triticum aestivum
  unsure (1)..(1059): unsure at all n locations
  Clone ID: PAT_TA_7282
cccctcgccgcggctccgctttttgacgagagcccccgccccacacaggaaatccggctccaccacttcctcacgctgctcccccgccgtagccgccatggccgaccgcctcgtcctgctcgttctcgtcgttgccgccgcatccctcaccgtagcctccccagtcgccgccgcgcgtccctgcaacaccctcttcatctcctcccactcggccaacgctaaccccagcaacgaccccgaccaccgctcccccctcaccacgacggtcgtcaccgtcttccgcatccgccgcttcggcccccacttcctccgcacccaaggccacgcgcacccccacctcaaccaccaccaccgccaccacctacactccatccccgccaacatccagatccgccgccctgagctcccagagcttccccactccgcggccggcgttgccgcgagcatccaggagcgcgttaaggacatcctcgtggtcctcgtcgggatcctcttcggtctcggctgcggcgccctcaccgctgcctccatgtacctcgtgtggtccgtaatcgccggccccggcgcgtcctcccactacgacgagctctacggcgacgaggcgtccgactccgagagccccaagaaggttggctatgtcatcatccccggcgtcgaggcctacgacggtggtaagaactagattctagggtttccctttcccaggagtggcaagttccatgatatgccagtgtgctgctgtttgtgtgttgcgtaataatccgtaaaatgcctctgtgatgtgtagttgggccgtagtagttctgtgccctccatgtgaatacgctcttgatgcgaacttatgctgtgaaatgtgcttcgtttctagtaatgaacttatggatgaatgtccgtcctgaaatgttatgagtattctgaaattcatgaaaaaagggggggccggtaccaattccccaaantgatcctatagcggtnatggcgtcgtttaaantcggatggaaaccnggttacaacttacnctnaanaaccccttccantggtatacaaaaggcgacgttc

SEQ ID NO: 7283 - DNA, 1093 bp, Triticum aestivum
  unsure (1)..(1093): unsure at all n locations
  Clone ID: PAT_TA_7283
cgcgnagccatcgctcactcgcttcacaaatccacgaaccttagctcgccgtccggccatggtcgctgcaaccgtcgcgtcgacctccaccgccgccgcgtactcgtccttggctccgaacccgacagcgcgtgacccggttaggaggcgcactactcatccacttgtggcagccaccaatcgccacgtgcacggccgcactgtgacgagtctccgccagattcactctcgcgaccatttcgcgaaccctccgcggcccctattcgtggcgtcgccggcggaagcagaagcggaagagatggccgcggaggcgagtactccggcgccggccgaggccagcgcgaagcccttcgccgtcctcttcgtctgcctcgggaacatttgtaggagtcctgcagctgaggccgtcttccggaacctcgtcagcaagcgcggacttgagtccaagtttcagatagactctgctggtaccataggttatcatgagggagataaggccgactcaaggatgatatcaacttccaagaagcgggggattgaggtgacctcaatatccaggcctatcaaaccctcagatttccgaaattttgatcttatccttgcaatggacaggcagaattatgaagacattttgagctcatttgacagatggcaacacaaggagactctcccagatagtggacccaagaaggttaagctgatgtgctcctattgcaagcggcatacggagtctgaagttccagatccttactatggaggcgctaagggatttgaaaaggtactggatctgctggaagatgcatgcgagtcattacttgacagcatcgtggcggagaaagaaaacatttctgcttgatctcggaatgaatttccctgagccaatgtaagcgtcacattttaatttgattgtaccagggatcagttgcaaagatgtggattagctttctgtgagccatcatctcttcagcccagataattgtaatgataattaactaaaaatacactctctcatcaccatgcgtatatatgtgttaggctgcagcccagataattgtaanataataactaaaaatacactctctcatcaccatgc

SEQ ID NO: 7284 - DNA, 701 bp, Triticum aestivum
  unsure (1)..(701): unsure at all n locations
  Clone ID: PAT_TA_7284
cgagttttttttttttttttttttttgtcataaaaaagctacaatgatcacaatagtgacaaatggatcgtgttacattatgatacaggtcaactattctcactaaccaacactactataatgtgaagatcgtacgtgccgcttattttggatgactattgtacactggtgggagaaagctgtgttgcccaggcttggcatatacaaacgcagccacaccacacctaaacactgtatctgctaggaaacacagcactacgtacagaacctaaaaaatgttgagaaatgacattactgtgttgatgcgcggtctgattcgtgtcagacggtatctgaaggcgaagggacaagatctacgatccttaggattcctcgttcttcaccggagtccattgtgcggcttctctcttcttcctgaggagaaatcccaaggcaaaaccaagcagcaatgccaacatcacactacctccaatttccaagtataatggggaaatcttcagcttggcgctggttcccgagccgagctttgtttgattgaccgcctcggtagcactagcttcagtagatgtttgtccagagaatatctccaccatgtcatggacttgtccgtcatggttcccgacgtacatcagcgttagcttctccctggtagctaccagttttgtgtacccgaactcaccaccacggtacatggaggttnn

SEQ ID NO: 7285 - DNA, 639 bp, Triticum aestivum
  unsure (1)..(639): unsure at all n locations
  Clone ID: PAT_TA_7285
ggattgtgnagggatagtggtacccaggtttccgtcngagtntaacgacgccgtggcgggtatagatcaccgcgggattcccacggcccccctgcatccccgtggcaggatgacgtgtgcgtctcttggggctcatgggtatctcctcacggcgtcccccttatcacaaacaatatgcatatgagcatcagacagtacactactaactagaggcagactaaagtccaacctatcccaaattagatacaagttcactcactgtcatgtcaaggcagtgccatggcagggtaccacggttagaaccatactagggcttgagctacacctccatgtctgacttgcggaggaaatggaccgtcatcctaagccgtgtcgtgctctttgcccgttcaaagaggcagatatccccctcccgcacgtcattgccggcgacgaattccttccagccacgacgaatccagttcactctagtcgcatctattcccaatctggctggccactccgtcgttcttccctctgcctggagcatgagaggctttcctttcctcataggtggaatatatcttgaaccgtattcacggcagaagcgcaaattacggccattaacccaggttttggtcattactgtcacgaagatag

SEQ ID NO: 7286 - DNA, 1417 bp, Triticum aestivum
  Clone ID: PAT_TA_7286
tgtgattgcagctgatgaagccatcaaccattggaggcacgggattgtcgagcccaaggttcgtcacccttgttttctaaagggaagctaaagttggggttgccaatctccgaggattttctcaacggtgagcacttcccttttgtttctcttcttctgatctttaccacaagtcggcaatagtccctattgcactgcttggactgatctctcattttagtcactattgttatttaatataataataagcctctattttttattccgcatgcagtattgtttgctaaacgaacaagatttctaagttgttatatattaatgtggtgataggttgaaaagtttgatcactgaggaatggggattacagtcacagatcattcggttatttctcttgctggtgcctccgctgaaagtgatgcatctatatacaaccatatatataagtttgcctgttcaatcagaagattgtattagctattaagtcatagttcaaccttcgaatatacagttttggctcagtagtttgagcctccgttgcgcaactggatcatggtagacatccagacctgcagctgtgttttattttgttatcctttttagaaactgacacgctgcctttgttgcctaaatccgtgctttaattaaatgataaatttactataaagattttttctttgactcttatatgaaaaaattgtacgaacatgtgatcgctatccagattagtcaggtcatcctgcaaataactgtgggatacattactgatacttactcaatcattgtagtgaaataatacaagatggtgaacacctcggatgcagctcaaaggtcaaatatcatgatatagagttgtcttcaagccatagaagcgctatcgagccctggagctgtggcgacagtgccgtcccagccaccggcgtcctcttccatgccatggccatccaggaggagtgccacggctatcgcagttctccccatgccatcctcctggatgttgatcgtgtccttgcaccggcggcagctggagcctggtacgtccagagaggcatggccttggattggagcattgcagtcatcgatccacttcgtggtagtcatggggtagggtggcgtagagctcagccccgtgagctgcagttcaccagttcattcctcacctgtaagcctagcaagaaggaaaatggtttgtgctatatatacgactgaactggacaattacatagaatgtagatatttgcacatctgatttcttttgtgtagtctgggtactctttcccatggtgttaaaaaatatatatgtttgtgaagttgtatgacttagtgattttgtagcacactaagttgacccaaactggcttgaatttgttggttatttggccttgcctgaacacggttggtgaaagcagcagtgcttgct

SEQ ID NO: 7287 - DNA, 609 bp, Triticum aestivum
  Clone ID: PAT_TA_7287
gccggccggttccaaacaaacaaccaccaccgctcctccaatcccacattcgctccaagctcgaacaaaggagagaccgtcagccatgtccgggcgcggcaagggaggcaaggggctcggcaagggcggcgccaagcgccacaggaaggtgctgcgcgacaacatccagggcatcaccaagccggcgatccggcgcctggctcggaggggcggtgtcaagcgcatctcggggctcatctacgaggagacccgcggcgtgctcaagatcttcctcgagaacgtcatccgcgacgccgtcacctacaccgagcacgcccgccgcaagaccgtcaccgccatggacgtcgtctacgccctcaagcgacagggccgcaccctctacggcttcggcggctaggctcgtcctcgcctccctgcaaattccgatgtgcttgttcgcatgtgcgcaggagtctcgctgtcgagaaaacttagctgaaatgaaatccccatgtttatctccgctgtttccttcgtaggattagctgtatcgtcaaacaaagctgttcgcatctgaagcttgagtccaatcttgtgtctacgcaaaaaaaaaaaaaaaaaaggccccta

SEQ ID NO: 7288 - DNA, 806 bp, Triticum aestivum
  unsure (1)..(806): unsure at all n locations
  Clone ID: PAT_TA_7288
ggcgatcggccggccggctccaacaccaatcaccccccctcctcgaccgacattttctcgcagctcgaaccaaggcgagttcgtcggcgaccatgtccgggcgcggcaagggaggcaaggggctcgggaagggcggcgccaagcgccacaggaaggtgctccgcgacaacatccagggcatcacgaagccggcgatccggcgcctcgctcggaggggcggcgtgaagcgcatctccgggctcatctacgaggagacccgcggcgtgctcaagatcttcctcgagaacgtcatccgcgacgccgtcacctacaccgagcacgcccgccgcaagaccgtcaccgccatggacgtcgtctacgcgctcaagcgccagggccgcaccctctacggcttcgggcggctaggccccgttccgtggtcgtcaatcttctttgctcccccctgcagatttcctaaagctcgatgagaacctgacttgtttagttcgctatttcctcctgtagttaccaagtggaatcatgaaacaaagctattcgcatctggagtttggaaatcgagcttgtctttgtgcaaataaactatttgtgatttaaaaaattaaaaaaaaaaatgtaaggctcaggtacatattgtgctctctaattgccggcgcgcggggaggtgcccgaagactcacccgggtccaagtaccacctcccccagctgctccctatctcccccctgatcggctccgtttagactcggcacggttcacgtgctttaccgtttgtcccgttcaggtncccctttncaacggggtaaaaca

SEQ ID NO: 7289 - DNA, 939 bp, Triticum aestivum
  unsure (1)..(939): unsure at all n locations
  Clone ID: PAT_TA_7289
cnggnncngttttttcttttttttttttnaaaaaannnnngnggnaaanaagggagtnnggnanatgtgnaaaagacnanaggnttcntcngccncnanncaacgatttttcgggatttttaccccgcgcgaaatacaatatctatggactcggccaacgcctattgttgtaatgtaagtcgcaacccagtctctctatgagaatgcttgatcttacatacatcaacactactaaaattacccggttctcacaccatattgggcctttgtggcagaagaaggttgtagaacttgtccttcaagaagaagctccgacccttgctgtcgacagacttcttccacgcgcaccatccaccattaacaatcttcttgaggtcatcaccaccagtgtagtgtggatcgaggatgagaaaagcacaatcaccgctggcttcgttgtaatcaactcccagaagggtataagccaaaactccaccaccaatcattacaggagttccctgggtttcaaaatgtatcgcaagttctctgcatttctcaggaagctcatcaccagatctcacgttaattatcttgcaactagcaccaagaagtttgtcaagcacaaagcttaattctatcgctccaatccattcccgagatccaataaatgatggatccttatcaccaatttcaacaagaacttgctggatctccctgtgtgaaggaacatttatagacgaatactgttgtagcctgtaccaagacatgattgtttgtagagaacgataagcacatccccatccattgtcatcaataccatcatgtaggtaatggtaatactcatatgaaccatcaatcaatgacatgattcctccagatacaccactagatggaatttctcccgggaattcgatatcaagcttatcgataccgtcgactccgagggggggcccggtaccc

SEQ ID NO: 7290 - DNA, 672 bp, Triticum aestivum
  unsure (1)..(672): unsure at all n locations
  Clone ID: PAT_TA_7290
ttttttttttagtagagacggtgaccacagcagggtacaaatgatattcacaaaccacaacccggacaagtaaaaagaaaccacactagctaaaaaattacagatggggagaagagaagatccacgaagacgcggggtcggtcttcctccagcctatacaaccacaacgcgcactgccttgacaaaatgagagcgtgccgcaaggtcaagtaagccttacccgaagggtttactacaccttcaccactacattacagcgagtcggtgtcagatgatgcaaagcctactcttttccccaatctaggtatcagagggtcatctgtgctaatctcaatcacaaaattaattgggggacacgaagggaaaacagaacctatcaaagaatttcatgctgcctggtgttagaggtgcgatgcgtcactggatgttgcgcgacaacccgccacgtggtgcacttcttccgggaagtgcctgagaaactgtgccaggtcctctcaaactaccaagacgcttggccttgttctcttgttccttctcaaggcgcatagcagaaacttctttctccatagcagctacctctctcctcatctttttagcctccacttccatggctttggttaaggtgtctactttctttgctaacatcntcaattgcatcatccttgtccttta

SEQ ID NO: 7291 - DNA, 169 bp, Triticum aestivum
  Clone ID: PAT_TA_7291
actccctatagcgaatcatattaataagttagacaaggatgacttaagaaggctagcatataagcaacacgatcgaagacgcaagagcctcctgcctgggacctcctaactactcctgttcgtggacggcctccatgtagtagtccagaaaaaatgatcgtctccaatg

SEQ ID NO: 7292 - DNA, 560 bp, Triticum aestivum
  Clone ID: PAT_TA_7292
cggacgcgtgggcgacaacagaaacgctccccccaaaatccaccttcccacctagttaacccatcaccctcctccagatccccaacctccccaatccgtggccagcagaagcggcggcgtttctagggatacagatagtactttaaagggctaagctgcaaaacaagagatggatggcaaaaagaagaggaacaggaagaagaagggaaaccaagggaagaatactggtgatgcggtgaccaatgccgatgaagctgttcctcagagccacaatgatgatttggctccaaaagaaaattatagtggtgctgatgcagatgatgctgtgtccagtgttggagatgcagtgtccagtgttggagagggaacacagtaccagaatcacgagcagactccgcatgcaaagcagaatgttgcaaacactgatgaaaccatatcgtcgtctgttggtgaggtgattccatgtgacgagaatcacgaacctaccatgacacaggagaatcacaaggtcagtaatacagtctacgcagatcagaggagtattgggatttcagattcta

SEQ ID NO: 7293 - DNA, 807 bp, Triticum aestivum
  Clone ID: PAT_TA_7293
ggtgcggcggcgtaaatagatagaacgcgcccgcagcctcccgccccgcctaccaaccgacctttccaccctaacaatcgctcccccaaaaatccaccttcccaccacgtaaaccatcgccctcctccagatcccaacctccctaatccgtggccagcagaagcggcggcgtttctaggtacatacagatagtaatttaagggctaagctgcaaaccaggagatggacagcaaaaagaagaggaacaggaagaagaagggaaaccaagggaagaatactggtgatgcggtgaccaatgccgatgaagctgttcctcacagccacaatgatgatttggctccaaaagaaaattatagtggtgctgatgcagatgatgcagtgtccagtgttggagatgcagtgtccagtgttggagagggaacacagtaccagaatcacgagcagactccgcatgcaaagcagaatgttgcaaacgctgatgaaaccatatcgtcgtctgttggtgagaagattacatgtgccgagaatcacgaacctaccattacaggggcgggtgacggtaccggttaaaccgtcaatgaggaccgtttgggaatagcggttgctgagtctaactgtggactaagggaagtccaacttcctaaacctggacctgataaagcactcaatacaatctagatttcggaagaggggtcctgggaaaggggtgatgaaacaaacagaactggccgggtaatttttccctaagcagaccggtgattttaccaccggggatcacggaaagggaacgaactctgttgttggacg

SEQ ID NO: 7294 - DNA, 823 bp, Triticum aestivum
  Clone ID: PAT_TA_7294
ccgcccctttttccacttagggagctgcccccacttcttgaccggaccacatccatccagcagctcatacatccatccagccgtacatgagtgcagagtccacatatgcctacctatcctacatcaagtcacacacgtatccacccgtacttgcgggcacactccgcgcatgcattcgcctgcgacggttcaccacaacatacatacatatgcgacgagaggttccccagtgcatgcatctccagcgacgggtccccaccacgcacgaacatatgcaaccgctccaccgcagcttatatgcccaccgtcaccgccttccacaatgcaaacctcaagtgatcactgttgcggggaggtcgaagccacttgaccccatagtgggtgtcactggacttgcttggccaggtgaagatccacctaccacaaagttattggagccttgtcccgactagagaaaaaaagttgaaattaggaagagtcggaagaggaggaagaacgggcaaagtggaaccctgcatattatttctgagttgcgcaaatgtctcttgcaggattgcctgttgtttaaccatgaattcttgctgttgaaatagggccctgctacattttcatggcttcctcctctcgaagcctggcattggccatcgagttgatggagcatgtgcagcccaggctgtgggcgacgctctatagcacgacctgagctcgacgtggtagcacggacgtgagagagttttgggatgtccttcttacggatggcaccgtcgccaacatataaccgaccacccttcttgccaccgcccggcggcgcgcgaattgtagc

SEQ ID NO: 7295 - DNA, 709 bp, Triticum aestivum
  Clone ID: PAT_TA_7295
ctagatgtcgtttcgtcggctgatacacaaaagaagagctaactcagagctcaatatacttgtaaacctattggcattcctactatacacgagaacagggtcgcggcagcagcgttgggcctacgattactcaaaagcagagggggagggaataatacataattgagttgctaagggaagggaggagcattaatatcggttagagatgctcttcttgtctcggtcccaggcagccctcaaagcgtcgtaagattgttgtttccttccaacccctcgctgcgaatcttgccgggctgggcttgctgtagtcctgataatgctgttgatcatttgcctttcgccagctcctgctcgcagaatcgctactcggggccgaaacggagacggaatcgacaaccatgtcgccctcgagcaagcgaagaacatgagacatgcgaggccttgaatgaggatcacgtcgtatgcacaggtttgcggcatgcaacatgcaacggacctcattttcgctgtatcggtcccccaagcatgggtctatcagctcgtcgactgcattatcctccaagagatggcgtgcccattcagttagaaactgctggcccttaggtcggttaatgtcaacagccttgcgcccagtgacaagttctaccaacacgacaccaaaactgtatacatcagccttctctgttatttgtccactctgagcatactc

SEQ ID NO: 7296 - DNA, 762 bp, Triticum aestivum
  unsure (1)..(762): unsure at all n locations
  Clone ID: PAT_TA_7296
ggagttttttttttttttttgtcacagcatanatggccctcttttatataaacaaatgatccaatctaaacatcttttgtctaagctagtagagtacaacgggcgatggcaaggcatatcacttggaaagatgctagctactagtacaacacaagcctctctggttctactgctaatcaattaataactctagttgctagtacttcactgatctctactgctgcatgcatgccaccagacaaggggatggatcactagatcatccaacatctcaaactcatctggtgcttcaactcagtcaccaccctggccagcattatttcctctcccctagacgttgtcaaatgtagggtcctccctttcactgctggaaggagcacatgtagttactgaacatcacttgattgaacagttcgtgccttggctcacctactgtttgcatcatgtagctgctgctgctgctgccgttgtcctgggtgccttgaagtgagtagggtggggaggaggaggaggtgcctgtgtccatcatggcctgagatggagctgggctagatgatctgttcatgggaggaccagtaggcaatgccgctgcgtcatggaacatgccttcaatcttttgtgattggtcactgaaggcagccccactctccatgccaaaaccatacaccacagggctcagggaagcaatcctcatggacaggaactcaacttggttttgcagtgactgcacatagttgatgatctcatccaaaatgagagcct

SEQ ID NO: 7297 - DNA, 1665 bp, Triticum aestivum
  Clone ID: PAT_TA_7297
aaatcctcctcgcttcacgcgtgagcccagccggatccccaaacctccttccggtccgacgccggcgccgacgggggaccccctccgcctctcacgcgtgccgccgcccccgccgtcgccgtcccgtctccctcgccggggcatcgcgttccaccccgccggcgactaggaacacggcaccctgaagctcctgagctagagtaggaggggcaaaaccatccagctgaagaatgaaaacacatgagcgtgctgccaacttggctcttgctggtttgagcttggcaccgctcgtgatcaatgtgaacccaaatttgaatgtgatactgacagcatgtcttactgtctatgtgggctgttaccgttctgtcaagtcaactccacccgctgagaccatgtccaaagagcatgctatgcggttcccgttggtggggagtgctatgcttctgtcgctattccttctgttcaagtttctctccaaggacctggtcaatactgttctcactgcctactttttcattcttggcattgccgctctctgtgcaacgttgcttcctaccgtcaaacgttttcttccagaaggatggaatgataatgccatcgtctggcgtgctccatatttccactcactgtcggtggagtttaccaagtctcaagttgtcgcttcagtccctggatttttcttttgcgtatggtatgccatgaagaagcattggctagcaaacaatgttttgggacttgctttctgcattcagggaattgagatgttatcactaggatcattcaaaaccggtggtattctcttggctggactttttgtgtatgacattttctgggttttcttcactccagttatggtcagtgttgctaaatcatttgatgctccaataaagcttctatttcccaccgcggatgccgcacgcccgttctctatgcttggtcttggtgatattgttatacctggtatatttgttgcacttgcactccgtttcgatgtctcaagaaacattaagaaccgttacttcaatagtgcatttttgggatacactgcgggcatgacagtaacaatcgttgtgatgaactggtttcaagctgcacagcctgctctgctatacatcgttcctggcgtgactggttttgtggcagttcactctttgtggaatggtgaagtaaagccgctactggagttcaccgagacgcagcccgaggaggagggagccgccgaggaagaagaggaagattccagtcagagcaaaaaggtggactagcgctcgctcgggtcgagtcggatctttttaattaattaggagaggagaaccaaaccaaagcaggatttcaaataggctgtatgatctcgagaatcgaaaaatgattcacatgatagaactctttttgtttcgaaaggtcattaactatttgttttggtgagtggtagatgatggacgaaaagggaacatatatatgctaaaagacttacaacataatccaatcagtgacatgactatatatacctgctgccgccccctgtctcccccctaacacaaaaatactcgtgcttgacgcagcaagcaatggtttggtccggtccttaccctaccctcggtgacattttctagatttcgctgctaaatttcttggaaatatgtatgtattccagttggatcatca

SEQ ID NO: 7298 - DNA, 1040 bp, Triticum aestivum
  Clone ID: PAT_TA_7298
gctaacctgggcaagtacatcaactggaattatagcttacaccacaccagccctctcgaaagcttccgtgacatggatgtttatggtactgcaaccattgtacaaattttaatatacctcacagcgaggtatattaagaacccatgaatgctcctgcatcccacttcgcccccctttccccaccttccgcttcctggggttggtggcactgcatccactcgacaaattttaatatacctcacagcgaggtatattaagaacccctgcatcctccggtaacgtaatttgtacctcgcatcccaccctggaccccgaccgagcgaccgctacccccacctggttcccctcttatatctcaccttggacttgcaagatatggaagcatatcatgcacgcaatcctcttacgataaatgtgaaccacctgctataagagtcaccaccaaacatagtcttggtcgttcctttgacgcttttgccgcggagggccttcggacgcaccttcacccccatcgtgtccatcacctcgagcaccctcagcagcctcacctcttgcaatggtattgtttctattaccgtgatccgcatcctcactgcccccacaagtgtctgggccattggctatttgctcttcagcagcgagtagcgcataagccttttcaatctcaaggagcgtcatgtagtcatgaagagtatcttcacgggcacctcctgcctctttcagtttattgaccttggtctgggcatacttgaggagggcctgacggtttgtctcttggctgcaaaattcaaataggtgacgctgtatgacctctggcccatacttctcgacgatgtttgaggccttcgcgttcagatccttcgcctccttccgacattgggtgagatacatggtccagcactgcccgcggagttcattgctatccagagcgacataggaggcggacacagggtagtgctgctttgcagcttgaatgctgacctcgaaggacttgcgggcctcatcgattttcgccatatagtgggcaatttttgcatccc

SEQ ID NO: 7299 - DNA, 1447 bp, Triticum aestivum
  unsure (1)..(1447): unsure at all n locations
  Clone ID: PAT_TA_7299
ggccctcaccgactgccgtccccatccgcgttcatccagccagggcatcctttgccgctaagcaagcgacacctcggggccgaggcgacgaggatgaccgtaatgctctagccccggtgatctctgccgttacagattgcggaactgcatttcgatttcgggcccagtagctgggattggttcggcggtgagggttgctgtagaatccggggggcggggagctcctcgccgccggagatcacatctagttgtcgagaaccacctacatctaggcccccgacgatatatgggggtgctatggaatcgggttcctgtcggaggccgccgctgcccgtgatcatatctactcgattcccttacccatgcttctacacccaacatcggctattagctgggagatcctccggtcagagatttgtcgagatcgcttggaacatgagattgtgacagcatcatttttcgacaagtttctgttcggctcatcgccctatacctccgacgatgctgtttcccaccattttgtccacgtcaacgaacgtcaaggagtcataatttcgtgtctctattgctctcttgacgtgggcaaactctacctcttcgactatgctgtgacgccccctttcttcctcgccaaagcgcgtggaggatggtgcactatggcactctctgacgctgctcagcttgttgtccaccgtgccaaacacctcctcaacaatggctttggcatgtatagcctgtttaagaaaaactgtgaggacttcgcgatatactgcaagacagagctgctcgtcgagactgcttacagcgttgggcgcagtgggcagctggcgtccctgacggctgcgttcagtgcggtggcttcttcgccgctgcgtttcctgacaactagtgctagtggtctggcaattgtgacaagcggcatgtactgcgtggggcgatatgtgtcagacatgggtgttcgccgtgatgtgatcaaggtgcctgtggaaaggcttgtagagcactgggtgaacaatgtcactcctgctcttcctcaaggggccacccaggcggagactgcaacaccaggaggcttgcctgagctaccagaggaaggggagcttgctaaaacggcaacaccaggaggctcgctggagctaccaggagaaagcgagcttgctaaaacggcaacactaggaggctcgcgggagctaccaggggaaggcgagcttgctaaaatggcaacaccaggaggcttgccggagctaccaagggaaagcgagcttgctaaaacggcaacaccaggaggctcgctggagctaccaggcaaagggggacttgctaaaaagtaaagtgttatttagctgcngtattgtcggtcgttgatttggctttgtgaggattgctgctcaattcccttatctggnngtgttcacgcaaattcttcatgcanattaatctacctctg

SEQ ID NO: 7300 - DNA, 714 bp, Triticum aestivum
  Clone ID: PAT_TA_7300
caggcagcggtactctggactccgggaggtaggaggcggtgagatccgggggcacacctttctagtcgaggcgacgaaaagaagagacctccccacataaatctcacctctctccttcccctcgctccagatctctccgcacccggcagatccgaccacccggcgcgctgccacgtcgtcatcatcggcagccatgatctcctcgagcaagctgaagtccgtcgacttctacaggaaaattcctagggatttgacggaggcatcactatctggtgctggattatccatatttgcagcactggcaatggtgtttttgtttggaatggagctgagtagttacttagcagtcaataccaccacatctgtaattgttgacaggagttcagatggggagttcttacggatagattttaacttgagctttcctgcgctttcatgtgaatttgcatcagttgatgtcagtgatgtgctgggaacaaacagactaaacataacgaaaactgttcgcaagttttcaattgatcggaatttagtacctactggatctgagttccatgctggacctatacccactgtcaacaaacacggagatgatgttgaagaataccatggtgatggtttcagttgccttgtcctctcgcaattttgatagctattctcaccagtaccctgttttgggttgccaacttttatgccccctggtggtattggagc

SEQ ID NO: 7301 - DNA, 1936 bp, Triticum aestivum
  Clone ID: PAT_TA_7301
cccacgcgtccgggcaaggcagcggtcctctggacacctttcgaaacgaggaaaagaagtgctcgccccacctaatcgaaacgacgaacagaccacatccccccatctttactcaccccgctgacccgacccccccgcgcgctccctcgccgccagcatcggccgccatgccggcgcgctgccacccgaagacctcctcgagcaagctgaagtccgttgagttcttaccgaaagaattcctagggatttgacggaggcatcactatctggcgctggattattcatatttgcagcactggcaatggtgtttttgttatggaatggagttgagtagttacttagtagtcaataccaccacatctgtaattgttgacaggagttctgatagtggagctcttacgcgatagattttgacttgagcttacttgagctttcatgtgaatttgcatcaaattgacgtcagttatgggcagggatcagccagactaaaaatgacgaaaactgagcacaagttttcacttgattgcaatttagtacctactggatctgagttccacgctggaccgatacccactgttaccaaacatggagatgatgttgaataatatcatggaattgcgtgagcttggtttccctttccctgtcctctcacaatttcgatagttattctcaccagtaccctgttttggttgtcaacttttatgccccctggtgttattggagcaatcgtctgaaaccttcatgggaaaaggctagggagagatatgaccctgaaatggatggcagaattcttcttggcaaagttgactgcactgaggaagttgaactgtgtgtggggctgcgtatgcggcgccacccaccaggttacccatcaattcgcatttttcataaagggagtgatatggggcaccatcagcgtcaccctgaccatggcgcacgcgatgcggaacgtgttgccgcggctttggtcgcggctgtggcaacttttcctgcagaggcccctgtactggccctggtgcgtcctgtccaacacgactcctgctcctctgttgatcctgcaaagcgtcctgctccaatgaccggtggctggagaatagagggttttgtgcgggtcaaaaaggttcctggcagtgttgtaatatcagctcgatctggttcacactcgtttgatccatctcagataaatgtttcccactacgtcacaacattctcatttggcaaaaggctctcatcaaagatgttcaatgaactgaaaagactatttccctatgttggcggacaccatgatagattagctggtcagtcttacatcgttaagcatggtgatgtcaatgcaaatgttactattgagcattacctacaaattgtaaagactgagctggttacgctgagatacgcaaaggagttgaaagtgcttgaagaatatgaatacacagcacacagcagcttggtgcacagcttctatgtccctgttgtgaaattccattttgagccttctcccatgcaggtcctggtgactgaacttccaaaatcgttctcccacttcatcacaaatgtctgtgctattattggtggagttttcacggtggccggaatacttgactccatcttgcacaacacgctaaggttggtgaagaaggttgagctagggaaggacatttgaacgatagtagactcgctgaagcgctcgtgcactagcggttgctctagttagtaattatttttgtacttaatccattaattaacatatacagtgggagggggattgggtctgaatgttggggtcatgatataactgggttaaaccactgtttcgctaagtaaatgggaataaagagacgctggatccttatagcttcatcctgatcttgtcaccagtccaatttcagctctataaaccttaaaatattgctttttctaataaaaaaaaaaaaaa

SEQ ID NO: 7302 - DNA, 571 bp, Triticum aestivum
  unsure (1)..(571): unsure at all n locations
  Clone ID: PAT_TA_7302
gcacgaggccagtgtccgtttcgtgccatttgcagccgcagagcccgcctctagtaccgcacgaaggaggggaaaggaacctgtttgcaacaatggcttcctccggcagccgcccccttcgcgctctgcattctgcttctcgcgtcccccgccgtctccgccacattcttgttcgacgacgggaagtcggcgtcgaagggaaaaagcaaggacaaggcggcggtcgacgtggagtggcggccggccaccgcgacgtggtacggcgacgccgagggcgacggcagcaccgggggagcgtgcgggtacgggacgctggtggacgtggtgccgatgaaggcacgggtggggtcggtgagcccggtgctgttcaagtgcggcgaggggtgcggcgcctgctacaaggtcaggtgcctcgaccacggcatctgctcgcggcgcgccgtcaccgtcatcgtcaccgacgagtgccccggcggctactgctccctgcgccgcacgcacttcgacctcagcggcgccgccttcggcaggctggccgtcgccggccacgccgggcagctgcgcaaccgan

SEQ ID NO: 7303 - DNA, 797 bp, Triticum aestivum
  unsure (1)..(797): unsure at all n locations
  Clone ID: PAT_TA_7303
ggctgcaggcgcgtcttcgaggtcgccgtcgagctgtccaggaacatgggctgcagcttcatctcccccgagcacctcgccatcgcgctcttcacgctcgacgatcccaccaccaacaatctcctcagaagcttgggagcggatccgagtcagctagcgtcagttgcagtcacccgactccatgaagagcttgcaaaagatggcagagatctcgcaggagcatcttctctcaaagtgcccgagaaagcacccgctggagctggagctggaagatctgccttcagcaaatccttgagcaaaaagaaagataaaggtgcgctagatcagttttgtctagatttgaccacacaagccagtggagggtttattgaccctattattggccgtgaggaggagattgaaagggtggttcagataatatgccggcgaacaaagaacaatcccatccttttgggtgaggctggtgttggtaaaaccgcgatcgccgaaggtttggctcttcggattgcaaatggagatgtccccattttcctcgtggcaaagcgtataatgtcactagacatttggcctgcttattgctggcgcaaaagagaggggcgaactggagtccaggatcactagtttaattcgtgaagtccgtgaagcaggtgatgttattcttttcatcgatgaggttcacaatcttgttggatctggaactgctggaaagggtaagggtgctggccttgatattagcaatctactgaagcccccgcttgccagaggtgaactgcagtgcattgnagctacaactttag

SEQ ID NO: 7304 - DNA, 809 bp, Triticum aestivum
  unsure (1)..(809): unsure at all n locations
  Clone ID: PAT_TA_7304
gccacaagataaataatctttttaacaaaaagccaacattcaatatagttgagtaccgtaacagcgcagtaaacacgacccttgcaaacatgcccgttgcacatgcaacggctgaggaaaatcttcggggtatatttatctagcctaacagggaattttttgtccagctggaccattgttctatcaaagtccaaaaatggcatatcatcaaaccttcaaactattctgcaggcttcagaggcattttcatcaggaaagtcataggagtatatcaggccaagaccatcatcttctctatcgttcactcgtgctgcttcctttcttgaacgctgtaaggttccttttgagagacttaacagcagataacatttgtagcttctccgtggacgccccagcatgtttctgcttgatgttcctagtcgatgcatcatcaggtggcaatgtactccccggagatgactcctccacaggtggttcactatccaatgtaactgcatgcacgcccttcttcccagcttgctttcgtttgaagtcggcactcctcttgtactggggatcagtaggatccagcgcaaacagatgagacgtgaacatgggatcaaacctcttgtcattgctaagatcaatatgaggatgtttgtcctcgacagaatccttgcccttcttgccctttttactcttctcgtgccgaattcctgcagcccgggggatccactagttctagagcggccgccaccgcggtggagctccagcttttgttccctttagtagggttaattncgagcaggcgtaancaangancaactcan

SEQ ID NO: 7305 - DNA, 1975 bp, Triticum aestivum
  Clone ID: PAT_TA_7305
cggctccagtaatgcatgaaagtgtatcagttatgtcatctgacgcacagattgttgattggcaaggaaatgatcgtctttctgattgcggccggcttcgggttcccgatactgtcaccagcggagatcgcggagcagctgttccagtacgggcatcgcccccatcgccaacctccgccccgagtaacatcgccagcccgcagcctgacttgctccctggcgtcctcgcccgcttcttcgactccttcgtcgatgcccccggggacggcgaggatgggctgctagggttcagcgacctggaggtgctggacaacccggagcaccacgcggaggccatccgggtgctacgcctctacaacaagtcgcaggccttcctcgactccatccagttcaaggacttcacgctcgccgacttcacccgccccaccccgcgccgcgtcgtcgaggtcctcagcgccctcatcaacttcctcttctacagggaggagaaggtcaccctcctgcagcccatcgtcagcgagacccccgactaccacgagcgcactctggagctcaaggccaggatggcccagcttcagaaggagatcgcggatcatgagctcgcagagcagatggaggagcccatggcccagcagctggaagcggacgtcaatgctctgcagcagaaagttcaggtttacaacaagcagcaactggccctgcgagcaaaggccgcagccatcaatgacaagaaagaggagattcacaggaagataacccaggctgattttgagttgactaaacatgcccaagaaaactccaaattgaggtccaagttagtaaagtccccagagaaggttcagagggccttggaagagaagaaatcagcccgtgctaagttgaaagagtctgagaaaatagcaacacaaaatgctcaagagaaaactggcactttggagatacgcaataaggctcatgaaaaactgacgaagcaacactctaaaatccaggatgtacatgaacagcttgttgctgctaaaacagttgaaaaggaagttaaagctcgcaaagcgaagcttaatgatgaaagtgtatcagttatgtcatttgacgcacagattgttgattggcaaggaaaagtacatgaaatggaggagcgtctcaaggggaaagtcaaagaaaggaatcaaataatagcagatgaaaatcagaagctgggtgctttgagctccgagattgagggtaaactgcagtgccttgaacctagagaaaagaaagtagaggcaacgatcgctaaggcttcaaatttgtgttcggaagctgcttcagcaaggactgctgccacagcagaacagcagaaaattcgtgcaaaattcaacaacattgtgaaggcgttcaacacctacatggatagcgttgaccctttcctcgagcgagttgaggaggttggcaggcaatcggcaggggaaggcgcctctgcccctgatccatctgccgccgtcacaacaaaaaccacaccgagagccagcgcaatgagcaagaagagggctaggaaaaggacatgagctgtgcttcttgccagtactcccttctgtctcggtgcatagggcatgcgtgtagttctagggtgaatttgactaactaaaaatgtcttatatctcatcaaaagcatatcattggatacatatatgaatgtagtttctaaatatatatttttgttacatataatacatattagctagttaaattgatggcctagaactacacacttgccctatgcaccgggacggagggagtacatatctttgtttatgtgtgcatgatgctgtagtagtgcctctagctgttattaatgtgctgaattatgtatgcgctggttggtttggatcggtgccagttattgattgaggtgaccgaatgctacgtgctgatgttatcttcaatgtaaggacccaccacatttttggcacttcccgaaatccgcagagcgcgcaaa

SEQ ID NO: 7306 - DNA, 610 bp, Triticum aestivum
  Clone ID: PAT_TA_7306
tacttctcttctttttttttttttgccttttatgctcagtgtgacagatgtgaccttctaacgtactgagatatgggcaacctatgcccaccgctctttatcacctgaagaatttgggctacatttaggcagaaattagcccgacgtatcgtctcgttgtgcgagcgaaaacgcatacgacaactgcattactaacagtactgtataccattcctcttggttaaactacgtaggcgtaggaaactaaggaggaatatatgccatagtttttcaacctaagaattgcatagctttggtcctcatgatttgatttgcttctccttatcctcttcctctttggcaggtggtactgtcgccgaggcatccctgctctttccccacagcagaatatagaggcccattatcatcagtatggatcccagtacactgcctggccagatcttctcatgcagaaggtggtgccctttggtcccccccttgctctgctgcatgggcatgagtgctgaggcgcactctggcccgctctgctccaccctccttgtcttcagtacgtgtcccgaatgaatgaatgatcatgagattgtactgatttataatctgaagcaaatca

SEQ ID NO: 7307 - DNA, 527 bp, Triticum aestivum
  unsure (1)..(527): unsure at all n locations
  Clone ID: PAT_TA_7307
gatttaccgtgttacattccgnaattgcatcagcaacaactgcgtagtaccgtgttacatccagaactgcatcagcgtcaaccgcatagggccgtgtttcgtcccgggtcccccccccttcttctgctgccccccgtgataaagcatgggcgtgcgggaccaacccgcaagcaccaattgttcgatactgtatatgttacacgggtcaatgatatacagtagtaaatcaaaactgccgtctgttctgtttagtgaatcatcgtgcgagctcctttccgcgtgtaattcccagagtgcggataaaaccttctgtggccgattggtttcagcgtccattaacctgttgcgtgctatctgtatcattactcatccttgagccagtgctgaatgatgtagacgacgaaggaaacacagaacacntacttgaaccaaggacgaccggaatttggacccacaacgaggaagcaaaagcttcccgcacgagcaaatgccagagcgcgacccacagagcgctgaaggctgatcct

SEQ ID NO: 7308 - DNA, 645 bp, Triticum aestivum
  unsure (1)..(645): unsure at all n locations
  Clone ID: PAT_TA_7308
tcgagttttttttttttttttttgacgaaaagagttcactgtatacatatcccaaatcccctcctcatgacgatgaagataatagacttacaaacaaaatcttctcaaaacaaagaattacacacaagaatggtcttcgtgggtaataacactttcccctcttccctctccaaaacaacatgcgcaaccatgccctgactatacatgccacaaagcctcatcaacagatagataaaagttcccacatctaaaagcccgaaaacatctcgaagaactatttacaaacataggcacgcggtgatgcagaaacatgctgcacctctgacaacaagcgatgccgcaacatgtcgcacctctgacaacaatgtactgtcctctcccctcatttgctccttaccatgaatgggaacgctaagggtctgagtagacccgggtttcctacgctctcgtgcctggcttgggccatgtcggcaccgtgcgacgagagcatcctcctatgtgtccaaagtccgggcagacaggttaccgatagattttcatcagttgtagtacgttcagcaccatggatcatctcctaactccgnaatgtccgtggaccggttaataccccagaagggggggccgtacaatccccatagggtctat

SEQ ID NO: 7309 - DNA, 674 bp, Triticum aestivum
  unsure (1)..(674): unsure at all n locations
  Clone ID: PAT_TA_7309
acattttagattagtactngcattcatggcttcatgccaacactaaaacaagaaaatctagctaagctcgatcgacttagccgacaaaaggggggtcaaggctaagaaacagtaaaccattgatacctcaaaacagtccactagcactacgattacactatgtctaaagttcaaggtgtgaatagtctcatggcaaccaaaagcagcagcaccctagatcatagataaatcataagtggcctcagcgcttcctcttgtttgactgcttctgttcaaggacaaactggatggtttcttccagtgttgctctccgaccgtccttcttgttccacagctctggtacacctacgcggctgcgggggtcgtactcgttgatctcaagcagtgcatttgttaccaaggcgtagacttcttcaccatgctcctcttttaacttctgaagcttggtgtcatccttggagagaattctcgtctctttaccatcaacggtgaataccctatacgggcgccaatttgggtttgcaatttcatcttgccacttggagcaaagagtatcataattaacttgtgcatcctgttgtgctgcatttttgctgcaagcatttgcaaacgctcttgggtcaagctcacccatccatctgacaccctatatgtgcatgagcatttgtagactt

SEQ ID NO: 7310 - DNA, 1223 bp, Triticum aestivum
  unsure (1)..(1223): unsure at all n locations
  Clone ID: PAT_TA_7310
atctgagntgatttttagnagncatgattgtgagagcattatatcgaatataagatacacaactacgtcaggcagaacatggcggctaagtcttacccccaagtacatgataatgagctctagggcttccaaatctttgtttattaccaattacaaccagtgaaaagtaacttcaacttaaaagcagagtagaggtgtataaagaaacattaatagagaccgatgcagtcttccgagccattggacgcccatcgccggccggcggtgggttgtggctccgcgcgatgcgctgggtggccggctccggcccttcgcacgaccgtcgatgatcctggtttggcgccaacggcctggtgtcagtttcttcagttacctacagaagaagtgttgttgtcttcagaagatgcagtgtgtttctgacagcgcggcgacaggtatcactcaccaaggaacacatttcaggccaatgttcaagttgaggaaaccggattacattggccagcgccgacaaatcaatttgctcattatcacagaccgaaaccgatcaaaattttgcagggcggagactgcatcgggtacatgattatgctacactgactgaaccgaccggcatgtacgattgtcccttcgggcaaccacagaatcaaagcctgccagcagctagctatcgaattttccaacctggaacggatggtgagaacaggtacagtggcgatcggccgttgccatttagaagagggagttgtaggtcaagaaggtgcatgcaattgatgcggcgcagatcaccagggagggcagcagggtgacgttgaggaggctcccgatgcccaggtaccccgctgcggtgatggtgcagtcggcgaccaccctcgccagggtgcccgcctccgtcgccaggtgcccgccgttggatgggccccgggccaggcgggacgacatcacgcgcccggtattgttatttattgtcactacctccccgtgtcaggattgggtaatttgcgcgcctgctgccttccttggatgtggtagccgtttctcaggctccctctccggaatcgaaccctaattctccgtcacccgtcaccaccatggtaggcccctatcctaccatcgaaagttgatagggcagaaatttgaatgaatgcgtcgccggcacgaaaggccgtgcgatccgttcgagttatcatgaatcatcggatcagcgagcagagcccgcgtcagcc

SEQ ID NO: 7311 - DNA, 664 bp, Triticum aestivum
  Clone ID: PAT_TA_7311
gcagcaggtccaatatttctgttattggttaaaacttcgaacatacgtacgtaaccagaccatgtaaccacacaattcaaaattcccacaaaaatggaaccagaagcagacataaccgtggcagcccagttccatgaacccgaacacaacatacattcttctaaaacatcctcagacaggcaaactttacacacggtaggctatgtaggttttctacgcattgtagttgtccaagcccaggtctctcagggcatctgtggcggcagctttgcagcttccatgtattgccttggctttcctgataagcttctccacaccttcgttgagcaagatcgtcctgttttcagggtttctgaccacgagattgcgaatcataaggcatgcttgcttctgagtcagcgcggaggaggggaacttttgcattgtatgtatggccagagtgccgtagcctagcgcgactgcacgtgctgcatgttctggtgaccgcaatgtaaggacttgcacgatagacattacctcctgtattactgacgggtcttcagaaaatctggacgctaacttcaagaacttgtcaaaaccatcttgctgaatgatattggccttgtttgcatcacttccagccagcttagacagcaaagagcagccaagattttgctataacttt

SEQ ID NO: 7312 - DNA, 662 bp, Triticum aestivum
  unsure (1)..(662): unsure at all n locations
  Clone ID: PAT_TA_7312
ccgcgggcganggtttttgcgtggttgcggccgtgggttcgtgttttttgtttttttttttttttttttttttttttttttttttttttagaatgaggtctcaacaactcattttcttctttcagttcttcgttcacaggtggtggtggtatgtaaaaagcatctaacaagttcaccggcaaaacagcaactcagagtacagagtaacacaaacgatggagctaggcctctatggacaggttcttcttgtgtctgctcagcttcagccggggtgtggcatcagctttcaccacggccagcttgtcgtcgtcgctcgacgttgccgccttcgcaggggcagcatccttggcggtgctgcagatctgcggcttcgcgccaagggagaacagcctgctcttgccggtgctcctgctgcggcccagcctcgcgatctcctcccgcatggtggagcactccttctccagctcggccacccgctgcttcatgccgtccatgccctcgcgcagggcctggttctccctggcggccaggggccagccgccgccgccacggtgttgctcactagaggttggcatgccgagctgcctcgatccgccctcgaggttctcggagatcatgaggcactcggcgatggagctccgcagctgcagctgcttcgaaga

SEQ ID NO: 7313 - DNA, 848 bp, Triticum aestivum
  unsure (1)..(848): unsure at all n locations
  Clone ID: PAT_TA_7313
gccccccccttcgagttttnttttttnannattttttttttttttgggtgcccccacaaagggggagaaaaacataactcgtctatcaaaaattctatcagcacttcggcaggttccagaaagaacacattcgggggtcaaatacgagcacaacaatgcagatatctctaatctagttctgtagtattctagttctttcgagcttggtgcagttgagctacaatatcaagcctcaagtaaatggaacacggtttctcttcattgccatgggttcttctttcggcccgctgcaagcgtcgaactagttttggaactggatttcgacttcttcaacttgccccgaatcctgttcttttgaggtttcagtttataaatgcgcaccatccagtggtgggttgtgaaaacctcctcaaaatgtgttagcttgaaatgcttctttcctatttcatatcctcttactctatcaaagcctttgccatcagtctcaacaaacctgtaatagcaaagcttgtacatgaggcaattcaacatagttggagttgcttgagcatcaacacggtactggccatctctaagataatctggctccttgatgtgagggaattcaccacctcctatgcgaaccatccaaaggaacttgttaatatcatcactagggtagccaaccagacctccaaacacaacaagcacatatttaacatctaaagaatcaaagatctcccatgctgccttttctggggatgacatcgctgtaccaactcttgctatgtgagtgttgttccaggtattgttgtctacaatcacagtcctgttagccatagcagttgtttgataaccatagtcccacc

SEQ ID NO: 7314 - DNA, 676 bp, Triticum aestivum
  Clone ID: PAT_TA_7314
cgtacgagagagccctcctcccccaccgtcgccgccgccgacactccctctgccctcgaccgcgccctccaccaccgacccctttgccctcgaatgcgccttccaccatcgaccccatacagtgatagtgtgcgacctccacccatgtcgatgacgccagtgcgtagaggtcaacctcgcctccctccacacgcctttggtttcgctccctttggcaccgccacaacgactggataccgggcctggtttgtagaggtcgacaccggcttgcttcccaccatgtctcccgccaccctgacgacgagcacggtgtctgctccacactaccctagtacaacatggtgctcagatctgtcatggaggaaacgcgatgcaggtgtgatttttccatacaaagaagctctccttttctgcttgatgaaaactcacaagatgctatcgcgttatcttctatcttctccttgctgcacattttccctaccttccaccgagtcagtacttggatccaagtctttcttattgctacttatttttattttgctactaaattgatgcaggtgctaccagtgaaaggattggagattggttctagtagttgtaggttcgtttggaattcataatgctcatgatttgcaaagcctatcagccagaacacgttgatgcatagcattaaatg

SEQ ID NO: 7315 - DNA, 849 bp, Triticum aestivum
  unsure (1)..(849): unsure at all n locations
  Clone ID: PAT_TA_7315
taaaatcatccaactatatggttatatagttgtagtngtttannaagcgaccttttgtaaataccccaaggaatncgcaacacctttnnaaccctgcnggagcgggagcgatncaatccangcgtttggaggaggtagnttctaaccaatctacnaagtgggctcgccacccaccggcgtgtgcggtacagtcgcacacacttccatgcaaagctacagctttggaccctgactattttgagccctaatcttgtcctagaggacgggaaacaaaattcgctatgctatgccctcacctcttagccacccccttttcagcggcagcgcccgcccgccgctccaggtctcagctaccctcggctcccttgggtaacgctacggtacttcccatagcattccacaaggagtacagctgcactaagtcaataacttctcatgcacgtttatcctcagtaaacacatgcatgttcacaatatctcctgttcctttaacagcactgcctacaagagagagtccttcctcgtcagcctcatcacctgtctcctctgaatatgcaaatcctgttggattacgagatggtgaccaaagggtgcatatgatggcaagaaggacatatgagaggacattccagaaggcagggatgacccaagcccttcgccaaagctcactcaatggatcggttgcattgaaatatagctcatagccaatccaagcaattgagataaccactgacatagctagagaatttgtaaacttccgatacaattcaagtttcgccatgcttctccgcagctgcagtttctctagagttctagagagggatgaaaatatccagatgatgaaggtag

SEQ ID NO: 7316 - DNA, 652 bp, Triticum aestivum
  Clone ID: PAT_TA_7316
ttttcttgcagagcggcggcagggtgcgcctccgcctctccggcggcgcaacgggtagctcagccgtttggaggtcacctcttcctaattggacagataaacccaagaagacgaagaataatgacggagggcgtaaaaaaagttgtactattggcggaagaaatcttcagggcggtgctgggatggagagccgttcacaggactgcggcgacgtgatcttctgaagtttcttcacactggtgaaagcctttgggagatttattctgtcatcgatctatacatgtagctcctgtcttatttcttcagtctgaactgttgggggttatgctactagttatcgtttgttctgaacttgatgttctggttgtttttgcttgagtcgtcctggagaacccggcttgtgagatttctcagggctgtgctgggtggttgcgttttgcgtttgtgaaacctagtcagtttcttagattgggtaaaaatctgcacttcaaaggagggaggctgtgggattggctctttttcatcttcaaggagtgtgcatcgtaggatttgctgctgtgatgtaagttggcaatagcctggtgtcagttgtaagacttggtgatttactaataattgaaatcatagaggaaactctttctcaaaaaaaaaa

SEQ ID NO: 7317 - DNA, 439 bp, Triticum aestivum
  Clone ID: PAT_TA_7317
cgacggcggcggggtccagatccggtgctcctccccctcccaatccatcttccaggcaggctcagcctccaggcgcccctcgacgccgcactgcacctcatcgaccaggaccctggtcgccgccgtcacggtctcctcctccctggtggccgcggacgccaactcgtgcatctgcccaggaatccatgaggcaccacctggccgtctctgtggcggattacgacagatttgcgaccaagctcaagacccccggcacagacttgttcgccaagacgcaacccgatggccgcgcgcgccaagtgttcttcctcgaccgggacgcatttgtaagggagtggtgttccatgatgtaagggcgtgctctgataaaaacatgacatgacaatagaggtagatttgacaactggatgcccaggcttagataggaactgagatgaca

SEQ ID NO: 7318 - DNA, 669 bp, Triticum aestivum
  Clone ID: PAT_TA_7318
ataagccggccgtaccaaacgtttcgcctccttgtccttcaaacaagatccccactagcccatctccctgtagcccgccgcggtctcctcctccactcgtgcatctacccaggaatccaggaggcatcacctggccttctctgtgccggattccgacaggtttgcgaccaagctgaagaaccctggcacagacttgttcgcgaagacgcaacccgatggccgcgcgcgccaggtgttcttcctcgaccgggacgaattcattcttggaggtcttttatcttcgttggattccctttttctcaatttttctttcagaggtagaactgacaactggatgcccaggctttgatagaatgttggaggatgtagtagcatgcatgggaaagcttcttacatcgctggaattttccacatcagttcctgaaccacgcttagcacttagtactgtgagagcataaggagaagaatcattacgcttttctcaaatagcactccgccgttgtgaaggaagctctgaccatgtaaaataaccacacctttgtggtgtaaaaagagtgctgatatattgtgtactccggctggcgtgactggtgtttctgttcacgcttaagaagtgcttcatataatggcctacttacaatccaaaaaaaaaaaaaaaaaaggccccta

SEQ ID NO: 7319 - DNA, 766 bp, Triticum aestivum
  unsure (1)..(766): unsure at all n locations
  Clone ID: PAT_TA_7319
ccctnaaaancggagnttactttcntggnancagggnttccatatccgcaagatncaacatctttttcataggcccnccgccctgcccataagtacaactttctccggtacttatcctccacatcactcctcggagaggggnagaactcctccagttctnancattgactcaccctctcagcggtgncagttcccccattctccacatccgttggtccagagtaggtctttatccaattcaattcccagtccaagccagtagaaggcttgtggccagcccccccctccttgttccattcgccccagacgacatctcaagcagtgaactttatcttctggaactgtcatgaccagaaacttcggtagcagccccaaaacggncacagtaggtcagggtttgtagagaacagagtagggcagggtcagaatgagatctccccgcgtagagcgaggaaaacaaacatcgaaaacctaggatggttcatcgtgttcaggaaatcctcggtccatggtcctgtgaacatgcaagcaataccaatctccggcggggtggatgaccgttcatgacggcctgggttcataggatccttcgatcttatgccatgtgaagatgcaagcgccaccaagggaagatagagaaaaatagaggtgtgccgacgacgacggccacatgcaggattcgtgtctccggcggactagccatgtccatgcacggcagccacgcacggggatccatcgccggaggcggagcgagagccataggcag

SEQ ID NO: 7320 - DNA, 1015 bp, Triticum aestivum
  unsure (1)..(1015): unsure at all n locations
  Clone ID: PAT_TA_7320
ttttttttttttgggttagctcgttnaatggttcnnaanaattggtataaatgctttgtaccttgtatcccttttctccgtccatccaacatcgaatcggtactggccacagggcagactgttaaggatttacgccggtaatttgcacatacaggttattttgcngaagtcaggaccttgagctctcttgtggtcatgtagcaattacatgggacactggggtgtcccattgctacctgttcgcaactggaaaagcaatctgccctcttaatgcatcaaagttatatatctaacatggagttcattgcacggagacatagcagcaatcaatttctctcttgtttgctgttcagagccaggggacttgataacgaaggaatgcatgactttcccattgttggatgcgatctttgattcaccaactttgacttctgcctcttcaaaagcttggaacacattatttatcggatagttgtccataggtgacattacacggacaagaacctcatcttgccccacctggatatctacttcttggcctaggtgtttggaccctgcggtctaccatacccagactcccaagaacatgtctctttccggactccatctctttgagcttcttctggagatccagtgatgtgcgttatggcatctcccaggagcgatgctttgtccatttttgagatattgggaacaacagctctcagtgcatagaacctctggttgagtttttccctcctttggcgctcagcctcaacatggttaagcgcctctaccctcccgtttgctggttttcttcccctctttcttggttgctggccctccattgcaggggccacttgctccttacacaaaccatcgacactgccattttccccacccaacagagctgcttgtgaagtctaaacaccagattttgaactagaccctacgctaaaatctatatgcctcggtgtctgtgactgaggtggtggttgtgtcagtatctgcgtgtgaattctggagctgaaatggg

SEQ ID NO: 7321 - DNA, 659 bp, Triticum aestivum
  unsure (1)..(659): unsure at all n locations
  Clone ID: PAT_TA_7321
ttttttttttgtccgggcgtgtcgtcgctcccctctgttatttacatagcggcaactaaagcatcgatagagatatatacagctatatttagcatctaagcaggtctcggtccaaaccaacgcttgatgtcaggtagcatcatctatggattatacttcgacatattagacaaagaataactgtaagatgaacccttcttatcggatgctcgagagacatatgcaaggggatcttcagaatagagctttgaccttgatgatgcgctggcacctggaacgctcaaaccacctggtctgatcgatgccaaattgtagaagtctgccacgccgccactgtactgagtctgaacagataaagcagccagggtctgattctggatgccaaggggacgctggttcccagcagaaagcaatggattatgagcggtagcntggaactatgttatggctagaaacagcttggtacttgttcgcaactccagctgtagggaggctctgccttaacatgagctcctgactcgatgttcctaccgggcgggcgttctggcccaaggaaccttgtacggcactctctggaagctgtggtctcttcctggagtccagaatgttcttactaacttcacgagcagctgcagctgcagcattggctgctcgctttc

SEQ ID NO: 7322 - DNA, 722 bp, Triticum aestivum
  unsure (1)..(722): unsure at all n locations
  Clone ID: PAT_TA_7322
cgggcagaggggaattgcattcntaaatatatcgtcttaatntgatttatagtcagttctcctaaaacagactacacccgggggcaatttctaaagtcccaactactaattacaatgctcatcagcaaggccgttccctggaatgcttgccaatttcttccagggaggaacataccaacaataaatgcatcccaatcaatcccgtccacaccagttagataacaacgagcatctgcttccaagtattgcatttccctgttgcaaattgcagatcctggcagaatggaagcaaatctaagcattttcggatgatgagtctcccgaagatttgactccttagacctcctagtttattcttctccttcaactagtcttccacgtacccatctcatcttagacttattagcaggtgaggacacattctctagtggctctgctgaaataaattctgttgtatctgctgcaatccggtcgatctggtcgttattgaccacttgctcactgatatatagatcatttgttccaagatttccgttcacatcttgagctgttgaaaaagctgaaggaagcaaataagctctttccatggagttctctatcctctgaaacatactgagttgttccttttcacctagtgcagacacatcaaaatagaaatccatgccattaacagtccttggaggtaacttcattccatttacagatttattctcttgtttaat

SEQ ID NO: 7323 - DNA, 734 bp, Triticum aestivum
  Clone ID: PAT_TA_7323
gtaaattatattcgttctctcctccccccccaagcagttagttatcggcacgaaagagcgagactatcgttccataagcgatgcaaacgataacaaattcagaaccattatgttctggcacaatggaagctggctagatgctcgtgggatcattccataagcgattaccgatgactgtttagtttggggtggcgcctggtctgtcatgaagaggagtatggctaaaggtgctggccgacccccggtccgcgccggtgatgggtgcgactggctccgcatccgttcgccttccagcccccaccttccgctcctgggggaggactgcttccttctcctcgttcatgaatgttgtgtttctcaggttgagactccagatgctgtcgcagtaccggtaggtgcgcagattgccgcccttgaaggtggccctgctctcgacatgcattgtccagcgcgtgacacatggacttgtcgaactgcatgacgacggccatggcgagctcggggctgagcgcgccgctggccaccatctcgttcagcgtctcgatgagggccacgccgatgaccgactgccggtacaggtcgatcgcctccgccatccctccgctgacccctagacccctgggcgatcggcggcgggtgcgccggtcggcgctccggatctggagccgcagggcgggcgggcgcgcgaggctgggggccgggggtgcgtttgctgcggcgcgggtttgggagcg

SEQ ID NO: 7324 - DNA, 995 bp, Triticum aestivum
  Clone ID: PAT_TA_7324
cggccgatgaggaggcggcggttacactccgtcgcctgcaccggccacaatcctctttgtctctaccactttgaggagttcttcggaacgatgggctccaagatgcttctggtcaccgctctcttggtgggcatagcctctcagagctatgccaccaggagccttgacggaaaccacttggctgatcagaagtacggcggtggcggctacggaggtggcggtgggggctccggaggtggtggtggctacggaggaggtggcagcggcggcggaggtggctatggaggaggaggcggcggcggcggctacggaggaggaggcggcggttacacaccgacaccaacaccgtcgacgcccagccacagcggatcctgcgactactggaagggccacccggagaagatcatcgactgcatcggcaacctgggcagcattctgggctccctcggcgaggtgtgccacgccttcttcggcagcaagatccataccctgcaggacgcgctgtgcaacacccggaccgactgctacggtgacctgctgcgcgagggcgccgccgcctacatcaacgccatcgccgccaagaaggagaagttcgcctacaccgcctaccaggtcaaggagtgcgtcgccgtcgggctcacctccgagttcgccgccgcagcgcaggccgccatgttgaagaaggccaactacgcatgtcactactaggctaggctgccgccccagctggtggtcgtcggtggctaaataagtccatatatgcatgcacgtgtcgtgcatgttttcatgcagttcccggatgcgcgcgagcgtgtcctccgctaagcctttatgtgtttgcttgccgtttgatgatgcatgccatgccgtctcatatacgtagtgatgcttaatgctttgcttgcttttcttatcgtcgttggtgatgtaagaataatttgatttgaggagttattagtgaaagacataatgcatgatcgctactttgttcaaaa

SEQ ID NO: 7325 - DNA, 1142 bp, Triticum aestivum
  Clone ID: PAT_TA_7325
acgggcccgtttggcggagcagttctcatcgcctttacccctggcgccgatgcttgggcttcagacgtggtcattgcttggtccccgctggcaaaccgcgtctggggcctggtgcggggggcgggctcaacgctgggtgtcgactggatcatgttgctaaaagaaaaggatgcgctggtcctcccgctgcggcggagcggcgctgttcgttggccgcacatcgacctgtccccggcgcttctacctgtgcttggggtttctcctttgtaccaaagcaaccgtccccgtgctccatgtggcgacggcttcgtcggcgcgctgctcctctccgccagtcttggctcgagccggtcccgtctgcacctatacaggcagggaaccaagcgttggcgctcgtgccatgccaacgacatactgaacgcggagaagcaattaatttttatgtgtatgtaattatgtattgcacatcatgattcggcgatgtgatggcaatctcgtaggtgttagcattgtgtcggcaaagaaaaatgaagatactggttgtggacggcgcggtgcctggccggggcccccctgacgggcagctcccggaacgactgatcggtgcggttcggatgtcgcacatagaactatcatctgcggttgttcctgtgcttgaggattaaccaaattacactactatcgctcatttggtccaagtgatgcttgcaacgtcggcactcatctcctctatttcagtcttgacaagacacagtagggtatacatatatacaggcagggaaccaagggttggcgctcgtgccatgccaacgacatactgaacgcggagaagcaattaatttttatgtgtatgtaattatgtattgcacatcatgattcggtgatgtgatggcaatctcgtaggtgttagaattgtgtcagcaaagaaaaaaagaagataccgaaattagggctaggagactggtcgaggcccaggtgagggccagttcagcgcgaataaaaaagccatgtgtttgctttgtttggaacttgtaggaaaggggctgagatggcagttccaagttcaaagttgaaaccacacaagccattgttcatgtactaatatgtaacttgagactgcaatataagatcatgcccctggt

SEQ ID NO: 7326 - DNA, 720 bp, Triticum aestivum
  Clone ID: PAT_TA_7326
tccatcctctcttgcggtaatacaatttcaaacgcctcgtctcgtcacacacacacacacacacacacacacagagagagagagagagagcccacatgtggggtgacatggatacctagtcactgccatataggtctgatttttattgcaagtgaggtgatgggatttacattttattatgcaacatccgcatagaaatcctgatttgtaatccgggccgcaactggaatcctcacagtatgtaggtcgttatgccaagtaagactgccaaacgtgtagtccccttgcaagttccacataggtgacagcttcacatcaaacttttgaactttgttcgcattgtcgaacacaagaacaggtgggaaaacctccatcttgactccgtctgggctttgcactatggcatgatacactgaatggacatcgccgacatttgtcaccatccttgggatggtgatcggacccctcaggtcgggaactgaaatggacggcaagttgaggttgtacgccagtagtgtggcgttgcagcccacggatgtcgatgtcctctgattgatgattgcacattggaagaatttgttgtaattgcgtggattaatgtcgtaaaccagtcctggatgggctgccctagaagggttgatgttcccacctccatagtcgaacgggtcggccaccttccgtggcagtccttccgccagtattgacatgccgcgttgatca

SEQ ID NO: 7327 - DNA, 726 bp, Triticum aestivum
  Clone ID: PAT_TA_7327
tcgcatcgtaggcgttgtcctgcgttggcgtacgacctgggcctcttgctcggcccacgcccccgccgacccaagcacgccccgtggggtgccgcccggagcccacgcctccgcgcccctcagggttggcgccgcgttccggcccccgggctaccctagctgatgcatctaacgtcgatttacaacgatgacgaacaatcatgactacttgcacggtgcacagccactggacgcgagcaaaaccaatggtgaatcgtcgctagcccgtgccattactgcacacagggaaggcacaacgatgcgtcgtcaggagtaacatcgtccagccgaaaatactgtctcgactctggccaggaacccgtgcctcgccttggcaacacacggttggtcagcccgcttgaatgaatcattgcctcaaacttccgtcgcctaaacggcgatagtccctctaagaagctagctgcggagggatggctccgcatagctagttagcaggctgaggtctcgttcgttaacggaattaaccagacaaatcgctccaccaactaagaacggccatgcaccaccacccatagaatcaagaaagagctctcagtctgtcaatccttgctatgtctggtcctggcatgttcccccgtggcccgtcctgctgcgccgccggctccacgcctggtggtgcccttccgtcaattcctttaagtttcagccttgccctcgtgccgaatt

SEQ ID NO: 7328 - DNA, 543 bp, Triticum aestivum
  Clone ID: PAT_TA_7328
cacacgctatactgagtcgtattacgcgacggtcatcaccgatgatggtctcaaccgacaattactcccgcaaggcgtagccccttgcacaccctgagaagctactggtcgtcgagaagtccgagccgagcgcgatccatgctaccccaacaacaactcctccaacgccgtcaagaccgacgaggcacgacggcgagggcaagcgcggccaccgcaaagttcacgctacttgcggcgcgtgtaccgacgaggacacgggctctgccgccgcccacacacacatatcaccatcatcatgcatggagaacgcgaagcgaagacgacgaagacgaccacacagctcaatcggaggtatctcgcgtagcaacccgcgggagtaattaaccgggagtcttccgaagccccggtaaccaggagatcacacaatcgccacagccagcttggccgtgctagtagggcacggagctcacctttttttgggatattgtaattttatttcttcaatgagattaatgaaatacatgttcccgtaaaaaaaaaaaa

SEQ ID NO: 7329 - DNA, 842 bp, Triticum aestivum
  Clone ID: PAT_TA_7329
ttcaggtaaactgtcaaacaaaaatattgcagaatgggcagttccaccacaacaccatgcagccactgtttttcatacagcaggtacaccaagaaatttcacatgccttcacttggcttggctctagtgctgctggtctctttggtccctccgaccagctcctgcaccgagcaggagaagagctcccttctccagctcctcgccgggctctcacaggatggcggcctcacgaagtcgtggcggcacgacaccgactgctgcacatgggaagggatcacctgcaacgaagataggaaggtcactgatgtttcgttggcctctcgaggcctcgaggggcccatctcgccgttccttggcaacctcaccggacttttgcgcctcaacctttcccagaatttgctgtctggtggcttgccactggaactaatgtcatccagcagcatccttgttcttgacatcagcttcaaccgcctcacaggaggcctgagcgagctgccatcttcaacccctgcacggcctctgcaggtactcaacatctcaagcaacttgcttacaggcatattaccatcgacaacatgggaggtgatgaagagcctggtcgttcttaatgccagttccaacagatttactggtcagataccaactacaccatgtgttggcgcgccatcttttgctgtgcttgagctcagcttcaaccaactcagtgggaacatccctccagggctcagtaattgctcggcgctgaaattgctttggtgctggctacaacaacctcagtggtacacttccagatgaactcttcaaggtcacctcgttagagcacctgctctttacctaaccct

SEQ ID NO: 7330 - DNA, 727 bp, Triticum aestivum
  Clone ID: PAT_TA_7330
ggacaatcccgaccttgctgattgttttccacactaaggagatttcgccccgatttcatttcattgaaatgaaaccgatgaaacagccgtcagaccacaagaatgcaagtaccaatccagaacaacaaagaaataggccacccaggcaagcgcccataacatgacactcgccagctcaaaacgagataaccagactccaagattttccacccgtcagcgggcattcgttagctgaccccctcctccacatagtgcgcaaccggcccccacgactacttggcttccgtacctccgctagcaccgcccccctccgccccggctgcggcccatcggtcgggtagttgtcccccgccgccctagcgggctgacacgcctcggcttgggtgtgcccggcggccgtccgcctccatgcttattccattgatcggagcaagcccaagcacaaagcgaactgaattagtgcccatctgcatctgctagtggctccgatgagaagagaggaacataaggccgatacggcccgacactgcttttctcgagatcgagcacacttgagagttggcgacgccgcatgtcccacgacaccaatgaagccgcatctcgtgcatcgccctcccaaagacccttgctgacaaagaagaaggtgtcgcgatcgggatggaacccaaccagccggtactccacctcagctaggttcagcacctcatcgattctgaaactgtgcttc

SEQ ID NO: 7331 - DNA, 1502 bp, Triticum aestivum
  Clone ID: PAT_TA_7331
ctcgcgccccactcggccggcgccgcgaccgaaacagatccagcccttgctgctcctcgtctccgtcttcttggccgggaagaaaggaagggaaaggaagcggcggagaccaggcgatggcggcgccgctggagttcctggaggcgcagggctcgacccggccggagctggcggagtggtacgccgccctcgccgacctctaccagcggaagctctggcaccaactcaccctcaagctcgaccagttcctcgccctcgccgtcgtccaggcgggtgatgctctgattcagctgtatactcatttcatctctgatttcgagagcaagatcaatcttcttaaatttgctcacttcgcggtagtagtttcacgccagtattcagataaagatgctggtataagctatctcgaaggcgtaatttctaagctgcgtgataccaaggaatcacgggttgaagagcccattctgtatgtgaagatgcagattgcaagttttcttcttgagaaagggaatcaaaaggagtgtaagaaactggtagacgaggggaaaaccactttggatagcatggacgatgttgatccttcagtacattcgacctattattggttatgttctcagtaccataaagtgtgtcaagactattctgaattctataaaaatgctcttctctatcttgcatacacaacagtggagtcactttcagaaccattcaaacagaacctggcatttgacctctcacttgcagctttattgggtgacaacatatacaacttcggggagttgcttgcccatccaattatccacagccttgtgggaacatcggtggagtggatttatcatatattgcaagcgttcaactctggcaatctagcgtcctaccaggaactctgcaaagttcacgccgccgctttgagtgcgcagcctgctttggtacagaaggagagggaacttcttgaaaagatcaatatcctttgcttgatggaaatcattttcagtcgagcatcccaagaccgtacaatcccgttgagcactatagctgaacagaccaggctctcagttgaagatgtggagtatctactaatgaagagcctctctgctcatcttatcgaaggcattattgatggggtcgacgggactgtccatgtttcatgggcgcaaccgagggtccttgggattgaccaagtgaaatccctgcgtgaccggcttgatacctgggtcgggaaggtgcacactactttgctatctgttgaagccgagacacccgacctggtagcttcgtgatgttcttttggtcccctgttgaacgatggctgtgaccttacacaaagtgaacagatggatttgaaatttgtattgattcttaggctgcaatctcgcaaaacctagaaagatttgtttgtaaacatgatgatcagtcttgttttgttttgacgtggaactcactgtatgcgcaatggctctttcctgacgcagtgaaatggtgaacctgttgcctcaaaaaaa

SEQ ID NO: 7332 - DNA, 773 bp, Triticum aestivum
  Clone ID: PAT_TA_7332
cttccacaaagaaattcgatgatacaacagaaactgaagttcataagacacaaagcataaaatcaactgctgtgatctgttaaatcgcttgtcacctacaagagaaagagcatacagccatacactaggaaaggaagatcagggttctcatttcgttgtgcattatcgcagctacacagcatgtccgcaactacacctaaatcctgtgcatctctaagcatctaaacattacaagacactactctgcgtccctacatatttctaccataaaagttccgccccctgtccaagccatcctgtaatgaaccaaatctgccggggcaagatttctgttggtttcgtaatagcatgggcgtgtgttaaacaccattaccttctttatctgcactctgaaatgaagtgaagaaaagcagctaaaatttggagttatcatggtcaccagctacccatgtcgacatggcatagagaacccgccctttccacccctgcagcaaccaacggttatccacgtcgatgagaaagtccttgtggtagaggctcttaaccttatccttcacaagcttaacaacagccgagctcaatggcacctgcctcagcccagcccggtggccccgcacctgccattgcttataagtctcaggccgatccacccgatctgcaccctcgcaggcaatgacattcagggcacacggcccgaagatatcccgctcgatgagcagccggtcgtcattgtcacgggggatggtcgcatccagcatgtcgaattgcgccga

SEQ ID NO: 7333 - DNA, 668 bp, Triticum aestivum
  unsure (1)..(668): unsure at all n locations
  Clone ID: PAT_TA_7333
cggaaaatattgcaacttgacagggtcgataatatgttacttctatacaaagtgatgatactactatagttctccaatggcactgccaagggaggctatccgaacaatataggccagccaaaagaacccaggnaaagtacctgtactatataccttccataccaccacatcagtagctaacgcatgttaagaaggttcagagggcaccccgccgactaggttggacctagnacctcgcttcttttgcttcggattgggacttgacgcttccttaaaagctgatgggcaaatggtgtttatgccacagctgccgcatttgggcctcagcggcgtacagattgtctgaccaaatccaaccagtagtgggtttatcggctcccactcatccttgggcagccacttctcaagagacatccttgtctgttctggtgtagtagttttctgctttgttccttctcggaagacccatccaagacggttagaaatgcgatgcacatgagtgtccacacagattccttgagtattcttccatgcgatgctcatcaccagatgagccattttagggccaactcctttcagagcaagcagatcagtcaaagtatctggaatatctcctccaaatcgctcaaggcaaattctggaagcttcttttatgaattgggccttnc

SEQ ID NO: 7334 - DNA, 421 bp, Triticum aestivum
  unsure (1)..(421): unsure at all n locations
  Clone ID: PAT_TA_7334
tttttacataagnagcactatttgtgagttacgatatgcatgaagtttagggaccaaaccgtaaaacggtaattctctgaataaaagctaaaaacgcagcagcaggggaaaaaatagaaatgggccgaatctgggcagcccaacagtgcatggcccaacagttaggaaaaaaagaaggcgctcaggggggtggcctcacccagtgggcttgggcccaggttggttacgggttgggtagaagggggcgctagagcggccggtcgaggcgttgtgcgagtcaatgaggcagggacgcgctcaagacgaagcagaggcagggcgttgacctcagggcggctatgcgcgaacgaaacaggaagcagggcgaggcgacctggccgtggtcttcgccggcagcggcggagaggcgcaaaggctcgat

SEQ ID NO: 7335 - DNA, 752 bp, Triticum aestivum
  Clone ID: PAT_TA_7335
ttttttagtagcatagcagtatatatattaatttgactaaactgaaccaacaccacaagtctgcatataatgaagttactaggtagggatcatataacatgaggcagatggatgattagcaaacatgctgggtggccaagaaatgaacagcatataaaatactcctgctactgtagtagttaagatgatgagacaaaggacagcagcatgcagagttcctgatgcactggagtggcccaactcggctgcaccacactgaggcactgttgttccatcgagctcgaccatgtgcaggcttcatcatcgccgtggaggtcccggtggtcgtcctggtccatggagtgtgaatcttattatttcatttcagagaacgttaaacacaaatggcatgtatatggatcactgtggacaagcaaacttcctaataaatatgaacaaggcctactatagcatagcaggtaaggagttagattaactcaagtattggtgactaatagacctattatttcatttcagagaaagcctgaaacacaaatggcatgcatatagataccaaggacaagcaaacttagctaataaatatgaacaaggtctactatagcatagcaggcaagtattggtgacaaatagacctatattaagagtaaacagaactagctcggaaaacaactctatattaagagtatcatgtgtgaatgtgatacagtaaaaaattgcatgctatgtacatcaatttaaaaggcacaagttat

SEQ ID NO: 7336 - DNA, 879 bp, Triticum aestivum
  unsure (1)..(879): unsure at all n locations
  Clone ID: PAT_TA_7336
atatatgtttaatgtttctttngaaattgcacgtatgttttcttgttctttctctttcgactcacacgagcgctcctcgttcgaccccacttccggagtctgacctgcccgatctcccactgcagctggcagggctgcggagcgccgttccgtttcacactcccatccaggggcctcccggctgggcctaccagcgccccccgacttcgctaccctcctaggcgaggcgaggtggccgtcgggggggccacgggaacctcctgcgttcatttgcatgtcgtaatcagtccagagaagaacggccatatctccagctactgtgggatcgtcggctgaactgctgcggcgcgaagcttagcccaaacatctccctcagcgcctttcctggctccaggaggccgatcaatcgggcgacaagggaagcgctctccctgacatgctcgaggtttttggtttcggtccaaaggcgacgtgccacctgaagccttctcctcttggaggacagcgaaactccccatttggtgtacatgctctctctttcctcgatcgagagccgcttctgcatttgcctgcagagcatctccctctcacgttgcaacttcctggcacttgaagccagagaagtgttcgggctaccagccacgactttgccttccatgccaccattgccataggtgnctttaaggaaagatagcctccttatctccacttccatgtagatggagtcggctggatctcctttaaacaacaagaaaaagtaggttctgtgaaccaatgaagcatagcatgcatgccaaaggtcaatgatctcttgctgtttcctctcaaattccagtggccatcgcgaaggtgattgcaaggcatccatgattggancta

SEQ ID NO: 7337 - DNA, 1683 bp, Triticum aestivum
  Clone ID: PAT_TA_7337
gcaccttcctcccctctacctcaccttccccccccccctcccccgcctgcttcctctcctcgcccgggtgcttcctccctccctccctcctggtgcccccttcgctccctactggctccgttcagttcctgaatcttcaccgacccgcgtcggccggtggcctcctgcccctgctcggtcctgtggtggcgccgaggagcggagggacgcagggaggagggccgggatggggcggtacgaggtggtcagggacatagggtcggggaacttcggggcggccaagctggtgcgggaggtcaggaccaaggagagcttcgccgtcaagttcatcgagaggggccacaagattgatgagaatattcagaaggagattatgaacaggcgatcacttatgcatccgattcaaggaggatgcactaactcccacacatttggccatagttaggagtagataccgctggccctgttgagctattgcgagaaaggagtctctgtggtttgggaagatttaacgaggatgaggtgaggttcttcttccaacaattgatttcaggagttagctaatgtcattctttgcaaatatggcatagagatttgaaactagaaaagacactaatggatggaagtgaagcaccccggcccaagatgtgtgatatcggttactccaagtcctctgtgttgcacttgctgccctctctcgaaggttgaaccgtcggcacaccagcgcacatcgcccccgtgctccaagcgaatatgatggaaaggtcgctgatgtttggtcatgtgggagttactgtatatgtaatggttgtgcgtggcttagcttttcgtggagccagacgagccgaagaatttccgtaacgcgagtcacttactcagatactcagcgtaacctatgaattaccccattgcgaattactaggatgctcagcgtacagttgtccggtacgttattaggtcccgattctcaacgaagaacaaacatctactgtaccaaatacccgtggtaaatcctgaacaaccagtaaccatccaagagataaagaaccatccgtggttcctcaagagtctgccgctcgagatgaccgacgagtaccagatgagcctgcacctggccggcgtcaacgcgcccccgcagaccctggaggaggtcatggcgatcatccaggaggcgcggataccgggcgacggttccaagttcgccgggcagctgtcggtggccgggctagggagcatggagctggacgacatcgacgacgtcgacgcggacgttgaggacagcggcgatttcgtgtgcgcgttgtgacgagcaggcgtggcggttccccttggtggtgtggcctttgtgtttgtaatgtgttcatccttctgttgtgtcgtttgtttcagagggttgcgctgtgctgttgtatgattacatctgttttctgtaaccgttgttggtagtgacgctgtggataaaatataagtatttgctcatgagtgattcaaaagttctcttggtggtttacttgtggatggatccctgtttgtcatgcttacattagattttgttctgggtcacaaattctctgtagcctacagattggccttgctgtgtaaacagtgtaagataagtttacatgcttatatcgaaatcagtagttttacccgaaaaaaaaaaaaaaaaaaaaaaaaaaaaaa

SEQ ID NO: 7338 - DNA, 932 bp, Triticum aestivum
  unsure (1)..(932): unsure at all n locations
  Clone ID: PAT_TA_7338
ttttttttttttacagagcaagaacttgcgttaatcttgacgtgcagttggagcagctgcagctgggaaggtctcttcctctatcaacaccaacactcacacagtcacactagctcaactcacggaaaccccgccacagccgggccgttttctccggcgacgacagccatcggcgcgtcatttggcaccgccggacaaggcggtgcacgggggcccggacaccgtctcagttcagaagcacattcctgccctgtttgccaaatgacatggnacacaacacgtcccgtccctgcaccccaccccaaaatacactacttcacacgaagttaactcctacataataccctcctaactcctcgctacatcatcagtatgaccacattactcctcaagtcaccgagcaactccacttttttccggacgcgcgggtcggtgcgcgagcgagcggctacttgagtgagcgacaccgaatccttttcagctctgagaccggcgcggaagatcctccggcatgcttccggatggctccgacttaagaggccttttaggacccgagccgtagccggcatgcaatctcttgtattcgttcagctttatgaactgatgagtcatggaccactgctcgatttggtgtagcgctgccgcgtagtcttggaagctgggcatattctcgattcttgacaaggagctttgtagcccgccaagcctcacatcgaaggtttccagaacttcagataagagtttacggtcctcctttccggaggtgcttgtctcgttcggtggcatgttttcactttgcatgaagttgttggtgtcgctgacaaaagattgaactgggtcagacatatcactgagcaccagtttacaaatgtggtacacaatggcttcaccgcaatcagcaacttttgctgcaagaagtctcgctgacagag

SEQ ID NO: 7339 - DNA, 659 bp, Triticum aestivum
  unsure (1)..(659): unsure at all n locations
  Clone ID: PAT_TA_7339
ttccntanagngcatgntccaanaaggggggagtcaatgggnaaatccttaattcannacggngtcatgttntgagtaccattctttgcggggaaatgatttgacggtaggtnctcagccaccgntgcaaataagcaatggtaccgtcttattanccatgcgtcaagttctgtntatattgccaaatctttgtataagcatagacgcctgcctcagaaggtcctgcgggactgccccgcntgataaatttcccttccttaaatatatacagcataggaatgccagtcgacaactcaaggcttattacctcttgagaagtcaacttgtccagatgcattataattgagcggagtgaattcccatgggcagcaatcataacatgctttccagacacaagctgaggtataatttgctctttgaaataagaaactgctctctctgcacacatctctaggctctctccatttgggggaggaatgtcataactacgacgccattcatgaactttgttctttgccaaacagatcagccgtttcttgcttgttaaggccttgcagttcaccatacattcgttcattcaactgccaagctgttattacaggaatggactgcttctttgtctcctcgctgtatacctgactccactggtgtgcccgttc

SEQ ID NO: 7340 - DNA, 727 bp, Triticum aestivum
  Clone ID: PAT_TA_7340
tttttttttttttttttgaaaaaaaaacacctacgtacataattcacaattgtactacaaacacggcgactcctgagtaaacgttcagtattaagaataattaaatactgaactacatgcagatcaagatgtaaccattcggtcattgactgaaacacaccgtcatcgctcgacatctcattattcatcgtcactaagataaaggaagggggaccccgtgtcaggatggccaccgtcgtacccgaactcaccaatagggtgcttcagtgcatgcattccttgatttatgcacgcgtagcagtgaccatcatcatatgaacttagttcgtagcaggtataatattttcttccatagttctctccctcttgagcaaaatagggcgtcgatgaccaatcaccgtctggcttcttcatcttaacggtgaagttgaagtgatggaaggtatggtcatagctctccacgctgaagcactgatgttgaagctcatccaggctatactccacgtctttgaattggtcctgccatttgatgtacttcttgaaagccaccatgacttcctcgcccatccacttcttagcatcctcaatgatttctttggtagacggttctccctgcactgaattctctgttggagaggcaaagggcttggagacttcaggaaattttaattcctctcctgatgaccaaaatgcttcagcatccagtttatgctgggccgggttgcta

SEQ ID NO: 7341 - DNA, 1322 bp, Triticum aestivum
  Clone ID: PAT_TA_7341
gccacttttcttctggctccttggccgctgtgctgccccttgtgcccttttatgcctggcctcccgtaccatcgcctcaactctagttgtgtatagaatgatagaatcatggccctccagtccaggcacggaaaaataacacataaattacagcaactcaccaaggaaaaatggcatgctgcaacaagcaaagctactttccatgatatctgtactcacatcatctacgaaaacttgtatactaatttacagatctccggcttacaaactcttcacctcctaggatgtagctattaaagcagatatgcgccttgaggacgtgaagcttccctcggtgcaccatgtgcaaaaaatgctgatacagaatatactccagtaagaaagatatttgcaacagggaggagtgtgagcaggactcagggcatgagtggagtaagttgtttgctgaaaagatcgccaagggccccacgaacatccatctgatcacagcagataagtttggtaattaatggatagaactctcttaggtgcttcttgaatatctgagcatccatgatgcacattccattcaaaaccttgataataacaggtgcacgtagatcaagtacacggtgtatgtccgcactagcagtttccccattgctaggctggagatcagacgcttctttcaaaatattcccacaaaatgaaacgagcttcccttctgccaggctcttgagcttttcttgttgatcagactccacgccagatccatttgtttcctcagatgagccatttgcaccattgtgcactgttgatttgtgtagaatctctaaataaatagtagttccagctagctcctggcgaagaagatttagtggtgccttttcaggcggtatatggtgcatccttgtccgaaggttcggatggtgagttatattgaagaagcaaattctaggagcgagagcaggatatccataattgcgatctgttgtgtggcttgcagtttgctccaatacctcttctgtatactatcaatagccccaagtagcagcagcttgagtgatgcatttacttctaacagtctccatcatagggttctcttcttcttcagtcttgtcagctccatcagcttcaggtgtctttgcaggtgagggcagagcagcatcgtccatttttccctttggtttggatgtaagacttctgaccaaaagattacccatcatattacccataaatctttgtccaaaagtttgattagatggggagactgcaggttgtgctctcccagatggtgatggcgaaccttctgaattttccaatccaatccgtggacttgtttc

SEQ ID NO: 7342 - DNA, 842 bp, Triticum aestivum
  unsure (1)..(842): unsure at all n locations
  Clone ID: PAT_TA_7342
atcttaatcgcaatntcataacagcagtccgtcaatcggatagcaaaaccttaaaaataatattaccagccttaaagaggcgactaataatcttcgtttgaatggaagtcgagcggccgcccgggcaggtactaaccataagcatcagttaagaacactctttatacaagattctcacagatgataactcaaccaccatacggaggggctccaaccaaacctaatgctatctcaagtaactgaaacagttacagaaggcttctacaataccatcagcaaggatacaccggaatagacttcttgcatccccttctactacagcacgggaccccaagtccaacaacgaacagtttccgcaaattagctgtgttcaccgcaaatgattatagaggtttgcctgcccaaaggacgactctgtacctcggccgcgaccccgctagaactgcgcacttatcgggaagagctgatttgttaaaacagtacagttcatgaacaacttccctagccagcggggctatgagaaaatatcctagttctaacaacggattcacctctggcgagagcattgccacacaccacacaccactaccatgtcctcaaaagatgatatccatgtgtccccaacttaagaaatagtttccttgtaccatcttaagttactcaaccatggcaatcttacaagttaagagcatgccatttactcttgatataaaggtcatatcatccagttttcacagttttaatataaaggtcatgtgctactttttattttgttctgatgtactaactaccaagcccgcataacgactaatggtgtagtgaactcacattcagctacaatc

SEQ ID NO: 7343 - DNA, 915 bp, Triticum aestivum
  Clone ID: PAT_TA_7343
ttttttgacgcaccccaaagactccaacactttgctctgcatgtccaaggaccaaaatatacatggagctcgcccaaatccctgacacccaacagctgcaggaatccacagggccacaaccagcgactttatttgagctacttattaacagtaaaaagacagctagatattgggttgggttggtgctgacaaaatattcattcagtccatagacagtccattgcaaggaacagagccgttccgctttagcgccctcatctccagtgtccccagtccatcaccttatgctatctccttgggtacagccgacgcagggaggacgaaaggtttccggcccttgtacatacgtcttatcctacgctccttgctcctatcatcttcatcggagtcgctccactctgccgggcatccacatagctcatctgcacccacatgaccacaagtgtatgcatcagctttgttggggtgcctcacaccacttttacaaccaccacaatgaccattatcagtaggatcgaccatgcaaaaacagctgactacccactctccatagctctcttcttgttttgtatttcttagttcaacaaagaacagtttttcaaaccagtccaagccatcagctcctttaatctttgcggtgaaattcagatggcggtaccattcatccttctcacgaaatgatttgtgtctcaccatgtctttgagtttgtatgcaagatcccccaaaagattgtgatcctcattatactggtccactatagcacacaccaatctggatatatgttcatggcccttcttaaatatatatgattttgtgcgcttcttccttgtgccatcgggccaaaaaagacactgccgtatacccatctcattttgagaaacaccagcttgctccatgcacattgaggtgtgacg

SEQ ID NO: 7344 - DNA, 791 bp, Triticum aestivum
  Clone ID: PAT_TA_7344
ttttttttttttttttttttttttttttgaattaaagtgcattgaattaaccctgcacacggtccaaactgaatatcttgtggaggttcttaaaactgaatgaaaaagagttacatggcatttccaattgcctatacctattccctcaaaacattgcctataccacacagggcaaactgttttacagaacaacaaatgaccctttgattgcctcaagcaagtcacttgccgccgctgaatggttcccttgcatccgcattagctcatagaacatcaggttactatgtgataacagagtttcctgcaagatagagtagctacattggtgaatttgcatagacagtgggcatgctttcaagctgcttgactgacaacctaagcacaaccagcttgcctctagaaaatactcaaaccgaacctcctgtgtgaaatcaccccaagtacattgatgaacatttttgtcccaaacaaccatcatcaaggttttactccaaaccaatcatctcccaatcaaaacaatcatttgacttgcactggatcaaaactcataaaacaaatatggttatactggatccaacatcactaacacccaaaactgcaaactgcattgttccattgcctctaaaaagtaaccaacaacctaaacacgaccagcttgcctctaaacaatccacaaaagttttactccaaatttatcacgtaccaataaaaaaaaatcctgtggcttccactgtagcgaaactcatcaaataaatacggcaattctgaactcaacatcactaacccccaaa

SEQ ID NO: 7345 - DNA, 717 bp, Triticum aestivum
  unsure (1)..(717): unsure at all n locations
  Clone ID: PAT_TA_7345
tacacgtgncaaattggcagccttgtcctgaatatttttgtcctatgtacaaatactatacagcttcatgtacagagaagatatgtccagaatgaatcaaggaggaatcctattaaatgattgttgtttgtacaaatattggccatctatcatgcccaagcagttagttaaacttcattctcagtatgtatgtatggcccaagcagttagttaaacttcattctcagtatgtatgtatgtatggagttaacagctacagctcctgtatgctgccgaaatgacaagagtgatttgccagggctagctgtgcgtttctgatggtcacgagcatccttgtgatctaccagtgaaatccctagcagcaaaagatgctcgggctttgggtttaactaaagatgctcaggctcaacatctttgctcgctttactgcagtctgcagtggtcagcagtatatactctcaggataagacgagggtgacaaatgccaaggcgatgagcgccaagaagtgaatcgccgtccgcgtggcgtccgattcatccatcggcgggaggtagccgcgcaggccgacattgtagaccggcgtgccgtcggggtagaagagcccgtagttccgctcggaggccggccccggcttgaggttctcgttgaagagcgcgaagacgtagacatctatgggcaccgccggcctcagcggcgtcccttgcttcgtctctatc

SEQ ID NO: 7346 - DNA, 1392 bp, Triticum aestivum
  Clone ID: PAT_TA_7346
tagcgtggtcgcggccctcctacctccgccacgagaaagctttgattgtcaagctggttgacatagtcgacttcaacgggagcttcctggcgcgcgtgcgcgatttcgccggcgctaaccccatcgtgctcgtcatcacaaaggttgccctccttcccagagacacggatttgaattgcatcggcgactgggtcgtggaggctgttgtcaggaagaaactcaatgtccttagcgtccatttgacaagctcaaagtcattggtcggcatcactggtgttatatcagagattcagcaggaaaagaaggcccgagatgtatatatactgggttcagcaaatgttgggaaatctgcgtttattagtgctatgctaaggacgatggcatataaggatccagtggcagctgcagctcaaaaatacaagccgatacaatctgctgttcctggaacgacccttggtcctattcagatcgaagcatttttaggaggcgggaaattatacgacacacctggagtccatcttcaccataggcaggcagcagttatccacgctgatgatctgccttctcttgcaccacaaagtcgtctaaaggggcgatgttttcctgctaatgatacagatgttggattgagcgggaatacgttgttctgggggggacttgtccgtgtcgatgttgttaaggctcttccacgcacacggctaacattctatggaccaaagaagctaagtattaatatggtccccaccacagaagcagatgaattttacaagagagaagtcggagttacattgactcccccaaccggccaggagagagctgaaggatggtgtgggcttcagggcgttcgcgaattgcagataaagtatgaagagcttgataggcctgctagtgacattgcgatatctggactcgggtggatcgcggtcgaaccacttggtgtgccatctagcgaccctgatagctgcgtcgaggaagaaggcggcggcagtggcgagttgcatttaagagtacatgtacccaaaccagtcgaggtctttgtccgcgccccactgcccgtcggtaaagcggcatcgcagtggtaccgataccaggagctgaccgaggtagaagaggagctgagacccaagtggcattactgatgctgcggttgccaaatgcctatttttggtctctgtgtatgctgctgttgctgctggagcagctccgcgtgatccagttgcgcaccgacattatgtttcttggatgatcttatagggatgaattcatagttctagcttaggatcagctgatgaaaatgattcaggaaacctcgagtgaaatgttgctgtggttacacttgttgcatatatatgaaactatttcaccgtcgttttgcaaaaaaaaaaaaaaaaa

SEQ ID NO: 7347 - DNA, 578 bp, Triticum aestivum
  unsure (1)..(578): unsure at all n locations
  Clone ID: PAT_TA_7347
atgttaatgnccggtgagcaaatctatgaccctgcaatttccacaaagcataaggcaacacaatttctttcaactgtgctaataccggtggaatgggactttgatccacgtcaactttcatgttgactccggtatacaggcagttgtcccttgctcgtaagactacccaaagtggggggtaacttagacttgctaacatatgggtagtcaaatatagcatttgttgtgccgcttttgttgtgtagacttgaggatgttgaggatggattcagtccagggcagtgaatatacagacctgattagtggcatgcctcctaaagccaaacatcggaagcataatgtttcaacgaggtaaggcatggagcacaagggcatccgttttttctccaggagttccaagaccaggttttctattcatcagacaacattctaagctgtaattcagccatgataccataacttctctcaccatgcatagataggtggtggagaaaagctgccaaaaagatcaattacatgcttcctccgcttgtcaacaaccttcctgggcatccaagaaatatgctcccaatgtgcac

SEQ ID NO: 7348 - DNA, 738 bp, Triticum aestivum
  Clone ID: PAT_TA_7348
ttttaaacctggtttccgccaaactctaaaaccgctgagctagcaaacgtagcccttaatgatgcggaggaatatatgtttcccacacgatggacctgtccgaaagctctatcatgcccaattttgtactagtacgtttattatagtcaatcagtgtttcatacaacctgttaataatactagaaaactacataaatagaaatgttctatgccaccagcttcaaccaaatcttaacatattgaatgctctagcctcaagcaatcgtcaacttgatgaaatggcaaagttcacgcgcttggctaatcacctctatatttttcttcaggtcccttctgcagtatcataaacaaatcctttcactgagaaatagcaggtgacacacatagatagctctagttctttctctcttgactcaaagttagataaactacggaaacgttcacaagttcccttgggtataacattgtgttcttcagctgtcttcattttctgtttgagaaaagacgtataaagctcgatttctcttgggaacagcttatcgatctcattacagatacgccttttgtaagtgccatctttgatgcttttctttggaggagacttaccaccagtaagttctttaagacgttcgaccgtgtcttgtacagtatattcacaatcctccaactctagagcagcaaactcggtaagatcatagaataaacgaactcttccttctttggatgtgcttgaaaata

SEQ ID NO: 7349 - DNA, 820 bp, Triticum aestivum
  Clone ID: PAT_TA_7349
gagttccatataaacatgccattgtacggctttgaaattaaaatggaaacatgtcattgtactctcattgagatgaattaaccttagtacaagtggtaaaaggttaatgcctacacacgcaacaagtatggtgtttcagtacacaaattgaaaatgcaatgttacacaagtttagaaatccaccatatcatcatcactaatttcacagtcaccatcggaaagccaaacatgatcaggtgttcctctctcatagtcacctctagttggatgccgaaccttcgcctccccatgttgacaaccatagcactcaccatcgtctgacggctccaggaaagagcaacaaaatgtctccacatcacattctaattttctttcagcaaagtagataccttcagtccagattcctgatttactcttaatcttggcaatgaaattgtaatgccaataggttttttcataactttcaggactataacaatgctgagtaaccttgacgaaatagaacttgaggaacttgtattcttcttgttgtgtaaatgcaatacaacaatctttagacattgtcttgatcctactatcatcaaagctttgcttagttctcctgcaatttaattcagcccaaacacatgccagatcgtatatgttatcaatcttgcgtgaggcgagagaccgagctaaatcatatctgtccttatcattctcctcatcttctgagtccaattccacagatctagtataatcaggattagcatagtccaacagccaatctggcacttctagatttgcctcaatcatcaattccagcaagccttttgctatg

SEQ ID NO: 7350 - DNA, 732 bp, Triticum aestivum
  Clone ID: PAT_TA_7350
ttttttttttttctttttgataattctatcaggcactacataacttcattaataatctcataaatataggagaccatctttcacatctcgcatgtggcagcaaatttgactatcagcagcgaagctgtacaaattatctatgactaaggtgatatggatcatatcgtccattatagtcctagtgatagtcctagtgcagcatgtgctgcacacttgcatatctgtctctactccgagcttggctagctcagaacacaagcaatttgtatatcaaccagcacagaagcggtttagcgtgctagattgcattactgtcaatcggtcatttgctacagctgggcttcaactctgaagctctgttcattatagccatctgcgtcttataatcatcttgtgcagcttctattaatcaacatatcatctataaggtacaggacttcccttagtttccatttacagagctggtggtccaaaatgatccaaattaatgtgaagttggctgaaccttcatttgccttgagaagcaggttcaatttctccaaaaaaaaagcccttagttgaaactcatatgtgaagggctattgagatggcaagccctcagttctgtcccaggtgtagcagaatggttcttcattgtgtggccctcaagtcacggggttcgcgatctgtgaactgggcttctgtgaaagttctctcaagccttgattctagtcagatgagccaacacttatg

SEQ ID NO: 7351 - DNA, 715 bp, Triticum aestivum
  unsure (1)..(715): unsure at all n locations
  Clone ID: PAT_TA_7351
aactgactaattatactccttttcaatcccatctaacaggttgtctaatttacagtcctgttggaaatattttgcggccagctctacttggtcgtacatcaagctcatagggatctccttcccatcaggccccacaggtccgacctcggccatgtggtttgggtcagccttcgggtaccgcgtcttcaccatggcccaggcctccctggcgccttgacggcaggctgatatcttccacagacggagacgttgccgtactccctgaagcttctcagcaagccctccaaggccctcaggtagggagatggaaggccataaggcctgaacgacgccactcatcgcctgccaaacacgttcgagcagttgcaccagctcgggaagttggtcacccgttgaaccgggcatttcctccgtagggcgaccggtgagcacaccatagatgccgcgacaaagccgctgattctccttcacggagccagacaactgggcccgaacaccttttagctcttctccaagctgggtgtgggccgtcttggagtttgttcctctcctgctgcaccttcacaagaaccctctcgccagccttcaactggcgcagtagctatttcttgtccggagcaagtccgtcaacatctgcaatattattgtcagatttatacgcacgccgcacgccataaaacatttttgaaatatgtgttaccgganggggtctctg

SEQ ID NO: 7352 - DNA, 1236 bp, Triticum aestivum
  Clone ID: PAT_TA_7352
ccccccccacgccccgtaagaccgaggtacccgggcaatcgtcttcttcaaatggcagtgccccaaaacaaactttcaagcacataccgaagaacggaatgttactatttgagacggctcagtttgagggaatccttaagaaaattacagaattcagtgcaacacttgcatctgactcggaacaaaaacatctatccttgtccgaggcagacttttcaagattagctgctatagtgaaagtattgaaaaatacatcattttatcacacaagcaagcttgcagatgctgacatcgtgttgttgctaaaaatattgaagtcttggccttcacagatgatgtttccagttgttgattttctgagggtgtttgtgttgcatcctgacggggctactttacttcttaagaccatcgaaagtggaaacgatgtacccatggaaaccttccgtaaggctgtagcaatacctgtgcactcaccgaatgtgcttacaatcctcaaagcagttactaacttatttgacaactcatgcttacaccaatggttgaaaacccattgtgctgagattattgatactttctcgggctgcaagccggctctgagcaaggccgctcacttggcatatgccacactttgactgcacccttctgctcttccagtgcaagcgtaaatttggcatagcctgccggagattttgctgccgcttcttgccaatcctcgtgcctatcctcaacgtttacaataaaaatacacgcccctgcctgcgcgcgcctctacataataaaaacgctaccacatgaaaagcaaaaaaaaaaacaaacccggcagcgtccccagcagcgcaaaagcttccatcgcctcgaagatcgccgaagtcggagctgatattgagctgctaacaagatgagagaaaagagtgtcacagatacattggagagaaaaggaggaacggagggctgggcgcagcgttgcagctaagtagtggtagcagcccacatccgcgcaggtggtagcaatagcataacttttgcgtgagtgcaggagagtttgctgcaccttgtaatcagcatggtatcgtgcgaatccttcgctctgatcacaaagtttactatttatgcgcacgcaggcgactgatcacaaagttagtataaagttgagtcacttatttttggacggagggagtaataaacacagaagcacatcgttgattcaaaaaacgaaacaaaaaaaaataaaaaaaa

SEQ ID NO: 7353 - DNA, 1353 bp, Triticum aestivum
  Clone ID: PAT_TA_7353
ttttttttttttttttttttttttttttttgacatcacaagacacttcactcatttagatgttttggattacaaggaaacaagcaaagcttctgtcaatgagtacaacaaccttcatctcaggaaaaataagagatgagatgcgaaggaaggaagaactatggaaaacctaagaggttgcgctcctctgacatggttagcttcaccaggaaccatcaccaagcatagcaattagcaaactgagcagccaattggatgtagtgccactgaccaattagtatttgctaaaggggagcaaacagcgccaccacgatgacctttctcaggtagagttgttggaatggggaacgcaccaagtcttccacatgatactgacaaaaaagcctgaaatagcaaacagggttacctactgccgctcccccttgaagagattagaaacgattcttcacaccatgtgaatgcctcatgctgcttccttccttcctgtacacagaggtcatttggaatttccaaaatcgaaatcccccgtcgacctgtttctctcctacactactcatcagtcagttgcaatgaaacgaagcaagtaccaatggcctgaaaatcaattgcgattttcaggtatgcgctcccctccatgctagctcgccaccatccgtcttctccagcgcagcaactttggcgcggtgaccagggggaggaccagaacttgctcttctcaccaccatgagggagctcgacggtctcactaacagatccagacttgatgtcggtgggtgggatgaagcagtccatggacaggccagggacattgaacgcaacctcctcgatgctccacgcctcctccatccgagtcttggtgtggctcatggccacctcgccgaagcggaacagggtcacggccgagcgccccgagtgcgcaatcatgatgccatccaccggccggtagtcctcgatgaatgagttgatggtggtctcccagtagaccgcatccccgccggttgttgactgaatccgcgttaggtgtgagtcctcgatgtggacgaggaggccggtcctctggctgaagtacccgaacatgacatgcctgatgatctcggcgaggccctcggtccgtgccttgagggtctctgggtcagtgcacagcttcaggatgaagcaatcctccccgttcaccttcctctccccaatgcaccgtgcaccggcaaacatgctcgctgcagtgagtggatccaggccctgcagagcacggcggagggggcgaacagggcctttggcggcatgggagccgagccacggggtatggcgccacacaagcttgccattgcagccggcatgcaccttgctcccaccgacc

SEQ ID NO: 7354 - DNA, 1015 bp, Triticum aestivum
  Clone ID: PAT_TA_7354
ccacgtaaaaccgacgagacaaggaccaaacacccaaatgaaagcgacgagacaaggaccaaacaccaaaatgctctcatccaccgctctccggccgctgtcgccggcgacggcgacgacgcccgcgtaccccgccaccgccacctcggccacgcccgggcggcgctcggtggcggtgcgcgtgctgcgggactacggctcgatccccaagcgggagcccttcagctccagccgcagcatcctcgacgagttcttcaagcaggagaagcctctcgtccagcgcaccaaggaccacatcacagattattgcacgacccttgaaggcgatgattgctgcagctgctgggatgcctattttgaactcaacaaactcgagcaagagctaccgcaagaagaaatctcaaggatggtgaaggactcgcggtcagacccaaggtacctcataagcagcatccaccaccggtcagacctacggaagaagatggccgagaaagctcacaattcagcgccatcaaactccccggggcaaacagcgaagccgaggcctttccccgtccctgatgggctgccgaaaacgcaggaagagatcgacgaggatgaggaggctctgatgccggagtctccttacacgaggctgctgagaaggatggggaggttccctgactggtatacccctcgcccagaccatgagactgactgaatcactccatggaccagccttgccttccagatgtacagcttgaagctctgttctcctggcatcgagcatggaagcttggattgctgttgcctgcttagttgttttttgctgagtggttaaatggaactatgtaatggtgtgtgcttcttgtggtgtcgagttcttctctttagattcagatacctgctaatgtatctctgtatatatgtgtttgggaatagagttcttgactactatcatgactgtgtgtgtgtgtgtgtgtgtgtgtgtgtgtgtgttaattgttggctgatgaatctgataagagatttcttt

SEQ ID NO: 7355 - DNA, 736 bp, Triticum aestivum
  Clone ID: PAT_TA_7355
tttttttcacctgcactgggggctgcgtcccgcgtcttgttcattatattttactttaaatattgattgcattaagcacggggcacagttatgagtagcagtggtaaattacacccttttataagttggatctcttccaccataaagaatataataccacagactacagtccataaaattgatttaacaaaagcgtctttccatttaagcaaaagatcgttgaaaaaaaatcatcttgttcatgaccccatttcttcactggtcgctggcgcgggtgttatcccatgcttccataacacgaccctctccgctccacttttacatggttgtccttcatctgttttgatgaaaactgaacaagattgctttctcctcgtcatactgaagctcgtccattcattttcgtccaagctaaagataacctgcaaataagaaacaacagacaactacagaatctgttagggcccaaattagttaatcaaattttaaaagatcagtaactaccaatgtgacactaatttactgccaggcaggttacattccacgagaatgaatctggcctttagtcgctggccacgtgggggtcgcgcgcctcctcgggttgccgccctgaccatggacccctccccaccccagcatgctcggcccatttcagcggcatgaaagaccctatcacaagaactcgtgactactggggaagtggggagtgataaaggaaatataactgcaaataaat

SEQ ID NO: 7356 - DNA, 995 bp, Triticum aestivum
  unsure (1)..(995): unsure at all n locations
  Clone ID: PAT_TA_7356
ctggtagcccaggncgcgtccttttatgtaaagaccccaagtattcttttttcttttcttttctgaaacaaggataagccacaagaagtataaaaaaagaagacaacctattctttctgagcaccgcaggtgcacaactatgtgcatccaacaccgtacatgcctgtttcattcggcattccttccgggaaaatgaagaaaaccctcaaacctcttttcagcacggaaaagcatcaatctacccatgaaaactacccacagagctgaagttaacgggaaaatatctcgatttgctaagctaatcaccccatgagagttgaggtagttacccaaactcatcatggtacagcttgatctccaaaggttccaagcatggttgacaaccccagtaattttggttgatgtgtcatgtcattagcccctgcattcctcaagcttctgctgcagcctcacgttgtgccttaaacaatcagcgatctcttcctgtttcagtggaggaactacttcgtcttgtttccagccaagagatttagggaaagccatttcttctggacttggttcctcttcggtaggatacgattcctcttgccctgctacaatgggctcggacaacaaaagggcttcgtcatatctagagtccgatctcgctgaaacatcagttgtatctgtgggtataatggacagactagcttttagcttcatcttcagcatcaacaggatctgatgaagagttggcgtccttgttgtcagctacaatctcatgcaacccctcataaaaagcatcatgaggctctgaaggtggcttgatttcctcattgtcggagaggtgtcgctgagatccatcacaagaatttgcatcctcacatgaactacttccagtttcaatanacttgattccactgttaaacaaggacaaatcaacagaggggttcttctgctcatcagccaagctagatgaggactcgatgccagcgcttgaaccatttaaagatttg

SEQ ID NO: 7357 - DNA, 654 bp, Triticum aestivum
  Clone ID: PAT_TA_7357
ctttagaacagtttagaggggcttttgctacaagaatcgtttgaaaaagcaaaacaaatgtccaaatgaagtacagatagtgcaccaacagtggtctcatggacacgtacattcgtttgtcagagcacggaaatatttgctaccaaatttctcttctcgggttcggttctgtgaaaatggctgttgcaacagccaaaacaattctagtgcttgaagacgatcagaacagcagtgcagttatccttgcacctcctctcgcggacagcctccttcaccaggcgccgcactgcgagcgtggctgaggacgtctccttcaatttgcttctggacaaattcaacagcgtcacttggcccaaacactccccacaagccatcacacccaaagaatgatgaaaatgggccctcacggttagttcaaaaggatgggcatctggtgttgcaatcaaccccaccttccttaaagtgacgatctccaagagctctagatactccattgcgcccttgtagtcttccattgggaccaacagaacctccagccttctggattctcgagcgttcttgtggaaagatggctttgtgttctcttgtcaaaacaatagcttttcagtggacttttggtgtcagccaccgcaccttcaccatcaagttgaagta

SEQ ID NO: 7358 - DNA, 721 bp, Triticum aestivum
  unsure (1)..(721): unsure at all n locations
  Clone ID: PAT_TA_7358
aatttacaataggactgctcagttatcaagagttcaaggccaagaccgtgcaaagcttggcaaaatatcacctaccattacaagcagtaaccacagccttcatgttaactgctgcaacaccaacggtcggacattgggaagagaatctgctggccacgctggttttgcctgaacaagagatgaacaaggcaccaaccccccgggcgcgaccagggaggttttgagccccctaccggtctccaatttcccctttgcggcgtgctgcggagctttggcttgacacctccctcctccggataagggcaaagtagtagatcattcggaggacgccntgtgtcctcctgaagagatcatcaagtgtcttgatagttgttccccggttgctttggaggaggtggaagcacctccctttccggcctggggttagatgtgggatatgactttgtatgaggctgtggagtaggtgacagaccccatgcggtaccagcgccatggggaagcatggtttggttagcttccgcttgttggaaggctactgcatttggagttgtatccttgctgagggtggtaggcggtggcggtgggggagggtgttcgattttgagcttcacctcaagtggatcaacaaattcggcagctaagtaactgccattgtttaggggccattggaggctgtaaacagcattcctggtagcccacctcgtgccgaattcggcacgag

SEQ ID NO: 7359 - DNA, 749 bp, Triticum aestivum
  Clone ID: PAT_TA_7359
tttccttgactacaataacgtgttctctgtggggggtcggccggccgcccgggcaggtctctgggtagctagagagggagatgatctcggaggtcagaaagcagttagatccaaaaagactcatagggtttgttctctttcgccgatggagagatggaccagtccagtccatgttcttgtgcggcgtcgccttcaatcgataatcaagaagacaagggcatgcatgcatagatcaacgcggagaagagggaagaagcacgcaagcaagtgtaagtctagatcactcctggctatactgcttgatttgctgcttctccctctccttggatgttttgtatataaggcatatggtgtaggtgtggggaggatatatgagagctagctagcaatagcatgcagcagcaatggtggtgcaagtaatgagcctctctctctatatatagctttctctctcatcttggcattttaattagtgtgtttaattggttactccaatttgccaactctcgttagatgtataagttaatactagtactcctcccctggaagcttaattagagaactatttttgagttctcaagcattggtcacctttttaaagggtttcttcttcctttctctctctctctctcttctagagtggatttctttcatttttcttggggttatcttttgttcaaactctgttgtaccagtgatgacattgtgagttatgaggaaaaaaaaaaaaaaaaaactcgagactattc

SEQ ID NO: 7360 - DNA, 1599 bp, Triticum aestivum
  Clone ID: PAT_TA_7360
gagaggcgccgagcccgggaatacccttactccgccccgcccccccacgacgagaggtctgacgacgagacccgagagaggccgagacctggaagatccgaatccatcgccgctcccccacgcaacgagaatgtcttcacccgcagagtactacaattcacttccaccaataagcaaggcatatggaacattgtgtttctttaccacagtgctggttcagctccagatactagacccaggccttctttatttatcttatccctatgtgttcaagagttttcagatatggaggctatttacaagcttctttttcctgggcaagttctccatcaactttggtattcgccttctgatgatagcaagatatggtgtgcagttggagaagggttcatttgagaagcgggcagcagatttcttgtggtgtgatgatatttggtgcaatctcgttactggtattgtctgctattccctatatcgagacttatttcttggggattcctatggttagcatgcttctttatgtctggagccgagagtacccaaactctcagataagcatgtatggcctcgtccaattgaggtcattttatctaccatgggctatgcttggattggatgtgatatttggctctccaatactgcctggccttttgggcattatggttggacatctgtactacttctttacagtgttgtatccagctagctagcggaaagaactacctcaaggactcctatgtgggtacacaagattgttgctcgattcaggttggggcgtgcaggcaaactctccagtccggccagctaacacaggccttactgccttcagaggaagaggctatagactcaacaagtagactgcggctggccctggcgatgtaaaagaggaatgaacaggttaacatggattcgatctaaactctgtggcagctctaggaatatggattggatttttcccattgaatctgtaatgtcctcattgaataactacagatgtgcacttgcattgtccctgccgaattatagctgctggacttttgggcattatggttggacatctgtactacttctttacagtgttgtatccgctagctagcggaaagaactacctcaagactcctatgtgggtacacaagattgttgctcgattcaggttgggcgtgcaggcaaactctccagtccggccagctaacacaggccctactgccttcagaggaagaggctatagactcaatcagtagactgctgcgacgcctggcgatgtacaagaggcatgaacaggttaacatggattcaatctaaactctgtggcagctctaggaatctgggttgggatttttcccattgaatctgtaatgtcctcatcgaataactacagatgtgcacttgcattgtacctgcgaagtagagctgcatggtttttttttaatactcactccggtacgtattactgtcaacggattagatacatctacttgagcgacaagtgatatggatgggaaggagtagcaaaatcttcttatatgatgtggttgattgcacgcaaaaaaaaaaaaaaaaaaaaaaaactcgagactagttctctctctctctctctct

SEQ ID NO: 7361 - DNA, 927 bp, Triticum aestivum
  Clone ID: PAT_TA_7361
gcgcaatttggtccatttttatcggatctccaccttacccacctgcagtcaagactcatgtatccggggcttcgctgccacgatcatgtcagtcctgcaccaatcccgtcaagaatcaccactgacctgaccatcgggagctcaccggcgcgcaacggcgtctcaaccactctgcctgccagcgccaagaggcccaacgacgccaagccgccggggctagtgctcttcggacaaaccatactaacggagcagcagatgagccgtggcgacttggcaggcgtgagctcagccgcggccaccgggaacagctcgctcaactggaaacaccggacaaagcgggcaatgcatcgcagggctcgggctctactgtcgttcagaacagtggctcgactgataacacatcgccggagagaccgcgggcggtttggagacaatagccacgtctccgagcttcgggttgaagcccgggcaatgcaaggtgttcgtcgagtcagataccgtcggccggaatctcgattgctcggcgatgagctcgttcgaggagctctatggccgcctgtccgagacgttctgcattgagggtgcggagctgaggagccgtgtgctctaccgtggcgccgacggtgaagtgaagcacgccggtgacgagcctttcagcgagtttatcaagtcggcacggaggcttaccgtactgacagatgctgggagcaacaacacggcgagctagataacagcagcagacaacctttgggcgagcatcgttcgtccatacttagtattcatgcagctcaatgagctagtatcttgttctttcaattgatttcggaaccagttaccagtatggcatagtagctttctttcatctagtgctcttcgtgtccaatgaggcagttcagttctcctcgtgtaatccatgtactagcatcc

SEQ ID NO: 7362 - DNA, 1012 bp, Triticum aestivum
  unsure (1)..(1012): unsure at all n locations
  Clone ID: PAT_TA_7362
gggctcccggccctctgcccggnngccccaccacccagtatcgactggtcgctcaaccaggcccgctctatcagatggaacctgacggcgagcgggccgaggcccaacccgcagggctcgtaccactacggccaggtgcccaccaccaggaccatcaggctggccaactcggcggccaccatcaacggcaagcagaggtacgcggtgaacagcgtgtcccacgtcaacgcagacacgcccctcaagatcgccgactactacaagatcgccggcgtgttctcggtgggcaccatctccgacagcccgacatacggcggtgcctaccttcggacatcggtcatgggggccgactacagaggctacgtcgagattgtgtttgagaactctgagaacgaggtgcagtcgtggcacatcgacggctacgccttctgggttgtcggaatgaatggaggaaaatggtcgccggcaagcaggcagatctacaacttgagggatggcgtttcacggtacactgttcaggtttaccccaatgcatggactgcaatctacatgccccttgacaacgtgggcatgtggaacgtgagatcggagacctgggccaggcagtacctgggacagcagttctacctccgcgtctggacgccgtccacgtcgtggcgcgacgagttcccgatccccaagaacgccctcctgtgcggccgagctgccggccgccggacaaggcctttctgacgagttaagccacacggccaacccaagtttgtcatgagaggatgacagcttggcctggagcaggcataaaaatttaccatgagaaaaaggctcacaaaaaatagttacccgaaggcagactgtcgtacatttgcaattgaacttttagtgccagcttgattctttctactacaattgttttggtggtgggtagtagtataattagtcatgtagtactgctagcatcttagcttcgttattcgcatccttactaaagagacaaaaggagtatatgctttgt

SEQ ID NO: 7363 - DNA, 861 bp, Triticum aestivum
  unsure (1)..(861): unsure at all n locations
  Clone ID: PAT_TA_7363
ctccggcgcgtcggcgctggggaggaccccctcctccgcctgtaccgtcggcgtccgcggcgacgagccgccccgccggcggtccgccggcttcatgctcccccgggcccggtgcggctgcgcctgcagggacagcctcgtcagggacaccaggaagctcttccgctccgaggacgaaacaaccggctgtaagatgatcaaccagtatgttcacctgggcaagattggtgctgggagctacggcaaagtggttaaataccgaaacatcaaggatcaatcagtatgttcacctgggcaagatcggcgctggaagctatggcaaagtggttctataccgaaacattgaagatgggaagttatatgcagtgaaggtgctgaataaacctcacatgatgaaagtacgtgtcgtacggtcagaaaccgccatgacagatgttattcgggaagtatccctcatgaaaatgttgagtcatcccaatatcgtaaatctcattgaggtgattgatgatccaaactcagataaattctacatggttcttgagtatgtggaaggaaaaattgtgtgggataaaggtttaggagaagctacttgcagaaagtacttgcgggacattatatctggtgttatgtatcttcactctcataacattattcatagcgatattaagccggataatctcttggtcacaagtactggcaatgtgaagataggggacttcagtgttagccagatttttgaggatgatgatgatatgcttcggagatctccaggcacttctgttttcactgcaccggagtgctgtcaggttcagctaccatggtagagcgttgatacatggcaggtcgtgtactctgtattgn

SEQ ID NO: 7364 - DNA, 708 bp, Triticum aestivum
  unsure (1)..(708): unsure at all n locations
  Clone ID: PAT_TA_7364
ggaagcagnaccccctactggcccaggccgagccgacgaggaaccaccaagagggggcccagcaactcaatgaaaacgccgatgcagcagccaccaaccctatccagtacgaggatcaaaatctcgagcaagccggcaacgcccccgcagcctcgggctccctgaacccgttcggctccctcttgctgtggttgctaggaggcggcgcttctgacggcatagtctccttcttctccatgttcagggacgtccgcgaccaccacggcggccaggactacgccgagccgccccaaaacgagaacgagcaggtgacatagaaaagagatgaatttggaggcgggccatataaaagatgaaatgccgggcgcggcgggtgagtggacaaatggtcctgtgttgttaagctgatgatactaacccgcaagtccggcccctcttcatcaaaggataatgacgaatatgcatgcatagcagcttgcgggccggtcgtgggctggaaatgccgccatgttgtctcccacatatgtctctctctctttctggttgctgggtaaggctgcacgccgaattgtgtctggtggtatgtgtaaattcctggtgcccgttcgagccttgtacaaaaaaccgctccttgatagngangtgttgtngcgaattcttttttgttactccaatgggtngggtgggangtggtcccatgttagtngt

SEQ ID NO: 7365 - DNA, 416 bp, Triticum aestivum
  Clone ID: PAT_TA_7365
attcggcacgagggcgacgccggcgcggtgtggcaggtaggtttccgtgtaggcgaggagggcgaggcctcggtcgtggtcatggatgtggtcgaggaggacgtgcccagggccaggcgcgtccactgtgaccactgtacggttgctggtaagtgcctcagttattccggcgtgctcgagtgcttgtgttatttcagcatgcccagctagtcgtccgggaatttctgttttttcttaaaggtgggaatttctggttttgtatataggtgtttgtgtcagctatagatttctctggggtgggtaaagagtattggagttcctagattagatttgtgttatttattagcttgggatgctgtaaaatccgtgtaaaggcatgttcgcatgaattagatttgactacccgaaaaaaaaaa

SEQ ID NO: 7366 - DNA, 660 bp, Triticum aestivum
  Clone ID: PAT_TA_7366
cgaggcccacttccacgccctgctcctgtacgaggccgcctccggtaaccgcgactacgaggacgtcgtcgccgagtgcgagcgcggactccgcatcgaggtgccctccgacccggcaccccacttcctcaagctgcccgccgctgaacctgaccagctccgagacgacctccgcaacctcatccagaaggccaatctcgcctccatatccacctgggtcaagaccctcggcggcactgatgacaagcttgggtttttccgcctggctgatgaacccttggagctccagccccttcctgcagcgcaccaccccatcgggatcaagaaggccaccaagacccctgaggagcgccgcaaggagatcgaggtgcaggtcgctgcgatgaggctggtggagcagcaccagctgccgcacaatcctgctgtcgctgcctcctcaccaccgttgtcagaggaagatgaggccccctgctcatcatgccagtctggtgtgaaactgcggcgttcttgattcttccttccattcgtttcatgtgaacctgaggttgcttagggtagccaaaatggcacccctttccttcgctaatcgtttgtgctacttctagttggtaactagctgtcaagttcttactgcttccagcacgtgttaactgagtttgt

SEQ ID NO: 7367 - DNA, 827 bp, Triticum aestivum
  unsure (1)..(827): unsure at all n locations
  Clone ID: PAT_TA_7367
gcctcccccctccagtaaccggcagaaactgacaaccaagatcggaaattcttcgggagaggggcacggataaagcgcaaggcgaagcggaagtggggcttcgttggcggcgaagcgggcgcggtggactctggcgggctgcgtccccgtcttagtcatcgccggtcgacctgcaggggaggagttggatccatggatgaagtattacatggtgaagtgggcatcaggagccgtttcagtgctgggaggattcgagagatcatgcgtggtctgacaccccggcagcagggaaaattttaggtgtacctacaggggaaagaccctttgtactgcatgggcagaagtcggacaaaatcaaagaactacgagatctgtacttaaataacggactaagggcaaccatcccccattgtgtcagtttgcttaagaacaatgaggacgaggagtccttcatgaggacattcctgcttattgcactggcggctgtgctcacccccaccactgggaatacaatagaccttgactacctgtgggcctttgaagatatgtcaaaggtgcaggacctcgattgggcaggccatatcacggagcatctgatggacgaggttcaaaaatttcagtacaaatctagggaggagaagatgagagacttctgggttggcgggtgcttgcctttgctcacgattgcttacatggaccacttggatctcccaagagggcgaattgtagaccatgaaattaactactcggtgcctangatctgccatgtttctaaggatgatttccaatttgctgcaatttgctganctgcatcgtcaacatttcaa

SEQ ID NO: 7368 - DNA, 427 bp, Triticum aestivum
  Clone ID: PAT_TA_7368
gcagcttcggagggttcccgtatgcggcaatcctgcttgttttgtgcattctccatgtggacgtcgtaaggggacaaatcactcaccctactgaagtaagtgctctcaatgctatcaaagacaggttaattgatcctatgaacaagctgaagaaatggaatagaggagatccatgcacatcaaattggacaggagtcatctgccacaagatacccaatgatgcatatcttcatgtaacagagctgtatgattgacacaccatccttatttataccgcactttcctttttttctccaccatgttaatggttacccacaaaaaaggtattccgtgtacttgtacagtgagccctctgctgaagcaactaatcttgcaagtcgtaacaaactgctgctcacaaataatagcaacaaccacaaaaaaaaaa

SEQ ID NO: 7369 - DNA, 581 bp, Triticum aestivum
  Clone ID: PAT_TA_7369
gccaccaccagaccagcagcgcacacacacacaccagccaagccaagggaaggtcgccggagagagaagcgccagagatgtccggccgcggcaagggagggaaggggctgggcaagggcggcgccaagcgccaccggaaggtgctgcgcgacaacatccagggcatcaccaagccggccatccggcggctggcgcggcggggcggcgtgaagcgcatctcggggctcatctacgaggagacccgcggcgtgctcaagatcttcctggagaacgtcatccgcgacgccgtcacctacaccgagcatgcccgccgcaagaccgtcaccgccatggacgtcgtctacgcgctcaagcgccagggccgcaccctctacggcttcggcggctaggccgcgccggtcaactcgaattcaccttgtgccgccagccagattcgtagcatagctagctatggctgtccagtgttcattgtcttcagtgtaatggccgcatctcgccgttcttgttcagtgttcagcgttcagtgtttggatgccatacgatagaatgaaatcgcagcattttaccctcgaaaaaaaaaa

SEQ ID NO: 7370 - DNA, 706 bp, Triticum aestivum
  Clone ID: PAT_TA_7370
attcggcacgagggaagaggcagagcagcccgcacgaggccctcctctccccgccgcgccgatcgatcctcctccgcctgacgtcacgccttcgcctcctcccttccagaagcttccacgcgccattgcgccccacccccaccccccacccctccagaagggttctctcttcaaggcatctttaatctgtagccttcctcccataagctagtatatagctgtcaggtcgcccttgaacaagtatgaatccttattttgttggccttcttgtgcccatcgcggtctctcttctgctccagaaaaggagaaaggttgaaaagaagaggggtgtgccagttgatgttggtggagagcctggctatgcgatccgcaaccatcggtttgaacgccctgttgaaacacactgggaaggggtcaacacacttgctgagctgtttgagcatgcttgcaaagagtatctctacatgcccctccttggcactaggaagctcatttcaagggaaatagaatcatcacctgatgggaggtcctttgagaagcttcatctgggggagtacgagtggaaatgttacgctgaggccttcaagagtgtttgcaacttttcttcaggattggtcaatttaggtcgccaggacaatgagagtgttgctatttttgccgagacacaggctgagtggcagattgcactgcaggcatgcttcagaca

SEQ ID NO: 7371 - DNA, 672 bp, Triticum aestivum
  unsure (1)..(672): unsure at all n locations
  Clone ID: PAT_TA_7371
gctcctctctccctctccgaatgcggcgctggcagctgacctgccgccgacctctggccctcggtgccgagctccgccgcctctgcacaaactctgccgcttcaccgccgccaacaccctctcccgctccggttccaccacttccagcctctcccttcttctccaccatgccgccccgtcgacggccagattcggcgacctcactgtcagatctggcgacctcgctgccgagtccagtgacctcactaccagatctgtggtgcgcagtctccagctaagtgccacgcggggtgagtaccggcgccggcgcgaggcgacccctctcctcacatcggtaacccatctgcaccaactccatagaaaaattccggatgcgttggtcgggaggcagagcggcttggtcaccaaggtcaaggaccagggcaacgacgctgagtgcgcacggcggcagatacgcatgaaacatgtgtgggcaattatctaggaagggcatgaaaggaaattcaagttactatacaacaaggtccacgggaataccgggacgggctcctttttacagatattataaggccccgcttggaatcgctgtagaagttttacatccgtacatgaatacccctgtatattacaggagatttgtaaaatacaaccggatattcccacanaatatgc

SEQ ID NO: 7372 - DNA, 1407 bp, Triticum aestivum
  Clone ID: PAT_TA_7372
gcggcgcctcaccggcgaggcggctgggccgcacgcgcggcatccagaccaacttcggcgacgactacgtcttccagattgcttcttgccaggagatctcaacgctcgcggtttctctgtcgacaaacgcactcaagttctatgctccagcaactgggcagtatctgggcgaatgcacagggcatacagggtccatccatgagattgccttttcggctccgtcatcgccgcaggtgatatgctcttgctctgctgatgggaccatcagagcctgggacacaaggagcttcaagcagatatctttgctaaatgctggcccctcgcacgaaatgtttaccttctcctttggtggaacaagtggtaacctacttgctgctggttctagctccaaggttctgttgtgggactggagaagttcaaaacaggtagcctgcttagaggaatcccacatggacgatgtaacccaggttcgatttgcaccaaatcaacagagtaaactcatttctgcggcaattgatggtttaatatgcgtcttcgacactgatggtgatattaatgaggacgatcatttgctatctgttatgaatgcagagacttctgtttccaaggtgggtttctatggaaacacatatcagaagctttggtgtttgactcatattgaaacactaagcacttgggactggaatgatgggactagagaattgaatatagagaatgctcgttccctggctagtgataagtggaaccttgaccatttggattactttgtcgattgccactactctctgcctgatgaccggttatgggcgatcggcggcacaagtgaggggacgctaggttacttccctgtgaaaaacgatcctgcaggaatgatcggtttggcggaggctgtcctggaaggaggccacacaggagttatcaggaccatatgcccaggtggaagcagtcttgagagccttggccaaaacaagggcatctttgggtggacaggaggcgaggatggccggctatgttgctggcgctccgacgacgccgtagcaacaaaaaagtcctggatctctagtacgctcgtgtcacgcatggacaagaaaatgaaaatccgacatcagccctactgaccttccaagattgatgtctggtctctcggttaacgcatccatatgagatttggttttgtttgtatcgaggcgataacgtcaggtccctgattttcttgccaattaaccatacgatcctgttattgctgtttcctggctgtactaatttttgctgttggtaaatgaagcaaggagtgcggtggtcgttattcaattttctcctttatattttggtcttaacttttcatctttttatgtttctctcttatgtatcggatgtcattctttttttctttattaatcttccact

SEQ ID NO: 7373 - DNA, 516 bp, Triticum aestivum
  Clone ID: PAT_TA_7373
ggcaacctgagcgtcttcgctgccagctactaccacaaggtcaacagccagaccgaggctggtgccaaggccacctgggactccaaggccagcaacgctgtcggcctcgaggttgccagcaagtaccgcctggaccctgtctccttcgccaaggccaagatcaacgaccgtggtgtcgccgctgtctcctacaacgtcctcctccgccctggcgtcactctcggcctcggtgcctctttcgatacccagaagctcgaccaggccacccacaaggtcggcgccagcttcaccttcgagtcctaaatatgtctcgagaagcagagtggaagaatcggtgaatgcctttctagatgaaggattgcagcaaactattctctacaaaagccctcgacttgtgtatagcagaggcaagagaaacagatctctttgcattcggatggagtcgtctttggaatgttaaaagcaatagaaattcccgatctacggatcataagacgatacatacgaaaaaaaaaa

SEQ ID NO: 7374 - DNA, 1460 bp, Triticum aestivum
  Clone ID: PAT_TA_7374
gcaggccttttctttctctctctctctcgcgagctcctcgctctctagattcttttctaggatgggtactgccagcggtgccgtggccctgctgctggtggtgctaggagccagcgtctccagctccagtgggcagctgcaggtggggttctactccaagtcgtgccccagcgccgagtccaccgtcgcgtccgtcgtccggggaaccgccgccgccgactccaccatcctccccgccctcctccggctccagttccacgactgcttcgtcagggggtgcgacgcgtcgggtgctgatcaagggcgggaacaacaacgcggaggtggacaacaacaagcaccaggggctccgcgggatggacgtcatcgaaaacgccaaggcgcagctcgagtccgagtgccccggcgtcgtctcgtgcgccgacatcgtcgtcctcgccgcgcgcgacgccgtcgcattcaccggcgggccgtcgttcgacgtgccgacggggcgccgcgacgggaaggtgtccaacgtgcgggacggcgacgtgctgccggacgtgcgcgactccgcccaggtgctccgctccaagttccgcgccagcggcctcgacgacaaggacctcgtcctcctcaagctcggcgcacacggtgggcacaacggcgtgcttcttcatccagggaccggctctacaagttcccgctcccgggcggcggggctcgggtcagacccgtcgatcccggacggccttcctgtcggagctcaagtccccgttgcgcgccgggggactccaactcgcgcgtctccctggaccgcggcagcgagcgcgtcttcgacacctccatcctccgcaacatccgcaacggcttcgcggtgatcgcctccgacgccgcgctctacaacgacaccagcaccgtcgacgtggtggactcctactcgggcctcctcagcaccatcttcgggccctacttccgccaggacttcgcggactccatggtgaagatgggcagcatcggcgtgctcaccggcgccagcggggaggtcaggaaggtctgctccaagttcaactgagagagacacatccgtggatccagattccattcattgcgctgccggccggagtactggtttggctagctggagatgaaaatcactagctagcccatgcggacatgcatctcgtgggtgcatggcccggtctcgtggcgctttcatggctttttcttcttcttcaatttattgtgtacatgttattgaaaagagagaggggaaatttagtggattcatgtgattctggcgccaaggtctagtacgtacggccaaggatctgtgcagttttctcttttgcagcggctggaagcgagattaaattcatatagctagggtatatataagatgtgcttctgtatgcttgtatgtacactacacacaccatatgtgcaattaagtggaggtgtaatttaaaaaaaaaaaa

SEQ ID NO: 7375 - DNA, 266 bp, Triticum aestivum
  unsure (1)..(266): unsure at all n locations
  Clone ID: PAT_TA_7375
attcggcacgaggggtcagcagnagggtattcagcgtgtgcaaaggggcagcgcgtcgtcggcttcttcggaagttcagtttgcgaagtatggtagttgaaaatagatgatcccgggcacttagttgtgtttcttttataacttgactgagaagcatatattcgtggtgccatattgctgacggctcgggacttatgtcttatatcattattattattatagctatgtcatccactgtgtaatttgtttgaaaacgaaaaaaaaaa

SEQ ID NO: 7376 - DNA, 567 bp, Triticum aestivum
  Clone ID: PAT_TA_7376
gagaaaaagaatcgacgcacagagcacgagctgcatccgccacccgcgatgctcccttacgcaacggcgtccgacgcggaggcggccctgaggcgcgccatgacgcgcgccgaggcagcgtggttcgggtacacggcggcgaaggctgactactacctttactaccacactgtcgccgtcctccttgccgtctacaccctgctgccgctcatgctcgcgcttctcgagctcggcgcgccggccctcgccatgcggtacaagctgcagccgcgtgggaagcggctgtcgccggccggcttcctccgctgctacacagacacaccgcgcttcttgctccccctcgccgcccctgtccagctgctatcctatcctgccgtgaagatgttggggatccggatggggctgccgctgccgtcggcgggagagatggcggcgcagctgctcatgtacctgcttgtggaggactatctcagctactgggtccaccggctaatgcacacaaagtggtgctacgacaacatcaacacgtcaacatgagtacactgcaccaaacggctcgtcgcgcca

SEQ ID NO: 7377 - DNA, 1607 bp, Triticum aestivum
  Clone ID: PAT_TA_7377
gaaattccccacatatcgtcatggcctgaagtctaccacgccacacgcttggcccggacttccggctccccccgtttctcggatgcactgcctcgcctgcgccgcgcccgctgcagcggccgccgctcgtgctcccggaaggcgcttcggccgccggagagtggttgtcgactgcgtcgcctccgcagaccgcaacgtggaaggaacgcctccgaggttaagggaagcatgtgaactttctgaaatctcaagcacaacactgctgtttgcgtcaaagaggaagattcttgcattttcggccttttgcctttgcctacattcttcaaggtacttatcagcacttgctttgggtgatccaaccgtcaaaattgaggatgttactccaaagatatttccatctggtccattgtttccaaccgagaaacggatcgcagagctttttgaaacaaatacttactcagtggtcaacattttcgatgcgacactgcgtccccagctcaatgtaacaggggttgttgagatcccagaaggaaatggttctggagttgtttgggatgagtctggtcatattgttacaaattatcatgtggttggcaatgctctttcgaaaaatccaaagcttggtgaagttgtcgcacgtgtcaacattcttgctgccgaagggatacagaaaaatttcgaaggaatattgattggtgcagaccgcgctaaagatcttgctgtccttaaggtggacgccccttcagatatcttgaagccaattattgtgggacagtcctcagctctaaaagttggtcagcaatgcttagcaattggaaatccttttggttttgaccatactctgactgttggtgttatcagtggtttaaatcgagatatatttagtcaagctggagtgacaattggaggtgggattcaaacagatgcagctattaaccctgggaacagctggtggtcctttgctagattcgaaagggcacatgattggtatcaacacagcaattttcacacagacaggcacgtccgcaggtgttggtttcgctatccaatcatcaactatactcaaaatagtccctcagttaattcagtctggaaaggttcgtcgtgctggcctgaatgtggaattcgcaccagatccgattgcgtatcagcttaacgtccgtgatggtgcccttatactgaaggttcccccgggcagcgcagtagaaaaagcaggcctagttcctacgggcaggggttttgccggcaatattattctgggtgatgtcattgttgcagtggatggcaagccgatcaagggcaaatctgacctcctgagggttctagacgactacggcgttggagacacggtgaccctgacaatcagaagaggcgcggagacaattccggtagccttgtcgctggaagacgcaagcgtttgatgtactgtaccccttgaagtttgttcccattcccagttctgcaatgtaatctgatgacctcctcgtggatttttgatcagtcggaagttttcattgaaaccttgtgcgttactagtcgtaccaagatgatgccatgtgctagtctgtaaccgaacaaaaacccacggaacgggtaaggacgtgcgt

SEQ ID NO: 7378 - DNA, 617 bp, Triticum aestivum
  Clone ID: PAT_TA_7378
ctccacccatcccggccactctcgtacggacccgaccgtctacgccgccgacgccgccggagctccagtccgccgcccgctaacccagcgcaaactccagtatcattacaaacccgagggagcaggcaccaaccgccacctcgcatcccgtgccccctccccctcgcggaaaccccccgccccccgtcgcctgtgctagggttgcagccgtattcctccggcttttgtttcccgggacacagggaagatgtcgtcgacgcagaagaagaagagcaactataaggagaagatggcgcggcggaaagaggagaacaaaaaagaagaaccagagacaccaaggtaccgagatcgtgcgaaggagcgtcgtgaagatcaaaaccctgactatgaacctacagagcttggttcgtttcatgccgtggcacctcctggagcagatttgaggctagaagatgcccaaaagatttcaattgagaaaagcaaataccttggaggcgatctggagcatactcatttggtcaaagggttggattttgctctacttaacaaagtacggagtgaaattgacaagaagcctgatgcagaggatgggaaggatgccaaggcgagggaaacaa

SEQ ID NO: 7379 - DNA, 580 bp, Triticum aestivum
  Clone ID: PAT_TA_7379
gcagggcggctccgggtcggtgtcggcggtgaccttcgagaacgtgcgcatggacgccgtgcgcaaccccatcatcatcgaccagtactactgcctcaccaagagctgcgagaacgccaccaccgccgtcttcgtctccgacatcacctacgccgggcatccggggcacctacgacgtgcgcggcccgcccatccacttcggctgcagcgacgccgtgccctgcaccaacatcaccctctccggcgtcgagctgctgcccgcctccggcgacaccgtcgacagccccttctgctggaacgtctacggcaacaccaccacgcccattgtgccgccggtggcgtgcctcatagagggcgtgcccaggaacgtggatgaagctagcagcttgaagtgttactgatgagcgacgtcaagccgtcgcacgccccttatagatgaggaagtaattaaaaccagagaaaatatattaggccagacaaaaaacttagttaaagcatggtcgtgtgtagtataaattacctatatattgtatatagaaagatgaaaatgtaacagtatgagatgattttgcgtgacagt

SEQ ID NO: 7380 - DNA, 1448 bp, Triticum aestivum
  Clone ID: PAT_TA_7380
gcacgaggaatttctttaccaacttactcaaattgtggcacgtggctgcccatcgcgtattcggttcagctcgcccgcgccgcgttccgcggttcgtcggtcgcctgcatttcctggcgggcgtttctgtctgggtggtgctgctccttcccttgttgtcgtccggggcgtagctcccgtgatggttcctcctcgttgccagtgtgagtggtacgcttctctgctctcccccctctcgtcgggtaagtcgcaggtatggccaccgggtaatcggttcagatctcgcgctccttgtttcgctgttcttcgtttggttgtaattccaggcgagcgttctgtttgggttgtgctgctccttattacgttgatgtcgatcgaggcctagttccggtggtttgtcctcctctgttccgttgatgttggtatcgtcttctgaacctcgctgctttggtttaggtcgcggctaatctattttgctttgacttctgatctgattgggtcctggctaatccatcatgctctgattgcgatatgttttagggtcgtggcttatccatttttatcctaattgctgatttgattcaaggttgtcaattaatggaggttatttttggcgagagcaactagttgtgttcgtttaatggggattttatttaaacgtggagcagtttgtttgctttcatctctgttcgttacggtggatcggttgtggtcagcttagttttctttggagatgtttgacatgatctgaatgagagattgaagttcgccgtgcggcctatgctggtccgtccatatcgatgcgtttttgctctgcggtctgccggctttttcttgttgcgctgggatatgtatttcttgaactgtgtggacatgctcatggtggagattcttcagtggctgggttttggggtccctcaactgtgtggacatgctcatggttggtttcatttcaagattcctaagaaaattggaggtgcttgttttgtttgcgttgtagatgtaactttcttgggaactaccttagaagaacatggaagtttgcttttgaagtaatctgtttgaggttccaagtactgtgaagaaagctgctgactagtttactgcctgctgtgtttttctcgggtggcacgtcaaggtctatccagatgctgattactgtgttggaatctaccaatccctctgatatctagtttgtgcctttgattttctacatggatattcggttgggtttctgccagtttacatgctccgtccggtgttggattagtcttagcttggtaattagtattctaattgtaatatgtagtcatgttctgttcatgcaagttatgttttatcttgtacacaattgtcaattatgcatcttgtatgatgttattggtgtaattgttgaatgatatatggatgacttacccttcgttgtttaaaaaaaaaaaaaaaaaaaa

SEQ ID NO: 7381 - DNA, 559 bp, Triticum aestivum
  unsure (1)..(559): unsure at all n locations
  Clone ID: PAT_TA_7381
gagagaactagtctcaagctttaatttctctctcttttttccaatagtatagtattcgttccttctctgacttttattttccgtgtgattgctgcggatttcgcttactaattgagctgtctgggttggggaggggggttggggttcggggtcaaacttgaggcatctctagtattttggtactagtattagtttggttcagcttgctgttggctgttgggcgtatggtgtgatttgtgaattctggcccggaagatgattttgtgagttcaagcttcggtgtgattacatgtctcctgctccgatttttctgtcaaaataacatggatcatggcgggagctttgtaccgggaaagtgtgcatctcaaatatctagaaatgaagttggtgtttgtttgtttgcgaggtgggattaaatctttggagatattagtttatcggaggctgcttcattgttgaattcacttgccatatgactactacagtatattttctaaatagtcttcagctagagaaccatataggcgcagcttcgannataaaagattcatcataagaa

SEQ ID NO: 7382 - DNA, 1104 bp, Triticum aestivum
  Clone ID: PAT_TA_7382
gctttatcgatgggacggtgctgtctttagaagatcgagtagctgttgctctgagaaggttgaactctggtgggtcgctggtgaccgtaggaacctctgttggtgtgaaccactcgactgtctctctgataacttggagatttgttgaagctgtggaggcacgagcaggccaccacttacgctggccagactcggatgagatggcgatgatcaaatccaagtttgagaagatccatggtttgccaaactgctgtggtgtagtagacacaactcacatcattatgtgtctctcttcagctgaaccaaactgcaaggtgtggctagaccacgagaagaattacagcatggtattgcaggctgtcattgatcctgatatgaggttcacagacattgtaaccggttggccaggtagcatgaaagagtcgagtattttacacagctctggtctcttcaggctgtgcgagaacggtgccacggttgaatggcagcaaactgacgggtatcagacgggtcagaagttggggaatacgtaattggtgatgcaggataccctcttctcccgtggctgttcactccttaccaggagaatgacctctcagaattgaaagtggaattcaataagagacactctgcagccagaacagtcgcgctgaaggcgctggcgaggttcaaggacacatggaagttcctgcagggagagatgtggcgccccgacaagcataagctgcctcggataatccatgtgtgctgtctgttgcataacatagtgatagacatggaggaggatgcagccatggacgacgctcatatatcagatgatcatgacgctaattacaggcagcaagtgtgccagttatcagatgagaaggctgtcaggatgagagacaaactgtccgagcacttgaacagcagttgacagaagagctggatgaagaattgaatgtaggtgctgctgttgattccgtccgttgcaggcttgcagcttaggctttggctgcatagttttgcggagttttggccaatcttgactgatgaaactcggttgtaatcttagagccgtagtccatgccaattcgatcggctcatttatttttttatcatctt

SEQ ID NO: 7383 - DNA, 1101 bp, Triticum aestivum
  unsure (1)..(1101): unsure at all n locations
  Clone ID: PAT_TA_7383
aattcggcacgaggagtagtntatgcttgtctcaaagattaagcctgcatgtgcaagtatgaaccaatttgaactgtgaaactgcgaatggctcattaaatcagttatagtttgtttgatggtgcgtgccgccccgaggcccctccggttccccccgcttcctccggcttcacgccccgcctgccgggcccgccgcccttttccggccgtcgccgcccccggccgcgccgcgcggctccgcgccgtcccccgtccccgccgcctcgcaccgccggcgccccggcgacgcgtccgtcgacgccctgcccgcccacctctccctggtccgcctcgggcccgccgtcgtcgtcgcggccgccgctcccggcgcggccgccgccccggcgcgggcctcggcgccccccgccgccgccaagcccttcgtcgacatcatcgccgacgccaagccggcgtaccagcacagttcctggatggatccctgctgcgctttcgcgggaatgggaggaggatcccctgacatgttcatcagcagcagcagacagagctcctgccagttggttccctgcgattccgtgaaggtggaggaggagtgcgccgtccacaagggccggaagaaccggcacggcgacgacgacctggagccggaggacgagaggcggcgcaagcagctcgcgctgtccgaggaggagaccgtccgggagatgttcgacaaagtgctcctctgcaacggtgtcaactgcatcctccagtcgccgctgccggccgaagcggagatcagcagcgtgtacgtgaaagggtcagggaaccggagagggcgcaagaaggggaagaccggagtgcccaccgtggaggaggagtccgtcgacctgacgacgttgctcatacactgtgcccaggccgcggctatcgatgatcaccgcggttcgggtgagttgctgaagcagatcaggcggcattcttcccctcatggggatgccgggcagaggctggcgcattacattgctaatgggctcgaggctcgccttgccggcaccggtagcaccgtctaccgctcgcttgtcgcgcggcgaacttcttccgctgacatgctgaaaatantnn

SEQ ID NO: 7384 - DNA, 979 bp, Triticum aestivum
  Clone ID: PAT_TA_7384
gaaggcagggccggacgagtacaggacaaggaagcagcgcgtgcacgctgccgctttgggtgaaggagatcgacaagatggaggaggcgcgccttggcggcggcggtggtggccgcggcgcagcagacgacatcgaccggcttcttgactcgtgctcagagatctttgattccggcaacgctgattttggcgattcgaagattccaagcactggtgagattaaaaccaagccggatggttgggaaactacctcgaggggtcaggacggtaacatatgggagatctcacagcgtgaggaggacatccttctccaagaatttgagaggcgcattgctttcagcaaacagcagattgctagcttcatcaaaactcacatatttagtcgaagacggcctatcgacgggtggaagtacatgattgaagaaatcggcccccccgcaaccggcgggatcgggaccgtgccggatggttgggagactacctcgaggggtcaggacggtaacatatgggagatctcacagcgcgaggaggacatccttctccaagaatttgagaggcgcattgctttcagcaaacagcagattgctagcttcatcaaaactcacatatttagtcgaaggcggcctgtcgacggatggaagtacatgattgaagaaatcggccccaacgcaaggaaagggaaggggagcgtacagaggctgccaagtgtgactgatccggctacgcagccgttcagggaggagtcgcctgcaattgcctctgctggtggttcctcctctggtcctccccccttcagaggaaaccgacattactgatgttcagtatgcatgcaatcccctaccgattttcattgcacacatccaggctttgtggctccaaaagtgcactggtggctagattccttgtggagaaactgtgtattttctggatcatatatgcttcctttgtgcactgatgcactgcttttggaaaaaaaaaa

SEQ ID NO: 7385 - DNA, 1501 bp, Triticum aestivum
  unsure (1)..(1501): unsure at all n locations
  Clone ID: PAT_TA_7385
attcggacgagggggatgggcagtgcggtggtggtgcaggctggaggctggtggtggcggcggcgcgcccagatccgcctctggcgccgcgagttgcgggcgacctggatcacggtcggccttccctaccatggctcgtgggggggcagcgggtggatgcgtgtgccgttgcccgtccgagcccttgtggcaggtcgatgttgcacggcgctggagactcccctggtggccatccatggatgcggcggcgggctctgcttcctcattagattaaattttggtattacattttttagcacttcatgtgaatgttctatagtctctattgtgcaggcgggtctactctccctcttgaggcgagtgtggatgtaatggacattgattgtggttgttcggacaaaaatattgcgtggaaacattatatactgatggatttaattagcatgggctggacgggaaggtgatgcctgcgatggcgaccgggacgacgggcagcgcaggggcaattgtggccatcgtggtgttttcaagggagagcgaggcaactgcaatcacgcaactgaagaagtcgaaacccggggcgaagttggccaacatgaaagctgacaaacctaaatgccggtgataggttgttcgccgctgtcgtgccgtctttgaacttggtggagacgcagaagcagtggcggagctaggatcaagccatgacccgggcaagccccaggccaatcacttggtacagtgctaaacagtgtaaaatccactacagtaaacgaaggagccaagcctcaggacccaggccgccgcccgggcagcctggggcttgtctccgccactatgcagaaggagaacggtggcgccgtgaagaccttgacgactgttgccatgaccacaaccatgatgattgtgttggtaataaagatactcattatatacaaatcccccagcacctatagtttaaattcctccaaccatataataataaactcctaaaaaaaataacagaaacctaaaatattcgacttctttttttttttttttagaaaaggaggatgacccccggcctctgcatctgggagatgcatacggccactttattgattattctcgaggaccttacaaagtattacaacaatgtgcctgaatccaccatcttggcaacatatgccgctactcctatccaaaatgatgaaggggtgctagctgggccactacccaaaccactcacctaagcctaacatcaaaagccggacgccgaaactcattcggaagccccagccgagccacataccgggtctggggcacaatccggtcagacacactcgtgtgtcgtcgccgccatcttccacaggtccgtcttcaggtcatattgaggcttctaccttgtcgtgcccactccgccatcgacgtcaccatgacgccagacagcaacctcctcctgcgcgagtccatctccgcgcatcgccccgcnatcgganggcngaatncccaaaanngccaagcc

SEQ ID NO: 7386 - DNA, 430 bp, Triticum aestivum
  Clone ID: PAT_TA_7386
caagacaagagaagagaagacaacaagagaggcatagcattttttagctgctgcttgtttcttttcctgcctgctcccccgtctcctggtacgtcgtcgtccgtgtgcgtgtgtgtctttgtgaggccctcatttagcttccggtatactccactgtgtttcatttatgcaccaggttggtagaggttaataatatatatggtgcttctaccgattagccgagtgtattactactagcttgtagacgtgtgtgtttgtgctgttgtaggcctgtagcttctctcagactgagatgcatcctctggctatagagctgttgttttgtactactagtactatctattgctaggtttgtccctgttttccaacggacaagctagctaggttaacgacgagcgtggactacggggaaaaaaaaaaaaaaaaaaaa

SEQ ID NO: 7387 - DNA, 571 bp, Triticum aestivum
  Clone ID: PAT_TA_7387
ttcggcacgaggagagccgagtctcttcccatccattttgccttggagaaattgtttgaacctttcctccacttactagcctttttcttcttcctccccattgctgccatgagggctctctttgcatggtgcgccctcctcttggcgtgcggcggcgtgatgcattgcgcggaggcggccaaggccaggcacctcaagtgggaggtgagccacatgttctggtcgccggactgcgaggagaaggtgctcatcggcatcaacggccagttccccggccccaccatccgggccaaggccggcgacaccatcgtcgtcgagctcaagaacgggctgcacaccgagggcgtcgtcatccactggcacggcgtcagacagattggaacgccatgggcggacggcacggccgccatctcccagtgcgccatcaacccggaagaaaccttcacttatcggttcgtcgtccacaagccgggggacatacttctaccacggggcactacgggcatgcagagggcggcggggctgtacggctctctgatcgtggatgtggcggacggggaggaggagccgt

SEQ ID NO: 7388 - DNA, 1309 bp, Triticum aestivum
  Clone ID: PAT_TA_7388
cggcgcgcagcatttgcaaggatgtgttcttcgtacttgaccgtgcaatcatatgcaatgatgtgtcttctcgtcaggtagaagtagccggctggagatcgagcgagcatggacgactcgaacatgttcatccagtgggccatggagacgctggagcaggagcaggacgccgccgccgccgccggagatgttttcccgtcgtcactcctagagctcgacaacccggcggagctgcagaacggcacgcacatggcggcccaccgacacggagccaccgacagctggagctcaggcgacagcggcgccgcagtggccgtggagaacgacggctggtcgtccaactgcagcaccaactacccggccgcgagctggaacttcacttcggccataccacagccgcccagcattatcgaggccaccccgagcccacccgcagctcccagccacgtcgtgccggagctggcgcacaggtcgccaccgtcgaggaaatcctccggcgccagtacaggggccggtgccgaccgtgcaggaacacgtcatggcggagcggaagcgccgggagaagatcaaccgacgcttcatcgagctctccaccgtcatccccggcctgaagaagatggacaagccgccccggccgtccgacgcactgaggtgcgtcaaggagcagcaggagaagctcaaggcactccaggaccgtgacgtgaggagcatcgactcggtggtgctagtgaagaggccgtgcatctccaacggcgatgatggctgcccgtcaccgccgccgtcagcagcagctggaggaggtccgccgacgacaaggatcccgttgccggagatcgaggcgaggatctcggagagcaatgtgatggtgaggatccactgccaggacggcaaaggggtccttgtcacgttgctcgccgaggtcgaggggctccaccttagcatcacgcacaccaatgtcgtgtctttcccggcttccactctgatcataaacctcatggccaaggtagacgagggcttcaccgtcacagcggacgacattgtatggaagctcgactctgctttgcgccgacatcatagcggcaaatgatagttctagctaggagaggaccaataaacatgaagacgcaaaggcttaagatgcggcaagcaggcagctcatgtcgaattagcatgttcaattagtgtgtgagtgtgcgtgcattgtgagttacactaataatgaccagtgagaatctcgggcacatgttcgatttagcatgttaccggtttttgggtgcatctgtacgtgtcactacagccatcagggcgt

SEQ ID NO: 7389 - DNA, 958 bp, Triticum aestivum
  unsure (1)..(958): unsure at all n locations
  Clone ID: PAT_TA_7389
gtgaaatggtaacnagtgtagagcaactatatgctgccactcgttcgcctggggtatctgttgtctacttcatgtcgtcggtgaatcaacaatgcatacaaattacacctgcggtggactctctttgcagcgaatgcccctcaatgaattttctgaaggtaaatgttgaagatagcccaacggtggcaaaggcagagaacgtgcggatagtccctacattcaagatatacaaagatggggcgagagtgaaggagatgatctgccctaccttgcatgtcctgcgctactcagtgagacactatgccgtatcgagttcttgagaagctttgggttggaacatagggctcccctttcctctgccagccagtcttttgctttaggtcccaaatttgctaaaacaccagcctccacagcatttcaccagctgcataataattccccattgagcatcgagcataatgagcctccccaagttttctgctttccacccatcattacccatcccatcccttgccgttgagaacatatgatattgccgaccccattcaattcttacacctttcaggctctttggctccctgtattttgatacattttgctttacatcttaggccgtaaaccagcagcgcccgtggagggcaatgtttgtaatgttgtttagtttagaatatcatagagggagaggggacggggttgctggttgcggtttccgttacgtgtatataccatatagcaaaacatgagaatccatttagtggaggtggtgaggaggagggggaggagggtacagacagggctagttgttgtgttactgtcattttagcggtaaaaaggaaaaatcaattggtaattggtgtagagaggggaaaggttggtggtgttaattggatgccattttgctgcttctgctggtctgtggtgccgatacattttcatcatcanaataaaacaatccaac

SEQ ID NO: 7390 - DNA, 629 bp, Triticum aestivum
  unsure (1)..(629): unsure at all n locations
  Clone ID: PAT_TA_7390
ggcgagggccattaccaaggccttcccacacgtcaagtgctcagttcttgacctcccacatgtgatccaaggcgtctcggctcaggccgacaatgtggagtttgttgctggggacatgatggagttcattccacctgctgatcgcattttacttaagtatgtgctgcataactggagcgacgaggattgcgtgaagatcctgacacgatgcagagaggccattgcccacggagaaaaagaagggaaggtcatcatcatcgatgaagtggttggatctagctcgcagaacatactcgaagcccagctcttgatggatatgcaaatgatgtcattatttatggccaaagaacgatatgagcaagactggaacaagatattcacggaagcaggatttgtgaattacaaaattcgacctatcctaggggtgcgatcggtcattgaactctacatataacttgctcgtgctccataatcctatatatatgaccatctatcatgttcccgtttgttgtgtaataaatgcatagtgcatcagtgtttaaaacatttatagtactacttcatgcaccatgtatcagggccaaccaattattggaatgtaccttctaccttgcagtcgnnaaaaaaaa

SEQ ID NO: 7391 - DNA, 725 bp, Triticum aestivum
  Clone ID: PAT_TA_7391
aaccgcgccacggacacggagagagaaaggagtggcctgcgccccgaggcactcgcgcccccggacactgagcagcgcaaaggcgcggtgctgccggcacttatgccgatgatctttcccttccccgttgccgtcgccgccgccctcttcgccgccgcagccttggctccgagacacgcctccgcgctcacccgccatgacttccccgaggggttcgtcttcggcgcaggcacctcagcctaccaggtggaaggcgcggccgcagaggatgggaggaaacccagcatctgggacaccttcacccatcaaggtcactcgtctgacgggtccacggcagatgtttcagcagaccagtaccatcattacaaggaagatgtaaagcttatgcacaagatgggtctggacgcgtacagattctccatctcttggccccggcttattcctgctggaagaggacagataaacccaaagggcttggaatactacaacaatttgatagatgagctgatactacatgggattcaacctcatgtcaccatctaccattttgatcttcctcaggtcctgcaggacgaatatggtggactacttagccccagattcatagatgattacaccgcttacgcaaacgtgtgcttcaagagctttggggacagagtgaagcactgggtaaccgtcaacgagccaaacatagagccaatcggcggctacgacaacggctctca

SEQ ID NO: 7392 - DNA, 688 bp, Triticum aestivum
  Clone ID: PAT_TA_7392
tcggcacgaggcggaaggcggcacgtgcttaagggtgatttggttaagcaatgggtggctgaaggtctgatctacacaacagaagggcaagacattgaaaaagttgcagaaagctatttctatcaacttgtcggtagaagcttcatccagccaacatgtgtcaactactacaatgaggtgttgtcctgtcaagtgcatgacatggtacatgatcttattgctcataagtctgcagaagagaatttcatcgtggcaatagactacaggtgtcaaaagaatgtgtcactttctcataaagcccgtcgactctcgctcatatttggtgatgcgagatatgccaagacaccagcaaacatccaaaaatcgctagttcggtcagttagattttctggattgcttgagtctatgccttgtcttacagagttcaagcttgtccgtgtcctaaaccttcaactaagtggtcaaggccgcagtgataatgatatagcagacctcactgggatttcagaaatgtttcagctgagatatttgaagattgcaagcgatgtctgcatcaaactgccggaccatgtactacagtgcctgggtacattggatattaccgatgcaagatttgctcctgttccatgggatgtgaatttcccacgcttgctgcacttgcaccttagtcttcctgtcgagagagatc

SEQ ID NO: 7393 - DNA, 817 bp, Triticum aestivum
  Clone ID: PAT_TA_7393
cccaactccccgccgcgccgacggctccaatccctgaactcgagcagtaaacgacaccacccagacggccccctcagatcggaggtcgaatccgaaccccgtcggcgatggcgccgccgccgcgccgcctcctcctcgtcctcctcgggttccttgccgctgcctctctagctaccctcgccgcggctgtctacgaagaccaagtcggcctcgctgactggcatcagaagtacataggcaaagttaagcaggcagtttaccacactcagaagagtgggaggaggcgtgtcgtggtcttgacagaggaaaatgtgatcgcctctcttgatcttcgttcaggagatatattttggcgccatgtcattgagaagaacaaccccatcgaccagcttagtctttcagctggaaaatatgttgttactctttcttcgggaggtagtatattgagggcatggaatcttcctgatggacaaatgatctgggaaaccaatattcatacttccacatcatcaaagtcgttgctgcatgttttgtcaaacagtaaagtggtaaaggataatttggttttagttttggctggacaatggatttatgctgtatcaagcattgatggagtcatttcttggggaaaggagttcacacatgacggcctagaaatcaagcaggttgttcaatcacctgataatgatattgtctatgttgttgggattgctggttcctcaaagcttgctgtttatcagttgaatgctaaaactggagagatagtaaaggatgcccaagagtcattgcctgatggattatgtggtgaaatattact

SEQ ID NO: 7394 - DNA, 452 bp, Triticum aestivum
  unsure (1)..(452): unsure at all n locations
  Clone ID: PAT_TA_7394
gtgacaagaagaggttcaagnagcacgctgcggccgtgctgcgagagcttccgccccgacggctactgcggcgaggaggacgagaacggcacgcggcagtacaccctatgcgacgacgccggccgctatttctactgggacgacgtgcacccgacgcaggccgcctgggccgccgtggcgcgcaccttcagggccgccgtcaagagcttcctctccgtctgagctgacatgaaacgaagatggccatattatgatgcatcgccagcagtcccgactaaccaacacgtaacatgcccttaaaaggcagcaactgaccaactgaagctagcttttttactgttgtttattggaaacatcaatttttctccagctgtcgcgatgcgacaaacaaacaaacaacgtgtctgctaattctcgggtggttgggaattttggaagtgtcaaaaaaaaaa

SEQ ID NO: 7395 - DNA, 737 bp, Triticum aestivum
  Clone ID: PAT_TA_7395
ggggacgtcctgcaggtgctgagcaaccaggacgtcctgggccgccgcgcgcgccggcctcagggcgcccgcgccgcgccccccccccaccgccgcctccaccaacctccacggcgacaagtgggtcgagccgctgccggagttcgcggcccacgccggcgagccgccgcggtacagggggttccggtacaacgagtacatgcagctgcggatgaggaacaagacccacccgccgtcaaggcccgaggatgtcgtccacatcacccattacgacatctagcttccatgatccatgggtacgctgtacggtgcctttttttctgttctcaaatttcagttcgtctgtggcgtgaacagcagcctggggttatttttgccttcagtcgaatgtggtcagaaccatcggattgtgcaatccaaagctttagagcgccgtcttcggcggcgaaccgccgcggtacagggggttccggtacaacgagtacatgcagctgcgcatgaggaacaagacccacccgccgtccaggcccgaggacgtcatccacatcacccattacgagatctagcttccatgatccatgggtactctgtagtctgtactgcgccttttattctgttctcaaatgtcagctcgtctgtggtgtgaacagtagcctcaggttatttttgccgctaatttttttaaataatacaatttttatattaaatttcaaaaaaaaaaaaaaaaaactcgagac

SEQ ID NO: 7396 - DNA, 839 bp, Triticum aestivum
  Clone ID: PAT_TA_7396
cacggcccccccctgcccagccagctcctccatcccctccccacctcatcctcttccccgctcatccccgccccctctcatcctggcttccgagttcccccgctccctagctcgctagatctcctctagatctcatcatgtctaccatctacatgagccagctctctactgctttccctctaatggaggaagagcatcaccaggatcaccatcaggggcacttccaggccttcaccctgcccaaggatccccccatcttgttcccttttgacgatcagcatcagcggcccgagcgacaaccagcagttctctcaggctcacggcttacgaccacgcacttgaatgcatgcaccatgccatgctaagattcatgccccaaccatatgcatccggctggatcagtcgagtcggtgtttctcggagctgccgttcccaggaccgatcgagtaggcagtccgtcgagcgacatgatcgcagcgatccctactccggcgagccatatgatatggcgaagctgcaggacaccagcggatcgctcaaaagatcggcaagtggacggcgcctgctcccgcagccaagatgaggatcacgaggaagacgagcgatcctggtgtcaagaagccgaggaagagggcgcaggcatacgaggatcatggccacatgggcggcatgaaccaagctctgggcgttattaggacatgctctgattgcaacaccaccaagacccccttgtggaggagtggtccttgtggccccgagtcgctttgcaacgcatgcggcatcaggcagcggaaggcgcgccgggcgatgatggccaccggggcggcgcccgtcaccga

SEQ ID NO: 7397 - DNA, 899 bp, Triticum aestivum
  Clone ID: PAT_TA_7397
gcagctgcccgtgcgcaccatttgctctctgtgccggcgtgtggcgcatgttcgccgtcgtagtggggctggcggttcgcgctgctcggtttgccgtcgttgctcccgaccgctgccgtgcggccttccccgcctccggggtggggcgcccttcttaggttgtgggctgtcgcgggctccgctcgccggtccgtgcattcatgataactcgacggatcgcacggctttcgtgccggcgacgcatccattcaaatttctgccctatcaactttcgatggtaggataggggcctaccatggtggtgacgggtgacggagaattagggttcgattccggagagggagcctgagaaacggctaccacatccaaggaaggcagcaggcgcgcaaattacccaatgccccctaggaacttgattcccccaatgcctgcatcagtttcaggtattcgagtgtagcatgcacgcttttgttcggagccaccacaaatatggtaccgaggacatgaaaatgcctggggtgaataattttgtgggcaaatctgtcaagatatgtgggtattcgagtgtagcatttttgaagaaagatttactactacttccaattaaacattcctcttaaggagaggagagcgaccctcctcctccccgggccgcgtgtccatcgtttcccgcggcagcgtaggccccaaggcgggaccccccagagtgcccgtggctgctttccgggaaattcgtacaggcacacacactacagctgcggttcaatctagagcatacagacaagtttatgcgagcaaatagcatcccatcattttgatgatgaaactaatcaatcttttcctttggagaagcatgatgcacgaaggcaggaacacagataattaattggtgtgcctgt

SEQ ID NO: 7398 - DNA, 820 bp, Triticum aestivum
  Clone ID: PAT_TA_7398
cacctctctctccctcacctctcctccagctccggccgctgccacggccaggccggcgtggtggtgcgcctcccatccatcagcgccgcaagccatcaccatctccatccatctccacgcaccatccatcaacgccgccaccagcgccgcatcaccacctcgcacccccagcacatcacaccacgagctcctcactgaacctcctgccaccgatctgaagctcttgttcttctctcaacgcccctgatgctccttctccttgcacctccttgttgctgctcttcccctccttttctgctactcaaatctctctgctgctccctcacgctcctgcctgccgctgctctttctctaacctccccacgcctctgctctgcttcctcacctccattgctgctcccttcttctcaacgtgacctgctgccgcaccttctgctccttatctccttcttcaacctgctgctgctcgccctcaaccctctctgctgcttttcttctccctcaacgcctgctgctgattcctctcaacgccccctactacttctttcttcttccacctgctgctgcttctctttagatccacaaaaactgctgctgctgctctctctctctctctctgaattttctataagctaagatgtgtaaaattttgtaatattcagatttttaagagtgttggcaacatgtagcttgttctgtttggtacttgtaatatataatgcttgtcttgaatttctgtaggctgtgagaaataattgtccttgaaatcttgctctgtgatttagtaaccttctagtatatttgtgtgataaaaaaaaaa

SEQ ID NO: 7399 - DNA, 1463 bp, Triticum aestivum
  Clone ID: PAT_TA_7399
tcggcacgaggatcctctccggcgccgccgtctcctcctccttcgcgcgggcggaccccaagcagatcggcttcttcctcctcgccgacgagtccctcctgcaggccgcctccgagtcgcggccgccggcggagaagcgcgcggagccggacgacccaaccggcgccgacgagcccgacctgtccggctgcgtcctctccagcccctacgtcaagaagctcttcaccttccacgacatggagggcgggcactacaacaagtccttcccggtcacccaccccgacgagtacagcctctacttcgccaactgcgcgccggagtcgctcgtctccatgaacgtccgcaccgagatgtacaacgccaacccggacggctccaaggactacctccccgtcggccaggcgcccgtcccggccatctacggcttcttcgccttcggctacgccgcgttcctcgccggctgggcctacctcacgctctcccgcgaccgcgtggcggccaaccaaatccaccacctcatgtccgcgctcctcgtggcgcgcctgctctactgcctctcggccgccgaggaccagcactacatccgcgtcaccggcacgccgcacggctgggacgtggccttctacctcttccagctcatcaagggcgtcatcctcttcgcggtcatcgtgctggtcggcacgggctggtccttcctgaggcccttcctgcaggaccgggagaagaaggtgctcatggtggtgatcccgctgcaggtcatggccaacatcgccgacgcggtcatcggggagaccgggccgttcatgcagagctgggtgacatggaaccagatcttgctgttcgtcgacgtcgcctgctgctgcgccgtgctcttcccggtcgtctggtccatgcggtcgctccgggagacgtccaagaccgacggcaaggcggcgcggaatctgtccaagctcactctgttccggcagttctacaccgtggtgattgggtacctgtacttcaccaggatcgtggtgtttgcgctcaggactattgccagttaccagtaccggtgggtgagcatcctggccgaggaagtggcatcaatggcgttctacatgtacatgttctacacattcaggccggccgagaggagcaagtacttctctctggacgacgacgatgaggaggccgcggagatggtgctccgggaagaggaattcgagctctgaacatttgtaattttccgcaacaatgccgtgagctgcaattgcgccttgattgctctcttggtgccctgtttatctgatctgatctcccctcttgagactttagcacactatttatacagataccaggtagcaggtatagctcatcgtcttgtatgtaccgcagggcttgtaagattatatttgttcctcttcccttgtagcgccttcttttgccggccagacgcaggatactaaacggatacgtgcaaagag

SEQ ID NO: 7400 - DNA, 842 bp, Triticum aestivum
  unsure (1)..(842): unsure at all n locations
  Clone ID: PAT_TA_7400
ccttcttgcccatgcctctgctgctgccgctcttctcctacaccttttgctgctgccatctctctctctctctctctctctctctctctctctctctctctctctaaatattctgtaatttgagaagtaagaagctttgtaatattcagattctataagtgcctgtaatctgctatatgttcagttcgtacttgtcatgtgttaattagtattctgctactgtatgtgtgagatcccttatgtgtttgttccttactgcagaaatttattcaagttgtccatgtgttagccccagtacatgtgctatataaatacacgtgtgttttgtgatgtaaaccatgtcacgctagctcactggtagtcatactcatgttactagctcccacgctgatgcttcgtctcctcaacttcccgctgctgctcctctcctccgtcttgctgctgctccttcccttgctctgcttcttctcctgctgctgctctcttcttgcccatgcctctgctgctgcttctcttctcctacacctttttgctgctgccttctctccctttctctctctgaatactctgtaatttgagaagtaagaagctttgtaatattcatattctataagtgcatgtaatctgctatatgttcagttcgtacttgtcatgtgttaattagtattctgctactgtatgtgtgagatctcttatgtgtttgttctccttactgcagaaatttattcagttgtccatgtgttagctccagtacatgtgctatataaatacatgtgtgttttgtgatgtaaaccatgttagctagttcatctctaggtagtcagttgtagnatcattaattt

SEQ ID NO: 7401 - DNA, 964 bp, Triticum aestivum
  Clone ID: PAT_TA_7401
ccacgcggccgagccagtccgctccccccccgccgcccccccctcctgcagcacgcccgaccgggcggccacgccccaccgctctggcccccccccgcgcgccccccctcccccgggcccgccccgccccgccccccgcgcccccggccgcccccgggcccgtgcccccccgcgcgccgcgccgccccccggccccgcccccggcctcgccggccgcggcgccgctccctctctgtcccgcctcctccccgctcctccaccccgcaccgtccctttccctccgccccccccccgcctccccccggcccctcgccgccccccggccggccctgggccccccccccgccccgcccccgccgtgcccctccccccccgcgcgccccccccccgccccggcccgccctccctcctcgccgccccccgccccgtcccgctgttctacatcccccccccccccccccccggccgtgcgccccgcgctcctctccgctgcgcccgcgatgtttggcgcccccttcgtgcgggggcgtcggttatcgatctattcggctcgccgtggccgctggcggcagcggccggtcaggactcctctcgatggccgccgcaggtgtctgctggtcgggccagttctcagggaacaacgcaagtgtttgaccatggttccatatcttttggaagattcgcctttgactcgcgcgctggggagttggggtctgtctttgcctttgtcgcgcgcacggaggcgttcgttgaagtctacggtttgggggctagggagctggcggcctttgaacaacacttccagcggaccgggctgctgctagcgttcggtcgccatggccgtcattctggtctgactcgagaggacagtggcgatggtagtgattctagtcagacaggagaagacgaaccagttgcaaagcatgcatctcctgctggatctggaactcatgttgatgattcc

SEQ ID NO: 7402 - DNA, 1002 bp, Triticum aestivum
  Clone ID: PAT_TA_7402
ggcatgccgaaacttcaccgcattcacgccggcggtgaacgtgctccgggagatcgaggcgttcctgaggaggaacccctccgaggtgatcacgatcttcatcgaggactacgtggaggcgcccatggggctcacccgggtgttcaacgcctccggcctgacgccgtacctgttccccgtgtggcgcatgcccaagaacggcggcgactggccgctgctcagcgacatggtccgcgacaaccaccgcctcctcgtcttcacctccaggtccgccaaggaggccgccgagggcttcgcacacgagtggggctacgtcgtcgagaaccagtatgggagcaaagggatggtgaaggggtcgtgcccgaaccgcgccgagtcggcggccatgaacgacctgtcgaggtctctggtgctggtgaactacttccgggacctccccaacttcccggaggcgtgcaaggacaactcggcgcagctgctgggcgtgctcgacacctgccacgccgcgtcgggggacagatgggccaacttcatcgccgtcgacttctacaagagaagcgacggaggcggcgccgcggaagccacggacaaggccaacggcgggctggtttgtggatgcggaagcatagctgcctgcactagtaatggtacatgctcgccgcgccggcgcgggagcacgcccaaaggcatctccaacaagacctcggacgccgcgtcgtggcagccgccggccatgttgcgatggcagcagctgatgctgccagccaccttcactgctctactattatgcttgtagaagaacattggactctgaatcagcaaaacttttgactagctggcagactgtaaatcatacgtagatccaaactagagattttatgtgccgggttctcatcgcacgctgcaagtaaactttgctgttgaatttctgctaggccaaaattcggccattgtatgacgtagcttgtacgttgtgttggtgatgaaccctttgtttggaaa

SEQ ID NO: 7403 - DNA, 512 bp, Triticum aestivum
  unsure (1)..(512): unsure at all n locations
  Clone ID: PAT_TA_7403
gaaatatcagatgacaagtctgttttgttnccaggnccctcagcactactcaaacaaagnatcctaagcgaactactgcatctagctctgcatgtttcaccgagttccaaacgttcgaggcagataatacagtatacaacaactcatgattttcccttccctcgggtttttatggaaccaagttgatgcagtcctgcagcccactcggcagcaactccgcccctatttcaaagtttttctacgacccgcgcccttctgctgccggagcattccacacctcagccctgcttgatgtgttatgtttgtcatgctgcggaagcctgtcggattcgtctttcttggagtgggtgaagttagtcatctcttcctcatccttcgaacggagttgtatatcggccggaacaaaatgctagagatgtatctttctccaaagctggggaagataaccgcaatcagctttccagcattttcaggtcttttggccacgtttatagcagcaattgccctcgtgc

SEQ ID NO: 7404 - DNA, 828 bp, Triticum aestivum
  Clone ID: PAT_TA_7404
ggcacgaggctcagtcgcacactcactcactcattcctgcaccgcaccgcacctcgccggccggccgcccggctccctccacgtccatggcagccgccagcggcgcctgcctgcctctcctcctgctcctcctgtcgccgctgaccatctcctcgtattcggcggcagcggcggaagcagagcagccggtacacgacctcctgctcagcttcaaggcctccctgcacgaccccgccggcgccctcgccacctggtcccgctccacgccctactgcaactggtcccacgtcacctgcacggacccctcctcctcgtccgcctccgcctccgtcgccgtctcgctccagctccagggcctcggcctctccggcgacatcgacgccaccgcgctctgccgcgtccaaggactgctcagacattgttagctgggtgcggaggcggatcaacctgatcgacggcgcatcgcagatactcgaccccagcatcccccgcacggagcaacagggcatgaaggctgccctggagctcgcggtgcgctgcacgtcggtgaagcctgaccagaggccggacatgtatgcagttgtgaggtcgctgcaggcgctgtagtttgtaccattcatccacggacaccaccatactctgaagttgctatgtgatctttggctggagaagcacttcagtttgtgatgttctgagttcagaccatctgttactatgtatttcgtgcctgttgtgtatatttgtgtgattgtcatgacattgacagaataaatagaaataagacgcctgtgtggaaaaaaaaaaaaaaaaaaaaaaaaaaaaaaaaaa

SEQ ID NO: 7405 - DNA, 1020 bp, Triticum aestivum
  Clone ID: PAT_TA_7405
gtgcccaaccagcaccagaaaacaaaaaggataaagatgatgagcaccatggccctcgcgctcggcgcggctgccgtcctcgccttcgccgcggcgaccgcgcaggcccagaggtgcggcgagcagggcagcaacatggagtgccccaacaacctctgctgcagccagtacgggtactgcgggatgggcggcgactactgcggcaagggctgccagaacggcgcctgctggaccagcaagcgctgcggcagccaggccggcggcgcgacgtgccccaacaaccactgctgcagccagtacgggcactgcggcttcggcgccgagtactgcggcgccggctgccagggcggcccctgccgcgccgacatcaagtgcggcagccaggccggcggcaagctgtgcccgaacaacctctgctgcagccagtggggattctgcggcctcggttccgagttctgcggcggtggctgccagagcggtgcttgcagcaccgacaagccgtgcggcaaggacgccggcggcagggtttgcactaacaactactgttgtagcaagtggggatcctgtggcatcggcccgggctattgcggtgcaggctgccagagcggcggctgcgacggtgtctttgccggcgccatcaccgccaactccactcttctcgcagaatgatgatcaaccttgctatggcagtattgcaacgacgaataatccgtggcagtttcattgccacgtacggtttcccttcacttacttttagcattagctagtacttaataattctctagcttgcaatgtgacatgcaggttactgcagcagaaacaaaatattgctgtggtacatgcatgggaatattgcagtgagaaagtactgtgtggcaatatagggtgtactattgttgccgcaaatttagttttcttgttatgacctgttgtcaggatgcatgcatcgctgttgtaatgttggagtacttcgtgatttcgttgcaatatattaccatgagcatcacatcattaacaaaa

SEQ ID NO: 7406 - DNA, 1137 bp, Triticum aestivum
  unsure (1)..(1137): unsure at all n locations
  Clone ID: PAT_TA_7406
ctggtaaaaaggaaaagtgcaatgaatctatgtctggtcagaacaattatacaactcccgagtcagaatcatcccggttccgtgattctctgacgtctgctgatgcacggggtaaaatgggtaatatgagagtagaagaaggaattaatactggatcaactcacttaacatctccagtagaactaacacatcaaataaatagtactacttcagattcctgtggcaatgagtgtactcctgaagtaatcaacaaccatttagacttgtattcctgtccagaagagtttggaaatcatgcttgttctgttgaggatgatgtcgcagctaatgaaaatttgtgctccaacgtgatatctgaccctacctccttcaaagagttctctggtgataatgaatgcttacatgtggataatgatcagctgccaaaaatttcaaatggttcacaacatgctcacaaggtggttccttatggagggtactataatgatccatacaggtggacagtagatgaaataaaggctgctactgggaaggaagaatgtacttatgtggaacataatttgaaagtaaggagtgtctacacagatgtggaggattttaacgggacaaaagatgccaataaggagcccttggtaaccagttacaacagcaaatttatggggacagtggactacatatgggcttctgaagatcttcagactgttagcgtgctagatacatttccggaagtgattttgaaggaaactaatggattccccacaaagaaatggggaagtgatcatatcgccttggtctgcgaactggcgtttaaggattgatgttcatgagactgtaagagagggatttcagtgccattgaaggcacccgcatgacaagacaactgactgcctagcacaagcctcaggcgaaataatcatacccaagaacaactgctgaacatttctccgtcaatcacgttttggtgtgtgtgtgtcatgatatatttcctgctttctccgccccacacaagggctccccagcccgctcccttgccagcaatgctttgtaattgtacatgagacataagtcaagtttctcaagtgagaagccancaatgggcaactgctgttgacttggatgggacaaaactgcaggcaa

SEQ ID NO: 7407 - DNA, 486 bp, Triticum aestivum
  unsure (1)..(486): unsure at all n locations
  Clone ID: PAT_TA_7407
gcaacagtttcttcatctgacgaagnaatttatggtggatgatatcactctgggaggaattatcaggcacacaaccagcgagcggtggcagaagcaacttctcccttgaactacatgccaggccaactttattctaagaggctccaaaatctgaagaaagatgtggctatgcaggatgccaagcatcgcaagactaaggtggctaacacaatggagctggaacatcgaccttttgtttcgtatcgcccaagccagcatgtttgcccttttgatgttcttctgaacaggaaatgtataacgtttagattcccgttgtcgtctttgtaatggaaggtagcacctggtggcatgttgctattttcactttgctttgaacaagacattgatagactttagatattgattctatctctctatcgtagaaagtaatgtatggtattgtgttttatctctattcaaatgaaagcaccgagcttaaaaaaaaaa

SEQ ID NO: 7408 - DNA, 1786 bp, Triticum aestivum
  Clone ID: PAT_TA_7408
ggggcctcgccccccgccgactcccgggaccgccggggtcgtccctcgcggcgagcccagtgcccgcccggacgcggcgcagcagcaacccagcccccctccttgtcggcctccggcagcccgggccccggtggccccccccgacttcgcacctcgcccgggctccctctcccctccgtctcaggcacgtcgaaagccggctgccagaagccgtccaccagctttttccggcctctccgtcgctcgtcgtcgcctccgccgccatgtggagaggcggcgccaccgccgcctccgccgcgagggctctccgctcgcgcatgctcggtgatcccatccaccaaccctccacggctattctccccatcccttcggcgcgcgccgcctgctcggcaccctctgccgcctcctctgcgcccatcgtcgctgaagcggcggccgcctcggtagctgtttcgtcgggggccagatccgcctccgacgtgctgcggcactacgggtcgtgctactgggagctctccaaagcccgcctcagtgcacttgttgtggcaacatcgggggctggatatgtgctcggtagtggcagcattgtagacattgctggactttgctacacatgcactggtaccatgatggttgcagcatctgccaacactctcaaccaggtgtttgaaataaagaatgatgctaaaatgaaaaggacaatgcgacggcccctaccatcagggcgtattagtcctgtgcatgctgccatgtgggctacaactgttggaactgcaggaacagcattattggcttgcaaggctaatgacttagctgctgggcttgcagcatccaatctcattctgtatgcatttgtatacactccactgaagcaaatacaccctgtcaatacatgggtgggagcggttgttggcgccattccgccacttctagggtgggcggcagcagcatctgaactgtcactcaactctatgattctgccggctgctttgtacttttggcagttaccacatttcatggcccttgcgtacttatgccgcgctgactaccttgctggagggtaccgtatgctctcttttgctgatcctactggcaagagaactgcatgggtttcactcagaaattgtctctacatgctgccgttggggttatttgcatataactgggggctaacatccgaatggttcagttttgaagcatcgcttctaacgacgggcctcgccattggagccttatcatttgtactggctcctagtcagaagagtgcaagaagaatgttccatgctagcctcttgtatcttcctgctttgatggctggacttatattgcatcggctgcccaacgaacagaaggagcataacaacattcatcagactagtgagatcgctggggttctccgcgggcgccgagctgtgggacgaagaagaaagagctagacagaaacaggaagacctgaaacattctcgtcgtgctcaatcacgccctccagttgcctatgcttctgtagccccattccccttcttgcctgtgcctgtgtacgtctctccagaagctcatgagttttgaaagccttgtcccagcagccagggctgcaatggtttcatcttccttcctttttgtctgttgtcagaaaattcttttccgctcttggcaggaaattttcccgctcagcggaattcctctttgtattgttaaataaagatctgagaataatgaacgccattttatttgtaaaaaaaacataaattcagttgttgggctcaagtgagtataaaatcgatgtttc

SEQ ID NO: 7409 - DNA, 1280 bp, Triticum aestivum
  Clone ID: PAT_TA_7409
cgccggcccgccgggaggcgccggcgctggggtccacgaggaggtcaagcgacggcgttcgcgacggcgacgtggtgaggcgcagaagacggtggccacgacggggtttagacgcgccgacgacggcgactcgttcctggccacgacggtgacggcgactcgttcctggccacgacggtgacggcgactcgctcctggccgcgacggcgacgctggccggcagtcgtgacctgaccgtgacggcgaaccgctcatcctcctccgctccgccaagaactgttaagagtgatttggaggattcaagattctgtgaagctcttttgacatttaaagctcagaactgaagttacattgtcataggttcaatatgacgcaaaatagggctaagtggacagcaaggtatgagaaaggtctcgtggaggtacttacagagtacaatctatctcattaccgtggtcaaaatgggtggactaccgaaggatggaatcaagttgtcaaggaactgaacaatttatatccagaggcaaggtttaccaaggatcaggttcaagataaggaagctcagttgaaaaagcactacaaaaatatcaagttgatagtcaaccgctctggaatatcatggaatgatattgcatgtgtgatcaacaccacgcctgaaaaatgggaagagatcattgcagaggaccaaagcttaaaatgtatgaaggaaagagtttcatagcaagcattgggtgtctctatgaaaacaaccctcaattacagaatgcttgcaggtcttgaatgacatggatgatgttcccgacgaggtcaaaatctttgcctctgatgttttcaaggatgcagcaaatcgtgagattttcctgggttacaactcaagattgcggggtatgtggctaaagaaggaagtcgacaagattagtcctcagcctcctccttctcggttttcatctggcgatattccttcaatcaatctggtgctctgatcaaaggatgtcctttcacatgattctatgattacccgagtccatgaagcaatcaataatattcctgaaatactttatgtctaagcgcacaatggttgaacaattgcctcaataaatttggttatgtagcatgcggacgagacgagacaagtatgcctcgataaatttgtaatttaaactactgactttgagcactatgagttatcggaactatgttcaaatggatgattgcaaaaatattatccttttttgatgtggttgtactgttatataaataaaaaatttagctcattttat

SEQ ID NO: 7410 - DNA, 1173 bp, Triticum aestivum
  Clone ID: PAT_TA_7410
catgtccccccgggctccggaggctgtccccctgcaggcagcctgccggatcggcgccgtcggccgaggcggaggccgaggcgctcctgccgcggccggagccgccgctgtccgccgtggaccacttcggccggcccgcctcccgcggcagctccggcgggtggcctgccgcgctcttcatcatcggggtggaggtcgcggagcggttcgccttctgcggcatcatgggcaacctgatgatctacctcaccggcccgctcggccagtccacggcggccgccgcgtcggccgtcaacgcgtggctcgccgccgccatgctgctgccgctgctcggctccgccgtcgccgactcctggcttggccgctaccgcaccgtcatctgcgcgtccctcctctacatcctggggctagccatgctcaccctgtcaacggtgctcgcgccgggagagcgaccagggtgcgccggcaagccggccgattcagccgggtgctccacgagctcgtcgctcgcgcaggtggcgctcttcttcttctccctctacctggtggcgtttgcccagggcggccacaagccctgcgtccaggcgttcggcgccgaccagttcgacgagaacgaccccggcgagctggcctccaggagctccttcttcaactggtggtacttcgcctcctacggcggcttcgccttcaccgtctccgcccgcgtctacgtgccggagagcgtgggcgggcagctccgctgcgcctccccccgcaccgccatggccctcgctctcgccgtcttctgcctcggaaccaagacctaccgcttccatccgttaccaagtgctaacaaattgcccgatgattctgagaatttgctggagccgccgaggggggatcatggagccaccggattgctgaagctgttccccatatgggcatcctgcctgatctacgccgttgtcctctcgcagtggttcactttcttcaccaagcaggcaaggcgccgggctcagccggatgctcgacgagctcatcgtccgcgcaggtggcgctcttcttcttctccaacaacctgaaccaagggcacctcgattatttttactggtttctcaccgtgctcagtgctctaggcatgtttgcttacatgtactttgcgcgggtgtatgtgcctaagaagaagggtgtttg

SEQ ID NO: 7411 - DNA, 840 bp, Triticum aestivum
  unsure (1)..(840): unsure at all n locations
  Clone ID: PAT_TA_7411
ggcggctcataaagtttttgcacagnatgcaagctcaggcacaacgaaataataaccagggaaatgcaaatcaacatccttcgtcatctctagcatctacagctgcgagtggatcggcaaaattgcctgatcagctagttcgcatgcccaccccacctaaccagggccacaaaagccagggatcatcttcacctcagaactttgtgccactttcaggcacacaaatgcaaagcagcatgcattactttgctcatgataattctatccaaaagccagatgtaaagggggtgcatgctgtgccgaatcgaccacctggtatgagcttgccaattccactacagacaagtaacaaacagctgcaacccacggaaatccagcaagcctcacagcaattatatggaactactaacacccctcagtcgtaccctcggccaaccagtggttcgatgcctcttagaccacagagtcaagcgcctgaaacacgacctccctttcatcctcatggaaggattcctgcgaaaatcggaaccgttcctactcatccgacaatgcaacagaatgcatcggcacgcccaatgcaacaaaacaaggatataaaaaataatgcttataacccaagtgctaatacaaaacaaggttctgagcctgcaggcaaggcccgccaggttggcccaggaggtccttcggcgaaatcgcaaggaaagcaggcggcccctaaaacatctacaccacctgctgcaaggactaagaaatcggggcgcagaatcatgggaacggtggtaanacacacaacanaaaggaaaagaagtgggcctcaganaagacgttaantannttaac

SEQ ID NO: 7412 - DNA, 611 bp, Triticum aestivum
  unsure (1)..(611): unsure at all n locations
  Clone ID: PAT_TA_7412
gcacgaggcggcacgtcggatccgctttggcctccatcgaatcaaattcccaaatccctccgccgcacgccatggcttcttttccgctgctctttttaccgccgccggttgtcggccacgaatcgggcttgttcaaccctcgcgttgtcgtgggcggagaagctctgtccaccgcggcggccgcctacaccaccacaagcaacgactgccgagtccgcgtctccgtgcggctcgaactcccccccgcggagtcctacctgcacatgcaaaccgacgacacgctcctcaaagatcccttggtgctggctgcctgcggcgacctcctcctcgtccacatggtcgtccacgacgctgccgatgatctgtcgtgcaagcagaacctcttcgtatacaaggcccaccccactcgcccgtcgctcagtcgtctccccaatcccgacaccttcaccggctgggcccaatcttgtggcatcgtcccctgtgacgacgggggntttcgttgtggcttcttttcggacaatcaagactgacttagatctgcaaacaggattggcgatggagcgtgtcgagttcttgcactattctcctgccaccggacactgggatttgnn

SEQ ID NO: 7413 - DNA, 608 bp, Triticum aestivum
  Clone ID: PAT_TA_7413
caaatcggtggcggcgggaggcgtgtgggtgttccggaaggacggggtgatggagctcaagagcgcggggttggagccgtcggcggcggcgccgagcaagaaggcgctggtgtacgtgccggcgaacgagacggtgcggtcgctggaggcgctggagcggcggctagggtcgctgggctgggagcgctactacgagaaccgagacatcgtgcagctccaccgccgcgacggcggcgtcgacctcatcgcgctcccgcgagactttgcgaggttccgctccacccatatgtacgatgtggtcgtcaagaaccggcaccacttcaaggtcgtcgacatctgaacattcatgcaagcttgcaagtctgttttgcaaataagcgcacgtgcatgcataatggtgtgcatgttatatgtgagtgattgatgtactgtcagattttgccttgtactgtatgatatgtctctgtaagtctctgaatttctcctagttagctagtgtgagctcttagtatttgattgagtctcggttgtgttcgtcacttttgttggcatggtcgtacatgtttgttaactaaaaagctggcaggttcgaattttcaaaaaaaaaa

SEQ ID NO: 7414 - DNA, 871 bp, Triticum aestivum
  Clone ID: PAT_TA_7414
cgcggcccgcgggcccaccccaatccactaacctagcgatgcctcccaagcgcaagtccccggttgcgacggcggcggcccccgcaatgccgcctaggatgacccggagcatggccgccgggaagcggggcgccgacgctccggctaaaaaggaggaagcagaggcggcgccggcggcggccggggggaagggcaggaagaaggccaagaaggaggtgtctgcggtggagacggtactgtcgcctcctgcagcggccaagcagaaggtgaagaaaaatgccaagaaggaggtggtggcggccgcggtagatgatggcggtgctggcgctgaaagcgggaagcgcgtcatcgtcgaggcctgcacccagtgccaacagttcaagagaagagctttaaaggtgaaggaggatcttgaaagtgctgtccctggggtttctgtgacaatcaaccctgagaagccacgccgtggatgccttgagatacgggaggaaggtggtgatgtgttcatttcactgcagaacatgccccggcccttcaaaaagatgagggagctcgacatggacaaggttatcaaggacattgcccagaaaattgcttgaatctgacgtggcattaatgtatggatgcgctccttttgcaattgatgtttagggcttattttgtgtgggaacttggtattgcagtggccgtagaatgtgggatcagtgtttcgttatggtgccctatgtgggctaagaccatggctgcaattatcgcattaccaaccgggattaccctcgcctcccgtgcttcctgtcctgaagccttggttggtcttaatatttgagtacctatatgttctacgtttccagccgatgctgtaacctttcta

SEQ ID NO: 7415 - DNA, 554 bp, Triticum aestivum
  Clone ID: PAT_TA_7415
ccgcaattcaggttacaacttctatgaccttatttaataatacccaataacaatcgcagcaaaccgtctcaagggtaacaaatatccagatcacgatcctatgttctgtagctatcatttgtttcatgtcgagcagagagaaaaataggcgaagaggcgcacggtatgcagctagaggagaatcactccggcaatttgctgcctagcctgctgacaaactggcaaagcacgtccctctgcgcgaccgcaccgtcgtcggccacattgctgaactgctgatagtaaccgtcatcatggtcgtgcgacgccggtgcccgttctctgtgtgtgtcgccgaggtcgatcatgatgttggtgagcaggcagcaggcgtagatgatcctcggtagccggtgcttgtcgggcctccacagctcccccttgagtacctgccacctttccttcagcctggccatagcaccctgcaccaccattctcgccgcggcgtgctgcttgtcgcgtgccgctttcgctggagacagatcgcgctcttggtatggagtcatcagccaggg

SEQ ID NO: 7416 - DNA, 820 bp, Triticum aestivum
  unsure (1)..(820): unsure at all n locations
  Clone ID: PAT_TA_7416
gccggccgcaagagctcatctaaatagcagcttatgccatgcctgttctcacaacttctgttcttttatggcgagtcctagctacatccacctcgcgctttttgcttcttccctgatactatttgaccctaaggcttggttgtagatcaaataccccagcgtgcaccccaacaactggccaatactgcacatgttcccttccttcgtggccaacctccacaacttgcaggactatttcacccttgtcctcgctggatcaggtcacaacttcagggcgcacggccctcccggaaccgggatgcagttcttcgtcacatgcgaccctgccaacatccggcacatcttcacgaccaactacaccaactttcccaagggggccgggttcgccgcgatcttcgacatcatgggtggcagcatcttcaccatcgacggtgggccagcccgttgacagcgtgcgaaaatcaagggcgtactccgccgccagcgggtgcttgcaaggatggaggcttgctgccgcgacaaggtagaaaacatccccctccctttgtttgcccacatggcgagcaccgacactccagtcaacatgcaagaactcatgtcagagtttatgtttgacatggctgctactcctctcttcgatgtggaccctggtctcctatcttgngacatgccgcccatggacgctgccgttgccatggacacgntcatggaggtggccttattccgagtcatgatgccagcttcttgnntgnagttgatcaggtggctaaacatggacccctgagagaaagctcaggcagcacacacggtgctatgtgcc

SEQ ID NO: 7417 - DNA, 659 bp, Triticum aestivum
  Clone ID: PAT_TA_7417
tttcttgtttggctttttctacttttccttgtggcaacgcacacttgaccaataactaaataccgtattgccaattgccaatcaccagcggtgaaccgatcgatcgatcccaaaacaaatccccaactataggatattcacacacgctcacgcacacacagagctcccaatgatccacggtcaaatcaaatgtaatcacaagtctcctgcgcgaacccgatctgggaccccgcggtgtcgaaaatcacccgcaggttcttctgctggtagttgccgatgatcggggtgtcgtcctcggacctgagggcggccagggccaggcacacctgggaggcgtcgccggcgaccacgtagagcacgcccttggagtccacctccacctccgcgccgccgtcgaacgccagcttcaggctcggcacctgcacctccctcagccccgtcaggtcgaagcaggtgtccaggatggagaagggcggcgcctgcgggtactccgccagctgcctcacgaactcggcccgcaccgccgcgtacaccgacggcaccaggctcgtgatgatcgtgccggagtcgacaatggccctgccgccgccggacgagaagcccggggactgcacgtcctcgccgccgacgctgatcccggtcaggctgaccctcgtgcc

SEQ ID NO: 7418 - DNA, 951 bp, Triticum aestivum
  unsure (1)..(951): unsure at all n locations
  Clone ID: PAT_TA_7418
ggttcctagcaaaaggaacatgcacaaaatggctgggggatttgatcggttgaggtgcaaaaatggcacttcaaatgcacaaacaagttatattgttgaccaatggacctagacacgctaaaaacctacagtcagtcaatcagctagttgtaagaagagcacgctgccaggatgcaacatcatacttctggcctgaacactgtgtttatgaactccttcaggttgttgcagggcaagatctggatatcgagatcgagaggtttgagcagcttctctgaagtcttggggacgacgcatttcctgtagcccaacttcgcgatagccatcacccgcttatccattcttggcacagttctaagttcaccaccaaggccaatctctccaataaatgcaatatcatttgggataggaaactccaagaaactgctgcaaatcgaagctgctatggccagatctcctgcagtctccgacagctcgaacccactgaccacattcagataaataacattatcctgaagttttagacctgcctgcttcataagaactgatattatcatctcaaccctttttgactttgtgccaacgacttttccttgaccaagagaaccaggaacagacagtgcctgaacttcaatagcgaaggttctggatccatccaaaacaacagctacagcaagcccagccagtatctcagaatcagagtcatgctcagttaagaacatctcactgggattcagaacagcttgcagaccgtgttctgacatttcaaatacaccaagctcgtctgttgaaccgaaacgattcttcgctgaccgtaacagtcgatgagataagcatctctctccctccatatacaaaacaacatctactatgtgctctagaacacgagggccagcaatatcaccagtttttgngacgtgtccaatcaggaaaacagggatatttgtcatt

SEQ ID NO: 7419 - DNA, 800 bp, Triticum aestivum
  Clone ID: PAT_TA_7419
tctttctttatttgattcggtgctcatgttacagcatttcaaatgtactctcgatcaaaaaggtagatacaatgtcagataggttgaagagtgcaggatgctatgctatccaaaacccatgtatgaggaataaccctgcagccaaatgttgttgccaggtctagagcctcagctccctcttactgaaaacctcatcaacagcatcttcgttacatccattcagaacttccttgttgtaaacaatcagggatgtgctagagagatcagccttgcccaaaattgatccccctgccgcggcaatcaattcatcaagctcaaccttgaatgtcagaggatggccaatgaagtagaaggtcaaccctgaaaacagacttggtgccttttgcattgctcgtagtcttcctatacgggggccatcaatggcgccatggacatcagagcaaatctcatagggctcttctgggactggttttttagcctccaggcaagcactcagccaattcacattgacaacccatttcccagcaagtatggccaggagaacctttcgtgtcctgccacatgctccatgttcgttggtattggcaagcacatgagttacgtttgaactccagttattggttgttgtgacgcctgagtggtactcaaactgatccaagatttccttgtcttgatcagagagggcagatccacatatcacccattcacttgtcggacaaagtgaggtccaaagttcattcatctccatcgggaatggtgagttcgaatcaccaagcactgtttcagaagatggttgttgc

SEQ ID NO: 7420 - DNA, 599 bp, Triticum aestivum
  Clone ID: PAT_TA_7420
gagcaagaagttatactcagcgagggggacgagcaaaaaccgaaagaaattgatctacttccagcctctgagaggcaaaagaggattgccgaattgcaggctaagctattccaggcagctgctgttggtgccgttagggttaaaaggaggaaaggtccacgactaggagaggatttcacgtgtgctgcaggcaatgatcaaggcagatttttggcttctatttttctcccttctgttggggtcaggatcaggtcttactgtgattgataatcttgggcaaatgagtcagtcattgggttttgaggattctcacatttttgtgtcaatgattagcatttggaacttccttggacgtatttctgggggcttcttttcagagattattgtcaaggattacgcgtatccaagggcaattgccttggcgacagctcaagtattcatggcaattggacacttcatcttcgcaatgggttggctcggcaaaatgtacattggcacattgcttatcgggctcgggtactgcacccactgggcgatcgtgccagctgctgcctctgaactgtttggcgtgaagaatttcggagcagtgtacaacttcc

SEQ ID NO: 7421 - DNA, 1096 bp, Triticum aestivum
  Clone ID: PAT_TA_7421
gatgggcaacaaacattcaatgtcacagagggctgaccacacagcaaaatgcagcttctcccaggtcactgcaaggaaccactggatcacatgctaacagttctatttctagtttgaagaagacttacaaagggttggctttccagttatcaacgctacacaaatcaactaaggaatctccgttcggtacaaaatccactaatgtacggcaaaagtaacaagcaaaactaagattgtacaagcaatggcactgcctaactgatcattagctgaatcaatagtcccgtcttcgatgcatttcacgttaagactttctgcggctcgagggagatgaaggtgcacatttgcgcagcaaggcgccactggaaagcaagtggcgcattggcaaactggcaatgctagtcatggcaaaagtgcgcagatgcagaatctgaagtgttttaactctggtcccacgctgaactgctgctcttagcacttaaatgttgattggccagaggctgagggctctctctagttgtcactggataccacctgttgccgggatgacaggttggcgaaccaaaccaagaggcatgttcacactgttgggattctctgctgctccgctgccatcacagttgggttccaataaccgtacaagcgacagaaagatctccattctggttacgtccctgtttgcctcaacggtaaagcgtgcccagattttacttttacgtgcttccattacacccctcaggatggtcaacccaagtcctttgatgaaatcagctatctccaagaagatgcctctatcctcacaaatcatctccacaagcatctgacgtggtctgtcaagatcctcaacgatgattggacatgtcatagactgagagccaacatcaaaggcccaggttgcaccaccttcaaagtagtctttccacacaggaccgttctcactgccaagtatcttagattcagtagaatccttgagtttgtctgcatgctttgtaacgctttgcaataagagcatgtgcttaactgtcttctccaacaaagcatcaatgctgcacttagctccattagccaccatttctcggagctcccggacgcgtgg

SEQ ID NO: 7422 - DNA, 1430 bp, Triticum aestivum
  Clone ID: PAT_TA_7422
gctggccgagctgctcgtcatcgcggtcgtccacctgacctacgggttctacctcttcaccatcgccgtctgccgcgacctctcccggctggccggcgcgccgaaggacgccgtcgtgggcgacggccaagcggaggctgtgctcgacggcgcggtgccgccgatcgtgctggtccacggcgtcttggggttcggcaagggcaggatggccggggatgtcctacttcgccggcgcggcgcggggggacgaccgggtgctagtgcccgacctgggctcgctcaccagcgtgcacgacagggccccggccctggccttcgccctgtgacctggccggctggtctccgccggggcgcacggccggtcgcaccgccaccccccctgcggccgcgcttgccgccgcgggccctgccccgggcgcggcgcggcgcccccagcccacttcgtgggccactcggccggcgcgcaggtcatcaggctcctgcaacagatgctccatgacaaggcattcgacgggtacgagaacagtgcggcgtattgggtggtgagcgtcacctccctctctggcgtgctcaatggttccacgacagcctacctcggcggaatacgtccacaagatggccggtctataaggttcgtctgcctcgcccagatctaccgagtgggtaccaccatctaccactggctcgacataccctggctcaggcgctactacgacttcggcttcgaccactttggcatgtcttggcgcacagtcggtgtgtcaggcctacccagcctactcgctggcacctcgggaccgttcgccacaggagactggattctaccggacctcaccatccagaatgccgcgaggatgaacgccgatgtgcgcaccttccctgacacgttctacttcaagctacgctaccaggcggacgaccaagttttgtggcatcaccgtgccgtccggtgttatgcacattcaccctcttgtgttcatacacgtcatgcagttgtgtcggtggcgccacttcgccgccgagcccccttgcaaaggttacagggatgaagattgggaggataatgatggtgcattgaatactatctccatgacacatcctcggattccagtagaacacccgagcatcttcgtagaggatgattcggattgccatcaacttcaaccaggaatctggtattacaagatcgtggaggcagatcacatgacgtttgtgatgaaccgccctaaaggaagcgtgcaattcgatctcatatacgacaacatctttaggaactgcaggaaaaatgtgtttaggacggccccacttacgctaccaaatcaaaactcgacctaggttaacatctttgcttatcgtacttacacaatacatgatactgggtgtacaatttctacaacttggtagaacttgaggctctcctcgaaactgtg

SEQ ID NO: 7423 - DNA, 3113 bp, Triticum aestivum
  unsure (1)..(3113): unsure at all n locations
  Clone ID: PAT_TA_7423
tcagctttctaccaagaatcggaatccagaagcagttctcggttaatccgatgaccctagttattccaatactttcggacaaacgtgttcccgtttcaacactgcccctgcaacgaacggcacttccccttacgacagcttctcagcatctcccccagcccagaaccatttattccttaatcgtgggcaaacgcggaaacatttacttcgaaagggaaagtggttggacgaagtattgttgacgagatttatgtttttctgaatacccttcgaatttttcccatttgtatttactaacctttgaatccaagcggccgcccgggcaggtaatggataggatagggtatttctatatgtgataagataatccaaatgcaaaaatttgtctgcaaaaaattttaaatacaaaccctaggaaagaaagggagtctaatccacagatctttttctggctccttttctacccaattagtttatgtttgttctaattcaaaaaaaacgaacagaacaagttttttatttttgcaggccaatcgctcttttgactttggaatacaaacctctttatcaatatactgcttcttttacacattcaatccataacatcccttattcaatccataaacaagaataagttacggatttctaaaaaaaactaaaatttcttgttattacaactaacaagctatttccacaggttcagaaccatttaatccataatcgtgggcaaatgcataaatatattcctgaaagagaagtgggtagacgaagtattgttgacgagatttatgtttttctgaatacccttcgaatttttccatttgtatttctacttgaatcagagagaagaagcatttctcggtttatcgaatgatgatacatagtgcaatatggtcagaacagggtgttgcatttttaatacaaaccctggaaagaaagggagtctaatccacagatctttttctgctccttttctacccaattagtttatgtttgttctaattcaaaaaaaaagaacagaacaagttttttatttttgcaggccaatcgctcttttgactttggaatacagcctctttatcaatatactgcttcttttacacattcaatccataacatcccttattcaatccataatcaagaataattaggatttctaaaaaaaaaagaaaaaataaaggggccactcataggaaaacccaacctttccccgcatccggcgactaatctaattttaacgctcaaattaagagccggccccgcctggagttgcgacgttttttttttttttttttattttaccaagaattggagccaggctctatccatttattcactagacccagaaaatcgtaattttggattccattcaaaaaagattgattttattacgacatgctattttttccattcattacctttgaggatcagtcgtggtcttctagactctaccaagagtctggacgaatttgttgtttcatccaaatgtgtaaaagacctcggccgcgaccacgctaagcgcaatcccccgccgagttcgcaacccagataaaaaaaggatcttagatacgatcgaaatccaaaaatcaatggaattacaccgcgcgcttctgtcaaaacattgaactagtaagacatcaaaagattttttttatcgaccatgaaaaacactcaaatgccaaaacgaacaggtccggttaaattccactaaagtaaagttaaaaaacgagcgaccctaatcacgatggccaaattctccttatttttaagcgatttttattaaaaatttatattgtgttgagcgtggtcgcggccgaggtgaacacccttatcatttgagcgaagtgtagggagaaaaatggaatatggagtgaggataaagagacccatctatctacaaattctatttgttcaatagacctttgtcaatggaaatacaatggtaagaaaacaaattagatagaaaaagtaaataaaataggggcttatgttggattagcacgatataatataaatccaaataggattaagaaagaggtaaattgtgtctaaataattatacaactaggaatactaataatcttctcctatcctactttttgattcatttagttcttcaattaactcaaagtgctttctttttctttaaagaattccgccttccttaaaatatcataaacagttcttgtcggttgagcacccttttcaagggaaatagagaatagctggaacatttaaacaagtttgattctttatcggatcataaaaacctactttttgaagatctcttccttctcttcgagatcgaacatcaattgcaacgattcgatagacagcttattgggatagatgtagataaacaacgccccccccctagaaacgtataggaggttttctcctcatacggctcgagaaaatgattcgaatttctgtcgataataatagaaattagactatgacgtgcattaatttccttacagaaaaaacaaatttcatttatactcatgactcaagtgggctaattttgcctgacaaacttcgaaggcaaaatccttccaaaatttttgagtcgtctttaaactcttttctttgtctcatttcgaacgaattgacttttattccttattctgatccaactctgttgttgagacaattgaaaattgtgtttactagttctctctctctttatctttgatttgtgaaatccttgggtttagacattacttcgggaattcctatttttttctttcaaaagagtagcaacatacccttttttcttatttccttcgataaagcatttatctcttccatagaaatccaataagagggattgattcctgatatacttttattgggactttcctcctatttgaacctttccgatttatttccatattaaaggatagactgacaaagttgggctaatttattatgttccactaaccctagattctttcccttgataaaaaaatctccctccccagggggggcccgtaccaatcgcctataggatcntatangcncgccacnggcgtcgttacaacgtcggacgggaaaaccngcgtaccactatcgctgaganaccccttccacngggtatacaaagccgacgt

SEQ ID NO: 7424 - DNA, 1033 bp, Triticum aestivum
  Clone ID: PAT_TA_7424
tttttttttttttttttttattcaaccataacatcataccttattattgatattacatgatacagataaagtacaaggaaagctctatccacttttgcctatagttagaagagcctcaagaacctagtactggaaaataaagatgatatcgccataccatggtcaccaagtgcagttgattaagatgccaaagtacagccactgtgacgataaacaagatggaactcttgaggttaattaaaggtaagctcagatcttaccattgagcttcttctggagaacatccatgacagacccaaagtcaggcttcacactgatcggtggattggcatactggcacaacatgtccttgatgttcttatcatggtagtcgatctttgattgtgtgaactttagcccgtgtgctgtactaacaaccaccgtgcggtcgttagtgccaattataccctggtcacggagcttgaacagagcagcaagtgcaaccccagtatgtgggcaagcaaacatcccagtgaggtcagcaagcgccgtggcatccatgagttcctcctctgtagcttcctcgacaatgccatcagttgccttcagcgcaacaaccgcacggtcaatagatactggatcaccgatctgtatggcagatgcaaatgtagttccagcaacaagtgactggaaatcagtccacccagacttgtagtaccggtacagtggatttgcgttggcggcctgtgcacatacaagacgtggaacgcgatcaactagcccaaggacacggcacatctcaaatcccttgtagaaagcataaatgttccccagattgcctcctgggatgatgacccagtccggcacctgccaattgaactgttgcaatatctcgatggctgcagtcttctgcccctccagccgaagcgagttgagtgagtttgcgaggtatatgggcagctcagctgtcacctccctgataagccgcatgcatccgtcgaaatccgtgtcaagcgagagcaccgtggcgccgttggcgatgggctggatgagc

SEQ ID NO: 7425 - DNA, 634 bp, Triticum aestivum
  Clone ID: PAT_TA_7425
agatagatatttggtatccacatacagactcatgactgacgaaccataacaaactacagaccttgtagcaggacagagccagactaactagtaaaacaagataaagcggatacagaggagtactgcataacactatgcaaaacagacaaaagagcgacatggctgcgggcgaccctacccgacgacccaggagagaggcaccaggcctaaccattgaaggagctgaagacacatgcagaagagccagaagcgtcaccacggaggtggaggtgtcgcccaacgagacagaaacgacttgggtattggcttgttctaggatggcgctggcgttgagctcgcaacactgagcaatcctcttcagtttgcccctagtcagaggcgacggcgtgttcagcagtggtaactcgaggaggccggccacggcggtggtcttggtcttcttcttgcggcgacgggaaagggaagcagatcggcacgacggctccgaactggagtcagatccaatagccaccgccttccgcttagccgcgcgctcaacagagcccatgcgcatgccgtcataggcgtgactgatgcgcgggctgcaccgaggggaagcagtcagcaccagcagtggcgcctcctcctctgccgt

SEQ ID NO: 7426 - DNA, 585 bp, Triticum aestivum
  unsure (1)..(585): unsure at all n locations
  Clone ID: PAT_TA_7426
ggnctgcaggnaattcggcacgaggaggtggagagctgactcatgatgaaactactatcattgcaggagcattggagatgactcaaaagactgcaaaagatgccatgactcccatatctgaaaccttctcacttgacataaatgccaagctggatgtgcatacggtgggtatgataatgaccaaagggcacagccgtattcctatatactctggaagaccaagcaatattatcggtcttatattggtgagtaagctgagattttcaagaattaattgcattgattgagatcatatctcattagttaggttcattctgctagatatgtttttacgggctccatgttatgaactcttagtggcgaatatttttggagttgcagtttccagagcggtgtcttaacaacattttgtaccattcctcgcaacaaaaattactgttaacacttaagatgattgcgcaagtaggcatctttatttggtttaatacatcagtctttcgatcaaagaactgttgggaaaactgaaattcgccactataaatccatcagtgcttttcgagttgtccttttcagaagaaaaagaaa

SEQ ID NO: 7427 - DNA, 941 bp, Triticum aestivum
  unsure (1)..(941): unsure at all n locations
  Clone ID: PAT_TA_7427
ggtttccttctggttttgggcaccagttaattctgctcgagctccatcatgcttctgtttcattaattttttctccccagatgcaacatctagccttcctttatgctcaataatttgattttcccatggttcaagctcagtccttacttgggcaagttcagcacgtagcttttcagtttcttctcgagagctttctttaattcgctccagcactttctcttcttggtttaatcgttcttgcaattttggtatctcttcttcaagctgtggaatgagattggctgattcttcaatctcttttgctgatccttcaatttttgaggtatccttttcagctttgtcctccagcttcttgatcttctgcttgagatgttttaaatcttccctgtgttttacatcttttctctcaaattccttaaattgatccttgcagactttcatgttattctcaagttcctcttgccttttgacacgtttgttgtaagctttctccatttccttcagctcctgagagttctgtttaattttttccctctcggaggcaaggttcttcgctaggtccgcaacattctcttcgagctgagtaacatgtgatgtagcatcatcagaggccattgtggttgccttttcttgccatttcaaaagcaaaagttccttcagcatgtatgcttcagcttcattttttgcattctctaaactgtccctttccttctcagccaatttcagcatctgcactgacgcggttctcttttcattgagcacttccaactgtttgttagcttcttcgattttctcaacatattggtttgtcccaatgatgtcttctagatattctagaaaaccctcgtcatgtggactttgagctttgggtttcancagggagatctgctcaacctcacccgaaggatcagaaagccctcgtgccgaattncctgcagncc

SEQ ID NO: 7428 - DNA, 778 bp, Triticum aestivum
  Clone ID: PAT_TA_7428
gaccattgcatattgcattgcattgaatccaccaaaaaatgcaccaaacaagcgtttcaggcgaaaaacctaacacggatgcataaggcccacaatgttaacaggtgagtgcttactaaataagacggctatgtttcgtttttcgcataagggaatacagtccggtccgacgccgatgtctcctcaactccctagactggaaggagggagccttgcttcacccataacttctatgctgtcccttttcttatcaaacgaccagactgattgggcatttggattcgttggaaataaaccagcatgccctccagttggcggcgaacggattggactagctccctggggtccattcggcaccagctgctccttggaccaagaatgacaaggatcaggtggtccaaaggggtgcgcacgggctgttttgtttggagatccaaaacccaagtcgttgtgtatagcattttctgacatgtcgtgtgaaaggaacagactatctgtatcaagaggcaactgctggaagggtgatttctgccgccataaatcgttgtcattcagaccagcactgaggggggcttcttgttccaccattcaaatgattgatgccatggttgaattgatttgtgtttggtagaagccattgtccctgaggacctcgcaggcctaaactgtcctgtaccagcggcgtgctccacatttgccatgtgccttgctcattgttagcctcagctgacattgaaccattatgcccttttgcagttgagaaatgtgagggtctaat

SEQ ID NO: 7429 - DNA, 924 bp, Triticum aestivum
  unsure (1)..(924): unsure at all n locations
  Clone ID: PAT_TA_7429
ttttttttttttcaggccaaccaagtgtatagtacttataagcttgataattagtaacaaagatacccagtatcaacaatttttttttactaacagctccagcggggtaaaacccttgggaggaagcacccagtacaaaccaacccaaaacttgacaacgggaaatatacttcgtacggactagcggagtccgctcggcgcactcaagaccgcaccaaaccttcttgagatctccaaccagaaacaagcaggaccaaccaacctttcaccattggcaggcttgcctctggatcttggagttcatggtgcccttgcccttatccttgtaagcgttcctcgagttgaggggccttctgcccccgcgcccggcggcctccgcccttttcctttgcttgttcagctgctttgtcagcaatgcgtccccttcatcctccgtatcctcagacgagtcattgtcgtcgtcgcctcctgattcggctcccttagggtcctcgatgccatcgtcggctggatctgtcgatttgttcttcgccactgggacttgtgcttgttgcatgctctttagataaagtttcatgtttatcttgaatccatcacaacaagatcaggcacacctgcagggtcctggtctactattttcaaggaactgatttcagcagacacggcatcgccaccttcactttcctgttctgatgttgaatcctcatcatctgagccggaatngtgtccttcagcattctcatcaatgaacttttctatctcaacttgctcttttttggtgaanccactggcanttaattctttgnccaaggcnccagaagacttttgaatggacagaaaggacgncctgccactgtcatcatcatcagtttcagagccactcgtgcngaattcggcangagctcgtgcngaattcggcacgag

SEQ ID NO: 7430 - DNA, 1903 bp, Triticum aestivum
  Clone ID: PAT_TA_7430
tggttaaaaaggtggattcttccggcaaacattggttccgggattttttcaccaaaagtttttacgcttgcccaatttgcccactcccacttcaagcggggcatgatttttggcaaagggccttctcctcccttccccaatggcaggcgccagcctcaggcagatctgaccgacgcgcggggccttgatccggcgccaggcgggcgggaatcgcgcgggtgccccgttcaattcggcgcggactccagctgggaggtcggagtagcggagatccggtcgccggacttacctccaatccgctggtcgccgtcgtctccgggtgacaattctgggcaatacagcacttaatggaatagagtttggattacatcaaagctacttcaacaagccaaggcaaacttatatccaagtgcctgtatcagcttacacagttctcaaccatgataatagatgtctgacttggcgacctaacataacagacgccatccaagcaacagggtgcctccttcataaatacataatacatgacatatagatagataaaacagagcagggcataatcacttctcctctaaccgtcgattgctttcaggatgacagccgcggtgggaataggcagaagcagcttgaaagaccaactcagatacttgttgctcttctcaagaaacccaatgcgcgatctcataaattcctggtgtttcttcactcgatcaagtgtagctagattctcttggtacagccttttcacatcttcctgatcttcctccaaggagctgaagagcctggagcggaggggccgcgtgccggccgaaggcgagacgcggggacggaggacggcggcggccggggaccgcatcctcgtggccaagttgcgcagcgccatggacatctggaccagatctagggttctctcctctttatttatatttttggacctgttcctctcctctctctcccgcgctcccctcgtgccgagtgtaattgaggctgctgcgcccagtttgaaccccggagcgcattggttacagcagtacctggagccccagcatccgcgcatggcaggtcctttcatggcaagtcatttgggtcctcagccattgtctgttgctacaggtgctatcatggaaccaatttacccggatggccagattacgtcaccaatgctcgatgcgctttctgatcctcagacacctaggcgcaagcgtggtgcctcagatggtgtaactgataaagtcgtagaaagaaggcagaagagaatgataaaaaacagggaatcagctgcacggtccagagcgaggaagcaggcttatactaatgagcttgaaaacaaggtgtttcgtttagaagaggagaccgcgaggttgaagaagctgaaggagttggacatgatgataacctccgcgcctcccccagaacccaagtatcaactccggagaacaagttctgctcctgtttgacctcgatagtaaattttgtagattacaccgctcatatgttttccgtggttgtggtagaaacagttggtagcctgaggtgttgtagcttgtcccagcccggtggttcagagtttgtagatgagtagcagccctaggcccttagcatgtcccagatgatctgtctgttccgaggctttgtcagtgtgtgtaaatcctggtgtttcttcactcgatcaagtgtagctagattctcttggtacagccttttcacatcttcctgatcttcctccaaggagctgaagagcctggagcggaggggccgcgtgccggccgaaggcgagacgcggggacggaggacggcggcggccggggaccgcatcctcgtggccaagttgcgcagcgccatggacatctggaccagatctagggttctctcctctttatttatatttttggacctgttcctc

SEQ ID NO: 7431 - DNA, 611 bp, Triticum aestivum
  unsure (1)..(611): unsure at all n locations
  Clone ID: PAT_TA_7431
atttagttatgtttgtcaatnctatatatcaaatttctatncagnagcattgcattggtacctacacattcagtacatagcaaatggtccaggaaccagnatcctgattcctctaaaaatccattttagatgagaaactgtggaaaggaaaaaagaacatgtcctgattcctctaaaaatcaattttagatgataacccatggtgtagaaagtcagggaggtggtttttcaccaatacgccggcagggtctccacttcctcctctctcaccctctcttcttcccactacaccccccctctatgcctcctctttccaccatataatctcaagatgatgcagagatggggaaatcgttgttggcgataccctgctgaacaaccacacataggggctacagatatttgaccgactaccatcttctgccgagaaggagaagcagatgcaagacctcgggatggtgcagagatggtgaaaccgcagatgtcgataccctgccgaacatcgacatgtgcgttgtaatcatgtgtagggtcatgaatagaacaatagaacaccagtatctgatactctgcatttgcaaagcattccgtttccatattatagcttgtcc

SEQ ID NO: 7432 - DNA, 1167 bp, Triticum aestivum
  Clone ID: PAT_TA_7432
gcgctaatgcctatattaacactacgactcctaactttggggcatgcaattctactacgtaagagtagtaatttaaacggggagcgaggctacgctaaggcattcttttaggtggtggttacatgttgagtgactttcagttctccaaggcaccaggcacagcacaaaaagggtccctcctgtcttcgccttgggaacttgcgtaggcggcccgaaatcaccgcggtggtgaccaaaagaccggtcaagtacgggcgttcatccttctgcccagatgagtttgaaaatgttcttgctagcccccgcgttgaccatgccgctcttgttcttcagcatctcctcctgggcacgcctaacgccatcaagcatggtgtacgccttagcaagcgagagaagagtggggtagagactcgtgacagcaagagcagcttcttctgtcacttgtggcacctgcataagctgaagggcgaatatatcgctcagagtgaccttctcaaggtcagaacacctcttcacaaacttatcgtaggtcaggcaaagtcaagaggtatcagcgccagcagagaagtttgtgctgtaataattaattatagagcccgtgaggtggtcgtatttattttcagtgtcagcatacccagtggttctctggacatcaaatccttcaggaacctcagtagtgaagcaggctgttttaacgctctctgatccatctacagtgtttacatccccttcaactagatatattagcttcgttagcccacatttcttcagtcttagtttttgatctttgtatctgttgtctttagtcgacccaagtaaatcatccacatttttccttttaacaatgaaatcaagaacatactccgtgtcaagttctttatggcgagcaatccaaagagcgtctccaacaggcaattgtttaatctctacgaggaatattaaaatgcgagcgtatattatcacccacttttcttctggaacggggtcaaaggaactggaactgcctgcttttgagtttggaagtccacttctttcagaacctatcaggggactgctgctgtcatgttcatcagaatctgaatcgctgagcacaactgcagaatgaccggctgccgttaaaggtcctgcaggaccatccaatccagatcgtgcgagacaatcgcgagc

SEQ ID NO: 7433 - DNA, 704 bp, Triticum aestivum
  Clone ID: PAT_TA_7433
cgaaatgcataaatgcgcatgtacacagcaacaaaagttgcccatcccccaagctccgaggcccgttgcacatggtagacgttaagaagaagctaggcacttgaaagaatggggagcatctaaatcatgcgtgttcacgatgctctgcggctcctgctacatgcagccggcattcacgttgcttgcggggccatgtcttcagctttccagtgaccatgcatcgcatgataacctttcaggccggagatgaaagtttggctccttcggaattgttattgtctttgatgactttttggggatgaatggccgatcaaaatacggcattggctgtgctttaggaacaagctctttcctcaactgccttatcatttcttcctcctctaacttctgttgacgctcccgctccaatcttaattcctcaccaaacttgatcctctctgatacatattgatcaaattcagcacgttcaactgcgcgcacatcactatggagaacaaggtcgactggctcagtcctttccttgactggtggcttgatcaagcactcaggctcatctgttgtccacggaagtccttgagcaatatgtatgcgcttcttctcatcctcaattaacatttcctggactttctgaataaactgttgttctttggcttttcccctttgctctgttctcagcttgaagggatgcggacgcgtgggtcgac

SEQ ID NO: 7434 - DNA, 871 bp, Triticum aestivum
  Clone ID: PAT_TA_7434
ttttttttttttttttttttttttgagattaatagtgcatacattgcaaggcccactagaatgtacttattcttcaaaaataattcataatgtacaaccgagacagctttgaagaaagagcctattctctggactggaaaagcgccaactgaacaggggcatttctcacctagaaaaacaagagccgtcgaatgaactaactatattcctatattctttggttggaaaaagaagaatctgagcacgggtaattgcccaaaaagacaggtctccggtgaatggggtatatttgtaaactgcctgacgtggccgtatattttcttcatttcctgtaaaaacatctacaagctggcgcctgtactatgtacaactaaggcactgggagagcaactcttccatgaaaatcaacctaatggaaaacttgtggagatgtgtaatactcgctttcactgaaatatggtctcaagtcctcttggcacatgaaatccaaaggaaaagatacaaggtggcctctgaccaactgcaatctctccatagggtcggcacctttgagatcgccatcctggtaggtttcgagctgttcttgggcaacgcctagatcaattgtagtgtggccaattttttccttccagtaagcaatgctttgccgaaactgtgtccttgaatggatgagatcgttgggaacacaagagaatacatcctggtaaatcgtggtatttgtctgcccggcggcctcccggatttctgtgatcggcgtatcggccatcggctccaggatgtgcaaataccaaatataacgtaatttatagggaacgtcccatatgcttagtaatcatagtcttgattcttgaatgaactatgacttcagggt

SEQ ID NO: 7435 - DNA, 1557 bp, Triticum aestivum
  Clone ID: PAT_TA_7435
ccttcacaatgaacttactgacctgagttccgagtattgtgtcctgggaaaagtctctccgtcgaaatcgtgcgaccgggggccggggctcggtggaggcgtgccacagctgagaagatggccccatcttcctcctcttccgctggaattcatccttgacgcttcgctggcaacttgaatgaagccgctatagaagctcctatgcccaacaagtcctacatagtcccccaacgcggcgggaacaagtggtgcctcatcctggacatgttgatagctcagcccactttggctataccatgttgcccgggagctttgtaaccaaagcacaagatgataaattgctagaatgggctaataccatcaagtctggatttcctctttttgtggcagccatggacgagagcaatgtcagcttgaacgactgccatgtttacataccgttgtggctcgtggggcagttcaaagaggaggtggtcaagattgtagcccctgacaagagtacatacgttgttggagcaaagaagcacaatgatgatcaaatcgtactccaatctggctgggataggtttgtgactgatcagcgcatacaacagaatgacttcctcattttcataattgagggggggactcgcctcaaagttctcgtccttgacccaagcggtagtgagaaaacttttgccatgggaaactcttccaaagtccaagaaaagccaccactcccacctacagttactaaccggagttctgaggacaatgaagttgctgacctgagttctgacgatgaagttattgacccgagttgtgacgatgatgaagttgtgggaaaagacaccacggcgtcaaggagggagcagccgctacgaagttgtcgtgcaaaagctgaaacgatggcttcaacatcctgcccttctactaaatcaggtcggcgcaaagctggcaactctaatgaagccggtttaaaagctcctatgcccaacaagtcatacatattatccgaaggggcgagcctaagtaagcaacaggaggagaaagttaaggagaaggtccgggcgattggatctgatttccctgtgtttgtgagggtgatgacggtgcacggtgtctggaggccaatacagctgagattctgcgtggaatatggttcagcatgtcctctcccgctccaacaaacacctctcctacttgggatagagggtagcgatatgcagtggcctagcatgctggtggtcaaaaagtataagaaggggtggtggatttcctcgttctggagcgaccttgtcttggaggccggcatggaggcgggagacatctgcctcgtcgaactggcagacaggagcagcgagaggctcaggatgacggtccatctgatccgcaagtcagaaatgcagctctagttagtgtgtgtgcggtctgtagtatgatggcttcaaactcagctgattatgccttcccatgacctgatgttaagcaaactctctaccaagtatgtaatgcaatctggggaaacactgaaccctccttgacccaccacgaaccttgaccactctacacgcgcgc

SEQ ID NO: 7436 - DNA, 611 bp, Triticum aestivum
  unsure (1)..(611): unsure at all n locations
  Clone ID: PAT_TA_7436
tgtgttnnnnnnngcgaacaccgccgcccccgaccccgaccggccgcggttgtcgaagtcgnnnatgcatataataatattgatttcatagtgtgaatgttgatatcttttcctacaaagctagtcaaagtttacaaagtttgactttgaccaaatcttatatgcagactaaaaagaaaaggaaggagtatgaacagagaagcagcagtcttgcagcctaaatgaatgattacaaagaataaaggtgcttcaaaacaatggttagcactggcgaaaagtagatgcacttagcaggtaaagccgacctcgacgaccatcgctttttcacatctgttcctcctgctatcctggccgtcaagtcgaccatgacgaccaccacctcgacggccaccacgtcggcaagcgtgtagagcactggcccccgatcacgtcgagctcaaggaggctcaaactgacccgagtagagcaagatgttggaggccttgtagatcaccgccaggttggcgtcgtggagaaaggcaaggcccttggccgtgacgacagcgatcttcatccttgtcatccacaggagggaaccatttgtaccagcatgcgtggatcgtgtggcangg

SEQ ID NO: 7437 - DNA, 760 bp, Triticum aestivum
  unsure (1)..(760): unsure at all n locations
  Clone ID: PAT_TA_7437
acataaattgacattttcggaaacatacatgtccagtagggccttttggctgctcagggttgtacaaattagacacttagttccttcccggttcttcctctgtaactgcttaacgcttgccactgtcgtccactgatgcagaggctcactaagagtaaaaaacacgcgacaaccaaacatgatcgttcactggccaacaccatagaccaaactggggagcacccagaggctctcaagctgattgcttttgccttctagaatgtatgaatccgagcgagttatactgtaaactgcctgaccaagctctacagcaatccaaggttcatcagagtctttggacgcacttggaacataaatgcagttactctttccgccccatctttcagggttcatgcaagaaaatgtagggctcctcctatcaaggctgataaagagagcccagttttccaacttctccatctttgtccacttagctggttcggctgaagaatcaaagcggaagacctgaaaggtgccattgcttatcaagtcatcaacaagatcaaccatgagaagcatgtcaccacagaccaccaaccatggatcataattcaagccaacaacaatgtcctctccccacacaacatcgacttcctgcacgttgggctgaggtgccaaggatatggttttcagcgtctggggaaagtctatggcaaacatctgacctttgaacaaaacaatctgaataagaaagtgttcagaaacaaganggtactctgtc

SEQ ID NO: 7438 - DNA, 1130 bp, Triticum aestivum
  Clone ID: PAT_TA_7438
tttttttttttttttttttttataagtacctgttgattgataaagtgatgatatccttcttacaatataactctgcggtcgcctttttggaacagattgatgacatcttcatccttcacttgattgaaaaattctctctcaacgaatgtaaccaaacaattgttcaaataatcatcacccattttgttccttaccttattcttcacatagctcattgaagagaataccctttcaacactagcagtagctaccggcagaatcagtaccaacttaagaagcttgtagtcaatgtattaactccctccgttcctaaatgtagggtgtacaatttttgacagggatattaaataacgcacatgaaaggataatttcacaaattttgggcgaggttacacctgactaattaacatgagaaaatagaggagattgcctaatacatggaaatgtaattatatccctaaaaaaattatccaaacgagtggtgcaacgcaatacaccttatattttggactttttctcaaaaatctatacaccttatatcaaggaacggaggaagtatgatattgttcatgcttgtttgtctcaacaagcataactgaaagctgacacagatttttcaggttttgaaacctttcatctctacgcacattagtaacatacatgtttagttgccatggaagtcttgccagttcatcccttgtaaaatcagaagcatagaacttattttccttgcctttgaagatttgtcccacaattcaaacaagctaacatctttcttcttcatcttggtgccggtggagcagtggagccgtcgagggagcactagaggccggccggatctcggaggcggaggagaccggaggtggaccactggaccagatgcagtttggggaggggaggggcggagcggactgccggagcccgaaggccgaggctggaggggcagtactgccgaggggaggaaaggagagggtcggccggacctgaattcgccgccgcccgccgccgcggcgccggccgctagcccgctagcgctaggtttgggaatcggggcacggggagggagactgcgctcgacggctggagactgggaactggttgatagacctcgcccgcggccttgcgtgtac

SEQ ID NO: 7439 - DNA, 811 bp, Triticum aestivum
  unsure (1)..(811): unsure at all n locations
  Clone ID: PAT_TA_7439
ccccgcgtccgccgcaccataccacgcgaccgagacccgcctcacttcccgcgatgttgcccgagatccgctaagagggcggtggcgcgggcacgagcgcgaccaaggcgatgtcggtgtcgctgagcgggaagcggggccggtacgtgcggtaggtgacgggccnccacaacgacaccgacctgcacgtggcggcgcgggccggggacgccgcggtgctgcgccgcgcgctggacgaggcggcggtggtcgtggcggttggggagggaggggagcagttggaggcggtgcgccgcgccgtggccgcggaggacaacgaggaggaggcgaccctgaacctgaacgccatgaacaagctccagaccaagaagccctggaacctgtccttctccttcgggcgtgccctccagcagagcaccctcaaggaagaagaagcggctcaagctcctgggttgataatactgaaatctcagagactgagcttaatcaagtgtatgccttgtaaagagacagggtgtttgaactcagccttgcctctgcaattgagaatgtacatgcttaatcaagtgtatgccttgtaagacacagggtgtttgaactcagcctcatatctggaatcgagaatgtacatgaaaattccagatgcgcgcattaacaaatagattactcacattattccttgattgcacaattcctttctgtaatgacaaacgatgcatacctaaaagggaggcccattgtgtaaggctcatgcagttgaagaatccactgtgcacaatctgttgtacaagtcggttgcactttttcttcc

SEQ ID NO: 7440 - DNA, 2233 bp, Triticum aestivum
  unsure (1)..(2233): unsure at all n locations
  Clone ID: PAT_TA_7440
tcgagccgccgccccggccaggtacttcgtggtgaacggcaagggcgcgaggaagattggtggaaaagagaagtcggtgtcgctgagcgggacagcggggccggtacgtgcggcaggtgacgggccgccacaacgacaccgacctgcacgtggcggcgcgggccggggacgccgcggcgctgcgccgcgcgctggacgaagccgcggtggtcgtggcggtcggggagggaggggagcagctggaggccgtgcgccgcgccgtggccgcggaggccaacgaggccggggagacgccgctcctggccgccgcggagaaggggcacctggaggtggtggtcgagctgctccggcatctggactcccagggcgtcgccgcgaaaaacaggtcggggtatgacgcgctgcacgtcgcggccagagaagggcatcatgctgttgtgcaggaaatgttacgtcacgataggatgtttgccaaaacatttggccctgcaaatactaccccgcttatatcagcagctacaaggggacatgctgaagttgtcaaattgttacttgaacaagatgattttggattgggagaaatggccaaagataatggcaaaaatgctttacattttgctgctcgacagggacatatggaaattgttaaagcattacttgagaaagatccacagctagcaagacgaaatgacaagaaaggtcaaacggcactgcatatggctgtgaaaggaactaactgtgatgttcttagagcacttgtcgatgctgatccagcaattgtaatgctgccagacaaaaatggaaacactgccttgcatgtagcaacaaggaaaaagcgagcagagatagttattgttcttttgcggctaccagatacccatgtcaatgcactgaacagagatcacaagactgcttttgatatagctgaagggttgccacattgtgaggagtcgtctgaaattaaggatattttatctcaacatggcgctctcagatctagagagctaaatcagcctcgagatgagctccggaagacagtgacagagatcaagaaagatgtccacacacagctcgaacagacaagaaaaactaacaaaaatgtgcatggcattgctaaggaactcagaaagttgcacagagaaggcatcaataatgcaacgaactctgtaactgttgttgctgtgctttttgctaccgttgctttcgcagctatattcactgtacctggtggaaatgacaacaatggagttgcgattgttgtccagactgcctcctttaggatattcttcatctttaatgccatagctctgttcacatcattggcggtggtcgtggttcaaataacagttgtcaggggtgaaacaaagtccgagcgaaaggttgttgaggtgatcaacaagcttatgtggctggcatcagtttgcacaaccatttctttcattgcctcatgctatattgtgctaggccgccatttccaatgggcagcaatactggttagtttgataggtggtgttacaatgactggtgttcttggaacaatgacgtactttgtggtgaaatcaaagcgcatgaggaagattagaaaaaaagagaagatgtcaagaagaagcggctcaagctcctgggttgataatactgaaatctcagagactgagcttaatcaagtgtatgccttgtaaagagacagggtgtttgaactcagccttgcctctgcaattgagaatgtacatgcttaatcaagtgtatgccttgtaagacacagggtgtttgaactcagcctcatatctggaatcgagaatgtacatgaaaattccagatgcgcgcattaacaaatagattactcacattattccttgattgcacaattcctttctgtaatgacaaccgatgcatacctaaaagggaggcccattgtgtaaggctcatgcagttgaagaatcccctgtgcccaatctgttgaacaaagtcggttgcactttttctttctaaaaaaaaaaaaaaaaaaanctcgagggggggggcccgggtacccattttccagccatcaaactgtgcacaatctgttacgcgcgctcaagtgaggtgcactttttttccgttccattttcccacccatcataattcacgagacattctgttttggttatttggaatgaaggcatctacttgtaacctgtcatcaactgcaaacaaacatttcatgacttaagtaagctcctggcccctcattctt

SEQ ID NO: 7441 - DNA, 786 bp, Triticum aestivum
  unsure (1)..(786): unsure at all n locations
  Clone ID: PAT_TA_7441
ttcctttttaccctccccgcgtccaagctcaggtgggcaaccagttggcctagcttgcaaagctcgatctcttacagcacaaatatagttcttatcaaacccatactgttcctaacacgaaaggctttgttttcagggtctcctaacgctctgcatatagaaactaaagaatacaacacagctttaatctgtaaccgctacaccaaactacgggcaggctcagcaacaaagattacacttgtccccggttacgactttaattcgactacaccacagctgttctgtgtagccgctacaccaaactacgggcaggctcagcaacaaagattacacttgtccctggttacgactttaattcaacaaaaccaaaaatgttctgatgcctctgattaggtaactcaagatgaatgcccaacttctaggggatgaatgcccaacttctaggagatcccatagcgcccagcgcggctcctgcacccgcgcccccaccactgccggttccccctcctcccccgccaccaggggccccgccaccataggcgccacctccgtaagcacccgcaccataggcaccgcctccgtaagcacccgcaccatagcccccgcccccatatcctccgtatccaccagcaccgccgccgcccggagcgccgccaccgccgccgccacctccagatccacccccaccattgcctccgccgccggcagcacccgcgccggcgccaccgcctcctcttgctncgtatgcaccataagcaccaccgtacatagagccaccatagccac

SEQ ID NO: 7442 - DNA, 1777 bp, Triticum aestivum
  Clone ID: PAT_TA_7442
agactcaaccacttgtaagcagtgcagggtccccagccagtgtttaaacatgcttcctataccgaatgctagcagcccttctgttgggacatcaatggctgaccgatcaattcttgagaaatttagaaatattgaggctatatccaatcggcatcagctgcacaataagaagaacaaagttgataatttatctaataataggaagtccatgataaatgcaagccgagagaaagttgttacacttctctccaattgcttccatactgaggattacaaagatgagttgaggcctctttgtaattctatgttgaatggaacaataaattcctttaggaccagaatactgaactttgttgtcaccaaccgctcataccaaggtcctacaaagccgttccggatcattttcaaggataagcctgatgggacagtgggaatgcaatatggagacccagaagatttcgacaatcggaactcacatgagtgtacactcatattacccaccaagtaccatgccgacttgcttgcaacacaactcattgctcggatggagaaagaaggctatgataaggcagatgatcaagttgtgcccagcaaccctcctggtaacctcagtggactatcaggcatgttagcagacaatacagccaatgaagtgaaacaagagggaggtataacccagcaacttaatgctgcagcccatgcaaatatggtatctggaagccctttgcaacaactttctgccaataggatgcttccatctgggagtagcaaccaggcagtaccaatgcagcaagagtatatgcagggtgcaaccatgtctccaaggagtcggacgcgtgggcaaaatttaatccagcagcaacaacatcagcagccacagctgcagcagaatgcacaatcacagcttcagcaacaaacatctcttcctctcaaccagatgcagagaccccaactgctaccagcaagcccattatctcagatgctggggcctggctcaaatctcccaatgggctcgaaccacacgagtaacaccaaggctactcctgcttccttgcagcttcatatgatgcagcaagtacagcagcaacagccagtgcagatgtcaagaaaagtgatgatggggcctggctcatctgtgaacatgggcaacatggttaacaatgtagtaggcctcagcggtcttggaaatattatgggaatgggcaacgtgcggtcagtgtcctccccgatgggatccatgtcaggcttagggaacagtcccaatcagatgagccttggaatggcatccaatcttgccgcagctgggcttcgtccaggtatgaaccctgctgctattgccaagatgcgtatgggattagctcagcaacaaagggtgaccagcctttacccccagactggaatggttggattgcctggcagtggttcaccaatccttcctagttctgccggcttggcgatgatgggccatcattcactaaatagaaacaaccttaatcccatgcagagggccatgatgtctccaatgggcccaccaaagatgccagtgggtaattttcagatgaatgcccaacagcagatgcaacagctgcagcagctccagcaacagcagcagcagctccagcaacagcagcaactgcagcagcagcaactgcagcagcagcaactccaacagaacccaacagaagcagcagcagcagcagcatcagcagcagcagcagcagcagcagcagcaactacagcagcagcagcagcagcagcagcagcatcagcatcagca

SEQ ID NO: 7443 - DNA, 697 bp, Triticum aestivum
  Clone ID: PAT_TA_7443
ttggtgtgtacaaagattacaggcacaacacggcctacaacaactcctgagcttctcttctcttttccttcttttatacacaaacaacatggcatggcacggtggcaaagcagcagcattcaagaacgaagaaaatggttccttcataggctggcctggcctggcctgctgctaccggagtgccgccatcgctagttcgccgagaggaaatgcacgcgggcgagcggatactccttcccagagacccagacgccggtctgcgaccactgcacatcctcccactccagattgtcctgcagcacctcaacttgttcagctggcagtgggataccaatggatctcatggcaacctcaggcatggccttcttacaccgtgaccatcggaacacgtcccggagttcatgttccgtggcgcccctgtccccgttttgcaaatggtggtggctattgttctggtgtttttccggttccaaatcagatgcattggaatttgatccaatggagcgaggcttttccccactaaagcacagctcatacctattgaaatgtgtttccaagtatatgacttcgccctttttcagcctcgcagaagtataaagagacttcttcaatcccttgtccgccacaatgcttatactgtactttaaccatggctcgttgcagagattgtactgtattgtaacttcccgaacaaatc

SEQ ID NO: 7444 - DNA, 796 bp, Triticum aestivum
  Clone ID: PAT_TA_7444
cacactcgcgcagctgcagcgaatttacactgcaggtcgaggctagctgagatccatggcgtcgagcagggcgatcttggccatgggcctccttgccgccgtgctgtcccccgccttgtcaaagcggtcgtttatctccatgccagccgacgtgagtagtcctgtgaccctggccaacggcctctcctacggctaccacgccaactcctgcccgcagctgcaagacatcgtgtggccgatcgtggagagcgcggtcctgggtgaggtggccatcgccgccggcctcctccgtatcttcttccacgactgctttcctcagggatgcgatgcgtccgtccttctgacgggacccaacagcgagcgggacctgccgccgaaccagacgctgcagccgcgtgcgatgcagctcatcgaggacgtccgcgtcaaggtacacgccgcctgtggcgccaccgtctcctgcgccgacatcatcgccctcgccacccgcgacgccgtcttcgtggccggggaaagcgaaatgttctacttctacgacctgccgctcggccggtttgacagcctcgagccggctaatagcagcgccgtcttcgacctcccgcagtccactgccgacgccgacacgctcatcaacgccttcaagagccgcaatctcgagcccattgacctcgtcgcgctctctggcgcgcacaccgtcgggaaggcgcactgcagctccttcaacaaccgcttctccgaggacgccgacttcgcccggaggctcgccgccaactgctccagcgacccgaaccggctg

SEQ ID NO: 7445 - DNA, 802 bp, Triticum aestivum
  unsure (1)..(802): unsure at all n locations
  Clone ID: PAT_TA_7445
ccggtggctcatggnatggaccaacacagggggcgagtggctgtagcgtcaatctcgtggcagctctacaacatgtcacaggagttaatttacagagctgttacatcacttcgcactcttggcaaaagaacattgctgctcaaatgaagcatttttacactatgggcccaatccatgtacggaaaagaatactgtgtgttggttggaaaaaaagaataacgcattagccaggtccttttgttctcctgttggcaattgaatctgtacacgctgttgtatgggttagtggcttgagagattcaagtgccaaaatgttgtccaaatgtataggcaaaatccagacacgccagagctccagtgaacaatgcttttgtacagaagccatgtctgtcactctcgtctgtagaacagaacatatgcggcagctgtttttatattgtcctcgcttataggtgttacacattcatcatcaaatttgtgccatcccttgccttcttggtagatgcttgctgtgtaatgtccacctcccatatttccatagtggttgctaatggcatacaagcgataatggttgtatagttgttcattctcggtggcaatatatgatgacaggtccaaatcactaatggggaaatctacaaatgtctcgagcttatttcttgtgaactgggtatatgaaaatcttttcagatggatgaccagaacttcaggtagcctccagagatctaatttcttcatcgcttgctgatgctttttgcagcaagggcagtaccacatgtcctctggccccaatggctcctct

SEQ ID NO: 7446 - DNA, 574 bp, Triticum aestivum
  unsure (1)..(574): unsure at all n locations
  Clone ID: PAT_TA_7446
aaacagaaagattttatatatttaatcaaatcggtttgcattacatggaacacaatctgataaagatattacatgatctcctatttattaaccatgaaactgacattgtataacgtaaacgtaaaactatcttgtagtagccccattctccacctttctatcaacaacttagcaatgcatcatcttcgtcttcatcgtccttcatgctggatgacaagcttctctaggaactacctgtgaatgccttctatgacattgttataggatgaattaccgccaccctgcccatggttcagtactagaactgactggcaatgcgccaattcaggtgtgcatttcgttccacaaagttgctgcagacgaacaaaaatccctttggaaacatcctatatgggtagttggggaatatagttagtggggataatttaacaaacttgggttctgtgtattttgtcaccagttcctcaaggaaatctaaagcaaccatatctggtatccctgcattgatgcattggcgggaataaagcattacctggcctctgcaagagcactccttgacacaagctaangcann

SEQ ID NO: 7447 - DNA, 735 bp, Triticum aestivum
  Clone ID: PAT_TA_7447
aaccaaggagccctggtcagcccagctaattaactagttttgatctctgtcctttcaagctctaggtgagcacgcaatggccgcttcatgacagtgaagaactcaacatgcggccggagatcgacggcacgctcaccttctccctccctccaccggaactccctcacaaggttggcggtgaagtagcttaagtgcagcgttgcgacacccctaccagggcacatcctccgaccaccgccgaaaggcatcattttgatcgtgccgtcggttccttgggatgcatccttgcaggacaggaaccgttgtggcttgaactcgtcagggttaccccacgctgtcctgtctcgtgctatagcagccagtgggaagtacacttttgtgcccactggaatacgccggccattgtgaaccacatgatcctcttccatcacctgcctgaacgcaaaagacgtcggcggatgcagccggagtgcctccatgatcacagcgtgcaggtactccagctttccaagaacaacctcgctgacttcctcggcgtccgcacccacgatggcattgatctccttccggacggtctcctgtatgtcgggacgcttcaccaagttggccatgatccactgcagcgctgatgctgttgtttcagttccagcaccaaggaactcggagcacatgccgacgagttcaccatcggactgccttctccgatgccgccttgggtcctgactgtggtcgtcc

SEQ ID NO: 7448 - DNA, 1335 bp, Triticum aestivum
  unsure (1)..(1335): unsure at all n locations
  Clone ID: PAT_TA_7448
cgggccgggnctcccgacggagccagtatcctcgtgtctggcaaaagagggcttgccgtggncttccaaggggaagactgacaaggatggctgttacccccctggccatggtgacatcttcccatccctgatgaacagcggcaagctcgatttactactctcgcagggaaaagaatacgttttcatcgcaaattcagacaacttgggcgctatagtcgacatgaagatactgaaccacttggtccacaagcagaatgaatactgcatggaggttaccccgaaaaccttggccgatgtgaaaggtggcacactgatctcatatgaaggaagggttcagcttctggagattgcacaggttcctgatgcacatgtcaatgagttcaagtcaattgagaaattcaagatcttcaacaccaacaatctatgggtgagcttgaaggctatcaaacgccttgtcgaggctgatgcactcaagatggagatcattccaaacccgaaggaagttgagggcgtgaaagtccttcagttggaaactgcagctggtgccgcgatcaggttctttgaccatgcaatcggcatgaatgttccgaggtcccggttcctaccggtgaaggcaacatcagacttgcagctagtacagtctgatctgtataccttggttgatggctttgttacacgtaatgccgctagaacaaacccatcaaatccctcaattgaacttggccctgagttcaagaaggttgggtgcttcctcggccgcttcaagtcgattcctagcattgttgagctagagagcttgaaggtttccggtgatgtttggtttggttctggcatcgtgctgaagggcaaggtgaccatcacagcaaaacctggtgttaagctggaaatcccagatggaaaagtgattgagaacaaggatatcaacggccctgaggacctttaaatgagcatcggaacatgctgacatcacaatggcagatcaattttactatatagaatctgctatgagtcatacatgcaccatgacattgtggtgaatattctgggatacagttggcttcaacataaatacattgtttggtttggttctggcatcgtgctgaagggcaaggtgaccatcacagcaaaacctggtgttaagctggaaatcccagatggaaaagtgattgagaacaaggacatcaacggccctgaggacctttaaatgagcatcagaacatgctgactttacaatggcagatcgattttactatatagaatctgctatgagtcatacatgcaccatgacattgtggtgaatatcctgtgatacagtttgcttcaacataaatacat

SEQ ID NO: 7449 - DNA, 861 bp, Triticum aestivum
  Clone ID: PAT_TA_7449
ccacccagcaggtggtggcagagagttgatatttacagttggttccacaaggtagaaggattctaccgctggttttcttcccctcttggccctcccccgtttccatgccacctgtgccgtcgttgcactgcattcgcaccaaccaggtacaattctcccactggggtaccaccaccacacaaagaccttggaccggccccttccaatgcctacctatgctgagggagaactgcttcaagaacatatgcagtagatggggacgagaaacaacacaacaggaggaacttggaggctatacctctgcccgaatataccatcacagagatatatctcaagtaaaggaatggagtgcgtggaaataggttttcctttcctgggagtattattgatgctgccgcacggccaggccgcaagaagtagtatggtctaaaaggctttcttccatagcagagtccaaagatttagctcgcaaaaatgcagctttctgatggcgtagggcacgggggtagcaaagcaaggagccatcatcatagactgtcataagagtgctaacttatctcttcggggacgtgcatgccaaaaccgcgtttcatcttctcgattgtaggagcgagctttccaaggctgcgtaatttgtcgccggttgcagcatcaatcacatttcctgagatatcaacggtatatgatttttcagagaaacgttgaaggcctctctttacaagcaaatcgaaatctttctgatgaagttctctgccatttacaagcactccagtgttcccaccggcacaattcttgggcattgagtaactgaattcttttataaatggagggataatgccgctgcactcgtgccccatgaca

SEQ ID NO: 7450 - DNA, 1555 bp, Triticum aestivum
  Clone ID: PAT_TA_7450
gcccctgtctcatccgtccgccgtccgcgtgcttttcttaggaggcggcgagatctggccgcatcctcgcgcagggtattgctccctgatggcatcctcggggaagatggaggggccgtcggcgccagcgctccggcgggacccgtatgaggtgctctccgtatcaagagactcctccgaccaggagatcaagtccgcctaccgcaagctcgcgctcaagtatcacccggacaaaaatgctagcaacccagaagcatcagagctgttcaaagaagttgcatattcgtacagtatcttgtcagatcctgagaaacggaggcaatatgacactgctggttttgaggcgttggaaaatgaaggaatggatatggagattgatttgtccaatcttggaactgtgaacacaatgtttgctgcacttttcagcaagctcggggttcctatcaagacgacggtatctcctactgttcttgaagaagctatgaatggaacagtcacagtgagtccactcccagttgggacatcagctatgggaaaggttgaaaagcaatctgctcatttctttggtgtgacaataagtgaagagcaagctcattcaggaatagtagttagagccaccgcagggccccaaggtaggcacacgcggcggctcttcgaacaagaaatcaacggaggctatggactagctctacaggaagatagtcagaagactggcaaggtgacatctgcaggcatgtatttcctgcattttcaagtctaccgtatggactcgacagtgaatgcgttggcaatggctaaagatcctgaggctgcattctttaaaagattggaaggtctccaaccttgcgaagtctcgacacttaaacctggaactcatatatttgctgtatatggtgacaattttttcaagccagctagctatacaattgaagcaatgtgcgcaaagagttacgaagacacaacagagaggctaaaagaaatagaggctaaaattctggagaaaagaaatgatctgcgtcaattcgaaactgagtacagaaaagctttggcacagtttcaggaagcgaccgccagatatacacaagaaaaagaagtggttgatgatatgttgagagaaagggatgacatccattcttcgttcacgaccgaacgaactatcacgagctctctcggagctggtagcagcagcagtagatatccagttgagcaaaacaaaactgagagtccggagaacggtaacatagatagcagggacaaatcgagtaaaaagaagtggtttaatctaaatcttaatagatctgacaagagagcctgagcaatttattttcatcaatgtcagcatcggcacatccactgttgtacattacacaaggctgcaattgtatttgtgccttctgagctgtacgcttggcgattcttgttttttcttcttttagcatagcagttttgagtaaaatcgtgtactattcatcatccttcttcctccacttgaggtacgtttgcctggtgtcacaatttcctttttctatccccattgttatcatccgggacagca

SEQ ID NO: 7451 - DNA, 939 bp, Triticum aestivum
  unsure (1)..(939): unsure at all n locations
  Clone ID: PAT_TA_7451
cccgcggcaggctcgccaccgacgacgcgcgccaccccccaataataggcgccggatcgggggagggccacggagcgagcgagccatgggcgtccacgcggcgcccttccccttcccccttccccgccgggaggaggacgacgccatcgtcctcggccgaggcggcgaccgctggggcgccgccgcgatgccggcggaggacgaggcggtagagcagtcgcccacggcgccgcccatctcctcctgcggccgctacatcctgcaccgcgtctgccgcttcgacacgctcgccggcgtcgccatcaagtacggcgtcgaggtggctgacgtgaagcgggtgaacggcctcaccgccgacctgcagatgttcgcgcacaagacgctgcggatcccgctccccgggccgccacccgcccgcccaacattcccctccctcctcctccccggccgccgccgccgccgcaaggtacccccttccctccccccttttcccctttcctcgattagattatacagtttccagccggaagatggatggattacgcccgccagattaccactttccacttggcagatggagcctcacctaattcctccgtctcactcccctgtctcgtctgaacccacggccgggcgactcgttctgaatcctgaccagttccaggagaaaatttcttcagatttgccaccgactatcccccttttctcatgttagaatttggcaatgtcccaccatgatctgcggcaaagaagcaggtcaaaatccagcgaggtaggcaggttcggccactcgaagtcactgttgacagtcgacagggatgcacacctacattgacatcgacaccttttggtagtggcaagtggcgaatgccaaatgtgctctgctttttctgaaccttccaannnggccggccggtctacgcccactcggttgcaann

SEQ ID NO: 7452 - DNA, 796 bp, Triticum aestivum
  Clone ID: PAT_TA_7452
cccaagccacgccactccacgccaatttccatgtgagagccgaggaccccggcgcggccgccggcccctcatcccgaccgcccgcccgcccctcagcccggccgctggaggaagagaatcgatggtgcacggaacgctggaggtgctgctcgtcggcgccaagggcctcgagaacaccgatttcctctgcaatatggacccggtacgcacttctcaaatgccgctcgcaggagcccacgcgtaggatcgcgtcaggcaaaggtagtaaccctgaatggaacgaaagctttgtcttcaccgtgtcagaccaagctacggagctggtgattaagcttatggacagcgactcgggcacatcggacgacttcgttggtgaagcaacgattcctttggaagcagtttatacggaagggagcattccaccaacagtttataatgttgtgaaaggtgaacactactgcggagaaatcaaagttggtctcacattcactcccgaggatactcgccagcgcggtctccccgaagactttggtggctggaaacaatcgcattgagcagattcggaagaacaaggattctcgtcaagccttgaggcttgaatcaccatctcatgcaaatacaatacgaaactcagtcactttttacttttaccaaaaaactcagtcactttggatttttatctgttccttttgagctgaaagtcagtttggcttcatcaatcatgttagaagtgaatttatactgtagatatctgcaattcctgcattaagtgtcttcttagtactggaaaaaaaaa

SEQ ID NO: 7453 - DNA, 1110 bp, Triticum aestivum
  unsure (1)..(1110): unsure at all n locations
  Clone ID: PAT_TA_7453
catttnagcgcngngtaatangacttcantntaggggcgaattggntaccgggcccccccttttntatgttaaaaagggaaccccgtgantgccagttttcnntgnttggtcttcccctgntgntgtccntgggtaacattttagtgcaagtgcantacntagcatttgcatctgacgaaacaccgatcatctaatgacagacaggaccgtttttgtctgggtgctctaatccaagcgaaccatcaacttccagtaaatgcacaccgatcatctaccatccaggtaacaactgacaacaacatccaggaacagttagataaccctatggcctatgcacaatcccttccatcacgactcactcccttgctctgcccctgtagctaccgatcgacgataacccgagaacaccgagcgccgcgatgacggggactgcgcccgaggaacaggcgaggcacagcccccgttgctcattgggagatgcaggccgtacgattcatcggcgagcggctcagtgccatcttctctgaagtccagcagcgtgtccttggattccagcttgccaggctcggtcatcacactgtcaaggttcgtcagagatttcagctgaagcccgaggttggcgatcgtcctctggcactccgcgagcttccctgcagcactggcgacctccttctcctgcttgaacttcaggtctccatttgtgttggcgagtcgccaaagctttgcctcgcgactgtcccttgacagctgagcctccaatttgcggcattttgcttcatactcttctgagagcagcttctcctgctcaatcttcccttgtagcaagctcaccctgtttgtcagtttcgcgagttccagatttggctcttcaagttgactccccattgccttcctcgcagacattgcatcctctgccttggcagtgaattctaccagcaacacactctgctctttaagtctcacttccagtgacaacaccttctcctggagcttcatggtctcctggtgcgcagactcaagctcagaccccaaaacctttctgatgccctcaactgcctccagttgcatcttgacttctgaagaatattccctctcctttgccacgtcag

SEQ ID NO: 7454 - DNA, 1289 bp, Triticum aestivum
  Clone ID: PAT_TA_7454
gaggaacagagggagaagggacagagagggggaggaaagagggggtgagggagagaggaggtggtggcgctgtcgctggaggcgcacggccccggcgacgaccggccggagaagccgcgccgctacggggtcacggagatgaggagcccctgctacgccttccgccccgcccaccacgcgctccaggaaattttggataacatcggcccttttgttgacggtctgaagttttccggcggatctcatagtttgatgggaaaggaactgatcagagagatcactgatttggcgcacaagcatgacatgtatgtgagcactggtgactgggcagagcatcttctgcgccagggaccctcttcgttcaagcaatatgtagaggaatgcaaagagttcgggattcgacaccattgagctcaacgctggatctctcaagctccctgaagaggctatcctgagactagtccgcctcataaagaacactggtctgcgagccaagcccctgttttcagtgaagttcgacagctctgatatccctgcggctggtgatagggcgtttggggccttacatagctccagtgtaggcgcagactcagaaagattcgaagacattgacctgctgatcagggagggccgagagatgcctggaggcaggtgcagatatgatcatgatcgacgccgacgacgtgtgcctagcacgcaggactctctcagggcggacctcatcgcgaagatcgtcggccggctcgggctggagagaaccatgttcgagacgtccggtgccaacacctccgagtggttcgtcaaacgatacggcccgcgggtgaacctcttcgccgaccactccgaggtgatgaacctggagcgcctccggggcttggacgtgcgcaggagcgtccggcccctgctcccttcgccgttcttcctgatgtgatgacggccttcctgagctctgacatgagcctcagctgagacccaagcgagaaggtgttgatggagttgagttcctacctgggctactgccgtgagttgtgtgaagtgttactgagaacctaagcactgttgatggagttgtgagttgtggagccgaggcagcgtgttggtagcagctagcaataaggcgagaacttgtgtgtgtgcgtaaattgacaacttgtttcgtgtatgtgtgaatgtcaaaatccatgtagagctactaaaatagatgacttatctttacactaactttagttgaaagggagtatgaatttgggtcatctatttcggaacgtgatgatccatgtagagcaaga

SEQ ID NO: 7455 - DNA, 1199 bp, Triticum aestivum
  unsure (1)..(1199): unsure at all n locations
  Clone ID: PAT_TA_7455
acgctcgtatctgacgtgtgactttatngggttctaagttttgggattactttccaatgctcgatgcacaatattgtccactccaagcactccagggcatgtccgtggctccggggacgtctgcaaatagctttgctgagcagcatgatacacacacagtcaagagtgcagtcacagtacaccgaccaaactatctaaaaatggcacgggatggctgcgccatgttagccttcatttgggggggcaacacgtctagaactagatgatacatttacatgattaagttgctgcttcttggacaggggcatggataaatgccattcttgtacctccattcttctccaaacgccctcaccgcagatgaataactaattcggtgccacaataagttcgtcgccacgtggcactttatcatctgcatggccatctgaattagcaacttctgtgtctgcacgtaaccaatcttgcgcgcagaccaatccctcaaccgttgaagggtccatagtactgagatactcattcagcacccgggcttcactgtccagtgggatgatagatacagggatagcaagaatatcacgggccatttgagaaaggacaggatactttgccgcaaaagacttccaccatcccaggatgtcaaaattatcttgattcccttctttttgacgatagacagcttcctcaagatacaagtccaagtcagacttgaaggactggcctgacgatgactcctgaatatactgatcaagtccccgtcgggcatctgataatgtgatgcgagagaaggtcttagagtcatttcccattgttgtacacagagctcatgcaagaactactgtttcccagcgtagaagagaacggctggatttttccaatgaatctgctgaatgttcatactcattgcacaggctggtaaaggtttgcttgatggcttctattgttgcctttgcttgtaaattggtcatttccataaatcagcttgaaaaaaatactcaattgacttcatcttgtaccgaggatccagtatggatgcaaatgccattactggcctagtaagatcccagtatccctcgaactttttcagcattcggccagccacttgtgcaacaacaggagatggactattgcgccaggtgttcaaaagaacctggatctcacacatgtcattgaaatataggtttgcggttgggttttcc

SEQ ID NO: 7456 - DNA, 833 bp, Triticum aestivum
  unsure (1)..(833): unsure at all n locations
  Clone ID: PAT_TA_7456
ggaaggnttctcagngttattgtacccggtttccgtagagtttaacgaggcgtgggnctatagatccttngggaatggtacggccccccctttctctggccaatnagcggccttaactgaatcttatggttagcttagtagtagctttcacagcctgtttggggagaccaattacaagagtactgtgcatacaaaggaaaagcaataggcagctcaactaccatgtaaaaagggagatttaaccagaatccaaactagcggctacatcatctttggatttgattgtcctgcaatagcttgaagtaaccttggcactggaggtgtctcaacttcagacagacactcaagaaactgcacgacctcactcattgtaggacgatcaaactcatcatcttgaatacaccaacatgcgactttgcaaactctttcaacctcctccagattcgcttcgcccaacaatttcgcatccaccagacttgcaacgtctccctcaacaagactgcgcgcaactcgcaccggaaaatatccttcatgaacaccgtcttgggaggatgattgcttgctcgacttcctgctgcccgatacgatctctaacagaaccatcccgtagctgtaaacgtcaactttcgacgtgatggcagttccgctgatccattcaggagcaaggtacccaatggttcccctcattgtggtaacgacctggctgaaatcccttcccaaaagtttggccattccaaagtccgcaaccttaggggtgaaagacccatctaggagtatgttctctggcttgatatcacagtgtataatgcagtcccggcaacttgaatgcagat

SEQ ID NO: 7457 - DNA, 1070 bp, Triticum aestivum
  unsure (1)..(1070): unsure at all n locations
  Clone ID: PAT_TA_7457
actttgcgtntatagcaactgaacagggccgcagattaaactgtaattcgagaataaatgttcaaggcaacaacatcaccatgttcccacgcacacacagaaaagtacaacaccaactgggtagagttaaacacatctaaactcatgttagcctgacatccttgagaagtcttgcagccatggccccggaccttctgatttcccagtcgtccatgtcttcttttgaagccgtacaaggttcaggtcttcactcctggatcttcgtcttctcctgggttggaggcatcgtcgtcctcctcctcctcggtgttcccattgccgttgggtccggcctcggggaccgacgaagccttgaggtccatcatgtaaagatttatgctaggatgttgatatttagcatccatctttgacttggatacagttttcacattaaagttgattttccacatctccatcatctgctcatggacggtggtggaacggatctcgtatcctagcagtactttcgtcttaggaccagatagtgcaataattgtctccagtagaggttgcaatagatgttctgaataaacaacatcagtcccaatgatgtaatcgaatggaggctcaacggctctgatatgttctttattcccccaatccaattctgcaaccgtaactgagccaaaggaacctgagtcgggattagactgcgcaatccacgatttattgcgttcaacattcctcatgagcagcgggagcacctcaacctggtcagttgtaacaacgtcacaaccaagcaatgccataccaagcccggctagaccacaaccagctcctaactcgatcgcccttttccctttcagcttggatggacaaaacctacctttcctgctattcttttccaggaattttgcgaacaccatcgacgcgtcccataccgtcgtgccgaggtgcttcgaattggggtcctgagaaatatgcaggcggtggcccatcagttccagcgtgatcgccgacgtgctcggggagttcagcctgtcgtagtccatggaatccggtaactttcccgccggcggcgtcgaggttgc

SEQ ID NO: 7458 - DNA, 1084 bp, Triticum aestivum
  Clone ID: PAT_TA_7458
gatcatgatcatgctcatgagcagtcacatgcacactccctgaaagatctttctgttggcttgtctattttatttggtattgtattgttctttattgtcgagaagattgtgaggtacgttgaggacaattctcaaagggggggtcatagccatgggcaccatcatcaccatcataagcgacaagacattagtgataaggccaagtcggatcacataaaaagtgatgatgagggtaaagacacagatcaagcgcaacaaaattctttgcatgatggcgcaactggaaaaataatagatgctgaaaatgagcaagagtcaaatgctactaaggaagccgttttaggatcacagagatcagctttggacgtggtgcctggtgccaccgacagagagcctatcaattctgaaactgatcctgcccctggcaaagcattatcgagtgaagattcctctgtttcaaactccaacctcgtgtttggctatctcaatcttttctcagatggtgtgcataacttcactgatgggatggctcttggaagtgcttttctgctacatggttctgttggaggatggtctagaactctatttctactcgctcatgaacttcctcaagagattggggattttgggattctggttcgctcaggattcaccgtatctaaagccctgtttttcaactttctctctgcgctggttgctctgggtgggacagcactggcactgtctttgggaacggatccaggacattcctctttgattgagggatttactgctggtggttttatttacattgctgttgccggagtcctcccgcagatgcatgatcagaaaactacgctaagcaactctttgtgccagttgagtttcctgacaatgggaatgctggtcgctcttgggatatctttggtagaatgatttgggcatccaattctctgtagttttagcgctgagatgcacttacattagtccggtgaaattttcaactacagccgggaatatgaattctgtcgatattgggctaaaaaaatatagcagtactttgttggcgactaaattaatttcacttgcatcactagtatcatcg

SEQ ID NO: 7459 - DNA, 1038 bp, Triticum aestivum
  unsure (1)..(1038): unsure at all n locations
  Clone ID: PAT_TA_7459
gcccggcccctccctccccgcccccttcggcaacacttctcatcttggagctcagcagcacagcatccaagctttttcttcggcgagatgaacaggaagccaggacactgggactgcaggtcctgccggccacgcagcctcgggcgtgggaccgcaggtcgtgcctggcgccacaacttcagtcccggggaccgtggccggcgctgtggcgcgcctggcggtgtgcacgcgaccgtgggcggccggggcgtgggtggttcctcctttcgtaccggctttggtcccggctcgcacgtgcgctcggtccactggtaccgcctttgcgggccgcacagattcccccgccgccccctgctgctgcaactgcgctgcctacaaggtaggcaagctgccctcaatggtggagctggtgccgctgatggtgacgtggctccctcaaaggggtggccgcttcgtggctgtcgatggcatcagtgccaggcctcaccggggcttgggccttccgccctgtctggtggtcagtgggctggcgttgcatcggatctcggcgcagggaggacaactgtgccagcaggcaggagtgcttcaggtgcaacgcaccgagggactccggtagcgccacgccatacgaaaatttcttgcactgaggtgtaggaaggccatggcggcggcgatgagcagaagcagcaaagggtgtccgtgtcctgcagtcgacatcatcatcataagaagaagaagaagaaagtagaatgcaaagaaatcctcctcgagtgcatgcttactagttttgtctcttcccgttttagatttggttgtcatttcccatttgggaccgtccgtctgtccgtctgatcgatgatgactagctatgtttaccgttttattatttccgttcctttcatcaagtttgcagttcgagttatgtaacccaaagacgtatgctttgcttcagaagtattattgactagtagtacctgcccgggcggccgctcgaaataagcaagctgccttacgcgtattatnactagtagtactant

SEQ ID NO: 7460 - DNA, 702 bp, Triticum aestivum
  Clone ID: PAT_TA_7460
gatcgaaagggtcacatctttagccattcatcacatactaaatcacatgtaaaatacagtcctgactggcttgttcatcgaactaatgaaagagccacctacaggctagcttttacattcaggatccaaccaaccaaaagtctccctgatacggaactaagtgtcagctaggctaggggcggctactccttggtggcggcggtcttcttcttgggggacttggtggtggtcttcttcttgggcgacttggcctccttctcagcggcggcgggggacttcttggggagcagcacggagttgatgttggggatcacgccaccgtgggcgatggtgacgccggcgagcagcttgccgagctcctggtcgttgcggacggcgagcagcaggtggcgcgggatgattcgggtcttcttgttgtccttggcagcgttgccggcaagctccaggacctcggcagcgaggtactcgaggacggcggcgaggtagacgggggcgccggagccgacgcgctgcgcgtagcggcccttcttgaggtagcgcccgatgcggccgacggggaactggagcccggccttgacggacctggtcaccgccttcttcctgtcgccgcccttccttccggccatcttgcttgctacttctccggcgagctggaaactactcgagatgttgtggtgttggcggcggtggcgctggatcggc

SEQ ID NO: 7461 - DNA, 764 bp, Triticum aestivum
  Clone ID: PAT_TA_7461
cgaccgacagcgcaagtgttgctgataagtggaaccccgggaggctgagttaagcaccatggctgaaggagttgtaaggaggaattacaccacatgggatgatgagatggatggtgcactgcttgaggtgcttgttgatcatcacaacaatggcgaccattcacaaaatggatggaaaccacatgtgtattgtgcagccataaggaatgtgaaggagaagtgcaacaagaatatcacaaaggacaacattttgggaaggcttagaactttcgacaggtactatgaagtcattaccaagatactttcccaaagtggttttgggtgggattgggtgaatcataagctatcaatggatagtgatgatgtctggatcaaatatgtggaggctaataagaaagagaaaggattagcttcctacaagaccaaagtagtgaagcattgggagtccatatctatcatatattcaaaagatcatgccaatggtgaaggtgcgatgactggtgctgagactactgcagatccagaagcagaaccaatagaaatctctccagaagtggcaccaaagaggcaacgaacaggtgagtccattatgtgcatgattggagaaatgagggctactttcaaggatgctttgaagacaactgatccacttccactgccaaaagctaccactcctgctgcaattcttgctgcactttatttgataccagacttggcagagccagacatgttgcgatcatatgggaagctgtttcttaatgagc

SEQ ID NO: 7462 - DNA, 812 bp, Triticum aestivum
  unsure (1)..(812): unsure at all n locations
  Clone ID: PAT_TA_7462
gagtaacttaagtggtcacagagcagtataccaaagacagttaacaccatagaaaacattttgtcgaattttacagagcatgcaagagattctcttgcacggttgcatctaggttacagcattcagcaaatggtaagcaaccagagttcagtgctccattcagcaaaagctagtatttcggtaaagcactcgatgtgcaatccagatgattccatatgctggtcaaatcccgagaaatcagcacatacagcttttttaggttcttcggctttgcacagattgtctcatatcaaatgacttctgtgagtctttcccgaactgacttctgatctggtatttgcttaatgctgtaaagaatttctccaccacgtagctcctttgatatccaatcaggagagagatcttctaagatatgcaactgttcttctatctctcctgtctcttctatctccaagttattagcaagaatattgtgaaagagttcctgtttagtgattagtgaattcttggttgatccagagataccacagactatgtcgaatgtgacacgtaaagaatctagcttttcctgggaattcattgaggatacttgattggttttgttatcattttccacggtaaaagtaaatgcttcttctgggaaaaggcattttccagttgtaacctcaggttctgtgatagaagtcaccccatccttgtcaagttttgaagtcaccccatccttgtcaagttttgaagtgtcaggaccatgatcagaanggctttcatcaaactttgatggtgagaacattattagtgatctgcgggctgaa

SEQ ID NO: 7463 - DNA, 670 bp, Triticum aestivum
  Clone ID: PAT_TA_7463
attcttctacatgttaaagtccggccaggtacagaatgacctacattcttacaggttgctacaattacagagaatcagccacagagatcaatttagctccatgaaaaatctggtgggcctcagcggcggcatgttatcttggagatttcactgaaatgcaccttccacacaagacgagtcttgatagggctcgcgatcttcgagtccttatcttcaattctgagagcttccgtctagtagtgctcgaagctttccaacaaagcagactcgacctaggctctaatctcaaattctcttgctctaacttttctgttattgacatccctttttgtcttgaccagcctccttgctgagaacaagcttccgccttgttaataacatgagcaagagataccttacctcttactatatttttttgtcgatcatgttcatttgttcctcctggaggacgtatattttcttggtcttgtgatgacaaagctgcttcccgtacacttcttcttttatctgaggcaacagcaccagtatctggttccccgttccgtcccatttcaggtgggcccactgcgattatctctccttcagtcaatatgtgtggatcagattgcatccatcttgtctgatttgagctagtaccctgggcaactctgcctttctggagcctgctaac

SEQ ID NO: 7464 - DNA, 729 bp, Triticum aestivum
  Clone ID: PAT_TA_7464
gagaaatatgcattgcttacaatttgtttttgccactacactttttacctcgttgggaactactagttgtatatagaagaaaaatctctggaataaaaataaattaaaagaatatgaagaaaaggaactaatctcatcatctcctaaagcttacacatacacccgcactgacccatgaagaacttgtttgttgttattcttcctctgccgctgaccaaaaatcagagctcggcgggcgatacctctaatgtctacggtcccccttttttttcctgcttttcttttggttttctccttttcttttaccatcatcaatcgtctgatgcaaagaagcaagaaacgtcgaactcaaacccgtccatcgagaaggcgttctcctccatctccatggcgagcgccggcatcgtccccgcggccacgagcgcggacaccacctcgtcgtactcagactgcgccctccactccgcctggaacgggttcatggagaagcggttcgagtccgaggttaccggcgagggttcaagggacgtcgacagcgacgcgccctgtccaaagcagttctccggcgtcgacggcatggagaacgggtagtgctcttgcggcgtcgccggcgcgcgcgccgcccccgaggagaagcagaaggacgtggtggtgccgcagccctgatgacccgtcgtcgccgtgagcccctcggtgttcactgtcaggctcgtgctcaggttctgcaga

SEQ ID NO: 7465 - DNA, 686 bp, Triticum aestivum
  Clone ID: PAT_TA_7465
gtttctccatattcttataaataacttcttcatattttacaaatttaatcaaggatttgatccaatcccactaaaaaactattttgtaccaactcttcaaagtcctttcacctttcctagctccaggggaagaataagctcagtccttactcagcctgtctgttgctgagtttgttcacagacggcttcctgacttggggagattgctaaagaaatcaagaagtctagttgtaagccacttgtgcaattcacagtggcatctgcatcaagccgaggagcgcgataaacaagagacggccacagacataaaggcaagcagattacaaactacaatttcaatccttgccagttttattgcgcctggctggcttggaccattgccagtttcattaccaatgatcagcagcttccttcatcatgtccctatgatgttttatccaagaagagccccttccttgtataaagcaaatcaccaaaaccaccacgtgatgctccaagttacttatttgaaacaagcaaaacatcaagctggctcattggtcctccaaatcaaatttcaccattttgtcagctgccaacttttggagttgctcagcaccatgatccacttagtgcttggcaactcacgctcctccagtcctccccatcaaattcacctttttgtcagcggccaattcattagtact

SEQ ID NO: 7466 - DNA, 679 bp, Triticum aestivum
  Clone ID: PAT_TA_7466
tttttttttttttttaacaaaacatatactccagttcaggataatgcaaggggtatatgtatatttttttcagcgaaaacaccggctcgctgacaattttccatattatagccaaaaggcgaccaaatacttgctggcccccatgcgacactctagcaggaagcagcgttagaagtgaataagttgaagcattgaagctaattttctagattacaagacaagcctaaattacaaccatagcattcacttgacatattccaagtggccatctattcttcctgtagcttggccacagcttcactaggtaatcttgagaaccaaagcaactccagatttagatgaaagaaaaggtgggaggcttcacatgaactcctgattgccttcccagcaccaatggctttgaactagaactaccatatctgaaaccagagcttgagctactgcatacttgtatagcagtcctgctcctcagaccttgtcctgaagcacctaaaacgcacttggattccttctctgtagatcctgataggttagctactggtgtcaaaagcttcgctcgccctgctggggaatatttatcgctagcagcctttatcttttctactgccttttccactcgatcagaactgaaactgttttcaaatgccagaaaattcacaaggccctctttgtctgctga

SEQ ID NO: 7467 - DNA, 1859 bp, Triticum aestivum
  Clone ID: PAT_TA_7467
cgcaatttgcgtccttttctcgtcttcttcctcccggttagtttataacctgcctgcccatccttggaacaaccgaacgagtcagacaggttatgtagtggtggcttgcgcggctggccttggttttgcttgcggcgagaagcaatgggcggagcggaggacggggcgcacgcggcggggggccacgcatccaacgggcacgccaatggggccgtggaggagaaggtggacgagctgcggcgggtgatggggaaggccgacggggacccgctccggatcgtcggcgtcggggccggggcctggggcagcgtcttctgcgcgctcctgcaggacgcctacggccacctccgcgacaaggtgcagctccgcatctggcgccgccccggccgcgccgtcgaccgcgccaccgccgagcacctattcaacgtcatcaacgcgcgcgaggacgtcctgcgccgcctgatccgccgatgcgcctacctcaagtacgtcgagggccgcctcggggaccgcacgctctacgccgacgagatactcagggacggcttctgcctcaacatgatcgacaccccgctctgcccgctcaaggtcgtcaccaacctgcaggaggccgtctgggacgctgacattgtcatcaacggcctgccgtccacggagacgagggttgtgtttggggagattgggaggtactggaaggagagggttaatgccccagtcatcatctcgctcaccaaagggatagaagcatccctggatccggtgccgcggatcataactccgacacagatgattagcaaagcaactaaggttccattggataatattctatatcttggtggccctaacatcgcatctgaaatatataataaagaatatgcgaatgctcgtatttgtggaactgacaaatggaggaaacctcttgctaaatttttgaggcagcctcattttattgtctgggataatagtgatctcatcactcatgaagtcatgggaggtttgaaaaatgtgtacgctattggtgctggtatggtggcagcactaaccaatgagagtgctaccagcaatctgtttactttgcactttgcacatccgaaatgatctacatcacccaccttctggaagaagaacccgaaaaacttgctggaccgttattactgacacttatgtcacattgttgaaaggtcgtaatgcatggtatgggcataagttagctaaaggggaactgactctggaaatgggtgatagcataaaaggcaaagggacaatccagggtgtctctgcggtcgatgcattttataaacttctcagtcaggatagtttgagtgtaatgcatccagaagccaaaaaatctgttgcgccagttgagatgtgccccatcttgaaaacacttcataaaattttgatcaagagggaacttcctactgagtcgattcttcaggctataagagatgagtcaatgtgtgatccgcgtgaaagaattgagatggcacggggccagtcactttaccgaccatctattcttggtcaaccaaatggagatgtgaaagcttagacagattctcctctcgttttccttctttctgttagtcgctagacgttttcgaagccctatgtgctcttgtccattcgggggctgctgcttctgctgctgttgttgtaacattagtaagttcagttaaaaactttagttgactattttgaggaagatgtgttttgagtgtgttagtagcttgatgtggttcacaccatcttgtgtatatagaacgatttaataatgctattattctgtatcctatttgaaatggaaaaacaatacaatcacatttcatgctttgaatagaggaccactttgttcagat

SEQ ID NO: 7468 - DNA, 658 bp, Triticum aestivum
  unsure (1)..(658): unsure at all n locations
  Clone ID: PAT_TA_7468
ggnactgcttgcgttcagcgatgggtttaatagtgcatttttctcatgcttacgctccaagggagatgtgtcaaatgaagccgctgctgctgtggataaaatagaagctgccttgaagttcagcgatggcccattcttccttgaccaattcagtttgtttgttgtgattttttttaggtggacattgcgtatgtaccattcatcgaaaggtttcagatattctattctggtatcaagaaggatgatcttgccaagggaaggcccaacctgcacaaattcattgaggaagtgaacaaggtcgacgcatatacacagaccaaattggacccacagtttctacttgatcaaatgaaggagaagtttgggattgcttgaagatgtgaccaaggataaccaaatatgcatgccagggaatcgctgcagaatagcagatttagactcgggggtgttgcaatatattttgaataaaagatgcatgccatgcatataggccatgcttttatatagagaataaacagacaaactgggtcttattgtaaacttttattgtctcgtaaaggatgatcattctgagttgtgctgaatgctcgtgaacttttcttaatgaaccggtgctcctttcttactcctatcaaaaaaaaaaaaaaaaaggccccta

SEQ ID NO: 7469 - DNA, 1208 bp, Triticum aestivum
  Clone ID: PAT_TA_7469
catttaccgccgcacaagctcgcaccaatgacttcgctcgctttcccctgccgcgcgtcaccactgacgcccgcctccatttcccctcccgtcccgtcgccgtgtataaagatccgccgctcgcgacgagctgctccccatcgccgcctcatcgccgccaggagttcgagctccccccgaaccgtcgccatggccgccgccgctgccgctgccgcaccggtcatctccccgaaagaaaatctgcccccttcgctgacctccacctccgagccccctccactcttcgacggcaccaccaggttgtatgttgcatatcactgcccgtatgcgcagcgcgcttggattgccaggaactacaagggtttgcaagacaagatcaagataatcgggatcgatctcgcagacaggccggcttggtacaaggagaaggtttacccacagaacaaggtgccttcactggagcataacaacgaggtgaaaggagaaagcttggatttggtcaagtacattgacagcaatttcgatggcccagcattgctccctgatgattctgcaaagaagcagtttgccgaggagctgcttgtgtacaccgacgagtccaataaagcactatactcatccataacctccaagggagatgtggcagaggaaactgttgctgcgctggataaaatagaagcggccctgggaaagttcagtgatggacctttcttccttggccagttcagtttggtggacattgcatatgtgccatttatcgaaaggtttcagatattcttttctggtatcaaaaactatgatatcaccaaggacagacctaacattcagaaattcatcgaggaagtgaacaagatcgatgcgtacacgcaaacgaaactggacccacaatttctgcttgaacacacaaagaagcggcttgggattgagtgaagatgtgaccaaggatgaccaagaggccagggaactactgcagcatggaagatgaagatgaagacactcaggagtgtgcttgcttgctagtactatatactatactttgaataaaaagatgcatgctactaaggccctgccttttgagaataaattaagtggttgttttgtgattatagtctttttaggcgttctgtgattgtggtttgacagtgtacaatattgtgagtatgtacgtgcaattaatatactgcctaatatcaattatcctagtacct

SEQ ID NO: 7470 - DNA, 1770 bp, Triticum aestivum
  unsure (1)..(1770): unsure at all n locations
  Clone ID: PAT_TA_7470
cttgtgtacaccgacgagtccaataaagcactatactcatccataacctccaagggagatgtggcagaggaaactggtaaaagagcagagccatacctgtaacttgtctaatcatctactcccttcgtcccataatataagaacgttttcgacattagtgtagtgtcaaaaacgttcttatattatgggacagagggagtaataagttctacactaatgttcatatattagacaagtaataagttccattggccattataacttcttatgcattatcttccattagtgagcgctcccccccccccacctgcctctcctcccgacctccccgcccgcccccgcctcctcctcgatctcccattcccaccctcccgtcccccagcaccgccaccttcccctcccccaaccgtcgccatggcaaccgccgttccaccgcgcatctgcccgacggcagctctcccccctcccctcacctccgcctcctcgccccctccgctcttcgacgccaccaccaggctgtgtcttgcatatcaatgaccatacgcgcagcgtccttggagtgccaggaactgcaacggtctacactacaagatcaacggaggcggcttagatctggaacacaggccatgtccggaaacctaacaaacaggccagaggagaaagctttgatttgttcaactgaacaaacagctgttatgatggaccatcattccggtctgaggatagtgcaaggaatttttgtagaacaaaaagacttcaattcagcgtcaggattaatggtgccttgttatcgtgcatacgcgcttggtgcaaggggacagtttaccccgagaagaaggtgcctacgatggaagcataataaggaagtttaaggagaggcctttgatttggttaaatacgttgactggaagatttatcacctagcattgctacctgatggttctgaaaataatcattttgctgacgaacggattatgtaccgcgaggagtgtaatattgcattatactcatacataagctgaccagggagatgtgacagacaaaacccatgctgcgctggacgaaaatagaagcggccttggaaaaattcagagaaagtccatgcttccgtgaccaattgatctaatgaaggagaagtttgggattgattgaagatgagaccaaggataaccaaatatgcatgccagggaatagctgcagaatagcagatttagactcgggggtgttgcaatatattttgaataaaaaatgcatgccatgcatataggccatgcttttacatcgagaataaacagacaaactggcaaattgttgtaaacttttattgtgctcgtgaagaatgatcaatctgagctgagccagtcttatggaataataaatattaggcctgacacaattgtgcggaagcattgatgtaaactttagatcttctagtattataataattttgtgtatttcattttacctaatttaagcaatgtgagtattaggcttatgccgttttctggccttctgggttgtgttgaatgctcgtgaagttgtttttaatgaactggtgctcttcttcttcaattagcctagtaaaaaaaaagccaagcgcagcgccagagatcccaagtcccatcctggcgccgcntccgatcgggttcccggggtcccgggtgcanctggcgacnatcccacaacgggaaccggataaaccggcaggtcctcgggccgcaanatcncaanagaagcaggntggaagacacngntttncggngggccnta

SEQ ID NO: 7471 - DNA, 1495 bp, Triticum aestivum
  unsure (1)..(1495): unsure at all n locations
  Clone ID: PAT_TA_7471
ggccgtgcgatacgagctggccttgtgccactcatcatgggtctagtaaccaaccccacaggagctctcatggacgaggctatggcgatactctcaatactatccagccaccaagaggggaaggcagctatcggggcagcagagcctgttcctgcgcttgtcgagtagctcggaagtgggtcaccgagaaacagagagaatgctgcagctgtgatgctgcatctgtgcagcggcgagcaacagcttgtgcatttagcccgtgcgcatgagtgcgggatcatggttccgttgcgggagctggcattgaacggcacagaaaggggaaagaggaaggcagtgcagttgctcgagcggatgagcagattcgtggttcagcaacaagaggaacaggaatctaattctcggctgcaggccgccgtggcacaagttctccctcaggcccctgaacaggtccaagaaagggacatccccgatcaattggacagtccggcatctcaataccccacgttgttatgaatacagtgctgatattgccctactacctgttggacctgttcatccgttcgatactagcgcaagtgggagtcaatcatgccaaccaagagatgtaattatgtgacgagcctctactgccaggtgaggtatttgaaatttatagttgcggccttcttccagcttgtaactgaagcactcgtcaggttgtcatgggcatgtcagcccagtcttgaggtatgtacagctcttcaatccacagtttcagatatcatgtagccgcagaacacaaggttctccaaatgtagtatatcctcagtgtaacagtaatgatgatttatgtaaaaaagaagattttatggtgggtttaactagtaaacatagaaaggggaaagaggaaggcagtgcagttgctcgagcggatgagcagattcatggttcaacaacaagaggaacaggaatctcattctcggctgcaggccgccgcggcacaagttctccctcaggcccctgaacaggtccaagaaagcgaaatcccggatcaattggaaagtccggcgtctcaataccccacgctgttatgaaaacagtgccgatattgccctacctcttggacgtgttcatctattggatactagcgcaagtgggagtcaatcatgcgaaccgagtgatgtaattatgtgacaggcctctactgccaggtgaggtatttgaaatttatatttgccgccttcttccagcttgtaactgaaacacttgtcgggttgtcgtgggcatgtcagcccaatcttgaggtatgtacagctcttcaatccacagtttctgatatcatgtagccgcagaacacaaggttctccaaatgtagtatatcctcagtgtaatagtaatgatgatttatgtaaaagtgaagattttatggtgggtttaactagtaaatattatcatctcctcgcactgtgtcacattgcctggtaatanattttatagcatgtaatttatttta

SEQ ID NO: 7472 - DNA, 663 bp, Triticum aestivum
  unsure (1)..(663): unsure at all n locations
  Clone ID: PAT_TA_7472
atgtgcagccttacaacttttttattacaaagggtattgatactttaccagtgaactgcacgttcatacaataatgtgtatgtcactagaaaataaacttctaattctaattctaactatctaaaagttgaaaccaatttgagaaaaaaatggaaattctcagtggaaatctatctaaaaattctatagctagtttggcgcggccgcgtcgccgctttcgcagcttttatggaaatgacttctagaaaaatgtgaagatttcccttgcacgtttcaagattatttccgatataaaacctgttataatctgtccatataattagttttgtcctctaaatccttgtattggtcccacattgattgctccttataaatatgtattcttttcacctgcaaaagatcattggctgtttgctgaaagaaaagaatcacagtgatgtttggttatagcccacgtcgatttgacaatattataatctggtgccttccgtccgggtggtcggcgcgcccgaaaaaaaatattgtatgtggtttggttaaagcccacatcagttttatattattacaatctgtataaaattgaccagctaaactgttgccagaaagaaattgcagtgntttgnttggttatagcccacataaatttggcagcattataatctg

SEQ ID NO: 7473 - DNA, 1889 bp, Triticum aestivum
  unsure (1)..(1889): unsure at all n locations
  Clone ID: PAT_TA_7473
ccccgcgtccgccccggtcctgggcctcctccttccccctcctccccctcccccccccccgccccgcagccctccgggaaccacctccagccgcagctcttgaggagaggagaaaggattcgatggcggcgtcggcggtgctggcggtgctgctggcgtcggcgctggcgggggcggcggccggcggcgacatcgtccaccaggacgaccaagcccccaagatccccggctgcaacaacgacttcgtcctcgtcaaagtgcaaagctgggtgggcggcaatgagggcgacgagttcgtgggcgtcggcgcgcgcttcggccccaagattgtctccaaggagaagcaggccacccgggagccgctcaccctcgccgaccccatccacgcctgcgcccctcccaaaaacaagctggtctccggaggcgtccttttggtcgagagggggaaatgcaagttcaccaagaaggccaagctcgccgaggccgccggcgcttccgggatactcatcataaactctgtcaccgagctgtacaagatggtctgcgaaaagaacgaaacagagcttgacatacacatacccgcagttctcttgcccaaagacgcgggccaggctctgcgttcgcttcttacagctaatacatcatcagttggtgtgcagctatactctccagatcgccccgtagtcgatacggcggtcggtgttcctctggctcatggccgtcggcaccgtcctctgtgcgtcctactggtcagcatggagtgccagagaagccgttactgaacaggaaaagctcctgaaggatggacatgaagtgtcacgattagggaggaggttctatggcgcggcgatcgtggacatcaacgtgatatcggcgatgatgtttgttgtggtcgcgtcgtgcttcctgataatgctttacaagctgatgtccgcctggtttatcgatctactggttgtcgatcttctgcatcggcggtgtagagggcctgcaaacatgcttggtggctatattatcaagatggtttacatctgctgcgggatcttttgtgaaagtgccgttctttggagcaatctcatacctgacaatggcaatatccccattctgcgtcggtttttggctgttctgtgggctatttaccgtcagttcccctacgcttggatcgcccaagatatccttggcattgcgctgatagtcactgtcatccagatcgtcagagtacctaacctcaaggtcggctcagctgcgcctgcccggtccgctcctgctgggtatccgccgccgggtggtcgcctcgcgtttgcgccatgagcgccggtgcgcgccggttgctcgtggtgacaataccgacgaagacggtgtgccatgctgctaaagattccgcggatgttcgacccgtggggcgggtacaacacattgggttggngacaccttctcctggccngttgttcattgcgttaagnatacgggctccaaaaaaaccgcatctggcactccgtggccggtcgccagggaccgctcctataaggggccaatccccataccctggacaatnggggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 7474 - DNA, 577 bp, Triticum aestivum
  Clone ID: PAT_TA_7474
ttttttttttttttttttgaaatttcaatcaaatttattactgcttcatcaaatatacatattacaatgaaatcattaagcttaatacttcagtcacgaggcatgaaaaaaaaagttgttgaatattgaaaacacacccaggcacgcacaagcacaccgacaagaaaatcatctgtttcaactttcagaacaaaggaagccacgtgaatctcaaacgaagcgataacactgcagacataagcagacagtaacaaacgagtagcatccgcggtgtctaattgactcctgcctccgatcctcctgacacattggggcctctcggtcgaatctcgacgtgctcctgcacggccggcaccggcgccgacttgggggcctccgccttgaccccagtacggccgcagccggcgacgcggtcgacaaggccgaaaaacctatccttgagctgggcggcgaagttggccatgatggtggaagtggagctagccgaagagaacagagtgccgtgcacactggctctctggaatctgaaccacgtaggtagctctagtgcttgatcttggtgggcgcgtgccctgca

SEQ ID NO: 7475 - DNA, 1021 bp, Triticum aestivum
  unsure (1)..(1021): unsure at all n locations
  Clone ID: PAT_TA_7475
atagaacagacccagaaaaactgattaataaacaatcaacaaacaggtgtgcatagcagatagcaccatgacaccacacttgaacattgcttgagtcttcccaaggaagcattaaccaaacatagaactaaataagacgcccggcaaacaagccgttagttttaatcataacgaacaaactgatggcacataacaccatgacattgacacttaaacatcacaccagtctttttaagagaacattaagcaaacaagagacaatgcaaacaagccattagttttgatcttgacgatgataagttggaatttcaatagaaaagagcgacgaatccatctgcatcaataatctccagccacttagtcagttttgccaaatagcttctcccggaaacacttcaatgccaacacgtcctcacatctcacatcttcagacatcctagttgtgtcttgcatcatcaacgagcggtatgtttctagcatgactgactccttgtgatcttttgctgcaaggcatggaagcttccgagcctcaagattgtgaaaggcttggcgtgttgttaaataaaccaaggaacccaccacgtgggtgagaatccactccccatgcttctggagtcaaattgtcaatatccctgtcccacaaggggccttgcgtctgggggagccagcatggtgtagaggccgctgctgcctttggtgggctggcgtggtggtgggacaaggtgaggtgccagcggcgggacgaggtgcagcgccgatggcaggattagctgtggcgccgacggcgggacgagatgatgcatcaacggcggaacgaactgaggtagcgatagtccctctaagaagctagctgcggagggatggctccgcatagctagttagcaggctgaggtctcgttcgttaacggaattaaccagacaaatcgctccaccaactaagaacggccatgcaccaccacccatagaatcaagaaagagctnctcagtctgtcaatnccttgctatgtctcctcgtgccgaa

SEQ ID NO: 7476 - DNA, 1435 bp, Triticum aestivum
  Clone ID: PAT_TA_7476
agatcaccacacactcacactgcgtcttggttctgcaatggaggtgaggtgcctgctgctcctggctgtcctcctcctggcgggggctcatggcggggaggcgcagccactcgtgccgggggtctttaccttcggcgactcgtcggtggacataggtaacaacgactacctccacaccctcatcaaggcggacttccctccctacggcagggacttccccaaccgtgtggccaccgggaggttttgcaacggcaagctggccaccgacatcactgctgataccctggggtttactaggctacccgccggcgtatctcagcccgcaggcgtcagggaaggaaccttctgatcgggcgccaacttcgcgtctgctggaatccaggcctagctacgatcacaccggcaccttatgtctcatgccatccctttctcccaacaattggagtacttcagagagtacctgtccaagctgacggcgtttgctgggagcagccaggccaagtccatcatcagcggctcgctgtacatcgtcagcttcggtgcaagtgacttcgtccacaactactacatcaatcctctgctcttcaagacccagaccgtcgcccagttctcggaccgcctcgtcagcatcttcgtcaacagcgtgacacgacttgacgccaggggagcgcggcgcatcgcggtgaccaccctgccgcgcctggcctgcctccccgcagcgatcgcgctgggcgggcacgggagcaccgggtgcgtgtccaggctctccagcgactcccagaggttcaacgggaagatgagcgccgccgtcagctcgctggcgaagcggtaccacgacctcaagatcgccgtcttcgacatctacacgcccctgtacagcctcgtcacctctcctggagatcaagggttcacggaggcgaagcggggatgctgcgggacggggaaggtggagttcacggtgctcctctgcaaccccaagtcggtggggacgtgcccgaacgcgacgacctacgtgttctgggacgccgtccacccatcggaggcggccaatcaagtgatcgccgacgcgctcctcgtcaccggcatcgacctcgtcacataataaaccacgcactggtcatctaaggtcatcggtcggaggacgacgatggcgcaagcttttcaggcgtcctgaggggaaaataatgtgtgcccagagctcccgttgccaagcgtgcccatgtggcgggaggggttactttctcgggctgtgccactcactatatcgccagcgttgtagctagggactgggacacatggagacatggcttatacctacgaaaagctcgaagttatgggtgcaagcactggatcttttcttttcttttttctttcatgtccttcaaatttgatgcatcaccgtgtttttttccccattgcatggctccgcttgaac

SEQ ID NO: 7477 - DNA, 654 bp, Triticum aestivum
  Clone ID: PAT_TA_7477
tttttttttttttttttttttccaaggtcggccatgccaaacagaataatcgaaccagattatggacttgttctacatgcggatttctgtatgtacatacacacagacagaatttatgcaggcggtctacaacagcaaaccagtcatacatggcatatctggtcgcaaacctttagccctaacccgtcatagcgtttcaaaatgacctagcccagatttacctgctatagatcaggttttaaaatgaaaatgcccgctcgcgtatacaatacataaatctatagaaagcagactaaagcaatgccaggcaacatctgtccagctgacagccttgttcaaatatggtccatgtaaccccgtcctgcacggttccacaacgccgagggcctgaggcagccatctgttcagcagccagacaaaatcaagagcccatagcccatgtcccaatacgacagcatccgattagtagcaacaggcaacatcctgcttcatcatccttcttccatgctgcaccactccacgcaaaaagctgcagacaccaatttgttctccttaggcttgtctcctcggatcattggacggattcggccccctgatcctcccaaactgcaaattatctctagacctatcaccaggatgccccacatcattgga

SEQ ID NO: 7478 - DNA, 802 bp, Triticum aestivum
  Clone ID: PAT_TA_7478
aaaaaaattcaaattgcattcctgataacttcaaatgcatcaacatactgcaattttttttacaaatctacacatgaccatagcgccgacaaactcaaaatgcatcaccagcgtgtacaaaaattctgctccttgtacctccctcttcgggcgtggacttattcggtgcccctctgcccatttctagctcacattatttctgataatccatatttgattctgccatgcatagcagcagtcgaacacactcaacaagcatgacactagaggagttctactgatggaactacagccgcacacattaagttctacatatttctagccttgacagacagggtcctgcaactgctcacatgccagtcatccgcaaatcacccactttgtggcagttgtttcgcctgtgaccttcaattccacaacttttgcaccttgctggtttccgaacaggcttcggggcatcaccacggtccgggcaagtcgtccgctgctggccccccttccgacttgtgctgcggctccccgtcctcttgctctgcccctcgttccgccccctctcccggccggccgttgcgcaccccagctcttcccgtttcttgggcgcctacaaaccagccagtctgcccccactgctacccccagtattagcctcgtcattcccttcgagtccagcctggagtttttggatcaatctgatcaatagattgcttagatgcttgtggttcatcatcgctcccggctgcgagtgccccatccgccgcacagatctgcctctcgccatgggggttagcctcgtgccgaattc

SEQ ID NO: 7479 - DNA, 553 bp, Triticum aestivum
  unsure (1)..(553): unsure at all n locations
  Clone ID: PAT_TA_7479
tttataaccatttgcacatcgccactgcaggggaaataggacatccataagcacaacngaagaaccagaatgatggttctatcttgaaacggcgaggaggggaggaatgcgagatgtccagggcaaaatttgcaagtaggcatgttattatgttccacgtgcacttaatacactgcaatatcacggcctccgcgagtgcctcttcaactcggcatcattgccgcctagagctcgcaccggcgtggtagccctcacgctctagcagtaatcaggctgaatcctttggggccgtttgcgcggcgcggggcccggggggcttgctcccggtaccggcctttgaagatttctgctgctggtcatggtagaatgcagcatccagcgcctgtgtcatgggctttacgagttgagatatttcatgtcgtacatcaggctgtgctgattcctttatatcctgtaacttctgatatatctgtgtcattgcttccttcagccgttgaacctgtggaacaaccggagaagtgcgtaaacatctaagcaataatggtctggatgt

SEQ ID NO: 7480 - DNA, 879 bp, Triticum aestivum
  Clone ID: PAT_TA_7480
agaccgttccctacgggtgatggctggctctggcttcgggtgcaggtgtactcccgggtattttgttgcctagtgttttacctccaaaaatactccagccctccgttcctctcaggcaaaaaatggggggaaagggaaacctctccttgcaccctgtcggcctggcccctgcgtcggcccgaggtcgccccggcctctacacagccccctccctcgcacatgccctcccctgatcttggatcaagcaggattgcacttttcgagatcagagatgagcttgatcgagggatgtgttctttccgattgctgaacagtccgttcgctccagcaatactcacacaagcgagaaggcgtttcagcaccgtaaggatgcatcttcgactcttcatgacgctcaaactgacgcgtgaaggcaggagacataattctctcaattccacagcgcatgccttcaagcaagctttcgaatgtctgaaaccttgaaggtgcttcagaattgcaagacggatcaaacaagcccagaaagaacttacatttgccaggtaacctgaacatgagttctagacctaatgcgaagcttcatttcgacaaattcctattctttcctattctgtacactagtttggtaactgcggtaaacgagtttccctatggctgaatatgacctagtctacaagtacaaagtgtcatattcagttatcacagaccaggctgacagataactcaccaagcatatgactactggatggaccacagtccacagactccaaatatttacaaaggtggtctgtaccataactgaaaacttggaagaaggggtggtggtttcaatgttgaagaagcagtgtcaggataaccgaagaaccacggagtgccgtt

SEQ ID NO: 7481 - DNA, 622 bp, Triticum aestivum
  unsure (1)..(622): unsure at all n locations
  Clone ID: PAT_TA_7481
tgcatgcacccgaanattgctattgcttgtatcgcatacgaacgtgtaatcagtgtactaaaaaaccataagttctagctaaaccttaccttgctacagggcacctacctaactatctctctgtaaggctgtaacttcataagaccaacactagccctggcaacctacaaaacatctgatcttctacaaacatcaccgatccatgggtgttacaggctcaaaattctggttcttccctgtcctctgattcttggtcctcagggtttatgtattgcttcatgtattcttcctcgaccgtctctttgagaagaatcaatcgctggatgatgaccgggtcgctcatccttctggcatccatgaaatccgtctcctccttgttgagatggtacgaatcgagcaccattttgatccacttgtgcagttcgttgggagttgtgtaaagagcatcttcatccttgacttcgtgctcatctcctggggggaaagcagacgcgagagcagcaaatctctcttcgggatcttcaatattcagtaggtacttcagaagtttcatctctggaggtgagatgattttgaggctttcctttgcagttgtataaatatgatacattatatccttgac

SEQ ID NO: 7482 - DNA, 1355 bp, Triticum aestivum
  Clone ID: PAT_TA_7482
tgaaggcccgaaagcggctgggcgccattgtggcccacatcatctcggtccggcgcgagcgcgagcgcgggagcgacctcctgggctccttcatggacggccgcgaggcgctcaccgacgaccagatcgccgacaacgccatcggcgtcatcttcgccgcgcgcgacaccaccgccagcgtgctcacgtggatggtcaagttcctcggcgacaaccccgccgtcctcaaagccgtcaccgaagagcacgctgagatcgcgagggagaaggcgttgtccggcgagccactgtcgtgggccgacacgcggcggatgcggatgacgggccgggtgatccaggagacgatgcgggtggcgtccatcctctccttcaccttcagggaggccgtggaggacgtggagtaccaagggtacctgattcccaagggctggaaagtgcttcccctgttccggaacatccaccacaaccccgaccacttcccctcccctgaaaagttcgatccttcacgattcgaggtggcccccaagcccaacacgttcatgccgttcgggaacgggacccactcgtgccccggcaacgagctggccaagctggagatgctcgtcctctgccaccacctcgccaccaagtacagatggtccacctccaagtccgagagcggcgtccagttcggccccttcgccctccccatcaacggcctccccatgaccttcacccgcaaggacgacaagaacaaagcctgagccatccatccatccatccatccatcgcctcctcctcgttcccaaagggaaatcaacagcgcgatagaggcgacggcgtggcacatgcgagcgagctggatcggctccgtccgtgtccgtgccggtcgccgtcggaggggacacttgtagccgtgggcgccgcggcgggagcgggagcgggctggcggaggccgatcggagagagcacgggccgtcaaagtcctttgtacagattcttcagccaggaccatgacggctgggcgagacaagaccaagaaaaatcccactcttcaaaaacacacacacgtaggcattctcagctagggagatccggcgccacaaagaagtggcgccgaactgtaaaaccaaccattttttatccttttttccttcagatttttatttttttggcaacacctatactagtataggaggaggagagaagacagcagactgacaggccctgattgggatgtaagataggctgcccgcctgaaagcaggctggcagctaggccgaataatcaatggatcgatcgctcgcggcaaagggccaaaaggaggcccccgggagagcgacccctctgtattgtttgttacacgtcaatgcagc

SEQ ID NO: 7483 - DNA, 637 bp, Triticum aestivum
  Clone ID: PAT_TA_7483
cccacgcgtccgcccacgcgtccgcccacgcgtccgtgctcctccacccatccctgtctctgtctgaggcgattctttcttgactttaggtacctctcttcgctgtcgttatcttcggccccacatccccggaaaatcaatcaaagtgaacagaagacattcgtttgcaaaggtgaaagagaaattgacctggtcaaggaaataatgaaatgctctgattgaataatgtggaactacatacacatgccatgaagtgttaccacagcaagatctcgacaaatccacttgaatcttgacaccagatgatggcacattaacacggagacgacaatagtgcacagatgagcactaatacaaatgtcaaccctgcacccaaggatgccgaggagaagaaagcagccggctcgtcctcctcctcatcggagcacctggatgaagacgatgatttcttccagatcgagggaccggtcctcaatacccaattctccctggccggaccaaacctcgacggatgcccagacccgaaaaggatcccctcgtcagtcttcgcaaggacgtcaacattgcaaaccgactggagcgtcacgtcgaacgaggctctcttcagcatcaatgtcgggaacacgagcttcgacaa

SEQ ID NO: 7484 - DNA, 780 bp, Triticum aestivum
  Clone ID: PAT_TA_7484
tttttttttttttttttttaaaaaatgttgtctttttttgtcttttgaagtagtccacatatattggcataatttgaagtagtacacatatataaacaaatgtttcatactagtacacatcacacaagttcgtaaattcatacatattgttaacttatggaaattcactacttgtaaaacacgtgcacgtcacatagaagtccacatgttcgggtttagattccgggaggaggaggagggtcatcacttccactgcttcgagattgtatcagaacctataagagtttggcggccatctgcccagctgcctagtaagaatgggccaaaaagcaccagaaggcatggtgcgatggtcaaccagtggagacgcgggaccattactgcatataaactagctgaacaagccacgtaagcaaaccacatgagcttcttagtaaatgatatgtcctggatcgtgcatatcaaggcgacagcaaacgaggagcacgcccgctaaggcgtctgagatcaggaatgcctgatatgcaatcttcctagacatcatggcaagtccctcgcttgccagcatcacctttgtatcttacaggcagaatgaaagcagtgggcaaggtgactttgctaccccgcttgattcattaattgctccttgcttgacatcaccatgaatattttgaagacacatggtattttggggacggcctttcaacttaagcatccatacgttattccagtttatgcttttggcgcaatacgtattgatccacagttcccaagctgttg

SEQ ID NO: 7485 - DNA, 751 bp, Triticum aestivum
  Clone ID: PAT_TA_7485
gaacaagatgaagatgttactgggttggatgcacgagtcggaagtactagtgatcctgggagtagcatgaaatttgtgctggttcctccagatgatggtgctggcattatggggcaacaatattatgaaagcggacccgagcatgatgagtcatttgaaactctaagcaaccattcacactctgaaaaggttggggcagcatccccatattatgggtcaccgcttaaagtaatactgcctgagcagaaacctgatatgaaatctacaagatgccatgtggtaaagccaatgaagagtgtacaagcagactataaactttatgatgttgagttggcagtcgaaggaacctacaagggccaccgtgcacctcttgtttctctgacaagtaaatggaaccgtaaacctgttatggggtttcctgtacctgttgttgttttggatgatagttgtcctgtggaaagtagagataatcaccatctggcaaagaacagtcctacccacttgctaaagaggagcgaagttgcagaaccgcgccagccaagatcgtcacattcatctaaatcaaaacttggtggccgtaaaaaggtctcggagcatgatattgataagtcctggcggccacataccaagaaatcagcatcttcaccaaggaaaatgcgcaggctctcatcttttggcagcagccgtagagaaagctcaaacagaaatacttgtagttcgaaaaattggcgggccaactatcgcgtgcatc

SEQ ID NO: 7486 - DNA, 944 bp, Triticum aestivum
  unsure (1)..(944): unsure at all n locations
  Clone ID: PAT_TA_7486
cggtatgcagtttagtgaaccatcaacgtcaagaagttatcctaaggatcaggcagatgaattctcaagtcatgagaacattccctctagaacagcggaagaaaataaggagtcgccattaaaatctcaagtgctcatgcaggctgcagaaattgagaatttgaagcaagacaagctgaggctgacggaagagaaagatgggctagaaattcagagtcaaaagctggctgaagaatcatactatgctaaagaattggcagctgccgctgcagtcgaactaaaaaatctggcagaagaagttaccaggctttcttacgaaaatgcaaagctggctgcagactttactgcagccaaagagcttactgcatcagtcacaaggggcaatgacacaaaacgccgtgatcaagataatggaattttggttgaggagatgcagaaagagttggttgctagttgccagcgagaggctgccttagaagacacattatcgcaaaaggcccgaagggaaaatgagcttctgaagataattgatgatgcaaagtgccatgagcatgatttggaaaatgaactggaaaacatgtgggcccttgtttcaaagataaagaaagaaagctctcaggatgatttgttcgaatttaaatcaaagcaaaacggctttcattcatcgaagactgatactggtagaatcctaagtgatatggaagcttcaagatnattggaaatgggatggcatcagtactttggaagaagccaaagctgcatacaattttgaaagaaggcgcttcaaagagtttgnaaaccaatgtctagattgaagggtgaagattcaaangcttggaggttaaatcctttaggagcttcaaaatttcangtggaancactttccaggattnccaagaaaantgnaancaagtctatagcaagctctgttaagctaatcctnn

SEQ ID NO: 7487 - DNA, 1145 bp, Triticum aestivum
  unsure (1)..(1145): unsure at all n locations
  Clone ID: PAT_TA_7487
ctgcaggntaccccggtgccggnaatnntcccgggtgcgacccccacgcggtccgaggaaaaaaaaaatagcacaacgcatcatcccagacgccgacgccacccaagctctcgaactcgaagcgcccgccctcaacgccggcggcgagccgcggcggcgagcggccgatggggtccaacgaggcggacaagccgctgcggcggatcggcgcgtcgttcgagcagctcgcggccgtcgccaagcagcagcagcagcagcccgcgatggcggcgggggacttctcgcgcgcctgctccaacgtctccgtcctcttcggctgcctcggcatcgccttcaagttcgccgagatggactacgtcgccaaggttaatgatttactggaggcatccaagacgatttcgacactgccctccatggttgagcttgacattcagaagggcactgtcaggcaggcggggagccatacgaggaatctactcagggttaagcgtgggattgatatggtgaaagttctgtttgagcagatattagtcacagaaggcaactccctgaaggacgcagcgtcaaaggcttatgctcaggtgtttgctcctcaccatggctgggccataaggaaagcagttggtgctggaatgtatgccctcccttttaagtcacagctcttgaagaaactgatgaagatgaaaattcggcaagggctcaaatgcagagtttcgtcaggtcgtttggaccagtaattttttacgttgaagaccttttcacctccaagaatttagggttagactggtgagcgaaacctatacagagatttccaatgtactaatgcgactaaatggtgtgctgtgacctcaaacaactgtaactggttttggtgtttgagttcgagagttcagagttgcaacctaaattcaataagctgtgctaccgtggaggtttttgacggggtggatacgggaaccgttgttacaaacctgaaattccagcttatttttaagctgttaaactggaatgctaccctgcaatgtatgatgtaacaacatgaaattccagcttatctttaacctgttgaactggaatgctacctgcaatgtactccctccaaggggggggggggggggggggggggggggggggggggggggggg

SEQ ID NO: 7488 - DNA, 1821 bp, Triticum aestivum
  unsure (1)..(1821): unsure at all n locations
  Clone ID: PAT_TA_7488
atgatccgaaccgcttccacccagccgccgccgcagacctcccccaatcctggcctcctccacgccgattcaagcgacactccccacttccagatcaaaccctagcctgagaccccttcctcctcgatggccaacccctccatggcggccggcggcggggtgccgttggcggagggggtccgcgccgtcggggcccagatccgcaaccgcttccgtgtggcgcccgtcgaccgcgtggctgcggccctggcgacgcgatggtagcatcggccctggcggtgttggcggcggcgagccagcccctgagaaaccgcgagatcctcgacgctgtgggcaccaccgcggcggcgctaagcaccaccgatcacatcagcccagacgccgacgccgcccaacccaagctctcgaactcgaagcgcccgccctcaccgccggcggcgagccgcggcggaggccggccgatggggtccaacgaggcggacaagccgctgcggcggatcggcgcgtcgttcgagcagctcgcggccgtcgccaagcagcagcagcagcagcccgcgatggcggcgggggacttctcgcgcgcctgctccaacgtctccgtcctcttcggctgcctcggcatcgccttcaagttcgccgagatggactacgtcgccaaggttaatgatttactggaggcatccaagacgatttcaacattgccctccatggttgagcttgacattcagaagggcactgtcaggcaggcggggagccatacgaggaatctactgagggttaagcgtgggattgatatggtgaaagttctgtttgagcagatattggtcacagaaggcaactccctgaaggacgcagcgtcgaaggcttatgctcaggtgtttgctcctcaccatggctgggccataaggaaagcagttggtgctggaatgtatgccctcccttctaagtcgcagctcttgaagaaactgaatgaagatgaaaattcggcaagggctcaaatgcagagtttcgtcaggtcgtctggaccagtaattctctacgtcgaagacctcttcacctccaagaatttagggctagactggtgagcaaagcctatacaaagagacttccaatgtactaatgcaactagatggtgtgctgtgacctcaaacaactgtagctggttttggtgtttgagttcgagagttcagagttgtgacctaaattcaataagctgtgctgctaccgtggaggttcttgacggggtggatacgggagccgttgttacaaacctgaaattccagcttatctgtaagctgttaaactggaatgctaccctgcaatgtatgatgtaacaacatgaaattccagcttatctctaaggacttaaacaggaaagcaacctggaaagtactatgatgaagaaaattatggatactttggtttgatgtactaatccactcagatggtgtgctgtgtgagctgggctcagaaaacctttttctggattccgtgtttccaagtcgtaaacaattatataactttcgcgctacccctcctgggcgttaaaaaaagggggggggcccggtaccaatttgccctatatgancctattaccccgncacgggcgtcgtttanaactcctgacgggaaacctgggggttaccaacttaacgccttgcaananaccccttcgcaaacggggtatacgaaaagccgcacgattgccttccaacaatnccaaccgaatggnaatggaccnccntacgggcataacncggggtgtgngtacccactgccntaaattcaagccnagcccgnccttnttttcctcttcncang

SEQ ID NO: 7489 - DNA, 795 bp, Triticum aestivum
  Clone ID: PAT_TA_7489
cgagttttttttttttttttttcgtgtttttttttttttttttttttttttttcaaaacactcatttactcaaacctcttaatttcaaatgcccaagttgttgaattcaatatttgcagtaagcagatttcctatcaacaccaacaacaaaagggtcaaagtcaccaaaattgcacttggttgtagcatcaccaccgataccctgttgaaaagaatatatatctacaatgccaccataatattttccccgttacactttttaggcagatttcaacagtatactagccatattttgtacccattagactggcgaatttcttctgtatatgtattctaaaccaatatgaagctcgtcgtgggaactccaggttgctaccaactatagaacatcaaggcaatggagacagtaatggttaagaattctctcaacaagactgttggattcaggaaccagagaagatgtaatgctgttccagaagtggaaagtggtagagtagtcaaaatcctggaaaacagagcatcatgttgtgctctttcagccgtactgtcgggttctgagaagtacctactgatatccgtagaatttatggggtggagtgtgagggcgcgttcccacgggctcccatggggctccccagttggttctctgcccggctgatttcttattactcttgtcataagttcagcaccattccactgaatgagagtatcatcatatgttgaataccattccttcaggcactcgagcaagaatgggcctctgtttttcaaatgccaatacagcaccactgaaac

SEQ ID NO: 7490 - DNA, 774 bp, Triticum aestivum
  Clone ID: PAT_TA_7490
ttttttcggggtgtttgcttgtggtgcctgctttaaactcaagtttaacattgtcacatgatttccataattaagattcataattgtgatgcaatttcactagtacattcttctgagtttgatttctcccatatgcaacgcgagttgcacatgcacaatcaaacatttattttggagaacccactccatgcatgtgtcacttcaactccttggctttgccatgcctttggcagaaagacttgaccctctccatgccatcctcgagaaggcctggatcgacagcaaacgtaatacggagccagttcttcattcctagtccactccctgggcaaatgacgacggactcctcgcgggcgagcttggtgcagaagtcgacgtcgtcggcgatgccgtccaagcaggagaggtccagcttcaccatgacgaacatggacccctccggcttgtgcgggcaggtgatgcactcgatgccctccaccttccggtagcatatctccgccgccgacctcatcacgtccatggccttctcgaagaaggccttccccgtgttggcgaggatctgcggcagagctccctgcacggaacgtcacggcgtccaccgagatggcgcagtagctcatgatcgactgtagaacgttcttgtccctgaggacccccttgggatcggtggctgcgatccacccaagtcgccagccgggcaccatccaccgcttggagatgccgccgatggtcaccaccggagctatctcccccaacacgcccctcgtgccgaat

SEQ ID NO: 7491 - DNA, 1068 bp, Triticum aestivum
  Clone ID: PAT_TA_7491
ataatcttctatagcatgcaccacatttaacacttgcgatataatgaaaatctagctacttatgcaaaattctgctaatgaaccttgaacacaaccacaattttatctaggaattaatccaccaacctccaaattctgatagcctgctagtgattacttttttatgttaccaacctccaattgagtggatctccaaatgctaccagtaaacagcaatatcacatggcgcaagaacagtctgatcatgcagacttcctaaacccttaccacattcagctgaaagtacactcaagtttaagtcagttagcaaacccttccatgcaaacaaaatttcatgatccttggttagctatcaaccgcctagatgggcaagacctagaggttagagatcaccaaaaatgcttgctgagtcatgacaaaactgttcctctcgacatccagtgcttccagcgtgtctgatctcaaaatccttcaccgacaacacctcatacaatcgattggcatccatttgtaacaagatgggctcagcatcagcccacccctgaagctcttcactcgacaaccggtgcctttgctttctccgcatgcttcttgctagttctttgcctttttcgcttatccccattggcatcttctttcttttgctccgtgttctcagtaggctgtggcctcttcttcaaaacttcagaattgctgagtcgggaaccatataccatcttccggacaaagaagcccgcgacatctccattgtcacgcttcaggagtaccgatttttggagtcgcccactggagtccttagtctcttggccatctaattcatcaaaggctttatctgcctcatctatgtcattaaaagaaatacacgtagagtaaaactcgcctcgaatccttgaatcaatcttctcatcgatgctgggattcccagagaatattttaagcagctcttgacaaggaaggtacactggaattctatgagcaagcaacttcatctggtcaggttcaggtacactattctccgcaatttcgatgggatcattaaatccatgcttgagctttgcagcctcgtgc

SEQ ID NO: 7492 - DNA, 1088 bp, Triticum aestivum
  Clone ID: PAT_TA_7492
ccacgcctccgaggacggcacacgctccattaatacctccctccctacccccctcccccccccagtccccccaccccaccccgccccgccctcgtgcctctcgcccccaaccacccgcgcgcctcgccccgcccccaaccacccacgcgccggcagcgagagctaggaggactaagatggcggcggacggcggaggggagccggaccacctggcgggggagagggcgacggcgcagttcgacgtcgacggcatgaaggtcgcctgggccggctcccgccacgccgtcgaggtcgccgaccgcatggcccgactcgtcgcatccgaccccgtgttccgcaaggataccaggacgatgctctccaggaaggagctgttcaaggacacgctcaagaaggcggcgcacgcgtggaagcgcatcgtcgagctgcgtctcacagaggaggaagcaaacttgctgaggctgtacgttgaccagcctggttatgtcgatctccattggggcatgtttgttcctgccataaaagggcaagggactgaagagcaacagaagaagtggttccctatggcgtacaagttccaaataattggatgctatgctcagactgaacttggtcatggttcaaatgttcagggtcttgagacaactgccacatttgatccaagtaccgatgagtttgttatgcacagccccgtccggacctctagcaagtggtggcctggtggcttgggaaaagcttccactcatgcagttgtctatgctcgtctcataacggaaggaaaagactatggcatacatggtttcatcgtgcagttgcgaagcttagatgaccactctccgcttcctggcgttactctcggtgatattggtggaaagtttggcagtggggcgtataacagcatggataatggtgttctgcgcttcgaccatgtgcgcatcccaagggatcaaatgttgatgaggctttcccaatgcacatgggagggattgtatgggcactcagatgttaccaaagcagttgctatacgtgacattggtttatgtccgtcagacaatattcgtaaatgcttctaaggcttttccccgtgc

SEQ ID NO: 7493 - DNA, 463 bp, Triticum aestivum
  Clone ID: PAT_TA_7493
gacgacgccgatcgtgtccgactcgcggcccgtcatcctgttcgcggagttcggcttgtgggccgacgcgggggcgcaggtctccgtgtccggcgtctcatggagcgtccccgagggctccccgccccaggccgtcgatcccggtctaatgggcttcatcctcatctccaacaccctcttcttcaagatcaccaacgaatccgagtacgccgaggagaccgacagctccttctgcccgctcaccagcgagtacgtgatgccgctcttccggctcaaggacatcgggcgcgacggcgccggcgggggcaacgtgaccatcggcgacgccgaccagtacacggtgctgttcaacagctgccaggacggcgttcaagatcaccatggacgtgcgcacggagatgtacaacatgcccggccccggcggcgacagggagtacctgcccgtcgggctgcttccgctggc

SEQ ID NO: 7494 - DNA, 546 bp, Triticum aestivum
  Clone ID: PAT_TA_7494
tgtaaaaaacatctaaatgtgaatttgacaaactgtaagtgtaatatactgcacagctgctgttcaattgcagttaccgtccgtgtaggacaaaaataaaatctaacaacttccacacctcactacagcgtgcatcaaactactatcgctacattattactgctacattacacacagcaacaggatacaatgtcaatgccattgttgacatcatacgccacacaacaaaggggaaggaagctccctcccctccctccctccctcgctctatacagagaccgtctttggcttggcccccatcttcttccatgacacgctgggcatgatctgcgccgtgtctacccggtccttgtactggacggcgaagttgagcagcgagtcgaggagcgagtccgacagcaggtggggcaccagcccgagctccgacagcttcgagtgcttggcgttgtagtagtgctcctccgcctccacgcgcgggttgggcaccgacttggtctgcacgtccagccccagcttcgctcccgcggcggtcaccagcttggctag

SEQ ID NO: 7495 - DNA, 525 bp, Triticum aestivum
  Clone ID: PAT_TA_7495
ctacgcgtccgcccactcgttcgtccacgacgcggccccgcccccaatccgacccgaggcggctgtagactccatagagttgccgccgcgccctcagcgtccgcggctaccaatccgtcacaccggcgccgccccgccccaccccgcgcaaacccctccgcctctcacgcgcgtcgccgccgtcgccgttcccgttcccgttcaacccatcgcgtccctggtgtctcgaccccgtccgcaattttggccgttcggttgctgagatagtgttggagaaacttctgtgatcgtgtttttacatgtaaaagttaagggggggcaaacttatctgcaactgaaataagtggcgggataatatggttgacatgaacactgatcacatttttgaggttcctgacactcctgaccgagtacagcagtcagtgtgcgctgtatcaagctcagctgctacgagaggtgtaacaaggatggctggaaatccttcaccagcccggagactcaaatttaatatcaagaatatttcaa

SEQ ID NO: 7496 - DNA, 842 bp, Triticum aestivum
  Clone ID: PAT_TA_7496
ttccctgacatctgttttcggataaaaaacagaaacccagcagttaagaatctggacgcttgtggccttgcacataaacaagctccggacatcacaagaaactgaagaaatacagaccagcgcctgaagccgaacaacaaaaacagggaccccttgagtacatacatcaggttgacagaaaaatagggtcacgatgaacagcgcggcacatcatgatcatcagttagaaaataattcaagtgtgtcacaaaattcttcctcaaaactcaactgtatttctatactgtaaaactatatctgccctgccgaactagttaactgatggatggggagcagcggcgtacaggatttctgatctcatggcgcagactgcgctcgctccccggtgtgttacggtgtgcagaggtcccgtcctgggagagccaggccggccccttgatctgcttcaccgccggagccactagtcgatgttgttccgcgaaaacgacggcaacggtgcgccttcttggggccgtaggatgacgaggacaaggaacatcccgagcatcggcagaaccacgagccatttcagcagcttgaagtagtgcacgtggaaggtgagcgagtactcgtcggcgaaatgcagcccgtgtttgtccaccatctccacgagcacagttcctgtggttctgacgggcacggtggggagctgcatccgcttgtgtcctggttcattgtagacttgactgaccacaatgcgcctgtctccctggtaattcccggggacgagtagagttaccgtgaccccggaaggagcttggtcatagtttggagttagtaaaagtatttggtttgtccgtcag

SEQ ID NO: 7497 - DNA, 529 bp, Triticum aestivum
  Clone ID: PAT_TA_7497
cggctcccctagcttttttctccctcccttcctccaatggccaccaccgcatccaagtacccccaacactacgacgacgatgaggatgacgacgatgaattcgaggacgacgacgacgatgacgagccctcccgcccgctgcccgccggcagcgcggaggatcgcctcgaggccgttcttcgccgcctcacggcggacgaggtccggatccgggtgcacgacgtcgcgatccggggctgcgcccgcacgcgccgggccgccgcggaggcagcggtggggccggacctcgcgcgcgccgctaccgtgccggagctcctgcgtgccgccgcagcggccggtgagcggctccgtcgcctcggcgccttcgaatccgtctccatcaccctagacaccgcgccaccgggggtccctgcggacgcgagaggcggcgccgtcgtcgtccttgtcgacgtcacggaggctcggggccgcgctgccggcggactcggcgtattcgccaacacggagactagatcatgctcagttgaag

SEQ ID NO: 7498 - DNA, 690 bp, Triticum aestivum
  Clone ID: PAT_TA_7498
aaaataatattgtcctcagcatgaaggggaactccagatctaaccatatgatacctgatactgaatctatccacctaatgacacctgaggcggtagcaaggaagacactataagctgagaaaaaggagacaacttataaagttaaaagaaaacatgtgcacacaagtcaccaagatagaacccgcaaggagccattcatgacttgttctaaggatgctctttagcctccctttcccccctgtgctggggcgcctcccccttccccatgtcggacggcgggtctcagaacccgtcaaccgccagaaaataagcggccctccaagccctggcgaagaacagtatgttacaggcggccaaaaccccgaaagcgaatcccgcttctgcgatgatgtatgtcattgcgggcattgtggatatggtatcggtgccatcattttctgttccttcaaatgaagcctttccgaaagcaggggccattccgacggaaggcatagtgcatcattgcccacggaaactctcatctgtgaatgtggaaaattggccccctgttgggatatctccagtcaggttgttgtacgagacatcaaacttggagagaaatgacaactttgttagagatgttggtatgctcccactgagataattgtgggttaaatttagctcttccaagttttccaagcttgataactc

SEQ ID NO: 7499 - DNA, 650 bp, Triticum aestivum
  unsure (1)..(650): unsure at all n locations
  Clone ID: PAT_TA_7499
agtatgaatncaacattgttataatgtgttggcttttacaatttnagcaaataaggagcacaaagcaaaacttgattgcaaaatctggtgacccctaacatggatctacttatgcgcaagcgctggcataggatgcaacaacttcatttgaagtcatgatctgacaatagggtgcacgtgcttccaaccataattggcatggtttggttttcgggatgtcttgtcaaccaatatagtctggattgaacagctgttggcttgatagcacaagaacatacgggagggaatcctcgtcacgctatctcaacccctgatgagatacacagcttggaatcagctccaccacttatcacgctgtctcctttccaccaatcggcgcataaaaccttatctttgtgggagtccacagaagccagaggccaagctgttcttagatcccacaacatcactttcccatcaaacgaggatgatatcaaatgaaaccaggaacttggatgccatttgcaggcggagatccagcttgagtgtgaagagaactggaaaataggagcctgtcgttccaggtttgcggggatcccataccctcaatacagggtcagaaccaccagctgcaatcagtgaagagcccgtcgacgcggccgcgaattcgg

SEQ ID NO: 7500 - DNA, 693 bp, Triticum aestivum
  Clone ID: PAT_TA_7500
atgaaagccctccgctggattatttataaataaagagacatagaatacctgacacacaacaacaacaatcaaactgaaacttgggacatgaacaactctagataggcacacacagacacacacaccatgcatatatatagaaaggttgaaaatgtaaaacacacaactaagcatcggcatttattattgtaggtagtaagccatgccgccgatggtgcatgcagtaacttagccacttaactaggcttccttgaggtcatccttgcgcttccagcggccatcagcgcccttaaccatgagcttcttcttatcggcccaccaatttgctggcaccccaaactcatatttcagtgcgtcggcactcttgttcaccaacgcgatgtcacgatccacctccagccagaaatccttgttgccatggtccccggcaacgccgtgcagatagcactcaaggttgtggtacgtcagcacgttgccaggacgcaagaactttgaccggtccgtattgatgggcagcgtcgccgtcgccacgtccacgtactcaaaatcttccggtggtagtgtcgggactatgtcgtttttgttcttcacgtggatggcgcggaggagatcgaacgaggcgaagacagatttgaaactatcatttccgacgcgcgggcatgcgaacaggaaggcagtcatggggcacggcgg

SEQ ID NO: 7501 - DNA, 691 bp, Triticum aestivum
  Clone ID: PAT_TA_7501
gtgtgtgttctcgtcctaggaagggcgtccgtgggcggcagcaagcagccagcagggtgcgatcgatatggcgtccaactacaagatgaaagggttcttcaagggcttcaagatcatctcccagatcttcgcggccaaggagcaggagatggtgatcggccggccgacggacgtgaagcacgtcgcgcacatcggctggagcagctccacgccggggatgctcacggggaatgcttctccaagctggatgaatgtcatcgaggggtcgtctgacttctcgtccttgggctacttcgcgccgtccgcagggacgtcctggacttctcaagacttcgagcagcagcaccaactcccacgggacatgttgcctctcgggatagcttcagagatcaccggggaagacgtagcggcagctccacgccctgatgttccacgcccgccaccgagaaagacaaggcgaaagaagaaaacaacggttggctctctagtagattcgtcaatgccaaatgattcatctacatcaggtctcgaaggcagctacagccgttaccgataccattgacaccagtggcgtgatgcagtgacaggcaaggctgcaaagtgtgtttgtaagtgtgggtgtgcggttctaaaaaactgagaattgtaaatgtattgatttcataggtagctgaatacaatggattgttct

SEQ ID NO: 7502 - DNA, 720 bp, Triticum aestivum
  Clone ID: PAT_TA_7502
gggaatcaaagacgaccaaaataatcccatcggacatccttggtgctgctcatgtcagcttggccgcggcgcaggacctgctcctgcccagtgtgtgcagtcctactcctggtcatctcgagcctggcctcccctactgcacagcgactcgcagctgtatctcttggtgcccctctagcacccctttgactcttcctctcacgcggactcctgtctgaagaaggcgggccgtccctgagtcaagttcgcgctgcccctccgatcttcactcgacagttccaagtgggtttttcgtcgagggtcatcgcgcgttgtgggggtctcaggtctctggccccccgtggcagctgccctacggcctccgcggccgctctttcccagccggagcccggtttgcggcagcagcagcagcagcaccggagcggggcgcccttgctttatctaacagaacttcagcttgaggatgggtggtaaaagcggcatgtaggtcgagtgcattctcctcgtttaaaatcacggcaaacttcaaccttgtcatgtgccacctcagtttgtgaatcagggtgtgcaaatctacatgattctctattgcacattttcttcaagtagtccctgcaaacttccactgtgttcttgttatcagcaaaacctctaggaggtgagagaggaggagccatcataggtacgcccagtggtggtggtggtggtggccatgtaaac

SEQ ID NO: 7503 - DNA, 700 bp, Triticum aestivum
  Clone ID: PAT_TA_7503
gggtttgacgaagcataaacatcacattagcaaagccgcaaataactttagtgcacgttccaataagctcaaaatatccaacgttccaaataattctggcaacctaatggtcgttccattgcttttgctttctcccacagttggccgagagcgagaggcctagaaacagggtgcacgagcaatcagggcctatcaaccgatgattccaccagtgatcaatcaacatactccaggttcccgtggacctgaacgcgcttaataatcatcggcacgcagctcagctaagctagccatggcggggccagactgaaccatacacatccttcttcgtgtacctccgatcccacgaccatgggacatcttccgggccgtagagttgtggagggagttgatatggcactggcaatctcacaacttctgcagatggatccttttcttcatcgcctttccagcaaagtgtcaccagcttgggcttgatgttcttaccaagggcaagtttatccaggtttgagcggctcttgtctgtgcatgaaaattgtggaacagactggagagttttgggcaagaacaatacacctaactcatatgatcgtatcatcagctgtgtattgttcttctgcagtgctccccaagcagctttgcttaaatttgatgaggtaagcagaaaccatgcaatattttgaccattgtagcgagtaaa

SEQ ID NO: 7504 - DNA, 499 bp, Triticum aestivum
  unsure (1)..(499): unsure at all n locations
  Clone ID: PAT_TA_7504
tgaaaccttcaggcaaccgggagtagaccttgttcnangngacctgcattatantcatcaggatttgatgaactagccngtgngangcggactttggtacatacccacaaattantgcttgaaaagtaataaaactccaattggaagatcccagagagcatggttatgcaggggttacttaacacactacacttagctgctaagtatatgaaacaacaagtaaacaatagtactacaaattaaggccatagtgatcagacactcaacagacaaaaggttaacattcttgtgtatgcattgatatcccccctcctctggagatctcgatcgacgagatggatcgagttcttgtaacacatattgtagtgatgaagaatttatacatccccggccccatttcaccatgcatcaatctaggtttgcangaacaaagctagctagatctagctagctaattaccagctgcattgctagtgcttggaatagaaattgaagccgc

SEQ ID NO: 7505 - DNA, 672 bp, Triticum aestivum
  Clone ID: PAT_TA_7505
tttttgagaatcatcggggaaggagtccttccacctgaatatattattcaaaatggcctttatgcctgaagagtgatccagtttataagggaaaccggatcgaaaacctaaacaagttgacccgtttataagggaaaccgggccgaaaaccgtacaacaaggttacaaggagaagagaagaacaagacactcaacaagggcaggacctagctagcagactaaaaggaccatcactatgaaagacacaagtagttgtggggtgtcgtcgagggatcccaatacttagactttgcgaggaacctaacgcaccgcattccgtgcataccgagccccacggcacaactcaggagcatccacaaccaacgagtgcaaaaaacacgaaccttgactggatgccccgtgatggaagattggaacgattaacaatttggggaggtatctggcgtcatcaaatagcaaagatgaaccaagacatcaccaagagcatgacgcttgccgcaacacatcgaccgccaagggagagtcttgagcatgcatagcgagacaccttcacgagggcgcgtcccgtggccgccctgcggcgcccaaggcactgccaccaaaccccaaagaacaccaccagacaaccaccgtcgactccaagccagtcgcaccaccaccagcaccattgga

SEQ ID NO: 7506 - DNA, 533 bp, Triticum aestivum
  Clone ID: PAT_TA_7506
agcccgtagggccttagacgaacgaaaagccccagatactccagcctcccaattcggccacagagtacttcaacctccaaattccccagtctgtaaccggtacctgcaacgccggctacgactacttttcatcattcaccttccgtggcccattccaaactacagcgcggccggttcgcaacaagagacgtcatgtccgcctccgccgagacaaactccattgtcatcacctactaaccttttgtgagccaaccaacccctgtgcgacccggggtggcgaggagcgccgtcatgagcgctggcgccgtggccctggtgcatgcgcagcagcgactccccgcagaggctggtcatctccaccggtgaccttaggagcacgcggggagcagaggccgggagtcgcctcgggagcggagctgagccagcgcggggggcggccctggcggcagccccgcggagagaggaggcagcagatccggatcggaggaaggatcttgcggcggcgacggcggccattgcggcggggtgcgtgc

SEQ ID NO: 7507 - DNA, 374 bp, Triticum aestivum
  Clone ID: PAT_TA_7507
gtggcatctgccacagcgcaagcatagctgcgaccttggtatctagcctcttgcaatttttcttcagcttgtagtttgggtaccggcggtgttaatttttgttgcatgttctactgtttcctgattctcatggaggtacaaatatccaatttgaaaagaaaggcatttgcctccaactaccattgtttcttgacgtggtttctattaattgaagcaaggttcattctttaattgaggttgggaggtggaagcgatccacgtgaggccgcaaccatataagtgagatctactcctatgttccataatgtaagagtgttttggatactagtgtattataaaaaacgcttttatattatgggatggagggattagtt

SEQ ID NO: 7508 - DNA, 289 bp, Triticum aestivum
  Clone ID: PAT_TA_7508
gacgcacgagggcttaatttccgtcgctagctagcaattgattagtatcaataagatctaaggtgcactggtagttggattttggcttcaattgactcaactgcccgatcgatatgccagcgcgtgggctttacttgcgttggctgatccgttcatctcgtgtgcatttctctgcatgtattgctgtgtgcactggttggcctggatgcccggaccggagcacacgcgacctgcctatgattaattgtgttgtagaccacctttattaataatgctgaatcgcaatcca

SEQ ID NO: 7509 - DNA, 721 bp, Triticum aestivum
  Clone ID: PAT_TA_7509
cacgcgtccgcccacgcgtccgcccacgcgtccgagcggcttcagctccctcccctccatctccagcaccgcccctccgcccgcccgcctgccctccctctccctcagcatcggcaacggcagtgccgacggagaggaccagcagctgggcctcagcagcgacgacggccacaggagcatccgggcgatgaagaaccgggagtcggcgctgcggtccagggccaggaagagggcctacacgcaggagctcgagaaggaggtccgccggctcgtcgaggacaacctcaagctcaagagacagtgcaaactgcttcagtcggagattgctgcactcaccgcccagcaggcaagcaacaagcagagcagcccgcacaggagaacttcgtccactcagttctagcaacgctacatcaggatgcacgagggttgattttcatctacgatctgcctagctagcagttggttagcattacaagatgcactggtagttggtttggcccttaattagctcagctgcccgggtcgaaatgccggcgcgtgggcttagttgcctcggctgatccgttcatctcatgtgcgtttctctgcatgtattgctgtgtgcactagtcagactggatgcttggaccagagcacatgcaacctgcctgcgattaattgtgttgtagaccacctttattaataatgctgaatcgcaatccaattgtgcttgttagcttca

SEQ ID NO: 7510 - DNA, 890 bp, Triticum aestivum
  Clone ID: PAT_TA_7510
gccggccgggctgcgacctgtagctcctctgttccatccagttccactgcacgtctacaccacaccacagcgcgcacaccacacgggcgggcgtagatagggatgtcgtgggaggagcccggcagcccgcagctgcctcccgcagcctgagcggcgccagctccctcgcctcgacctcgagcacggcctctccgcatgccccccgccccccccagcccagcctcagcggcttcggctccctcccctgcgacgccagcccggccgacgccagcgccgacctcccctacatctccctcaggatcggcaacggtagtgccgacgcagcggatcaccggccgggggagagcagctacacgcgcgagatcgagaagggggcgaggcggatcgtcgaggcggcgctccaacccaaggcaaggaggaaagcctatacgcaggagctcgggcgggacatccgccggcacgccaagaacaagcccaaactcccgcaacggagaaaattgctccactcagttctagcagcgctcaccacgcagcaggcaggcctcaatttgcgcagcccacacgcgagtagctagtccacacaattcttgcaaccgctacatcatgggttcttttcccccttgcactcaactgcctagtcgtagtagtgcccctgtggttggttcttggcctcaatctactcagctgcccgatcgatttgtctgcgcgtggtccttttatctcttgtgcacttatctgcatgtattgctgcacacactacttgcctctggatacttgtgctgcagcacatgcaacctgcctgcgattaatcgcgatgcagagcacctttattaataatgctgaatcgtagtcctgcggagaacctttattaataatgctgaatcgcattc

SEQ ID NO: 7511 - DNA, 695 bp, Triticum aestivum
  unsure (1)..(695): unsure at all n locations
  Clone ID: PAT_TA_7511
cctgtctgaaaactgcncaaaatgtgctgttctatgtgactggtcttacgcgggccccggcttcttcccgccgccccgctcttccgcttccttcgcggcgcgcgcgcggcatcatcgcccccgagaccgatttgtgcaaccggattccgatccattacactattaacatccaacaaacaatgctaccgaaattcactctccatcttcagctttacttgtgcgatcatcccccttcaggcgaaacctgaatttgcccgttctgcatatcaggaagatgaatgttgtgatcatgaagcatccttctaacaatggggcagcacgatgaactccgcgttgataagtccaccgtggaataacaggttgtgcactgatcgaagcaaatctctgatccccttcttcacccctgaacagattcctgacggacccccaaaacgatgatttcttccctgcggaagaatgatggcttctgtttctcaagtttccttgatctatagtttcatcaccaggaactgaaatgccccgagttccctttaatgcagcaagatcttcaacaagtgaacgtgcctggtcactgatattcttcgggatcttcacctttatcacaaagttgtggtctcctctatggttaggtctcttaatgtcccgagcttccagttgcacaatcttcaacttctncccaggctgagttncagggg

SEQ ID NO: 7512 - DNA, 789 bp, Triticum aestivum
  Clone ID: PAT_TA_7512
gttatatataaacgaaaatgactaataggatggcagagcgccgacagagcaaaatttcattgtctccaatatgaacatactgtgtggctatacatacattatccatcaaatggtaatgtagaagagatgatacgagcaaacaagcgctcagatggctagtctcttggccggtgagtagagcgacacggccccaagcttgggatttgcgtacttgttgtagaccaccttctgcttgctgctccccgctgccgtcgagtgcaggcttgccagtcgccttgcgcactgcatcaactgcgactcgcctaagccggtgtggtgctccaggatgtcgctccatcccggactcatgttcagggtgcaccgagcagtgtacacagccgctgccgcagtcacggatggcgagtacacgagcatcgagtagtccaccagtgcgagctcagcataaaaaaatgccatgttctccagctccttgtcgcccatcgcagctttcgcatatcgaaggaggaacacatacaccgtcggaactgttaagttccactggagcttgtttagtatggacttctccgtgcttaggacctgctccctgctaaatgcattgtctgataggaccaaaagctccttaaccagtggagcccatatttcttcatacttgcatgatataagcatggcgcttacgccaacgagctggagctcctttctcagcacattctccatgggataagtactgatcaatgatgtagaccgtgagatataaagtctctggcataagcataagcctgtggtgcactt

SEQ ID NO: 7513 - DNA, 841 bp, Triticum aestivum
  Clone ID: PAT_TA_7513
gccggcgactccttttgaagtcccgagttcgggttaacccgagcggttcctgatctgccaagggctgatcggcctgcgcataccttgctcctgctattccgttctaagcccttttccaaacgcagatcacaagtttcaggttggcaagagatcctaagcttcattatccaatcaatcaaaacgacgaacagaaaccaaatctccaccctatgattcatctgtgcagaactactacactcctgcatctgctgcaagcaaaggagcacaaacacacaccaagagtgcgatcagctgctacaataagaatccaccaggacctccaatccacctcatattagctgatgatgcgtgatgagaaccagaagaccacaccggcgatagccatttaaatctgacctgctcaaatccccttccgacatacaacatcatagggatctccacattccagatccaatcctgcaaccaatgtgtggaggaacacaactaaaccaaacaaaccgttgatagaacactgacctgactcactgtacagagatttgcccataagcacaaacttcctaaatatggcctgcagtcgacaggataagtgtacagataacaaattgaaacgcatagagatagattgcaaaccaaacgattttaacagatttcgactcactgccaacactctctgggctaaaataaatctgcaatcacaggggcagaagcaaaaaagcctaaatcaaaggcatgaacaaagtagctacgtgatataaagaaaaagaggcaagagttaaaaatggaggagtctctttttttgtttggtaggttttggccaagtttgaagctccattcgtgaacc

SEQ ID NO: 7514 - DNA, 729 bp, Triticum aestivum
  unsure (1)..(729): unsure at all n locations
  Clone ID: PAT_TA_7514
ttgggaaaaaactttccgatgaacaaaacggagtcctcaaagtgagaaataatctgtccaatctacaagcaagattacagttttgatctaaatagctaaacctgaatcaataatataaaacttaaatgcaaggattctagatgacaaaagggcgtgcatatctgaacaaaaatgggattctttgtaacttcaaaccatcctcgcatactttggttcgatactcagccaatggcaggcccaaagattctacaaggacatccagcatcattctgttggggattttcaccgatggtggagtagcctcaatagactgttgtgtatcctcagactcagtgtaatacactgcatccgagggaaactggctctgcatttcttctatgcttgccacttcattcttttgtttctgctcacttgagcctggtcattgttatcatccttttcttcaacagtaggtgatgaagtttcagctttaccacaagagctcaccttggctgttgcaccaagcctctccatcggccgacatctgtccagctggggctttaccatcggcactcgcaacgtccgtgccaccctccccgacctcgcacacatgtgtatgggtcggcatagcgcatngagctacccacagcctccaaaacaggtataacaccggaaacaagcatacacatccttgatgagtcaaacgacagtgacagaagaaatcatacaacccgaggcagnaagcataag

SEQ ID NO: 7515 - DNA, 1157 bp, Triticum aestivum
  Clone ID: PAT_TA_7515
gctgtacaaggcagcttggctaaagggttgctgtgtctttttattccgtgttgtgcgccagggtcagccgtccattcgcaagggtcactctgcactcgccgcgtcatggtggaaaagtaagatcgatctgaccaaaatggccagcagaattgttggacctcagtttgatgattggggagcggcctgtaaatggcttaacatggcataaatatattagagggagtgtcgtcaaaggagggttcaccatgcacatttggattgtcatccgagggattgccttggctacccacttacatcaccaaacagattctatgtgcatctgcaatagactttcagcacctcttacaatacagaatcatttaattccctgattttgtggatgaaaaattcggtgagcaagcttaagctttgctacaacgttgcttgtgtctctaatattaacgcgaagggcatgaggatctagagtccataggcatggatccctctgcaatcgccgttgtttgttggtaaaggaaagaccaatctgtgcgtcatggtcactcccatgggatgggagggagctgcttggaaggatctcatttcgtttcgggctcaaaatcccaaaacttggatgatgggaagcctgacctgaagtgtgatgatggatcagatgagcagcccgatggtggcgccgagacggttgatccagattgtgtgcctgagagtaaagcatcagaagacatggatatctcagacgtcaaggacacggagtagctcggtttgacgccaatgcaaggaggcatgttatatctcgttacgatgatgcagcagagaccgctacctggcttacgagttgatgattactctaatgggagtgttgttgccatcccttggttcttcatgtagggattctatcctattgatttgccatgaaaaccacaccgcatacatggtgctagactgctaccctgctgcccccctgtaacgttctaccagtttgtttttggtgtgatgttggcacacaactgtcaaacggaacttcgaacatgagtgccgacaattctaatttgtttgagacataaaaaacctgtgatggaagtgcatgggttagtcattccggtgatggtaggagaaactgtgccgtatccggaatgtttaatttcaaaaaaaaaaaaaaa

SEQ ID NO: 7516 - DNA, 619 bp, Triticum aestivum
  unsure (1)..(619): unsure at all n locations
  Clone ID: PAT_TA_7516
atgctctcctagatcggtagatgacatggctcacctgacggcactactcctcgcgtccgttctcgtcttcgtcttgagcgcgacacccacgctaagcattatcactggcggaggcggtgcgacagcgaggcagagtaccagcctcaaccatggcgccgctcgaacttacgtagtgctcgtcgagcctccggcgcacgcgcaccacgacgacgaagccgcgcaccggagatggcatgagtcgttcctgcggacggggtcgcgccctggcaggaaggccggcggcgaagcacccaccattcgccactcgtacacgggcgtgttttccggcttcgccgcaaagctgacggaggacgagctcgcagcggtgtccaggaagcgcgggttcgtgcgcgccttcccggagcggagggtgccgctcatgacgacgcgcacgccggggttcctcggcctggacgccaagcaaggcgtctggaacgccacaaactacggcgagggcgtcatcgtcgggttgctcgacaccggcatcgccgcctcgcacccttcgtttggagacgagggcatgccgccgccgcctgccannnggannnncaagtgccaggcccccgtgcgttgcannnnn

SEQ ID NO: 7517 - DNA, 942 bp, Triticum aestivum
  Clone ID: PAT_TA_7517
gttcgcggttttttcttttgtctttctcctgctaacggacttttcccacgttcgagttactctttgcatcccccataccctgctgggcttcgaccacgcgggctccctggccgactggagcaatcatatccttcgcacgatctgatcttttttcttcttcacaggacaaaaatcattaagtgacattcacacaaacccctacgatagaatgtacaccgattatcctattcatcccgggttatatccgataaaggactatagcctcaaatcagtcactcaaactccgcacggattctgccacgtgtagtacattctcgagtgaagcaatcttatcctactcaacatgtaaccgtcaatcttgcttgtcgctggagttcgtgtcatcagttgggccacaccactgtttccattagcctctcacgcatgagctccaagttctcattcgaaatcctctcctacattttcgtatggtcacatttcttgatccatctgccgtataagtgaaggcgcgtgaccatcaccctctctgccaggtcctgcctctccttcgagagcgctcgcaggaaatgtataccttcttttgcgtcattgacgacaagataattataaagccaagtgtatgccggcggattcatctcatacaactgatagagtaccgtctgtgtggccttgtaagtgaagtaattcatgatttccaattccacgtccccgaacccgtcttcgtactgcccgccgaacgcgcccgccatgcccgggccgcgccccccgcgcccccccgcccgccggcgccaccccagcccgcctccggctccggccggtccccgggacggcggccgcggagagacggacggcgcagccccggccaccaccggcgtgacaaccgctgcggcctgggcgacggccatcgcggcgcagtcgcagaaagcaagaggacggcgagat

SEQ ID NO: 7518 - DNA, 779 bp, Triticum aestivum
  Clone ID: PAT_TA_7518
cttggcggtgccggtgggatagcgcccctttattttcttgtttggtccattcttggcacaagtgtatgcaaggctttttacaacgtaaaagattgacaccgagcataataaagactaaaagccaaagaaaaaagactacttcgacgcgccccgagccgaagccgcttgcctcgtcgtcgttggcggcagcgccaacccgcgagagctgtcgacatgtgactttttggcatcggcatcgtgctggttcaactccttgtcatcctcagtctcaatctcctcaaagagctactcccgtcgtgcgtggttgatgatggcgcaatggctccgcaccaacggtagcatcatcccgttctcatcaagcccatcgacaacatgtgggcaccagcaccacaacggagctcggtggcccggtccccgggggcggtgaagtccgaggaaaccgctaggctcgtcgtgcagaatgacgacgagatgatcgggtgccgacagagtgggcacgataatagcgcctgttgggttcaccaatgtgtagctggtcaagcaaatgtacgtggcacacatctcatgcagaactcatgtttgcatccttctgtggcaacagagctatgtaagcagacagcacatgggacaatacgtacaggtgacttgttcaggtaccttcaactcactccctgcgaagcaaaaatgccactaactataagatagatgatgttgccacttaccaatataaacattggacaatagcttaatatgacagtctgttaaaaaattgcagctct

SEQ ID NO: 7519 - DNA, 663 bp, Triticum aestivum
  Clone ID: PAT_TA_7519
cctctacaacctgcatcggcgggtacttggggcctgctcgtccttgccgtggcctgcgcctgcgcgccctgcgaccctcccccctgcggcgtgctcccttccccgccgggtctccttgccccgtactttagcagtgcaggccgctccccccctcatgtccttgtcgatttcgggcagctgcacggggtagcgggcgatgcactcggcccacggcccgtcggcgtcgccggccggcttgacgcactcccacgagacactgttgcagtcgaatccggcaccgaaggagatcatccacaccctgtcgtccttcttcatccggcccttggcctccaggtacgccagctcgtagaggaccgagctgctggatgtgttgccgaacctgtgcagcgtcatccgcgacgcctcgacgtcgtcgtcggagaggccgaggccgtcctgcacctcgtcgatcacgccacgcccgcccgcgtggatgcagatgtgctcgaacgcagtgcggaagtccgggcgatacagcctcaccttggcgcgccctcttaggagcctccgtttgagcagggacagcgcgacgaggagctgctccgtggccggcaggacgaggggcccgaaagccgcgatgttgttcttgagcgcgtagccggcagtggtggcgaggtccttgga

SEQ ID NO: 7520 - DNA, 815 bp, Triticum aestivum
  unsure (1)..(815): unsure at all n locations
  Clone ID: PAT_TA_7520
aatgagatagcangattgagacaaaatgtacagcacgacattacaaagatctggcggcagccatgcacttgtaaaaatgatgagtattgaagacaagatcgcaagaagccaagcaggcccctacacgaatcaatttcctaacagagtacacagagagtacagaggagaggagccacaaccgtatcctgcatcagtagccgttgctgcggcgtgaaccccacatgcgcgcccactaacctcagcgacaatgccatggcaggaggagcatcatgccaagcaccacccacatggccacctgacctccctctaaccacgagattagaaaccccaacggctacttccgccacccacttgcttggcgggcacatgcggctgaggcgccaaacgctaatctgaactaagaaaagaattacagaaaaaatggtactaagagtacaagctactgaactgaatctggcatgacgaatgccggctgagggacgccggagctactacgccggggatggctgggtggtcgggtcggcggaggaggggatgtccgggccgacgcggcagccctcgagcatgaacaccacgtcgcccatcgccgggcgatccagcgggtcggacgcggtgcagagcagacccaccttgatccccagcaggaactcctcccactccgacgactccgggtccagctccagcagacccggctccagcagctccgccactgccccgcactgcagctcccgcttcacccacttcacgatgtcctcgtcctcgccggcgaacatgccggggcgccggccggtgagcagctncagcaacacgatgcc

SEQ ID NO: 7521 - DNA, 634 bp, Triticum aestivum
  Clone ID: PAT_TA_7521
taggctgtatagcatggcgtgccgccgcgggctacacgctagctagtaattaacacaatgagtctagccgttatgatcgcagggtattttccttcattccttatccacgcacccaccgtagggcagaggacccgttgcgctcgacttatttcaccatactcacatatggggacagctcatgtactgaatagatatttcacagcattgcaccatcaaatagcatactagttcttctaaaaataggatggcatactactcatttatctgccaacaagcgactattttcacatgcaaatgggtttgtcccaaggagcataccaacagtaaccacgcaggcgtccaccacctaatgaacaaaagcacttcctcaagacctgcctctcccatggttttccctgtaaatttggattgtaccattccagtgaattccaacgtggctcaatttttatgtcgcatgtgtagagtttgtaactctgagtacaatggcacatatgggagatatcgcgggtcgttgtctcctccaagatcgcagatctcttgaacttggtgatgatccatatcataagataccaaagtattatcccaccccacagttaagaagatcatgttacaggggggatgctttgcaacccac

SEQ ID NO: 7522 - DNA, 1026 bp, Triticum aestivum
  Clone ID: PAT_TA_7522
ttttttttttttaaaaaaaagtaatatctcatattgaaatgcaaatgtacaaaccttccatgacacataagatacatactttgctttcaatccaacaataagtgtcactaatttagtacaacttcatattaattttacactaatttattttgggacgaagagagtacatgttatccatcaaccacaactgcatcctttgtttccttgaaggagaactcacctgtcttatgttaaatgttagagaccatttcatatccacccgatctcctcctctgcgcaggaagcgatgcggtgcctccgagccgctgctgcaagaacaacaacaaggccagcagcactgccccgcaaggtataaccacgtcccacgcgatgctgaagaggtcgccatgggggctcgcgtacaggtgcgacgagtgcatgctcggcttgtagacatgggctctgaccacatcgtacacatgaggcgccacacggaccatggtgccccctatgtagaaccatggcgagatcgctcgtgctctggatcctcccaaggacgcgtttaggatgacctgcgggaggaggaagccatccagtatcagccccgcgtatgacacaaggtcctcccagatcgtcgccggccctccacccatgctgatcattgacgggtcgccgctcatggcaccggacgttgatcctgtggattatcgcggcgaaggctcctccgagcgcatacaatggtaggcatatccatagcacggtcctctcagacacggtggatgtgtggcggctagaccatgctagctgaagaaggcgcaactgcagcacgaaggcgatcagcgtaggcgccctcatcatgacctcgttcaactctagcctccggctcgtggagtagtagaagtcatagtactggttcctcctgcttgcaaacagggcctcggagttgagcgcgagaggggcgagataccccatggtgaccacggcgagcaaggtgatggacgtcgccgcagccgcctcggggttcctctttgtgtgaggatctgcagg

SEQ ID NO: 7523 - DNA, 708 bp, Triticum aestivum
  unsure (1)..(708): unsure at all n locations
  Clone ID: PAT_TA_7523
cttttatgtagtnccagtgacaacccaagtttgcacagaaaatctgaagaaaagatattaatctttttatgtctatcgtgaccacaataaagtgctattctctcagtgtcctcttcagattctgtctgagcagaggcaatctgcatacactatctagttatctatggggaggttgagggggtaagacatacacctaagtgaaacctacatccatacatcacatgctacaatcacttatgcgccgtactgtatttagtctgtgaagggttgcattctttgttcccagctgccatggacaggagctccgctgcgcagcaagcagagcgccatcctgttgttcagatgatgatccctgtagtgcagttactaggaacgtgaggccacaacctttcttgatgactgagattcagagtcagaggtattgatccttgatcgtcttcaagagctcttcaaccctctttataattttagggttcatcaggtcccttgcctgcccaaggagagtgccctccctgctgctataatatgcatcgattatagcgcttgcccaagtgtgcaacacctccggactcgtgaataaggtatcgacattctcgccttgaagttcaggaccaggagtaaaagcgtcattcaacgcactcaggcgttctgctggatcctcaatcattataagatgcttcagtattctgatgtcctttggcatttgcc

SEQ ID NO: 7524 - DNA, 1480 bp, Triticum aestivum
  Clone ID: PAT_TA_7524
cgtccgcccacgcgtccgcccacgcgtccgtgtgatggctcttgaaggaggttataaccttaagtccatagcaaactcactttgtgcttgcacaaaagttttgttgggagataacttcacatataactctccacggatgcaaccatttgaatctacatggagagtcatacaaatggtacgcgatgaattaaaggcatactggcctgttttgagcagcaagcttccggataatgtacctttgaggagtgcaccgtcatatatcgagccatacgcatcctctggttctgagtctgatgttgaagatgttagtgagcttcctgatgctatttcatctgtcaatggtactcaagttgttgatgatgttttaagtaaacacatcacaatgttgaaacttgacgaagataaccttgcgacgaagaacacctcaagtgattcagttcaagcccaagacgacggacctgttgtggcgtctacaagaatatatgatctaccatttacttggagatcagcattgtcaaaagtttatgtttggtatgccagctttggttcaaacatgtggaaaccaaggttcttgtgctacattgaaggggggaaggttgatggtatgagtatatcatgctttggttcacatgacacaagcccaccaagaggtaccatgtggaagactgtgcctcatagattgttttttgggagatcttctaccccttgctggggtaccggtggtgttgctttcctcaaccctgagataaactacaatgatgagtcatatgtctgcatgtacaaaataacgcttgagcagttcaatgatgtattgtttcaagagaacaggttagtgaaggataacagcgaagatggaaaacttgagtctcccagctctcctttgattggcttgtccgaaatagagtctgtctcttcaaacaaagctcttcatcttgaacctatcaaggatagctggtactccaatgtacttcaccttggagaggaggacggccttccaatcttaactatgacatgcccctcaactgctgttgcgcagcacaaatccggcgagctgccattagctcctccatctgagacctactccgccactctgatcaagggactcgtggaagggaagcagctggacgccaacgaggctgccaactacatctcctctgctgccgcaagaagcctgtgaacttgtggaggctgcttcgccgtgtgttgtgtacagccagtgggaaggaaggaattaagggattgtgcgtagtaggcatgtaaaaatgtagtttgattcggaaccaggggagccgtagaggcctcattttgtgccaccattggatctgactatgttcatcagtaggatcgtttggagtttgcactggtttgacgactattctcatcagaatattaaatgtatgaactagtttgagtagcaaaaaaaaaaacttgggactgagttgcccctgcaggtggtaaaaaaaaaaaaaaaggcgggcgc

SEQ ID NO: 7525 - DNA, 1016 bp, Triticum aestivum
  unsure (1)..(1016): unsure at all n locations
  Clone ID: PAT_TA_7525
aattcggcacgaggcagaggtgccctgccgtcaactttgattgcgattacgcctatgttcttggtnatgtatgctatcacatcatagctgctggtctgaatggctacatggccactgtaactaatctaaaaagtcctgtggaccagtggaaatgtggagctgctcctattacgtctatgatgacggtaaggggatggtcgcgcggtcccactgccagtcaaattgggaagcccgctgtccacatggcaagcgtcgacttaaaaggaaaagcatacgagctgctgaggcaaaactcttacagcctcctgatggaagacatctacaagaaccctggaccgctgcaattcgaaggaccgggcgccgacgcaaagcccatctcgctgtgcgtggaagaccgggactacatggggaggatcaaacagctgcaggagtatctggagaaggttaagaacatcgtcaagcctgggtgctcgcaggacgtgctgaaagctgcactgagctccatggcacatgtgacggagatgctgaccatcatgtcttctccgtcttacagtggccaaggcgaccatctgagagcaaactcggagcgttccatatgccggaatcccacaggcataattttccttttgtcggccgtagaaaccgggatcttgataggctctgttctttatctgagttttagactgcagagtgtggcaagtttggagattgggatttgggaagagttagaacaggaataattgcccacttttatggcagaaatcaacgtcaatataaccagtgtgagttagaagctccggataataacaacaaatactgtgtaaatggtaaccctattttttcttctctgatataaatgcaatccttacccgctagagaagcggcttgagtcaaaataaaaaggcaaaaaagcaaattgaaaaaaaaaaaaaaaaaaaaaaaaaaaaaaaaaaaaaaaaaaaaaaaaaaaaaaaaaaaaaaaaaaaaaaaaaaaaaaaaaaaaancnnnaaaaaaa

SEQ ID NO: 7526 - DNA, 673 bp, Triticum aestivum
  unsure (1)..(673): unsure at all n locations
  Clone ID: PAT_TA_7526
ntttaatatttcaccgtttattgcaaccatcgggagnacagataaattggatgttgagcatctcttcccgcgatgttacaaaccaagggaaacacgcgagttcagtgttcaatgggttcacaccatttttacagggtatatagttgcacgtttcgttatcaaggaccatatatagcccactgggaggttaaaaaagataaaacccagtgtgcgttatttgcatacatcatcagattctgcagcgtgtagccagccgatgacgcggtgaccgcggcagcaccgcttcactcacaagatcagtggcatacaatggaccaagtatattggtaggcgggtttaaggatcacacgacttcacgttttagggggtctcaggctctgatgatgaagtatattgggctctcctttccagccggtagccatcaacatatgctacaggaacgtgctgaagcttttcccaattgggatctccaactgttctgcatgaactcatcaacatctcattggagcgactgagtttgaagcactcaagagactgcggcagcgttggaagcgaccgaatattcctgcagcccttgaggcccaggtccttcagtgacgtcaggtgctccatttgatctggcaaggtgtcccagctgcaaccgaagatatagagtgaacggaggtgggagcaa

SEQ ID NO: 7527 - DNA, 1353 bp, Triticum aestivum
  Clone ID: PAT_TA_7527
gtgctagcactagctggcctgcttcgcgtgagttcatccatccatccaccatggcctccgaccgcctcgccgccctcaaggccttcgacgagaccaaggccggcgtgaagggcctcgtggacgccggcgtcaaggccgtcccggacatcttccgccaccctcccgacccgctctccccgtgcaccaaggtcgccgccatcccggtcgtcgacctctcgggtccccgctcggaggtggtcggcgcggtgagggaggcggcgcggacggcgggcttcttccagctggtgaaccacggcgtgcggaggcggccatgtcgggggttgctggcggcggtgcggcggttcaacgaggagcccgcggaggccaaggcgccctactacacgcgggacgccgcgcggcgcgtgcgctacaactgcaacgccgacctcttccggacgctgctgggcaagtggcgcgacaccatctacatggacgacgtggaccggctggcggcgggcgaggaggaggaggtcctcccgccggcgtgccggggcgtcgcgcccaagtacacggcgcagatgcggatgctggggcgcgcgctcttcgagctgctgtcggaggccctgggcgtgcggcgcgggtacctggaggaggaggccggctgcctggggacgctcagcgtcgccggccactactacccggcgtgcccggagccgcacctgacgctgggcgccgtcaggcacaacgaccccggcttcctcaccgtgctgctccaggacggcgtcggcggcctccaggtgctcacggacgtcgaggacggcgaagggaacgtgtccgccgcgtgggccgacgtgccggcggtgccgggggcgctggtggtgaacgtcggcgacttcctgcagctggtgtccaacgacaggttccggagcgtcgcgcaccgcgtggtggccaacagcgtggggccccggatgtcggtggcgtgcttcttcagggccaagggagctacggtgtgcgccccggtggtcatggacgggggtggcctgccgcgctaccggaccgtcacggcggaggagctgctccgctcgtccgggaagcagaacgggctccgtgacgtgaggctctagccggcgagcctcaagaaagcagagaggagagacgaggcgtgaatgcttgttggaacatggtgatgaaatgcttgtcgatgaagttggagccttgcgtgaatttgcttatctttgtctgaaaaataaaaccaatttgcttatctgctcatgcaagcaaaattgttcatgactttggaactttgcacgagtttgttatctgttcatgcaagaaaaaatgttcatgaaagaagcaaactttgctgaccgatgc

SEQ ID NO: 7528 - DNA, 624 bp, Triticum aestivum
  unsure (1)..(624): unsure at all n locations
  Clone ID: PAT_TA_7528
gggcgccaccgtcgaagccgctgccctcgctgaagccgaaggatttgggccaacagatggtgcatcaactggcagtctgttccccccagatattacattttacgtggatggaaaacctattgaagctcatcgggtcatcctttgtgctcgatcgcccttctttgaacagaaattcgagacagactggaaaaacaggaaggaagtgagattttctaataaaaaattatcttttggtgccttgtacaaccttatccatttcttctatgccgatagactcgaggctccagtagatgaaatggaaagtttgtcacgcacttgcaaagtttgcaagtgtgaggagttgcgtaagttagttgataaagaaattctgcatcttaggtttgcactgtataagtcaacaagtaagttgggtttggaaaattcacaagagtccgagacggttcattttactcgggcaagtcattgccacgaagaagatcgtcttccatcggcattgcggcgtgttcttcaaaaatgtctagctaattcaagagaagaagagttcaaaaaaactctagcaaatgagatctgcagaaactggaagggatgatgatcttgctgatctcactgtaaaagtanatgata

SEQ ID NO: 7529 - DNA, 649 bp, Triticum aestivum
  Clone ID: PAT_TA_7529
cccacgcgtccgcggcttttactgcgccctccgagcaaaccagagaggaggacagagcacacgacgcgcgcaagagagagacactacggcaatggcggaggggaagctgctgctgcggtcgttcgtggaggtgccgagggactcgcacttccccatccagaacctccccttcggggtcttccgcaggaggggccagcccgagggcccgccgcgcccggcgacggccatcggggacttcgcgctcgacctcgccgccgtctccgccgccggcctcttcgacgggcccctcctctccgcctcgccatgcttccaccaggaaacgctcaacatgttcttggggttgggccggccggcgtggaaggaggcgcgcgccacgctccagaaaatcctctcagctgatgagccggtgctgcgtgacaacgaggccttgaggaagaactgccttgtgccaatgagtgatgtagagatgcttcttcctatcacggtaggagactacacggatttcttttgttctgtgcaccacgcaaggaactggattcatcttccgcggaccacagactccagtcaatccgaattggtttcatttaccagttgggttaccatgggacgggcatcatctgtaatcatatctggaacagacattattcga

SEQ ID NO: 7530 - DNA, 1563 bp, Triticum aestivum
  Clone ID: PAT_TA_7530
cccacgcgtccggcgcccttggagcaaacaaccacaaaggcacacgacgcgcgcgagagaggaccaagtcggcaatggcggaggggaagctgttgctgcggtcgttcctggaggtgccgagggactcgcacttccccatccagaacctccccttcggggtcttccgcaggaggggccagcccgagggcccgccgcgcccggcgacggccatcggggacttcgcgctcgacctcgccgccgtctccgccgccggcctcttcgacggccccctcctctccgcctcgccatgcttccaccaggaaacgctcaacatgttcttggggttgggccggccggcgtggaaggaggcgcgcgccacgctccagaaaatcctctcagctgatgagccggtgctgcgtgacaacgaggccttgaggaagaactgccttgtgccaatgagtgatgtagagatgcttcttcctatcacggtaggagactacacggatttcttttgttctgtgcaccacgcaaggaactgtggattcatcttccgtggaccacagactccagtcaatccgaattggtttcacttaccagttggttaccatggacgggcatcatctgtaatcatatctggaacagacattattcgacccagaggacaaggtcatccaacaggaagctctcaaccttatttcggtccttctcaaaagcttgattttgaacttgagatggctgccattgttggaccagggaatgaactgggcaaacctattgatattgctgacgctgaggatcatatatttggcttagtggtaatgaatgattggagtgccagagatattcaagcctgggagaccatacctcttggacctttccttggcaaaagcttcagtacatctgtatcaccttggattgtgactctggatgccctaaagccttttgcctgtgaggctcctaagcaggaacctgagcctttgccttacttagctgaaaagaatcatataaactatgacattcctcttgaagcttggattaagcccaaagagcaaagtgaagcatcaattgtcacaaagaccaatttcaaacatatgtactggaccgtgacgcagcaactagcacaccacaccgtgaatggatgcaatctgagaccaggggacatgtttgcgactggcaccctcagtggacctgaaccagactctctgggatgtttgctggagataacgtggaacgggcagaaggagatatcggttgggaattcgatccgcaagttcctccaagatggagatgaagtcatcttgacagcctgttgcaagggcgaggactacaacgttggattcggaacctgcaccgggaagattctgccgtcgcttccatgagccaaggcgggggatgatcttcagttcttggagcaggcgcattgaagggcttagcagtggtggtaaatagtagtaataaaattaagggatgtatgaattccccccctagtgatgtgataacttgattacttttagccgcacttcctcgatgatatcgtgattctaccatatcgttattctaaaaaaaaaaaaaaaaaaaacttca

SEQ ID NO: 7531 - DNA, 806 bp, Triticum aestivum
  Clone ID: PAT_TA_7531
ctgtgcggcgctcaggcggcaggtctcaaacaatgatctacagggtctctggtttgagagagattcatcactcttgatgttaccatccatgaatgataaccttctagatcatcttaaaggcaggggagtttcaacagttctgagcttgctagatcattctcgtgaagaattacacaagttgcttcaaccgttttctgctgcagagttgtatcaggatctgcaacatttccctcgccttgatgttaaagttaagctacagaatgaagataaggagcagtcaaaacctcaaatgctgaacattagaatgcaaattaaaaatacacgtcgttcgccaagagtattttcctctaaattccctaaggcgaaacaagaagcctggtggctggtcctggggaatactacaagctcggagctatatggtctgaaaagaattagttttgcagatcgtgtgcttaacactcgcatggaattgccaccgatgttaaatatccaggaggcaaagctgattgttgtgtcagattgctaccttgggtttgatcaggaggtctccctggggcatttagcgaaggtctaatccagatattcaaaatcaagcatgctcccatgctcatcagagccgtctggatttcgctgttgaggtttacctgagtgtagctaacaacatgtctcttttaatgcttatatatacaaatctattgtgaggtggttttgggcctcctacgatttgtacacgtctccttttacttttccatatgccgtaattgatatccttcacctcgcgaaaaaaaaaaaaaaaaaaggcccta

SEQ ID NO: 7532 - DNA, 742 bp, Triticum aestivum
  unsure (1)..(742): unsure at all n locations
  Clone ID: PAT_TA_7532
ggggggagcacatcaaattctatcaaagagcttatcagcaatgctactctgaattatagtgacaaccggataaagaagcctaaggctgtactcatcatggacgaagttgacggtatgtctgctggtgatagaggtggagttgctgatcttattgccagcatcaagatatccaagattcctatagtttgcatttgtaatgatcgttatagccagaagctgaagagccttgtaaattactgtttgctactcaacttcaggaaaccaacaaagcagcagatgggcaagaggttgatggagattgccagaaaagaaggcattcaagctcaagagaatgcaatggaagagcttgcagaaagagtacatggggatattcgcatggcactcaaccatttgcaatatatgagtctctctcagtctgtggtcaaatatgatgatataaggttgcgtcttaatagtagctcaaaagatgaagatatctctcccttcacggctgtggacaagctttttggttttaatggtgggagactaaggatggatgagagtaccgtccggagcatgagccctcccgttccccttcccctcctttccccggaagtccttctcttttttcggccggctgccgctcggacggttgtctgtggtcctaaacgtttgagtttgcgtgcccgtgccgctgtggctttccccaatnaatttttggcaaagtgttgggtttggaaaaccgacctaatgttaccccaac

SEQ ID NO: 7533 - DNA, 722 bp, Triticum aestivum
  Clone ID: PAT_TA_7533
ttttttttttttttttttattacgataagcttaaccaaatcattttaactgtccgtcatgacaaccgggaagtacacatgctaaacggtaagtaaatgatcgatgttcgaagataacatagatatgcccgtgttctaattgctgacgcactgtatatgaatatcatacatatcacgggcagggcacagtatcacgagccaggatcgatcagaatgatcctacggagcatatcatctgaacgtatgtaatgcttagtcttcttcccctcaattttctccttcatttctcgacattcttttccgccaccatcttcagctttgcttggcctgccttgtggcgtctgaaggcgttatctgtcccgtacagataatcgcaatacgtgaacacagttgcaaagttgctctggcagttccctcccaagtagtggtggtagtcgtggaactctgctcctccccagagcgggataagctttgtcgggttgaacgggaagttgtacccgcagtgggtctcgatggccgaaatagccactatcacaaaccagatgccgaaggtgatcatgtggcaaggcgcgatcaccgggccgacgacggtggggacggtgaggatgagcacctcggtccagtgcatgtatggcgcgacgaagccgttgggtgcagtgtactcatggtggacgtggtggatgttgtcgtagcaccacttggtgtgcatcagctcgtgccgaa

SEQ ID NO: 7534 - DNA, 820 bp, Triticum aestivum
  Clone ID: PAT_TA_7534
tttttttttttttttttttaggtgaagctattttccccgtgacaagagacggatatttcccgcggaagccaccagatcagaatcgtctcccacaattttacatggcctctcttatcatgtctggtacttttgcctgacctgactaggtgggaccatctggtttacatattctacaacgaatgccatgcaagactaatgtccatcaaaaatgaaactacaggctacagacttaatggtttcagctcacaaaagcatggccgtttcacagttccaacaagacagacgaaaaagaaaaacaatggatgaccagttagatcaagctcgctgtttcttcccgctgggtagatcgtcgtcataatgcccttcacctccatctttatcgcccttcttcctcgccaggatcttgttgatcttgttgaggtcgttgctgagcttctgatccttgttctgcttcctggtcttcctgccatcctgcatcttcacaccaaactggaatgccgcctttggcatggcttccttctgatcgttgtatttcgcccactcttcttccgtctcaaagtcccaccggtgaagacggcccttcgcccgtccacccatatccatctttgacaaatcatcttcatcgtcactccctgcaatctcttgattataaccctggtaaccaggataacactcagagtaactatctgaaataaaatttgggtctttctcccgcgcatctttttccctcagctgcttaagcctgtcatcatcacgcttgaagacagaacctagacccttatccttgtctgcttgagtcatcaaccttggatcctgagat

SEQ ID NO: 7535 - DNA, 793 bp, Triticum aestivum
  unsure (1)..(793): unsure at all n locations
  Clone ID: PAT_TA_7535
nnatttantcccgggaaggggnanttttnaanttgganttttaaggcaaccattttttgttggcaaaaacggaattttacatcccagctctaatctagcttatcttgggggcaatgggcanggggaaccaggggaggcaaactaatttacaaaggggaactgtgacaaggttacagttgagggtttcattctcaggttgggatgaacctaccaaaaccggcagaggggcactggttcaatttgtttttcatgtaaaagacccaagtagcagccctagttcaaaagttttataggacgggtttcacgggtcgacccaggccgtttttgaacacccttagttcagggggttcagtcactcaagccataaactcgtttggccgagtcaagtgtgttggcaagaagcattgcaatggtgactggtcccactccgcctggaactggagttatagcagaagccacattcactgcttcttcgaagcagacatctccggttaatcgatagccaaaatcactggctggatcctccactggatttgtcccaacatcaatcacaactgcaccttgctttaaccaacttcctcttacaaggttggctactccagcagctgagatcacaatgtcagatccacgagtaatctcctctggattttctgtgaaggcatggataacacttacagtagcgtgatgtctctgtaaaagtaaggaagtgggtaatccaacaactttgcttctcccgataatagtcacatgctttcccatgagatcaataccagattggaacaacaattcaagg

SEQ ID NO: 7536 - DNA, 871 bp, Triticum aestivum
  Clone ID: PAT_TA_7536
actctgctcccgcaaagggtcaaaattaacaacataagcatcagaatatcagatacaacagcaacagaaaaaagtgatgaaaattcgatcaaagaaaaaagtgatgaaatgtaccaggcaacatgtctctaaagttctagctaggtttccatgtggatagggcgccgatgactctgcccttccaaccctgcagcatccacttgttatcttcgtcgacgaagaaatccctgtggtagctcttgattaccttgtatcttgcttttttcaccgactcttgaagcagaggtacctgcctgaaccctgccctgaggttccttacctgccattgcttgtaggtctccggcctctcgaccctctccgtgccctcacaagcgaccacgttgagaagctcccgtccgaagtattccctttcgatcagctgcctgtgctcatccaccggcggtgcggtcgcttcgagcatgtcgtagagtgaggagaaatagaacagagcctccttgaagcgcgtcacgaagaatggcgcattgtaggtgccattgacaaccgcgtggatgaaccgatgcgggttcatcttcctgatcgtgttcaggactgtcttcctcgggctctcatcggtcaccgtctcgtccatcatgtgccgcattctgaacaagcagttgacaataagaagatcatccttgtcgatcctgaggtcttcgactcggatggcatcccacttggcagcaattgcgcgatactcgaaggggacatgaaacatcttggcgtactcgcttaaccgccggcccgtcgcctctaaacgctctgcaggccggaaccctggctgcggtaagtcgatggcggtgatgcggattcttggggggccgccatctccctc

SEQ ID NO: 7537 - DNA, 591 bp, Triticum aestivum
  Clone ID: PAT_TA_7537
gtccgggcaactccacccccaatccccaaccgtaccggcggcggcgagcgccgcgacgaacccgcgcagcgcagcccaggcgccatggccgcgccggaggcacccacgtgctacgtcgggatcgcgcgccagtccgccgccttccgcctcatgaagcaaatgggatgggaagaaggtgaaggcctcgggaaagacaagcagggtataaaggggcatgtcagagtgaaacaaaagcaggacacactaggtgttggtgtggacaatcctcagaacaaatgggcgtatgataccacccagtttgatgatatactaaagaaactgaaagtgcaatctacaactcctgttaaagaaattgaggatgtaagcagttcacctgacagtacacccaagaaagataaacctgcaaaagatgaagtcgctaaagttacccggcctcaaggaagatacaagaaaagggagagggggaaaagtgtgaggggttattcagcagttgatcttgaaggcatacttgttcggaagaaggaaaatgattgcaaggtggatcaggaagttcaaccatcatgtatggaagagcctgatatcaccatcggc

SEQ ID NO: 7538 - DNA, 651 bp, Triticum aestivum
  Clone ID: PAT_TA_7538
gaaagcccaagatccgatgcggatcgggcgtcggcggcgccctaggcaccgtaaccttcctggaggcgacgccaaggacattgggatcggatggaagggtctgcaggtgaggggtgggggtgtgctgcctcccttcggtggaacggtgtttcgttctacatattcttggcggcggctcttggcggcatggagcagcggaggcttggcgtcagatgtgtggtgacggacacgcgcaggaggtcgacgctgtctggcgtcgtggtggcgtcggcggcagcgagaccgagcaaggcagttacaacagtacagctctgaagttgtacaacaataagaccaaagccaccatcttcgcaacctctgtcgctacgaggggttattcagcagttgatcttgaaggcatacttgttcggaagaaggaaaatgattgcgaggtggatcaggaagttcaaccatcatgtatggaagagcctgatatcaccatcggccagggtgcagtatcccaagctgaagatgtgaactggtgggggcacaagtttggatatgtatcaggaggctttttaggagcaaaatctcgcaagaataaaaaagataattctaatgtccgtcagatgtttggggaagatgatcaagaaaatctgtacaaccttgttc

SEQ ID NO: 7539 - DNA, 500 bp, Triticum aestivum
  Clone ID: PAT_TA_7539
cgctcttgcagataatgaaaataacccatccgaacaaagaacaagtgccaagcaaatggaagacaagttatcaaaggttgtggaagtctttgttggaagaatcaggaaaatggaaaacgactatatgagcttgagcaagagggcttcgatgctagatgtgcatctggagtgccaggatttggaaaggatttcaatcgtaaatcgtctgggaagattccatggccgaaaccatgcagctggtgtcgaggcctcatctggctcacaaatggtttctcgcagaattttccctgatagacatgtcatgtctttctctgtgccaggaaatcttcccgaagaggtgcactgtttggcactctagtgcatcgatcttggattgtccctcaaacctctcctcagatcacctctgtggctacaagtgtgattttccaatgctcctttttctcctgcaaagcatggcgtttatacagaacggtcagatccaggggtggtttggaaatccc

SEQ ID NO: 7540 - DNA, 1186 bp, Triticum aestivum
  unsure (1)..(1186): unsure at all n locations
  Clone ID: PAT_TA_7540
ccacgcgtccgatcaaatgcaagcaatgggtcatgtggatgttgatccaggcaataaaactggaaagatgcttaaaccaaatgagattagttctgacgcgtcgcaagttgactggaagtctgctcagaggtttgcacatggagccactaactcactcaggtcgtccatagataacattggcagtactagtgtccaagggtcattcccttcagacatgaaaatgctaagctttgctccatggcgcggtcgcggccgaggtacaagcataccttctcagatcccttctagggaagttctctctcatggtatggtcatgcgtaatgatcatcaaagtcaagttcagtctcttgggacaaatgcatcatccaatttgattgaaagaagtgagagacctgggataaaccctcaaatggcaccctcttggtttgaacattatggaaaccaaagaaatggtcagaatcattctgtgtttaatgctcagaagaccccaactccaccatataatgttccaaaagcttcttggtgcatggaaaataactctctcgaggatagagctgatgccggccaagctgccaggcctttggtgcctaatatgaagacagctttgatgacaaggccaaagaagcgcaaatttacagaacgtgctcttgtttcttggcataaaatcagtgaaggcactcaaaagttgagaaagacaagcacgaatgagatggattgggcttgggcagctaatagattaattaagaagtctgaggatgatccggaaagtctggaagatgccccggtaaattatttaccacggaaaaggctaattatgaccacaaagttgattcaggaagttttccctgctataccagcaagagttctcagagcacaagctgtatcagcttatgaaagtgctacatacaatatcgcaatgttcactctaggagatacatgcatcatctcatcagataactctcgcgctcttgcagataatgaaaataacccatccgaacaaagaacaagtgccaaccatggggcagtctccttagctggggttgcgggtggctttcctggatgggtcccctttatcgatcacggcggtccgcgcttgggcaccgnggcgcccatgctggatgggcttccccagcgccgggatttgccggggannncaatcgtaaatcgtctgggannnnnncatggg

SEQ ID NO: 7541 - DNA, 691 bp, Triticum aestivum
  Clone ID: PAT_TA_7541
tttttttttttttttttttttttgaggaagctgaaacggcatttggcactcgtcactctacataaataattggcaaaaattcacgattacatcttagaccggcagtagccagaagaataacttcctcacatggttttttacttcactactttcagctcatatattgtgttacaacactggagtactgctaaaatagctttgaggcaatatttccgcaaacactgcacttgcagtgaaatgttacaccctgtctcgccctactgagatctgcacccgtgaccttttagcaggtgaggcatcgccggtttctagcgtgtggaccgcagttccttctacgctagcttgcgccccgctattcgactggcacccaaaggtccatccaggaaaatctgactcttgaaataaagatgttggcgtacttctgtagaacgcaagtgggacttgttttatccgccgccggggcctcatctcgggaaaactgttgcataggagcctgaactaaagtctgtgatcttcatctccattgttttggcccgaacagtgagatcagtttcaagcgacgcaacaaatcttgaaactgcaggagtgtagtgatgacgcagcgtatctatttcccacaaagaacttcgcattgcgccagactttgcagggtctgtctcttcattgttaaaagggtcagcgccaatcttct

SEQ ID NO: 7542 - DNA, 954 bp, Triticum aestivum
  unsure (1)..(954): unsure at all n locations
  Clone ID: PAT_TA_7542
ttttttttttttttnnggntatacacaaagcctagctttgttcaacttccaactgcttcaaggatgatcatgtagttgaatgcaggtatgtttttgttcggtgcaaatctacatgtgtgcccccaaacaagcccctgcatctgtatatgactatcacctctacctctacaagatacaaaagagagagaaagaaaataataagaggtgtgtccgtccggtattctcctcctgtttgttccttcatcagataatacgccaaatcatctcttctcttgacatctcccacccaatcgtgttgcggtctgatctcacactcggggagccttcaggcagctatatatgatctgcactgtctacatctatacccggacagaacctcttgactctgaatacttgttaggacctcgtcagaatgaggcgctccagatcgcttcgtctccttcgccgcacctcatgtgcacgtccttgagccgctcgactgggttgcagaccccgctgcacctccagtcaaacgacgcaacgcatgcgttccccgcctgggccttccactcgcagtctggtggtgttccgcagcacatgtccctgtcgtcgatgtgctccacatctagcccgatgaaccatgctcccagcgacacatcttcgttcgcgaatttgtgcagaagggggttgttgactgagatgtaggtggcgaggtccttcgagatggcgtatatctgcccggtcgcgtgccggaagtacttgttcccgtcttctccgaacttccagaactcgggctcgtggtatttcgaacttttgtcggaaagaaccggtccagacttcatacagccaatgtagacacggggtttcaatttgtgccgcccgagggttgtgaggagcattcctaggttgacatggacatcgtcatccaccttgacataaaaatcagcatcccatgaggccacagcagggagaaga

SEQ ID NO: 7543 - DNA, 1945 bp, Triticum aestivum
  Clone ID: PAT_TA_7543
cccgggctgcaggcagaagtgcaaaaattttgtcgcagttcaatcggggaaccagtgccatgcaacactatgttgcaacacgaccaatgttcattgatgtggaaattatgaatactgatattcaagttgttcttggtgacgatggtccccaagctgactccagtagtatagcagagggtctctctatcttcgtccgggaaattgctgatactgtgagaaaagaggcaactacaataatggctgtctttccttctccgaatgaggtcatgtcaattcttgtgcagcgagtgttagaacaaagggtcacagcaattcttgataaacttttgataaggccttctcttgctagcttgcctgcaatagaagaaggtggccttctacattatctgagagttctgtcagtagcatatgacaagacaaaagaacttgccaaagagttgcagtctatcggctgtggggatttggatattgaaggtctcactgagtctatatatgtttcccacaaagacgagtacacggaattcgagcatgcatcactcagacagctatatcaatcaaagatggctgaattaagagccgaggccaagcaacaatctgaatcgactgggtcaattggccgtgcaaaaggagcatccttgaatacctcaccccagcagctgatatcagttactgtagtgaccgaatttgttcgttggaatgaggaagcaatatcgagatgcacactgttgttttctcagcctactactgttgcagctaatgtcagatccatatttgcgtgtttgcttgatcaagtcagccaatatttaactgttgggcttgacggtgctagagagagtttgaacgaggctgcagctatgagggatagatatgttatcgggactagtgttagtagaaagggttgccgcggctgctgcttctgctgcagaggcggcagctgctgctggtgagagtagctttagatccttcatgatcgctgtgcagcgttgtgccagtagtgtagcttatcttcagcagtacttctcaaatactatatcacgtctcctgctgcctgtcgatggtgcccatccatctgcttgtgaagatatgggatcggcagtatctgttgtggaggctgctgctcataaaggactgttacaatgcattgatacagtcatgtgtgaggttgaaagattgttatcttcagaacagaaagcaacagattattggtcaccaagatgatggagctgcaccagatcatcggccaacaaatgcttgcataagaattgtagcctacctttctcgtgttctcgaggttgcattcagcgccctggaaggtctaaacaaacagtcctttttgactgaattgggaaaccgcttgcacaagggtctgcttaatcattggcaaaagttcacatttagtccgagtggtgggctacggttgaaacgtgacattactgagtatggggagttcgtccgtagcttcaatgccccttccatagacgagaagtttgaactgcttggaatcatggctaatgtctttattgttgctccggaaagtctagcttccttgtttgaaggaacccccagcatccggaaggatgctttacggttcattcaactccgggatgactacaagacagcaaaaattgcttcgatgcttaacagtataatgtctgaataaaatttacttgaaggttgatgtttgtcaagcggtggaacgctatgaaatgctgcagggtcatcccaatcgattttgaccatcagtgtagcctgtataattgagcttcaatattatgttaattcttttggttccctttgtttatctgtttctaacttgttctgccttgctgaatcttagttttacatgtgcgggtccatgaaacccttgtagcaaactggatagacaagcattatttttgtctagtaatagcattatgtttgcgaaaaaaaaaagttagttttaaaa

SEQ ID NO: 7544 - DNA, 608 bp, Triticum aestivum
  unsure (1)..(608): unsure at all n locations
  Clone ID: PAT_TA_7544
tttttttattccttcttctggctatgttccactctgttgtaatcctttagcatcgtgttacaacttaaaatccgcagcatgttatcaggagaggagaacaacattagtgcacacactcctccttgttttcttttgttttagtaacacttcctaaattaagctgatgatcgagaattgctccaaaatttgtcaatgagtgctgatattatactatattaggctatgatatcacttattgccgcagttacattatacaatcaatttatttctgaagggttgccaggttaaagaatgcccccttcttgttcatgagctgtgggtaagtaccacgctcaatcaccttgccctctcctaagaaggctattgagtctgcattcttgattgtgtttagtcgatgtgccactacgattgtggtcctccctgtcatgatccgatcaagtgcttcctgcaccacttgctcggactgtgcatcgagagcacttgttgcttcatcaagaagtagtatagctggatttcggattattgccctcgcaattgcaatcctgcgcgtccgccctcctgatagtnaatnttncccgtgctccccacaatcagtgncatatncnnnc

SEQ ID NO: 7545 - DNA, 1068 bp, Triticum aestivum
  Clone ID: PAT_TA_7545
gcccaatcaatcaccggcggctccgctcaacgatccctagattacctcgccaccagaaagccaggaacctcgaagcggacagcgagagagatgggctcctgcgagatgacggccacggaggtagcggcgctgctggatctgaagccgcacccggagggcggcttctacgccgagaccttccgcgactcctccgtcttcctcagcaggtgacatatcgtccagctcccatggaaatacctctaataccttctttatgtatgctgcagacaaggtcggtcgtgctgtgagcactgctatctatttcttgcttccttcagggagtgtttcacatctgcatcgtattccttgcgctgaaacctggcatttctacaagggagagcctctcacggtatttgagctacacgacgatggccacattgacctcaccgtaattggtccgcacctagatgctgggcagcgcccccagtacaccgttccaccgacccatgcgtgtttggctccctctctcacccagcttgtcagccccctgcatcgagatccccagaagcattactcccttgttggctgcacttgtgcccgcggctttgagtatgacgattttgaaatggccacttttgatgatgtgaagtctattgccccgaaggcagaacccttcctcaactaccttattccttccaagaagtaagcaggatcagagacgttcatattgcttgctagcagtctatatatcatggcattatccggccttcctgtattggctttggatgccattttctgtgattccacgaggtctgtatttttagtcttgtcactctgaaagagcactcttgtgctggtgctggtgcctggttgtaacattttatgtaccataattaatggaagaaagtttgagcttaatggtgaaacaggagatttgcttgtgtagttttgtatagttctgtatgcctttatcaaacactcgctcgttcgttaaatttgacccagttacaaactcattggaccctttcaacttgtatagtacatgccaagatcactgatgaatattgatttcgtgaaacctttgtagtc

SEQ ID NO: 7546 - DNA, 1137 bp, Triticum aestivum
  Clone ID: PAT_TA_7546
ggggccctggcccccaccaacccccgcagccgctccccggcgcaggcccccgcacctcccacgttccagccggataaacaatcagcccaatcaatcaccggcggctccgctcaacgatccctagattacctcgccttcccgaccagcaagccaggtaacctcgaagcggacagcgagcaggagccccgccggtcgatccagaggagatgggctcctgcgagatgacggccacggaggtagcggcgctgctggatctgaagccgcacccggagggcggcttctacgccgagaccttccgcgactcctccgtctccctcagcaccgcccagctcccgccgcagtacaaggtcggtcgtgctgtgagcactgctatctatttcttgcttccttcagggagtgtttcacatctggcatcgtattccttgtcgctgaaacctggcatttctacaagggagagcctctcacggtatttgagctacacgacgatggccacattgacctcaccgtaattggtccgcacctagatgctgggcagcgcccccagtacaccgctgccaccaaaagttgtggtttggactctttccctacgttgtatgttgagccgtttgcatccggatggcaggccatcttgtgaactctccggaagcgagatcccggagaagcaatactgcctagctggactgcacctgtgcccctggtctttgagtgattaaggattaggaagtggcctcttttgatgatgttaattctattaagccgtaaggcagaacccttcctcaaattatttcattccttccctagatgcttcgaagaattagacaggttcagattccttgcatgcagtctgctatcagtttatatatcatggcattattcggtcttcctgctatttgctttggatgccatttgtgtggatttttacgacttgtgtattttcagtattgtccctctgaaagggcacgccggttgtggttaagttgtcaggttgtaacatttttatgttccataattagcggacctagatgataccccgcacgttgctgcgggaatattttgcaatatttcaatgatggttttggttaccagaaacataaggaataaaattgtaaatataaaaaattgtgtaaaaaaaaaaaa

SEQ ID NO: 7547 - DNA, 835 bp, Triticum aestivum
  unsure (1)..(835): unsure at all n locations
  Clone ID: PAT_TA_7547
gttcgtaagatcnattttctttggaaaaaacagataagaagcattattgtcagctgacagtttgtaacaacgtaacagttcacacgcggacaacaacatgcagatgatgatgtgtatcaagttacaagcaggcaatatgcctaagtggattcaagacattcccccaaaatgcttcacaaactcaatgcaagcgaaagccaggacagcaatttccgcgccaccagattatctgctgctctttacttatagcacctgaaaccgacctgtgctagtactcctagctagtagctacaagcagattgattgaaccacctcattcggttgttatttgtgtctcggtgctctcgttgccatagtaaccagaagaatccgctaactgcacgtcaattatagggttgctcggatgattactaaccacgccaatcagcgagacacactccagatcggcagctgcacccctaaattttgtggagacctctctaaggcctggcatataatcgatgttgattaatgccgtaccatgtgcatatgttttccactgttggtccattggggggatggcatcgaaaactagcttgagcttccagagactaggcattgcatccgcctcaaaatttacccaggctataccccgcatgaacgtaagcttgaagtgcttgagaaccgagaaaccggccttgtcaaagatgatcgtgtcatcaggcggcgtctccaggtacagcgacagggcagcgagggccggcaatcctctgagaatatcagcacactgtggtggcagtcccttgacagcaatcttcaaaatgcataggttgccaagttcggacgcgtgggtcga

SEQ ID NO: 7548 - DNA, 698 bp, Triticum aestivum
  unsure (1)..(698): unsure at all n locations
  Clone ID: PAT_TA_7548
tggcgcactaactgaagcacttcagagaatatttcctcctgattggaattcattagaagttctaggagaggtttctgattctgtaagcactggggactcagattattccagtgattctgattttagcgatggtgacgagaatcaagaagctgatgacaactgacaatctgtaaacaactttcgacggtatgcactcccaagctgcttttgcgtgagctgtgccagagtttacctaacaaggtcggcagtttgtggacgacccaaaagttgggtttggaatcttacagtgcagtaagcatgggctgtctgtcttctgctgtatttttttaagagctgccgacagtcagcaacagttctactggcgctaagactcatctgtcaatgcaagttagcagcagaccaacttgctcaattaagtgtgttcctgttcagaacaatgacgcccttagttaatattccttacctcttccttgtganacattaaagnggnaaagngttagngtttcaaatttccnanaattgttaaaatttgccctaaccnaatgancggaaatgaaggccggnanagtccntcaaaaaggccattacnggaatgacaaaggggnaanacaaaccctccggtttaaatccttggaaaaattggacccatgggttaanggatcaaaggtccaatggggatttntaaaanttccncaagg

SEQ ID NO: 7549 - DNA, 964 bp, Triticum aestivum
  Clone ID: PAT_TA_7549
tcggcacgagggactgcagacgcaccagatcgccgccgcggacctggcagggaagacgcggacgagatcccaagccgctgctcctcctctcccgggatgcagccgccgccgccgaaccagggagacgccggcgaccgtctccgccgtcgtggatcaccaggacgcccccccctcccccccccccccccccccacccgtccgccgcctcaatcccaccgccgccggcctcctcctcctctagcgcctccgctccagcccctcaccttctcatcctggatccgcacgacaaggtgtggggctatgggagagaaggctccatatcgcgcgacaaggtgagggggcgcccagatccgcagcggcaccaccgcgccctcgtccacctggccctcgaggtcggccatggaggtccggcccgaccaatggatggatggggatgaaaccctagcccaacacccacccatggatggatggggatggggcgacgacggcggcggcggcggcggccttctctcggtgcttgctgatgtggtggacatcgacgtcggtgacgggttgcagcacgtagacatcaaaggctgcgggtgtgacggaggagcaccatggcgggcgtgcagaccatggctcgctatggaaggcccttcccttccctctctctgttcgggccatgctcaggcagtcttttctcttctcttcccgcaaaaaaagtcttttctcttcatgatctgaacatgttggaggccattatttctcctctgccatagtttgctgtccctgccatgttaactgagagttggtagccaatatcaagtgatttggaaattttgttggtctgaaccataaatgtgatgatttatcacaattgtcatctgatcgccattttgttgatcacattacatctatgctctgtttgtttgtttgtttagctgcctgcttcctctttgcatcacggttgtcatgtgatgat

SEQ ID NO: 7550 - DNA, 662 bp, Triticum aestivum
  Clone ID: PAT_TA_7550
ggaatacgttgcaaacttgcaataagatgaccatgacaatagtcctagtagacctaggctgccaaactgccgtgagcatacacagctccagcagcaaacaatggtgcaaacagacgggatgtgcttacatacgtatctatatatgccgatgttcaatcagaatcaaccaccggctattactactaattgttactagaaatgaataaccaacgcccgattattgtcgcttcaaagctacgagtaaactaccagtactagtagtaaaataacatccacgctccccgtagatcatttgccctatagatttggagcccaagtcaagtgttcatcatgcctctttcttgtaccgtcagtttgtcacttcttggcctagcccgagccaggagttgtcaccattagcttgcttggacggagccgccgatgcgctgttaatttggtaaggcgccttcgccactatcctgccctttcttttctcgagaaacctatggagtgagttcctcctcgctattggcagatcagggagagtgttctgtgaaggctggggagggctctgctgaacgaggctgctgctcccggccttgtctccggcgccgtcggccatctgcagcaaatccttgaccttggtggacgggaagttgtcaaccacgaccacttttccaccg

SEQ ID NO: 7551 - DNA, 1192 bp, Triticum aestivum
  Clone ID: PAT_TA_7551
taggggccttttttttttttttttttctttttttttttttttttttttttttttttttttttttggggaaggcaaaccatctgtaacacgttgcaaattaacttgcaataaaatgaccatgacaatagtcgtagtagacctagcctgccaaactgccgtgagcatagcatacacagctccagcagcaaacaatggtccgaacagacggcatatgcttaaatacatatttctactaataattcttactagcaatgaataaccaacacccgattattgtcgcttcaaagctacgagtaaactagcagtactagtagtaacatccacgctccccgtagatcaattgccctatagatttggagcccagtcacgtgttcatcatgcatatctttcttgtactgtcagtttgtcacttcttggcctagcccgagccaggagttgtcaccattagcttgcttggacggagccgccgatgagctgttaatttggtaaggcgccttcgccactatcctgccctttcttttctcgagaaacctatgcagtgagttcctcctcgctataggcagatcagggagagcgttctgtgcaggctggggagggctctgctgagcgaggctgctgctcccggtcttgtctccggcgccgtcggccatctgcagcaaatccttgactttggtggacgggaagttgtcaaccacgaccacctttccaccatagaagatggtcagctggtgcgcatcctctccggcatcttggttgtcagttgtggccttgagaaactggccaacactagatttctcgagggggagctccacgtccgcggcgtttggctcctccagccccgacaacaggttcatggtggtgggaggctggaaagctccttctcctacgacgacggcggccggcggcgacatgtcgaggccgacgaggccctgcagtgcgccgcccttcttctccttcatgtagcggctcaggaggctgcaggtggcggcgaagccggacttctccttcgccgccgacgcggcaccggcaccggcacggccggccatcccctctcctccgctcatcttcccgccgctccccgccccttccatgcacaagaaacaagtcgcctctccaccgcggctagcttcctcgctccttccttggctcgcctgctgactccgacgaaccctcgtgccgaattccgcacgag

SEQ ID NO: 7552 - DNA, 705 bp, Triticum aestivum
  unsure (1)..(705): unsure at all n locations
  Clone ID: PAT_TA_7552
tttttttggtttgtcttttttggttaagcatagcgcagctgcttcagattatttctcggggtacaaacaccctacagggtacaaatatcaaagatccatgtctcgaacacacctnggtaaatgcaggttaaaacttggaatacaacatgttgttgaatttggcatacaacaaacgcttgaactcactgagaattgcaacctctatagacatgatgatgcgcacactgccatcaccctctgcactgtcaatcaggtgcacaaaacctccacggtttggttcagcacggaacatagccaatggcctcccccagctgaaatccgcatcatacgacggcatgccaagccagctgacaactcttatgtcggtcaccggcaaattgcctgcagccgggcgctcgtcgtctctctttgttagctcgaggtagtcgatcgccgaatgcactagctcattgttcacccggctgtgggtgtctctgattcgccgcacgatgtatgtcagctcacacgaactgatgtcacgcactttgtcggtgacacttaggtttattatagcattgccgaagtagccgtctgggagtggtggcctcatgatgcgacggatgttggctgagaacataggcggggtcctcgcgcccggcggtagcatccgggctaagcacatgcattgccacaggtgggcactgactgcactgaangtgctcacgg

SEQ ID NO: 7553 - DNA, 544 bp, Triticum aestivum
  Clone ID: PAT_TA_7553
ggagaaagaacaaacattcatatgctctttttcaacacactttcattgtacacgcgtgaaaatgatgtttgcattacacacacagagagaacaccactcactacactattgtccgaacattcagaatgatgccatatgttttgccaacaagcaaacacgcaagtctaaaaccgcaagcaaataagtacattactctacattcaaaatgttgcaagaaccaaaaaaaatttagacgagtgaccaatctgcacagagacactacggttcagaatcgagaaacatcagaatcaacgcctgtttgcgatgctgaaggagctgactttcatcggggtggcgaccaccaggggagcttcaggggagtcggagccggcgaagttctcgtgcatgaacctgctgtcgacgatggactcctccttgaggacgaccttgtagcagtagcaactcttgaggccctcctggtcgcggtagcagtgatggttgctgtccttgaccttttggaagttccatatgaggctgaacttgccgaccgtcgcgacgagatgcc

SEQ ID NO: 7554 - DNA, 1438 bp, Triticum aestivum
  unsure (1)..(1438): unsure at all n locations
  Clone ID: PAT_TA_7554
tttttttttttgcgaaaatgatgtttgcattacacacacagcaacactactcaactacactcttgttccgaacattcaggacgaggccatatgttttatcaacaagcaaacccgcaagtctaaaaccgcaagccaatcaaatacgtgactctcactgtgtaaagaaccagaaaaaactagccgggtgaccaatctgcaagagaggcccctaaacttctaacatttcggttcaaaatcaacgcttgcttgccatgctgaaggagctaactttcattggggtggcgacaaccaggggagcttcaggggagtcggatcctgcgaagttctcgtgcatgaaccggctgtcgacgatggactcttccttgaggacgaccttgtagcagtagcagctcttcaggccctcctggtcgcggtagcagtgatggttgctgtccttcaccttttggaagttccatatgaggctgaacttgccgactgtcgcgacgagatgcttttcttgcttcccgttctccgttacccatgaaaattgtccaccatggaatttgttgtcattcccagccaagattgaatcaagcggactgagcttcagcaacctcggcgcggcgatcctgcttcccatacgcccactgaacccggtcttctccttgccatccttgtccttgaagatggtgcagatcaaaaccaagtatgtgtctgtggtgcccaggatccacttcccgtcataagtaacatccacatgcgtgatcggcgacccaagccccgggaagaccgtcttggccatccgcatcgagctcctggagtagagcctgatcttgccatcgacggagccaacaacaatcgagccatccccggtgctcgcgaagcactggaagttggtgccccgcgagaactggtggccctgcgaccagtgcagcaccggcgagtcgtcggagttgccgatggtctgcaccctgcccctcgcgtcgcgcatgtcccacctgcacagccggttgtcgtccagccccaggaaggttgatccggagggctccagctgcgcgctcttgctgtcgttggcgatgtcccgcatcgtgatgtcggtgccgtccttctcgaaccgccactcggcgacgaccttgccggtctcgatgtcgacgtggtgcacgccgttggaatgcggcgcgccggtgtccccggggctcatcagcagcatgttggtctcgccgcgcatcagcagggccttcttgggcgtcgagtagttggtgctggtggtgctggtgccgccaccgcggccgcccgagatcctgaccgacacgcccttgccgtgccccccgccccggtcgttcttgaccacctgaatcccggcgccgccgaccaggaagctgttgtcgagcgcgccgagcgcgaggctctggatgccgctgccgtcgccggcctcctncctcgaacttcnngagcaggt

SEQ ID NO: 7555 - DNA, 384 bp, Triticum aestivum
  Clone ID: PAT_TA_7555
gtaaaactgccataaggccctgttgcgtttacatatgatgagcaaaccgcttccaaactggatgaacgggacagacagctaggtttgcatggggaaggagtactgaatgggtttctagagggtctgactgggctcctccaatcaccaatcagaggtgctgagaaacatggtcttcctggggttatctcaggtatagcaatgggaacagctgggcttgtggctaggcctatggccagtattcttgaagccacaggcagaactgcacagagcataagaaaccgaagcaatcctcatgaatccaaccgcctgcgtgtccgtttctcgaggcctgtggccagagatcgccctttgttcccatactcctgggaaagagcagtttgagta

SEQ ID NO: 7556 - DNA, 782 bp, Triticum aestivum
  unsure (1)..(782): unsure at all n locations
  Clone ID: PAT_TA_7556
tacttgtttattatnatnaattgcacactcgatncggtacaatcagcacaaggtacactcattaacaagtacccacccacactaaaaagggagaagagaaagagaggaaaacatcgactaaaaaagagagggggggaaataatataataataaaaaggaaaataacagaactaggtagctagagcttgaggttaaggtcgaccttcctcggctgttgctgcttcttgtcgccgtcctggtcgcgccaccagctgccccccggcgagccgccgtcggcgacgtgggggtacccctggtgctggcaggagtgcgagacctggatggggtacatcgtctggtggttgggcatggcatcagcggctgagttggtgttgatgggggtggtgtagaggtgcgcgttccagccgatgttcctctccttcttgtgcgcattctggtgcccccctagcgcctgcgacttgaggaacttcttgttgcagaagaggcaggggaacagcctcacgccaccacgaccaccattgccactgcgtctcccattgccaccgccggatgaagcagccggaggagacgacggtgacgccggccacggcgtgtgggcgagcgtcagcgacaggtcgacggcgtccatatcctcgtcgtcgtccgtgaaggcgggaggtggcggagccgccattctttagagagcaaacgagatcgaatgcttttgatccagactctggctctcctggtgccaattctgtaaatcaagcctttaccactactaggtagctgcggtgccgaat

SEQ ID NO: 7557 - DNA, 672 bp, Triticum aestivum
  Clone ID: PAT_TA_7557
tggaaggtgatctattctaaggatgtcctcgggcagggtacttagatcaggtctgtgaccctaccctaggtacatgactccatcagtgagaagctctggtttgtgagaagcatatacccaaacctaccccaaatgggacaaaaaatttaccacagcatgttgatgccgctcaatgatagcatgcaaagtttcatgaattttagacgagttttggatttactagaatttaaaaaccaggcatctcaatgttttgccgacattcaacggtgcggggtgtttgaaattcattcccatttcttgcatgggacctaagcatgaacccaaggacacatacttgatttttcaataagtttatatgcactggagcatgtgcatgtagttcaaacttgaattatgcacataaaatgcctggaaaactcagttaatgtatgaaaatttacaaacgaaccctgaataattccaatttttttgacgacacacctatagttgcatgttcacttcagataaaagttctaacaattcaaacaccatcctttgtagcagtgaccccattacgtaattcaaatgatcaagacgataaatcaattagatcacagccagtttattatcaccaaccacgtgagatgcagcacaaaatatcttggagcaccgtccgggtatagtacgcccaag

SEQ ID NO: 7558 - DNA, 1355 bp, Triticum aestivum
  unsure (1)..(1355): unsure at all n locations
  Clone ID: PAT_TA_7558
tttggtttctgatttaaatttgntccatttttgggcaaaaagtccnttgtnttnaatcagcccgctcccgggggccctcgcgcccccctgcggccatttgttttccacccgagcatgtccttgtagttcaattttgaattatgcacataaaatgcattgaaaactcagataatgcataaaaatgtccaaacgaaccccgaaaaatcacaaaaaaatcacacaacactcctgttgttctatgttgacacgagaaaaaaattattgaaagcaataagaggcaatggatatcgtttcgtccccaaaggtgggacgttccctaccgaaaaccatcatgcttgttgtgagaagctccggtttgtgagaagcatatacccaaacctgccccaaatgggacaaaatttgtaccacggcatgttgatgccgctccatgatagcatgccaagtttcatgaatttcagacgagttttggatttactagaatttaaaaaccaggcatctcaatgttttgccggcaatcaacggtgccctggtgtttgaaattcattcccatttcttgcatgggacctaagcatgcacccaaggacacagatttgatttttcaaccaatttatatgcactggagcatgtgcatgtagttcaaatttgaattatgcacataaatgcattgaaaactcagttaatgcataaaaatgtccaaacgaaccccgaaaaatcacaaaaattcacacaacactcctgttgttctatgttgacacgagaaaaaaatttgaaagcaataagaggcaatggatatcgtttcgtccccaaaggtgggacgttccctaccgaaaaccatcatgcttgttgtgagaagctccggtttgtgagaagcatatacccaaacctgccccaaatgggacaaaatttttaccacggcatgttgatgccgctccatgatccttgccaagtttcatgaatttcagacgagttttggatttactagaatttaaaaaccgggtatctcaatgttttgccagcaatcaaaagtgtcttagtgtttgaaattcattccatttcttgcgtggcacctaagcatgcacccaaggacacatattttatttttcaaccaatttatatgcattggagcatgcgcatgtagttcaaatttgaattatgcacataaatgccttgaaaacccatttaatgtataaaaatgtccaaatgagccccgaaaattatgcacatgtatttgcttgttgacactaataatgtattttaaggctctaagacacaattcaaacaccgtcgattgccgctgtgaccccattatgtaattcaactcaagatgaaaactcatgtatatcccacacatttta

SEQ ID NO: 7559 - DNA, 651 bp, Triticum aestivum
  Clone ID: PAT_TA_7559
tttttttttttttttttttttttatttttttttttacacatgacatgcatgttgaatagtaatatttcacaaaagatcatagcgtaaaatcttacaagtttgcatgctggtaaatagaattcacaggagatctaggcccgatccgtggaacttgctttgcaaaagggcgtcaaaacgatgtgccatttcaggtgtcatatggttcatccagtctcctacaccccctctcctgaagtaagattcacgagggtacttggtgaacaccacagggcccgccttgttcaccttgaggctgctcagcttctcaaagctgcacagatccacgatgtcatccacaaccttggtttcctcttcgacagcggagaagggttgcccaacgaaccgcgccagctttcgtacattgttggccggatcttttatcatttcctcgtacctgaggaaaaggaccgctgccgaggtcatctctggctggccctcgtcgccgctcatggttttgccggcgttccagtacccgaggatgtggtcccagaatgggccgcatagagatctgccctcgcaggtgagctcgaacatgtcgttgaatgacaggtttggccgaggatgcctaaggaagtgccacattgagactaccatgtccctttgggtccctgc

SEQ ID NO: 7560 - DNA, 678 bp, Triticum aestivum
  Clone ID: PAT_TA_7560
ttgtttgctggtgcgcgggcctggtgcatcgccgggcgctcgtcgtcctgtctcctctcacccctcccgctctggcggcggtctggggtgtcctatgtccgtggctgggcgccatcctccctcttagcggtctgtgatctctactggccgccacccgcctctgccttccttcccgcccccccccctcatcttctccccactcccgctgtagcctaacatacgaccattttgagccctatcggtgggggcctctcccgcctatcgctctttctgccgggagttcagccgcggcttcgtcatcggcggctcccgccccagctcgcggggtccctcctgcccagcgcccgttcgcccgggccctcgcccgcgccgtcgccctctgaggccccctctccaggacgcagattacatccttcacggaaacagttcgctgaggcccatgcgagtggcgattcgcaaatgaacccttgccttgcctttccgtgcctccagttccaaaggccgcaagatggctcctctttgaagcctcactgcgttctgcagacccttttccagatgcatgggatggtcttggagctggtgcccgcttctgcttagcttgttcggccatcagctgccactttgaaaacatatcacttcctccaactgcctgccgagcagcaacatttgcagctgttg

SEQ ID NO: 7561 - DNA, 601 bp, Triticum aestivum
  Clone ID: PAT_TA_7561
cgtacttcactgacatgatcatccgcaagtacaagatgcgcagcgacatccgcaacgtgcacctctccgggatggggtgcagcgccgggctcgtctccgtggggctggcgcgcaacttcctgcaggtggcgccgcggggctcgcacgcgctggtggtgtccacggagaccatcacgcccaactactacgtcggcaaggagcgcgccatgctgctgcccaactgcctcttccgcatgggcggcgcggcggcgctgctgtccacgtcccgcgccaaggcccgcttccggctctcccgcgtggtgcgcacgctcaccggcgcgcaggacaacgcgtaccggtgcgtgtaccaggaggaggacgacgagggccaccggggcatcaacctgaacaaggacctgatgaccatcgccggcgacgcgctcaaggccaacatcacggcgatcgggcccctggtgctcccggcgtcggagcagctgctgttcgcgctgtccttcatcgcgcggcgggtgttcaacaacaagagcatcaaaccgtacctgcccgacttccgcatggcgttcgagcacttctgcatccacgcgggcggtcgcgccgtgatcga

SEQ ID NO: 7562 - DNA, 975 bp, Triticum aestivum
  Clone ID: PAT_TA_7562
tttttgtgtggtcgattcatacatgatttcttcctttgaacatgtctctgaatcttataacagtacaaaatgaaatggcagaactaggccactagaaaaacataagactgtgagtaactccttgtttctacacatcaaaggcgacaaaagtcataaatcaagacagcaacgttgcaggttcacgcagtcgagcttgtttcttcaacttgttgcggaaacttctttttctactgaacgccctctccactggctgggcctgctcctccccttggcgaactgctctctcgaggtcccggtttgcatctgtatataggctagtcactattccagatcggccagctctagctgtgcgacccaccctgtgcaaaaagtcgacagggcaagcagcaaactccgcctgaataacatgtgatacatttggcacgtcaagcccacgagcggcagcatcagtgcagacgagcacgccaccattctcccggaaagattgtaaattggctgtcctttcctccagggagctctcacggtggtacaagatgcatggaataccaactctccgcaatatgtcagagaccgaattagcagcgtcgacagtgttcgtgaacaccatagttcgatttggaccaagttctgtgtcaacttcactcttcaggccatactttactgcatccagaagcgcatcgacttgtgtatcagtagtaacctctatccatcttctctccagtctagggttgtgacggtgcagataagcaccactaacccacacagcactaggaaacatacgtttcagcacaccaccagcagtcttttttccactctgagggagggtggcagcaacaaagacatattgcttgctgcgcctataaacttttctaacccttctccaatccctgcgtgctcctacatgagcattcttcgccttgactgctccatcttgaatatgaccatcttcattttcatcatcaacccacgcgtccg

SEQ ID NO: 7563 - DNA, 679 bp, Triticum aestivum
  Clone ID: PAT_TA_7563
gtactggcaatgcagccaaggtgcttttaacggtggatgaggatctgaagcctcttcctgttccagtgcgggttgggcaagcagttgatgtggtcgggcaggcgggacgacctaagacgataaccggctttcagacgcataccactcctgtcttgcttgcagccggggagcgagcggaattggcgactgacaagtacatccccctgacctcgacgttggagggctttgtaattctgaagaagaacccggaataccacgaggagtgagggggaaaccccctaggctttgatctgatgcaagtttttggagtcccccagcttggcagtcgtcaccgaggatcctttgatatgccctcacacaaggcacttgctggtgtttcatccaaaaacattttattccgtccaccagagctgtaactaactgcaagcttgtttggttgcccgaatggaccggcatgccacttgtacccacactggtggacatgtaggagttgaactggtggtgtcttttgaccttgagcttatttgtatatgtatcaagtgtgtactgaaagttacatctttagaactgatacggcgttgtcattcattagcacagtatgtttagcctttcctgtggacctgcgcccgtctacttattttttgtggagtaaaaaaaaaaaaaaaagggcggcgctcgc

SEQ ID NO: 7564 - DNA, 2131 bp, Triticum aestivum
  Clone ID: PAT_TA_7564
tcctccctcatgctacgtgacatggacggattggcgctattatgcctggatgcctttgctaaggtctccttgattgacgggaaatatcccagcttccttcttgcttttgcattgcagatgttgccagcgatgcttgttaatgcgcttgagaatctggactttcgccaggttccgctgcggattgcgccaacagttgctctagagcagcaggtcctctggcagagtgtgttgacaggatttccaacccataccaacccggtcctgcttcccgccggggaacgagtctcctttgggactgtgatgcacggcttcctcgacttgacaagtactagcatagtactaattctcaagatgttgctggagctttgctaggtattggagttatcacctgcgttgtgaagagagattgttatcctgcatttgccatcttcatggagtatgtggcaaaggatgtctcaaaggtggggcttaggataatctcggaccttggtcacgtatttgttgtttctcaaaaggctgttctaagcgtccaactgtccggtaaattgggagacgctcaagtaactcccctagtcgtggtcttcgcagccattcttttgggtatggtggtggtgagctcgtgcagtgtagtgattgctaaacccattagtatttgctttatggcacgtattgagggcgcaccggcagggccaattatgcgtcttctgcctgttgcgccgaggattctttatcttggaaagacacaaagcgctgaggctactgcggaggtatctaaaacatttgaggagacgatcgggaaatataactgacggaacacttatttcccttgcatatgctggatgaggaaatgtgctcagggttcagaaacttcatggtatttgctcacaacatcttgagaaaggcgaaacacaccaaggccccagctgtccttggaattgctcttattgccatgtctgaagaattaggagctgaaatggctgtacgatcacttgaacgtcttctacagtatggcgagcagaatattagacgagcagttcctcttgcacttggtatcctctgtatttcgaaccccaaggtaaatgtaatggacacactgagcagattgagtcatgatgcagatgctgatgtgtcaatggctgcgataatctcattgggtttgattggtgctggtacaaacaatgccagaatagctggtatgcttcgtaatctttcgagttattactacaaagaggctgctcatctattctgtgtaagaattgctcaagggcttgttcaccttgggaagggtttgctgacactttctccataccattccgaccggtttcttctttccccgatggcacttggagggattgtcactgttctgcatgcctgccttgatatgaagtccaccattctagggaaatatcactacattctttacattattgtattggcaatgcagccaaggatgcttttaacggtggatgaggatctgaagcctcttcctgttccagtgcgggttgggcaagcagttgatgtggtcgggcaggcaggaagacctaagacgataaccggctttcagacgcataccactcctgtcttgcttgcagccggggagcgagcggaattggcgactgacaagtacatccccctgacgtcgacgttggagggctttgtaattctgaagaagaaccctgaataccacgaggagtgagggaaaccccctagctttgatctgatgcaagtttttggagtcccccagcttggcagactcggaggcaaaggttgtcgtcacggaggatcctttgatatgcccttacacaaggcacttgctggtgtttcatccaaaaactttttattccgtccaccagagctgtaactaactgcaagcttgtttggttgccctaatggaccggcatgtacccacactggtggacatgtaggagttgaactggtggtgtcttttgaccttaagcttatttgtatatgtatcaaatgtgtactgaaagttacatctttaggactgatacggcgttgtcattcattagcacagtatgtttagccttttttgtggacctgcgcccgtctacttattttttgtggagtactcctacaatgttatgtcagcagttaatggcttgctgtgcta

SEQ ID NO: 7565 - DNA, 1001 bp, Triticum aestivum
  Clone ID: PAT_TA_7565
ccgctcccacggcacctaaacctgtcgcagcgccgatgggacgggtgtcgccccagtcaggtcgtccaccaagaacatcctcgcgccagaccaccgttgtgcctctacacctggcacatcctctattcgctaccaagctatgagaggatggatggctccccagtcttggtggcctccgcgtcaatcttcacgctagaccaccatattgcttctccacatgggaaaagcactattagcactattgaaagcattagcaacacactcttcattagaaccattcaaaatcgtttcaccaatatatgagaagaagaaatgcttcttagaaatggaagggtgagcttcattgaatagataacgacacacacacacaagatcaagaaattgtctacacgggctttgaactggagagaagaaagattacggtaaatgcagtaaagctctttcatatcgaattgcttcatacactgaagaggttagaacattggcagcggtacatctcgtttgccctccggtctgcgtgtcgggctgtctgtgtcacccctcgagcggctcaccgcgcctgagcggttgccccctgtcgcccctcctgtccttcttcggggccagtcttaagcgcctgactggccttctcacatccctcctgccagcagatgataattttctcttcaggtacttgactttattattcacatagaaattgtaaagtgcttcatcaaactcttcatcatcaccgggacagcccattagtcccggcgtccgctcaagctcgaggcgcgtgggggcccgccaccgcctcaacccgcccgagtgaagaaagtaggggaacatccttgcgacagactttccgcagtctactcattgagatagtaccagggcagccggtagaccaagagaagaaggagaagaaatcaaatcctgcggtggatgagctcggaatcgccatgaacagaagcaatcgcctccgcctccttcgccactggagctctcttcctctgccttat

SEQ ID NO: 7566 - DNA, 586 bp, Triticum aestivum
  Clone ID: PAT_TA_7566
ttttttttttgaagagaacagagcagcttgagctcacaagaaattattataactgcgccaaatggcatcatagataaccctctgcatcatgtatgcttttgtagcacttagtgccaatgaacaagtctcaacttcacgcggctagactatttaggggatacgagtaatatctatcgcgctctctgatctatttggatatataaaccatactgcagggaatttgaaaatcatataggcttgctaccgcgagtgactggtccctcatatgacctgctttcatagtaatacctccacactgtcatatgcagggatatgcacgaagggtcttaactctctagccattcctcccgggccttctgcgtggatcatgcctagagtttgctcctccatagtcatagtcctgaatctctgtgagaatcttcctgctgtgcccctttatgaacttcgggggaacatcattatcaatttccaccactatggtttgacctgcagatgcactgaagagagcaattagaaggatgatggcgagtacaaaagcgggcttaggcatgttgttctccgctagctgctaaaggagttttctagt

SEQ ID NO: 7567 - DNA, 1641 bp, Triticum aestivum
  Clone ID: PAT_TA_7567
gaattcggcggacgcgtgggttcccggaagaattccccaattaaaagagatctctctctcgtcacatccacctcactcgctcgcttcctgctgccattccgcggccggacatgtcgtcgtcgggggccggcgaggagggcgccgccgcgccgcaggggccgctacccgtggagcaccggaagggcgccaacgggctcgacaaggtcgtcctccgcgaggcccggcgcatctccgccgaggtgtacctgtatggtggccatgtaacatcatggaaagatgagcatggggaggagctgcttttcgttagtaataaggctattttcaaacctccaaaagctatacgtggaggtataccaatctgctttcctcagttttccaacttcggacatctggaagctcatggatttgcaaggaacaagatctggggtgttgacactgatccaccaccatttccagtaccaatctctagtagagcttacatcgatttaatccttaaacctactgatgaagacttaaagatctggccacatagttttgagtaccgtctgagggttgcacttggacctggtggagatctgatgctgacttcacgtataaggaataccaatgcagatggaaagccattctcttttacctttgcatatcacacgtacttctcaatttctgatataagtgagatacgagtagaaggcctggaaactctggattacctagacaacttacaagatagggcccgcttcactgaacaaggcgatgctattgtttttgaatctgagttggacagaatatatctgggcacgccgtcaaaaattgccattattgatcatgagaaaaaaagaacatttgttgtgaggaaaggaggacttccggatgctgttgtttggaacccatgggacaaaaaagctaaggcaatggcagattttggggatgacgaatataaacgcatggtatgtgtggaagcagctgctatagaaaaggcgattactctgaagcctggcgaggagtggactggaaaattggaactatctgcagttccgtctagttattacagtggtcaattggacccagatcgtgttattcaggattcagttgttccggaggattcagtcagctagcccttagtcaagttctgtgcaggtagactattaatatcatatgcacaagggaaatggcagccacgagtgtcaaaacatttcttccattctattcaaatctttgttgttttcggcgtacctaccgcaacagagcgaaaatctcaacattgatttctgtttcggtatccacatgacataaagggacaaatcagtgtttgtaccctgcatagggatgatcgaagaaacatcttagatgggttgtaaaataaatttataactgtattttcttcttttaccagtttcttttatgcgtaagtttcatagtgtggccaaaaggcgaagatgatgtcaaaccacctttcagataaacacacatgatgtgtaaacatgccaaggttttgagctgcatggcttggtggttgttgaaccatgcttatttggatgcaattgtgcaccattggataggtatgttccggcttggtgtttttgggtccctgagtaaagctttatttttgtgaaaaaaaaaaaaaaaaaaaaaaaaaaaaaa

SEQ ID NO: 7568 - DNA, 928 bp, Triticum aestivum
  Clone ID: PAT_TA_7568
catcgcgcctccgctgaaccccccaaaccagaccatggagcaagccacccctcccgccgccgccggcatcgacctatccccggcggcgaccgacctcggccgggtgcacctcctgccctgcggcatcaggcacaacagcgccgccgccgtctccgactacttcaagcccagggacactggcgtggaggtggacggggtgaaggtggaggaggccttcttccgcgggaggaacctgcagggcgccaccgtcgcgctccccgatgactaccgaggttatgtattggagaagaagaagaacgaagaaaaggatgctcagggcatggatgaggaggctagcaattttgtatcccgtgcagaattccagaacataacttactggaatcatgacaccatgccatcagcagaggatcctctcccacggtgctttcattggttagccattgcgaatgcaatgcacaagccagtgactgctgaagacatggctaacatgtcagccaggcagaatcagaacagttgaccaagatctattgcatagtgaatctgttatttagttccagcaagaaccaatctaacaagcaatctactactccgatgaacttggaatgttggaattgtaacggtcgttagctgcgagcctgtgagggccaggcactcttgtgttaagattatcagtctgtgttgccaacctattgttctcttcttgagggggctctttcctgttctactgagcagttcatttgtcagcctatcagataccccctccgtcctataatgtaagatcttttttgacactaatgtagtatcaaaaaacatcttacattatgagacgagggagtacatgtgatcttgtgaatttaagttctcatgtcttgatatgatgtgaatttgtcttatatgatgtggacatattaaattgtcataataaaaa

SEQ ID NO: 7569 - DNA, 660 bp, Triticum aestivum
  Clone ID: PAT_TA_7569
tgcagggaattcggcacgaggagcctagctctcccgccggcgcaccggtctagcatcgccgtttacttgtcgagctctccgtgaaccagtggccccacaagagatgcgacacctccggcccgtcgcgccgctccgggcactcgtcggcgtggtcaagtcctgctgtctccctcctctcatggtggctgtcgtgtgcttggattcgcggccaagcaaacaagcagcgctggccggcaaccaaccaagcaagcagtagcagcagcgccagcttgcgaggaagcaagcagcagcagcagcgtcggctatcaaggaagcaagcagcagcgcaagcggcaagcaggaagagcagcagcaccgccggcagcacgcgttggcagcggtggcgcgcggtagagagattggctgacggcagcacgtgcatgcgctgtggtggcgctggcagcagcggcgtctgtggcgtttttttttaatttctgccaacaagttttaccgagtgcgtcgctcggcaaaaacacctgtgacacgtggcgaacctatgaatttccaccgttttcatctgccgttagttgatttttgccgagttcaaatctttgccgagtaccacgagaacactcggttatattgttgccgagtgcccgataaacggctctcggcaaagaa

SEQ ID NO: 7570 - DNA, 526 bp, Triticum aestivum
  Clone ID: PAT_TA_7570
gggcactccacagccagctccctttcccttctcttctcatagcttgcacgtccaaggaaaggagatcatggaggtgaagaagagggcggccgccattgccgcactgtgcgtgctcctcgtcatctcagtgccgccccagcagcgggcggccgccaagaccttctgcgagtgctaccagccctgccacgacgggtgcagccgcagcggatggatctgcaaagtcgactgtgtcgagaaatgcaaggaagaaggctacatggaggagagccgcgccgtctgcctctgggtctgcagcaccgactccccctgcggcccgtcggcggcgcccaccgaagcagaaggcgctgcggattgtaagatcgagtgccacaagaggtggggccaggtttaacgcccagcagcaacctgcaaaataaggagatgttgaacggctgtggttgccgaaccaatcaataaaatgtgttccgcgcgccggcgcatcacttgtgtgaaaaaaaaaaaaaaaaaaaaaaaaaaaaaactcgag

SEQ ID NO: 7571 - DNA, 963 bp, Triticum aestivum
  unsure (1)..(963): unsure at all n locations
  Clone ID: PAT_TA_7571
gagngttgnnctttgattcnccagctcgaaattaaccctactaaagggaacaaaagctggagctccaccgcggtggcggccgctctagaactagtggatcccccgggctgcaggaattcggcacgagacgacgccgaccagtgctccagcgataacctcagctgcagaagcagtgtcatgagtgctgatactaacaaccacatcgacactcggtctggcaggaatgctccgtacaagtccccttatccacccagcatagcaagtgcagatgacattgagctgtatcctcagacacccagcagcttccagagcaactcgcggactccgacgcccattgcagagcaccatccctcgaagcatttcaacccaatctatcagacatcagcaaacaggtccccattctcagccaaagcaaatgaagcagctattccagaagccaacaacgcaaggaggtttagtgcgccgaacacagatagatctcctcgatcatcggtttactgggatcaggaagctggccggttcatgtctgcacaggcaaaccagggaccgagctctcgggtaacccggcccgaccttctgtacaccggtcagtctatattctttggtggacccctgatggcagattctgcgacgagaagtttcagagaccctggcggctcgagccagcgctccggtgtgtctcggcctcaccagctccccgtgttcattcccgctgatccccagaaagatcacctccccaagttgccatgaaatgaactgttttcggagtatccgcgcgaagcacctgtttctctgcttcatggtggcatgatgcaatgtatagttctcagttcttgcatcagaccttttaggttatgattttgtgtcagctaggtggaaattgaaattaatttagtaacgattgtaatacagaatcatgaagtctcttttgtttatcaaggaaaaggatgtctaaaaaaaaaa

SEQ ID NO: 7572 - DNA, 1543 bp, Triticum aestivum
  Clone ID: PAT_TA_7572
ctgtaacctctggactcgcccaaatgctccgatcctcctcgccgcagacgctagtcgccgtcccgtgcgcccaggctgccccctaggctgccctccccccgtactgcgccctcccctagaacggcaagccgcaggggagtgagtcttccaccctcgccgccttcctgcgctcctctccagccagcccgctgaaccccaccgtccgctcccccgccactggcaccaagtgcctcggcgcagcgcccctcggacctcgcggtgatctcgtccctgacgcccccgccgaggtcgtcgcccgccgcgcgctgctccgccccatgtatgccgagactggcacagacaacccaccctgtgggctgctcgcatctggtgccgatgggcgatggagcctcaagcccgggcatcggctgcagctctacgtcacccacctcccctgtggggtcatgccggtgccacagacacccctccaggttggctggttacatctggataccatgggcagtggagggtaggggtcgggtttcgttcgcagcacgacatcgcccggtgccccagcgtggtcagtccgctggtgccaccatccttggaggttcgaatggaacagctggataccatggtgaatggatgcagtgacgtgggttgcgtgctgtggaagcccgggcgcggtgattctacgtgggcggtgagctgttttggcatggctccccgctggtgtgtcgttgggatccaaggtgcattgctgtcacacattcttgaacccttgtatttgtccaccattaccattggacaatcacctgatggtgcacctgacgggttttgtgttgaaagtaacgttgtaaaagttcttggtgctcgcctgtcctgtctatccagaaaattccctgaccctttcaaaccgaacaagccactattttttgaggcacctatcccccctcaagagtttcaacagacttcgggagatataccgcctttgacttgcgggtagttatacggtactcaatatgctggaataaatccggtttgcatgaagttgttttaggaacaactgggagaaaacaaggtacatcttcaaaggcagcatcctcaccctccactgagtcattgctctgcaagataagattggcagaggccttcgtatcacttgaacatccattagtcacaaaattccggcatgagaaactttcttatcgtgcaattaaggacatggcttgtgagtaccagcagatgcctgagcttcttagaaaggctccattttttggcccgtggcgtgctaagccagcatccgttgattcgtttacagttccacggtgataaccaaatcctgaagttctatgctgtgcccgagaggctggttcttgaagttccttgattcccccatatgtttcgctgctgtctgtaccagctctttcaacttatttgtagcatgtatgcttgtgcacaatactgaagtattgaacagtggtagcctgtaacaaacctataaagccctgtgatgtttcgcaccatggggtggaaaaaaaaaaaaaaaaaaaaaaaaaaaaaa

SEQ ID NO: 7573 - DNA, 665 bp, Triticum aestivum
  unsure (1)..(665): unsure at all n locations
  Clone ID: PAT_TA_7573
aggaattcggcacgagggcggtcggggcggccggcaaccgcgtggggagcggcgtcatgtccatgaccttcctctcgctgtccggcgccatcacgctcgggcggaaccttcttcctctacgccgggcgtcgccgtgctcgcgtgggtgttcttcttcacgtgtnctcccggagacgcgcggccggacgctggaggagatgggcagtctgttcggcatgaccgacacggggccggaggcagaagatgctgcccccgggacacaggacgcgagctgcagggcgagactcttgattaatcacatgaatatttggggctcagtacatagaaaggtgtgtgtaggacacatctaaatgttatgtcacgtctaatctgatgttcattatgtttgtggtttactttattttgtttgttgttgttacgtttatttgtgagagtttagatgcgacatccttagaaaacatttagatgtgaattagacaaactgaggtttatatatgacacatctagatgtgacatctaagctaatgtccactctgtttgtggtcaatttttttgtcctattttttattgctgcattatatgtttgtgtgagtttagatgtgacattcttaaaaaatatctagatgtgaattagacaaactaatataaaaatatgccgccaaagg

SEQ ID NO: 7574 - DNA, 398 bp, Triticum aestivum
  Clone ID: PAT_TA_7574
cgtccgcggacgcgtgggtccgtctcctcgccagcgacagcgagcagtgagcagcggggcgcgtgcggcgtcggtgccgagagcgacgcggccgactccggcaggcgcctcctgatcaccaccgccttctcctccgcaatggcgaacaggggagggaaagggtcctaccccccgtccaagtcaggagcaccgaacggaaggcagaacaattctaatgatgttattcacctttctgattctgattctgattctgatgatttttttgaagaagaggctccccccacacactccaagtcaaatgggaaagcttcatctgatagcctaaaaactggtggaaaggcttcatccttttctaatggagaaggtagcaaaggagggaaggcatttagtgctgggaa

SEQ ID NO: 7575 - DNA, 781 bp, Triticum aestivum
  unsure (1)..(781): unsure at all n locations
  Clone ID: PAT_TA_7575
cggacgcgtgggtgcagaactaaagcttcagcttgatatgcctccaaattctatattgttatcgaactgtgaagcagcagaaatgttgcangaaaattcaaggacatatggctatcttatcagaggatccgactataaaaattcccgagtcgtttgacaaggcctttccttcttttgcatattgaattcccgagtcgtttgacaaggcctttcaatatgcaaaagaaggaaatcacttcacctctgcgaagttggtgaaagaaatcctggaacctcttaaagactatggtgttaatgatggcgagatatgcatgatagcaaacattgggcctgagaccatcgaagaggtttatgcactgataccgtctctcaaggctactaggtcgatcaatgaaggcaagatcgtggaggctcttgctgccctcgctaacataaaagcctccaagtgaacctcagctacacagctgatcgggcaatgaaggatccgtaacgggggtctctgtggtgtatggttgttcaccgaaatcgagctctttctttcgagggccgaaatcaagttgtgtgtatgtaaaccgtgctgtgcacctgtgtgccagttctaggtctggctggttgaactttgacttttggaaactagcttgtgtctagctgccggtttagctagttgttgaggtgatgtactctgaattgccaagttatgcccgatggtctggcacgcctgagcgaggaatattgttgttgcgggctgtgtgtttctgcatttgtagtttacttctctgtg

SEQ ID NO: 7576 - DNA, 1162 bp, Triticum aestivum
  Clone ID: PAT_TA_7576
cgcactctccgacccctcgccagcgacagcgagcagtgagcagcggggcgcgtgcggcggtcggtgcggagagcgacgcgaccgactccggcaggcgcctcccgatcaccaccgccttctccgcgggcagccgcaatggcgaacaggggagggaaggggtcgtaccccccgtccaagtcaggagcaccgaacggaaggcagatggttctgatttctgatgattctgattctgattctgattctgattctgatgattttttcgaagaagaggctccccccacacactccaagtcaaatgggaaagcttcatctgatagcctaaaaactggtggaaaggcttcatccttttctaatggagaaggtagcaaaggagggaaggcatttagtgctgggaagggtgggaagggctccgcatcaaatgcaaagcctgcaatgtctgatgcagaactaaagcttcagcttgatatgtctccaaattctatattgttaacgaactgtgaagcagcagaaatgttgcagaaaattcagggacatatggctatcttatcaaaggatccgaacataaataatcccgcgtggtttgtcaaggcctttcaatatgcaaacaaaggaaatcacttaacttccgcgaagtaagtgagagaaatcctggaacccattaaataaaatgttgtgagttatggatagcgaggtatgattgcgagcatacggtcggagagcattgaacagggatatgcactcacaccgtcactcgatccaaccatgtaggtcaatgaatgcaggctcgcacaggcccttcccgccttcactcacataaatgaaccccagcgacccagctgtacacacaaggaagggccagtaacggggggcaccggggtgtatggttgttcacggaaattaagctctttccttttgagggcgaaatccaagttttgggtatgtaaaaaccgtatgatgctctgttgtgcctgctgtaggtctgggtgggttgtacttttacggttggtagctagttgcaggttgagctttgaagtggttgtagtggtgttctccgcattgtcaagtagtactcgacgatcttgctcgactgctggacgatagaagtttgtggggccggccaaaaaatgtttctgcatttgtagtttacttctcttctcgtgcc

SEQ ID NO: 7577 - DNA, 638 bp, Triticum aestivum
  Clone ID: PAT_TA_7577
ggtccagccctggtgcgccgtcgctctcctccccctaccagggccccacgctgttgcgcaggtagacactaccagggccccgagcgcagcaccagatggacccctgtgtgcaattcctgcggacagcaatccagcacagtgaccctgccatttgtgcagtcgcgtatgtggcaacttagcagttgccatataatgcgacaccagtgctgccagcagctagcgctgatcccagagcagttcaggtgccgtgctattcacaacatggctcaagccatcatgcagccgcaacccgagcaatggcagggtatgtcccagtcccagcggcaagccccgcttgaggtcatgaggatgtcgcttcagatcttgccgtcgatctgcggcgtgtacgtcccgacagactgcgactccctacggcatccgcatcgccagcatcgacggctgatggctctgtgcaatggagtggtggcaaaataaaagtggcctgcatgatcatgcgtggccctgtactgtactagttgcaacttggtaatagcaaacatctgcttctcaacgaaaaaaaatgcaactgggtgattacagccttctcctgctcaacgaataaagcattttccagaaaaaaaaaaaaaaaaaaaaaaaaa

SEQ ID NO: 7578 - DNA, 758 bp, Triticum aestivum
  unsure (1)..(758): unsure at all n locations
  Clone ID: PAT_TA_7578
cattcatcatctccctctgttacaatatatttttctagcaagcctggcaccaatggaaatggtgcaaaccacctccttagcattctctggaattgtcatcattctcctttccatggccatcaccgctcaagcttccgacaccaagcccatgtcatcagccatcatgttggaagcatgcaagaatgtctcgagtaacttcttcaaggtgcgctttacatatgacttttgtgtatcaacgctccaatcagacaaacgaagcaccgacgcgaaggactaccgcatcctagctctcgtggccgtcgacgccatgaagccccaagccacggccatgacggacaaggttgagaacttgatccatggtgccaccaaggacaagctcgcgattcgcgcccttgggttctaccgagtggactacggtggcatgatgagcacccttgaaatctgccaagatatcatccagagctttgagattcgcaaaggcaatgaaggtccaacgcccttcgacttgcctgattgcattgcgaaaacaaccaaagccatcaacgattgcgctgacaaaacagagtttacgtcggtttcagaagggctaacaaaggaactatgaggagttatctatgatggccagcctcagcagttgtttgctacatctctacaatcacttccacctcctccctcgtggactacgacttnnangatattccntagtaactagaattgtctgatgggctggttctctcctgttgctcttgtcgtttggg

SEQ ID NO: 7579 - DNA, 968 bp, Triticum aestivum
  unsure (1)..(968): unsure at all n locations
  Clone ID: PAT_TA_7579
ggcttctcgccgtccgtcgccgcagggcgacgcgtgcacggacgctgtcgccgaggcccgcacgggcaccgaggctctcctcctctgcagacagcgtttgcctttgcggctgggcgatggatttggggacggagaatcgccttgcggcgttgctcctcgaggaggcccggaggctgcggatgcaggcggagaaggaaggggtgcacgcctatctgcagaaacctaatgtgaggcaccgccccaactcgcggttccttgccgccaccgttcttggcgttcagcaagcaaatcgagttgtggaggttaatgagatgtggcgtgccagggagaaggaactggagctggaatcaaagatgaaaaccagaaccaatggtcgaattgactcgagatcccacaaacggaagaacgactcaagagaccagagccctgtctctaagacccagcgagacagaccgtatggcgcatcattttcgtcgagggattcacatagcagttcttattcggactgggaggatgggctaggcgatgatgaaatcgaagagtttcttcgatcaagggtgaagcgcggacgaggagccattggttctagaatggatgagcctggcccatacctcaagcctccatccggtgggcaagacaattcaataagtccggatgcacgagtgaaagaagaacggaagcgccaagtttatggcccagagaagccactatttttgagatctaagtcctcagacgaggagccatccacctcgaagcacaagcacattaaacaagaaaagaacaatagcagcanccgcgagagaaaggaggagaacaggaggtccaaacatcaccatcgtgaacataaaagccgtaagtagggagtgatggctgatgattaatcggaacgtggacaaaaggttcaccctttgccactaatttgtgatctgttgaaactgttgtatcaaaacatgtctcttttaagtaaa

SEQ ID NO: 7580 - DNA, 602 bp, Triticum aestivum
  Clone ID: PAT_TA_7580
actccctccaagaggcatgggcagagcacaggggacgaagcaatggatgcgacctggatactgcgcaagttgggcaatgatgcaattgggaagaggattgagatccaattagcttctgatggcaaatggcatcaaggtgtggtatctaatgtcatcagcggcatgctttgtgttcagttagataatggtagctctgagaacttagagctgggaaagcaggcggttcgattgatagctcaaagatcgaagggcggaaagagatgaaacctttctccatctactctcgtctcttcccggtagtgcggcgggcggagttcacccggcggctgctgctcatgtggtggctcctccacatactgccgctgactggacgagttacagtgcgcaaccttgcgccggttacgtcatcagtctagcgtaacagacttgttttccatgctgtttgaagctcatttgcttccattgaattcgttagtgtagcaactgggagagtagttcgttttccatggatgtaaaagacgcggttagcgtgctgttgtgatggtcttgtacatgggccgcgtccacgcggagttcgaatgagtttttccttaaaaaaaaaa

SEQ ID NO: 7581 - DNA, 1236 bp, Triticum aestivum
  unsure (1)..(1236): unsure at all n locations
  Clone ID: PAT_TA_7581
aggaattcggcacgagggcgacacgggatgccgctaacaatctaactgctgtacaactcactgttgatttgaagcctaaccttcccaaggaagctgagaggatccagcaatgcagaggaagggtttttgctcttcaagacgagccagaagtttcaagggtatggttgccgaataacgattctcctggattggcaatggcaagagcttttggagacttctgccttaaagattatggcttaatatctgttccacagatatcatatcgccgtcttactgaaaagggcgcgtggataatactagccactgatggggtttgggacgttctttcaaacaaggaggccattgatattgtagctgcagctccatctcgagcaactgcttccagggctctcgttgattgtgctgtcagatcttggagattgaagttcccaacatccaagagtgatgactgcgctgctgtctgcctgttcttggaccatgaaaagtcacctaacttggttgaagagagtgaagccaagaatgaaaaggcagaacctgccaaggatgctttgatctcagacgccggtgataaaatcaatgaagacattgcggatgtgaatgaacacatctccagggaagagcaccctgagcccacattggaacactcatccacgctaagaaatgttgacgagattatgccggtggacgaacctcctgtatcaaaggaacctcaaaggtgcgggtctgcccgcagcctggctgactgcatatccacaaacgaggaggaggaatggtctgcgctcgaaggcgtgacacgggtaaattccctcttgaaccttccaagaaaactctcaggtgacaagaaatctaccagctggaagaagcgacgctgagcgaacattatgaaaaaaaaccatctgctctgatgaaagtcaggtagggtgcttgcagtggcgcatcacagccggcatttttcagccgagcgcgtgcaaattcttcagccgattttaggtccctgccctagattgtttcaggctggctggcaggtgtgtacatttaagaagattgttttctcttcttccttgtggtatttgtcaggaggcgttccatgcttgggcttctttacttgtatgtgcatatgaaagtttttgttctgtgagaagcttttctgtaaatcatgtaagacctcctctttaatgtcgggatgttcggttgtagctgtcctagaacaataactcaattctnctatgtgtagta

SEQ ID NO: 7582 - DNA, 1196 bp, Triticum aestivum
  unsure (1)..(1196): unsure at all n locations
  Clone ID: PAT_TA_7582
gncttgttccttgctcccacatcacctatctcttcctctctcatccctcaccaagtctgtgaccaagatctcatggccgccaacgccaactgcatgtccacgaaccgacatgctgatgaccagccttcgctaccaccagcaatctcgctagcatcctccacacaccaccctaaccgcggactcagctccgaggaggagaacctcgccttctctctgatgatgctggctagtggcatccgtgacgagcatcctgcatccctcgaccatgttacaacgccgtcatcgcctctgccaccacacgtgacagatgttccagcgggtgtatcccagggtgcaccggcgaccgaggcgaccagccaaacacccgcttcggtggttgtggtcgcttcaaggcaagttcccacacaagtgccttcaccgtcatcggcagtcgctgtcaggccaaatatggtgctggagcaggtggttccaccgagccaagcgacaggcctggtgaccgtgactcaaccagcccctggtctggcattggcatcaacccaagtgcatccgattgtcgcgacgggcaaagcaccattcagcaagcccaacaaagtatccacacggccgatcaagaccgtggccacgatggcggagaatcagacaccacaacaggagagccaacagctgttgcacgagtgcccgttgtgtctcaagaggttcaagaagtctcggggccttaatgtgcacatgaaaacccatccagatgggaggatgcacccgtgtgtgtggtgcacgagcactttcccaacctcctccgcgcttcgctcacacgtcaggcgcagcaatacctgcggtggaaacaggccgagaaggcttgcacccatagccgcggcggcgatcgcatggcacaccatcgacctgaacatgccggagatttgattagttcggcgatggagaaggaggaggacatcgacaaagaacttgcggttggtgtgttaatgcggcaataaatgtcagtttctagtcctcatattagagtccggcagtttccagttgatgaacagctgtagtatttaattttggtggctagcttgggcttttattgtcggtccgtgtttttatcttgtgcttgttgattggttcaccatggtccgatctttcttttttgtatgccctttgtctggtcatgattgcatttacanattaataaactttat

SEQ ID NO: 7583 - DNA, 1144 bp, Triticum aestivum
  unsure (1)..(1144): unsure at all n locations
  Clone ID: PAT_TA_7583
gaggaattcggacgaggctgctctcnctgccaccgctgctgtccttcacctccgcctcgccgtccggcaacgcagctcacttcgcctcctcctggtcgacgcaactccggtcatcttgccctctcaccatggcgatggcggctcccacccggatctgaaccagccgcaccctaccgcccgccgccggacagcagcagcagctaggtacgcgtcaccggcgacggcatccgtcaccggcaggaaggcagcatccatcaccgccagacctccgacgcaccgtgccaccgacgcacagcagcaggcctgctgtgctgcgacccaacccccaatttgaagcaactaggtgctaggcagcggcagcggcatctgtcaccggcaggaaggcagacaggcagcatcccatcaccggcgtgcttgcgacaacgtacgtactagtttacagctaccagcagcctatttttaccaacaaattccttttgattcttggatgcaggcgccgcaggtcgtccatctctgcttctggcccgaggatggccgacgctgccctcggcgtggtgcaatgggtggtgagcaaggcgctagccaccgtcacggatatcttccaggaggcttgggagggcaccaggatgtttggtcccaacgttgaggccctcaggatggaactgctgctcgtcaaggccacgctcgaaaatgctgcctgcaaggagatcagcggtccagccatggaggagctgttgcagatgatgcgggactcggcgcacaatgctcaagacttgctggacgagctggactacttccgcatccaggacaagctccgcggcacatatgaggctgccgacgagcacggcgagggtggtgtccagcaccttgcccgtgatgttcgccacactcgcaaatctattagcaaacggctggcatctttcaccgggtcctgctttggtgccaatgctcgccatccccaacaagaagatgcaagacaacatgtcagctgttgcgcttggcagcatgctaggcacataacacgcggcgattcctcctctgcgccaaacgccaatcaggctgatcaggaggtctccccgcatccacatgttcatggtaatgaagatcgtgacaatgcaccagaaacaccaataccagagtttaa

SEQ ID NO: 7584 - DNA, 877 bp, Triticum aestivum
  Clone ID: PAT_TA_7584
ttcggcacgaggtcgatctgaaggggtgcgtcgccggcgagctgcgacggcggttcctaggtcacggccgcgagcgccatggcttcctctcctcccgagctccctccctttccctctctctgtcgagccagcaagtcaattgatcgactaatcgcagcgattaatcgcagaaaatcgctgttgagccagcgagtcgggctactcgctccgcgagccaagtcgcccgcgcaagccagtcacgacgcgacgactaggcgattagtcggcgactaatcggcgattagtcggcgactcaaaaacctcgtcagggaggagacttgtgtggcatatgacgaaataatttttttcaatgggatatttcattgcagggtgatatggaggaaccaaaagatccagaagcatcaccctcattaaaaatttagggaggacacttgtttggcatatgacgaaattttgttgaaggtatttgtgtgattgatgagaactacatacataacaatgcaaggacactataatttcgcattttcaaggctagcacatggagcggtaaaagggaggaggagctaccatggtggccaggtaactcgaggatggaagggaattggtgtagaataagcctgctctctacaagaaaatacataggataattaggaaacaaggtgctgaaaaaaatagaagaaaatgcagagaccaaatacagggactgcaactctgcaagactgaaattaatgaaaagctaagccttttctattttagatgaacaaacagcaaagccagttgaggagcgatctccagtagctccccggtcactagcggagtcaaagattgtccgctgaaagacggacaagtgatcatgttttatcattgttaaaggagt

SEQ ID NO: 7585 - DNA, 861 bp, Triticum aestivum
  Clone ID: PAT_TA_7585
gtactgtacgcaggagggagggtgaagatggatggcggaagcagcggtgtgggcgcggatgggatctggaggccatgggacgagcacaccgtgctccgcccagaggagatggagtacgtgcggcggttccaccaacacgagccaggcgccaaccagtgcacctccttcatcgccaagcacatcaaggcgcccctccaaaccgtttggtcagttgtgaggaggtttgacaagccacaagtttacaagcgttttgtggaaaactgtgtgatgcaagggaacattgagccaggatgtgttagagaggtcactctcaaaagtgggttgcctggtaaatggagcatcgagagattggagctgctcgatgacaatgagcacatcctcagtgtcaagtttattgatggtgatcatccgttgaagaactattcatctattttgacggtccaccatgaggtcattgatggtcatccgggagcactggtgattgagtcatttgtggtcgacatcccagaggagaacaccaaaaatgagatcttttaccttgttggaaactttctcaagtttaaccccaagttgcttgctgatgtgtcagagggacgaatcgatccccgggcactaaactaatggtcccttattggttggctaatgaccaatcaattagcttgctccccccatgaaacttctctatcaaattgaccgagggccctacatttcatcgttggatatttttagaaattaatttgtacaatgtatgtggaaaattgtttgttgagtttggttttttcaagggcaggtttatcaggattttaaattgaagaatatgaataaaggaccttttccatcattccgggggaaaataaagtt

SEQ ID NO: 7586 - DNA, 807 bp, Triticum aestivum
  Clone ID: PAT_TA_7586
gcgggggtggaagtctactgacgcggagcagttgaacaaccaaggcctttatgttctatcatctcactgcccctcgctgtctgatcttgctttaagcttctgctcatacatcgacgacactggtcttggttatctatctgactgcaaaaaattgaggtccctcaggctgaaccgtgcaccagcagtcacttctactgggatttttcgggtggcggttggttgcaggtatctgtcagttctccaccttgttgactgtaaggcagtagacaacagggagtggcttgagtactttgggaggtatggatcgttgggtgaacttgttgtaaaggattgtgatggaatcagccagtatgacctcttaaagtttggcgcaggatgggcaaatctccaaaagtttgagttcgagattaagggagcttactgcctgtgtctgccccctgatccctccatacgtggctggctacccatatagctatgacatctgctgtgatagcttgaaggatcttcggttggctcatattgtaactaagccggaaattggactccgttttctcctggggaagtgcaaagcattggagacactttacctggagtatgttattggtctacatgaggatgagatgattgcactattccagaggtgctgcaaccttaaaaccgtcgcacttcggctcatgcctctgcgctgtgaagatcattgagtttaggacggcactgactgatgacagcctagaggtcctagctctaagcttccctatgcttcaggttgttgagctcactttcacattttgtgaaccctcttatcct

SEQ ID NO: 7587 - DNA, 971 bp, Triticum aestivum
  Clone ID: PAT_TA_7587
tcggcacgaggcatgttgatatgctttttatgtgcatccggcggtctcacttcagtagatgcatatggacgcttgcaaaacaatgggacgtttttaacatcaccaagatcaacctcgtttgtgttagctgggaggaacaaatacaaaggcaacaatgattacaatcatgtagctggctggatcacgcgagcaagcagctacggcgctcgagttaaaataggtatatggggttcacaagtacaacatcattcccaagaatccggggcagcaataagtatcagcactgatgatcaagataagaccttcaatatgatcgaagctggatttcatgtacttcctgagttatataataataatgatgtccacttctttatacgatggacgaaagacgacaacaaatcaacgggctgttacaatttggaatgccatggttttgtgcctgctagtggagctgcacttgttccgggtcaagctgttgctcctccctcgacttacggccgggacgatcgctacataacaattagcctgcatacagatccaaaaacgagagattgggtgttgtatcgagacgatttgcataaacctgcatttttgggccattttccaaaagagctttgtcctagactgtatggtatagcccccggagtagcattgcttggatttgtcaattaccaggataaggataaaggtggtcccgcaatgggtagcgggcattttccagaagagggccaaaggaaagcagcatactttaagaatatcaagctctttgattccaaagctaatgtatatgatccgagtggcttggttagacttgtcaccaggccagcatgttacaaagtaagtgacgttctccatgctaaaaaggatggccatatgttttactatggaggtccagctggttgtatgggttgacgagtatcacttgttgaatataataaaagtgataaacacatcattgaacaaaaaaaaaa

SEQ ID NO: 7588 - DNA, 618 bp, Triticum aestivum
  unsure (1)..(618): unsure at all n locations
  Clone ID: PAT_TA_7588
atccggcgctgaatcagaaaatgtggatgaagaccatgttcttggtgctcctactatgcatgctggtggtgacaccaaaggcggccgagtacggcgtggggagccataacagtggtccttggatgtggtgtgatccggccatgggccacagggtgagaccgctcatgggctgccgagcaatggtgaagctccagtgcgtgggcaaccaggtgccggaggctatccaaagagactgctgccaggagctcgccaacatcaccaacgactggtgcaggtgccatgacctcggcagcatgctgaacagcgtgtatcaggagctcggcgcgcgggagggaacggaggtgttcccgggttgtcggaaggaggtgatgaagctcacagtggcgagcgtgcctgcggtctgcaaggtgcccattcctaacgcgaggggtggagaaggtgtctgctactgggcctagtcaagccaatctgctttttaactaatgtgttgagtgtgcacaggataaataaaatgaattaatggtgtatgtgcctatgcgagaggcatgcttcgtgaataaatgtgaactcaatttcgcatagaatcaacaacaacaacatctcgcatcaaanaaaaaa

SEQ ID NO: 7589 - DNA, 926 bp, Triticum aestivum
  unsure (1)..(926): unsure at all n locations
  Clone ID: PAT_TA_7589
cgtgcctggaccgcaggctgagactcgcgcaaccttcccatcccatattaaactcgccccaccccatctagggtttggccctcccaagagacccgcgacccccttaatccctctcccaacccttatctgcatccctctccatggccacggcggcggcggcgaagcggaagccggtgttcgtcaaggtggaccagctcaagcccgtcaccagcggccacacgctcgtcgccaaggtgctcagctccaagaccgtcctccagaaggcccgcgccgctggcggccccggcccggccgccaagcccaccaggatcgccgagtgcctcatcggcgacgagaccggctgcgtcctcttcaccgcccgcaacgaccaggttgatgttttgaagcctggcaacactgtcattatccgcaatgcaaagattgatatgttcaaagggtcaatgaggcttgctgttgacaaatggggccgtgttgaagtaactgaaccagcaagcttcggtgtaaaggaggacaacaatctttcacttgtggagtatgaacttgtcaatgttgaagagtgaaaatcacatcgatcttaatcagaagtgctttcccaagcctgttggtcaaatctacttgttgagttgtctagaatgtgaaagatggatcttctgagttcatattggaattgttcgctcgaactaccgcaagttccttcttatcaagcatttctatctatgagtgattgttagttgctgcagcagttgtgtttctgagaacaaatgtgatgtgctgagcagtaatatacaatttgatctccctaaatgggattatgcacctttcaagcttgcaatttttgttttattttaaacactgaggggctcgtctttgcggtccttgcgatgatcaaacacactgatgttgggatantggcttgatactaccca

SEQ ID NO: 7590 - DNA, 606 bp, Triticum aestivum
  unsure (1)..(606): unsure at all n locations
  Clone ID: PAT_TA_7590
ggnctgcaggnaattcggcacgagggagaagaccgaggagacgggggagggactgactgggctccggcttcgcgggcgctcctcctagggttccgggcgccggtcgccgccggggcaagcgagaaaaatggtcgcagggaatgccctgccgttaattggaggtaaaggagatgcggactggcaaccaagcaaggacctgggttcatatgaccttttgccagcaagtctttcaggagaagagctggcattcaacatgaacagtggtgctattcatggaagctggagggatgctgcccctgatcgcagtgggagtgcacctcctagcatggaggggtctttggctgaacttgatcacctcataggcaagcacagtgggaaccttgaggccacattgaggaacttgagctctggagctgtcagttcagagtctgagctatgctctgatccggcatacttaaaatattatggctgcaaggtgaatttgaacccaaggcttcctgcaccgcttgtctcaagagagagcagaaggttgatgaaccggtctagcaaagctggagaatggaggccattatatgatcacagcagcagtgacaggtccttgactca

SEQ ID NO: 7591 - DNA, 1184 bp, Triticum aestivum
  Clone ID: PAT_TA_7591
acaaattctgagaaaaccgtggggcgaagttgaaaccctgcggctgcaatggaggcggcggcggcggccgtgggcggggaggacgacgggaggggtcggaagggaagctggtacgcggtgggggagcgcgcggtgctggtgccgtacctgcgggagcacgtcccgcggtaccacgagtggatgcaggacccggcgctgctggaggccaccgcgtcggagccgctctccctcgcccaggagttcgaggtccaccgctcctggaccctcgaccctctcaaacatactttcatagtgctggataaggagttgatcgagggagacttcgtagtcgggaaccctcacactgaagctatgattggcgatgtcaacatctatatgaatgaccctgatgatttggaacttgcggagatagagattatgatagctgaacaaaagagccgtggaaagggactaggtcaagaagtgaccttaatgatgatgtcatttgcagtagagaaatacggaattcacactttcagagcaaaaattagtgactcaaatactgcatcgttaaagctcttcaggaaattgggcttcaaggatgcttcccatagtgcagtttttaaggaggtgacactggaggcgcctgcagctgaactcccattgagctcccctttgaccataggaagctggtgacatctgtgattatgtgccccaagatgtgctgcagtagacatgcaatcagtggctggtcttcaccaactgatagaagctaattgtgtgcgctatttggcatgcttaatgtaatgagtactgccttcatctgccaacaactgcttgggccgattgcgcacagagatatatagcaataatatgaagaaccctgtgttggattgctgagcagttgaggtggcgcctgatgttttgagacgaaacattgcaagttcggtacaaattgccattggggcaaatggaacaggtcgcggtaatttgcaggaactgtagatggtatatgcatcgtcaatgacacgacacgggacactttgtttgaagcatttcacggtgctcgtcttttgcgtttgcggagttcagatagccttatgggtgaattctttttgtttttgttgaacgtgcatgattgaatgtactaaacgatttgtataagcgaatgggcaaaaaagtttcaaagttcaagtacaaaatat

SEQ ID NO: 7592 - DNA, 1108 bp, Triticum aestivum
  unsure (1)..(1108): unsure at all n locations
  Clone ID: PAT_TA_7592
gcctctctccattgcccgatctcctctccaagccgccagcacaccccctgccatcgcgccgccgtcgtcgttcccgctcgtcccggcccccatcctcgacctcccttttcgttcttccccacaccgtgtccgtgccgcgcggggtggcgctacaggacctgctcgcgcgcctcgccgacgccaccggcccgcacttcccggtcaggtaccagctccctgacaagggcctcgacgcgctcatcttggtctcctcacccaaggatctcgacggccccaagctgcgggtcttcatcttcccatctccaacgtggcggcgggggatgagggtggtgagggcagcgccgggtttgacgccgctcacgacgccggacgcggcggtgcggccgcatgtgggctgcctccccggccttccgcatgcagctcttcctgctccgctctctcgtgcccacctgcgtagatgacggccacgcctcctcgagctatcttcgtccccgcgcgatgtatgcaacatcggcggacgcggagtcggtgatccagcgaatcacgcctccgctcgatcgcgcaaggcacaagggtcagacagatatgttttgagatttccctagagccgaccaataaaacaacactagtttatataacacatcgtttcttcacaatttgactactacggtcaccgaatccttggaacaggttcttatttatctatgcctatatgttgttccatgaaaatacaagtagactccaaggtggtgctgcttggatctgggggagcactgggtgcttaataagtttcttgagatgtatgcactgcatgaaggagcacatttctgtcaattttactagaggtcaaggttaccttcaaatgcatgtagttatttgtaagcttcaacagcttgaatgcaatggaagtttggattgaaaggatttttggttggctataaggaagagagtagttgatggccatttgtactgttgttgtggtcgtccttggcgcagaaggggtggcgggggaggcacagagatggggcaaacctttcactgtgtctaatccacttnattccatcattttctatgagatgcaccaanattgtaacgaatcttcacgctt

SEQ ID NO: 7593 - DNA, 645 bp, Triticum aestivum
  Clone ID: PAT_TA_7593
gcacgaggccacgctgctgcgccgtcgccgatctagcactctgtgttggccttcaacaaccgcacaccaggacaaggggaggctcaccagcggcggcgaaagttgctgctgtaggttcctggatgtcttctttcatcacaacgacaacaagaccctcgttactctcacaatggccactgaaatgcagcctctagggtcacatctcatccccatcaactcaaatcaaaacagaaggagcagacaaaacagagctgtaggagctaggcttccaccgcagctggcgtgcgtggagggcaaaggccaagccaaaaggtcagacgaagcgccgccaggcggtggagtacgtgcagacggatttccgacgaagcccacggtgtacaacgacgttagaaacttgcgacacgacgatgagccaaataactgcagattatcacagagttagaacacacaagattatttaaccttgcaattagaatacaaagggttcagtgatgtcttttttccttgatgacagatgcaaatcatctggatatgaattgggtagtatttattatcaggtttagatacgttgattaatgggactgtagcaatagcaaaaactttcagtagcaagctacatctctgttctctatcccaaaaaaaaaa

SEQ ID NO: 7594 - DNA, 174 bp, Triticum aestivum
  Clone ID: PAT_TA_7594
ggagcgacctgggactcctggtggttcagagttcatgcttcaaattaagtgttgacgtgtcttttttcgagttcttcgtagctactatcggtacctatgcatttattttgttgttaatgccatgaattttctcgtggtacaatatgatttcttttttgcgatagaaaaaaaaaa

SEQ ID NO: 7595 - DNA, 690 bp, Triticum aestivum
  unsure (1)..(690): unsure at all n locations
  Clone ID: PAT_TA_7595
gaggaattcggacgagggacgctgacgngtccgacgccacaacggcggcggcttctcggtgccgcgctactgcgccgagaccatcttccccaagcttgactacagggctgacccgccggtgcagacggtgctcgccaaggacgtgccccgggaggtgtggaacgttccgccacatctaccggggcacgccgcgccggcatttgctcaccacgggctggagcaccttcgtgaaccagaagaagctcgtcgcgggggactccatcgtcttcctgcgcaccgagcacggggagctctgcgtcgggatacgccgggccaagcgggtcacctgcgggggcatggagtgcatatccggctggaacgcgccagggtatggggggttctcggccttcctcaaggacgaggagaacaagatgatgaatggtggccccgccggttacgtcaagggcagggggaaggtgaagatcgccgatgtcgtggaggcggccacccttgcggccaacagccagccatttgaggtggtgtactacccgagagctagcacgccggagtttgttgtcaaggccgcggcgatgcaggctgccatgaggatccactggtgccctggcatgaggttcaagatggcctttgagaccgaggattcctcaagaatcagctggtttatggggaccatatcttcggttcaggttgccg

SEQ ID NO: 7596 - DNA, 797 bp, Triticum aestivum
  Clone ID: PAT_TA_7596
gcaagaagaaactgacgacaccaacagttcttgataccctgaagaagaaaactaaaagggcctataacaagaggaggaatgccactgcgaacaacctatgcacaacgggtcaccgcaactgacagcataacagaaagcgcaaatgttcaggaagatcaagtaaatgagggatggccattaacatctagtggtgcaccagataccttcccatacggagtggagaccatatctttcgatttgacacaatacaacaatgcgccaagcttccattggcctgaaagcagcagcagatctcagcttcagtgaaaggaggcaacacttagttatgcgttcattcgagtagcctgcgttctaacatgatcacatgacgggcagagtaagtgttgatagttcaggtccgaccttgtttgctctgccactaggaagttggtggccgcccgaacaacggtgaaaaaattctcaaacatggcagaaaccagtaaaactaccaccgacttctaaccaacttggtctaaattggtttggctaattcggcacgccgctgattgtcacctccatgtaatggcccagctgtacatattcatttctgttttttcgcgtccttagatatttgatgttccattacttaggtttacttgaatcatgttaggtatatcttgaataattcgacctgatgttatcctgtgtaccattcatggagtgcactgttgtgtatgatttgttcggtaaaaaacatttgtttggcagttatcaggtgatgctgagttgcaggcctgctgtgcctcacaaaaaaaaaa

SEQ ID NO: 7597 - DNA, 557 bp, Triticum aestivum
  Clone ID: PAT_TA_7597
ttcggcacgaggaaagaaccctgggtgctgatctctgcctccctgtgtcccttggctgggccgccctgcctccctccctcgctccgcttgcgccccctcctcttctcccatccaccgctggcggcttcccatcagcttctttcgaggtcagtccacttcactatcgtgtctttgctccatctcccgcctcccccccttcacctgcccccccctcccgtcgcccccgttcctccaccgcccccgtgcagccggcgtctgccctccacgcaccaggcagtgccgcctgctccccatcactcgcaaggcagtgaagttaggccgccctcacacgtgtggcagtttaatatggcgtctccacctcctgggtctttgtaaagtctgctgtacacctgcagcttgtgtgctatgtcttctcgacaacatatgcatatgttctaatcaataagacccatctagtgaatgatctactatctttctgtgatatatgtggtccatcttgttatttggaaacatgagagtcaaagcttgcattgtgaaacaaaaaaaaaaaaaaaaaa

SEQ ID NO: 7598 - DNA, 1086 bp, Triticum aestivum
  unsure (1)..(1086): unsure at all n locations
  Clone ID: PAT_TA_7598
ggcacgaggcctcgacgagggcgagggctcccacaacgtctccctcggcggcgacttcagcatccaggttctgcagaaggcactggaagtctgggacctccaagttcttccccttgactccccagcagctgggtcgtccctatttgacccagagctagaaattgctttcatttgccaccttcaggaccactggttctgcatcaggaaggtgaatgaggagtggtataacttcaacagtctctaccctgctcctgagcatctgtcaaagttctacctctcagctttcattgacaccctgaagggggcaggctggagcatttttgctgttaggggcgatttccctaaagagtgtcccatggcgacagaaggctccaatggtttcgggcagtggctgactcctgaagatgcccggaagataacagcctcttgtaaccaggtgccagcacccactcatcagggagcagtctctcagcttggtggtcagtcagcaggcatgagtgaaatggacatcatcgcagcacagcaggaagaagctgacctgaacgccgctatagctgccagcctgatggacgctgggggcccatttggcagccagagtgcacctcaagaagaatccaggccccagcctagctatgtggtggagcaaggagctaatgtaactacctctgacgcagtcggcgaagatagctatgtggtggagcaaggagctaatgaagctgaagcaagcgagccgggcagcgataccatagaggggtccgccccaggcagctacccgagggagaggtctcccccttcagagagaagatagtgatgaaagatgatttaggtcgttccattcgggctgggaactgtgttgggactatacagacagaaagtgaaaaagggaccccagtgattccgtttaaaccgcccctccgcggggggcaatgttgttccgaacttgtagtagttccggagtgccgtatactcctcagtcttgaacctgcctggattttgaactttgcctcctgttaagggttgtgtggaaactgcatagagtccccctttttttataaataaactgctgnaaaaatgnggttttgctnc

SEQ ID NO: 7599 - DNA, 579 bp, Triticum aestivum
  Clone ID: PAT_TA_7599
gtccccccctccctccgtcccccggcctgccccctcccccccggcctctccacccccgcccccctcgtccgcgcgggcgccgccctccgcgcgtccccgtcgtcatcggtccgtcctcccccccgccacccccggcgcggcgtccgtcgccgccccccctccggcctctccggctccgggccgccgtgccggcgggggggcggggcggggtggtcgccgccggccggcgggcggcgtcgccggcggccccgccggccgcgtccgcgtcccccggcgccggcgccggcggcccccgcggcgggggcgccgtgctccgcggcggcgtcgaccccccggccggcgccgtcgccggcggccccgccgcccgcgtccgcctccgccatcggcaacttcgggatgccgcagtacgggggcaccatgcacggcgtcgtcgtctaccccaaggccaacaccaaggcctgcaagcccttcgccgacttcggcctctccttcaaccccaaggccggcggcctccccgtcttcctcctcgtcgaccgcggagactgctacttcacaaccaagggatggaacgcgcagacg

SEQ ID NO: 7600 - DNA, 1318 bp, Triticum aestivum
  Clone ID: PAT_TA_7600
attgaacctttctttgatggtttcaacaaaggaaaatgaggagaagctatgtactgctttcaccattactgtggatgctaaagaaggcacaacgactggggtatctgcaaaggatagggcaaagacagtcatgactcttgcatccccttactcaaagcctgaagatttcaatcggcctggccatattttccctctgaagtacagagatgggggtgttctcaaacgagctggacacactgaagcatctgttgatcttgctgtgctggctgggttacctcctgttggagtactctgtgagattgtggatgaggatggctccatggctcgcttacccaagctgcgcttgtttgctgaaaagaataatttgaagatcgtatcgattgctgacttgattagatataggagaaaaagagacagactaattgaacgtgcatctgttgcacgcatacctttgagatggggcaatgtccgtgcttactgctacagatctgttattgatgggatcgagcatatcgcaatggtgaaaggtgagattggagatggtcaagatattcttgtgagggtccattctgagtgtctcacaggagacatttttggatcagcaagatgtgattgtggtgaccagcttgcaatgtcaatggagaggattgagaaggctggaaggggtgtactagtttatcttcgtgggcatgaagggaggggtattggtctgggtcacaagcttcgtgcttataacttacaagacgatggacgtgacactgtggaggctaacgaggaactaggactgcctgtggactcgagggaatatgggatcggtgcacagatattacgcgatctaggagtccgttcaatgaagttgatgactaacaatcctgccaaatatgttggtctgaagggttacgggttgagcattgtgggtagggtgcccttggtaactccaataaccactgagaatcagagatacttggagaccaaaagaacgaaaatggggcatgtatactccaattgaccatccgacccaaagcaacggaacagattagaagcgctaggccaactggacttgcttccattcacatttttatcttatgatattcttctacagttgagtttctgggattatttcaacccatatgttccaggtgaattgttttctaggccatgataggtggaaatataaatatttggccagtaataataataattatccaaatgtcccttagtttctttgtaattcccagattttacaaacacattgttgtaaatatacaaaatcgaatacaattatgagcaaaaccactgccaaaagatgtttcggttc

SEQ ID NO: 7601 - DNA, 1451 bp, Triticum aestivum
  unsure (1)..(1451): unsure at all n locations
  Clone ID: PAT_TA_7601
cccccgctctacccacaccaaccccatccctaatcaactcacccaaccacgaccagaactcaaatccaataccgagaaggaaatcgaatcgaagctctcttttccctcctcctactcgttcgccgccgcaggagacctcggccgagaagcctccgacggcaggttgagtccctgttttggaggggagcatcggaatggcttcgattgcgccgtcgtcttcgtccgtcgccgtgcttcgccgccaaccggtgcggttcttgggaggcagtgatgtttccaagcaggcaaagggatcagtttcttattcttttcccacaaattcgagaaatgccaacatgaagtctgtgggcttgaagatagcagcatccttaaaaaagaatagtggacttccagctgatggttgcttggaaaatgatgacacgctgtcgctaaagagcacttctgtgcgagcccaggaccatccaaccacaaactctgttattcctgtggattccgttgttgcagcagaaatcatatctactgatctgtcatgtgtcgtggacacattgtcaaacgaagaagacgatgctgaacttgatctggatagcccgaccgagggcttctcatctatttcggaggctattgaggacattcgacaaggaaaacttgtgattgtcgttgatgacgaatcaagagaaaatgaaggtgatcttatattggctgcttctttggttaccccagaggctatggctttatagtaaggcatagcacaggaattgtgtgtgttagcatgaaagaaaatgatctggaaagattgaaccttcctttgatggtttcaacaaaggaaaatgaggagaagctatgtactgctttcaccattactgtggtatgctaagatattacgcgatctaggagtccgttcaatgaagttgatgactaacaatcctgccaaatatgttggtctgaagggttacgggttgagcattgttggtagggtgcccttggtaactccaataaccactgagaatcagagatacttggagaccaaaagaagaaatgggcatgtatactcaattgacctccgacccaaacaacggaacagattagaagcgctaggccaactggacttgcttccattcacatttttatctgatgatattcttctacagttgagttatattttggtgttatatgggcaacaatttctctgttgcttgtcaaaagtatggatatggcatgcttctctctagcatttcttttcctttgcaaaagcaaaaatgcacagatacggtggtctgtggtacaagcacagatcaattctacgagtttcatgtttgtctgagcaacatgttggcacctttgttttttggtgtgtctgtgttgttgttgcaaaattgtccttccctgttatcatccttcttttcttggagtcctatagaacaaatactgntctgatctacattatatgcaac

SEQ ID NO: 7602 - DNA, 621 bp, Triticum aestivum
  Clone ID: PAT_TA_7602
gattcggcacgagcggagacagagagtacagagtgatggcgccggtgattccggcggaggccacaacggcttgggaccccatcggcgggggcgcatcagcggcgccccgggcggaagcctcgaagcctcgcgaccccattaggagggggatttccagcgggggcgcagcgggcgcgccggattgggaagaagtcaaggcggaagcaaggcgcattatccggcgatctacagaccggaagaggtgctggaagcaaatgaagaggcgagcggaggagatgatgcgcgtgaatccagtgaagatcctccctgatctggcggggaacgtgaagatgggcgactactacggcgacaaatccgaggtacagaaatatggtaggggttgtaattcgctggatttgatcccgtccgggacagggggtccgattttgggtgctagtagtatggaaactagtactattgttcaggattatagagaaatctattcggtgggagatatggatgaggaagagagaaatcagggaaggagtcccatctgtacaataaaggaaaatagagagattagtgggattttattttggaatctgcccatttatgatcctttaattttcgttaaaaaaaaaa

SEQ ID NO: 7603 - DNA, 1373 bp, Triticum aestivum
  Clone ID: PAT_TA_7603
gcttgcctcagccctccgagctccccaaaatacagtgcctgcaatgtcagaaaaaaccaatggctaagcttatcaaaagactgctaaaaactgttttgatccggtcagtaatctcggatgtattactggtgaagctcttcatccactgttttgcccgaccctaaggtctcagcgtaacttgacccaggccacgggagcgaacgacttctcacttccaccatgaccaggacttatacctgaagagaaaggaccaatcggcttcctcagcaaaagatcaagcgctttaaccactgcatgaaactgctggtcatattgctcacgccatcgttcgttctgatcgtgaagcacctgtatcaaagccctggattaacatgtagagatccctgtacaagagaagtgataagccagctgcgcacatcttgttagccgtatcacgaagtgttctgctgcaggttttgggcgcttctgttaaccgagaaaggcgcaagaaggttacatggtcgtcagcgcttatgtgtactgtagagcacaagcgaactttacttatatcgtgacaacctaatgcgcacttgtgtagtagtgacaataaaactgaatggccatgacgatccaagcagtgctgcaaactttttttacccagtcagtggtcagtcgtttatgacagatgatgctcttgatcaagtattctccccgccacttctgctggagtcttccttgttccccgacgcgtacgaggacttgcttgcaccattatcagaaactgatgcagctttgatggaacattaggcttcacgtgtataccatgtaatactttaaccaccctgaagcttcagtgcttaactgcagcccagaggttctgatggcttatttccaagtgcggatggcacatacggagtgaattctgttgcttgttgagttgcatgccagttgccaccagcttgtgagagggatgcttgtgcatcctatgttggatctggagagaagggcggcaaggggtagatggtatgggatgggacagtaggatgtaccgactgccagtaaaaggttgccaatcttatgttagtacacatgatctgtatttgtgttgtagtaattttatatcctcttattgaagttgctgttttgatgcgtcccaattgttatcccccatgtctttagggctgcgaggctattggcatgtgctggattgataaaaggtgggtcctccgtcgaatcgttctctgtcagttgggactcgtcgggggggtttcggtacggtcctcgggttggtgcttttatgttatccttcaaattttgtgaagcttctttccttgcacacttttttattgtaaagatgagtattcttgttgaacagtgcatactaccggtaatgc

SEQ ID NO: 7604 - DNA, 406 bp, Triticum aestivum
  Clone ID: PAT_TA_7604
cacgaggcgtaccccatcgatcgctatggcatggtgcacgaagaacatcggcaaaggactgttggcagccaccaaggtgttgatatgcttgtgcctggtgacgatgcttgtcttgtcatctgaagagatgaaatcggatgcctgtgataaagattggagcctgacatgggacaacagttcatgtatccttcgcggcacctgcaacaagccctgcagaagggagaactttgagcgcggcatctgcaaaaaactctttcattgcatgtgctacagacactgcaacactgaatctatctagccatatatgtgccattttcttgcatgctcgatcaaagctattgctatgagttcatgcattatgaatgaaataagttaattaattttaaaaaaaaaaccaaaaaaaaaa

SEQ ID NO: 7605 - DNA, 476 bp, Triticum aestivum
  Clone ID: PAT_TA_7605
ttcactgataacatcccgagagtatttccttctggactcggggccaaaatcttcactggatcgtgggaagtgccacctgtgttcaagtggcttcaacatgttggaaaaattgaagacgccgagatgatgcggacgttcaacatgggcgtcgggatggtccttgtagtaagcaaggaggcagctgacaggattatcgagcaatcaagccctgcttaccgcgttggagaggtgatccagggcaagggtgttcactatgtctgatgccttcgataagcttttagctcaaatttggagtgatttgagatttgttttgtcgtgtgggcaaagcagccgaatttttgtaactcttttatcttaggcgagcttcgagtgttcagttgaacttctttcaatggagaagttgagaatattttattacttttgtatcaacatctttatatatataaattaatgatatttttgtactaaaaaaaaaa

SEQ ID NO: 7606 - DNA, 1163 bp, Triticum aestivum
  Clone ID: PAT_TA_7606
tccgcgcgtggcccggcgcgaccgccgcccgcctcctcctccgccggtcgtcgtccaaccccccgtcctgccgccgcctcccccccccgctcgccccaaggcggcgcagatgggctctagcacaagcgcagacggcggtggcgcgtccgtgttcggcggtttcatgggctcgtctgtcccgcagggccgcgcacccatgctcgaccagggacagatgcacctgcagagcctgatgaactcgctggccggcggcggcaatggtggcggaatgtttggcggcgccaacggccgcggcatgattgatccgaggctgtatgatatggatcagcacgaggtcaaatttagccagggccgtggcggcgctggcggggacgtgacgcgggactttcttggcgtcggtggcagaggggacatgatgagggggatgtcagtggcaagaggagagaaccacagcggcagcgacatgagcttcttggaggcggagatgaagtcggcctcgtcgcctttcaatggaggcaggatgcagtgaagagcttgtagaaaggcagctggcttgcttaagctagatcctatagtgagcgagttgggatctcgggatacatcatacatccatggaacaagctgtttacacaggttggcacttggcagcacaaatgttttgacttgagagagcaaggttgagattcgtctaccaattcatgaagagccagatcaaccggaaccgtgagacgagactatatatttagtgtctgctttcctgttcatgttttgttactgtagttgaaccttgttaaattgggttaattcataccgtccggaagagatagttgcatataccgtaaggtttgtagcgcggctttgggagggcagcggcagcaacatgaccttcttggaggcggagatgaagtcggcctcgtcgccattcaatggaggcaggatgcagtgaagagcttgtcgaaaggcattgagctggcttgctgaagctccatcctatagtgagcgagttgggatcttgggatacatcatacatccatggaacaagctgtttacaaaggtttgcacttggcagcacaaatcttttgacttgagagagcaaggttgggattcctctaccaattcatgaagagccagatcaaccggaaccgtgagacgagactatatat

SEQ ID NO: 7607 - DNA, 665 bp, Triticum aestivum
  unsure (1)..(665): unsure at all n locations
  Clone ID: PAT_TA_7607
gtcccgattgatgcccagctcgttcttctctgtccctcgttctcccggtggatgccccgacgtgttcgctggcttcgaggacctcggacgctgcgaagagcctggccaccctagccccgccgcttgtgccccttcccggtgtgagccgtgcgcaccgccgcgagctgcacgccgcacgtcctcgctgccgtggtcgtcggggcgaaggacggaaggccgcgccagttcggctctcgagcaggtcatgtcctcccccgtggccgagaataaaagcagcgctgcatcatggtgcggcaagagcatgctcgagtcggcaggcacccagccgccaggccgtcatctgactccttcgagccgatgcagccgtggagctcgagcaaggacagcggcagcgcaatggcggaagcgtggacctgctcatcgccggtggccagctagctttcgctgcaggcgtggcggctagccgccggcaggttgcagcgcgcgggcatacgcagttctcctcgcccagcctggtgctcgacctcgatcccggcgaggtccatccgccgctccaagccggcgacgaaagcccatgggcgccttgccggaggttctgttcatgtggggctaattgcgttttcactttatggttgaggggtgngtatgtaaaattccagagacta

SEQ ID NO: 7608 - DNA, 699 bp, Triticum aestivum
  Clone ID: PAT_TA_7608
gcaaagcatcatcgttgaaaaccacccggccgtcacaatgccaaccacttccgacaaggaacttctgcaagcgcacgccgagctttggaacctcacttttagctacctgaaatccatggcgctcgagtgtgccatcaatctaggggttcccaccgccatccaccgatgtggcggcaccgcctcattgccagacctacttgccacccttcccatacctgagagcaagaagtcctacctccctcgcctcatgaggttcctcgtcgcctcgggtatctttacggttgatgtccccgcaacaggggagtgcgctaacgtgggtgcaactagtacctaccggctcacaccgttatcttgcctcctcgtggatggagacgacaccgacgcccaccagcgcacaagcctctcgccgtttgtgctctcgcagaccaacaagtaccatgtaacggcggccatgcacttctctgagtggttcacgagcgacgaaggctcagcctcggccgagatgccatacatgatggcaaatggcacaaatccatgggcaatcatggctcgtgatccaaagctaaatcaggtcttcaacgctggcatggcggctgatacccaatttgcaatgaacttcatcgtcagcaattgtggcgaggtgttcgagggggggtacctcgatagtgacgttgccggtgggacgggtacggcggcgaa

SEQ ID NO: 7609 - DNA, 472 bp, Triticum aestivum
  unsure (1)..(472): unsure at all n locations
  Clone ID: PAT_TA_7609
ttcggcacgaggggaaggagtactctacattgttctctagtgcactctgttcagcaagttgagtgaaaatgctgaatagaaccatccaagtcttcctactttgtctcatggcagatgcttgccttctcatgacggtggtagcgccgcttgctcaagctgctgggaggcctgtggcatccttaccatgggtagcggggtgttgcccaaggaactacctatgttgtggtgtccgtactgttgccccgggaacacatgcatcggaggccacctctgtgccttgacttatggtttcgcttgatcttctcccataacatagttgatataacatagtagcatcacaaaggtagcatggtttaaagtgagttaatctncctttactacctcagacttgtgatggccacttttgaaacaatgttttttgcttatgtcttaggttatagaatggggggatgtttgcatcttaaaaaaaaaa

SEQ ID NO: 7610 - DNA, 766 bp, Triticum aestivum
  unsure (1)..(766): unsure at all n locations
  Clone ID: PAT_TA_7610
cccagcatgaaactagnaataagccttctggnagcttgagttatggacaataataaaatgaaattcaaactaacacgagtactttatgattgctatctaaggatgttgtttagactttccctgtgaaggaagaacagtgaattcagcaaaatcaagtcctaataggataatactccctccgttccatggagggagtagtttataaataataactaaggaaacaacgatgggataaagttaggttatactacaaaaactaactgtgttgttgtcgccttaacagaaataatgatgtaaatctttgtgatgttaccatattattatataacacaaactgcacaattagcataaatatagtactgtttattaattttagtggcctcaatttccacttctgcacttctttcaatgtacatatagtccctcagaggctatatgtttacttcttttattgttttgcacaggaaaactgaaaaggttctttcaagctctacagacagcatggggctgtgttcgtctaggattaggcattgtcaaccttggattagagcacgagttctttcaaagcttgatagtttgaagtaactgtaatgtcgtcattttaagaggtagtactcacttttgagagtacactgcttcaggaaatgtactgccggtttgacatagcggcaggtgaattgctgatctgatgctgcattgctgcaacagttggtttgatgccagatggattgtactaggaatatagggaagttgtaaaaaaagtgta

SEQ ID NO: 7611 - DNA, 1406 bp, Triticum aestivum
  Clone ID: PAT_TA_7611
accggtccggaatttccgggtcgacccacgcgtccgccattcccctcccctccctttcccgatcagtccacgccgccgccgcccgccgccgccgccatggattccctcaagcgagctctcccccaagcccaaggttccccgcgacgaaaccccagagccatggagggcgacgagaacgcgaccccgaggcgccccgtggcggcggggtccgcgtccccgcagaggaagaaggttctgggggagcggaacggcgccggacgcggggagggcgccgcgtcgcccgccaaggccgcgctcaccccgccgccttccaccggagggggggcggggacgtacgacccgaagaccaactacaccacgccgcggccggacttcctgcgctacgaccccaagcggagccgcgagatcatcctccgcctggggcgcgaggtggagggcgacagctccagcgccacctcgggcaccgagctctcggaggtgctgtcttccggctcgtcggcggcgagagggagcgactccgagtgcgacgacgccgatgaggaggaggtggtgcctgcgcaaggacggggaggccgctgggcgcggcgactgctgctgcttctcctgtcctcggcctgcctcttctgctacatctactgtatgagttccgctcccttccctgctactaattcagaagaacccatcagtttcgtcggattgaatgggagcatgtatgatgtcggtgttcacgaggtagttcctctgctggggccaattcaatatgaacatgaggcggatatagatcaaactgtggtcggagacagtgaagatggtatccttttgcacggcccaggagcttcacctagcaatttcatggcagttgcaatgatgggaatggcagatgactgccctaatgttgccttcggagaatttacatgccaaatcggggatgagagcagcgagattttggatgttctgaacgaagattctgggataggcgagctgaaatcagaagcgagcatgaggccactcgagaatgctgaagaaagcagtgaagttgtatgctcgggtggagatgtcactgcagctccctttggttccacccacagcgatgatttggatgaggacaggctaggattagttcctcaagagacagggggagatgaatcaaaacaatccatgccacagttggtcaccatggatgaaattctggaatcagaaagcgtgaaggtggtgagtgatgataagggtttggaaactgagaggttggatcaagaagaattcgactcgttggggtatgagaacacagctgaaggtgccaagaaacttgttgatatggtgaaaatcctgtggtctgcagtggaaccacatttgctgaagatgctggcatgcttatctgttgcaggccttgtgactgttatgatcaa

SEQ ID NO: 7612 - DNA, 1508 bp, Triticum aestivum
  unsure (1)..(1508): unsure at all n locations
  Clone ID: PAT_TA_7612
aaaatctcgcatcctctcgctgtcccgtcgcctaaccccatccccacctccaggcgccgccggcgcctcctcccggctcgccgaactccgccgccccgcccaagcttccgaactcctttcacaagaccggcgcggataaggtcttcgcctctccggttccccccttacccgtctcggacccaggaccccatcgggctggatctagggttgcaaggggaggggttctggaggcctccgccacgatggaggcggccgatctcgccgcggacggccgcatcatcaaggccgacttcaccgacgccggcgcctaccagctccgggagcgcatgcgggagaagctccgtgagttcgagggcagcgccgaagactccatcgcggactacgttattgtgcttctcaggaatggaaaacgcaaggaccaggccaggaaggagctccatatttttttaggagttgatgatagtgcattgtttatttcatggctgtgggatcatctatctttaaatttgcacttgtatgtgcaaacacaagagcaggaggtggagaacaaggacgatgaaatcccaaaagaactatctggaagacataaatcacctgaggtgcacgcgagaagagatcaaacgcctcttgagcacacaagtgaatcaaatacgaccatcaggagtcggaataagagggattggaaaggaactggcagggagggtaacagaaactttccacttcgaagtgtactaacggatattttgcacggagaagagaaaaagctgcaaaagtctactgaaatacgacagcctccatcatctaatcaacggaatggcagaaagcgtgatcgggaggatgaaccacaacaaacaaagagagaactgccttctcgtccggtgcttggtgcttcccgtcgtcttctgcagttcgccgttcgagatgctgtaaaagctgtacagcaaaccagcagctctacggagccatcttctaagcgcctacgctctgttgtttccacggtatccacagacaaccagcatggtaaaatgtcacaaagatctacagacagcctacatgacaggagatcagagagagctacagacagcctgcatgacaggagatcagaaagatctgcagacaacccgaatgataaaagagtagaaagaaaaaggcaaattctacaagtacctgggagccgctttagctcttagagctgctgcagaggctgctgcagactcttccaaagcaagtctactggaagtgtgttcaattagattgggtcaagggaatgctgtgaataacaactcgttcncgtgaagaganaagagntatgatattttgaacaactacaacttagntgtcacaccccgtnaacatgttatgccaacaanntctgganactggaaatacaaccgggaagttgaatgaaggttgaaccacccccgataggtncggcaaaatatgaatgcctaatcaaattccgtccatntgcgggaaaattcttgcaaatgaacctaacnngacataaa

SEQ ID NO: 7613 - DNA, 1014 bp, Triticum aestivum
  unsure (1)..(1014): unsure at all n locations
  Clone ID: PAT_TA_7613
gcagactcccactcggggggcttagctgcagtccaagtactcgcctaagtttcaataaaatcctaccgagtggtgagccagactcccactcggaggcttagccgcagtccaagtactcgcctaagttcgaatacaacgggcagtagcaaggaagacgaggtgcaggtcgactgcgaccctctcctccgagctacaccacaagtacaatgtgcggtagcaaggaagacgaggtgcaggtcgactgcgaccctctcctccgagctacgccacaagtacaatgcgcggtagcaaggaagatgaggtgcaggtcgactgcgaccttctcctccgagctacaccacaagtacaatatataaatcctaccgagtggagagcagacctcccactcgggggcttagctgcagccctgtgctcgcctaagtgtttgaaaatcctaccgagtggagagcaaacctcccactcgggggcttagctgcagcccagtgctcgcctaagtttttgaaaatcctaccgagcggagagcagacctcccactcgggggcttagctgcagcccagtgctcgcctaagtttttgaaaatcctaccgagtggagagcagacctcccactcgggggcttagctgcagcccagtgctcgcctaagtttttgaaaatcctaccgagtggagagcagacctccccctcgnggggcttagctgcagcccagtgctcgcctaagttttgaaaatcctaccgagtggagagcagacctcccactccgggggcttagctccgcccctgcgcccgcctttgttgtaaatctcccaccgggggaagagctcccctcccgcgccggcggctccgctgctgcctaaggctcgccggagaattcattgcctgaccctcacgtgaccanaaagaactcaacaatgaaaatatcaagtcaatcaattcggtaaactaaaggaacgaatgtaaggcaaccgtaagtttcgtaaaancattganacgggaattaantcaacaaanttttcc

SEQ ID NO: 7614 - DNA, 1338 bp, Triticum aestivum
  Clone ID: PAT_TA_7614
ggtttgggtttaattaaatcccaagtacacaatatgatggtggagttgttgctattgattcagagaaggagttctatcgtcttcagggtgacctttattctctctgtcgtgctaagtttatgaggcttgcttatttgattggttatggggttgaaatagaaaaaagtccagtcaacagtgcctcattaagcatgctatcttggccaaagccagctacttggccttcgattccgcctgattcgtcggcagaagtaatggcaaaggagaagacaattcttcaagcaaaagcaagagaaaagctctttgacattcagaggaaaccactgccattggaaccttcttctcttctacgtgaagctaataggcgtagagcttttctttcagttggaaatttgtctgaattatatgattcagttgatggttcaggtttagcgcctccgtccaaactttctcccaacaaatcttcttccaacttgatgacaagaactatgtctgggccagcaacctctgagacttctctaccagttgatcggcccatgaggttgtcagaaattcatgttgctgctgagcatgcattgaaacagacgatatctgatcctgattttatgacgtcactttcatcaccagaagaatttgagagtagatatatggagcttactaaaggcgcagctgacaattatcgccgctcttggtggaaaagacatggagttgtgcttgatggagagattgcagctatattttttaagcatgggaattacgacctggctgcaaaatcctatgagaaagtgtgtgctctctattctgcagaaggctgggaagaactgttggcagatgttcttcctgatcttgcagaatgccagaagattcttaatgacgaagctggttatctggcttcctgtgtgaagttactttctcttgagagtagcttgttttcatctaaagagctgcaggctttccagtcagaggttgttcggcttgctcacagtgaaatgaggcatcctgtaccccttgatgtttcatcattaattacattcgctggaaatcctgctccgccattagaattatgtgatggtgatcctggtacactatctgtagcagtttggagtggcttcccagatgacataacacttgagtctctaagtttaagattgtcagctttctctagcgcagatgaaggtcttaaggcaataaggagtacagatgcacgtgttcttgtacctggtagaaatattatcaccttcgacattcctcctcaaaagccaggttcctatgtgttgggcgctctcactggacagattggcaagctgtcattcagatcacatggattttctcaagatg

SEQ ID NO: 7615 - DNA, 2138 bp, Triticum aestivum
  unsure (1)..(2138): unsure at all n locations
  Clone ID: PAT_TA_7615
gttcgcaccgggcagaatggccatgggcaggccctggactgaatgttcgagggttcgggccgagggggttgagcagcttctttgcttcggtttgatggtccaggtcgtagttgttcttacacggacggttttccgaggtcattgtgtttcgctttccacatgttgcgatcttttcccttgcacttgttgtaagatatgagagtcttcagtgaacagtgaatagtggactgagttcagagattcttcagcaggggaccgacgattccttgaaggaaaaaaccttgcagggtgaacgattacttttcttgctcgaaactgtggttgagacacggtctatcagagatttcaccttttcatatagtgtttactcaggtgatgtgtccggtggagtgcttgtgcagcgctcaatatttcgtcactatgatgacagagacattttcagcatatgtctcttacctggaaataaccagaacagaaggttcttcaggtgggcagttgtgtttattgttgatacaagtggaagcatgcaagtaaagcctattgagaatgttaagaatgccatctcaactgctgtctccgagcttgaggaaggagattacttcaacatagtaacatttaatgatgaacttcattcattctcatcctgtttggagaaagtaaatggcaaaacaacagagaatgcaataaactggatgaactcaaatttcgtcgcccagggtggcactgacatcatgcatcctttgaccgaggcattggcgttgctgtcagactctcatggcgcacttccacaaatctttcttgtgaccgatggttcagttgaggatgaacggaatatctgtcacactgtgaaaactcagctcacaaacaaaggatctatttcccctcggatttccacttttggactaggttcgtactgtaaccactatttcttgcggatgttggcatcaattggcaaggggcattacgatgctgcgtttgatacaggatcaattgagggtcgaatacttcaatggttccagaaagcttcatccacaatcgtggcagacatttcaattgatgtcacaaagcatacccaagaatttgaagtggattgtgaatatattcctgacatttcagcaaaatatccattatttgtttcgggaagattccgaggtgaactgccggaaactctttatgctgagggctatttgtctgacatgagtaagatatcaattgaattgaaggtccaacatataaaggacatacctcttgacaaagtgttggcaaagcaacagatggaccttctaacagcaaaagcatggctttctgaaaacaagcaactggagcaaatggtggcaaaaatgagcatgcaaaatggcattccttcggagtacacacggacggtcctacttcaaaccatcatggaaaaaatagatccagcacaacagggaaaacggaaaccaaagaaaccagaggagccttcagcgacgccgctgcagggcctgacactcggcttcggcaacgtgccggcgacgacggagaacctaacctcggggttcggggacatgagggcgccggataaattcgagatgttcgggaaggcggtcggcggctgctgcggccgcgtggcggacagctgctgctgctgcatgtgcttcatcaactgctgcagcaagatgaacgaccggtgcgccatcgtgctggtgcagatgtgcgccgccctctccttcctcggctgcttcgagtgctgcacggagctgtgctgcggcgggggcgggtcggattgacgacggcccgaggaaaggcgtggtgtgttgtacagtaaagtgtgcatagtgttgctgtataggatgcgcgtcacgtatatttattgttgtatttatgtactgcttgattgtgaggcctctcttgtcaatatcggccggtaataaaccgtctggtgcactggcgatgtaaagcgagctaagggggatttaaacgaagagaaatgactgcttgtcccataagaacagtctttctctctctctgaaatgcacaagaacagttgattatgtgggcagagtacctgaattaacctgcatgtaacctctccttttgcccaactgaggcgcatgaatatctcaggcgactggggttttgcccgacaananagaatgata

SEQ ID NO: 7616 - DNA, 890 bp, Triticum aestivum
  Clone ID: PAT_TA_7616
tcggccgcggcagctccgatttccctagcgcgccttgccttcaggacctgcaagccatggcagccgccgcaataagggcccagatcaacatcctcatcgccaccatgttcaacacgggtctggtggacgacgctttcttgcagctgcagaggatgcgggagcagggccgcgtaaccccggcccatgtcgttgaggtcatgaaccacttcctcaacgaagccgagaggatcatcaacgacatcaccggcctgatgaacgggcccgaggtggacttcgacaaggtggacgacctcgtgcagcagctcaaggtggcctgcagcagtgttggtgctaagagattgaacctctgctgcgtgcaacacttcagtcctgaggcaaaaaccaaagaagggtacctcgcggcactgggtcgtgttaggtttcagttctgcgatttgcgcagcatgttcaagatcataatggagctggagcagcactttgcggcatgtggtcctaagtaggagtaattgagaggtaaagggcatagccccatgcgatctctcgcaagatggggtgtatgtatcactgaagatgtgtgcagttttcattgggtgtttggctttggagggtgcgctcggatagtagcagattctcgtctcagaagtccaggcttgcagccctatgaaagaaacttgttatgatttgtgtcattgtgtcaacttatacatgtttctgtctggatgttggttggttgttggtgacttactttgttgtatgttgctctctctctctctctccctctttctctcttactctcggtctctctctatcatcttgagagatgttgttgcctctcttttgagcaagggtaaataattgctagttgtctggcagtgctcagaaatcatgct

SEQ ID NO: 7617 - DNA, 544 bp, Triticum aestivum
  unsure (1)..(544): unsure at all n locations
  Clone ID: PAT_TA_7617
gttcaaaggcaaggaaaataagttctacatccacatcaactcctctttccgttgaggttgagagcaacctgcagctagcactagtgcatacacatgacgaagctccacaaccggagagggagagaggctcccgtccccaattgtagaagatgatgaagcggttgatgaagatgatgaaccaagtccccaatttgaagcagatttgaaggctctggaacgtgttcctggcaagcgacttgccatatcttcatatcatgtcaatgaccaggatgtagttagaaggagatacattgacttgggagcttgtcaaccaaagagtcacaaatttgagatcagagattttagtggacatccccgccgcttttgcccatcttggtttaaggatcatatgtggctttgagtacagtgtgaaagaagaggctgctttctgctttgtttgctttttgttcaaggataaaacaaaaagtcccggaggagatgcatttgtgaatggtgggtttaataattggaacatgaaatcaagattgaagaggcaaaanaaaaa

SEQ ID NO: 7618 - DNA, 575 bp, Triticum aestivum
  unsure (1)..(575): unsure at all n locations
  Clone ID: PAT_TA_7618
cggacgcgaggctgcggtgacccatggccgccgcttcgcctgccacgctcgtcttcctcctatccctcatctgcgccccctcccggttcctcaccggcgccctgccggcaccgccgccgacgccgcccaagcctgtcatcccataccccacgacgccgcccaagcctgtgatgccagcccccacgacgccgcccaagcctgtgatgccagcccccacgacgccgcccaagcccgtgatgccggcccccacgatgccgcccaagcctgtgatgccggcccccacgacaccgcccaagcctgtgatgccagtccccacgacaccgcccaagcccgtgactccacctccggtgacgccggcgaagtatgcgccgaagcccgtgctgccacctccggcgacgccgaccaagccagtgctttcgcccccggtgacggcgccgaagcccgtgacgccacccatcgcgatgccgccaatgaccgcgctggcgcccgcgccgtgggacnnacctggctacgggtccaacccgattccgnnnnnnntcnnnnnngtgtgcnnncnnacnncgttcccgcngctg

SEQ ID NO: 7619 - DNA, 832 bp, Triticum aestivum
  Clone ID: PAT_TA_7619
ggtctaccattcaggaacacgttcagaaattctgctggtgttatgaccggattgggtgtaaaaacgggatcacagaggaagaaaggatagttcaggcgttgggagtgtacaaatcagaagagaagaaagcgtttggtttcttgcattgttggaataccttacacgcccatcaaaagtggactgataggttgtctctcggcacgcggaagacaacctccaattcaagcccgggtacatttcctcttggaaccaactcaattcggcttgacgatgaagcggcaggctcgtagtccaaaaaacgaggactcgggctcggacgacggaggggactgtgggcacgagctccaggttcaggccctggagtgcgccctccaggagcagcctctcgaccacaagccccaccttcaggttgccgcaatggatggttatacctacaggagcttgttgaatcagggaaacaaggaaccatttcgggatgaccgtcaacttggtagtagctcagctgaggagcaacaatcgccaattgaacaagctattcagtccatgccaacgaacatcaagagaacagaaaatttcagcgataaggaagactatatgttggtgttggcatggctaaatatcagtatggatgcagcacaagggaatgagcagacttgttctacttactggcagagaatgcattgttacttccacgagaacaggaacttcgagtcagatcatagtcaaaattctctcttgcagcgttggtcaaccattcaagaacacgtagagaagttctgtagatgttatgacccgtgttgggcatagaagcgtggtgacagacaaagataag

SEQ ID NO: 7620 - DNA, 345 bp, Triticum aestivum
  Clone ID: PAT_TA_7620
ttcggcacgaggggacatcattacatagctagcattgtatcttgtgatggcgattagtaggagaaatgcaagctttgtatgcgtggtagctgtcatgttggtgatggccaccgtgatgttgtcctgtgacgctgctccaaaagaatcatgccatgggcttgaagatggatgcgacgaaccgaagtgcaaggaatattgtgtgctcacttgttacaccaagggatctcattgtagggctgaagattgttgttgtttgattgctgccaagcccatggtggacgtgctccgtcgtcatgattgagcggttacgaacgttatttttatttattacatataaaaaaaaaa

SEQ ID NO: 7621 - DNA, 852 bp, Triticum aestivum
  unsure (1)..(852): unsure at all n locations
  Clone ID: PAT_TA_7621
tcgacccacgcgtccgccctaatgttcctgacccctcgggtaggctgccaatagaactcgctgcactaaacggtacaagggaagatgttgagatcttattccctgtaacttcttgtattccaactgtgcatgattggagcatcgacggaataatacaccatgcaaagtcagtgtctatgaaacagggtgattattcaaatctaagaagaatagaagagctgaagtcacttggggttaagtctgtcaagagaaatgattattctactgcggcaacaatgtatagtatggcaatggagcatgaccctcatgatgccaccttgttctggaacaggagcctttgctggctccgcatgggtgatggacacaatgctttgcaggatgcccttgcgtgcagagaaatgcggcctggctggccaaaggcctgctaccggcagggcgcagcgctcatgttattgaaggactacgggggtgcacgtgatgcttttctggacgcagccaagttggacccgcagagctctgagatcaaggctgcgttgcgggaagctatgaattccttggagatatcccatggcgcaacaaagaccacttgaacagtatggaactggagttccctgaatcggccttgtttcattggttaacttggtgaaccagtatgaggaaagaagtagcattagggatcgacggagggcacttttgtcatttccagctgctgcctcggctcttttgtttcctattttcttttacctttggtgaagaaaagtagcaagaggatgcgtcgacctagtcatcagtggctaagtagccgaagatacatggaccaaactccaaaanagaaatgcaagagaagaagca

SEQ ID NO: 7622 - DNA, 879 bp, Triticum aestivum
  Clone ID: PAT_TA_7622
aggaattcggacgaggctgtggttattggaattgcggtcttgatgtcatggatgttgaagaacaacagctctttatttagtcttgttgtggtcttgaggaaagaatcaacgttctgtgattggggtaactatccctctttaaaatattccatctgaaacttgtgaccaacgaaacaaatggcatttggcctttgtgttcctattggtctgcttggcttagtgctaaaactttgctgttcaaccatgggtccgaatgcttgctctagtactgttctgtggcacttccctcagttagaccaacataagatcttgctggcatgggtcactttgctcatcaacacttctttgggctcctagtataacgcaatgcttccttgggaacctggaaagagttgcttgcttcactgggatgggctctctcttaccttcattcctgctgtaacccaagtctgagggcccttaagaaagttctagaatctcccatgtgaaggttgatcctttattaatgtgtttctcgaagggggaactgtgttgtttctcagcgaaggtcgcctacacttgcttctggttaacttacgcagcgagaaggtgtagatgaaaatgtttatttgtagggttcggtgtctttctttttgacagtagagtgagctccaaatgttttaagaaaggcagcctgattcatattgtgccaataattttggcagcctgagctccaacgattttgttgttgctgtgtttgccttctgtaattttgtacaatacttaattcaccagctgttgtcaaatggatatgcttggttccaaattattggaagtttgagctttgtcgtaagtcaaacttctatattttgtctagacaatgtttaacttcaaatatat

SEQ ID NO: 7623 - DNA, 805 bp, Triticum aestivum
  unsure (1)..(805): unsure at all n locations
  Clone ID: PAT_TA_7623
nnnngntnnntttaaaccctgttgattcccctgctcgaaattaaccctcactaaagggaacaaaagctggagctccaccgcggtggcggccgctctagaactagtggatcccccgggctgcaggaattcggcacgagagataacctcctccaccgtgctgctgcttgttgccggcgtgctagtccatgtcctgcctacgacatgcacggcggtccgtgggtttagcctcccgctagtcgccaaccacggcgggggcacgtaccgtgtggacgccgatggcttcatggtcgtgaacaccacgagcttccaccaccgtcccttcctgacggcccccctgaggtacatgtatggcgtggccgtgaccattggcacgggccacggcaagagtacccatttcctcgtgctggacacggccaacagcctgccatggatgcggtgcgcgcactgcttgccggtgcaacgacaacgtagcccggtgttcgaccctagccactcgagcagctaccgccccctccatccgaccaacccactgtgtcggccgcccaaccgcgttcaccccgctggcgacaagtgctccttccacctcccacgggaggcacacggcttcgtcggcgtcgacaccatcattctgggtaatccaactttgcctatccatggcatcgccttttgggtgtgcgcaaggccaccccagggggttcgacaacccaaaggcaccgtttcagcgagcctgggccttggggccatggggcgcgggctgggcttaaccctccccttcatttattggcgcgaattcaaagggggcccg

SEQ ID NO: 7624 - DNA, 532 bp, Triticum aestivum
  unsure (1)..(532): unsure at all n locations
  Clone ID: PAT_TA_7624
cgtccggcgccccacgcgtcttcgtctttctcccgcgttacctccctctctccctccaaccctagacccgcgcccgtctccctgccccgccgccgtccagatccaaccccaccccgccgtcattctccttcgcccagaccaatcccatctcaacctccctcgatctttctctctcaaaaaaaacctcccccgatctcccgtacatcccctgtcatcgcgccgctgccgtcgctgccgctcgcctcagcccccgtccctgacctcacgctgcccggcgcctcctccccacaccgaggacctccccttgctccgcctcttcttcctatccggctagaactgcggcgcacggcctctcatgctcgctcgcgaccctcagccgtgtctagggttttgggctgggcagcgccttcgccgccggcgcggctccggtgggctctgacgactcctctccgtctcctccctcgcccccacggggcgggtccaattccgctgggcangaaggtggaagccttgtaggggggcatcgggnttg

SEQ ID NO: 7625 - DNA, 672 bp, Triticum aestivum
  Clone ID: PAT_TA_7625
tttaaaccagagaacatcctcttctggttacaacatggactagttccataatggtgttcctttgaattacggaagatcctctactacttgtatactccaccgggctctccttcaatttcacgcaagcgagatggataacaaaggcaaatctgaggccattgacaattacgtgcgaacgacatcccgttcccatggtggcagcgggatagacagtggcaaagagatatgggacgacgatgctgccaccattgctcttggcgccgtcaacgtgacaggagccttttcctcggcttcctagatgaagagatgggatggctgcatttggattatgagttgggacaacattctacttgcttgttgtgtatcaacaaaccttctacttgcttgttgtgtatcaacaagcttctagcaaagcttgcttaagatgtgtcaatatgggtagtacatggaagcacctctgcaagtcacaattatgcaattatcagctaccaaggatgcaagccttgttctatgatgtgagagacatcgaggatcattaaccacaagcttaagtgagctccctttagaacgtccatattgatgtgtattgtagaacattcccaattagtggggaacttaattatgtaacattaatagacattgtgtgtaatgttaataacgtatcaagttaag

SEQ ID NO: 7626 - DNA, 697 bp, Triticum aestivum
  Clone ID: PAT_TA_7626
ctcgcgagaaagtatgaggaaatgtggaggggcctcccattagctccttgataatgtgggctgtagtgccgtcatgttctccatatagtttacattgagtagcagtgaatgaagtgagtaaaagttgcacagactgtctagttcaaggccggatttgcacacaatgtggtggcaatgtttggggatgcattttgtgctcagaagaatctggccaagggtaattttgtagtccgatctgactcctcccggtgttttccgagtggtaccaggacaatgtcagtgtttcgtacccacgatcggaaaggcatgtggaggcagagttctgtgtagaacggcaggagccctcatttactacataactgtcaaaagatgaggtaatctgtctattgtgagggtgatatggcatccttagaaaaggctgtctgattctcggtatgcaagctaatctcaattgcgcaggagttgcaggtaagttttggttgcctgaaacttgcacgacagttgtacgggaaggaaactagtacggcacttggatagcggggaatttggagcggtgagtcaggagcaggtaattacatcatccgtccaatagtataagaacgtatttgacaatacactgtcataaatgttcttatattatgggacggagggagtacctgcccgggcggccgctcgacgcagggaggtaattccctgc

SEQ ID NO: 7627 - DNA, 1206 bp, Triticum aestivum
  unsure (1)..(1206): unsure at all n locations
  Clone ID: PAT_TA_7627
attcggcacgaggaagacgctgagcctccagtgagcacgtcgacactgatctatgtcttcgtggcattggctgttgcaagttcgctatgcatcctcataagggcactgtttcttgtgacagctgcatacaaaacagcaactctgttgttcaacaagatgcatatggccatattcagagctcctatgtctttcttcgattccactccaagtgggcgcatcttgaatagagcttcaactgatcaaagcgaagtggatacaaacatcgcttaccagatgggttctgttgcattttccatcatacaactagttggaattattgcggttatgtctcaggtagcatggcaggtgtttcttgtgttcgttcctgtgatcattatctgtttctggtaccagcgctactacattgagaccgccagggagctgcaaaggctggtaggggtttgcaaagctcctatcatacaacattttgctgaatcaattactggatcaaccaccatcagaagttttggcaaagaacatcagtttgtatcaactaatagccatctaatggatgcctactctcgaccgaaattctacaatgctgcagcaatggagtggctttgtttccgcttggatacgcctgtcgtccttcacatttgcattcgctttggtatttctgatcagtctaccaactggtatcatcgacccgggccgtgctcggctcgcggtcacatatgggcttaacttgaacatgctgcaagcatgggttgtgtggagcatgtgcaatttggagaacaagatcatatcagtagaaagaattctgcaatacataagcattcctgaagagcccccactttcaacgtcagaagataagttgccccgtaactggccgtcacagggagaaattcagcttcgtgacgtccatgtgagatatgctccacaactaccatttgttctgaagggccttaacgtcactttccctggaggcatgaagactggtattgttggaagaacaggcagtggtaaatcaacactcatacaggcccttttccgtattgtcgagcctactgtcggtcagatactggtagatggtgttgacatctgcaccatcgggctgcatgatctgagatctagacttagcatcattccacaagatccaacgatgtttgagggaactgtgaggagcaaccttgaccctcttaacgaagtacaatgacgatnaagatn

SEQ ID NO: 7628 - DNA, 692 bp, Triticum aestivum
  Clone ID: PAT_TA_7628
attcggcacgagggctctccccccaattcgcctggctagggtttccgccggcggcgatgggtgctctcaccgacagccgcaagcgcgtctccgccgaccaccgcctccttccctccttcccttcctccgctccatctccctccaagaaacccaagctctcaccccttctccccaccgcccctcccccgcctctcccctcgtcttctcacatcccctcgtcgacttcctcggctgcgccggggcccaattcctcaaccgccttcgcctccacctcctcctcctcctccgcattttcctcgttgccccatagccgccaccgccgccttcccccgccaccgccggtccagcgctccatccatgcccccctgcgacgcatccgtgccttccgcctcggaaatacccgctccaactccgatccatcgtcgtattctccgtccccgccaccacaacctctcggcctcgaccagtacgtcgacctcgtcaatagtgtcacccaccccccgccgcttaccccccccgcttatgtgccgagaggggcgaaagctaccgtcgaggtggtcgccgtcgatgacctgggagatataaagcaggacgaagaggagcgagatgaggaggacgaggtgaagggtgaggtggtagtgaggaaggtgcctctgtacaaggatctgtatgaggcgtccagccggcagcgg

SEQ ID NO: 7629 - DNA, 709 bp, Triticum aestivum
  Clone ID: PAT_TA_7629
gggaagtccgccccacggaccctcccccccccgctctcccgcgcgccccagccgcccctgcccgcccccccccctccccgccgtccgtccgcccacctctctcccccgctagctgccgtccctaccttccctctctctctctacccccttccagcgagagagcgacaaacccccgtaagggggggagagggagatggtgctgcggggggcggcgctggagtctcctatgaaggtggcggcgctcgtggagctgtttaacctgcgccgggcgctgcgggagttcgcggcgggccgctcccacatgtgccccctctccttcttcctcggcgtctgggcacacaccaagagcaacaacctccacggcccgaccaacaggaaaactgtgaactgtgataagaagatgaaaaatctgttgttgggcacatctctggtggagctctctgaactcccaatgttcgtgtcgctacatttctcaaaagttttttagtcgtatgaataatatactgtctttttcgaaatttccatgcacggttgatgtgtagacaatatatgagtcttcctaacccctccggtacgtgtctttttttttcttttccaatttttagtagcttcagcttgtgttcagatgaagaaaaaacatgtagtaccacatagctgctttgctgtctttctccttggcatattgcggcttggactgcagccccaattt

SEQ ID NO: 7630 - DNA, 682 bp, Triticum aestivum
  Clone ID: PAT_TA_7630
ggcatcgtgtggctctacaacatcgtcttctacttcccgcttgacatcatcaagttcttcatccgatacgctctgagcggcaaagcatgggatcttgtcattgaccaaagaatcgcgtttacaaggaagaagcactttggtaaggaagagagggagctcaagtgggcccatgcacagaggacgctccatgggctgcagccaccgaatgccaagctgttccctgagaaggcgggctacaacgagctctgtcagatggccgaggaggcgaaacggagggccgagattgcaaggctcagggagctccacactctcaaggggcatgtggagtcagttgtgaagctgaagggcctcgacatcgacaccattcagcagtcttacactgtgtgataggttcaagtatccttaatgttactgtagaagagagagtatatccttgctgcataggaataacagacttttgataggttgcttttgccccctcttatatagttgactgctgatacatcgtgggaataaaacggttactacatctcagttgctctccagtcgctggttcgttgtgcttcatgtaaaggaatacagttatcctatctcttgcctctgcaactgggggttttaaccactgtttaagaaatccttccggttcaccgattaatcttccgatttatcactaaaaaaaaaa

SEQ ID NO: 7631 - DNA, 722 bp, Triticum aestivum
  Clone ID: PAT_TA_7631
tcgcccacgcgtccgcccacgcgtccgcccacgcgtcgaaggcccccctcccctccccttcctctgctctggacaccccatctccgtcgagccggacgccccatccacctctacgggcggcggcggcgtagcaaagtcagtgagaaatggcgccgcccgggtcgcgccggtgggcgtacgtgcggatcatggccggcaccatcctcggcggcggcctcggcttctacgtcatgcaccgcatcgagacctcctacaaggtgaggatggaggagaggctgcggaggtacgaggcgcacatgctcgccaaggagaaggaggcgcagcagctgcaggacgaggggcgccgcgaggaccaggcgcaggtcttgccggactcgtgattttctctcgtccccttgttccggctcgccttcccgagctgttactacataacctggcggctcaaagcttccggaggcgggcccctccggcgtctacggtcgttctctgaacttgaagagttatttttcttcccctcctttttgttgtcaatgagtgtgcaccagttggaggctgagcctaactgcaactctgctagtactgtaagattcggaccctgctgtgtgaaaatttgttgttcctggttccttatctttcggtatccgaatccgaatgcgtcgacgatagatcttgaacaaattttttccttcctagtgcgcttcctctctgtgctcgttttctcc

SEQ ID NO: 7632 - DNA, 978 bp, Triticum aestivum
  unsure (1)..(978): unsure at all n locations
  Clone ID: PAT_TA_7632
tnaaaaccttttgattncnccagctcgaaattaaccctcactaaagggaacaaaagctggagctccaccgcggtggcggccgctctagaactagtggatcccccgggctgcaggaattcggcaccagagtagtcatatgcttgtctcaaagattaagccatgcatgtgcaagtatgaaccaattttcccctacacatccatctgtatccatttatccccacctctctaggttgtagtatagttcaaggcttctaacaagccgtgcaaaaatatatggcagcaacaccgatggccaccatcttcttttccgccagtgtcttcatgctgctttccgtgaccacgacggctcaagccggtggatctggtggaggcaagcccaaggcgaccaacctcatggtagaagcgtgcaagtctgccacattcaccaacccatatggagaccctgacatagagcaattctgtttaacgaccctccaatcggacaatcgaagcactaaggctaaggatctccgtgacctgcagctagtcgccgtcgacatccttaggggtcgagtcactactatcgtcattaaggtcaagaaaatgttggaaaacatcaaaaagggcacagtgccaatgcgggtcctcagtttgtgtgaggtggattatgacaccgtggtgagcgtcatcaacaaatgtgatgccatgatcagggattaccaaggggacgagggcgggctacggtccataaagctagtccgttggatggatatggcatatgaccgtgtccacgagtgcagctccgagcttgttgacatgcctgcggtgggggctcttgtcaatgaaaacgatgaattgggcatgctggttaaactgaacaccgccttggtagcaccataggtttcttgagtaatatagtgtttatgtttatctgggagaaaatatgtcgatgataaataaattgtaatncttactagttattataataaatataataat

SEQ ID NO: 7633 - DNA, 804 bp, Triticum aestivum
  unsure (1)..(804): unsure at all n locations
  Clone ID: PAT_TA_7633
gcggcaacgccttcctttccggcgtcggcagggnacactttgccccaggatttccccgccgggatgagggtcctcgtggtggaggacgacccgaacgacctcgagcacttgacgcaaatcctcgagaggtgcggctacaaagtgacggcgaaagcgtcgccgagagaagcgctgaaagaggtggaggagaatggagagggcttccacttcgacatcatcatgaccgtcgtgcacggtggcgaagaaggagatggattcgatggcttcgacctcctcgagcgtgttcgggatcgttacccggtcatcattttctccgccgactattccaaggagatggtgatgaggacaatcaatgaaggcgcctgcgacttcttgccaaagcctatgtgctaccaggaggtgcgcaatatatggttccatgtcgacatgcagaggggattagaagtggacgaccccgacgagggggtagaaggacctagcaaccatgagaatccccctgagatcaaatagctcgggagacatctatgacttccgctcgatgaataaaggtggcaccattgtttgctcggcaaccagctctggcgacctctggcattgaagtcttaggcactcggggcaagcttctgtttctgtagtagctacaaaattacttccatcatgtaataaaaaaattcggcaaactcttgtttgtgattcttgccaatttggacgacaacccagctgcgtattgattcttcctttttttactactacccctccaaaaaaatacattatgatttgtgaaattttcccattgtattttcc

SEQ ID NO: 7634 - DNA, 1635 bp, Triticum aestivum
  Clone ID: PAT_TA_7634
ccacgcgtccgcggacgcgtgggcggacgcgtgggcggacgcgtgggcgagttggctgcgcacatgcttgctggctggaaggtacttgcagctataatgaatcatgatttggcacttactaaaatcccgcccctgaatattttttatgattgactctgcgctataactataggagtttgattcattacttgatggcctcaaaatggatacaggatctgttggaatcaagaaggccttaaggtagcccacttgatctactttagctccatgctttattaatggccagcttacttactttgatatataacactaatgttgattgacatcaactcgtggttcttccctgaggcgaaccttacccactgcaagtccgcagtgtggctgcttggtggctgtcgcattgctggccaggctccacctccgccttgtggttgttggcgtcaccggccatgccccacccgcacaaactcctgctcgcctcccatcttgatgtccacatctaagtatggggtttccgactatggtgcagcataacctcagtagatcatctccaaatgggtgctagtatggtagttcaatatacgcattgatttggcaggatttatgaggagtgggtaatcaatgaacctacaatcagtcacgactctagagcaaaagaaagggtcaagcagtgatgcgtcgagctcgggttcgaggacaaggccaacctcatgcagtcgattaagaatacgctgcagggtttggtggtctggcacatcgagtgctcgagagcctggagcccaaggtcaggaagcgcgttgaggcgctccaaaatatatccaggtgctactcaattcgttagttgtatctcattatgcgctggacaacacaacaatttgattgtgaatctattctggtgcagagtcgttcgatgcttgcaccgttgtaattgctttggctacttccagtgctgatcaagagcagggacaacagatcatgtatcctttgcttcatgaactaatgttctaaattcttcaagcagcgaggcacacataccgtctagtagcagtactatcgcaaagccagttgatgctaggtgtgcttgaagatgttccactccatggatcgatagagtacaatggctttgtctacacttatctttaaggacacaacctggagtcttgtggaggtgtgaagatgatacccaagtaatctaggacattaatttgttacgggttcacttgtgtacaagagtgccatgttctttcccgtgtaatatattgtgatttttttgtttaacatcatgtagactgtatctttctatggtagtaaacattatcctgctttttggtttggagctgagcgctggaccatggtgatggagactgctctttggaattccagtatacttggagaaagaagcaaaagttgaggaccaggttgttttcagtatatttgtcacaacaagtatgatttggtatatcatgttatcatgttatatttcatatgaaatttgccaatggcgtgtgatgaaccttgatgctgtctatcctttatatggataagatgtaaactttgttttagattagtacttcctcttttatgtttgcgctcttagtactgaacttagagtcaagtggttaccttttgtggtcc

SEQ ID NO: 7635 - DNA, 444 bp, Triticum aestivum
  Clone ID: PAT_TA_7635
ccccccaattcgcccaacaccttgcgggaaccccaatggcgagctttaacgccgccggcgccggcgccgccaaccccaaccctaacaaatccctcgaggtgaatccgccgcccggggactcggtttccagcctcagcttcagccccaaggcgaaccacctgattgccacctcctgggacaaccaggttcggtgctgggagggtcagcctggcggccaatgccaggccaaggcgtctatttcgaacggtcagccagtcctgtgctctgcctggaaggatgacgggactactgttttttcgggaggttgtgacaaagtggtgaagatgtggccgctgctgtctggcggccaggccacggccttctcatggcacgaggcgccggtcaaagaacttgcctggattccatagatgatctcttttgttagtggtttttgggattagactt

SEQ ID NO: 7636 - DNA, 673 bp, Triticum aestivum
  unsure (1)..(673): unsure at all n locations
  Clone ID: PAT_TA_7636
gcaggctgatgcttcttcgcttgatgctgaagaaaaggatgaacagattcagacgcccaaatatcaaaagagagttgggccagggaagaaatcaaagcagtgacggctctgcactagttgtgcagtgatcaaaagtctatagatggcattcctcgaagctctacctacatctacagctgcacaaaagcttggatctttgtagtgtgtctcctcatcagtagagattacatagcgttcaagacctggcggggctgggccaaccggtccttcgtgttcaagatctggccctgatgagccctaacaacccgtgctaccggacgggcaccttcttcctgagccgggtccggaaccagaccaacagggacacactgagcgagtactcgaggcatgccgtcaagtcggaggagtgcaaccaggcagctgccgtgggtgtccaggttcatactgtcaaggtgttcgctcattgcccagtacgagtggaaatgggttgttatttcgtaatgtgtttcgggcgacatggtgacattgctgcaaacgaggaaggaacatatggttgacactgatgcatgtaatgggttatccacagtatatcttaattttgaatgtgtcatgttctgtacgtatatgttataattgagccttttgtcagcctctacgttatgnagtttccaaa

SEQ ID NO: 7637 - DNA, 1771 bp, Triticum aestivum
  Clone ID: PAT_TA_7637
gcccgagcctgccctgcgcccgtggcgcgcctcgccgccctccccgcgcgcctcccctccctccctgcccgccccgcctgccgccgcctccccactgaccctccccatcagcaccccctcatcctccccctccttcctcacgcagatgctgcggctgctgctgctgctgcgcggggtctgccggccggatcggcctccaccggcagccacggaccaggtcgcccgcctccacctccccccccaccgtcgcccccaccacgcccacggcgtcgacgggggagggcgccccccaccacggccaggctgaaggcccgaaggcgaagctgctgcgacgttcccaccaccgccactgcgctggacagcgacatcgtcgtcgacgaggtcgaagaagtggccaggaggctgagcgaggcgatcacgaggaggaggttccgccatggcggcccccgccacgcacccaccaccaccaccatggagcggagggcggggtgaagaaatggagcaagggcgtgatgggcgggttagggaggtaccgccgggaggttgcttgtcaatctggccctgcttagttacttagcatttaaccattcagctgaactgtgtcccggcacgagaggagtgctctgccaagggcgctactgaatttgctattcgggcttcctattccacattacattaccgctacgatttttgtaacagcagggcaaagtacgtggaggacgcagcaaaccacaacgaggaacaatgcgaagttccgcagatgaagctgtacccacgtttcaacaaccacaacactcacgacaacgacgacgaggtacaacgaaggtggagaaaactgagcgaggaagataagcgaggtgatcatgagaaggagccccacccatgtcggccgccgccaccaccatggcgacgccgtggcaggtcgggggtagaagaggtgcatcggccgcgtgagccgattctacacgtaccgccggccggcggctggtttgatttggtctgtttaattactttggttaatcgtgttctctgcactgtgtgcgtgacgtggagtgctctgccatttccgtacctttttttgcttcctattccacattacattactacttgtgttgatatatgtactggtgtgttagtttactcagggctgtgagattgtacgagcagcaatgttatgtgtttttccgtgtcagattaactaatacttttgtcttataatattgaaaggacaggacgtggagtatgggcaaaacagttccgggaggcctcgttgagtaaggatgatgcggagctacgaagggttatggccgagtatggtgagggtgtggtggatgctctgggatatgaagtggatcggctggagtcagagatacagaagattgtgacgggaatcagacatgttgacatcgaggcgcacaacccagacggtctttcagtttagagtagcattttttgtacatttttatggatatattcggttgattgatcacgcttgctgatcaacgccaatctgatttgttctatgacctctggatactttttacccctcagtaattcaggccattgtctcccatgtaagaacgagatgcttacagtaatgccctacagaaagtcagtgggcacataatcttggtgctcacgtgttgggtatgttctgtggcgcggcaaagatagtgtgctgtcaagatttattgcaatcaacatgaatcagaatttaataaaaatctccaatgtgcttcacttaaatcatgagcactagacaattttgctc

SEQ ID NO: 7638 - DNA, 1092 bp, Triticum aestivum
  Clone ID: PAT_TA_7638
cgactccccaatggcccctcgtggccgctcttggtctccggcctgcgccccgccccccgcccccgggaccgctgccgcgaccctctcttctgccggtccgggctgtgcggccgggtcccagataacaccactttgagtcctatgcagtttacacactacacacccggtatcaccctgccccctgctgccgtcgctgtcgaactaagaattattgagggcgatgatgagatcaaagacagagtagtgatgagtcttagcaagcgttacgacggtgcagagcaacctttatgcttccatggctccatgtgtagtgcagagttgagccttgggcgacttgctgcaacggtccaggcaactatcgtgggggttcgtgttggtaaagggaggtggccttttgaatgcggaggccgagttacttgctccttgtattctgcagaggttggtgatcactcgtgtgatgaagttgttttgcttgattccgctgaaaaaattcctgaagatggtttagatggttatatttctctttcaaggagcgttgtgtcagtacaattgcaaggacggttgaaagttagcatacaagcatacgggagatctgaacctccagtcgatgttgaattccatccccaggattgcaacataagtatgggtagttgttttgtctatggcagtaaggtggacatcacggttgcttggtcccagcttgtccgggacaagatggatttactaattgagggttattctacccaggcgtagtgtgctgtcttcccatctaatatgtttgctagtggtatgttatttttatgccggccagctatgcaagacggatgatgtcatgtcccaactatttgtgtattgactctctattgtgttatctgatctgactataacttattgtactatgttatttgtgtatcgactttatattgtgttatctgatctgactataacttattgtactatgggttattctacccaggcgtagtgtgctgtcttgcccatctaatatgtttgctagtggtatgttatttgtatgtcggccagctatgcaagtaggatgatgtcccaactatttgtgtattgactctctattgt

SEQ ID NO: 7639 - DNA, 497 bp, Triticum aestivum
  Clone ID: PAT_TA_7639
gcaacgaagaatagtgacacaacttcatagggggaccggggtccaaccggcaatgctgacacttatgcaattggggctctgaatcctcctggtgacccgcctcttgacgccaagcaggagcctagttcgcctacttgacaacctccaggacctgaaggagagcatcgtgcgcacgcagtcgtcgtccccagccatttggagtagcccggcgaggctgcagacggcaagcgttgcatgatgaaggaaatccggcagttgagcctcccttggagatgttccaaagcccaagttgttcgggtgaccagttccttctagcatttcctcgctgctggagtgccgtgactaactcatcttggccataaatctcccgttttttagcatttcctacttgtaaacaaatgtatggtacccttctctgctgcccctatcgagataaacaaagaaagcaagtgacccaacaaaaaaaaacactctcctgtgcatttaaaaaaaaaaaa

SEQ ID NO: 7640 - DNA, 1087 bp, Triticum aestivum
  unsure (1)..(1087): unsure at all n locations
  Clone ID: PAT_TA_7640
ggacccttgtnaagcaattatgattcagctgaggacagaggcattttgggtcctctcctttccgatatcaaaatgatccttaaggataaggactacaattacaacatcttgagtaggcgttttgagaattcaattttcctgaaccggctacccttaatgatgcaaagggaaaatttcaagtatgaggatcttgaatacggtctttacaagtctttgtcttctgctgctgctgccctggctgatgactgcgatgtctgtctagtttcaagttttgaggaaaagaagcttattgaactgcactttgggagcaaaatgccttgcctgacttttggccaatccactgggttaaccttcactagcggggttatccttgtctctcaagactctttcaaaaccaatgaagagcgttggtttgttgccctcactcgtttccgaaaagttccaaactttgtgaacatttctggcgtttccttcgagggtgtagccatgcgttttaaagatagggctcttggtctatttcttactggtcaggctaaacgggattacatttttgacatgcttcctggcaatccaaaattcattgagggtttttccatgaggcttggcaaggatgaggacattgttgagaacaagttggttggggacccatggttgaaggcctccatgttcttagggcaatacccagatgatcaagaggctgaaattttagagccttgcgtcgaggaaggcctgtctaaagttcacattcctttgtgtgaggaggaaatgttgcgtgtccagtggatagataagatagtggccaaggagaagagggagaccagatgtggttttgaaaccacagagcagttccgggatctagaaagcaaaggttgtggagtaattaagtccaacttcccagagcaatggggttccatataccctaggcactccaattctgatgacgtgacctttctcatggctgtcaggaaacgtttgcgcttctccaacccgatgaaggagtcgtcaagatggcacactgctaaaccttttggggaatttctcctcaagaaatttnctgaagatggtgcctttgtnatntttncccata

SEQ ID NO: 7641 - DNA, 445 bp, Triticum aestivum
  Clone ID: PAT_TA_7641
gcacgtcgaccatctttcagagccgcgacgacggcgagctcttcttccttgactgcttcagcgagggccgtggcatcgctctgtccatgatctgcatccgccctgagaacgcccgtgagcaggagtttgtgtatgagctgaagacgccggtaggcaacggcgacagacggccctggctgcagatgcagtctacggcacggaacacgtcgctgcgtcacgggctgggggagaaggagaaggtctttctgctggtccccaaggacctgccgggcaccgaggatggcaacgtggaggtgtgcatccgtaagcttggccaccagcgcgactctgtataggttaggcgaccttggttgatggcaacacttgctaaattttataggattacagttcattgttgaatgttgatgttgaggtagtctgaatttcatatcggtgaaaaaaaaaa

SEQ ID NO: 7642 - DNA, 576 bp, Triticum aestivum
  unsure (1)..(576): unsure at all n locations
  Clone ID: PAT_TA_7642
ctgcaggnaattcggcacccggcgctgaccgctgacgcacctcccacctcggcgacgccgccaccgccccagcctcctatccagcaacggccccgcgctctccgcccccgccagccgcgcagacgaccaccagcccatcactagtccaattcgagaaggactccgagcacaacaccggcacaccgcaacccgcgggactccggatcggcaacggaatctcgatcgatcgatcgattcgttcggccgctgaactcaacacgcctcctccatccagaaacctcgcccgccgcatctccgtctccaaatagagccagggaggggggattcttgcccgccttgttggtcgttgcttaccacgctcgtcttcgcaatggggggctcctcggcgtgcgacgggactctgtcaactccgacgaagttcaacgcctcagcgaaggccctggtcaccaagtggagggggatcgacgtcgacgacgctcttcccgactgggagtggaggccttgccgcaagatgggggtgccatctgagacggaggggttcgtagccctggaaggagtgtaccgcattggcgcagg

SEQ ID NO: 7643 - DNA, 1714 bp, Triticum aestivum
  unsure (1)..(1714): unsure at all n locations
  Clone ID: PAT_TA_7643
cggcacgaggcctcagtgtatcttatccgcttcctttccagagcggcggcggaggacaagaaggtgaagggcggcgcggcgctctccgacttatgcctccacaccacctacgtgtcgtcgttcgtctgcgcggtcgccggcggctaccgcgccctgcgcgagcgctcgaactgctggtggagggagagcattcgtggaggaggcagggtgagtatgccgtgcgccagcgccgtcgtcgtccgcagcacggtcgcggatgaagctctggatggtgcgcgccgccacgaccatgttgctctggacctgcgtcatgcagctcaccgccgtcggtgagacgtggggcccccaggttctcaagggatggccctcccgcctcacggcccccgaggaggctgccgccgtgcgcccggccgtcatcgagagggccgcgttgccatcgcgcaaaacatagatttcatcaacctgggaatgggatgatacagattggtggttggcgtcgattttgctcgcttcactgtgtaacatcgagtctccactgccagtcctctacgatctaaccaatcaggcctccatcgacgtaagcttcttaatctccgatatcctgctccgtgtctgatttggattgaattcgtgaccgtgtcctactgtccttctccaacacaaatcaatggattgcctgacccggattggacttccctcctataagaaggaagggtcctcgaccggaatctccattaggttgcgtacttggaccggaaaatccatcaaatctcgaaatacttggacgagaaaagcatcatgtcgccttcgacttcgccggaggtagaagaacatctgtcgagccgtctaatatcgcggctacagcaaaggttcaaggtgatcaggtacggctcatgggctgctacaactattagtgggacaaaagggttgtgcatgcacatgcttattgattgaaggcataattatgggagatggtgcatggtccagacgaatagatggaacccgtccagagaaaagaaaaagaagaataagaagaaaattgttcttcgtaaacaagtactccctccatcccacttatgttgggacggaatacatattacatcatatgtaaccggagaatggcggcatgtcaagatcaggcaagaactctgatgcctgtgtgcacttgctgaatatagatgattgtgatggccttattccttggatgtgtagggagcttcaacctgattagtgctgatttggggagtaaagctcttcgagcaagtgacaaatcatgtctttcgagcatctcaaagatggacgacctggagtcatttgactggcagcttaaaagcaattaaagtgaacagaggaatcaaactttaaagccactcttgccatttgtggactgttcctgcttgttggtgactgcttttgcgagtatgttcactctcatctagcgatgaaatattttgtttctattgcgcagctgctgaaagggcaaaccccggatcctagatatctgtgggttttgggtgccctctagggttacctggatgttcctatttctgttttcttcttccctttttagttttcttcatgctgtagatgaacttttggtttctgttaatagaattcacagagaaggttctcttttagaaaatctaatgagggggagacgaaggccgagtgtaganacacggccaagttataatagngtccnaaaaaaaaaaaa

SEQ ID NO: 7644 - DNA, 1095 bp, Triticum aestivum
  unsure (1)..(1095): unsure at all n locations
  Clone ID: PAT_TA_7644
ggattgaccggctgaaaagggacaagcaactgttgatggcagaagtggtgaagctaaggcaggaacagcagaacacgaaggcgcgtctgaaagccatggaggataggctacgtggtaccgagcagaagcagcagcagatgacttcattcatggcacgtatcttgcggnaaccctgaattcttgaagcaactgattgccaagaatgggatgaggaaggagctccatgacgctatctcgaagaaaaggaggcgccgcatcgacggtggacctgaagcttatgccgtgggtgctagtagcagcagcctggaccaagagttgcctgttgtgtttgattctcatgggtcagtggaacttcttgccgaggggtcggtgccggtggaactccttgctgacgggatcccacccgatctggaaggctcagtggacctccttggtgacgagatcccacctggcctggaaggttcagtggcactccttgctgacggcctggaaggttccgtggaactccttgttgatgggattccatctgatctcgacggctcaggtatcgactctaacggcgtaacagagccacaggattatggtctcggtacctgtgaagcgcagcagaacagagccccggggctgttccatgataatttctgggaggagctgctgaacaaaggactcagcgttgagaacgacgagccggttaacgtagacggcatggatgtgctgtctgagaagatgggttatctcatcccaaatagcccaaccctctcaacctagttccatttcattctatcaaattgcggcgactttcttcatgtttcatctatccaccctgcagtgcatatgcaagtgtcgtccccaccgtgtcctggtcttcgagtcgtctaaaccctagacttccctgggattatgtgatttatgagtgtttccttcgattgaccttagagatctgtttgttgtttcaggcaatatagcctcgtcagtctgtaaagcgggcgctgctagctgttcaatgcacatgttctgatctataccgtgtaagaccgtcttttgtgggctaaagtggactcccgtctgggatttacagggcanaaaaaaaaaaaa

SEQ ID NO: 7645 - DNA, 419 bp, Triticum aestivum
  unsure (1)..(419): unsure at all n locations
  Clone ID: PAT_TA_7645
acgagaggtcgagccgcgccgagctacataccacggagcgcatggacgggcaggggaaggagggcggcgggggagcggggagcgagtgcgacgtggtgggcagggccttcgtggagtactactaccangacgttcgacgccaaccgcgcgcgcgctcgccgcgctctacggcggcacctccgtcctgtccttcgagggccaccgcgtggccggcgccgaggagatcggcctgaagctggcccagctgcccttcgagcaatgccgacactccatctgcaccatcgactgccagcccacgccgtccttccccggcggcatcctcgtgttcgtcagcggcaacctccagctcgccggcgaggagcaccagctcaggttcagncagatgtttcaactggtgcccaacgagcagggaagctttc

SEQ ID NO: 7646 - DNA, 880 bp, Triticum aestivum
  unsure (1)..(880): unsure at all n locations
  Clone ID: PAT_TA_7646
ggctgccatcagctggggtggcttcggaccggaccgtggacggtgcagcgggtgaaagttggggcagaaggcaagtgcggcggatgcggatgccgcctagcttctgttgatatcgacatggaggatacacagaagtttgctgactctatttctgggttggcccttgagagggagaccaaagcaaatttcagccaatttcaggagtggctggaagcacataaagaatacgaagctatagtcgatggtgcaaatattgcactttatcaacaaaattttgctgagggcggtttcagcttggttcagttggatgctgttgtaactgagctacgagatagatatagtgggaaatggccacttgttatactacataataagcgcatcgctaagcttatggaaactgcatccaataggcatcttattgaaacttggagagcaaatggagcattgtacacatcgccaagtgggtcaaatgatgactggtattggctatatgcagcaattggattgaactgtttgctcgtgaccaacgatgaaatgagagatcacatatttgagctcctaggatcatcgtccttcttctacaagtggaagcaaagacatcaggtcaagtacacttttaataaagggaaggcggtgcttgttctgccacgccccctattcctcagagattcaagaatctgagacaggatcttggcacgtgccaatagaggagaaatctggcgatgagagagctaggacatggctttgtattggtaggacagatctctccaaaccaccccgtgaacctccggtggccaacggagttgcccaggatttatctccatcctgaggcatctaatggggctgggcacanggcaacctgaagaacaggctgcaccgt

SEQ ID NO: 7647 - DNA, 724 bp, Triticum aestivum
  Clone ID: PAT_TA_7647
ttcgagcggccgcccgggcaggtctgcccaaagcattgggacgatgcggatgttttcaatccagaaaggtggcctttggacggaccgaatccaaatgagacaaaccaaaaattcagttatttgccatttggtggcgggccaaggaaatgtgtaggcgatatgtttgctacttttgagactgtggtggcaacagcaatgcttgtcaagcgatttgattttcagatggccccaggagcacctccggtcgagatgacaaccggagcaacgattcacacaactaagggactcaacatgactgttactcggaggataaagccacctgtaattccaaacttagagatgaaaatcgtttccgattcagaaggaagcacaagttctactgcgccagtggctgtttctgctgctagtattgcatccggagaaggtcaacaagtagaggtgtcgacaagtcaagtgtgatttatcatttttgatgctcagattgcaatgagatacataatgagtaccttcccgtccctcggccgcgtccacgctttaatagttatagttccttcgcatttgaattggttatattctctggtatgggcattcattggccttttccctcctttctcttgcattgtcctgctgtagttttcgtatggcacacttcgtttacctgaagtgctcaaagatgttgtatgtccaataaattaaaggcactgctttttcttcaaaaaaaaaa

SEQ ID NO: 7648 - DNA, 565 bp, Triticum aestivum
  unsure (1)..(565): unsure at all n locations
  Clone ID: PAT_TA_7648
gcacgaggaacccttccccaatcacaacagccgccagagccgccgcgcctctccttcctcctcgccgccccctgccgcggcgcgcatccctcggatcatcgtgcccaactccccttcgtgtttctcctcctcccagaaccacatctcgtcgcttaggctccttggtggcggctggctcgaggcgagcctggcgcaggcggggagaagcagcggggcggcggatgtaggcgggagagtgccggacggcgccgtcattgtcgccccgccaagacgcatcgaagaaggaccaggatctcaccctcgtcccttctggatgcacctccccagtgagttcctcctgcctaattcagctcccctttccatctaatttcattcttgtttcacatgttggtttggttggcaagagacgttgcgccgtcgactacagtagccagggttggcgttggtgatgtctgtagtattttcgtcctcgccagttacacaattcctaggtttggtgactatactttcattttgaagattcctatattttccttcctgattttnnntgatgatttgctangtt

SEQ ID NO: 7649 - DNA, 1382 bp, Triticum aestivum
  unsure (1)..(1382): unsure at all n locations
  Clone ID: PAT_TA_7649
ggttttccttgctttgttgtgaaacgtaaccattatccttcaagttaacctcattgatgttggaaactgatgcaaggatgtgcaaaaagatgattctaagaagagggagagggtgccgaaaagaagccagagggagaaggtgccgataatgagggagcctagaagaaggataagaccaataagaccaagtgtctcagtggctctgtcaagagggagctgaagaagcaaaagcctaggaaggaagactctgatggggatcctcctaatgagactgctcaggaagagcaggaggctcccattgaacaagagaaaattgtgattgcccttgaagaatatgagaagatgcaagaaaggaagaagtcccaagaggcctctaaacctgaggagaggagggctgctgctgtagattttgagggtctccagctcttagagaagaagaagattgaggatgatgctaaattgaaggcggaaaatgttcgcaaggcaaaggaggctgctgcaaaggaagccaagcctcgcaaggctatcagcatccaggagtacctgaagccagaggatggttcagagtacgtgcctcctaccccactgaggcgccctcaaaatggcggctacaggggaggccgtggcaacggtgcttacaatggctgcagcagccgtgatagcagctctgagtgccgggtctacaatgctggccgcggccataactccatcgtgttccacaacgccgaggccaaggccaacgccaacgatagtggcgccccaaggagggttgagggttacaatggcgagcaccaccatggcggctaccacttaccagcaaggtgggtacaatagcggcaggggcagcggcaggtaccaggagcgccaggatgggtacaatggcgagcgctgggatcagcagggtgggtactaccaggagcgcagggatgcctgcaatggagaccgccgggagcaaggcaggtacaatggtggtggccggggcaatggtgggttaccaggagcgcagggatgcctacaatggaaaccgccaggagcaaggccggtacaatggtggccggggcaacggttaccagcagcaccaggatggctacaatggttaccggggtgggtacaacaacagtgggcggggcaatggcggataccaccagggcggcaactaccggcagaggcaagctcccaagccaaaggaggaggataaagtggtgatcacagaggccgacttcccagctctaggtggcgcatctcaggcgcagtcccaggcctagataggtcttcttttccttcttattattaagagggagaggagagtttagaggaaagaagaggagcacagttttgtaacagagctactacgtggtatacatgtgttgnccctgggttta

SEQ ID NO: 7650 - DNA, 660 bp, Triticum aestivum
  Clone ID: PAT_TA_7650
cccacgcgtccgtggatccatcccaattgttcgaaaaactggaggcctttatgataccgtttgtgacgtggacgatgataaggatcgggcctgtgaacaaggccttgagccgaacggattcagcttcgaaggagctgacagcaatggcgtagattatgctctcgacagggcgatcaccacatggtacgacgctcgcgactggtttcactccctctgcaagcgggtcatggagcaggattggtcctggaaccggcctgctctggactacatggaactgtaccattccgcgcgcaagaactgagactttaagctggcagggagaagaacagatgaagttccgggagtgggtttgccaggttttgcgacatgccaatgtctcactccatatgccgttctccggaagccattctttgggctctgagaagaagtattgggcttctgcatccctctgcgataggctgagatgtgagctgtttactttatccattgatcatgatatcgcagcatgtgacacgcagacgtcaaatgtggcacacggcaaagttcgttctagcgggagtcttcagttttcgcaaacatgtaccaatgcaaatatgttcattttacggttatgtagtccttgaagatgtacatattttgtaagctggcagttagattctt

SEQ ID NO: 7651 - DNA, 1499 bp, Triticum aestivum
  Clone ID: PAT_TA_7651
ccaaaccaaagccctaaatccctctttcggaagataggagccgccccctttcgtcgtcgccgccatcgccgttctacagctgccgccatgccgtacctccagcccccgcgcccccacccccacccccacccgacctcccgcctctcgcgcgcgtcgccgccgtcgccgttcccgttcttccccgccgggacatcgcgctccggtcgtctccaacccgtcccagtctccggccactcggcctcgagggttagtaaaggaaagtttgcagttgcagccgtcactctagatgattatcttccgatgcgaagtactgaagtgaaaaaccggacatcaacagatggaatcaaaagcctcaggactaatcacagcggtcaaaaccccctatttgccagatggaagatttgatcttgaagcatacgattctctgataaacacgcaaataaatggcggtgcggaaggtgtaatagttggaggaacaacaggagaaggtcacttcatgagctgggatgagcacatcatgctcatcgggcatactgttaactgctttggagccaacattaaagtgataggcaacaccgggaagtaactcaaccagagaagctgttcacgcgacagagcagggattttctgttggcatgcatccagctcttcatgtcaatccttactacgggaagagctcaactgaaggcctgatctctcattttaaggaagtcctcccgatgggcccaacaatcatttacaacgtgccatccaggacaagtcaggacatacctccaccagtcattgaggcgctttcatgttactcaaacatggcaggagtgaaagaatgtgtcgggcatgagcgggttaagtgctacactgacaaaggcatatcaatatggagcggcaacgatgatgaatgtcatgactcaaggtggaagtatggcgctactggagtcatttctgtggcgagcaaccttgttcccggtctcatgcacagcctcatgtttgaaggggagaatgcggcgctaaatgagaagctgctgcctctgatgaaatggctgttctgcgagcctaacccgatcggtctcaacaccgccctggctcagctcggcgtggtgagacctgttttcaggttgccgtacactccccttcctcttgagaagagggtggagtttgtccggattgtcgaagccattggacgtgagaactttgtgggacagaaggaggcccgggttctggatgacgatgatttcgtgttgatcagcaggtattgaatatgtgtgtgagttctttgtgtccagtgtatgctgacgaacagcggtagtgtcacagtgttgtttgcggatcgttttagacgcttcgtttgttcaccagtcatttgttgatctttttctctgactgcatgttaatttggaacccgtttggtttcttggcaccttgtgataccagttccagtaagatatgagaatagcttgagacatgtaccgccgccgcgccacgctaaaaaaaaaaaaaaa

SEQ ID NO: 7652 - DNA, 815 bp, Triticum aestivum
  Clone ID: PAT_TA_7652
gcagagagcagcccgtgcatcagcgccatgattaaagtggtgaggaaagaagcccaggagcatcccaactggatgcgcttttttgtcactcgccgcgaggaagaggaatttccagcgaacgaggaagagcgcacaggcttcaagcagtgggacggcagagatcaaggaggagatatttcaggcgaaggaggtttccagtagtcaggggacgggcgagatcaagggggaggaggagatcctggaagaagctgcgtgattgggtttcttctttgtgggtattgctcacgattagcgagtcgtcttaatttgcaggttggttatttcatcattgtaatgactacctgaatctatctgcgaccatcttcaactgtatatggctagctattcttctcttcaggcttgcgtccttgaaaatcttgtatcctcaaaggtcgtatactgctagatccagtttattgtttgcccacattacttatccaagcttccaagttgatttggcgtgaaggcacctgtatctgtatcaaggccggcgggtgtttcttttattcttttttcatttcagtaagcagcggaggtgcgtctgtcttgcactgtggaacactttgaagggcccggtattgtcatgtaatttaattacttcctccgttcacttttgtaggacagcatctagaacagtttaatttcacctgccttaaacgacttacaaaaatgaacagaggaagtaatagtaatccaaggagggggccaacactttgctgctctgtctctagtgtaggttttattatgcacttgttaccaaaactttgttgctatta

SEQ ID NO: 7653 - DNA, 405 bp, Triticum aestivum
  Clone ID: PAT_TA_7653
gcgagcgtactacgcggcggtgaccacgagcgcgtggcgcgggagcgtatctcgtgggggcgtagcgtggatcgagtcagaaggcgaggggcacgtcttcttcctgaagaagccggactgcgccagggccaaggagctcatggctcgcgtcgtggcgttcatcgccggcgcctgagccctgatctgtgggcgcacgccggcgcggcggcagtgtgctctcgtcacaaacgaactgtaagagtggcttcgattcacaacgtagatctaatgttacaatccgatggattggtgagcttgatgaaggacacaacaatggccatttccttggccgccttctccgccacgacggagttggatctcgcgtctttcgagaaataatacatatgctcctcgccaaaaaaaaaa

SEQ ID NO: 7654 - DNA, 637 bp, Triticum aestivum
  unsure (1)..(637): unsure at all n locations
  Clone ID: PAT_TA_7654
ttcttactnttactcttcgtgcgccgcctctcattccaaatccttctcgattttctcagacacccatccagcctcaacgttcccgatccactccacccgagccagcccgcattaccacctacctcgctcgatctgtgcgcttgcccaaccggcgctgcagctctccacctgctcgatccaaggaaaggagatcctctcccgaagcccctgtctcttctttcgcccatccctaacctttctctcatgccccgttgcctctccctctgtgtaccaggaacatccatggtggctacagctccctcgccgccgtttgcaccaggtccaaccgggagacggacggatccatcctcccgcgtccaccccgcatctcgttcatcccagagcactcctgctacgccaagtccacaagatccatagctgcagggaacgaggcgcactccgccccgattgcatggaccccggccggatcgacgcagtccgccgctgtcctgcttccctagctcgggcacgagcgccccgtcttcctcctcgttgcgcggatccaggaggagcccccgccagcaccgccgctcctctgcgccctcgctgcaccaagccggcatgtacgccgatgcctggagctccaagtctgtggccg

SEQ ID NO: 7655 - DNA, 948 bp, Triticum aestivum
  unsure (1)..(948): unsure at all n locations
  Clone ID: PAT_TA_7655
gttttgaagtgtagatgttccgggattgctagctcctgccagaaatactacatggtagtcttgaagtaaataccaatcatgtgatccgatatgttgtttcagaacaatagaccatcaatattattttcgcctggggttctagaggaggacatctaattaagagaaaactttggtgggatagagacagaagtttgctatatttcacaatacccaaacagaatttcattgctgattcttctgccctgaactttgctcatgccaattacattttgtagaccctttttaaggaaactgctttgtttacaccatcccattggcatgtctattagctgtaatgaaactcaaacggacacttctagaattagcaagaaaatggtgttgtgtatcttgcaccgctttatatgccttctttaggattacaaacaggtgatcagtcatttaaagtatttgagaaacttgaagggaagcacatgggcaaaccataataccttttagttatatttcaagttgtaggaaatttggatcaatccgggaaagcatcttccnattgccagatatttaataatgggcttgaagactacactantttggagttacagaaaaatgagnttatncacaagctgataacttggnacttgttaggatgganagggagaaaacnaaaagattcaatatgaggaaccaaggaatggaaangaanaantcggagatggggatattaaaacaattgnnacatagatggacagaggngaatctgcccaaacacaagattcagaantaggggaccacatccgaannccctnggtaaacctaaccaactcctgantacgagggagcnnaattnaaggannccccccacggaatttggtngagaaggtatccaaacgggttncanttgaaggtccnaataggccctgggngtaaaanntcccatttttnggggaccct

SEQ ID NO: 7656 - DNA, 1140 bp, Triticum aestivum
  Clone ID: PAT_TA_7656
gtcgactcgaaaccggcaccactcctatagccaaatgaccctacaagatgccgccacatgtactcattgagcttaaggaggaaatctacaaatctcttatcaaaggttccattcgccctagttgctctccttggggagcaccttctctctttgttaagaagaaggatgggacgaaccgattagtccaagactaccgtcctataaaccaagctaccattcagaataaataccctcttcctcggatcaatgatctgtatgatcaactggcgggttcgtcagtgttctccaagctcgacttgaggttgggctaccaccagatccgtgttcgcgaagaggatatcccaaagaccgccttcgtgactcgctatggttcatacgagtacaccgtcatgtctttcggtttaaccaatgctccagccaccttctctcgtctgatgaactacatattcatggattacctcgacaagttcgtcgtggtttatctggatgatatcctgatattttccaagaacgaagaagaacatgctgaacatctttgccttgtgctggaaaagctacgagaacatcaactatttgccaagttctccaaatgtgaattctggctaccggagtaacctatcttggggcatgtcatctctaaggatggtattgccgtcaacctcgaaagacttcacgtggtgcttgattgctctcccccaaaacgtaagcgtcagaagttttcccccgccccactgcgcggctgggtaaccaccagatccggctccgcgacggggatagcccagtcaccgccctcgtggctcgccagccctcatacgagtacaccgtcatgtctttcggtttaaccaatgctccagccaccttctctcgtctgatgaactatatattcatggattacctcgacaagttcgttgtggtttatcttgatgatatcctggtattttcaaagaacgaagaagaacatgctgaacatcttcgacttgtgctggaaaagctacgagagcatcaactatatgccaagttctccaaatgtgaattctggctaccggaagtaacctatcttgggaggagtccaatcaagaatagcctgaactcgctcggggttgacggcaataccatccttagagatgacatgcccaagat

SEQ ID NO: 7657 - DNA, 247 bp, Triticum aestivum
  Clone ID: PAT_TA_7657
ggttgcatctgcccgtcgactaaccatttcgttggcttggggtttagggtttaggaatgtggtgggcactagagatcgaacacacatgtttgttcgtccccacatgacatgcaagagagcttgctgtctaattatgtaatatggctgctgtcgcttgtaggactgcttgaatatatgtatgtaaagctgctatatgcagctgcaaccattcagcaacaaaatgaatgtacttcagggaaaaaaaaaa

SEQ ID NO: 7658 - DNA, 842 bp, Triticum aestivum
  Clone ID: PAT_TA_7658
gtcccctcaagacttcgctgttggcatgtccatctacgaagcctcgaccgccgggcccccgttttccttcccggcgctggccactccatcgcctttccgacagacgcatctcctccgcctccactttgcctatgtggggatcacactaccactgaccatatggccggttcctcaggtcgggcaccagatgctccgaacctgccatatcatgctcggctatggcgggaacgagacgatcgcctgggccacctcccatggtcctcggcagctcaaaataagaggtgagaaatcatgcacacctgcatgcgtgcgcggctgggcgcgacgagccttcgcctgcgcctccgccccgggccccccgcacctcaacatgacaggaaggacagacggcgtaggaaagacgctcgatcgagagacggctgcctctggcatcacaagacctctatgtcgccatggcagttagacgcgtgatgcgtccgacaacgcgccctcactcccagacaactcgcagccgttctccgacgacgacgcttgcggcttgcccagccgccctatgcagccctcccgccgtcagcgtgcgaggtcgctacggcccggctaccttgcgccctctcgctgtctctttggtcgcagcccggtgccgccttccagcgcagatgggaggccgccgccttgagctcgcgccagccctgctgcaagtcaaccgtggatgaggtcgacccgcacagacgggagacggcgcatagtgttggccgcgctcgccgccgtggtaatgggcatggccaggccaatacgatgatggacgagatggtctacatcatgaacaacaagaaagtgcacga

SEQ ID NO: 7659 - DNA, 801 bp, Triticum aestivum
  unsure (1)..(801): unsure at all n locations
  Clone ID: PAT_TA_7659
gtgagagnnntttgatccccctgctcgaaatttaccctcacttaagggaacaaaagctggagctccaccgcggtggcggccgctctagaactagtggatcccccgggctgcaggaattcggcaccagggcactgccaccacatccacagccacggttctcgtcattcttgtcatcctgtcatgtggcctccccgcaggccacgctaacgcggtcttcatctcccgcacatgcaagaagaccaataacgccgcattgtgtaagcaagtgctacaactcaaccaagatagcgtcaaggcctccaccgtgcacgacctcgccagcatcgcactagggatagccacctctttcactacctttcaggccaataacatcagagtcggggccaaattcaaccagggtacacccgtgggagacgcgctatccgtctgcctccgggcctattcagatgccgaagatgacctcaggtacaaagcgaaacgaagcttcgatcgtggggactatgcggacgcgtcaaagatcgtgatgggtgctaaggccgccggttatgtgtgcgataacacgctgaagcggatcaaaaaggatttccatgccgaagtagatcgctatatgaaggagcgatgtggcgtcgctgctgaactcatcggcctccttatccataagtgatggatttatggataaggaggcagtctcggctcatatgtgtatgtttctatcaataaatggctagtttccgtttcgaaataaataaataaataaatgggtagtccgtcgtctatcaaaaaaaaaaaaaaaaaaccaat

SEQ ID NO: 7660 - DNA, 1102 bp, Triticum aestivum
  unsure (1)..(1102): unsure at all n locations
  Clone ID: PAT_TA_7660
cggtcggggtgaagcccgcggcattagttcccgttcagcttcacgtcttctatgtctttggtcctgtgctgcagagcatgcttgcccctagggctgcttttagggtccttgctgtgcggggtacttgcgtccagggattggcctcgtgccatgatcatcttgcagggaaaccttttcccacgcctccggccagagagagagagaaattaccgacagaggagattttgtcccttcccatgttcaagattttcacgccagggaatcctgccagtgtatcatacattaagttcttggcaaaagatggcgctcttgttgacttctactatgtcttgggatcggtccttgaaagcttggatgctgcaaggtctggtttaagtatcaagttaatgcaggaaggtcgaatgcggggccaagcttttgtgacatttccatctgtcgaacttgctcaacgtgcactgaatttagcgcatggttatgcgttcaagggcaagccgatgatcattcagtttggtagaagccctgctgctaccaaaacttcttcctaggaggttgcattctttccgactctgatgtgctgtgaagctgttggagttggcaaccaagattctcatttttacctgtgctggtgccgttgttgctgttaaattccaagtcgctcttaccgtgttgctagaactttaggtaagcaacgacgtcggttaatttgacccgcttacgtctatctaacgtactgcatctctccatgagaacaaattctgtaactattctacgctatatatgcacactgccctgaatggtgttggacttggactgtaagacagctaggcatgtcgtgtggaagaaacagctgtatctactatcttgtgcttctcttctccagattctgaattcggggtaatgtacttcttctgtccggaattacttatgtcgcacctgagtggtagtagctgtggctgcaaaggtctgcatgttgtgctgaccgccttgcgcccacgtccatttgaggtggagggtgagtttttaggggcagtcgtgtgtgccacggcttggagcgcacttcaacttctcnaatgaacaagcttttgtgtnatctcgtcggaac

SEQ ID NO: 7661 - DNA, 256 bp, Triticum aestivum
  Clone ID: PAT_TA_7661
gaggaattcggcacgagccagaaggtgcgccggatcaagaagtagacagacacaagatgaagggtcagatagttccttctttactagcagcaataaacagtagctgaaatacaggttgcctccctccttggtaataagtatagcgagagagaataaagagatcatacaaatagttatatcaaaatatcagatgatagactatagattatgtgttaccaacttaccatgcagagggatgtttgaacataaatatata

SEQ ID NO: 7662 - DNA, 588 bp, Triticum aestivum
  Clone ID: PAT_TA_7662
ggaattcggcacgaggcagatcttgctcgttgctcacgtcatcttcggatcctaccgagtaaaaacagaaacactggaaaagtgcaaatgatgcattttactactgcggcaaatatagcaacatgatcatgatatgcaatgcatgatatggcgaggttgatgtttgaaaagacctaatgcatgttagcaacaagttaagtgtaagttgaattgcaactaaaatgcaattcaattaaactacacattcaaagaatagggtctaatcctgttttagctaaaatcatttttaaatgatgttaacatggcatatggtggtgtttggaattaaactaagggaatgctaaacatttaaaatgtagcggaatgatcatatgcagcattttcacaattctccatattaaaagaaagacattaatcatggctcaacactaaacataattttagaagttattaacatgcacaacaatggcatatttagaatctacacatttttttttgataattttggtatatttgaacatgttttcttgaattagttatggatttttgaagtttgcacaattttctagaatttattgttttgactag

SEQ ID NO: 7663 - DNA, 691 bp, Triticum aestivum
  Clone ID: PAT_TA_7663
ggtttagctttcttcctcccttgtagctctattgtccttgttgcgggtagccatggcggccccaatgttgaaccagcccaacggcctccttgccaacatgttcgctgcgggtttgctggatgatcagttccaggagctgcagatgctccaggaagggagcgccccagacttcatcgtcaaggttgtctcactcttctgcgaggacggcgagcgtatcatcggcgagatcgccaagctgctggacaagccatgtgtggactatgacaaggtgggtggttttgtgcatcagctcaagggaagcagtgcaagtcttggtgctcagagagtgaagaacagttgcattcagttccaacagtgttgtcaggagaagagcagagatgggtgcctgaactcactgcaatctgtgaggaacgatttctatgatctgtgcagcatgttcaaaccacatgcttcagctgtgccagcaggtccaggccttaatcctaaagtatagacttgagcgataaagctggagatgcattttctcatggtacaacacatgttcaacctagcttatagcttggagtcatttgcttatgtggggtatgtagctgccgagtggcaagctaatcatctactagtatcgatgtctttgttactgtccgtagtttcatttggaattctgagtggtcaaataaaaaattcagctgtg

SEQ ID NO: 7664 - DNA, 415 bp, Triticum aestivum
  Clone ID: PAT_TA_7664
gggcgggagagagacgtcgggagttttggagaaggtgaatatgtctctcccaatgacaggtgggtcccaaacggtagatacaatatgcagcccaatattatagcgaatctgagtttcagtcacctgttttaggctccataaattttgacacgtcgccctttcagcgaatatggagatgagattttagtgattctgccagagttgctcgaagggcgacctgtcattgttggctttaactaactggaactgcaatatagtggctgccgaagccaatggttagaatactgctgtaaagaatgtttggagttgcaatatagtggcctcccgccgaagccaatggttatacgtagcatactgctgtaaagaacgtttgttccacagaatgccaattgctgtgttgatcttaaaaaaaaaa

SEQ ID NO: 7665 - DNA, 1021 bp, Triticum aestivum
  Clone ID: PAT_TA_7665
ttcggcacgaggctcgatcccctcctttctctcgatgctccacctccgccactactatcgccgcctctcctggccatctccggtggtcttcagcgccgcgctagctcataaattacttccctcgctccgctcttcctttcagtccaaccaatctccttgattgcttcctcctagcccggtcccttgttcttggtgacctagggtttcgttggtggttctggtgtggaactccggtgatcccccggttgatgtggggtgcacaggacgtctccatttttctcaccgcggcgcggtgatgctcctgggtggcgtcttcgtgcgatggtgcccttggagcagcgtcagcgtgcccggcgcttgctctggtcgccgtggattctccgacgaactcctagccctttcctgggtgtgatggtggtcagaccacagccatggtgtggctttgtttatactacggctccatcccctcttgggtcatgtgatgctagaagaatgagcatacgcattacaacaggaggcactgacggcccatgcagacgggcgtggggaatggagacggcaaaattgtactccctccagtgttgtttcataaacgctcttatattatgggacggagggtttcataaacgctcttatattatgggacggagggagtacgtctaaaagagggtggacgagcagaagctgaagaaaaagctgaaaatgggaacacaactatggaagaagagtaggagaaggaaaacagaggaacggaaaggctgatgcatgcttgcgatggttatattgctttgtgtgtgtttatactagttgctctattttggatgccgtttccagtgttgtttcatgtttgctttgttgttattccctctgttctgaattataagatgttttaatcttttttcctgattcagatgtgtataaacgtggtttactgtgcttgtttattcatttaaatctgtatgtaatccatattgaaatatccaaaacaggatggggcaagcctgcaaaactcgcaccggat

SEQ ID NO: 7666 - DNA, 1534 bp, Triticum aestivum
  Clone ID: PAT_TA_7666
ccacgcggccgggctccggttgccctgggcctgctctgccaccgggatgcaccgctgtcggagggcggaataggccctgctctgtgcctggagtggctcctgatggcccgcggtgtcttgctccgtgtggtgcccctcaaggccctccattttacccaactaagtgccatggtggtgatttgagttcttgtgccgcacctccagctcatgtgccaggacatgtgaactcttcagctttgagcgcagaaggctgcgattctctagcactgagcatcgcgccaaactgccatgagtaacctgcatgattcctgtggaccaaatacattccctgaaagttccacagctcttcagaccaaaggatgtagcactctcaggcgccgtacgcagcccacatgggttatactgctcctgcaccgacaaccggggaggctatccaatttggacgctgccatatgccatcggcgcccaagcctgaaaccggcagcaacgtcgcttaggcggctgacatcctcgtcgccctatcaactccgcgagagagccgcaagtagcagaccggacagccgaggttgcaccgccgatgacccctttggtccccgtagtggatcttttggaatatccgtgtaaatgtttacccgtttcatgtgctggatggtggcttggcttgccgttgtacaggcggggggaacttgtgctgttagctcaggtgtaaacaaaccagtgggatgtgctgttagtttcggttaatcttgtagggatacataccactcacccctgtcgaactctgacacctggtggccgggtatttctttcactgagtattgcgccacaaagccaagcaatttatccaactaagtgccatggtggtgattcaatttcttctgtcgcagctccagctcatgtgccaggacatgtgaactcttcagctttgagcgctgaaggctgcgattctctagcactgagtatcgcgccaaactgccatgatcctccagcatcaagcaacaacgagccagcgctccatggggctccaacaacacatacagcatctgaaggcgagcactctcaggcgccgagtgcagccaccatgggttatactgctcctgcaccgacaaccggggaggccgtacaatttggaccctgcaataagccatcggcgcccgtccctgagcccggcagcaacgtcgctcaggcggctgacatcctcgtcgccctgtcaactccgcgagagaagggcaagtagtagcagaggggacagccgagactgcaccgccgatgacccctttggtccccgttttggatctctgttgctgtacatgtaaatgtttacccgtttcatgtgctggatggtggcttggcttgccgttgtacaggcggggggaacttgtgctgttagctcaggtgtaaacaaaccagtgggatgtgctgttagtttgggtcaatctgtagggatacataccagtcaccctgtcgactctgaacacaagtaactgtttatctggtgaacttggcaaccgttatctcctctgttttatgtgcc

SEQ ID NO: 7667 - DNA, 895 bp, Triticum aestivum
  Clone ID: PAT_TA_7667
acgcgtccgatccccaataaggccggcagcatggaggagacgccgccgcagcctcaggcggcgcacgcatctcctccgttcccggcgatcttcacccctccgagcgctctctcctcgacgtccttgcggggcagccccaccgtccccagccccgcgcacttcagcacgccaccgggcccgcccgtcttctcctcgccgctgcgccccgccgccgtgccattccgcaccaccccgatctcccctcaggcggtacccttggcctcccgcaccgcctcctcatcgtcctccgtctccctccccacatcctccgagccgcacaccatgaacggcgcggccacccctcacagccacgcgccctccgtggcgccgtctctggaggactccagcatcgactccccatacgtcctcttctctgcccgcaaggtcctgaagcagaagaaactgctgaatgcccctagcttggggttcggagctcttgtttcaccagggagggaggtatcgccaggtcccgaagccttggagcgtgatccccgccggtgcctgaactgtggggcttatgtgaatttgtactgtgatgtgttgattggctctgggcaatggcagtgtgtcatttgcaaaaagctgaacagcagtgagggggaatttgtggtctccagcaagcaggacctggttcagtggccagagctcatgtcctcgactgtcgattatgtgcatccaaggaataggcggccaggcttgatcccggtgcctgtcttgagggtctctggtcccatttttattctcatagatgagtgtcttgatgaggcgcacctgcagcatctacagggctccttgcatgcatttgtggattcgctccctcctacagcaaggattggaatcatctcctatggtagaa

SEQ ID NO: 7668 - DNA, 608 bp, Triticum aestivum
  unsure (1)..(608): unsure at all n locations
  Clone ID: PAT_TA_7668
tcggcacgagggctcctccccatcgtctcctcctgcccctaccccatctcctacggcgacgacatcaacaagtacgtcgtcggcaccggccgtccgcggagtctccaacgcctctcctgcctactcctccgatgcagcagacccgccgcccaacaactccccttcctcacctctgtctcttccttcccctacccctatagcgtctggtggcatgcacggctggcggcccagatgtcagtaatgccaacagcagacagcactcggtggaggagctctggcaggaaggcagcgaagtccgcaccggagccaggagtgttcttcggcgggggagccgggggcttgagcttttcttggagtagcgaggttggggtccgagaagacacacggggttgggatgagaagggcaccggcgaggggttcggcagtggtcagatgctctatgtaatctgttgacgctctcattgttaatctatctaggcaggatgcatatgcaaagctctagatgtccacgctctatatgtattgggcaccttttctgcagagctaagtatggacttnccaatttttcctattgctgaaaagaaattgtttcttctacaaaaaaaaaa

SEQ ID NO: 7669 - DNA, 944 bp, Triticum aestivum
  Clone ID: PAT_TA_7669
ctcacatcctgggatcaccttacattgcataggcctctccaatcatttctttcgcgtgagtccattccctcccacataccctgatactactttttccaatgactggaatgtgaagacttctttgtactggagttgaactcttatttagctttacaatctagatttcagatttgctaatttttttgaattaccttaccaagctccagataagctttccacaaatataaagtagatagggaatacttggcctgctggccagtgaggactataattatgtgatgagggtaattccagaacatgacaggagcgcctgctcttgcaagattcacaaaggaataatattggtggctactaatgtttctttttgttcttgacattgaagtcaagcaaccaaggattgtgttcaaaaactttgatagctatattgttgatgctgttcactctcataaaatggaacccattccttactggcaatgaatacgagttgttatttaagcttgtgctcaattgctagcttgctactttgataagtttgtgggaagtgtctcgatccgaagtttatgaggattttaataattgtttgcacatgagcacttgtctgcaatctcgctatgctaagctttcaggtgtttcacaagcacatgggcaagttgaatcaggagcctaaatcctatggcctgccatttgctgtggtctgagactctttctcggagggaagaatcagaaagggagaagcctgagacgaaccataccctttgtttgtctttgcagcctgagatgaagagcctataaggaagagaggatacttttttcgcactcatttccttgtagcttcagtctgtagtaggtctcgatgagtggtacgaaaacaggacaactttttttgtcattcgttttctcagtgtggacatgtatgttcagtgaaatgaaatgcagttctttgc

SEQ ID NO: 7670 - DNA, 965 bp, Triticum aestivum
  Clone ID: PAT_TA_7670
attcctttcacgtgagtcaattctgtcccccatccatcccctggacactactttttccaatgactggcatgtgaagacttctttgcactggatttgaacactctttgagcttccctacctagctcccggtttgcctccctctttgagttaccctaccaagctccagataagctttccacaaatataaagtagatagggtgggctacggcctgccgccagtgagctatataattatgtgacgagagtaattccagatcatgacggtaatttctcactagatacctgctcttggaagattcacaaaggaataaaattgttggctactcgtgttttcttttgttcttgaaattgaagtcaaaccacctagtgattggtgtcgaaaacttttatagctatattgttgatgctggtcactctcaaaaattggaatctattccttactggcaatgaatatgagttgttatttaagcttgtgctcaatcgctagcttgctactttgataagtttgctgaggattgcagtaattgtttgcacgtgagcacttgtttgcaatctagctatgctaagctttcaggtatttcacaagcacgggggcaagttgaatcaggagcctaaatcatctggccgccgcgatccgagactcttttttctcgagggaagaaccagaaagggagaagcctgagatgaatcataccttttgtttctctttgtagccactttcttcctgataatgctataaggaagagagaatggtttttcacacctagtactactttccttgtagcttcagtctgtagtaggttctcgatgagtggtatgaaaacaggccaaaaatttcatttgttttttaagcgtggacgtcatgtatatcagtgaagtgaaattgcacttgtttgctatctgtgctggcatgccgctctggtcacctgagctaaaaaaaaaaaaaaaaaagcccctagggccgc

SEQ ID NO: 7671 - DNA, 793 bp, Triticum aestivum
  unsure (1)..(793): unsure at all n locations
  Clone ID: PAT_TA_7671
ggaacacttctgtttcctggtcatcctcccactccttggcttggccatggccttgcagttgaccgccccatgtcaagctacgcaacctcagccacaaccgatctatgacacagaagatcatgcgctaacaggtgacaacttctacaatctcatgccggtggacctcttactgaatggtcaatgtgttaaccatagctctatatggaagtccgggtgccctaggaacgtgaatctggcactatgcgacgactccaccagcagtagaagcgtggctgtgtcgatcaagctggcggcggcgaccaacggctccgacaaggaggcatcaccccgcctctcgactgacgtcgtgatcgaattcggcgacaccgtcaacaagtgcaagcagcgtctccaatggtacgtcggcgcaggtatcacgcataatttgcatgtgaccgtcggccacttcataaatacggaggggagcgacgtgctgacagatggcagagaccaaaagttcatttttcgcgtcgagaggtatcacggcgcatacaagctgacatcgtgctacgccccggggtgcaaacatgagccgtgcggttgccgtgatctggtgttgtacaaatataacaaaaagtggtggctggttgttaaggaaaaagggtggcaggggctgcccctggtggttgtgttcgaaaaatgtcctaggccgtgctttcctcctaagggcctgcctcacgagtaatncttgtagagttatgtactagtactactagncttgctagttaaccgnatcattaccaataataaataa

SEQ ID NO: 7672 - DNA, 1148 bp, Triticum aestivum
  Clone ID: PAT_TA_7672
ggccggccctcccgcccgctggcgggctgggacttccccggccagagcctgcagggttcctacggccggggaggccgccttgcgtcctccctcctcctaccgctccccctgtgatgcatccccggttgttgtgactcgtcggttgggatgtcgtggccgtgcggaccgtcttggtctacgctcgcccgatgcaggccgcctactcccattggctcgctcgtctgccccgggtcctcgcccgtggcgcgtgcgccggcaagcggtgtggccgcggttcgcccttcaggttcctggtgtggtgcctgcggctgttcctcctgcccgcggacggtctggtcggagtcccggtcatagggccccggcccgttcgctcgcagtcgcttgttgcccagcccgtcgcgcagcggcatgctgcgggcttttgacagtaagcactagagtcggaggggttccagaggttctaccagatgacatgatagtactagcagaaccagatccagaagatatggtacgggctgtgaggcaagctatcgacatacttcctggtatagatccccaaattatgcatcgccggatgaaaaaactctacagttgggatgatgtggccaaaagaacagagattgtctacgatcgtgcaatgcagtcatcaaacactaatttgctagatcgtcttccccgatacctcacatgtggagcttgggcaggcaaactgttttgcctcgttatgatcataaactaccttgtgtggtgccttctagaattcctgcaggtatttcttttttacctaggcatttcttattttatggagattgatgagattataacggggtttctctccctctcagcctgctgaaggtatcgaagaagtcccagatatagggccactgcacattcattcggattcagtagatgaccagtgcgaagcgcaacgaaattgaactgttttgcaaccattgtggcatggatcgtattggaggtcgcgatatctattttaggctggctctcactctggaatttctttcagtgtttcccggttctgcattgactgttttgagaacaagtctttggcgaatgggataactatgaaatcatctcgtcacaccaaatactggaatttacagtcgtgttgcataaagttagtgagtgtg

SEQ ID NO: 7673 - DNA, 890 bp, Triticum aestivum
  unsure (1)..(890): unsure at all n locations
  Clone ID: PAT_TA_7673
ctaccgcgtcgtgacatgagnaggaagacctcgcttccaccactatcgtgctggcttctccaagctattcttaggcatgttctacagtgtggcccagggataatggacaagcacattgagaatctcctccacaaagaccaacgtctatatttattaagtcagagcaccaaaaattcatatcgtagcaattatgacaacctgtttgagactggacaaactcggcagtcattgccacttcaaccgatgccaactggaacaatgacattagggctaaatgattctggagccctgcaaggtgtacactttcaaagctcagggcagcgagctccactgaaggaggacatgcttaactggaaatactttttgggcacgcctctcgggtcacaacctacctccatgtccaactctaatgccggtatcatgtatagtaactttggaaaccgcttcgacaatcacatcagttcatggaacttatctcccagtgctgattactcatcattgcgtgagatgtatgacttgaatggcagccataccttgttgccgagtaacagcaacttatcatcggagacaatgacacttgagcagctacgagaaaacttattgagcgacaacgagatcgtgaatgtggtggacgaagaggatctcatgagcatggtgaactccctttcctgtttgattgggaagagttcccactcccaggcaaacaataatctggtcgctcctcctcctctagatcttgaaccaacccaagtcatcaacgttcctcctcctggaagcagccctccatggacggagtggccaggctcaccatgagagcaatcgatggaggcacatgaacattattattatgtgtgtgtgggtgtgcttgtggcataaaacataaaattgtt

SEQ ID NO: 7674 - DNA, 629 bp, Triticum aestivum
  Clone ID: PAT_TA_7674
ctcgcaccgatccctcgctcttcgccgccctcgtaccgattcctcgtgcttcgccgccgccgatcccttcgacgccgccaatcccttcgccgccgccgatctcatagctacgatccgcttgaggagccgccgccgatctcgtcgctacgatcagcttggggagccgccgccgatccccttcaggatccgccggcgatcgccatccagggcacagtctacacgttctagcgccaagatcctttccccttcctcctgctatggtcgggggtcggcggctcgccggtgtggcgcatggcagcggagagaaggggggcaagaacagcggggcagagttcttccgggaggacggcgtgttgcacgacatggacgcgtaactcaactacctgtccctcgagcatgactcctgggacaccaagccatggacggcttggtattacttcttggatccttcctcccttctctgtatttagaaactgaaatttaataaggctgtgacgcaattttgttgatttgttgctacctgtattaggctgatctgctatggttgtggttccttgtcgtagagtgccaactacggactccgccatgtccaaccacctacacatttaggtttgttttaaaatcgaata

SEQ ID NO: 7675 - DNA, 791 bp, Triticum aestivum
  unsure (1)..(791): unsure at all n locations
  Clone ID: PAT_TA_7675
cgtggccgggcgcggcggcccccggggccgcggccacggccgccccgtcgggccctcccccgccgccgaccagccgctcgtccgcatctccggccgccgcaacgacctctacaccctcgtgatgacggatcctgacgcgccttccccccgccgccccgccctctacgccctcctcctctcggtcccggtcgcccctccccctggcgcgcccgccacgaggggggacctcctcgggccggtcgtgggcccgccgccgccggcgggcgccccccgcggcgtgctggtgctgccctagctggggccgcgcccgccggtgggcatccaccgctacgtgctggtgctgttcgagcagaagacgcgcttcccctacgtcgaggcggcgccgccggaggagcgcgcttacttcaacacccgcgccttcgccgccaaccacgagctcggcctccccgtcgccgtcgtctacttcaactcccagaaggagccctccgggcaccgccggcgctgaggaaagcgagcgccggccgggctactcgggcaccgcccgctgcatgcgcaccgagctacaatacttaatcccggtgaagaataataactaaacttccataagttaagcctgaactgctacagtatctgctgtttactgttgtgtaattgcactgtgcttgcgtatgcatgcatgagatgcatggaccatatatgtcttggggttttgcagaacaactnctccgcgcgacggggatatttncctgcgcgtgttncttgtaataatagtactagcatgcagctggcgc

SEQ ID NO: 7676 - DNA, 656 bp, Triticum aestivum
  Clone ID: PAT_TA_7676
gggcttctcccctccgcgcttctctcgtctgctcccggcgagggtttttctccgccgtttccaggaggagtaaggggacgtcagacagaggggggattggttaggcgaggcggccatgggtgcgttcggctccaaggacaactcgtcggggcggcaccaccaccattgcaaccaggaccacagcaagaacgccgcgccgggagggaaagaccgcttcgccaagttcggcgacgattaccacaccctggagcaggtgactgatgctctttcacatgctggactggagtcctcaaatctaatcgttgggattgatttcaccaagagcaacgaatggacaggtaaagtgtccttccacaaccggagcttgcatgcaatagggaacactccaaacccatatgagcaggctatatccattatcgggagaaccctagcacgatttgatgaggacaatctgataccatgctttggattcggtgatgctactactcatgaccaaaaggtatttagcttctatcctgagaaccaaccgtgtgatggctttgaacaagcacttgggcgatacagagaaattgttccgcagcttcgtttggctggtcccacttcatttgcacctatgattgagactgctattgggattgttgatagtagtggtggcc

SEQ ID NO: 7677 - DNA, 431 bp, Triticum aestivum
  unsure (1)..(431): unsure at all n locations
  Clone ID: PAT_TA_7677
cgcagcaatagctttggtcttgctctttcttaccttgggtggagaggccgagttgtgcaagcagcgtagccgaactttcaaagggcggtgcacccacaacgacaattgttttgccatctgcctcactgagaacttcaccggagggtattgccacggcgttgtagaacgtcactgcatgtgtactaagaagtgtggcgagccgccggaagagccagaggagccgccgctaccggaaatgatgatctgactgaagtgtgcctgagatttgagttgatgacaatgaaattatctctctaccaaaacctggtcagagagtgagaaatgaaataaagtaaaccatattatatgataccaatataccatngcagtagcacaaactaaaccttttacagctgaaaagacaaaccatatgccgacaaaaaaatttaact

SEQ ID NO: 7678 - DNA, 431 bp, Triticum aestivum
  Clone ID: PAT_TA_7678
aggaagtcttggaccttgcttaatgcttggaactacacctttccaaacatccttgttgcttgatgccaagaggatttctccaagagactggaactatgttcctctgcagttctccattcagacatttctatggttagagctttcttctgacaaaattgtgctggtgtctggatgtaaaatgtatttcctattacagctgagaaagagagtaagtaaaaagggtaagccaagggctagcctaaaattccaaaaggactatttcctgaggtatttgtcgccggccaacctgtcatcaacccagggttggtcgcttgaacgacattcacttcgagggagttctgattaaaagtttgtgacttatcatgcatggaacatgcatcttttgttaacattttcattgcattatatattatataaaagcaaaaaaaaaa

SEQ ID NO: 7679 - DNA, 857 bp, Triticum aestivum
  unsure (1)..(857): unsure at all n locations
  Clone ID: PAT_TA_7679
gangatnccctttntcnnnncnanaccctcnctaaagggaacaaaagctggagctccaccgcggtggcggcccgctctagaactagtggatcccccgggctgcaggaattcggcaccagctacaatacacgcccttctctatccattccactctatctccctctgcctaaggacagttcaaggtttgtatctagccttctaacaatggcaataatgccgccgacctccatcttcttctccgtgatcgtcttcatgctcctttccaatgccattaatactcaagccggtggctctggcggtggaaaacctaaggcaacaagccttgtagtggaagcgtgcaagaacgcttcgggcgagacccaagaccctgatgtcacaaaggaattctgtttgtcgaccctccagtcggacaagcggagcgccgaggctaaagacctccctggcttggtgctcgtctccatcgacatccttaagggccgtgtcactgatgctggtgtcaaggtcaagaaaatgctacaaaacgccaaaaaaggcacaatggcgatgtacgctctcagtatttgtgagttgcaatatgagaacgtggtgagcacgctcaacatctgccaggccatgattaaggatcaccaaggtgacaagggcgtcctgcactccttgcgtctgccctactgtgtggatatctccggcgacacttccagagagtgtcaaactgctcttgaagatgtgccaggggcggaggcgctgcaaactgataacgaagaggctgcgcattctgttcaacctcaacaccgccttggttgtaccatatgatgtccgtgattagattagtatagtgatgttttttatcggcgagaaag

SEQ ID NO: 7680 - DNA, 1396 bp, Triticum aestivum
  unsure (1)..(1396): unsure at all n locations
  Clone ID: PAT_TA_7680
caaggttgtgcggggcagaggcaggaacaagnaggaagtggacaatggacgaggacgaggagctggtcagggccctctgcgaggtgtccaccgacgccaggttcagggccgaaggagggggcttcaagaactgctacacccaggggatagagagcctgctcgcgcagcggctgcccggccgcggcatcaaggccagcccgcacgtcgactcccggctcaaggtgctcaagcgcaagttccacgcgatcaaggagatgctcgcgtcgccggggttctcctgggacggctccaggaaggtcgtccggtgcgagaagcagcgatacgacgagtactgcaaagataatcctagagccagggggatgtacggtgttccatttccgcatttcgatgtgtttgatgcggtgtatggcaaggatagagccgctagagaagtggtggaagtgtccgaggaagccaccgccgacatggagaatgggaatacgagtgaagccggggatgatgaaggggaggaagatcggactgtccaatggaccgtccggccgatccttggatgctacgtcgagctataaaaaacaggaaagatgtaagaatggcggtaaaaggaagagggctgaatcgaattgcccgtctccagacacgttgaaggatgtgcgtggtcactatcaacgcgccagccagcatgtcgacacgatggcagaagcgatggagctgttcaaggatgtgcaccgtcacttccagagtgttgttcagcatgccggcgcaatggcagcggcaatggaggcgttcaagggcgcacacgatcagtttcagagtgttgttcagaatgcgagcaccgccgcaacagccatggagcagttcaaggatgcacatgatcagtttcgaagtatcacccagaatggcagcgcgactgaagcagttattgagcctcatgctgatctgcgagaaaggttgtcgcctgaggtgccccaacaggatgccagggtaagggccattgccgagatgcaaaagcttgggtttaccgggagcgaggtggtcagcgctgcgagtgttttcgcaaaggaaccggaccaaatgggcatgtttttagcactccccgaaatctacaggagggagtacatactcaagatgctcaatggtgggcaatctctccatttttagcttaaagcgacatgggaggagagaagctctagaagttctaattcagcctagttgcagcaatggcagttgaaattttggtactagtacatttgtaaatggttatatatctagcgtccctctgctctgctcggttgcgctgcgcgacggggccgtgccttggcactcctctccgtgctccggccccgcgggtaatttgtacggccggagggtattgcgcgccccctccgtttccaacagc

SEQ ID NO: 7681 - DNA, 1453 bp, Triticum aestivum
  Clone ID: PAT_TA_7681
tttctctctggagaaagaaacagaagcttcgagtacccctatcaaagtcgctacacacggtggaaatctcttggtctctctcccgacgcgagaggcggtttccaggcgtgctgcctccgctggtctccatcgcctccggtaagccgtcgggctctgggaggtgtgcgggacagtgtacgaccgcgacgcggttgtagataatgttgttttaggattttattctggcactggcgggcaggcaggggcgacgtcaacgctgtgggataaggttccccctggctcctttcccgtctccgcggtgctccctccggccggtggcactgtggggttagggaggttggcctctctcttatccggcgaggtttggtcggtgatgggggtgcacaatagtatagaagttgggatttgtggagagggattcccagatcaggtcgcctcggacggccgacagctgcgcactgttgcgggcgaagtggtttgagttgcggctccactccgtcgtaggctgccgctggtcaagggatcacttggtctaccccaggccgatgcaccagaaccctccctggttccgtcttttggggagggacttatatgcggctcacaaagccatggatcggcgatgctgctcctcatgcccgttgtcttgtggatgacggctagcaccggcgagtgcagagatcagcgtgcctaggtgaataaggaagatgaactgggctgtaagttactttgtttgctctgtcggcgttattccctttagtgttatctctgcctctctagttctcaacctccaacgacatgcccttttttgtgctggccatggaggctagcagcggcaggactgccatgactaggccgcgcaatatttctaacagtgttgagctactcgttcccgacagctccggtgccaagctgccaatagaagctgagcagatttcaggatatagaaggcagcttcaggaaggggtcgctgacgagagaaataagtactgaagcaggcttcaccgaagactactgatctagaattgtctgttgctgaaataagtccaggagcggtggagcaggctgaacaattttctgttgattttactgaatggattgtccctgtaatttgaccaaacatcatgtcgccgtgccactgaagtttttgcacagaattcttgtctttttgggtggtgccaagctgtctttttattgaacaatgccacaattgcatagttgtaagttatttaggattgtctctattgcatacgacctggagttacaagaggtccagtacctcggttgtgtatgtatgtacatgtgcagtcgcccattttctatacacatgattccaaaacatcttttactgtacattttgtttctttgctcggtacaaaatgtattgcaagtgttgttcatttttttcccttctgtaaatatactagagaccctctaagggctcagttttcttccc

SEQ ID NO: 7682 - DNA, 683 bp, Triticum aestivum
  Clone ID: PAT_TA_7682
gcacgaggctcgccgcccccgctaaacctcccctcccctcccctcacgaggcgagagagtgcgacgacgaggctcaccaggagcggcagcagcggagtcagaaccagcaggcggcgcagcccctgcagcagacggcggtcgaatcgcgggggagaggtcgccggcgtgagggaggcccgtcccggcgacgccgcgcggccgttttctctccgcggtccggcccgtcgatctcgtttctcagcccccgctgctctccaccggccgatcccgcgagcccaggccgcagatcgttccattccgcgaggggaggcgaaagggagcgccgcctttggaccaaccggggaaaggcgaaggggggagtggagattcttcgggtttcggctttaggagctcccggctcatggatttcttcaagctcaagaagttcggcaaggcccggaagggctccaggcgtgagagagaggccctggagtgcgacgaggaggccaacggagggaatgtggcttcggagggcgacgtcttcgaggagaaccctgaggcggccgcaggggcttggtgtggccaatgggggaggggcttggtgtggccaacgggggagaggaggttggggaggaagaggaggatgaggacgatgatttcatcaccaacgaggtgaagcggaggctcaaggagatgaggaagaa

SEQ ID NO: 7683 - DNA, 717 bp, Triticum aestivum
  Clone ID: PAT_TA_7683
gtcggctccggcgcggcggcgcgttgcgccggccctgtggagagctaaatgatgatttctgggaggacctgctgcatgaaggggggctcggcgaggaggccagcaacctggtggttccagatgacatgaacttgttggctgagaagctggactagctcgtcgcataggacgcggattccggtcaattatccatcccgttctttcgcccagcagccctgagcatcctttccaggatccccgttgtgattcctgtccagatggccgcttcggccatgtgcagtcagtcgtgtggttcgcccctgccctggctgttgaggccacccctgctgcctttggtcgtgctgcctcccgtctatcccggcgtcggtcctacttccggcagggccctggttgggtcgcctgccgcgggctgccgtgcggggtgcttgcgcggacggggctgcatccctcggcctctgtctccgtgcgtcgtccttaggcggattgggctgtttgcccccagccttctgctcgtctgtgtgctggggtcgtccctgggtgatttcgttggacacgtggttcccggtgtgccgctcgcttatgtgccggcttccttcctcgttgaggctactgggcctgttgcttccttagggaggctttgtactgtatcctgtattcctcactaaggaatgggtatctaaagttgctcacatttgggaggctttgtactgtagcctg

SEQ ID NO: 7684 - DNA, 1058 bp, Triticum aestivum
  unsure (1)..(1058): unsure at all n locations
  Clone ID: PAT_TA_7684
cccacgcgtccgccaccaccaaacttctcccccacccaactcgactcgagcgatcttcaaagcctccacagcgagcaaagcaacaccaccctccatgccaccctccggcctcctctcctacatcccgaccagcctctcctccatcctcccggtgcgcggctgcgccgcgcccccctcgccgtcgcctccaactccgccggcgtccccggccccgagcaagatgtcgccctcggtgaaggcggcggaccgcgcggagctggcgcgcgtgttcgagctgttcgaccggaacggcgacgggcgcatcacgcgggaggagctggaggactcgctgggcaagctgggcatccccgtgccgggcgacgagctggccgccatgatcgcgcgcatcgacgccgacggcgacgggtgcgtggacgtggaggagttcggcgagctctaccgcaccatcatgtcgacgggcggtggcgggggccagaagggctcgtcgggcgaggaggcggcggcggaggaggacgaggacgaggacatgcgggaggcgttccgtgtgttcgacgccaacggcgacgggttcatcacggtggacgagctgagcgccgtgctggcgtcgctggggctgaagcagggccggtcggccgaggagtgccgccgcatgatcgggcaggtggaccgcgacggcgacggccgcgtcgacttccacgagttccgccagatgatgcgcggcggcgggctcgccgcgctcgcctgatcgactacgactgatgctgatgaatgtgcgctttgtatgcttggttggtactagcaggtgtatgtagatatttggctcgggccggggggaatccgtgtaaccgctcccgaaattcttctcgttttttctggtttgtttgttccttcgtacgcttaatctaagatgtactgtaagattgatgggcttgcagattaatggtttgtactgcttgctgctcgcaagaattgcttggaagaaccacaacatggtgttgtaccacaaaganaaacanaannatgtttanttcgtcannaccaacccctngggggggccc

SEQ ID NO: 7685 - DNA, 670 bp, Triticum aestivum
  unsure (1)..(670): unsure at all n locations
  Clone ID: PAT_TA_7685
gaggaattcggcacgaggctttnctggtccttggccctccccacgccgcgtcgccgtctccgccgcaccgccgccgtcccgctccttctcctcccgccggatccaccggagcacgcctcgaagaggagcaaatctctgtacgcctctctgctggatctgtatcggctcccgggactgctcctccctctgtcgcagcgccgagttgccggagcagatggtgggattcggtagccttgctcccaagaccaagaacctggtggtgggcggtgggttgacggggttcgtctttggggtgtactattacaccatgagagcagtcggcagcactgatgagctgcaggtcgccatcgacaagtttgaagacctgaagaagaaggacgccgacgccacccccgctgcaaacccctccaccccaggctcatcgtaggaaaaacatgctctgaaacttttgtttacccgtaccgagcttctaaactagttacctcacaaccagaacccagaaccatggtttggtttctgtgatgataataggtcatgttagatagagctttttatggcatgggtggagtccagaattagtagtgctttagtgtttatggtgaccgcggtgccggaagtttgatatactagtactggagtagattttttggaggcacgtttnaaaaaaaaa

SEQ ID NO: 7686 - DNA, 688 bp, Triticum aestivum
  unsure (1)..(688): unsure at all n locations
  Clone ID: PAT_TA_7686
gctgctctgctctgctgccggccggccaagatcgaaccttgtaccagcgaagggaaggggaagggaagggaggatgctgcggcggcacaagggaagggaatcggcgtcgtcgtcggattccaccttctaccagctgcgccccgactgcgcccacaacgtccccgacaccaagttcaagatcaagattggcaagacgctgagcgtacgcaaatggcacgccgccttcacgcaccacggatccctccacatcgcctctgttctaaaccggattcagagcgggggtgtgcaccccgcaatcaggggaagaggtctgggagttcctgctcggctgcttcgatcccgacagcacattcgatgaccgcgaccacatcaggcaagcaagaaggatacagtatgctagatggaaggaacaatgcaaacacatggatcctcacgtcggcagcggcaaaatcatcaccgcccccatcataaccgaggatggcgtgcctatcaaggaccctttgggtttacttgaagccgccactccaggcccaagcaagctagtcgattacccnccaaanatggagatgacgccgacaacgcctgacgggtaaaagatatcaaatgggaacttacgctgcacaaatcgnctggatttctcgcactgacgctccatggcttctacgagaagaaagaaatctatcaagtt

SEQ ID NO: 7687 - DNA, 665 bp, Triticum aestivum
  unsure (1)..(665): unsure at all n locations
  Clone ID: PAT_TA_7687
tgcaggnaattcggcacgaggcgagggagcaggtcatccgcgagctcaagnaagattgtgacggattgggccaagacggttgcctgtgaggagagggttcccccaaggcgggtgacggctacggtcctcacctatggttcttacacgttaggggctcacggacctgaatctgacatcgatgcactatgtgttggtccctgtatcgcaaacttgccgcagcacttttttgttgttctgcgacaaattctcaagtgcaggccggaagtatcaggactgcagactgtggaaaatgccaaggttccattgatgcgatttagattcagcgggatttctgttgatctgacatacgcccagctcccagtccttgatgcagttcaggctataaatacatctagtcctcagtatcttcggagacttgattcacggagttggaagagtttgtctggagttcgtgttaatgagcagattgtgcagctagtgccgaatcaagagaaattccaagttctgttgcgatgcataaaactatgggctaggaggcgtggacttcattgccatttgcttggtttctttgctgggattcatttggcgattcttgcagcatatgtttgtcagaaatttccaaatgccactgccaatggtctgttcaccatgttctttgagatatt

SEQ ID NO: 7688 - DNA, 549 bp, Triticum aestivum
  Clone ID: PAT_TA_7688
gtcgagattggtctcaaagtttcataagcgcatacgtcaagccaaacccgcaccacctcaaaattgtcagcaatgaggaccggtatcctcatcatcatcatttttgccactattgtcgtggcttacccctttgcaacgtctgccgaggaagagtggtatcctataggggaccccgacaatgaaccacatgtccaggagcttggtggctgggcagtggcggagcacgtcaaacaggcacacgacgggctcaaattcatcaacgtggtgagcggtgcggaggcaaatgccgctggtgtgaaatatcgcctcgacatcaaagcattgaagaacaacggccaacccggtgcatacagagcgattttactcgaggaggtcagggacaacgagcgcaccctcatctccttcgaacccacgaactaagtggcaaccaactaggttcatagtactttgatgtaataaacatgtaccaatgagaacaaataatttgtgtaagcggtgtggaaaacataattgaattttatataataagtgtttggcctaaaaaaaaaa

SEQ ID NO: 7689 - DNA, 1049 bp, Triticum aestivum
  unsure (1)..(1049): unsure at all n locations
  Clone ID: PAT_TA_7689
gagtccggatntagaatcgctccagcaaagcaattactgtggacttgccacttccactctctccgacaagtgcagtagtctgcacataataatcangttttaacacgttcagtacaaccataggcagaaatataagtgcaaagaaacaactgaaaaaagggtgtgcccagtgctgaaagctcccacacaagttgggggtctggggaagggaatttctagacagccttacccttgcataatatttctgcaaggaggctggctcgaacccaggacctccaggtcacacaatattctaccattgtgccaggccagcccttccaaggggcgaaataactgacaaagaaaaatcttaatgcatagcaactttatctcctttcttgactttcctgttttctaacttcatctcattgcttattttactttttcttgtgaacatggtgcttaaacttgaacatttgtacagtgctacatgaaattggtgtcacctctctagaattatgtgaaactcataggtggacattctaacacatggagtacactaacaaagtttttgcagcacttgatgttcttcatgtcattgatgttaaaataaagcagttcaaggttgctacaacccttttgcgaaacacatagcaggataatacgtggatgtgtgctgctgcatggtctagtcttcatgccagacagtaaactagggcatcttggaccagtacagtgtccgcagacattctggaaattgcttccccagttgtcatctccacatcaaagaatgaaacatcctgttttagaacagcttcaaggtatagagatcggatgcgtattgactgcctttctccagtcattgtccagcatgacacctctgccacaggtagcaagcaggttaatgtttaaggctgtcagccactccatggcaaattctgttgcgtgtgaatgcaatccaactaaaagcagagattatgcaactcattcgtactgctcggtattttggttcaagttaaattngaaaactactgctagttgtaagttttaaatttcaattgggtagattt

SEQ ID NO: 7690 - DNA, 1249 bp, Triticum aestivum
  Clone ID: PAT_TA_7690
catctcttgaagagagcaaaacttcagaggcacacagtgatgcaataaaccatctcaggaatatccctggaaacgacagttgtgcagaatgtcgttctccagatcctgactgggcatctctaaacttgggtattcttatttgcatcgagtgctcaggggctcacaggaatctgggagtccatatttcaaaggttcggtccttgagattggatgtgaaaatatgggagccagtaattattgatttgtttccgtgcacttgggaaatgattacaataattccatttgggaagctttgcttccgaaagaaggtcaaggaatggatgagtcaaatagcgctatcctgttcatgggaaaagcctaaacctactgatgctttctcaataaaggaaaggttcatacaatcaaagtacgtgggacaaactccttattgccaaagacgccaatcaaattaccattggtatactggaagctataaggacaaatgatgtgagagcagtgtttcgcatccttgtgttggctgatgcaagccctaacatgacatacgatgagttgaacaacgacgttaatcatgttctaccagtaacagacaggaaattatttgatccagcctcttgtgagaaaatagaggattccgggagaccggaaggttgtctgcaaggctgctccttattgcacttggcatgtcaacatggtcatcctgtactagtggagcttctgctacttatgggcgcggatattaataagcgggatttccatggacggacaccattgcaccattgtgtccaaaagagtaatgatgcccttaccaagcatctactgaagaggggtgcaagaacaacaattaaagatggcgggggcctggctgctttggagagaagaatggagcttggagcaataacagatgaagacttgttcatattatttgtgaggtgattgtggaacaatactcctaggttgtgccgctgtagccgtagcaagcaaagctcgtctgtatctgaaggaggcgtcgtgccacctgttttagcatcttctacacttttacatcggaagacaagacaaaacacttactggagattattgtatctgacctttgcactgcgtcgctcctttgtattacaactataggctagtagtttgtatgatttcccttttgtgaagcatatcatactatactatatatacatttgggcaatgtaagcctgttttatcttgcggcatcgtgctgatttgcaaaaaaaaaaaaaaaaaa

SEQ ID NO: 7691 - DNA, 500 bp, Triticum aestivum
  Clone ID: PAT_TA_7691
gcaaacgcaagtcaaagaacttcaaagacgagcttgctctgacgctgaaggacgtcgaatcactgtttcctgtggcaacacccgatcaacctccagaggagggcgataaggatcacggtgatagcttgaggagtttacccccgtcagtcgctgctgggttggctgctgaaatgagggctatcaatggagcaacatgattaaccaccatgacgtaactgaggcagtcttggtctaactggaaattccagtgctcgtccgaatctccaggttacaggaggcggcactaaattttagataaatgtagacggtacggtggtgaagttctggcatcaccgattgaatggcgtagagcactggcgccggtgtggccgtttagggagacggtgaacttgtaattctttgtcacgtgtcgcgagccatctcatttcctatctttgtgatggtgattctgccatacaagttgtgtcaggtgtgtgatgttcacggacgtaaaaaaaaaa

SEQ ID NO: 7692 - DNA, 911 bp, Triticum aestivum
  Clone ID: PAT_TA_7692
ctgttacagtctcagattcagaaggctatctatttgatggagacgggtttgattatgtgaaatatacacttataaggaatattaaggcacaacaaaggagcctcaaggaatacttgaaaacatttccacgtgccaaatatatcaatgatgctaagccatggggtgagcggtgtgatattgcattcccttgtgcatcacaaaatgaaattgaccagggggaggctctttcaataattagctctggttgccgtgttcttatagaatgttcaaacatgccatgcactggtcaagcagttgatatcctaagaaaggcaaaagtccatgttgctccagcaaaggcaactgctgctggtagcagtcggtgaacttgaactgaatccagagttcagcttaatgcagtggtcagtagaggatttcgagaacaaaatacaggaagcagtaaagcaaacatatgacaggtcgatgaaagctgctcaagaatatggaatcctgaaagagaacccagagtctttggtgcatggtgcaaacatatcggccttcctgaacattgcacaagccatgactgatcaaggatgtgtgtagttaagcgtttttgttctgtcaagaagcagaatttgacatccctgcgggctgcagccatgatctctggttgtactgtggttgctgcagccattcgacgtttattcgtagcctccctcacagatcactgttttacgtttattggtagcctccctcacagatcaattttatgtttaggccttgtcaaagctttcctctggtatgaaggaaaagcttagatctatttagagtatagaagtgtttcctgttgtagatcccccatgtatttattcattactgccaacatcaatgcttgaagaaggaaatgttccttttttgtgtgaaaaaaaaaa

SEQ ID NO: 7693 - DNA, 637 bp, Triticum aestivum
  Clone ID: PAT_TA_7693
gctcctctcccccacatcgccgccggcggccggaggcggtacacacttgtgctggcgtggccgcggctccacgaggtcgtgctcgaccccgctggcgctgagcccttcacgcgcgcccatgccagcatccccgcctacgcctactacaaccaggaccgggaggcgaacgaggtgatgctacgggccatgaccagcgtgtcggagccgttcatggatgtgctgttggacgggtactgccccggcggagggttcgagggcgtggccacgctcgtcgacgtcggcggcagctccggcgcctgcctcgccatgttcatgcgcagggtgcccaccatccgccagggagtcaacttcgacctgccggacgtcgtcgccgccgcgcctcccatcactgaaccaaacaatgaaaaaatttcagcatggggactcgtaaataaaattggagggggtgaagactgaaggatcaatctccgatctctgaagactccgaaaaccttcttatctagcaaggttcaaagatctatttgaaatttatctgtgatggtatgatctgagaatagatgcctgaactctttggagtttgtacatatgcagcaaaaaataatctttaatacatcatgtttcttagacaaaaaaaaaa

SEQ ID NO: 7694 - DNA, 213 bp, Triticum aestivum
  Clone ID: PAT_TA_7694
gtgacaatgggaaacaatgttgtatcgtagtcaaatctctttaagttgccggttgattgttctctaggaagtatagtattgttcacgtgtcttggttgctttcgggtgaaggtgttgaatttacccatgctggcattttttacatgctatatgtagccaattttctgtaacgatgactaagtgaacagcgtgaaattttgactaaaaaaaaaa

SEQ ID NO: 7695 - DNA, 762 bp, Triticum aestivum
  unsure (1)..(762): unsure at all n locations
  Clone ID: PAT_TA_7695
ggccctcctcgcctacggcttcttccaccgcggcctcatccccggcctttgcttcggcgcgggcctcgggattacgcttttcgggatggcatacatgttcgtccacgacggcctggtccaccgccggttccccgtcggccccatcgcggacgtgccctacttccggcgagtggctgccgctcacaagatacaccacatggacaagttcgagggcgtaccgtatgggcttttcctgggacccaaggagctggaggacgttggtggcctcgacgagctggagcaggagctcgccaggatcaaccggactcggagcatctgaaggactctggacatggtggcatacgcagctagaagagccttgtgatctcatctagcagatgaactacatttcaagattttttttaaactttttggtggttgctattgatttaattgatggtactggagctggggagtccagagctaatgatcaggcagtggtggtggtgtactccccgttactcggctgcaaggggcgtggatgtgtccaaacagttctaggaagaagcacagatggttcaagaggttgtgccatgattttttttttcctgccttcgaggtctcaccgcgtccacatttttgttttgtggagacccaactccatgtcttgttcttatatatggctagaaactacgcttnctgtgtataacaagtagagaaggttggaaccacttcaatgaaagtaaaagttggcggttggcaagaaaaaaaaaaaaaaaaaaa

SEQ ID NO: 7696 - DNA, 631 bp, Triticum aestivum
  Clone ID: PAT_TA_7696
ccgcaggctcctcggcctcactaacaaaccaaatttttcatcatcacaaagtttatacgccctaaacctcactagcaaaccaaaattttcatcatcgcaaagtttatacgccatgaggacaaccagtttcctactcattgttgttgttgtgatcgtgtatgccatcggtgtaccagccacgggctgtggtgaatcgatgggaacccgattgtggaacacgacaggagctaatggatgggaaccaatcaagaacataaatgacaaacacatccaggagcttggcaattgggcggtgttggaattcagcaagcgtgtgaactgcctggtcaagttcaacaaggtggtgagtggcagacaacaactcatgtctggcatgaactatgagctcatcattgatgtggcacactttgaggggaaagatggaaaatacaaggcagagttgcatgagcaggagttgaccaagaaacgccaacttctctccttcatgaaggtgaactaagcgggaggaggaaactttgttaacaataattgtgttcttggaattatgttagctcaattgtttgtccaataataaattatcatctcgcattgccatgtgtttttaaggatcacacatctacaacttgattat

SEQ ID NO: 7697 - DNA, 1143 bp, Triticum aestivum
  Clone ID: PAT_TA_7697
ctgtgcggcgctcgagccgaattcggcacgagcggcacgagcttcctccgctgctgtgctaggctagggtttatcttcggatttacgagcaaaatcctcgggcaatggcgtcggtgcagctctgcggtgccgcggccgtcggcgcggcggggtttgccgggaagggggcggctgccgtcgagcctcggcgcgtcgccgcgccggcggcccggcggggggcgctccgcgggctcgtcgccagggccgccaccgtcgtcgcccccaagtacacgacggtcaagcccttggccgacagagtgcttctgaagaccaagactgccgagcagaagacgaccggtgggattctgctcccttcaactgcgcagtctaaacctcagagtggtgaggtggttgctgttggagagggaagaaccattggggatagcaaagtggaagtcggcattaaggttggggctcaggttgtatattcgaagtatgctggaatggaggtggagttgaatgattccaaccatctgatcctaaaagaggacgatatcataggtattctggagacagaggatgtgaaagacatgaagcctcttagcgaccgtgttcttatcaaggtagctgtagctgaagataaaactgccgggggcctgctgctgactaacagtgtccaggagaagccatctgttggaacggtggtcgctgtcggcccgggccatctggacgaggaaggcaagaggatcccgttgccggtatccacaggcagttccgttctgtactccaagtatgctggcgccgagttcaagggtgccgatggcacaaactacatcgtgttgagggtatctgacctgatggctatcctctcttgagctggtttgtagcgcaaggcgtggttttcctgatctaattgttccaaaggcaacttaaactagatgaagagaaatgagaatccccttccatgtttgtggctctgcaccaaagctggttttcctcactgatatgtactcctgcattatactctttgtgccagccaccgtggttggtagtagactcctagcaatctgatcacgaatcgacggtccaagatcttataaattcaaataaaaaaggcaaaatattccaacccaaaaaaaaaaaaaaaaaaaaaaaaaaaaaaaa

SEQ ID NO: 7698 - DNA, 482 bp, Triticum aestivum
  unsure (1)..(482): unsure at all n locations
  Clone ID: PAT_TA_7698
nggcgaaattgggtacccgggccccccccctccataaacaagccagccatgtcctcggcaaagatatgcattgccaccaccattgtgctagtgttgctgcttcaagccaccgttgatgcgggctggacgatggggagtggtttttgtcaaagcgaccatggcttggtggattgccaagccatggcgactagtacgaggaagtatggcaacaggcaaacatggccgattgtgtggccggcgtggttcgcgaagtgcccagaaggaaaacgcttctggtgcaccctgagatggtgtacgtgtgtatctagcatgcgtgtacaatccatatacatataggaataagggccgtgtaggccagaataagcttgatgcatgttgtgtgtggcgatcacaagagtagtactgatgctactcagctctttgtaaggccagatcatgtataaatgaataagataattgtttcgaaacaaaaaaaggggggg

SEQ ID NO: 7699 - DNA, 673 bp, Triticum aestivum
  unsure (1)..(673): unsure at all n locations
  Clone ID: PAT_TA_7699
ggtcggcgacacgagncgcaccacctgcctcatcggcgggagaagctccacattccccgacgggagaccagctgcttcttcgctcgtgcgccaataaagatggaagttgggagtataaagaaaaggcatatcaagtgcttgaatgagtatggtcctgctgcttatcctaatgagcatagaaaaaaacaagggtattcaggatgatcctcttgaattgttctacaatctgatagagtcactcattgatgaacaaaagaacacaatcagaaaaatgggccttggttctttgttggaattaaagtgttctttttctcctattggaatataccattggcttgcattccattttgatacagtcacaagaacaattaatcttgaaaacagtttcttattcaacatcacacccaatactatccagattgtgttaggaataccaatgggcaagaaaattcttgacaagaattgttctacagaaaattacattttggttcatgatatcataaagtgggaaggaaattctccatctgtgaaagacttgtgttcaatgataaaaccagacatgcaaattgatatgtttacaaagacattctttcttcttgcgatggcttcatttctgtgcccttcttcagatagcctagcaagctcacaatattacagtgttgcactgatgctg

SEQ ID NO: 7700 - DNA, 509 bp, Triticum aestivum
  Clone ID: PAT_TA_7700
gggtcctatcgaatgtgtgaagtcgcacgtcaaagaaggtggttatccatgaattccgcggaaaacaaagcgaaaacgaattcctcgagtttgttagcagtagtgcagagaagctgcggtctttgcttgttgtgattacccgagaaatgtttgcttcggcatgggatttctcaatttcattgccaaatgaggtgaatgaggtgattgtcaaagcaggggctctgacgcgtggagcatgggcctgcgaggactgtcaactggtggtggcgggtcctaaagtggtggatggttggagcttccgcagagcgtctgatccctctgtaaaggaccctttccgctgatgcacttgaagaagcagagcactccttcaggtaccatgagcagctgcaagtgttcatgttagctgaaactgatgtttgatttgacatgttatgcactgtgtgtgatcaacattgatctgtctttgatgctgatagaagtaaaagacatgcagttagttaaaaaaaaaa

SEQ ID NO: 7701 - DNA, 426 bp, Triticum aestivum
  unsure (1)..(426): unsure at all n locations
  Clone ID: PAT_TA_7701
gggaaagtctgttgattattgggatgtggtggccgtgccttgggatgatgatgtgctcctactggtcaaatttgatgactgtctgcttcaggttgacattcatggcaaattggttgccagtttctgtcgcagaggccttggtcctacaaatcttcggatcaagcaaactcttgttcaacatgccttctttccgacactagagggttatgttgtgaactctttgcctttcgtctgatagagtgggttgtggttctgaacgacccaactgtcagtactctcatgagctgcaatatgtatgccttgggtccactatgagccgattagtttcattttgatgtatgcaaaactatgatcaataagtcatgaccctgtcatggtttcataaaatttgtacttctgtgaatatccttttgggcaanaaaanaa

SEQ ID NO: 7702 - DNA, 450 bp, Triticum aestivum
  Clone ID: PAT_TA_7702
gcaagaattttcattttctctgtactctcatgcgtgctcacaaaggtcggacgatggctttgtgacaacaccttgtgcgttgaccttttgttctgccaaagatatgtacactgagatggtgttaagattgtgggtgaacggttaacggacaacacttgagaatctgcgaggggccatttggtgaacgaggcgatcactcctcttagctttacaccttttattcttgggatccctccctaaataaaaggaaaaacaatgttctaattaacccaaatgataagtgccacacgtgtggcacgaagcaaaatggtccaaacgccttcattactatccattttgccacatcaaatagatgacatcagtggaatctttttggtttttcggacttggaaatgttttttctcttaaataaaatgtgattaaaacccattttcatcattaaaaaaaaaa

SEQ ID NO: 7703 - DNA, 1049 bp, Triticum aestivum
  Clone ID: PAT_TA_7703
cccagctctacccttggcgctccgccagggggcaagcttgcaggagcccccacccgcgccgccggctgggtctttgtccgccatgtcctccgcccgcaggcccgggtcccaggccctggtccgcgcgcccgccacagccgctgccccaggccccggtaaggagtgcccacccgaggtcgggccggacttctccccccccaccacgcgccttggcccgcccccttgggcggtcattgccggacccccgccccggccccggcgccgtcggtctacatcgcgtccaggctctgcctgctcggaccgcgcgccatggtccgctttccctgaagagccgaaagctcaagcagctgtaaaatgtgcccgcccgaggtcggtccgaactttaagggcatcacaaagcaacaaagccggctcgcttaatcagtcaaaagcaaactctggtgccgacccctttgccttcggtcaagatagctttaaggctgtaccttctggcaccgtgccttctgagatgtcaaatttggggaatgcttctcagtccctcaacactctgaaggctgaagtggagaaagatgcaccctaccaaccagctggatggactgggttttaatgtgctatcgcctgtcaggctattgggtctctgatgcctctatccgcctgttgattgacagacttatggtccatcctctgtatcataatcatataaattgtgtggtgttgaaagggagcaaaatgagcccaacctaggagtgccagaattgacgtaggtacgttcgccaattattttgtataagtttctttggtactgaaatttagtgacatgtatgttggaacttgcaaatgtttcactgaaacctgtaagttgtcagataatagaaatactacagtagaattttcttcttcttttgttaaagttttttggtgttacatctataatattcatataactaaatctggacacatgtgacatggtataggatgtagcactatcaatgtttggacacagcatgtacacataccaaggtaatacattgttatctttcgagactttt

SEQ ID NO: 7704 - DNA, 1437 bp, Triticum aestivum
  unsure (1)..(1437): unsure at all n locations
  Clone ID: PAT_TA_7704
gttattgcaaagcatgatcagattgtgtctggaatagactggagtagatcttccaacaaaattgtgactgtttgacatgatagaaattgatatgtttggacacacgaaggacaagattgggtacctacgcttgttattttcaagctaaaccgcgcagctctatgtgtacagtggagtccaaaagaaaataagttcgcccacggaagtggtgctaagtctgtatccatttgctactacgaacaagagaacaactggtggattagcaaggttattaggaagaagcatgaatcttctgttactagtgtcgcgtggcatccaaacaatatacatcttgcaacaacttctactgatggtaaatgcagagtgttctccactatcatcaagggtgtagatacaaggggttccttctcatcatttttgaaggattaaccttgccattaatacagccagtacacattccaaatgctttagctgtctcatactttctctctttctgattaggggaccacaagcaggtgcctcagtggattggaaattcggagagcaaattgctcaacttgatctatcacctacatgggcatttggtgtaaggtggtcgccaagtggaaaaacattggcctatgcagggcacagttccatgatttatttcgttgatgacgttgaagggtctcctgctgcgcaaaatttggcactgcgtgatctgcctctccgtgatgtggattctttttgtttctgaaaagatggcgattggtgttggatttgactgcaatcctttgatctttgctgcagatgagactggactttggagttttgtcagatatttggatgaaaggaaagttactccatcaacttcaaaagcctcacagctcccagaggcccttgggaagttgtacggccaatcgaggcaagggtcgagcagcgacactgtcgaaccatcgaagcctcgaggcggcgctcacgagaactgcataacttgcatcgtgccgttgagaaaagggagcgagagtattgtcaaacggttcagcacatcagggctggacggcaagattgtggtatgggatctggaaaatcacatcaccattccaaaatagaccctcggcggatggcgggcgggccctgcgggttttggaagatccagggccagggcaaggtagattgcttattttttgttgtacctgtacacaaaaaccattcctttagccagctctttagcgtagggggccatcactactataagttggctttcatatttttggaaccagttccgtccttctctctgaatttcatcatctgtaacacctgtataatcctagttaggatgccataattccatacccccccccttctctcttctccgtgttcgattttcgctccatataaaaaaccccgggtggttcggaattcgcccgnaatgaatgaaaaaaaaaaaaaaaaaaa

SEQ ID NO: 7705 - DNA, 613 bp, Triticum aestivum
  unsure (1)..(613): unsure at all n locations
  Clone ID: PAT_TA_7705
gcgccggccaacttctgtcgatggaggaggatctggtgactgatctggacgatgactcatgggacttggtctggagggacctccgcctgaaggctaccttcttgtacattgatctgagccgtgtgatctcccgaagtgagaacgatgagcgcaggaaggcgctcacccttctcgccaacaaattcttctactgcacggatgagctatgcgatgcggtgacgagccgaagcgtccccgtcgtgaagatgtgctacaacgacaccgctcaggctctccgtgagttgctcgcggcccttgcgccgccgcagtagcatgttgggctcatgccatgtggtcctgtactacgatgcgatgctgtgaggctggatcaagcagacacagcatttgcatcttctggatagcaaggaaaggatggagtcgtgccagaaactcttgcagagggatgagtctttatgtaaggaacgtatgtgcctgaaactcacatgggcattttccagatgagcaccggctagagcacctgtgtacaatacatgggccaaaatatcccccccggttgaagcagnaccaaggaggaaataatacctaacgtgtggttatctccaaaaaaaaaaaa

SEQ ID NO: 7706 - DNA, 832 bp, Triticum aestivum
  Clone ID: PAT_TA_7706
aagcattaccagcttctcttgagaagttcaatgggtcccattgattgctttttgataagtgaccatcagggggtatccgacccagagcaggtggcgcaagacaatttgggtcatgcatccacagctggaggttcagatgctccaaggccggtggatgatcatccaagtcaagctcccgaaaagggagagggcgacactgtcggcaagcatacatcggaaccatccagtacacatgaaccgatgtctggcattctgaaaatcttactgccagatactgatgttgatgctgattactggctcgcatctgacattgacgctaccatgactgaaacatgggccacttagacttggtccgccactacgtggcgaaatagcaatgactccacaatgcacattcgcattggcgaaggaaccggagcctggatcagtaggcccaccttcagcgggagtctttcattgggtaaccgcagattttccattccccccggcgcatgctctgttccggactttcggctgactggcaaagcagagagagtatactgtaggcagtagatgttgtacattggcaggatggttgtagctggtacatcctcctggtacatctatacatgggataggctcagcaactgagccatccattataccggccttccttagagggactgtgtgtgtgtataccaagataggaaggcaacacagtccagaggaaggccaacatccatcggtcggtgtgtgttgtgttgttatctggtcttctcccccattgaggagaggcatcggatgtataccctgactggcaacctagattgctggtagcttatcaataaaggtc

SEQ ID NO: 7707 - DNA, 861 bp, Triticum aestivum
  Clone ID: PAT_TA_7707
gcccgacacattttcctatatccaattatctccaccactcttgactttagtatatttgaaggcattctagctacccttgggacaatgggaacgctggaagcctccatcatcttcatgcttctttccatgatcgtctctgctcaagcaggcagctctggtagtggcaagcctaaggcaaccgacctcatggtggaagcatgcaagaacgcctcgattgactactacatcgcgacggtcccgcaagaattttgtttgttgactctccagtcagacaaacggagcaccaacgctaaggatctccatgatctggtattcattgccatcgacatcaccaaggctcgtgtcattgctgcgagcggcatggtgaagaaaatgttgcaaaatgccaaaaagggtacggtgacgatgcgcgtccttactttatgcgaggtggactatgaacaaatggcgagcatcctcaacatatgtgatgccatgatcaaggactaccaaggatacaagggcgagatgcggtcccatgagctggctggttgtgtggctgaggcgtacagcccggccgcctactgccaaaccgagcttaacgatgcgccaaaggaagtggcgctggtcaaggaaaatgctgagctgcaaatgctagtacacatgagcgctaacttcctagagccactcacattgccagaagagatgttattttgacattaaaatttgctcttatttgaaataatgagaataataataaaggtgatttattaaaaaaaaaaaaaaaaaaacttcgagggggggcccggaacccaaatttgcccctatatggatcggattacaaattaactcgggccggggttttacaaactccgggactgt

SEQ ID NO: 7708 - DNA, 966 bp, Triticum aestivum
  Clone ID: PAT_TA_7708
ctgcccccccgccgccggccgacggcccggcggcgctcccgcccccgccggggacggacatgacggggatctgcttccgcgaccagctgtggctcaacacctacccgctggaccgcaacctcgtcttcgactacttcgccctctcccccttctacgacatcacctgcaacaacgagtccctccgctcgcgccaaatccaccccctcgacatgtcccagctcacgaagatgaccgggttggagtacgtgctgagcgaagtgatggagccgcacctgttcgtgatgcgcaagcagaagaggacgaactccgagaagtctgaccccctgctcgcctactacatcctcgacggttccatctaccaggcgccgctgcttggcagcgttttcgcctcccgcataagtagggctatgcatcacatatcaaaagcattttcaacggcatgctcaaaattggagaagattggtaatgcggaaacagaggctgatgcggcagcttctgaatcaaaggcccagaaggaaacaattgacttgaaggagttgaaacgagtggatcacatcctcatgtctttgcaacggaagctgcctcctgctcctccccctccaccctttccggatggttatgtcccatcagaacaagagaaagggccagatgatctgttggcctcggagccattgcctcctgcaattgaccccatcattgatcaagggccagcaaaaagaccaagatttcaatgagattgtgccgtcaatcaagtaaaattagcaagatttcaatgagattgtgccatcaatcaagtaaaattactggcacgctaatggcatgttgtattgcaaatgataagtagagatttgtaattccctgagctgggaaggtgcagaccattttcctgaatgtacacttggacttgatcctttatagctatgtaaggccagtttggctcgtcccgaaaaaaaaaaaaaaaaaaaa

SEQ ID NO: 7709 - DNA, 981 bp, Triticum aestivum
  Clone ID: PAT_TA_7709
ccggacgcgtggccggtggaatgactcggcaaccatggcgcctgcagccttgtccgcccccgtccttcgcgtctctccacagtcggctggaagggccgccgccgccgcgcccgccggcggtctccgcttcggccagacggcttgcctgcactccggccattctggccaaaccgtgctgcgatcgaaggtgctgctgcagaggcccgtggggcagaggaggcgctcggcgctgagaagcagcgtggatgactccaaagccacggatgacaaggtggagttcgggtactcgaggaaagacgtgctgctgatcggcgtcggcgtcaccctcctcggctacggcctcaagtccggcctcgagttcgtcggcgtggaccccctgcaagccggcaacgtggtccagctgttcatcgtgctcgggatgacggtggggtggatctcctcctacatgatccgggtggccaacaaggacatgacctacgccacgcagctcaggaactacgagaagcaagtcatggagaaacggctggagagcctgtcggaggcggagctgcaggtgctgctggagcaggtggaggaggagaaggaacgcctgccgccgatgaggagggatcagggaatcaccatcaacaggaagacggaggatcagaccactgccaactaatagctcctagaagacctcgatcatgatactagcccagtacattgttaggatagcttgcatcgattgattatggcttttcctttgttataagaatctgtagcacaatactagtagtgctcttagcagcaacactgagttatactccgaagaatagttaccaagattcacatggatagaagccatacataaattatctacggaggaacggcacaataaaagtcaggcattgtctaacctatggtttggatacttggatatttaggacgacaatgatatctccggtccatcagggttcaaatcctaaaaaaaaaaaaaaaaaa

SEQ ID NO: 7710 - DNA, 1031 bp, Triticum aestivum
  unsure (1)..(1031): unsure at all n locations
  Clone ID: PAT_TA_7710
tgcaggnaattcggcacgagggttcggcggcggcctgagncctgccagcgagcgcccactgggagcaggtcccagcggcgctgccggtgatcatcttcacgctggtctaccacgacatcgcgccagtgatctgcgcatacctggagggggacctggcgaggatccggctcgcgatcctcgtcgggagcctggtgccgctcgtctccctgctcgtgtgggacgacgtcgcgctcaccctcgccgcctcctccacggaccccaacagcctcggcatcctcgacaagctggagacagagtggagctacgcggtggtcgagaccttctcgctcctggctgtcgggacctctctcatcgggaccctgcttgcagcgtcgcagttcttcatcgagcagatgaccaatctagccccctctgcaaagatcgacgaggccgcttctgaggaagaaggatctacccagcttggctggccaacattgctggaaagcaacaggctcagcttcgttgccacaggggcggtggtcgtcccaaccatgctcatagcagctgccgtcccagattcattctctatagccactgacatcgccgggggctactgcatgaccatcttgtacggccttctccccccattgatggcctggtctattgtctccaaattatccgatcagaaagctgggcttggacaggtagaagcagcgtccacggctggcaaagaaagagtgagcttcaccggtgcaactgcaaagcctgtgctggtggggatgggggtgttctccgtgctcatggtcttccagcaaatcttgcaagaccttgtcagttttaacacttatctcctgtcatgggctagctagagtaggaagaagtagcgagcgctgaataagtcgagattctttctagccatggtttgctgattcgggagacaggctcgtgagattccgcaggtgcggccatcggtggctgcctgcataccctctcttttttttcagcagaaaccggagaagccagtgctgaataagttgagtggagctgctccc

SEQ ID NO: 7711 - DNA, 223 bp, Triticum aestivum
  unsure (1)..(223): unsure at all n locations
  Clone ID: PAT_TA_7711
ggccagcgcctgatgccaccgccgccgccgatgccctgtcccctgtacatatctactccgtagcagtactagtcgtacgggcacgttcgatcgagctcggtgttctgtaaatatctacccgtgtgcgtgttttcccggcaataatggcgctnctcgtgtcccggcgtccctggacgcgaggaaggagaagatggtgaatgtggctgtggctgcaaaaaaaaaa

SEQ ID NO: 7712 - DNA, 673 bp, Triticum aestivum
  Clone ID: PAT_TA_7712
ggacgagcacgcggccgagaccaaggccgggggcaggtggaggaaccagcgagtttcatctggatcaccttcttcaatgtattccgcattgaaaaaggatgcggcgcacatacaataccgctacggtggatcctctcgtgccacctcgctcaatacagtgcctgatcctctactctcctcctttgttggtagcttcattgatgatgatgcagattcgcgaaaagatgcacaagaagagttattggaaaaagttattgagaaaagtgatgcctcggagcagaaagcagaagaaagtgctgaggagcctttgctccctgaggagaaggaggagagaaccaagaggagccagttcgtgcaggggctggtgctgtccctgatgtttgatgacatcttgtgaagaatgtcttgttccgaaaattgattgagaaggcagctcttgcttcaccagaaagttgtataccttagcgcgagttgctgcctttcacccagttgccattaaaaacagatggcagctttgttgtgcgatgttaagaaggatgaatgttgtgaatatggatgttggttagtatgcgcgtcggtcggtgtcgcatgaacaataagatagtatatataggtctggtaatttgatgagatgttgtcggggggctcccgcgggcggccctggttgtatgta

SEQ ID NO: 7713 - DNA, 607 bp, Triticum aestivum
  Clone ID: PAT_TA_7713
gcacaagcagcaatggcgagcaccgtagcaaccgtagcaatggctcttgtcatgctcgccgccgtgtcctctgacatccttcccgtcgttgacgcccacaccggcctcatctccaggacgtgcaagaagaccaagacccccgcgatctgcgtggccatgctgagagccgaccgaaggaccgacggcgccatgaacctgtacggcctcgccagcaacgcgctgctgatcgcaatcgacactgtctacaacaacactagggcaatcgtcgacttgttcaagggcaaagagggcacaccggaggggggagcgctggatgtttgcaaccaggcctatctcgaagccgacaacgaccttgagctccaagcgcgccttgccctcgactttttggactatgccggcgcgtccaaggtcatcttgctcgcgaaggacgctggtgatatgtgtgaggacgcgttcaaggcgatcaacaagaagtcccccctgaccgacatggatcgccagatgacggagcgctgtggtgtcacggccgacctcatggatctgcttgcctccaagcgatcggaataattctcggcttgtttttctatgcatgttgctgtcaataaat

SEQ ID NO: 7714 - DNA, 683 bp, Triticum aestivum
  Clone ID: PAT_TA_7714
gtggatttgtactaggatgagcagtacagtggaggggattgtgtggcagtccaaggaagtctctaggagaatgcagttttctgggtccagctttttaaccctggactttccgtggaaggatacgtacatctgccttattcgataaccaaaactggatgctctaccaagcacctgtccagccctgtgtgagctacacttcaatttgtattctcagcaaaccaaaagaaatgatgctgacattccggtcagatgaagtgatttgttcaagccacaacaataaagagaagatggaatatgtggtgagctatctcaaaaaagtccgaagccattcatctttgggaccaagctgtatgcacgtagctgggctctccatgggcagcatggcgctggtgaacaccaacaaagcctttgacgctctcctaaattatgagaactgttccttcagatgcatgccaaaacatcttcgtctcactattcactccctggagacatcgtcattaatctgtattgtcacctatagcttgtatggcaaacttcatgttcataatgtttttgtgccatgtgtgatgcgctcagcagttggttatattcccttgtggattattgtttcctataaagagtggatcatccatctaaactactatacaagtatcaatgcagatgacccttaattaaaaaaaaaa

SEQ ID NO: 7715 - DNA, 1298 bp, Triticum aestivum
  Clone ID: PAT_TA_7715
accggtccggaatttccgggtcgacccacgcgtccgcccacgtttccgcgacctcgatcaaagccgccgccgccgccccccaccgccgccgccaccatggggaggcgatccggaggcaggaagctgcccttcttctccgccgcctccacctcgccctccaccaagcgcacccgctccgcgcgccgcctcccttccctgcccaagcccagctcgccgcctcccccctccccgaccactccgccccccgcgccgcagaccaccacgtctccgcctgccccctctcccgggggtagtgccgccgtggccggcgtgtccggcaaggtcggcaagaagaaggccggcgcccgcttgtggatgcggctggaccggtggggctcctctgagatcctggagctcgacaaggcctccatcatccgccgcgcgggcgtgcccccgcgcgacctccgcatcctcggccctgtcttctcccactcctcaagcatcctcgctagagagaaggcgatggtcatcaacctagaattcatcagggcgattgttactgcggaggaggtcctcctattggaccctctgatgcaggaggtgctccctttcgtcgaccaattgaggcagcatctccctctgaggagcctggtgggtgggaatggtgaacacggcggtgatagcaatggggtcaagcaggatggttcgcccggggatcaggtgccctgtcttaatgaggccaccggggcagagcatgagttgccattcgagttccaggtgctggaggtcgggcttgaggccgtgtgctccacgttggactccagcgtggctgatcttgagaggcgcgctattcccgtgctcgatgagctcaccaagaatgtcagcactaagaacttggagcgtgtgcggagcctcaagagtgaccttacccgtttgcttgcccgcgttcagaaggtcagagatgagatagaacatcttctagatgataatgaagacatggcacatctttatcttacaaggaagcaagcacagaatcagcaggttgaggctataatgacgtctgctgcttccaatagcattgttcccgcaggagcaagtttgccgaggctgaactccagttttcggcgcagtgtgagcattgctaccagtatatatttggataacgatgtggaagacctagagatgttgcttgaggcctacttcatgcagctggatggaattcgcaacagaattttatcggtccgagagtatattgatgacacagaagactacgtcaacattcaactcgacaaccagcgaaatgaactgatccaacttca

SEQ ID NO: 7716 - DNA, 611 bp, Triticum aestivum
  Clone ID: PAT_TA_7716
tagcgtggtcgcggccgaggttcgggagcgcggcgcccacggcgtcgtgctgcatcaagatgaaggagcagcagccgtgcatgtgccagggtcaatcatgtttgcacctaccgcgcagctggtcgcgaaccggatgcagacgcatatggccgattgatagggacccaagctcgacatggataatgtgacatttggacgcatgattccggccacggtttcgcaggcaccaagcaaggactttgctgaatcatattgtgctcatttgatttttttttcgagtcgctgttgctgtgccgcaccgtggccttgtctctccattgtttttcttcttcttttttttccgagaatgggatctccattgttcgttatctgtggtgtaattgcttagatacctaggacttaggatagaatgcagattgcagagatatgtgtgtagagggtattaacagcgtacttaagtcgggttcagagatttgaaaaagttctgatgttgtagaaaccacaggggaaccaatctgtatatgttatattgaatgttgtggtattgttaccacagttggtcatggtgtgtctaaagaaacgaaaaacttaatttgctaacaaaaaaaaaa

SEQ ID NO: 7717 - DNA, 2011 bp, Triticum aestivum
  unsure (1)..(2011): unsure at all n locations
  Clone ID: PAT_TA_7717
cgcccgcccatcccgccgctactcaaacagtgagtgagtagctgctccagctctagtacgtactcaacctcactcaccggcgtgcacccatcgaccagctagcacttaacccgcactgtccaccatctcttgctccgctatcccctccctctccgcccccgccctcctatcgcgcaacgcccgccccctcccgggcagcccctgccgcccgccggagcgtgccgccagccgcccgcctgcccctcccgcaggcgcctgccctccggcacccccggggcgtacaccacctctcggccgccacccccctcgtctcatctcacgtcggcggtgtcggccgacgaagccgcaccgatcgagcaggagaacgcggcctccttcgtcggcgacccggagcgcggcaccctggcggaggagtccggccgctccgacggcgggctgacgtcgcggtggcgggagatgcactgctgcaacgactgcgacggcctgctggaccccatcgacaggacgctccgcggggagctcatccgctacggcgagttctcgcaggcctgttacgactccttcgactacgaccgctactcccgctacgccggcacctgcaagtacgcccaggactccttcttcaaggacgtcggcctcgccggcgtcggctacgacgtcacccgctacctctacgccacctcgcacgcccgcttccccagcttcggcgtccagaagcacaaccccagcgatgaccggatgtggagcgagaccggtaccttcatcggcttcatcgccgtgtccacggacgaagagacggcgcgcatcggccgccgggacatcgccgtcgcctggcgaggcaccggtccccaaagctcgagtggatcgccgacataaccgcgttcctcaagcccatcggccagtttgggctgccgtgccctgacccgagcgtgaaggtggaggagggcttcgcggagctctacaccagcaagaaccccgactgcaagtactgcaagtactcggcgcgggagcaggtgctcgccgaggtgcggaagctggtggagcggtacaccgggcagggcgaggaggtgagcgtcaccgtcaccggccacagcctcggcgccgcgcttgccgtgctctgcgcctacgacatcgccgagacgcgcgccaacgtgtctaccggaggtgccaaggccccggtctgcgtcttctcctactcgggcccgcgcggtggggaaccccatgttcagggagcggttcgagggcgagctgggcgtgaaggcgctgcgcatcctgaacgtgcacgactcggtgcccaaggtgcccggcatcttcaccgaagccgtcctccccatgccgctgctgcgcgtcgccggcgcgctcggcctgcccagcgtctactcccacatcggcgtggagctggcgctcgaccacaagctctcgccgttcctcaaggacgtcttcgacctcgcgtgctaccacaacctagaggcgcacctccaccttctcgacggctaccagggccgcggcaaggagttcaagctcgggggcagggatcccgcgctcgtcaacaaggccgccgacttcctcatggacgagcacatggtgcccgacgggtggcgccaggagttgaacaagggcatggtcaggaccgaggacgggcggtggatgctgccgcatcgccccaggaatgttgaggaacacccggaagacaccgatctccacctcgccgagctcggccttgccgccgccgtcaccgccaaggccaccgctgccgccaccgccaacgtctgactgatcgttccatcatgggctgggccggacatgcacgtgtccattcatcatcactatattgcattgcaagtatatatatagttgcgatgaatacactagttagttacgatcgagttaccctactatatcttagaaaatggagtagccttaatggaattttcgcgcggctcaccatcttattgatncttatggtgaattattattgtattgtatgacaaaaaantaagacaaagggcag

SEQ ID NO: 7718 - DNA, 242 bp, Triticum aestivum
  Clone ID: PAT_TA_7718
ggctttcctatcctggaaagggggacagaaacttactatatttggagggctgccaggtaacgctagggagcacccggctgctccctagacgcgtccttcctttgtgtgtgggcaaggtgctgctctacaacattttcgcatcattatcatgttttgtaaaggtgttgacatggtggactgcttttcatgcccggccctcagagcatcttcaatagataatgtaaaatacatcaaaaaaaaaa

SEQ ID NO: 7719 - DNA, 2325 bp, Triticum aestivum
  Clone ID: PAT_TA_7719
ccgcgcgtcccctgatgacctggacccccagctttggggtgaccgcagcgggcctgtccctcccggcccgggaccgcgccgcccccctggggcggcggctcccccacttgttcctaacggccggagcgcgcgcgggggcggtcaagcccccccggctcggccatctccttctgtttccagccgttcgccgcctgttcctgacgctgtgcctcccggggtggcgcagcctcctggacgctctggtggcctggtgcctaggcttaatcttccccttcgtcaggcaccagcctatgtgcagccatcaggtcatcagtatacaagagataatcgcggaaggccacgaccgtgtgcaggggcctatgaagagaagtttggagcaagaacacctgcgcatattgaagaaatacggagagatgttgttctcaaatatactgaaggtttgtgttgggtcatgcactgctattatgatggggtctcctcctggcgaccgcctgacccggaccgctacgcgcctctcccctccgttgtttctagccttggccttcctgtcactccttttgagctcgggcctccactcaaaccaggcgtaggaattgtacacagcatttgcaaagtctggtgatcttcaagcttcttagagcgtcggctattgatgaccgaggcggatgcgccgtttactgtattttatccccatgtctccgaggtactggtgtaggcacagccgttttcctggctcgggtgagctccactgcccctcgtcggcggcgcaagctgccgcactgattgtaaggggcgtgtgcttcccttgccgcctgttgcagcccgccggatctgggtggcggacttctggcttttcgtgaatggcgcgctacccatttcgccttatatctactcgctcagcagcaaatttggacatctacctgagatcgagcgaaatgaaattaaagaagatctcaatcccgtagctagtggaggaatgaatggttacatctcactttgtggtggggatccgtgcccgcctgtcttcaggtctcctgtggatgggctggaggatatcatggacaatcaagtgatatgctcaatttacaagcttccagaccctcataagcacatagcacgtccacctcctggtgttatcatacccctgaagattgttgaagctggtgacctgaaaccaccgcctgtgctgtggcatgaagacaatggcaggaggccttatgacaataacaggaagcattgtgataacagcagcaggcaaaaccctgcaggatcgatacggggccgccaactaggggaggctgcacaccgactagtggcaaacagcttgaatgtttgcggtggcggacaataccccccggctaggccatatcaaactataatgaatggtatgcattatccaaacggaatgccaccaaggatggagcagcctgctggacgttctggttggcatgttcctagtgataatctacccaatggtcaggcaccagcctatgcgcagcgatcaggtcatcagtatacaagagataatcgtggaaggcaacaaccatatgcgagagacagccacagcgattcaagaggagcaggccggcatccatctggataccatcagaatagtagcaacgcatattcatcacatactgctcctccgtcatcgggttttggacgatatgggcaacccccctcgtatgctgggggctatgctggtggggtctaccagcctgcaccatatgcaggagcccaacagtggcagcagcaaccacctcatagttcctattctggaggtggggcgcctgctgctagacctaattcacgaccgcagcagtcacagaaccgctacagcaacttagataggacttcaaacaggagaccaccaggtcagggccgctactaggctcgcctcctctttggttctagccctggctttgctgtcactccttactagaacttaccttgacttaaatcaggcataggaatagacacagcatttgcaaagtctggtgatcttcaagcttcttgatcgtggtataaaaattacctagggggaagtgttgtatactataaattattgccatatcaccagatactggagtagacacatccaatttgcaaattctggtgatctccaatgctccaagacagcagcagaagcagcagcaaagattgtaaggggcgtgttgtacactagcatttattttcagaccaccagatgttggtggctgatttcggttttttcattttgggcgtgatacacaagttatctgctgttgggaggatgttaacaagtttttgtattgtaaagatgatgtatgtatctggattcattct

SEQ ID NO: 7720 - DNA, 2436 bp, Triticum aestivum
  Clone ID: PAT_TA_7720
gggagcgcacgcgtccggtataaaccggtctcaataaaatcaatccacacacagggcattcagccatcattcgatgaggtggagaagttcaagaaaccttgctattacattaatggggacatgtctagcttgaatactctggtttttaatagggaaaagggacactttatgaagggtgatgctgtcattgttgttaaaggcgatctaaaaaacttagagcgtgggcttggccgagccgcctctccctacccggccaccgtctgcatcacccgcgcccttctgcaccagtgctgctacggaccgtctgatcccacgccggccaccagtagggttttggcgatccgcctcacccctgcgccggccaccaccagattgcctccgccctacgcgctcaccggtgccgacgatggtgggatacgggattcagtcgatgctcaaggatgtgcacaagcatctctccgggcctcgacgaggccgtcctaatagaacatcggcgccgaccgcgagctctccgccttcacccggaacctcccttgtcgcgaacggaatgaataagatgggcattgatcatctagtgaagctcttggtcacgaagtgaatgctgcaacaatcgtcgaacgtgctttagagccagaagcctgctgctaaactcagggtgctcgtggcaagagcgcaaatggtggagatgcgggagatggagctaacctcaccatatcaatcgctaagtgatctgctcgagaaggttgagggagctccgcacggaaagaactggctgctaagcgagatcatgatttaggacaccaagcccattaacaaggcacagccaggcctgaaggggtcattccacaaagcaacggaataaatggatggagagaacagtgcggatgtactcttgattgctgtatatcctgctgtgggaattttcgtgcaggaagactttcagcttatgcaggttcaattcgagtaatggattttggatgctacggattaacgggtagtgttgaagtatgatatagctgatgttgcccatgctggttggaagtgtcctaaaggatactgttgtactcgtgtcggatggtacaagtatagcgatcttgtcattgagattaaaaaaagaaggagatagtgatggttgggagatttcctcggtgatcttgttgcttcttgcaacgtgagccgaaagggaactgatctttatatattctacggtagaagcttgaaagctatgcttagaagtggaggaagcaaaggtgcaggagcttatccaaatctgtggctgatacaggtgccaagtttatagtcagtcgtgcagcagttggcgatatggcattgcatttttgtgaacgttacaagctaatggttctgaaagtcagctcaaagtttgagcttcgaagattttgcacgtactactggggtgctatagcacttttgaagcttagccgtcccattggggacgaataagcatatgcagactctttttccgtggaagaaaccttctgtgatcgaaatactgttctctgaagcaacaccgatacatgatggattgcgactgtcgacgcgtaaggcagtacagatagtatattagatgatcttgaaagagctgtcgatgatggtgtaaacacgtacaagtcaatgtgcagggacagtcggattatccctggtgctgctgcaacagaaatagaactggcaaagagattgaaggagttttctctgaaggaaacagggttggatcagtatgctattgcaaaatttggtgaaagttttgaaatggttccaagaacattgtctgaaaatgccggacttggtgcaatggagataatatcttccctctatgctgagcatgctgctggcaatgtgaaagttggcattgacttggagaaaggtgcttgcgaggatgcctcaatcatgaaaatatgggacctctatgttacaaagtccttcgctctaaaatactcagcagatgctgtatgtactgttttacgggttgaccagatcattatggcaaagccagcaggagggccgcggcccccccaacaaggtggcattgatgaagactagttttctgtgcactcttgtttcctgtgtatcatgctgtgggattttcatgcagaaagacggtctctgtttcatcttatctaggttctaattcgagtaatagattttgtctgcttgggtttcatggttggtcggggcagcatgctttagctgatgtcttgcggtgtatttgcgagttcctctgtggtactgtcttaccggtgtatcacatgataactagagagatttgttcgtcgagtttatcatacgaaccaaagcttgtcttgaaagattttttttgttaaaattctattttgacatcaatagaaaagaaaaaaaacccatgagggaaatgtttgtccgcaaaaaaaaaaaaaaaaaaaaaaaaaaaaaaaaaaaaac

SEQ ID NO: 7721 - DNA, 550 bp, Triticum aestivum
  Clone ID: PAT_TA_7721
cagtgagggagagagcttcgtgcttgctgattgggcttggtcattggtgcggaggggaaagacgctggatgtgatccaggaaggaatggctgaacctggtcctactaaggtcatggagaagtatgtgcttgtcgcggcactctgcacacatccgcagctgcatgccaggccaacgatggagcaagtggtgaagatactagaagcagattcagcaccagggcctttaatcattccggacaggcctctccctgttgttgcaaacctggccgatattgagaggtcagtgagcagacagcaccggctcaggtcagctgttcagtccctctggcttccggtcttttattcatagagacgaggatgctacaccggaatctccaaaggaaacataacattttgtttcacagttgcaatttaatgtctatcatctttgttttgttagcttgattttatttcttggattacacattgcaggcagctgctgtagaggataacatgtatttttgctctcataggaaatatatgattctcgtgtgacagttcaaaaaaaaaa

SEQ ID NO: 7722 - DNA, 537 bp, Triticum aestivum
  Clone ID: PAT_TA_7722
tggcaatgatgtcgcatgtggagggatcggtatctcggggagaaatggtaggttttgtaatcgtggatgtgggttttttggaatgcacgcgacgtcttgcattcttatcatcccagctctagcacttggcgcctggaggtccgaccaggcggacaggaaagcacagtcgcagtcttgttgagacgaagctaagaagagaagatgtccggagaatgtggcaaggagctacagtgcccattcctgtgatggttgtgagtgatcccaatagacacaagttttcagaggaaaaagagtctttgcagacttgcttctttctactattagtagatcctaatcatcattagccatgaaacttttgtagacttgcttatttttgctattactagatcataactgtcaatcttcatgaagtttgttgggtcgttatgggtctggtgatgatgttaagtattggtgtaattattagttatcagtttaaataaaaaggaagaagatatgatttgctttaaaaaaaaaaaaaaaaaaaaaaaaaaaaaa

SEQ ID NO: 7723 - DNA, 722 bp, Triticum aestivum
  Clone ID: PAT_TA_7723
taccccgcacgtggggtgctccgcgaagctcccctcggtctcctctccttcgcgccgtcctctctcgctctccccgcggcgggggctgcactttgtttgcctgcgcgcgccgcgtcgatctcccggcccgtcttcgggtgtccgggccctgacatccgcggcgcgtgggaggctgcggccgcgtcctactcgacggcgctggggccgccggcttcaattgaggcattgaaggagtggatatcgttccccttagctcctgcagattgtggttgtcggaatcctggggttgttttccgtcctcgagcgccgggccgaaggcatcgtagcagtccccaagcgagcacgccgacgcatcatcttaatttatgacagtcgcaacccggcttcagtgtcgcattctttcacctgcaggtgcaaagggattagaagatgcttatgggacaactgtgaatgttgacgggaaatagctatttcaaaagtttgattaagaaagtcacagtaatcaaaagtcttaggtgggaaattctatgggctgagatgtccatggacactaatgggtaagatcctattggctgtggtctcctgggacactcatggccaggaccctacatgtgactgtcggatcgtcttgctcctgccatggtacgttggcgtgtcacatatcaataaaataaaaaaaacctatgtatattttggcatcaaatatcaaatttctatgtgtg

SEQ ID NO: 7724 - DNA, 650 bp, Triticum aestivum
  Clone ID: PAT_TA_7724
cccgcatccccgaccctcccatctccccctcctcccgcccgcaccccccaccatcgccgcaccccggcgggcactgccctaatcggatccaaccatgatatccgagacgcagtgcgccccgttccggcgatattccccaattacttactctcgttccagagcgcgatggcgagatctggcggcaagcgaggcgtgatggagcaccactgcctgaaccgattccgccgccggcgactcctcgccttcctccgccgcaacagccttcccgccaccttcgacgcgctgaagcacgagacgagcgtcttcttggacgtgcggttcctgcggcgcctggtggcgggcggccggtggcaggaggcgcgagagtacttgagccgcttcctgccgtgccaggacgaggtcgacgcgcccaccgcgctcagtttcctcactcgcctcaacgttctcgacgacctcgcccagggcaagctggagggcatcgatttggcccaagatctccggaaccaaatcgacgctatcccctccaccatgttccgcgaggacccgcactacgccgcggctccccgcacagtcttgttctggcgctctcacccggcaaactggtctccttcatctatcatctatctaattatccgttagtttcattcatt

SEQ ID NO: 7725 - DNA, 603 bp, Triticum aestivum
  Clone ID: PAT_TA_7725
gaagaaagccatgaaaagaaaagaaaaacaacgatcaaagttcaggtgaatctgatgtggtccgctaggggaagcacatgggagtttggtgcgcgccaagggggcaagagaaggaagggccgagagggttatggagttcgcccagcggatgagccaaggaggcgccgcgagaggtgagggaacgcatccatgaggaggagaagagaggtcggagcatccgctgggtggaggaggggaggggatcggtggcgtgatggtgagagcgagagaggaacatgggcggcatgaggtgccgcgcctccctgccgcggggagccgcccacaggctgagtaccgcgcccggagatcacacaaatccgcgtggaaggtacggcgaggcagaggagagaggcggcggcggcgcaagatatggatggaattcgtgggtctggttgaggaagatgacctcatggagaaactcaactcatttgtcaccggtgaaaatgaaccgacctgacaaaacggatccatgggacagaggggcaacaatgaaaaaatatatcggaggcctgagagctcgctatttcaagggagcttagtaacctctagtgatgaaaaaaaaaa

SEQ ID NO: 7726 - DNA, 454 bp, Triticum aestivum
  unsure (1)..(454): unsure at all n locations
  Clone ID: PAT_TA_7726
tcangcggccgggtacgttggcaccgacggggtgggcntggaccagagcggcggaagacgaagaagaagggatggggatggcggcgggctggcgntgggngcgncggcgggcgtgctgggcgggctggcgctggcgggcggggcgagctacgtggagcacaagatcgaggaccacgtgacggagcgcgtggaggaggacatgtaccgcggcggcggcggtgggtacgacgactacggcggcgacgacgactactagaccaaccatgggtccgtcgttccggtggccatgcatgaatgaatctttctttatgttttctgcgcgtgtatgatgtcgagggtgagggtgatccatcggaccggagagttgagaagaagagaggttattttcttgtgctgtctgtgcgtaccatcattaagatgaaattaagattgttcattgcataaaaaaaaaaaa

SEQ ID NO: 7727 - DNA, 663 bp, Triticum aestivum
  Clone ID: PAT_TA_7727
cggacttcgctcgccttaatgcacttgcagaaggtgaggtgttcccaccgatggtgctcggggtgacgaacttgtttttcctgaggagtcttaagagtgttccaaatgtggtgtccgtgggaagcccgaatccaaattctactagggtgctcccagcaggtgggcaatcaccagcatcaccaaatggatccaatgggacacctgtgaggctcaaactcgacaaacttgcaatcaataagttttcgcccactagtctattgaattcaatcaagttgagaagagaaggccctctttccctcatgacagagcataaagaggcgctatggagcacatatgtgccaactacaaagcctgacacctctgttctaaatagactcattgatgccggtgtgtcaccgagaattgaggagtccatgtcagtcgtcaacaatgagatattgaggcggcatttcttggagctaacgaccaacttcctttcgccttttgggccatatctgagaactacgacaccactggaagggagttctccattcgttgatccaccattacttccaccatttcacgcagatgagtttgtcaatggtttggcttctagaggtccagggaaatttttgtcgaaaaggatgaagtccaattggttggatttatatagaaaattcttgg

SEQ ID NO: 7728 - DNA, 752 bp, Triticum aestivum
  Clone ID: PAT_TA_7728
gccggctcctactgcttcgcctgcgccgccccatactccggccccgcccgctggcgccgcgacagcccgggccaggatgggcggccggcgcccggcgccgcccgcgccgtcgcggccggcaccgccatgcgggtgagcagcgccacctcaccggcccctgcgccccgtcggcgcccggtgggcgccccgccataacttctccggctgggccaagctcaatgggcccttctacaagggcggactacctcgcgttctatcacccggacaagaagttggacgtggtggaggtggacaaacgcgggttcgacctgtgcgacactcgaaaccctatccaccgctaccccggcggcggtactcgccgcggcactaccttcgtcctgctcagcgaggccaagttctactacttcacctgcagcgtccgctatttctgccctgccgggatgcgcctcgacatcccggtccaggaaaggcggcgcgacgacacgcccggcaccgccatggtggagagcagcgccacctcaccggtgcctggaccccgagggaactcggagggcgagagagacgggcagggacgaggacgaagcgaccgtggagtacaaggaacaaaatggccagacatggagtcccccaggcccggcccgtaaattaggcgtctcgttgagaagatactcatactcatatggaccaaagttcaaatgatgttctcaagtaaaatagaccaaatgaaaataagagaacgaattaaaaggtgc

SEQ ID NO: 7729 - DNA, 2680 bp, Triticum aestivum
  unsure (1)..(2680): unsure at all n locations
  Clone ID: PAT_TA_7729
cgcgcctctgctccccccactcacccaatggtctcgcggcgcttacgtttagctgcgcgcacaggggttgcgtgacactaccggcaatgcagcagcacgggagccatggcgcgggaggaggaaagacccccaatgctggacgcctcgatgcggcaccttcgtgtggtcaaagcgctccccgtcccccagaccgactacaccaccggccaggacgctaaccccttcgtcggcaaatacgccgacgtgcagtgtgaaaacgtgggtcacgctgaataggaggtgcaaacgatgtgaaacatttaccgatgctgcggagttaccttctggtttacataggatagtgcctcccaagggaggcacgggaacactatatgtcaattatgagtaatcacttgcggctgttaaaggtaggaaatatcggtgggcaagagtgtgcgaatatttagcacaaagtgaaggtaaattgccgaggtatttggaagttggtaatagctgtaatgctcgcgtctttgctcttatataatttgaaacatatgtatttgaaagttgggctgcatatgaaggaaaccaatatgaggagttaatacagctctgtgcttgatccccagatcaagagctgcctgtgcctggctgacatggattctatttgggtgaaggtaagcacagctaagaggttttgagtttgtcaaagctgttactcttgttgctgaaccattcacactagaaaatggcctcctcaccccaacattcaaggtcaaaagaccgcaagcaaaggcgtattttgcaaaagaaatcacagatatgtatgcacaattgcttgatgcagagtcagccaagcctaagttgtaattacacaagtaatggtcaaaataagcagtcaatcaaggaaccaaaactaatctttccaatcaacaacagcctgggacagtgcttagtgcagttaatttgattgctgtggtcaagtataactgaatgagcccagcatatgcattttcttaacttattttccccctttttttacagtacacgcatgtaacactgtaaggatacatagattagcatattggcgccctaatcctgatttgctgtatcgctttatttgcaaggaaaccaggggtcgcaaaatcaggaattaacgattttggtggtttgagaccaaccgcattatctattgtttaccggctaaataacaaaatttattctgcaatcacaaatgctgtgaaggattctggtgggctaaaagaaagactattccgtactgcgtacaatgccaagaggcaagctcttgtgaatggacgaaatccttccccaatgtgggataagttagtatttaacaaaataaaagctaggcttggtggacgtgtgaggcttatgacttcaggcgcttctccattgtcagcagatgtaatggaattcctaagaatatgctttggtggtgaggttcttgaaggctatggaatgacagagacatcttgtgtcatcactacaatggatattgggtgacaaattaattggtcatgttggatcaccaaatccttcttgtgagggtaaacttgtggatgtcccagaaatgaattacacttgtgaggatcaaccatatcctcgtggagaaatctgtgttagaggacctacaatattccgcggttactataaagacgaagtccaaacaagggatgtcattgacaatgatggctggttgcacactggagacataggtttgtggctgcctggagggcgtctaaaaattatagataggaaaaagaacattttcaagttggctcaaggagaatacatagctccagagaagattgagaatgtgtatgctaagtgcaagttcattgctcaatgctttatatatggtgatagtttcaactcttttctagttgccattgtagcagttgaaccagatgttttgaaggcttgggctgcatctcaaggaatacaaagcgaggacttaagacagctttgtgtcgacccgagagcaaaagctgctgtcttggctgacatggattctattggaaaggaagcacagctaagaggttttgaatttgccaaagctgttactcttgttgctgaacctttcacagtagaaaatggtctcctcacccccacgttcaaggtcaaaagaccgcaagctaaggcctacttcacgaaagagctcgcagatatgtatgcacaactgcgtgacgccgaatcagctaggcagaagttgtaattactcgagaaatgttcaggagtaaggttcaaaccaatacaggacaggttcacacaatggagcaaggatttctcatttgctttatgagcaggaatacctttcaccccaggagtggtgttgggtgtggttatatttataaaggaataaaccgaaggccccattatagaatttcgttcgttattttggtagaaggtatacaatttataggaaaacattcttgatataactatacccatcaacagttcatgccttcttgctgctgcagaagttatacaaaagactgaagatatcctatacctgtaagttataggaaaacattctgtaaccatcatcatgttcaaatatatatgttacattaaggcaaaaattggggggcccacgctccaattgcctataggagcntattcnccgctcannggctncgtttanaacttctgacggggaaacctgggtacaactancncc

SEQ ID NO: 7730 - DNA, 696 bp, Triticum aestivum
  Clone ID: PAT_TA_7730
ttcggctcgagctatggttccaaaatgcaatggtgagtgtttcaacatttgtagctatgtttctcgccgtgctcgccatcgtgtcctctagcctccttgttgcccatgctgacactgatttcatctcccgcacatgcaacaagaccaacaacaccgcattgtgcatagccgtgcttaccgccaagccacaaagctcccatgcccccactgagcatgacctcgctagtattgcgttgaagatcgccactaataccgccaaacacaatgtcaaggtcatcagtgacctatccaagaacaaccagagcacacacagaggcagtttgcaattgccatctgcctcaaggcttacactgaagccactgagcgctctagagatttatgccgacctatactttgaaaggagggttttactctgatacgttgaccgttgtttcatttgcaatgggatgctagtgacacatgcaaggaagcgttcaaatggattgaagaagaagtccccaatgtcctacatagatcgtcagatgacggagcatttggtagtgttgccagcaacctcatcaacctacttgtccccaagtgatgacatgccattcctggctcatgtatgcctattgatttcaataattagtcgactgtatctaaaaatgttatggaggtcatgcaatttatagttatcgagttatatcagttttatat

SEQ ID NO: 7731 - DNA, 673 bp, Triticum aestivum
  unsure (1)..(673): unsure at all n locations
  Clone ID: PAT_TA_7731
ggacggcctgctcgcggactacgccagcggcatcgccgcggtncctgggagcggatggaccattctgcgtggcgccggcacggaagacgacatcaggatcacgtacaggaagaacaacgacgacagcaacaacgccgtcgtgtcggtgtgcgcgtcgttccatctgccggtgccgctcaaggtgacgtttgatctgctcaggaacaacctgttacgcccaaagtgggatgtgctggtgaacggtaattcggtgagggaggaagtcgctgtttgcaaaggcgtaggagcaggaattgatgatgttgtctccatactgcatctcaaggatccgcccaccggggagaacagggacaacatcatgatcctccagaacagcggctacgacgtgtcgggcgcgttcatggtctactgcccagtcaacatccaactgatgaacgagatcatgagccccagcgacacggcggcgagcaacaaggtgtccctctaccccaccggcttccacctcctccccgtcgaggacactgcccttggcctcggcgagggtggagcaactcttgtgaccgcggggttccagattatgctcaagctcgctccgtgggcaccggcctgtatcctaaggtccgcgtccaacgggcgtccggtctgatgacaanaaaacaantgcctacaacaa

SEQ ID NO: 7732 - DNA, 166 bp, Triticum aestivum
  unsure (1)..(166): unsure at all n locations
  Clone ID: PAT_TA_7732
ggtatgtttgtcaggttgatncgtggtgtcacggagtttctttcttagcgagtagtccgtatgtggttatatgtatcggttttcgcccggttttccattaattaactgggaaattctcttctccttaattaatcgatgaggtaaatcttctgcctcaaaaaaaaaa

SEQ ID NO: 7733 - DNA, 866 bp, Triticum aestivum
  Clone ID: PAT_TA_7733
cccccctctcccctcccgacccctcccccacccctagcccctccccccctcgcccctcccctcgggccctctcccgcgagcctcggccccttcgcccgcccccgccccccccccccgccgcctccccgccgcagctcccccgccccccccggccccccccctccccccccccgccgccgcccccgccgccccgccccccccgtgccggtccgcccccgcccccgcccccgccgccgcgtgcccgggcggtcgattcgctccctttctcccccccccttgccctggttcggcgtcggaatccatctccccgacggtgcgccctccgtgctacaaaccggagtcggtatccatcctccacggtttcgttccgccccgccgccccatcccccgacatttacggcctctccctcccaccgcgccggagctcccgcccagccaatctgaccgctgcgccctagacctgccgccgctcgcgccgtagctcagcgtcgccgccgacgcctcacccccccaactccacgcgccccggccatcgccgtctcggttcggcgctcctcggcgcatcaacgccctccaccctttgccccgtccagccggcccgccccccagacccgccccgctgaggccgagccggcggactgagtcgcccggcctgggcctcggcgacgtgtaggctcagtttgattctactgctgtaatatatttttggtgttgtattgaactctaccttgtaaagctggtatccccagcattcccctttgcttttatataaaggcttgtacaatcgacctttcattgaaaaataaaataaataattccccggggccctatataaagcttgtacaaaaaaaaaaaaaaaaaaaaaa

SEQ ID NO: 7734 - DNA, 659 bp, Triticum aestivum
  unsure (1)..(659): unsure at all n locations
  Clone ID: PAT_TA_7734
gatcattcagaagaagatgtccaacagctacgcgtccccgtatacgaccacggtgctgatggcgtccatggccagcgtccagtgcggcgtcatcgcggtggccgcggagcacaggctctcggcgtgggcgctcgggttcgacatcaggctcattggctcgctctacgcgggggtggtggcgtcagggatggtgatcgcggtgatgtcgtggtgcatccaggtgcgcgggccggtcttcgtgtccatgttcagccccatgatgctcatcatcgtcgccgtcgtcgggtggggcatcctcggcgagaagatacgcgtcggcagcatgatcggcgccgtgttcatagtcgtgggtctgtacacggtgctctggggcaagggaagggacatcgtcgccacggaaaccacggaagacgacgaggagaagaaaatcggcggcggcgaagcgagcaatggggccgtcgatggcgcggcggtctcgcggccatgcccggctgctgatcgtcatgaggcgacgggccaaccgtagcatggcacgagatttgcggtgcaatcttaactcgtgtcatggcctgagtttatgacttcttggagtattaacaaacaaaaccacanattagcttgtttcactatcttanaatccatcactccgatccattaaa

SEQ ID NO: 7735 - DNA, 830 bp, Triticum aestivum
  unsure (1)..(830): unsure at all n locations
  Clone ID: PAT_TA_7735
attcggcaccaggaggggntgggctggtgtattttgctggtttgaaggggcantatgaaattgtggttcatcattacattcagcaaggagaagcaaggaaagccttggaagtgcttcaacgacataaccgttccagaagaccttgtgtataaatttgccccagatttaatcatgttagatgcttacnagactgtcgaatcatggatgatggcaagaaacaagttgaatccagggaagcggctcccggcgatgatgcgttatgtgagcgaaccacatgccaagaatgaaacacatgaggtcattaagtacttggaattttgtgtcaaagatttgaacaatgaggatcctggagtccacaatttgttgctctcattgtattccaagaaggcggatgagtcccagcttttacaatttctcgacaccaagtttgggagtggacaagcaaatggacctgagttcttttacgaaccccagtatgctctgcgtctatgtctccaagcaaagaggatgcgtgcttgtgttcgtatttacagcatgatgtccatgcatgaggaagctgtggcacttgctttgagggtggacttggagcttgcaaaggcagaagcagacaaagttgaagatgatgaagagcttaggaagaagctgtggcttaaggttgcaaagcatgtcatcgagcaagagaaaggagtcaagagggagaacataaagaaagctatagaatttctatcagaaactaacaacttgctgaagattgaggatatcttgccatttttcccagactttgtattgattgacgaccttaaagaagaaatctgcaaatctctcaagga

SEQ ID NO: 7736 - DNA, 634 bp, Triticum aestivum
  unsure (1)..(634): unsure at all n locations
  Clone ID: PAT_TA_7736
gagcagtgcgaggnagagatagatctccacgacttccactcgcctcttctttccgtcctcctctccatggctcccctcaaggggatcgatgcggtggctctcccctagcagttctggctcaccctactctcagctctccccggccaccatctcggtgtgcggtgggcggtggctgtggttgggtcgcccacaagaggacatgcccctaattcacaaaaaaaaagagagtacatgcccttggccgccatcggattttctccctctcctgtgccagatctgcttctttctgcaagctgggtggtgaagaagggagagagagggctgcagctgtttgtgctgctgctggtccaaccagcaggtcctttgttcgttttttcgattactttctcttaacttttttggaccctgattatttcatgaggtccttaccaccggatctaaagcatctttggaggatttctttatctgcattagttttagcctttctatgctaattttctcggtgtatgtacggcgtggtcctcaacaatacaaattgagttgtgtcgagagatcaaaggaaagctttcctcacatacttacaaaagttgtacgagatattctaagaaatttatgtggctatctaaaacttaca

SEQ ID NO: 7737 - DNA, 507 bp, Triticum aestivum
  unsure (1)..(507): unsure at all n locations
  Clone ID: PAT_TA_7737
gcaaacacatgtttgaactagtatagttcgggttcttgcatgatactgcttgaaaactctttccttcaactcaacaattagctaagatgaggactacccaaatgttgctcctggccatcgccatcctcgtgctagcatcagatgcgctaatggaggcatcagcggacattagtattgatcccgtcacatgtacatcaaaaatcatgccatcgccaacgccctgtgaaaaccaaagttgcaacaagacatgtgttgaaggtctagggtacctcgcagctggatggtgtgttacccaggggtgcatgtgtatgtattgcccactgcctccacggcagttagcaaatgggcactaattatctagactaagatgtcgtgttcaattgaatagcgcaaacgatcataattggtgtagcagcgaggttgttcactgataagtcataagaagaatgatgaatttggtcttgcttcttgaattatctgaggttatgaagtgggctannnaaaaaa

SEQ ID NO: 7738 - DNA, 2260 bp, Triticum aestivum
  Clone ID: PAT_TA_7738
attcggcacgagggtgccaccacaatggcagctctgtttgagatggctagcaaaaagtacactcagcaccggtgtcttggcacaagaaaactgattagtagtgaattcatagaagctgctgatggaaggaagtttgagaaactgcaccttggtgaatatcaatggaattcctatgcagaggcatttaaacgtgcatgtaactgggcttctggtctcatcaagatggggcaccagctagatagtcgtgctgctatcttttctgatactagagccgagtggatcattgctgctcagggatgctttcgacaaaatttaactgttgtaacaatttatgcatctctcggcgaggatgcactggtgcattcactaaacgagacacaggtttccactctgatttgtgattcaaaacaacttaagaagctgcctgcagtcagctcaaagttgcatagtcttaagcatgttatctacattgaggatgaacctgttgaggctgacacacttaatcaactgaaacacttgacaacattatcttttaatgcggttgaggagttgggccccacgcgtccgccagatcgtgggctaccatcaagcactgatactgcagttattatgtatacaagtggaagtactggtctccccaagggtgtgatgattacgcatggcaacatggtggccacaattgcagcagtgaggacaaccattccaaaccttggcacaagtgatgtttatctggcataccttccgctggctcatgtttttgaactagcggcagagtctgtcatgttagcttctggtgttgctattggatatggctcagccttgacaatgaccgatgcatcaaataagataaagaaggggacaaaaggagatgtttctgtactgaaacctactctaatgatttcagttcctgcaattctggatcgcataagagatgcagtgtttaagaaggttgctgagaagggtggcataaccaaaaagctatttgatgttgcatataaacgaaatcttggagcaatcgaagggagttggactggatcttgggcgccagagaggtttatatggaatagcattatcttcaaaccaatacgtgcgatgcttggagggcatataagatttattctttgtggtggcgcacctctttcaagtgaaacacaaagattcataaatatatgtctgggtgtcccagttggtcaaggctatggattgaccgagacttgcgctggagcagctttctctgaatgggatgacacaagtgtgggtcgtgttggtccacccctcccttgttgctatgtcaagcttatttcatgggaagaaggtggttatagaatttctgattctccaatgccccgtggagaggttgtcattggtggccacagtataacaaaaggttatttcaacaatgaagcaaaaacaaatgaggtgtataaggtggatgagaggggaatacgctggttttacactggagatattggccagttccatcctgatggatgcgttgagatcatcgacaggaaaaaagacatagtaaaacttcaacatggagaatatgtatctcttggcaaggttgaatcagctctacagacaagcaattatgtggacaacatcatggtctatgctgatccatttcatagttactgtgttgcactggtcgtgccaccacaccaggccttggagaagtgggctcaaaattcagggataagctacaaagacattgaggagctgtgtcacaatgatcaagcaattaaggaggtccagcaatctctatcaaaggccgcgaaagcagcgaggctcgagaagtttgaaataccagctaagatcattttgctgcctgaaccttggaccccggagtctgggcttgtgaccgctgcgcttaagctgaagagggagcagctgaaggccaaatttaaagatgatctgaacaagctctaccagtagtgacccgccattcatggaactctccgattaacgtgttatgaataatttgtatttgtttgctaatctggaaagctcttagtgagacagctacacacagttcttcagcttgtagtagcttgtagtatccctttatcgtactgggtcaggataaaggtgttacaaattgtggaacgaggaaatgttgtttctttgatactagctgtataatcgctgctgtaataaatgggtaagaaatatagggacctgtgggtttaaaaacattagcctgtgacctgggccactgaggccgagggacatgataaacaaacgtggcggtttctctgtt

SEQ ID NO: 7739 - DNA, 1625 bp, Triticum aestivum
  unsure (1)..(1625): unsure at all n locations
  Clone ID: PAT_TA_7739
agtcctccatctcctcccctcttcctcaccccaaaccctagcgccccatagcgcgcgtcgctaccgccgctcctccatactgccgtctaggtgcggaattagagctgcccatgcccaacggcgagcccgcccccggcgatggccagaccgaggccgccgacactgtcgattccgtgaagtattcggcaaatcccgaaagagcggaggcggacgtggaggtggaggaacagggggaggacgacgccatggtggatgccgacgccgacgccgaccccgttggttctaccaaggattcgggcggtgcctgaagaagggggtgccgaggaagtgggggaggagcacaagggcgacgccctagtggtggctgccaccaccgttgcgtcccttgacgatttggggaaggttgaagcccaaggtgcggaggaagaggtagaggagcgtttaggcgatgccctggtggatgtttctgtggctcatcaggtcaagactgaggcccagggaaatgagggggcggagacggagggtgaggcccagggaaatgaggtggtggagaccaaggtcgaggcccagggagaggagggggctgagttgaaggatgacacccagggaaatgaagctgccgagatggatgttgataaagcaggaaatggagatgaccacaccgaggccagggtggatggtgacaagggcagcttgctgaaagaggaaagcgacaatggtggagatgataagaaggatgccaatggtgaggatgagctagtgtcgtcactagctggggagggtgaaaaccaaaacttgtctgacaaggtctcaaacaactccttcatgtttgattacacccgtggaggcgatgactctgggacggaggaggagcaggctgagtttatcaaggagcttgaccggttctacacgatgaaattaatggaattcaagcccccaaaattttatggtgaaggattgaattgcctcaagttgtggagacaagtaactggattgggtggctatgatcaggtgacatcatgcaaactatggcgtcaagtgggagaatcattcaaacctccgaagacgtgcacgactggtttcatggacccttccgcaacttctttgtgaagaaaggcnctctctctgtgatttccgaagaaaaccccccaggatattgaaaaactgtggcggaaagttctcacttggtgggggtgtggatttttatatcttttcacacccgaagcgggaaaattgggctttctttgaaatagagtccacagggtgtggggtttggaaaaacccttcttgcgccttttaaaggaatatctgtgggaaggagagctcatggaaaagaaggaatttttgtgaaaaatttggcgggccaatgtgccaaggggcttgggcattttctcgcaaagcggcttttggctttggggcaaaatggggtgaaaaaattggctctggatcccaggtaaatttaaagggtttaaaagccgggttattgccctggtccttgaagaaaagggacaaaaaaattcaaaaaaagcacatggttctgggcccagaaggaaaaaagggccacccaacctttgaaagaatagaaggggaacacccttcccaaatttgagaaagcttccaaatgg

SEQ ID NO: 7740 - DNA, 669 bp, Triticum aestivum
  unsure (1)..(669): unsure at all n locations
  Clone ID: PAT_TA_7740
gcaggnaattcggcacgaggcactcatctgccctaagncgggaacccttcaggnacgctctcatagtaattctcagggcagcgatgctccttgccctccggcggcccctccttcacaagcttcacggcgtctagctttgcctagtgcaccttcgcccgggcaaaagccctgcgtgcaccttcgatgcagacagatcgcttgatgacttcaagccgtgggcaggcttccaccagccgcctcaccagaccgaagtagctgccagacaggggctcgccaggccacatccggactataaggcccctcatggcctgttcggccgccttgtgaagttcgaccaactacttcagctggtcgctcaaggacacagggtgttcggtcccagtatactgagaccagaacaacttttctgttgagctcccctcctcagcccggtaaaactccgcagcatccaacacactgcggggaagatctgcaaatgctcctggagagctccgaactcgggtaagaaaaaggaaagtctccttcacatgcttgctttgcatattgaatgccttacccgctgctatcttcttcgccgcatcaatctcctagagggccttgtgggcttcggccttggcgctccggacgctttcaagcgcctgcgcgagctcggactctcgcgtcttggag

SEQ ID NO: 7741 - DNA, 674 bp, Triticum aestivum
  unsure (1)..(674): unsure at all n locations
  Clone ID: PAT_TA_7741
ggtcgaaaataaagcagatgctgccagnaaggaattaatggatctcagcctgttagcaaaatagttattctgaagccaaatccaggaaaaggaattgatcagacagtgacaagcagtgcaagatatttacatcagcaacctagtacctctcaaactccagagtacagtgggagggaaacctcaaaattttcaatcaaagaagtcaggaggagattcagaattgtgactggtgagacaagaagagaaagaaatgcagcacctgcagacgaccttcaaagagtttcacgttggcattccatgattgcaacgaagaagagttctgggtatcacacacaagggagcttggcagacaaatctgcatcaaattttaagaacgacatcgccagaccttcaaccagcagcaagcaaaagcaacaaaatggcggcgagactgaaattagtggtcatatagcagtgccacaagatgattctatcttctacaaggaggccaagaagcatttaacagatatgctaaaggataacaataagtccggcaactatccaacagcccaggtctcaaaatccttggaaggaatgctttcgctccctcactgcgatgtgtcatctcctaggaatagccgtagtggaaaatgccacactgatctctcacctgaagagacggattcttgccttgt

SEQ ID NO: 7742 - DNA, 2305 bp, Triticum aestivum
  Clone ID: PAT_TA_7742
cggacttaatcgaacaagacgcctagcgtgggtacattggattggagtactttggccggaccgttgggatcaaaatcatgccagtttgtcagcgggagaggcagggataaattgggcgaatggttttggacgtgtccgaagctgggtattgcagctgaacatggctacttcttaaggtggagtagggatgatgagtggcaaacgtgtgctttggcttcagacttcggatggatggaaatggtggaaccagtgatgaatttgtatacggaatcaacggatggatcctacaggtagaacatgcaaagcgctttcgttggaagggtaaagatctggaagccattgcgtttgagattccacagagctacaataggatcaatggagagttggagaggtccgggtaccaaactaaccggtttatttatagggatgtgtctatattgttgaaaagcgcaccccatgcgataaccgagggagtagtagcggaaaccgtacggattgcaatgaacgagacacgaaatcaatacatcgtctgtaggcaggggacacctaggtgggagtcctcatcggaggtgactgggccgaagaagagcatgctcgtggtttcagagttcattgggtgctcaccgtctttgagtggtgctattcgtgttaacccatggaatgtagaggcaactgcagaggcgatgaatgaggccatttcaatgtctgatcaggagaagcagctgaggcacgagaagcactaccgttatgtcagcactcatgatgttgcttattggtcgaagagcttcatccaggacttggagagggcttgcaaggaccattttagaaggacatgctggggcattggattgggatttggtttcagggtggtggccttagaccctcatttcacaaagcttaacatggattctattgttatggcttacgagaggtcagagagcagagctatatttcttgactatgatggaacattggtgcctcagacttccatcaacaagacgcctagtgcagaagttctgaggattatcaataccctctgctcagatgagaggaacatagtttttattgtcagcgggagaggcagggataaattgggccgggcggctgcctcgtgtccgaagctgggtattgcagctgaacatggctacttcttaaggtggagtagagatgaagagtggcaaacgtgcgcccaggcttcggacttcggatggatggaaatggctgaaccagtgatgaatttgtatacagaatcaactgatggatcctacattgagaccaaggaaagtgctttggtgtggcaccatcaggatgctgacccaggctttggatcctcacaggccaaagagatgcttgatcacctggagagtgtactggcaaatgaaccagtctctgtcaagagtggccagtttattgttgaagtcaaacctcagggagtaagcgagggagtaatagctgaaaagatactgatatcaatgaaagagagaggaaagcaggccgactttgtattgtgtattggtgatgataggtctgacgaagacatgtttgaaaacattgcggacataatcaaaaggggcatggttgcccccaaaacaccattgtttgcatgcactgtgggacaaaaaccaagcaaagcaaaattctacctggatgatacgtttgaagtggccaccatgctgagcgcactggcggaggcaacagatcctgaacctatgaccggctccaccgatgagttagctacggctatgtcctcaattgatattggtggtgaacgaagtcagtcaaggggtagacctttcgatggattgtagttcagatcttggttaaatctgcagattatggcgattgattcaacagtcgcttctacacatatattctgacagatatgaagatgggtactcaatgaacgactaacaccagggcctacaatttgaagctagggcagaagcatgcccgattatccagccgggcaacacattaccatcttttgctgcaaaatgcaggtccatatgtcaatagctgactcgtcacctctctttgcatctttctcttaaacctttttccttctctagtaaaacgagatgcctcatggaaggcaagtgaactgtatggacgaggtgataggcactttgggatgataggattggcactgcacatggaaattcaatggagtgcatcctcctctgcgtgtgatcccgtgtaaacaagttacacatcggtttcagttttgtttttgaagtctaaagtcgcgtagtaaatgtgaatggtgagatttggttcgtcatttgaaacctttttgttttttgct

SEQ ID NO: 7743 - DNA, 684 bp, Triticum aestivum
  unsure (1)..(684): unsure at all n locations
  Clone ID: PAT_TA_7743
ctcggcctctcctccgcctccggcctccgcggaccaccctgtaggttgtagaagaggaggagtacgcattgcctagcaagcctccagcttcaagcgattggcggcgatctggattccgtctggattagagcagtgcagcaggaagaggatcagggggtggtggtggtccaggccatgggggcggggaggtcggacggggagaggagagatagccctaaggacgaggtcctcgccggctgaatcgaatcgagaattcgtcagctcctcccacccctgcggtcacatctctctcggagatcctcttcaaccccggagttcctcgtggagggcacccgctcaaccccggcgtgtggagaggggggtaagccgcccctcctttgcggggcgtccgccttgaaggaaaacaagggcgccgccgggaaacaatcgggatgttggaaacaaacntgcttgccaatgggtcctcaatcccgggcctttaantttcaaaaaatacgggtggtaaggttcccgaatnntgattccttgtngactaagaaaattaanccngggaagcttgcaaangggcaaaattcanaaaaattaattgtggttcccggttcaattttatgccaacaaaaaagcttgcaattgtgattaattggnaacggntaacttttncgnncggagaatggttctcaaant

SEQ ID NO: 7744 - DNA, 914 bp, Triticum aestivum
  unsure (1)..(914): unsure at all n locations
  Clone ID: PAT_TA_7744
ggcacgaggnctccgtgccttccctctgctactccatcctattctacttcctcgtccaccagtcgccgcggtggctgctggtgcgcggccgcaagcaggacgccatcgagacgctgcagcagatcgcctcgctcaacggcaacagcatcacgtccagcttctccatgctgcacgcctgcaccatgaacaatgacactgcggaggagagcggcggcgacagcgtgttcgccacgctgcactcgatgtgggagcgcccgtgggcgctccggaggctggcggcgatcatgacggccagcttcggcgtcggcatggtctactacggcatgccgctcaacgtcggcaacctggggtccaacctctacctgagcgtcacgtacaacgcgctggccgagctgccgtcgtccatcctctcgtggctcctgatgggcaggatcaaccgccggagctcggtgatcgcgctcaccggggcggcgggggtgtggagcctcgcgtgcgtcatcatcccgcagggcgcggcgcggatggccgccgagctgctctccttcttcgcgacgtgcacggcgttcaacgtcatcatgatgtactccatcgagctgttcccgacgtcggtgcgcaactcggcggtggggcttggtaaggcaggcgctggtgctgggaggcgtggcggcgcccgtgctcgtcgcgctgggccgcgagaggagcttcttgtcgttcggcgtgttcgggctcgtncgtccggctgcttcggcatgttcgccgcctgcctgcccgggacgcgggggaagggcatgtcggacaccatggacgaggaggagcacaaggaggcggcggtggccgcttgcaccgtcgacgatgcggactgtaacagcgacctcgtgtaattatactaaactgcgggttgatgtacaaagtta

SEQ ID NO: 7745 - DNA, 595 bp, Triticum aestivum
  unsure (1)..(595): unsure at all n locations
  Clone ID: PAT_TA_7745
ttttcaacacggcctggggngnctggcctgaggcttcgtcctntacgcagccncggggggcccgtccttgtgtcggccgcggccgccgagaccaagtgtnatcctgccttgtgtcccgttttgctcttcgtcggcaccttgtcgccgccgcccgngtcgccgangactggacgagcggttcctccgggagatggagatcaacaaggcgatactggaggagaacgaggcttcctccgaggaggcggcagacggcggcggagagtacgtcgtcaacggagacgaggccgcgttgccggcggcggagaaggagcaggtccttgtcacagctactggcactggcacgcgcgccaggaacaggccgaaaagggaagtgtattagctactagctagatttgcacggagggaaatgctttgctacctttgagatgtgtccgtcaatcagcttgtaaatcttttgcaaatgtttcagtgtgattgatagcatatgcaaaaaaaaaagctttcaaaaaaaaaacatatacccgaggcggccgaagaacgaatatatgtatgttttgaggtaaaaaaaaaaaaaaaaaaaaaaactcgagactag

SEQ ID NO: 7746 - DNA, 779 bp, Triticum aestivum
  Clone ID: PAT_TA_7746
ctcggctcccggtggtgtggagcgccatcctgtggcagttcttcttcctgggcgccgtgggcgtcatcttctgcgtccacaccctgttcgccgggatcctcatcgccgtcttcatcccggtcacggaggtgctggccgtcatcttcctgcacgagaagttcaccagcgagaagggcgtggcgctcgcgctctcgctctggggcctcgcctcctactcctacggcgagtacagcgacgccaaggcggccaagaagaaagcggccttggatgcccaagcctcgtgactaatagtacactttgatttggaaactcattttatgttttccttccatgaattgtgatttggattgttgtgcttgtctactcgtaaggcattggtaacctgccaccagtggtaaatggcacggttattgtcatgacccaaaatttcagaacctgccagtaaaaaaatactgattttcagccgagtacagcgaggccaaggcggccaagaagaaagcggccttggatgcccaagcctctgactaatagtacacttcgattccaagaattgtgatttggattgttgtgcttgtctgctcgtaaggcatacataacctgccaccagtggtaaatggcacggttattgtcatgacccaaaatttcagaacctggtaaaaaaaatactgattttcgtcctattagctcatgtaatattatttacaaagttattccaaagtgcctagtcaacaggcttaggccagttctggatgatattatttctccccaaaaaaaaaaaa

SEQ ID NO: 7747 - DNA, 603 bp, Triticum aestivum
  Clone ID: PAT_TA_7747
gtccctccctctcgccacttctcacctcttccgtttctcgcctcccctgactccgccccgcccgcccccggcattcctgctcctcgcgtcgcgtgctcctcggcgagcacgcggccgtggcgcgggggtgccagaggcttctccgaccgtctcgtccgccgtctgctggtgaggcacaagtctgaccttctgtgaaccggcaagatgcagccaccgcagccgcggcctgaggactactcgttgaaagagacaacaccctgccttgggggttttatggcagcaggggacaagcgcacaagtacatacgaccttgtggagcagatgccatatctctacgtgcgcgctgtcaaggccaaagacctccgtgccaaggatgggtctgggagctgtgacccatcagtagagatcaagcttgggaattacaggtgcaccacccgtcagtttgagaagaatactaacccggagtggaaccaagtctttgcctttcccaaggaatgcatccagtcctcctatattgagatcactgtcaaagacaaggatgatatcattgggcgagtcatctttgacctcagtgaagttcccaaagagagtcccacctgacag

SEQ ID NO: 7748 - DNA, 1217 bp, Triticum aestivum
  Clone ID: PAT_TA_7748
gatcccagattattccttccctcgcgtgaagccgagctcagcaggcgccggagcagggacggggacgcccgtcgcaggccgcctcgccgcccgagttgccgccgtccggggcccttctcgcctggaggaaaagatggagcctggaaggaaacctcgtcttctggacctatgcatccggagcgccgtcgacaacctcaggaccctcaacagcgtggacatcgtggctgaggagctgctcaagagaatcctgccccactgcaccttggagcagctgacccacatagagagctgcacacatgcggaccttaccgacgttaccgatgtgctgtggaagagattcttccagcgcgagttcggcgaggataatatgaaccttgccatcaagaggatgaaggagaacggggtgcgttacaaatggaagaaactctttgaggcaagaacagaaaagcaaaagcaagttgaagcaagaatgtcggcagggctgaaaaacaaatatcaagcagcaaacgctgcgaaacaaagcaaacaaattaaagtttgtaccaagatcccacccaacagcaaaagaagtttttggggaggaagtggatccagcagcctatccaactccagctacaagagccctatactaaaaaaggcaaggatggaggttgacagccgggcgaaaatgcaagctgctatccaaaggaacacttttgcaaggtcatcacagccagcaaggctgacctttcctagcgaacagacatcgaggacgacgacaattcatcgacctaattcaacgataaccatcaccaaaccaactggtccgaacaggccgattcaaaagcagaacaccagacccaaattttagaggccactgccatgacatcatgcttgtgaccgtggagttcgccatgattgcgcggaaatcttctttcctgtggacaagttggcactgcttgccattcaccaagtctttgtgagacaggaaagaatcttgtttgtagttgccccagctgagcacttgtatctttaggggagcaaacaatatctgtaccaaacatttttttaaaatttgattcaatcaaatcattgaaatgcatgagcttcaaaaaaaaaaaaataacgtcggaaaaaccgcacgactcgcacacgtcgcgtggccggctcccgggtgccctctcgagctctcctgccaattaattctgcaagaacaattcagttcaaaaaaaaaaaaa

SEQ ID NO: 7749 - DNA, 1847 bp, Triticum aestivum
  Clone ID: PAT_TA_7749
cgagcggcgccgcggcccgcacgcgcgacccgacggcgcggctgcagcccctgccgggttccgcgcccgcgcgggccaccgacccgaggccccctccggaggtaccccggaccggagggcgtcaaccccgtcggcacccaacggtcccccgcgcgccgaacgcaacctcgccgcttaggacccctcaatgcgctcacccctccccctcgccgtggcgcctatgttgccgcctccgcctccgccgccgccgccgccgcccacttgtcccccacgaggagctccctccccacaccgcgccgctgctccgccggcatggcctcggcagagggaagcgaggtgtccgagctcatcgccgggaacaggaaggacgccgccgtcaaggggaactcgtcctcggggatggcgtgcgagctccttcagagggccgacacgaagccccttgacgagcgccgctgcgtcaagcacgcgctcgagctcagggaggccgccaccactgcgggtttccttcccttcatgtgccagggacctgagatgcccttggttcataccctggacatgaacgtgtttaccaagttgaaggagaaggatgccaccgccaccaaaggctaccctgctgctgtggtccagggaccggaggtgcccctggtccataccctggagctgaagcaggctaactaccttgccgccatgcgtcagggactgcaggtgcaccgtaccctggagcttaacacactgaagcccgctgagtacctttcctccatgcgccagggaccagagccactgacgctcatcccttgtgcccttgtacgcacgatccctcgctgtcttccccagtcaatccctaagcatgtgcctgcgccgggaaacctgggcataaaggatgtgggagaagactgcgcttgagattcaagacaaactcaagcggaaaggacccgggtactctttgcgctccatcagggcaacggttgaaatctttcaagggaagaaccaagggactgttgttgttcgcagtcaatctttggctgagaagttcaaggcatgggcatgatgacacctcctagggggtttaccttctattcgatcggggaaaaggtacttcatgctttgggaagaagtacttcccgaagcagtaatgacagtcttaagatattacgcaccctccggttgtgtcaagaatatgattggtaggttaatttatccagcgtaagttattttctctcgggcggggtacctttcgttttatgctgaatatacctgatgctaataacgactcactttttgtgcccttgaactcacgatccctcgctgtcttccccagtcaatccctaagcatgtgcctgcgccgggaaacctggtcatcgaggatgtggagaagactgcgctcggggttcaagacaaactcaggcagaaaggaggacctgagtactgtatgcgcaccatcagggcaacggttgaaatcttgaaggagaagcaagagaaggcgttgcgcaggcaatctttgttgaagaagttcaaggcatgggcagatgacacctccagggggtttaccttctattcgatcggggaaaaggtacttcaagtttgggacaagtacttcccgaagtagaaattgcagtcaagttacgaagcagaactttgatcagaatatgatttgaggctatttgtctagccatgttattttgtctgtcggtttggctttgttttggctgagtttgagaattgctccggttgctattaaatcatattagcctcgactgtatgctgcatgagaactgcctgattattgaaactgaattttttgtagtttgatctagataggcaaatgtgctcgtgccttaaaaaaaaaa

SEQ ID NO: 7750 - DNA, 1329 bp, Triticum aestivum
  Clone ID: PAT_TA_7750
gcgtccgtctgtccatttccgtttgtgggcttcagcaatcattttgattgttctggccatgatagtcttggatctgatggtatgtttgtctctctcctgtccaatatgtactactacttctgattatatgtattttcaaattcatagcaactgatggcctctaatggatattggatagaacttagctatgttttaaatacaagtggttgcagagtagaactgtggtgacttcatgtcaacaattagctaaaatatataggatttgttcaactgttggtgaaagcagttggcttaattagctatgcattatgtattggtactatattgtagaataattgtgacaaataagaaacacccataaatcaaaagatggtttcacattaccttggtacagtattattggcatatgtgattgagtttgcaaatgtaaagctattctgtattttctagtttctacagtagttctagaattcaagtttcaatgctaaattatttaattgttattttcattatcaagatttgacatctttcaaacttttggcagggagtgatggctgtccttggaattcagctcaatgcaatatctattgtaaaccttgttatgtcgataggaattgctgttgaattctgtgttcatatcacacacgcctttatgataggcatcggggatagagaaaaccgtgtaaggcaggctctatcgacgatgggtgcttctgtattcagtggaattaccttgaccaaacttgtaggagttattgtccttcgttttgcaaaatctgaagtttttgtggtgtattacttccaaatgtacctggcactcgtcctcattggctttctgcatgggcttatcttcctaccggttgtgttgagtctgtgtggccctcctcaaaaaaccatgaaaccgattgaacaaagtcagactccgccttcaaatgagcaaacttgattagtacataacattcagggattattacaaagcatttcagtgtacatatccatctgttaccccggtgctggaggagctgtgagggtgtagatcatttatagaggcggagtaatctctatagaaagataggctgtacattagttaagtttactgaactagtactagtttagttgatatcgccgcgaggagaaggaagcgtgagctactactggcagttccatggtttctgttttgtatttgtttcatgcgagaaaccaatgtcatatttggtgccaatcagctatggtttggtcgcttcagttgctttattccagccatgatgtgcttgcgtgtcaagaggtcagctatctccaagattttttatggcagggggcataactctg

SEQ ID NO: 7751 - DNA, 612 bp, Triticum aestivum
  Clone ID: PAT_TA_7751
ccccaccaacgtgagagagaagcagcccctgatgggtgccgaggacttctccttctacacggaggccattcccaagacatactactacttcgtggggatgcccaacgagactcgtggaccgcaggggcctcatcactccccctacttcaccatcaacgaggataccctgccctatggtgtggccatgcaagcatcgttggctgctcgctatctgcttgagcaccagcctgttaccgctgctaaggtggaacctcccgacgagctgtaaatggtgtccgtgttgaatgaaacggagaaggacaaggacgtgcccagcaattgttggtgtgtgtgtgtgtgtgtggggggggggggggggggcggcggtaaggctctgggccaactgaagcagacttgttcgaggaggacctctgtatcgccaggtgattatgcaactgcttgtacataatttcctgattcgttttcgcatctgcacttagccgggtctatgtgcaacctttgagtgcagtgctgagacaaaataaaacacctcggggatgatgaatgtatcgttccagcaactactgcctccgttcctaaatattactgtcttttttataagatttcaatact

SEQ ID NO: 7752 - DNA, 1740 bp, Triticum aestivum
  Clone ID: PAT_TA_7752
gtttctgctaaaggactaagcaaaagcgcatgaatgtcaaaaacgaaaggcaaccacgccgttcgctttacgctatacttctctatggccatcgacgctgggctgttgcgcgtcgccctcgtcctcatcgccgctgccgcgacctgggcggcggccctagacgacccggcggggcttctgcgacgggccaaggaggcggagttcatggactggatggtgggggtgcgccggcggatccacgagaaccctgagctcggctacgaggagtttgccaccagtgagctcgtgcggggcgagcgcgatgccgtggagatcccctacaggcaccccttcgcgggcaccggcgtcgatcgccaccgtcggcacaggcggcccgcccttcgtcgcgcttcgggccgacatggacgcgctccctatgcagtaaaccgtggagtaggaacataggagcgcagtgcgtgcgaagacgcatggcatgtggccatgatgcacatgttgctatgctcctggggtggacgaagaatagtccggagaacccgcgccagctgaaggggaagagcgcccggccgctgcagacgcagcggctggcggccatgggccacgcaatggcaggagcagcagcagggggagcgcgctgacgccggatcatgttggacccgcccgtggcctgcacgtagtcccgcctgctgccagtgtcggcctcgccgtggggcccattggtgcggcggcacgcggcgctgatggcgaggcagtaggaggggatgtcgaggagcagcaccaggctcctcatcacactattgatccgatactggctgcatccaatgttattgtaagccttcagcaacttgtttcccgagaagctgaccccttggactcacaggtagtaacggttggaaagtttcaaggtggtggcagccttcaatgttatccctgattccgtgacaataggtggtaccttccgagcctttttgaaggagagttttaatcaattgaagcagcgaattgaagaggtcatagtcacacaggcatctgtccagcgctgcagtgcagttgtaggacttccttgacaaagataagcctttcttccctccaacaatcaacaatcccgagcttcacgatttctttgcgaaggtgggcagtgagatggttggccccaacaacgtgagagagaagcagccactgatgggtgccgaggacttctccttctacactgagaccgttcccaagacatactactactgactcgtggaccgccaggcgcctcatcactccccctacttcaccatcaacgaggatgcactgcccatacggtgcagccatgcagcatgttggctgctcgctatctgcttgagcaccagcccgctaccgctgctaaggtggaacctcgcgacgagctgtagatggtgtccatgttgaatgaaacggtggaaggacaaggacgtgcacagcaattgttggttaaaaagggacgaggacctctgtatcgccaggtgattatgcaactgtttgtacataatttcctgatttcagcgcattccaagcgagcagatgaccttgtgacggcattgaagcactgcgaacatgtgtttctgtggtaggtctcgttcgtcttggccgcggctccgtgccggctctgtgtgcagtcctgaggcgcagtggtgcgcctcaataaaacaccccgtggatgatgaatgtattgggttgttaagagttgggacagacaggaattttatagcatcattc

SEQ ID NO: 7753 - DNA, 731 bp, Triticum aestivum
  Clone ID: PAT_TA_7753
atgttttcttgcaagaagttatggagaagatgcaaagtcaaagtcaaacttgtctcagctttcaccttttgttccgcctgttattgatgctctcatttgtgcttcagatctggctagggagaccccttataggcttcttgcatgtccttataaagcattgagtgtagattgttagagtccgtccccttccaagacttgcaagtctgtcgggcacttataggtttgatgtctcatatcatgagaagattgaacactgtgcttcatggtcatggtgcaatttcatctcttaagaggaagaaccaacttgaggtcttgctgtgtggtctacttaatgtcttaatccacaagcttggaagcagcaaaaagtttacacttaagtggtctgctaaatgtgtgttgctgttattgtgccctctgttgacccgtgacagtactagtgcgcgtgatggagcagcccttgccattggtgctcttgctcatgccattggtggtgattttgggcaacacatgcctatgctgctacaatattttagtgtgaagcgactctttccagtttatctagaagtgatgtgtgatatttgccaagtcttgggaaaaaaggggaaaaaggaagaagtggtgccatcctttgatcatattatggatgttctgtgccaaggtatgacagaactgacgcttcaacctccaattctatcaagcattggacagattgctcttgctcttggtgagaa

SEQ ID NO: 7754 - DNA, 670 bp, Triticum aestivum
  unsure (1)..(670): unsure at all n locations
  Clone ID: PAT_TA_7754
cgggaatactgcttgtgcatccaaaatccttgaaccaagttccttccatgagtgtccatcatatctacttatatgcggtatttacctgccgttccaagtaaaattgcatgtgccaaactctaaaccttcaaataataatctgttttgtatgcccaaatcgctcatgtagcgattaggggctgtcagtatcttccatgttgggtgggttattctcacgatgagtggactccgctcatcattcacgagaaaatggctggtaactgggatgcccagtcctatgatcaaaagatcaaaaacaaaatcgcaaataatttaaacaaactcccccaggattgttgaaagttggacggcacccgttgtttcggacaagccgtggagtgtgattgttggtggagggggagtaaaatctttactttctgtttgggaaccgcctataatgtatctagtatggaagatattgggaaccctgggccgttatgttgacaatgaaagcatactctcaaaattattcacccctgtggctctgctccgggctctggcacctccgcccctgcctccccctccgtcgggccgctcttcttctttcctgcatcagccctttgtggtcctcctcgtgccaacctcctctgcatcaaaatgtagatatatgtgntncttggaaggtgagnaa

SEQ ID NO: 7755 - DNA, 469 bp, Triticum aestivum
  Clone ID: PAT_TA_7755
agtcactttcctaccaacgccacaaacaagttaggatgaagattgcagctttgatgctactcctgacactcgcctatctcgtgctaggatcaaatgcggatacaaaccgaaggtgtacgtttaaatacctgaagaagttttgtggttgtcaggaagattgccaccgaatccttatgtgccctgagaacaaggaatgcaatttggaggctcatattgttggcaaattgtgcaggtgtacaatgtgcatagactactccaaggctccaataaaggaaactatgatgttaactagctaagcaaatatcagtgcaagtttgctaaaaataataacaatgccatatcatgggttgtattagcatgactattcggaataaatctttatagaacataattcaacattacaccttgagttttgtacatggggttattaagtgatctatatatgaggcgttaaaaataaaaaaaaaaa

SEQ ID NO: 7756 - DNA, 850 bp, Triticum aestivum
  Clone ID: PAT_TA_7756
ggttgactggacctgaagtgatcgaggaggtcatatacggcttagaatcaggcattttgtttgggatttcaccagggatctctaagatgggattcgtgatgtctgaaatgggctttccgaagattgttgtgccagctgccatttcttgtagtgtggcctgcagtgccgtgggatttgtttaccagactcgaggtctcaagcatgggagggcaattgttgtgtccacatgtacatcagtggcatctattgtgtctggtgttgtggctggtatggttgcacttgacgaacatctgccgacagctcccgcaggacgtttttttctcttgcttggatggttcttcattattacgggggtgatactacttgttacttcaacccgagtgattgcgcgcctacctaagcctgtgcagaagtttttgaagagtaatatggagcgttcacacagcatcaggaggcctgggtcagcccgagggaaggattccaaccaaagcacaacaatccatgcctcgacattacatatactaacctctacagggaaagagaaggcctagaggtgctactggagcatgactgtcttaacacctttgatgggtccaatcactaatgtgaatgtacaagtctagagtagcatctcaaaagtttgggctggctgctcatatactgactgcccttatagatctaacagcaacagaagttcgtaaaatctcctgtgaattttgatcaagttacataccttcctgtggtcagttgtaagtggtatattagtttgttctcttcccttccgaatcttgtgtgcgtgtttctgctttacttgcagcaccattatattttgcttttaagaaaaaaaaaa

SEQ ID NO: 7757 - DNA, 893 bp, Triticum aestivum
  Clone ID: PAT_TA_7757
tgaattccaatgatcattaagtttggtgattgtctatgagcttactaaccttatgcctgccaaaggagatgttggaatcattagcaatatcatctccgaagccattagaattcataaagatgatcattgtcatgatcatgtatctaatgaatcaccctctctaggaattgatccaccacatgacgatgtcgaacatggatactatgatgaggatgatgatagtgactttgatcttgatgatgcaatgagacactttggtcttatggcaaatcttcggggatacatggcaggaggaaaggaatgggtccttgatagtggatgtaccgatcacatgaccggagataaggatatgtttcctgagcttgctgaaagcgacggccctcgatagtatgtcacttttggtgataactcaaagggtaaggtggttggcctccgtaagggggccatctcacatgatagctccatacaaaatgtcatgctcgttgaatctcttggctgtaatctactttccgtttctagacttgctgactttggcttcaatgtcccatttaccgaagtagattgccaagtgtttcgtagagataatcataatatggtctttacccggtatacgtagaggtgatctttacattgttgatttcactaaaaaggctcaacctagaacttgcttaattgctaaatcctctaaaggctggttgtggcatagaaggttaggtcatgtgtgcatgcgaaatctttataagcttattaaaggtgatcatatccttggagtgaaagatgttatatttgacaaggatagattgtgcagtgcttgtcaagcaggaaaacaagttggaggaagccaccccgtgacgaacatcatgaccatgagaagaccgctcgagctacttcat

SEQ ID NO: 7758 - DNA, 339 bp, Triticum aestivum
  unsure (1)..(339): unsure at all n locations
  Clone ID: PAT_TA_7758
gnatgtccggcttgttgttctccgtttcctcctcctagttcggctcctggatccaaatcctgctgccatggccgagtattgcgggaaaggagcttataggcagccattttgtttcgacgcttggtgcaaagggctttgctggacgaaggcggctctcatcgagggcggccatgtcaaagatgcctggtgttacaaaacaccattggatgccatttgtgtttgtttgttctgcagcaaatgattaattaatctcaacaacaaaaataaagggtttctgctaaatgaagtacttgctgctttttctctctgaaaatgagaatcagccacccaaaaaaaaaa

SEQ ID NO: 7759 - DNA, 977 bp, Triticum aestivum
  Clone ID: PAT_TA_7759
taaattaagtagcccatctagttgcagaattaactactaattgatttggaccaggctaattaaagataaacaagctaggaatggagaagcctgaccttttctcattggggggagacgactctctacatagctgtagaactactcaagagtatccccgtgtcgacctgggcagggcagccatcatacacctcgcatccaacttgtgagcagtaagtggaagagagagagcttgcacccagtggtgctgatggcgtcgaggagcagcgccgacgaaccttctagcttgctcatggaggaaaatgccgtgcaagtgtcggtggatgccaaactgacggtggccgcaggccgtggcaactgtcagcagttgaaggatctgctgagcacggaggattcgaagacaatgctggttgtgatggccccgagcatccaggcttccacggtgaagcctctcccagaggtcatgagcccccttctgctatcatcggcttgctctggcgcctggcaagacttggaatttcttctcaacaggggacacgtccggccgcatccttccatgaattctagtacaaaatttcatgaccttctcacggcatatggctcccacagctgcagcgacaaaggcgcgtcgatgcagaaagcttctgatgatgttgaagcacttctgaacctgccttcaggttctaccgtgtcacttctggacggggtcaccattgaagggggcactgcactccatgtggtggccacatatggtgagagtgatggattcttgaggagtgctgacatcatccatagcaaggcaaaccatctcctgtttgcgcataacaagaatggtgacacgcccctgcactgcgctgcacgggccgggatgtcccgaatggtccgtcatctcatcactctggccagagacgagaatacaggtgttaacagagtgaaggaacttctagaaattgaaaacagccttaaggagacagcatttg

SEQ ID NO: 7760 - DNA, 966 bp, Triticum aestivum
  Clone ID: PAT_TA_7760
gccgggtcccccccgggggactcatcgcaggattcccaagccgtggatagtgtccgaccctacaaaataagttccacataccaccgtagagagaataatatttccacaaatccttaatatgctgacttgttttggcaacacgacatcatgccctggcccggtgcttattcgaaccgtttcctttaactagccccgcacataacgcgaggtagttttttgacacgtcttgtcacagcagagatcgtgtccccttatcacggggattctcatcaagtacgggtgtggggtaacccaaccgcgccctcggactccgtcacattgcgggcaagcccggtcatctcggcaagcggccgcgagatcaacctcccccatatagcggcaggctggtcccttctcccccacccttccctggtggcccaggggcgtatctttcgatctggtccagatggccgaacgagtcggcccgcagtgcgaagccgccgaatacgaagatctgcccggggagaaaagtctcatcccggaccgcatcgcgtttggcgagccggcttccctgccgccccttggccgaccacacagcgggtccccctattctgggattctcatcaatacgggtgtgggtaacccaaccgcgccattaacagcggcgcttgggagataagcgagttttattaggccggtggggggctcgtagttttggccgcccatataaggggagccctttccattcacgccctcttcctcctctgcttatccgtccctgcacgctcgagctccagcgcccaagcccgcacttcccacctcaagcttctccatccatgtctggagcgagaggtagatggatggcctcctccgtcacggagggacaaatcaaaaacctgaggaaggccggatacttgtctaacgacatcgcgcacctgctcccagatgtggggcaactcatccccacccccaggccccatgagatgg

SEQ ID NO: 7761 - DNA, 832 bp, Triticum aestivum
  Clone ID: PAT_TA_7761
gatttctaactctggaaaaaaaaaaaaaaacaatcaagagacacacacaggtctagcagatccagagccgaagatgagcggggtgaagaaggtgacggacgttgcggccaaggccgggaaggcgatcgactgggacggcctggccaagatgctcgtctccgacgaggcccggaaggagttcgccaacctccgccgcaccttcgaggacgtcaaccaccagctccagaccaagttctcccaggaaccaaagccaattgactgggaatactacaaaaagggaatcggatcgaaagttgtggatatgtacaaggaggcttatgatagcattgagatcccaaagtatgttgacactgtcactcctgagtacaagccaaagtttgatgctctgttaattgaaatgaaggaagcagagaagacatctctgaaggaatcagagaggatagagaaggagattgctgaattgaaagagatgaagaaaaagatcagcacaatgacagcagacgagtactttgcgaagcaccctgaactcaagaagaagtttgatgatgagatccgtaacgattactggggatactagataacggcgaaagtccaagttcttttactagaacattcaataatacttatttgtccctctggaatctcatcatccaaacttgaattccataacatgtggactgggcttgttgaaattccgacataactcagatctttgtgctttctgttggacctcatcattttatgggtcgccagcttatttcattgaaattttgtcttgtgtttaactttgctcctttgtacaagaggatttctgctatggcttgattccaac

SEQ ID NO: 7762 - DNA, 927 bp, Triticum aestivum
  unsure (1)..(927): unsure at all n locations
  Clone ID: PAT_TA_7762
agtcctataactctggaccgaacgcctggacagaaccggccgaacactcaagagacacacagccctagcaagtctagcagatccagagccgaagatgagcggggtgaagaaggtgacggacgttgcggccaagggccgggaaaggcgatcgagtggggacggcctggccaaggatgctcgtctccgacgagggcccggaaggagttcgccaaccctccgccgcaccttcgaagcacgtcaaccacccagctccatcaaccaagttctcccaggaaccaaagccaattgactgggaatactacaaaaaaagggaatcggatcgaaagttgtggaatatgtacaaagggaggcttatgatagcattgagatcccaaagtatgttgacactgtcactcctgaagtacaagccaaagtttgatgctctgttaatcgaaatgaaggaagcagagaagacatctctgaaggaatcagagaggatagagaaggagattgctgaattgaaagagatgaagaaaaagatcagcacaatgacagcagacgagtacttcgcgaagcaccctgaactcaagaagaagtttgatgatgagatccgtaatgattactggggatactagataacggcgaaagtccaagttcttttactagaacatgcaataatacttatttgtccctctggaatctcatcatccatacttgggtgaattccataacatgtggactgggcttgttgaaattccaacataactcttatctttgtgctttctgttggacctcatcattttaagggttgccagcttatttcaatgaaattttgtcttgtgttttaactttaaaaaacaaagactcgaaaaaaaaaaaaaactttgctcctttgtacaagaggatttctgctatggcttgattcaacatgtaccttgtcgnttgtcg

SEQ ID NO: 7763 - DNA, 962 bp, Triticum aestivum
  unsure (1)..(962): unsure at all n locations
  Clone ID: PAT_TA_7763
ncaggaattcggcaccaacttcgccgccgacgactacagctccgtcgagggtccctccatggagcgcctcttcgagaagggcggcatcttctgcacgtccaacgtaacgaccatggtgttcaccggctccactgtcggcggcggctccgcggtgaactggtcggcctgcatccgcacgccgggggaggtcttgcaggagtggtcccgcgaccacgggctcccgttgttcgcgggccaggactaccagcaggccatgaactcggtgtgtgaccggctcggcgtcaccgacgagtgcctgaaggaagggttccagaacaaggtgctgcgccgagggtgcgaggcgctagggctgcctgtcgacgccgtgccacgtaactcgtcggcggtacactactgcgggagctgcaacttcggctgccccaccggcgacaagcgcggcaccgacacgacgtggctcgtcgacgccgtcttgcacggcgcggtgatcctgaccgggtgcaaggccgagcgcttcatcctccagagcaacagcggcaagaacggccggagcaagaaatgcgtcggcctgttggcgacgtgcatgagcaacggcatcaccaagaagctgcgcatcgaggcgaaggtgtccatctcggcttgcggggcgctcatgacgcctccgctgctgcgcaacagcgggctgaagaaccggcacatcggccggaacctacacctccacccggtctccatggcgtggggctacttcccggagaacaagcaagcggtgcccatcaccggcaagtcctacgagggcggcatcatcacaagcatgcaccgggtcaccgcgcgcaccatcatcgagacgccggcgcatagggccgggggccttcgccgccatggtgcctgtgggagtcgggccgcgatatgagggagcgcatgagccggttcgcgcgcacggcgcacgcgttcgccctcgtccgcga

SEQ ID NO: 7764 - DNA, 1359 bp, Triticum aestivum
  unsure (1)..(1359): unsure at all n locations
  Clone ID: PAT_TA_7764
cgaggcacacacacacaaagnagnagagagagagaggagacgggagaaaggtgatcaattaaagggccaggaagcgtcgcgagcagtatgggtattgaggttgtactccaatcttccaaagaggagctggattcttccattgtccctccatctagcgacaacatggaaacgccggatgataagggtgaccgtttaacggaactttcgggcactatcaatgctgaaagttctttgggtgcacagtcagacaatggcatctcagaaccattagaagctgctgatgtgaatggagatattgagcatgatgattcctcagccactggccacgctgaacagaatgatgatgagcccgttgcagatgaagcctctcccatcatcatcgagaaaggagacgtggtgcaacattgtgttgaaattagtgcacatgaacaagagaatcaagaaacgtttccagcgacagaaacagcggcaagtgatggttactcagtcacatccatggaagatgtgcagcctaaaaaaggtgctcagtcagagccaggagatgttagtgggtaccctcctgatctacccagcgacaagaattccactgggaatggaaatgtctatgagaatgcaaagtgtgtattgacaagctcgacgaagaagatgaagagaagcgcgtctgcgactacaaggaagcccctacaagctacaaacagaaacagtcatccggatgactggaatgcttccactctcactaactccaaatcgtcgaatggaaagactactactgtcccgtcaagcccggtcttcagatgtaccgaacgtgccgagaagcgcagagagtattattcaaagttggaggagaaacatcaggctatggaggagcagaggattcagctggaagctaggttgaagagagagcaggaggaggctcctgaggctactcaaggaaaagcctgacattcaaaagccacacccatcccaagcttctaccatgaggcaccttctccccaaaggcttgaattacaagaagttgcccaaccgaccccgaccccaanccccgagcctttagggaaggaaaagaaaagcccgcccattgaacaccttcgncactccatcccgggagggaagagccgaagagcacgagcccctggctgcccgcgcnaagcccgcgaacagacacgacagccactggcaaataccaacaagcaagcaagcaagcccacgacaagcaagcaacagcanacatcccttgcaagcaactccatcccnnaagaagccanggcaagaccatgcccaaaagttatcggggctcaaatnnccgtttgcaatttcnaaccgtttttttttcccncccggaatactggttncnngcaa

SEQ ID NO: 7765 - DNA, 912 bp, Triticum aestivum
  Clone ID: PAT_TA_7765
gcctccgggcacgaactgccgccccagggcttcctcctcctctccctcccgcccccctccgccctcccccacctgaccccccccaacccgcccagtccggctgccggcccgccccgctccgaccgccgtcgccgacccgcccgcagccgcccgcgttcccgccggccccgcccccccgcgcccctccggaccgccggccttcgccgcttcgcccgtcgaccccactggcgccccatggcttgcgcctcgtcttcctcccgtaccctttcgccctcctccgcctcacccgccccgccctgttctgctcgtacgccgtccacttccctctcgccgtcgccgccgttccctgctcgtactcgtccgcgcccctccaaatcgccggccctcctcgctgcgtcagccggcgcgcccggatttcccgggcgcgggttccgagtgagctgtcggtacagggtagaactgcttaatgatacacatcagtctgattttcaggttttaagtctggaagattaccaagacccaagggtattgcctgagcagagtaattgagttctaaatctgccatcatgtttaattgaagagttaatgaaaaagcattgttgatccataagcaagggcattgtggttggcatcatgccacatagaaatatgtgttggacacatcagggtgataatcttgaatcagaggaaggacaagctcagcctgaaaattacaataatggtggcactgggagtaatttatccaatcaaggcgtgcaagttgctcttggagttccaggaaatactactagtgatggagtccatgattcacggagttactatgagagcattaataatcagcgccagcttgctcagaatttatacccatatggaggcgttgatccgagttttgtctacccatcgactatgtac

SEQ ID NO: 7766 - DNA, 740 bp, Triticum aestivum
  Clone ID: PAT_TA_7766
agctcatccagggcccgacgtcgtcctgctgccgcccgggggccgcctcgccccgctgctcggcgggcacctccgcgcgcggccgcccgtcccgcaccgcctccgggtccgccgcccccgcgcgagtggcccgagcgccgcctcagttcgtggagggcatcatacgcgagttcaagcagcaaacgaagaaggcgatcgcggtgtaccccaacagcggcgaggtctgggacgggagagccaagaggtggctgccggtggagtgcttcggccgcaagagcttcgacgtgatggcgaggaggtggcaggaggccggccccggcggcgtggcgggggccggccggccggcgccagccgaccatccgggcggtctccaaggacgctcaagagcaggaacgaccagtgatatcttcttcagaagttcagagtcgcggtctcgtttgagggttatattgtcccgagggggtgcggtacttccgctggtgagtactgctggcgtgcaccaatcgtacttgggcacgggctatccacgattcgggtataggctgtggtagagaaatatttctatatcgtttggatgtcaggttctttaccaaaatcagtcccatcagggtgttcgaagatagctgctccagaaaatcatgagcagcttattttgtaagaccaccctgatctaagcagcgtgtcctgtacccatccctctaaataacccggcagccccccatgcctacttgacaaaaaaa

SEQ ID NO: 7767 - DNA, 642 bp, Triticum aestivum
  Clone ID: PAT_TA_7767
tcggcacgagggtctcttgttagatgggctacgcctcagcttcatgacatcgatgcactttctaagatggttgatccagcattgaacggaatgtaccctgcgaaatcactctcccgctttgcagacataattgcactctgtgttcagccggagccagagttccgtcctcctatgtctgaggttgtccagcaacttgtgcgcctgatgcagagagctagcatagtaaggcggcaatcaggcgaggaacttgggttttcttacagagctccagaacgcgaaggagatgcgagagacatttccttctgagcattttcttgaatggcaaaagtgaaaaggaggtctgagggacaaatacaagaattgggtgactgcacatgaactggatacatgagttgttcagttgttcagacggttgaggatcaaatgaatttgagaagataattttggtatttacattgttcaattatgctcattcttctcttcgttttgttcggggtagtctacttcacagttaaactgtgttctcaaatcaagggcgtgtacagcatgttagtcggggtagagaaaagaaatgttaatgcaacaggataactctgttggatgtcaaacaagtacataccggtccctccgcattgcaaaaaa

SEQ ID NO: 7768 - DNA, 949 bp, Triticum aestivum
  Clone ID: PAT_TA_7768
gaattattcagaaagaagtaaagacaatggctcaattccagaaagagtatattagattcctgcagtataatgtcaagtgagaaaaatagaatctcaactgtgctatttgtttatcatttagagtaatatttctcttcattgccaatttatcgttgctgctggatgcacttactgctaacaattcatgaactcctgccagcatcccgggacgacggcagagaacagccctccgtcgatccccccgcgcgcctccgtctcgctgtcgccgcttcaactgccggccggccggcagcgctgcctccgaccagctcgcccggcggaaacatgatcgtctgcgtcgccgtcgtcggccaccagaacaacccgctgtacctgcagagcttcacggaggcggacgacgccctcaagctccaccacgtcgtccactgctccctcgacgtcatcgacgagcgagtgaacaatcctaaaaagagtgcacctacactgaacgaaacatttttgggtcttctatatccgactgagaactacaaagtgtatggctatttgacaaacacaaaggtcaaatttttaatggttactactgatcttgatgtgaaagatgcagatgcccgaaattttttcaggaagttccatgctgcatacgtggatgccgtctcgaaaccccttccacgtcccagggaagaagatcgcctcgagaagcttcggcgcgagaggtgagcaccatagtgaaatccttcggctcagggactgtcggttaaaaaccacatcggcctgagcaccctccgcaatcaattgtcatgcgctttccaccttaaccggcaacctatctttacctccattgtgtatcactacatgtatgttggacaagaactagtttgatactcgaggaagaatatatatggctgttattgattactaagctttaggcctaaaaaaaaaaaaaaaaaaa

SEQ ID NO: 7769 - DNA, 889 bp, Triticum aestivum
  unsure (1)..(889): unsure at all n locations
  Clone ID: PAT_TA_7769
tgcaggnaattcggcacgagggtttgttattagtaagaaaaaagaccgctcgctgacatcaccacagtaccagaggcgcagtgtgcttgagcaggctaacaattccgatttcgtcccatttgttccgtttccgcctcgtgattttgccaagaaagatgcgccagcggagagtactccagatacgggaatagtgtcagaaagttctccatcagctgataagctgccagaaacaaatgctccatcaagacattcgggaaatagcccaaacacctcacaggtgattggccctcagggaagtagcatcacgagtaatgagaactcgaataggaattactctcagcagagctcgagtccaggtggttatacacgtggtggaagcagcagccagcagtatcaacagcaaccttatggggtgggtgatcgatctgctggtacaccaaattcaggcgcctggaacccaaactactcccaggggacgtctactgatgtcagaggaggatctagcaactatcagcgtcaacagcaaccccatgagggcggtgatcgatctcggggaacttcaaatactggtgctttgaacacaaaccactcccccgggaggtttaatgatggcagaggtggagctagcaactatcagcatcaacagcaacctcatgaggcgggtggtcgatctagtggaacttcgaatactggcgcttggaacacaaactactcccagtcccacgggagggttaatgatnggcagaggtggatctaacaactatcatcatcaacagcaccctcatgaggngggcgatcgatctagtggaactttcaaatactggggtcttggaacacaaactacttccagtccanggganggttaatgatggcaggggnggatntagca

SEQ ID NO: 7770 - DNA, 1266 bp, Triticum aestivum
  Clone ID: PAT_TA_7770
gcgcttctcccgaccatcgctcgccgtagcctagccgttcaccgccgccgccgccgccgccgcctccactctactcccataaaacaaaagcgtccccagaagccgaaccttttgcttcgacccgcggcgcccgaggaaaagccgaacccaaccctaaccctagcccgagggctcctcgccggcgtcggcgatggagactactgagtcggagccggcaccggagcttcccgcggaggaggagatggcgctcatccgagatatcaccgccgccgcggaggcccacgccaaggagggtgacatcttcttcctcatcacaaacaggtggtggcaaagttggattgactatgttattcatgatttggctggtgtaccaagtaatggttctcatcatcatgagttcggttcaaatactcctagaaggccaggagctattgacaatacaaatttgttggatgacatggcatctgaagtctccgacatgcagattgagctacatgataccttggttgaaggccgtgattatatattgctccctcagcaagtctgggaaaagctgcatagttggtatggtggagggccaacactaccaagaaaggcaatcaatactggcttgtctcaaactgatctagccatagaagtttatcctctacgtctgcagttacttctgatgccgaaaggagagcaagctgtagtaaggataagcaagagggttacagttgatgtgctccgtaagaaggcgtgtgaggtttttgatttggtaccagatgaggtgtgcatctgggactactatggtcgaacaaagcatgctttgatggataacttggagaaaactcttgatgatgccaacattcaaatggatcaagatattctcgttgaagtcaccactgatgcaaatggtagtttggatggtgcgtgcatgagttcaatccaagaagattattttggaagcacatcaacttatttgatgacaaatgcttcaaaatcaggatgcttgaatgagaatttagcatcactctgttatggttccagaagctacagctcgagtctcatgcaaagccagtacctgcgctcttccagtggtgacttggataatgttcctggtactgttggtatgaccaccaggggatctccgtcaggtcttactgggctacttaacttgggaaacacatgtttcatgaacagtgctgtacaatgtcttgtgcacacaccagagtttgctagatattttcgggaagattaccactgtgaaattaattggcacaatcc

SEQ ID NO: 7771 - DNA, 1770 bp, Triticum aestivum
  unsure (1)..(1770): unsure at all n locations
  Clone ID: PAT_TA_7771
ctcgacctctccttnacgccttcaacgggaccctgcccggggcgctctccaacctcacccagctcgtcgcgctcaacctctccaacaactcgctctccggccgcgtcccggacctcggcctcccggcgctgcagttcctcaacctctccaacaaccatctcaacggccccgtgcccggctccctgctcaggttctcggacgcctccttcgccgggaacaacatgacgcggtcggcgccggtgtcgccagccgttccgccacagtcactcgccccgccggcggccggtgcgcccgccaagaaacggacaaggctcagcgaggcggctgttcttgccattatcgtcggcgggtgcgttatgctgttcgcggtcgtcgcggtgctgctgatagccttctgcagcaggcggggcggcgacgaggggagccgggcggggtccgggaagggcggggacaagaaggggagggagtcgccggagtccaaggcggtgaccggcagggccggggacggcaaccggctggtgttcttcgagggcccgtcactggcgttcgacctggaggaccttctccacgcctccgccgaggttctcgggaagggagcgttcggcacggcgtaccgggcgctgctggaggacgccaccaccgtggtggtgaagaggctcaaggaggtcagcgccgggcggcgcgagttcgagcagcagatggagctcattgggcggatccggcacgacaatgtggcggagctccgggcgtactactactccaaggacgagaagctgctcgtgtacgactactacagcaggggaagtgtatccaacatgcttcacgggaagcggggtctggacagaacaccattggattgggagactagagtaaggatagccctgggcgcagcaagagggatcgcccacatccacactgagaacaatgggaaatttgttcatggcaacatcaaggcgtcaaatgtgttcctcaacagccagcaatatggctgcatctctgaccttggcttggcgccactgatgaacccgatgaccgcaaggtcccgttctctgggatactgtgcacctgagatcaccgacacaaggaaatcaacgcagtgctctgatgtctacagcttcggtgtctttgtgctcgagctcctcactggcaagtcacctgttcaggtaaccggcggcggcaacgaggttgtccaccttgtcaggtgggtgcagtccgttgtccgggaggagtggaccgccgaggtgtttgacggcgagctgatgaggtaccccaacatcgaggaggagatggtggagatgctacagatcgccatggcatgcgtctcgaggaacccagagcggcggccgaagatgctggacatggtgaagatgatcgaagaggtcggcaggaacgacagtgggacgcgggcttcgacggaggcctcgacgccggtgggggaagctcggaacaaggcagaaagctcatctgcagccccctgatggagttctccgaagtatcattttttttttctgtctttgcaagggtaggagcacggatagttctgtgtcttgacggcgctgcatgattcttttgtcttatgatgatttacatgttacgaaattgtaacaccttgccatgtggaactacggaaattgtttgcttattatgcagcacctgctcactgcttttctgcaagcaaccggacccatgtctggtctgtaatcacgggcggccgggttccaggttcccttgtcgggccccaggttaaggggaaccaggttttttttccaa

SEQ ID NO: 7772 - DNA, 2023 bp, Triticum aestivum
  Clone ID: PAT_TA_7772
ggcggagcgccgtccggaaacgccgcccctcggaggaggggagaccgaccaccggagcaagaagcaagggagggcccggccatggccctcccctcgccctccccctcgccgcgctgctcctctccgccgccgcgcccgcgctggctcataccccccccgtcatgccccgacggttggcaaatcagtcctgatcgggccaaatgcttcatgcacatctcaacctccctttcctgggacggatccgaagctctctgccgcaacttcagcggtcatctggctgcattatcatcagttcaggagctgaatttcgcaaggtctctctgtggagctgcctcctccgggtgctgggttggagggcgtcgccacaacaccagtggtagtgttggtggctggaaatggtctgacaattcgtcttcttggaacgagaccgcatttcccggtgagccgttgcatcccaattgcaccggtgctcgctgcggtctagccccctgtgacgatatgtgcactttggtgaccagtaagcacactgcacttaccggaaagaagtgtgctgagtcacatgggctgatttgcatgatgaatcacgaagatagatgctaccatgatcactgccacaaggagtatttcatagtcctcatcgtcgtaagtggcttgattctctcaaccactctggctgttgtggtttggctgctcgtctacaagcgaagcaagaaaaggaaaagatcacgtgaagcttccggcgcttcagctaccgcgttagtgccaccgctatggaaagtgttcaacagtgaagagcttagatcgataaccaagaacttcagtgagggaaaccggctgcccgggaatgccaagacgggtggtacctacagtggaaccttgccagatggatccaaattagcaattaagagattgaagagatccagcctacagaggaaaaaggatttctactctgagatcagtagagttgcaaagctctatcatcctaatttagtggctgtcaaaggatgttgttatgatcatggcgaccgctttattgtctacgagtttgttgccaatgggccgttagatgtgtggctgcatcagattcccagaggagggcggagccttgattgggcaacgagaatgagagttgccacaactcttgcacaggggattgcatttttgcatgacaaggtgaagccccaggtagtccaccgtgatatccgtgcgagcaacgtccttctcgacgaggaatttggttcccatctgatgggggtcgggctgtccaagtttgtgccgtgggaagtaatgcacgagcggaccgtcaaggcggcaacatacggataccttgcccccgagttcatttacaggaacgagctgacaacaaagagcgatgtctacagcttcggcgtgctgcttctagaaatcatcagtggccgtcgcccagcgcagtcggttgaatctgctggatggcagacaatattcgaatgggcgacgccgctggtccaatcacaccggcatctggagctgctggacccgctcatcaacgacatgccggagataggagtgatccagaaggtcgtggacctcgtctacgcctgcacccagcatgtcccctcggtgcggccaaggatgtctcatgtcgtccatcagctgcagcagcttgagctaaagtcagcggcgtctgagcagctgaggagcgggaccagcaccagcgcgacctctccgatgctgccattggaggtccggacacctcgctgaaaccatcggtctagaaacaccgctgtgctgttcttctcatcgtcagccattaggtagcgcatttcttgcagcgtggagtgacccaagagcctcctgtaaccataagcgcaacgactttcttgtgggcaagtacttagggagagtagggtcctggaggtctaaacccctcgtgcttgccatcgtcgtcgagggccatttgtaccccagctgatttctaccttagatctcaacatgtctgagtttagcaagcaacatgaattgttcgatgtctactcagtagatg

SEQ ID NO: 7773 - DNA, 985 bp, Triticum aestivum
  unsure (1)..(985): unsure at all n locations
  Clone ID: PAT_TA_7773
gcacgagggtctcttttagccgccgccgtgccgatccgacggaccgaccgaccagaaaaccctagcccgtcgcgccgccgccgccgccaccgcaaaatcttaaacccgcacgcacctccccctgccccgacctcgccgtcggcgtcctcagccatggcgttcaccgcccgcatgaaggacctcatgaggaagtacggcaaggtggccctcggtgtccacgtctccgtctccgtcgcctccgtctccggcctctacgtcgccatcaacaacaacgtcgacgtcgacgccatcttccgcaagatcggcatcagcgcccccggcaccgccgcaggcgacgcggccctgcccgccccctctcccggcgccggcgacggggccctccccctccccgcccccgccgtcgtcgtcggccaggaggcgccgccgcgccggcccggggagctcgcggcgtccagcggcggcgcgctcgcgctcgccatcctgtgcaacaaggccctgttccccgtcagggtccccatcaccatcgcgctcacgccgcccatcgccaggctcctcgcccgctggaagctcgtcaagagcctcaagcagacctgagctgtgtcctattgcaagtgctctgggagattgctgcatccagtccaggattcaaggtccactttccagggcatccgcaatggggctacgccgtaaattactccactctgccgtctggtgccattgcacctgtttattttgtcaggtcatggatgcatgcacttgcaagatagtttcatacgcaggaattcttgttatcctctgaactcagaggcggcaactcattctctgaattttgtaacttatacaaaaaaagaaggctgagaacagaataagcactattatgattaatccaagtaggtttatttctgtgacttttcaagattggtgatatcacattctgttatcgacatttggtctgtgaggcaggtngaattcaagcacaaatctt

SEQ ID NO: 7774 - DNA, 1281 bp, Triticum aestivum
  unsure (1)..(1281): unsure at all n locations
  Clone ID: PAT_TA_7774
ccacgcccccccccccctgctctgctccgctgcgctctggcggctgcggccgccagcgcgaggcgacaagaagcaggatgaagagcctgctgggggaggagcgcagcttcatcatcgagagcgacgacgacgacgaggaggatcccgcccacaggggcgacggcgttggccatggggacgacgggtcgtcgtcggactcgtcgtcctgcgccaccccgcgcggcggcggcggcgacagccagcccaactcctacaccaaccaatggccgcagagctacaggcaatcgatcgacattctgagcaacgtgcagtcgccgagcctggggttcctggggaccccgacgctgagctggctgtccaactccttcctcaacagctccttcctcaacagctcgttccgaggcaaaacccctgagatcgtctccaatctcgtcaagccgctcatacgccccaccacaagcgacgagcaacagcaacacatacagcagcatgaggatatccggaagagctcgcagtacctcctgccgtcgaggaagccgtcgctgcagcagatccccgaggatcagaagccgctggtggttggccatgaggtttctccctaccagcagtgctcttacacccagggagctatgaatggaataaatgttctgtgtggtgtcggaatcctgtcgacgccttatgccatcaagcaaggggggtggctcggactggtgatactagttgtatttgctctgctcgcatggtacaccggtgtgctgctgcgccgttgcctagacagcaaggagggccttcagacatacccggatatcggtcatgccgcctttggcaccaccggtcgcatagccatctcgataattctgtatgtggaactgtatgcctgctgcatcgagtacttgatactggaaagcgacaatttatccaagttgttccccaatgtacacctgaacattgggggcttgacgataaactcgcatgtgttcttcgcaatcttgactacgcttgttgtcatgccgaccacctggctccgtgacctcacctgtctgagctatatttcagctggaggtgtggttgcatcaatccttgtagtcatctgcctatgctggattggggttgtcgatatgtcggcttcgagaacaaaggactgcgttaaacctcccgggaatcctatcgcgattggactgtatggtacgctaccaggcatgggtgttccaaacatataccctctcgaagaacgcaacagttccttcatcnttcactgcatgggtttcacaattgttacgn

SEQ ID NO: 7775 - DNA, 844 bp, Triticum aestivum
  Clone ID: PAT_TA_7775
gtggatcccccgggctgcaggtacattggtgtttgctctctcgtaggttccatctcggtcatgagtgtgaaagctcttgggatagctctgaagctcacctttttccggaacgaaccaactcatatatccccagacatgggcttttactatggtcgtcatctcatgcatcattactcaaatgaattacttggaacaaggcccttgacacatttaacacagcagttgtatcccccatatattacacaatgttcacatctttaaccatcttggctagtgtgattatgttcaaggactgggaccggcaaaatccgacacaaatcgtgacggagatgtgtggcttcgtcacgatcttctcgggaacatttctacttcacaaaacaaaggacatggctgatgggctttcgaactcttcttcattccgtcttccaaccatttcatcggcgcggtccttcaagcagacagatgagtatagcgaaggggttcctctcagatcgtcggactcgttccggtcactgcattgatgcccggtcagcgcgccgtgctgaccatcgattttcaccgagctagggctcaggagcaagcttgtaatcaaaactgtctcgtgtgcgttgtatctcggctgtttcgtatgttctgggagcattgtggctgagccccaaggtatctaagtagtacgtaggttgttggcttagcaccggagtgggagttgttctgtataatggatggatgggttatcaagcaggcagggtgctgaaattttaaccctgctcacttcgctgttcagacaatatctaccaaaaggatagtgaaggtaaaaaaaaaaaaaaaaaaaactggagactag

SEQ ID NO: 7776 - DNA, 440 bp, Triticum aestivum
  Clone ID: PAT_TA_7776
ggagagaacaaccaagcactacccaacccagcagtacaagggaaatcctatcaaccgacgccaaatatgaagaccatccatatggtactgctcctagccatggtcctcgtcgcatcatcgtcaggcggcatggcgggcaaggcagttgggccccagtacttccaagacacttgctcggcggtgatcccgacgggtaccaagtgcgaggcggccaagtgcaaggcggactgtgcgcgccagttcaagggcggagttggtggttgcgccgcccatggttgccggtgcatctacacctgcaccttcccaagtagtatgtgaccttgatgtagcgaccggggctggatgctgaccagtatgagaagagggtcatatatgtgcttgttattattcttgaaatttaatataaatggaaaaggaaatgttatgtagtaaaaaaaaaa

SEQ ID NO: 7777 - DNA, 477 bp, Triticum aestivum
  Clone ID: PAT_TA_7777
tcgattaagtatgtccagactggactacagtaaatgggatcatattgaaatctccgacgacgaagatgagacacatccaaacattgacacaccgagtttgttcagatggagacatcaggcaagagtagaacgaatggaagagcagaaaaaggaaagagagcaattggaaaaaggcaaacaagcacataagcagaagcttcaagaagtggaacagaaattgaagacccaagctcttagtgaagcggatgcaaaaaagatgagcatgaccaaggaggagctcaagaaacaagaggaggagttccaaaagaaagagagagaattgctcaaaaaagagaaagagcaaccatggaatattgatacaatttgtaaagagggtttcagcaaatcggtgatcaataaaaaagcaaacgacgatgataaaaataaaacagaagaagaattatttgaagagcaaaagttgttccagcaaaaaaaaaa

SEQ ID NO: 7778 - DNA, 1060 bp, Triticum aestivum
  Clone ID: PAT_TA_7778
gccggcccacgcgggcggcggaggcagagaaggagagcggcagctcgcgcgcgcgcgcccccattgccgccgcagcaggagcccgccgattccaatccaaggaggagctttgaaggtttgtcagggcggggaagatggttctcaagacagagctctgccgtttcagtggtgccaagatatacccagggaaggggatcagattcatccgctcagactctcaagtcttccttttctccaactcaaagtgcaagagctacttccacaaccgtctcaagccagctaagctcgcatggacggccatgtacaggaagcagcacaagaaggatattcatgctgaggctgcaaagaagaggcgccgcaccaccaagaggccgtattccaggtcaattgtaggtgcttcccttgaagttatccagaagaagagagctgagaagccggaggtccgtgatgcagccagggaagcagctctgcgtgagatcaaggagcgcattaagaagaccaaggatgagaagaaagctaagaaggtggaggtgacgaaatcccagaagaccgccggcagaggcaatgcccccaaacccgggaaggcccccaagcttggcggtggtggtgggaagcgctaggtggcgtccctgccgatcaatgcgaaattttgaactagttacatgatgtcctaccctgtatcttttaggtagtttttggctcaaacctgctgttgccgtcggtatgcagcatctgggtgcataaaccagtggtggatcagtgtgaaagattgttttatgtttctcatcaatgtgagattgttttatggttaaaattccgcaccacacttgtgcgtgtttgtctgtcttctccgaagaacctttctcatgcccttgtaacggtgttatcgatgtggcgcactgccgccataatgcgaccttagcggttattcaaaaaatcaataaaacaataatttattataattaaaacataatataagttaaaatattttgtcttgtaaatacttatttttcttaaaaatcaggggcggctcttctaatggatccaagtttttttaccc

SEQ ID NO: 7779 - DNA, 766 bp, Triticum aestivum
  Clone ID: PAT_TA_7779
cgaattcgcggccgcgtcgactggacttttttcaccggaccgcacaagaggcgcccacacatggcaaggtgttgccaacactgacacccgccaaggcatgtgcgcccaagaggagatggatctgcaagaccgacttggcgacggcagaggccgcggcacccaagatcaatccgccaaaaagcgagctgctcgtgaggccaccggaagtctcctactccatcaggtctcctcgttgtcttcatttcttgcccacgacctcggagagcaaggtcatcttggccgatcgcgcgaaccgcatgttacgcttcgacaccattgacggttgcagctacattgatacaatgcctagcctcaacgggtacaagcactcgccgctggccatctctgtccctccgacggacttgcacctccatggacggcgaagacaccggcaacctctacatcattgacgctcacctgcaaggcgagtacctcggggcagagcccgcgctaccgtacctgagcccctacatgcgcggcgagaacctgctcgtcggtgccaacttcgcgtccgccggcgtcggcatcctcaacgacacaggcgtgcaattctcaagctccacgcgcacgaacacacacatgctcgaatcatgtatatgtatctacaataatgcaatgttgatcctacttgttttcaggttacaatttctgtatatatactacaatgttgatccaacttttcggccctcgttctcctatcgtataaatatttcggtgaaaaaaaaaa

SEQ ID NO: 7780 - DNA, 241 bp, Triticum aestivum
  Clone ID: PAT_TA_7780
tggagcacaagcatccataataaacaatcaagagtaaccacaaattcaccatgaagatcttcatggtctttgccctcctcgttgcatcaacgaccatcaccaccgcgaccgcacagctcgaccctcgcatccatgaccaagaaaggccacaacaatcgtttctgcaacagcaaccacttatccagcaacaaccatacccgcctcaagagccacaacaaccactattcccgcaaaaaaaaaa

SEQ ID NO: 7781 - DNA, 951 bp, Triticum aestivum
  unsure (1)..(951): unsure at all n locations
  Clone ID: PAT_TA_7781
gcacgaggagaaatcagaaaagggcgaagagcccgcagtagaagaacagcgcgaaaaaggggtgttcattcggagccaatctcgaagcggtggccgggagtaccctcgtgcggggatgcgcccgtgtctccatcgaccagaagagatagaagtactccctcagctccttcgcgccgagctgaggggagaagagggcccgctccttccgcagcgccgcgagccgttgcgcctcagccgatttcacgcccttccccttgtcggctttcgaagccatggcggaggtagcgagggagatcggcggcgttggttgcgccggtngcaaggcgcgccggtgcccgcttcttcttctgcctgtgactccaccgcgccccccgccgtcttgttgccgggcgggccgcccgccgccagggggggcgaactgcccctgtttcctctgcttataaagagggacggggcggacgtttcgcccttccgaataaacaaaccacccacgatctctcccacgacgccgcattcaacgcgtgccgttatgggagagcgtggtggatacggagcgagattcggcggggcccaccccccgggtgcccctcccctagcgtgggcctggcccgttctgcgctcggcctcgtgtcgggcctcggcccgggggctcctgtcggtgtactagaataggggtaccctagtaccccgaacttgtgcacgggcagtcgcagcaccccgcggcaaggcttgccgggcgaccgccgaggtcctccgtggttcccttggagccattcaagaacaaagtatttaagcccaggagacaaggccccggcaagaggagcttgccgggaaggccaaccaaggcaccccaaggaacttgccgcgacgcgccacgcgccccggcaaggcagcaaggccccggcaagaggtgcttgccgggaagaccaaccgagccnaaggggggggggc

SEQ ID NO: 7782 - DNA, 2052 bp, Triticum aestivum
  Clone ID: PAT_TA_7782
tcgaccccggcaccgggaagccagtaaatcggtgggaggatcctcgtttgatgactgaggacaaaaagatgccagaaggaatagcagctacagcaaactactctcctctccgtcgtattgggataacgaggaagtgatattagctcaattcgtgttgtccgtcttgaatatcatatcatggaagcactgaataaaccagcttcacgaatgcgttgtgggtgtgcctcctttaagcgtcgtgtggactagttatgacccgtttccagccagaacctattggggaaaatagtagcctgaagctcctgcttatgatgattcgtcctagaacgaggaacctgcctcaaaaacagtcttcattgaaaaaactggattccgctcgaggggctcgaaagatagcattgatctgactcctggtaaaagtgccttgcttagatatgctttcccgattaaatggacagaggtttatttatggtgataatccagatgttattgttgaaattcgagccgagtaggacccctctaacaccacgtggactaccagtctgctgcactgggcagcccagccagcgcctggaattgagccgttcaaggttggaataagattgtttgagaatttattcatataggtgaatcctgccgacttgggaggttggctgggcgttctgcaacccgccctcgaaagaagttgtaaaggatgcataagatgtaccttcacgcgcgactgccgtactgggcgaactagttccctcttgagcagcctggctactttgggtttgactcgcccacgtacgcccgagaagattgtattgtggatgactctgaccatcctcgcccattctgggagggctgctcccgttcgactgccgatgcacgtaagactcttcgttacttgttggccagggagacgctaatgggagaaaacatagtcatgacatacaacatgaaaatgtccatgtggccctttttgtttttgtgttgcgtcctgggcttgtgatgactattatagtatgtgttgtttcaatcgatcaagacttgggtaagcctgcgcccacggggagtatcagcaactgcgatcaattcatttatccgtggaattgggataacgagatgtgacaatagcttaatccgtgttgaccgtcttgaatatcatatcagagaagaactgaataaaacagcttctcggaccatggttgttttgcatcctctgaaggttgtaataactaatttggaagatggaaaagtcatagaccttgatggaaaaaagtggcctgatgctcctgctgatgaagcttcgtcctactacaaggttcctttctcaaaaaccgtctacattgaaaaaactgattttcgcgtgaaggactccaaagattactatggattggctcctggtaaatctgccctgctgaggtatgcattcccgataaaatgcacagaggttatttatggtgataatccagatgatattgttgaaattcgagccgagtatgacccttcaaagacctctaaacctaagggtgttctgcactgggttgccgagccagcacctggagttgagccgttaaaggttgaaataagattatttgagaaattattcctctcggagaatcccgccgaattgaaagactggctgggtgatcttaacccgcactcaaaggaggtagtaaagggcgcctacgctgtaccgtcactcgccaccgcggttctgggcgacaagttccagtttgagcggcttggctactttgctgtggacacggactcgacgcccgagaaccttgtgttcaacaggactgtaaccctgcgcgactcttatgggaaggctggacccaagtgactgcaaatttagtgaaaatgctccgtttttcttggtcacagagacgctaatgggagaaaacatagtcatgcatacaacatgccaaaggccaagaggccctttttgtttttgttttgcatactgggcttgtgatgactattatagtatgttttgtttcagtcgatcaaaatttggatcatcatatgctcaaatagttacccagattacctgctcgtactggt

SEQ ID NO: 7783 - DNA, 640 bp, Triticum aestivum
  Clone ID: PAT_TA_7783
ccacgcgtccgagaaaaccaccccgcaggaggaacgcccttcctctcgatcccctcccgtcgccgccgccgtcctctctccgatccctagccccgcaccttctcccatccatcccctcgcctctctttcccccgatctagatggcacctcccaccatggcggggaagcggcttcgagcgccgcctgatctcctcgacccagggcctcacgctcaccagcgcccgcccaatcgcgcgcgacctctccactgcagcgcgcccccgccctgtcgccgatgtcttgatgtgcagcccacgccatgggtctccgccgacgccacgatggtcgtggcctcctcacccgccgacgcctccgctccagatccgagccgccggtgagccgtcaaggtcggggcatggtactatccatcttcccgcgtgtagggcagccggtgcccgcgtccgcgtatcccggccatgggtgttgtattcatctcctacatggggcgacgaggaagatgagcccagcggcacgtgtgtcttccagccgctcttgtgagatcgggaggcaatcaaaagcaggaaggggagatcgatgcttgggggtgacatccaatgacccaggcatcaccctctcctgacgtcttactacaaacccgcag

SEQ ID NO: 7784 - DNA, 327 bp, Triticum aestivum
  Clone ID: PAT_TA_7784
gcgtcgacatcacggccttgaagctgtagaatcggatgcagtgtcgacatgccttcttcttgttcttttgccttaattataatactccataaaaccgactgggaagttggattaggatgcctagctgttttgggcaacatgttgccctgtttcatccttgagcagagcagaaaagaaggaattgcttttaatttgatttgctgagtaatttaagagtagtgcaatagacttcttgctgcaaatcagtaaagcacacggtcatgtacaaatagctttgactttggctctggggattaatttcatttcagcattagtagaaaaaaaaaa

SEQ ID NO: 7785 - DNA, 616 bp, Triticum aestivum
  Clone ID: PAT_TA_7785
ttcggcacgaggcggaagcgaagggagctgcgctgaggggaggaaacgaaggatccgctcgtgcgcgtgctatctgcctccccggtaccaaatctttcagatgtcaagagactcttctgagagaaatgtgtctggaattgatcatatcaagcactataaaaacattatctctgagttgttactcggaaaagaaggcacattctctactggagttgcaaaacaaactgaagttgttatggcccaatataaccgcaaagcgggtgaagattctcttccattattcatggaagaaattaggggcctatcaaaatgtgccatggagagattaaagcatgctctccataaggtttttacaatcctcaatgatgaagttgatgagatatttggttacattttcgcactatctgaatttaggtctgagaagttgccgtcaaaccatggaagcggatcgtatgaggacagtatcgccccaccaagtgttaaaaaacagaaaactgtgacagtttctacaatcgatgcttatgaagaatcgcatggtcatattgattcagatatctttgcacagctcacaagagatatccggctgatagaagaaagtggcaaaacacgtcaagag

SEQ ID NO: 7786 - DNA, 864 bp, Triticum aestivum
  Clone ID: PAT_TA_7786
ggccccgaggtcatccccatcgacgagttcatcgagtggcactgcgtgcgatgcaccggctccgaccggtggttccccgcattgcactgcttgctcaggctggctttcgtggacgagcatggcaacctgttcgtacctttccagtggaacggggaggttgaggacggcgaggagttgccttggtggatgactcacctcgggaccgcagacttctccaagacgtgcaccagggatcgcgtctgcaacacctgtggcggcgccgccttctgcgagcactgctgcggggagcaccaccgaggccacgacacctgcgcagccgccacggacgagacggagggttcggtggcacccgcggggtaccggagggactcgttctgcatcggctgcggcctcgccttctgctccgagctgtgtgcgcaccacgcgggtggcgacggccacgagatcatccccgtcgacgtctacggcgaccggcacttcctgcgatgcaccgggtcagagcccgtggttagcctccgccttcggcgacatcgagacttacgaagacaaggacggcaacctgatggtgcccggggaacgaaagcggtccatgatccctgagccgggcctgaggtacgccactcgccactgcggcggaaccaccgtgccgccggccgctgcgaacccgttcgtcttctaggagatcgatggatgggggtgaggccgtgagggtcgttagctagtgaaggagtggtgattgcctggctattacatctatgatctggaatatcgcgtggcgtcctggcgttggatttgaaccaccatgatcgaggaacttcggaactgttcgaaagtgtcgtcggtggatagatttcgtgtctatat

SEQ ID NO: 7787 - DNA, 634 bp, Triticum aestivum
  Clone ID: PAT_TA_7787
cgggctgcaggcttgggcccacgcgtaagggaatttcctggagaagagctgctccagcccccgccccccgccccaccccccgacccgggtttcggccgaatcgatcccaggaaacgaatcactgcctaccacaccaattccccagcagatcctccgcgattgatgagtattcctcccccactctcttggtggagcgacttggatttggatgcgagggagctcacccttctcttcgatctccccggcccccgtaaacgcctttcgcctcccgccgccggagatagtcccatgggctagggactccacctgcagccaccaccggtgggccggagccttttccgatctgcccgtattctctattcgctctagaagcccctcagctgtgttggtggagccagaaccgatctactagtatatctgtcaatcacaagtgttgccaacagtttgtctacagctatgcattggccacgcgaatgcttaggtctttagtttgtttattatttaacttggagggcaaagaatggcttagttgtgttgtgtgtgtctttttcgggcgattgttacccagatagtactgtgccagctcagcttctggtttatcctgggtttaccatttaatatgagtgccgaggag

SEQ ID NO: 7788 - DNA, 1100 bp, Triticum aestivum
  unsure (1)..(1100): unsure at all n locations
  Clone ID: PAT_TA_7788
gaggattggatnattttgcttttggtattctttgcctgcgaaggatattccgtatgcacaaatataagaaacagcgacagaacgggtggctttgtgagtagtcctttctatccttgggcttacacaagcaacaccatatgctcgtattacatcatggcgccaaaaaaacacgttgttgcagtacagttcacctatttcgaattgcaggatgttgtgttgggaaacatgacagattacctaaaggtcatgtacggaagaaaaaacagcgaaatacctccacaatatttttacgggtcacattcacctttcaattttacatcgactacccaaagacttcgtttgaaattcgtttctgattatcggatcaatctatatggtttccacgcaacttacaaatttgtcaatatccaaacgcattgtgataccacaaagttgccgggcaacgtgacgtcatgctctgacgtagtcaacgaatatgctaccgagtgtcttgcatcctgtcccactaactattcaactatcagtggcgcagacaccgacatggacttgttcaaataggaatttcacagacaacacaacgtgcttgccgaaagcggaattggtacaaagatgcgaggacacagatatgtttggactgtccctttactatgaatgaaatcattgatttctatcgtacaaaccgacttccgaatgatgcaaatgcctctgcggagcatagagcgaaagaggaagtggagttagatggagtcccttcgcctgtcaatcttggtcgttcgggaggtgatttgtatgtttgcaggaggaaatactgcagacaagttttccgaccatggcgacattacccgtttaagtgtggccgctgtagagattccaagcgaagaattgcttgcatggtatgcaggtttcaaacacgttgcaaccgaaacccatccccagggttctttatttgaaatatccgttgacgtccgtctttcgggacctgcctttactgcttattgttctattttactgcattcctgtattgagcgtaccattacatttgcctattttatgtacaactaaaaccccttttgactttcgtactggatgttttgttgtag

SEQ ID NO: 7789 - DNA, 951 bp, Triticum aestivum
  unsure (1)..(951): unsure at all n locations
  Clone ID: PAT_TA_7789
gcccctctgacctctctcccaacacacgtcacacacacagatcgatcgatcgatcgaggaggcggaggagcatcccgatccttatccgcccggcgatcttcgtccgccgtcccggcccggccagccgcaagccccgccggtcgccggcgtctggaccgatccgtctccgatctggtcgattgaggaggaggaggaaggggatcgagaagaggaggggcgggcaagatgatgttcttggcgtgctgctacaacgacccggacatgctcatcgatccggagaccatctaccccacccgcgccgactgcaccgacgcccccaagtcccgcttcaagcccatgcctcgccgcacgctgagtccgaggagatggaagctgctgttcaacgaggagggctgcctcgacgccgctggaatgatcatgagagtgcagcgtgggggcgtccacccaaacatcaaaggagaagtttgggagtatttgctcggttgttacgaccctaaaagcactactgaacagaggaaccagttgcggcaacagagaaggtttgtttttgagctcctctgcaccttgcgccgggcggtgcactccactcctggttgtgggcggtagaagcaatacatagttttataatcttggcaaagattttnaccagccactttcttttnttggatcctaattttggaaataangnttanttnaacnnatagnntantncattcanncttntnngtaatggaaagttnaaatggttnaantaaaagttaaaaaattggggttttttanaaaagntgaccntccacaaaanggggataccnttnaccctttgttttagnggttaattaaatttggtnaaaaagggaaaagtgggttntgcacatgntatgccgcaaataaaanttttttttttttttngggattnccccgttttttnaaaaagtttaagggcaaattaga

SEQ ID NO: 7790 - DNA, 851 bp, Triticum aestivum
  Clone ID: PAT_TA_7790
cgtccgcccaaaccaagcagcacctacttgtctccgcgaatctctccctcccacgctgatctcaatctggccgtccctccacgagcctgcgccccctccctccctccccgccgcatcgccggcggcctcagcttcgcacgctccgatggtgccgagattggtctcttgctagtgctggcggctcaacctgcagaccgcggcaccgccatggaggctccgctgacggtgcagattgtcgagttcaacaccaaggtgatgcaagaggagctgaagaagctggggctcaaggtcaaccaccatgaggccaacatcacgttcctcaagtctgagatctatgctatcgaagagtcgattgctgacctgacaattaaacgtggaaagaaggttgtagcttcaagtaatggtacatcagttcaagaagctgaacagcgtacaattgaaagcatatgtaatcaggacaagacagcagcttcgcttatatgccagctcaagaaacgtcattccacacaaatatcaacaatgccaatgatgaaagatgtccttggtgttgtggctaccttaggaaaaacaaatgatgataatctaagcagcctactctcagagtacttgggaatagacaatatgcttggtctcgtttgcaagacttatgatggcataaagagtcttgaaacatatggcacagaaggcaacattgataagaaaagtggttttcatggactgggtggctcatttggtaagttgctgcatgggaggtttacgtgttttgtcttgaaaacataaggcctatttcttgagaagttgggatctgtgatccacactgatatcttatgctgcgtaaactcaatgttgcc

SEQ ID NO: 7791 - DNA, 937 bp, Triticum aestivum
  Clone ID: PAT_TA_7791
atcagaaaggaagcctatggtctccagtttaggtgccgcaattactgatatgtgcagaccggtttcctgatgaagaagcagtaacctttcaagacaaggagcattgttgatgatgagttcctgtaactgtaacgcgactttgttattttcccaaacagcataactatcaagaccaacgcttttaagggaaagcgagttaatttggatgcaggcaaagccaaaactgcggtgaatcagaagggactccaggacggggcagctggcaatcaggctatgcagcgagcactcggagatgcagacaaattcaagcccgagctgctgaagcaggggaaagtgaatcccttggacggtgctgtcggggaggttggaacattcgatggtgacaacacggagggtgggcgagaatcggaagattgatgccggcggcggccgctcgaagcatgagaactcaagctcctggaggttgcccagagcgtcggaccggagcaaggagtccacggtagtggatggggcgtcaaggaggtcagcgtggatgcagaggcggcggcagggcccttggtgggaagaaatgatgcgtgataaggcaccaacgagctcatccccatgattgaggccgcggcagtcgaggttgagaggggcggaacgccagaggtggcgccaccgggacgcgaggatctgggtgcgggcgccgtccttggtggggaggagcgagatgatctcgccgaggacggcgtcggggaggttgctgatggtgtcttgagccggcggttcttattccgccaactttcttcttcgggtagtgtccaggccggggggcgccggtgccggcgacgccggccgccgcctcatatctccctcttgccggccgttgacggccgctgacttaactttcttcgaactaggaccgcccggctccatttccatggccggcggccag

SEQ ID NO: 7792 - DNA, 811 bp, Triticum aestivum
  Clone ID: PAT_TA_7792
gtcggccatgctccgcccggtcttctttctcttcttcgccgctccgagcatggcgtccctcgcctggtgctccatattcatgtccttcgacaccgggctgcaagatgctcttcttcctctccatgttcctcttcgcctccctggtgtcccggccgacgctgttcaagcgagcgatgcggcggttcagcgtggcttggtgggcctactcgttcccgttgacgttgcatggcgctggcgtcggcggagtacgcgcaggaggtgagggagccggcggcgagcgtgctgatgctcgcgctcgccgtgctctccgtcctcgtcaccctcgcgctcatggtcttcaccgcgctccggcccaacgacctgctgccgcatgacgaccccttcttcgccggcacgctgcccccgcgcgctagctaggttagcatatgcagacacgcggattctggtagcccgatcatgacgtgccagccgtttcatcagacgtgtacagatacactttgtacgtacagcaggatcgggacggcggtagacgtcgtctatacgatgcgtgtgttgcatatatgtgtgtgcacgtgtacatgtaatgtacgtaatgtcaattaggggtggagacgtgcacgtggtgtaacgatatgattctttttcgctgtcacctacctggggaatcgggatgatgccgatcggaagtcccaggttctgagcctacgaaatgtgcttatcaagagcgaggagagctggacgatcgagatgcttcaaactaatttcttgtcttgtatctcaaaaaaaaaaaaaaaaaaaaaaaaaaaaaaaa

SEQ ID NO: 7793 - DNA, 937 bp, Triticum aestivum
  Clone ID: PAT_TA_7793
gtctgccccggcggccccgacgctcttcgggacgcgtgcttgcgcaggtccggccggacgcgcgggcggacgggcggcgatcgccacgctgcggctgctggtgatacttcatagttttgccaacgtcaagtaatggttaaaatgattggtactgagccatcaagtgaattagaatgggatgagccattatgaagggtgccaatcttttcctatggctctgggcatatgctaaatgatatcacatcatcttgttggtttacatatttgttggtattcttgacggacgtcggccttagtccaagtgatgctgctattgtcatgctttccggtcagttggcggatggcttcacaacaatctttgttggtgagctgattgatcgttttggacatttcaaactgtggcatgcaggaggatctattcctgtagcaatttccttctcatctgtttttggtagctgtttgccttgcaaactcacggggactaattcgtcaactctggagactgttggatacagcatatttgcctctatttttaatgttggttgggcagttacccaagtcgctcacatgtcaatggtgaactgcatgacgtcaaacccaacaagtcgggttgcactagtgagctgccgcaatgccttcacgatggtcgcaaatcttagcttgtatggcattgccttgttgatatttactctaatgcggtcagtgagtgtattagttcagtatcgttggattgcttatacggccatttccatcggatgttgttttgttgtcgcgttcttgattggaacaaaagagccagggttaattcaaccttctcaggataagagcctgtccagaatttcatgggcccactggttcaagaaagtattgtactacctagttgttttagtctacatgtgctctagattggtttcctattgtttacaggctatttttt

SEQ ID NO: 7794 - DNA, 611 bp, Triticum aestivum
  unsure (1)..(611): unsure at all n locations
  Clone ID: PAT_TA_7794
tcgtcatgttcatctacgtcatcgtgccgctctgctactggcgcttcaacaccttcgacgcccgccgcttccccatcttctccaaccagctcttcacctccacgggccagaagtacgacacgaccaaggtgctcaccgccgacttcgacctcaacgtggccgcctacgacagctacggcaagctctacctcagcccgctcttcgccatctccatcggctccgggttcctccgcttctccgccaccatcgtgcacgtgctgctcttccacggcgccgacatgtggcggcagagccggagggccataggcgccgcggccaagctcgacgtgcacgccaggctcatgcagaggtacaagcaggtgccgcagtggtggttcctgggtgctgctggcggggagcatcgccgtgtcgctgctcatgtgcttcctgtggaaggagcaggtgcagctgccatggtgggggatgctcttcgccttcgcggctcgcgttcgtggtcaccctccccatcggcgtcatccaggccaccaccaaccagcaacccgggtacgacatcatagcgcacttcatgatcggccacctcaaattaggcggttaaactgaacnnccctccc

SEQ ID NO: 7795 - DNA, 750 bp, Triticum aestivum
  Clone ID: PAT_TA_7795
cttcaatgccgcttgctcccctgctccccctccccctcccaatccctcccacattgatgcgccgggagccacgccgacgcgccgcagctgagctagtcgccggtagctgggacagctccagccggcggcacagcgcgcggcagtgagtgaggcgacggggatagcgacagcgggggtggttggttggtgctgctgctccaagaaccctagaggagggcgcgggaggcggccgccagggttttctcgccgccagccgctccaaaacaggccgctccaaaacagagatggtgacagccgaaagcctacgtgccgagctgtcatccaagacgccaccgtttggcctcaggctgtggatagtgattggcatcagcatctgggtggtaatcttctgtatactaggtttcatgtgcttctggtccatttaccggaggaagccgaagaagtctgttgataagatcccagtatctcaaatccccgatgtatcaaaggagatgcccgtgcatgctgtgcgccaacatgctcttgttgagaactaccacatgcaggagagccacacgttgccggtgcacgagaatcctcatgaaaaagattctgggttggtccgggcacactcgggcagggcagataatttgagccagtgcagctcggcctaccaatgcgatagggctggtagtgcttattctggcgatgaaggcagctcgggcaacgctaggaggcaatattctcagtatgcgaccgtctccgcatctc

SEQ ID NO: 7796 - DNA, 715 bp, Triticum aestivum
  Clone ID: PAT_TA_7796
attcggcacgaggcatgccgatccccggagcgacgacgccggaggcgttggtatctggatcgatcttggctgctagggatgcagtggcgcatgaggcgccgtgcgttttgggcgggggcggcgacgctgtgcccgattcggccgctggctcgtccgattcggccgtcggaccggtctcgccgggcgtgcgtcagttggatcaaggggtgggcttggctgatggcaagttttccggggcgtcctgcaacaccttcagctctggaggcggtccgtcgagtcgggcggccgcagtggcgcggcggattcgtgcacgacattcagttctgggggcgtggcgacgagtcgccggccgtcgtctcgagctgcacaatgcagtccctacgtcacagcggcccggctttggctaacaccaccatccgcgtaggctggaagcggaggtacatgctaattgtgctgtcgccttgggcaaatctgtatttacttgatcgcattcgtacgagctgatgagagaagtttcactagtttggccaaattggggataaagactggcgctcaatcatccctggctgaaaagttcttagtagctatccttaagccgtaccgcatcgttcgtttggtgaaaattatcattgccactgcataaaaaaacggtttaagttccgttgacagataatgattgaattgctgctgctggggcccctaaaggggggggggc

SEQ ID NO: 7797 - DNA, 597 bp, Triticum aestivum
  unsure (1)..(597): unsure at all n locations
  Clone ID: PAT_TA_7797
gcaagatggatnggtgcttaatggagtctgccttaaagtcccccagaaaagatgagcatgttgttgcttgttcacatagaaggtggcaggctttcagactaagccgccgcagtaaccgcatgcactcaatagattggacaatattgtcatcttctcataatgatccaatggcatctgatgttattgcaccttctgcatggacaatatttggctgtacaaacggtaagcatacaaattgtctttccttctttattatatgattaaaataagcttaataagagccatcatgttcattctcaagggctagaaatcgccatgttaacttgggaaccatgttataacagggatatttcatatgatgggctagaaattactccctccgtcccataatataagacgtttttgcaagctatgttagcttgcaaaaaagtctaatattatgggacggagggagtatatagtaacagcctttagctgtggaatttatagaagtatgcgatggaaccatccagacacgtttgaaactaatttggcactaaatttggtgtaatttcctcttccttttacatnccattattgtgtacatgnaatgttgta

SEQ ID NO: 7798 - DNA, 594 bp, Triticum aestivum
  unsure (1)..(594): unsure at all n locations
  Clone ID: PAT_TA_7798
cccccccccccagggccagcagctccttcctttctttcnttaaatccacacctcccttccaggcagcagctgctcttcttcctaatcacactatctcggagaggagcggccatgtctgggcgcgacaagggcggcaaggggctgggcaagggcggcgccaagcggcaccggaaggtcctccgcgacaacatccagggcatcaccaagccggcgatccggaggctggccaggaggggcggcgtgaagcgcatctccggcctcatctacgaggagacccgcggcgtcctcaagatcttcctcgagaacgtcatccgcgacgccgtcacctacaccgagcacgcccgccgcaaaaccgtcaccgccatggacgtcgtctacgcgctcaagcgccagggccgcaccctctacggcttcggaggctagatttgtgtggtgaagcaacttcctcgtttgctctgtgatctgtgctgtcgtagatgagatttactgatttggcgtgcgccggttgtattctgtcatggggttcagtaggctgtgtaataccttgctctgtacttctgttcaatgcaatcacttctattctgaaaaaaaaaa

SEQ ID NO: 7799 - DNA, 482 bp, Triticum aestivum
  Clone ID: PAT_TA_7799
ttcctgtcgctgctcacgaaccagtgcaagctcctcacgccgacggccgtcatcgtcgctgcggttccatcgctcctgctctccggccacccgtgcagaccacgctcatccctcggccgccccatacttctgtcataagactacagctcacccgccagccggttccagctcgcggccaccatggccgcagcatctccccgcgtcgccgcctccgctcctcgctgtcgtccatggtcacagcgaagacaataagtttgaagcttttttcaattccggttgtagcttttgtaaacgccggtcgcagcttttcgtccgtagtccatggcttccggctccacggttgaaacttttttcatggccgtatgaagcttttttcgtcatcagatgaagcttttctgtcagcggttgtaacctttcttttttggttgtcataggtttcttcgtacatgagttaaaactttttttcaaaaagaaaaaaaaaa

SEQ ID NO: 7800 - DNA, 399 bp, Triticum aestivum
  Clone ID: PAT_TA_7800
gagatattgcaatgtagcaagcgatccgaaccacgacctggtcgtgtcatgaacttcggtatttggttaagatacgattctcgcagtggaactcacaacatgtacagagagtaccgtgatgtgaaagtagcaagtgctgttaccgcttgttaccgagacatgggtgctcgccatcgtgccagacctggctccattcaaatcatgagagtggaagaagtggctgctaataaatgcaagcgaaagcatgttcaacagttccaggattccaagattaaattccccatgcgaagaactgtattgagcaaaaagcagcagaatgcaccgcgtttcacaaccaacaaaccaaacctgttcttctaagaattgagcagaaataaaacaactttatgaaaaaaaaaa

SEQ ID NO: 7801 - DNA, 790 bp, Triticum aestivum
  Clone ID: PAT_TA_7801
tccggaatttccgggtcgaccacgcgtccggcctctctctcgcgccccccctctccccccgcccctcccaccctcccacgcgcacacacaacacacgcccaccaccagggcggcaaaatggtgatgatggctcagaagacgaaggaggcggagatcacggagcaggactcgctgcttctaacaaggaatttgctccggattgctatatacaacatcagctacatcagaggcctattccctgagaagtacttcaatgataagtctgttccagcactagagatgaagattaagaagctgatgcccatggatgctgaatccaggaggttgattgattggatggagaaaggtgtctatgatgccttacaaaagaaatatctcaagacccttctcttctgtatatgtgagaaggaggaaggcccaatgattgaagagtatgccttctcatttagctaccccaacacaaacggggaagaagttgcaatgaacatgagtcgcacagggagcaaaaagaatagtgccacattcaagtcaaatgcagcagaagtcactcctgatcagatgaggagctctgcttgtaagatgatcagaacgctggtttcacttatgaggaccttggatcaaatgccagaggagcgaaccattctgatgaagctgctatactatgatgatgccacacctgaggattacgagcctcccttctttaaggggttgtgctgagaatgaggctgtaaatatatggaacaagaaccccttgaagatggaagtggggaatgtcaatagcaagcatctt

SEQ ID NO: 7802 - DNA, 713 bp, Triticum aestivum
  Clone ID: PAT_TA_7802
gggcggcgcgcacggagacggcgtcgggtggggagaggagagcgtatcgtcgatccttggaacggagccccatgggcggcgacgaggagatgctgccgtaccaaggcgatggcgacatcgactttgctgatggtgatggcggtccacgggagcctgacggccgcttcaggaacagaatggagcaccgagcaaggggcgagcaggaagacggcttcaggtaccgtggccctcagggggggtgccgtgacggcaacccgaatgacagtagatcgaagaagaggaggaggtatgctgcagcgtaataatatctacagtgatacacatgttacactgatgagatgagcgtcatcgggtgactgcttggtataagctgaagctagcagcatgtcaacatggtggccaaactcttttgacatttctcgccaaatcttcaaactaaacgagagatggcctgaagctgcttgcagaagtgtctctttctccgtctacctacttgctgcacggtattggtagggcgacctgtattaaagcgacttgtcttcactataatttgcctagttgttggtctggaaaagcagatgggatacggtacggtacgcatacaatacccacccggttgggctgtcgcctcggtaggccctgttgcccgcttcggtcctgactttttacctactgtttattaatgggtggacctgcaccaccgccgggcaatt

SEQ ID NO: 7803 - DNA, 1806 bp, Triticum aestivum
  Clone ID: PAT_TA_7803
acgcttccgccctttttctcttcccttcctccctccccgcagccccaataaataataaaaacccaaccccgacgccgaattccttagtcctcgattcgattttctcgccaattcacgggccgctagtgccgggggcgcgatcggcggtgagattcgtcgccgggcggaaatggttgccgtggcggccgagggcccgatccgcgccgacgccgtgccggcggcggctggggcgggcgcggagagggccgatgcggcgggcgcgggcggggcggcggcggccaaggccagggaggacgaggtcagggagtacaagagtgacgtgaggaagctggaggagctgttcaagaagctgaacccctccgcggaggagttcgtgccgctctcccgccgccagggggacggcgcacgccgcctgtcggccgacgcgccagtcttcgtctcgcccgcgatcgactactatgcgccccaccacccgttccagcatcagcagatgcacgtgctgcaggtggtcggtggcgggggcggagcgggaatagactccagcagcgacgggatccgccaacggccagccgaatcgacggagaaggaatggcttcaaccaggggagacgtaggatgggagttcggccaaggcgaactgatagggaggatagtgtacggcgaactgtctatgtctcagacattgatcaacatgtcactgaacagaagcttgctgaggttttctcaaactgtggtcaagtggtagattgccgtatctgtggtgatccaaactcagtgatgcgttttgcttttatcgagttcgccgatgatgtcggtgcaagagcagctctaacgcttggtggaaccattcttggtttttatcctgtcagagttctgccatctaagactgcaattttgcctgtgaaccccaaatttcttcctcgaacagaggacgagaaagaaatggtatccaggactgtgtactgtactaacattgacaaaaatgttccagaggatgttgtgaagaatttctttgagggaatttgtggggaggttgctcgactgaggctgcttggtgattacgtgcatgccacgtgcattgcctttgttgagtttgttcaggcagaaggagcaattttggccctgaactgcagtggcatgcttcttggctcccttcctgtcagggtgagcccatccaagaccccagtccgcccccgttcgcctcgcgcgatgttgcactgagtctgtctcgtctgaagccggcgtccagggcagcaattccgggcaacaaacccctagtcgtggccttagagactgttgcgtcgcggatcagtaactgtcgttgaagagagtgagtgttaccgttttggttatctaggctagaagaaggcccttccttgctgatcagatgagagacccatctgtatgttcttcgctgggagctctattttcacttcttcttctttttgctatatccttattaatccgtttgttaattatggatggatgctgtagctgccttcgacaggcactggaacaataatgtctatggcttgtcctatttcgaaaaaaaaaaaaaaagaaataaaaatagagctcccagcgaagaacatacagatgggtctctcatctgatcagcaaggaatggcttcaaccaggggagacgtaggatgggagttcggccaaggcgaactgatagggaggatagtgtacggcgaactgtctatgtctcagacattgatcaacatgtcactgaacagaagcttgctgaggttttctcaaactgtggtcaagtggtagattgccgtatctggggtgatccaaactc

SEQ ID NO: 7804 - DNA, 889 bp, Triticum aestivum
  Clone ID: PAT_TA_7804
gccggccccggatcgccggacctccccgcctcgccatgccgctcgtctcgctccgggcaaagctcaacacgcttctcgccgtcatgtacgcctcgggcacgctggacgagcagttcaaacagctgcgggcgatggaggaggacggcggcgcgcccccggggttcgtcgccgaggccgtcaccctcttcatccgcgaggccgacaggatcctcaccgaactcgccgccctcatgaagcagcgcgtggtggacgtcgacaaggcggacgccctgctgcgtcagctcaagggcagctgcatcagcattggtgctaagcaactgagcgtctcctgcacgtacttccgtcagttctacaaggaaaaacccaaaggatgcctctttgtgctgactcttttgaggaatgagttctatgatgtgcgcaacaagttccagaccatgatgcatctggagcagcaaatcgaggcctgcagtcctaagtaaacttgcaacaactgaagcaagagcatatgtagagtgatccctggcatgatggggtgtatgcatctttgaagattgtggacaatgttcaacggttgtttggctttggaggtccttcgtgggatcagactggttctcgcgcggcagaactccgtgctcacaacccttcaaatggaacttcttgtcatgtgttaatgtatgtctcaactctatacccgtttatgtccaattaatgggccgctgttggaagaccgctctatgtaaattctacctgattggctagttggttgctggggacttggttttgttttatgttgttgcctccctcatcttttgaaatgctggtgactctccttgctgttctgttggctgagggcactgaaaaaatagcggctatagcgccgctaataaca

SEQ ID NO: 7805 - DNA, 1084 bp, Triticum aestivum
  Clone ID: PAT_TA_7805
ccgcgcgtccgagctgatccatcgagctgcgcggcgatggcactgcagcgtgctgcctccgtgctcgccgccgcactggcgtttgcatccatacttattactggcccggtgcagtccgtgggcgtgtgctacgggatgaacggcgaccacctcccgtcgccggccgaggtcgtgcagctctacaaatccaacggcatcaccgccatccgcctctacaagccggacgtccagacgctccgggccctcaatgggagcaacatcgccgtcctcatcgacgtggccgacgagaccgtgacccgcctcgcttccagcgtccccggcgcacagctctgggtgcggttctacatccagcactacccggggatctccttccggtacatctccgtcggcaacgagctcaccggcgccgccacgcagaacatcgtcccggccatcaagaacctcaacgccgcgctcgatgccgctggcatcaagggcatcaaggtgtcgacggcggtcaggctggacgtgctcgcctcctcctcgccgccctcctccggcgtcttcaaggacggctacatgaaccaggtcgtggcgctcctcggcaccacgggcgcgccgctgctggtcaacgtgtacccctacttcgcctacatcggcgaccagaaggacatcgacctcaacttcgcactcttccagctgagctccacggtcgtcagggacggcgggctcagctacaccaacatcttcgacgccatggtcgacgccgtgcacgcggcgctgaggaaggccaacgtgcaggtgcccgtcgtggtttccgagagcggctggccgtccgctggaggcgtcggcgccagcgtggccaacgcgcagacgtacaaccagaatctcatcaatcacgtcggcaagggcacgccctataggccccagccgctggaggcctatgtgttcgccatgttcaacgagaatctcaagccgggggctgagacggagaagcactttgggctgttcaatccggacaagtcgccggtgtaccctattagattctgaatgtttcgtgtctgaaattagtgacgatttcaataaattaaactgcaaaattcat

SEQ ID NO: 7806 - DNA, 1015 bp, Triticum aestivum
  unsure (1)..(1015): unsure at all n locations
  Clone ID: PAT_TA_7806
tgcaggnaattcggcacgaggctcctgctctctctctctctcttctgcgatgttcctccttcctattggcgcgcctcgccccgtcttccaccttcacgttcatcttcaacaccccctcctcggctagatggcacctctgggggtgaaggagcaggggagggccaagaggccagcggtgtggggtggagcagcgaggccggcagcccagacggcggacgcctcatgggatggaggagaggccagcgatagggaaggatcagaatcctcatggagcgcagggaaggtgaagtcccgacggctgaagatggtgcgcacgggaggagctcaggtgatgtcaagggtagttatgcctccatgcattccataacaaaatgcggatgggggaggggggcgcgatagggggggatcagcttcctcatggagctgcagggtaggggacgacccgacggcagtttattttgggcagggcaggtgcccggcggacgtccgggtttatatcgtctgcattggcggggaggtctttttttatgctgcaaatattaggcgtgcttccagctccacacgcgcgtgcgttatgacaacttgagggggtatgaatggtccacagctcagctgcctgttgtttctgtaagaaattactttcttcattattgattgctcatgcattattctgtcttgaataaacatatggtgtggcacttttcgtataatgattttatatctttctggtcccgattcttgccgccggctttctttcgtgtttgtgccttccttccgttcttcttggctcggtgtagcagttgtatagttgttcctgggcctttttgcgctttgtttggttgggcctgctcgccggtggtagtccattcgctggtgcgtagaccacacctttgtcatgcccccgccggatcaaggtgtggcctccggtgctggatttccccccaatgccatgcttcagttcggtattaccgatttctttggattgctatgctgcaaaacttgatgtattgtcttg

SEQ ID NO: 7807 - DNA, 927 bp, Triticum aestivum
  Clone ID: PAT_TA_7807
gcttgatacaacgttgtgggaaaggtttgacctctgaggatgtcaaattcaggcaatctgtaaacatttaattggttgatggcttatgattgagctgatcatgggtaaatagagatgctgggttcttcccataggctggtggttgggcggcgaggattatggatgcaatgccttgggagatgtggctgtacgggatttggccttggtctcgttatttcaggagcaatccgtgtccatgaggacatgcttcttgctgcctgttgttgacaaatatgccaattcaaagccttgaaatccgaacattaattcaatcaggtgagttgagtaaattttaggttgttcatggcatgagtacttgtaccagttttgaacatatttgtgctacctcctggccatggtgatatctttccatcgctgacgaacaacagagagctttatttattactctcataggtgatagactcacatgttacccccttgggatgacaacatctactcagtggcggaggacggaataaaagttaggttggagtccaatgaaatttattttgtggggttcattgttcccaaacagagtttccaatggaaagttagtttcaattgttacactcagataaagtcaagatgaaagtcctaagtcctggagagtaacaagacactcataggagattacatgcctttgaggtgtaccattctcatgttcagaaagaacggcagtttgtccggcttcctttcttgtcaggcttagctcggcgacgatgacacgtcactctattttgtgtgtttgtcgctgtggtgttggtgggtgtttcgggctatccctgggctgtacttagaaagtgtgcacactgctatatatggttagaagtttctgtagagtactcgcatgtgatttataagtgcccatagtgttactgcttttatgtg

SEQ ID NO: 7808 - DNA, 455 bp, Triticum aestivum
  unsure (1)..(455): unsure at all n locations
  Clone ID: PAT_TA_7808
gcacagccgccacgccaatcccacctcctacctcctccctcccgcgtcaccatagccgtcggtcccctccctccagatccatcttctctcccttgttagccgccgctgcacgaaccgcgccaatctttgggcgcggcaggggctgatggagtggcggatccgggcatgctcccacccttaggtactccacgatgacggccagttcggagggagaaggtagaaagcaatggcgaagtcctgcgcctctgggtggaagcagcggggttggtcgagcaggggatgtggtcggggtcagcagttgaaggaggctcgccggccgggagcaagcaaggaggtgattcaaggagcgcctccaggagtggaaaggganaagtcctncaaggacaggccaacaaagagcaatttgagcaaggggggattaaatattccattaagccctatattcttcttctccn

SEQ ID NO: 7809 - DNA, 353 bp, Triticum aestivum
  Clone ID: PAT_TA_7809
gcctcgggccgattcggcacgaggccgcggtgacggtggaggctctgcaggtgacgaggctcgcggatatgcgcccggacgctcaccccggcccgtacttccatcccttcccgttcgccggcgccggcggcgagaagaagagggagcgggtgccgaacgactgcgtgcactcgtgcctccccggccccatcgacacgtggaacgagatcctgctgcagatggtaaagagatggagaggtgcctcctcctccagatgatagtgatactgaaatccaatcatggtttttttttgtgcgactatcactcctatatttggaaccaaggaaaggaaaataatttttgcaaaaaaaaaa

SEQ ID NO: 7810 - DNA, 494 bp, Triticum aestivum
  Clone ID: PAT_TA_7810
gatgaattggaaattgttgttcgttgtttgcttgatgatgatgatcatcaactcagatgcgtggaggagacgacgaagacgaagaagttctcgtcgtcgtcgtcgctggagggtggttgtgaaatgggctggccatgcgtatcgtgtatacaagtgggtgagaggcgacactgatctaaatgctttgcgtcaactcaaagacgaggacactgacgcttacaacaaggcaatgaaagaaatgcaaaatgacctgaccagcaaattcggatccgacgaagctgaaaaaatggtggcagaaatggaccaattcctttctgacaaaaccatcgatttggaccaagcattcgaccatgacgatactgaagaaccgaacatcgaggacgaaatgatcggaacgagtgacaacgaataatttgtaaaatgaaataattttaccgataccgttggaatggcttcttgttttaaaataaaaaaaattgtgcacaaaaaaaaaa

SEQ ID NO: 7811 - DNA, 632 bp, Triticum aestivum
  Clone ID: PAT_TA_7811
atacagagcacctccacttccccactgctcctcctcctcttcctcgctctcgccacagcagagcagagagcactcactcactgtggactatccatccacgcccctactccagtccgaggacacaacgtgagtaggcgcggtggtgctctgcttcttgattgttgatatccattccatatgcgctgtgcctgtccccggttttcgctaagaatgcatccgcttttgtgttcgccgcccaaaattagactcatttcgtccacacaaggatctttgctttcggacgcgtgggggctaattgatcctgccttctttagcttccggatctaaaactgttcttttgttcctcggattttgcaggatatactcgagttcagctgcgcgtgcatgtggagagattgctgtcggtgctgccgaccgatcgattccagcaggatcactccttcgagtaacctagtctgaccttgcctggggattgaatgctgctcactctagtgtactggtctttcccctatcttagctgctgggacaggtccttgatctttaaagtgcagaatacccagtcgtagaattctgtgtcggctagacaagagaatttcaagatggtgctggcgcacacgttcaaagtggtgctg

SEQ ID NO: 7812 - DNA, 1326 bp, Triticum aestivum
  Clone ID: PAT_TA_7812
cccctcgacctcaccccacctccaccctccccctcctccgctcctcctcctcctcctcctccccctcgcctctaccgaactgtgcacaggccccgccgctgtggactttcgctccacgcccctccccttctgccaggaaacccactggctttacgctcgcgggctcagcagctgcgccccatccgctggatttctgtcttcttcacgccaacacgtgtcaagcggagcctcttgctggattggtgcatcggtgccggcgctcgagaccacccccatgttgccgcaggaatgcgcgtccttttcctttttctcgctgctggaagcctactcgtccgcttccctgatggagcatggagcgattgccgtcgctcctcccgatggtatcctggggctggagctccgcgtcgattgacctagtgcggcctcgccccccgatcgaacgatgctgtccgctccactcctccggattaccgctgcgacaggttcctgctctggatcctagtgtactgttccttgcccccctcctagtggctactccaggttcttgatcttcggcaagcgcagaatagctggtacgtagtagaattctgtgtcggctagtcaagagaagagaattctagatggtgctggcgcacacgtccaaggtggtgctgggatgcgtggcgttcggcatcttctgggtgctggccgtcttccccagcgtgcccttcatgcccgtcggccgcaccgccggctcgctgctaggcgccatgctcatggtgctgttccgggtcatctccccggaggacgcgtacgcggccatcgacctccccatcatcggcctcctcttcggcaccatggtcgtctccatcttcctggagcgcgccgacatgttcaagtacctcggcaacctgctccagtggaagagccgcggccccaaggacctgctcttccgcgtctgcatcgtctccgccatcgcctccgcgctcttcaccaacgacacctgctgcgtcgtcctcaccgagttcatcctcaaggtcgcgcgccagaacaacctcccgccccagccgtttctcctcgcgctcgccaccagctccaacatcggctccgccgccacgcccatcggcaacccgcagaacctcgtcatcgccgtcgagagcggcatctccttcggccagttcctcctcggggtcttcccggccatgatcgtcggcgtgctcaccaacgccgccatcctcctctgctacttctggaggtacctcaacgtcgagccggccgaccagaagcgcggcggcgttgtcttcacggggcccgaggtcgtcggcgacgacgaggtcacctcgcacc

SEQ ID NO: 7813 - DNA, 951 bp, Triticum aestivum
  Clone ID: PAT_TA_7813
gaggaattcggcacgagggaggggaggtggggcgatctaggcaggagctcgccggagctgggcgacggaggacgggcgcgggagacagaaggatccagcgctacggctcgaagttcttgcaggtggaggcgggcctcatggctggcactcctgtgccgccttggcctcggcctactcttcgcccgccctgcttgccgcctccgactctttccacacctccatcgccattgacgtcgccgggctggagtacactcattcctggctaaagtggctccaagaggatgaccaacagtggcggggcagcaccgttggaatagccggagaaaaagcaatgtcatgggagccagcggtggtgaagcttttgctgctttgaagttgcgttcttcacagaacacggcagtttgtggcggcaaccatggtgtgagtcgcgactcgcgaccaggtccaggacaacggcagcacaaggcttcggcgagcagcagcatgcggcgccaacgagcaagagcagtagcagcggcagcccgtagcggtggtgggcgtcggggagaagcagctactgcccaagtggaagcgggtgcacctgccagagaatgcaccagcggcaccaacgagcaagagcagtagcagcggcagcccgtagcggtggtgggcgtcagggagaagcagctactgcccaagtggaagcgggtacacctgccagagaatgcaccagcggcgcctggtgatggacatggtctactccccatatctctgaaccccttggcgttcatcagggtagccaggcatgcctttgattgctgctttcgacgaaatcaacaacttcctgccatggtttgatacaggtaatcaagtggatggccggttttgggttcaggagtagccgcaagattgcaatgtattgtgaaacaggtgttaaggtaattccaataatattaggcgtagactttctgt

SEQ ID NO: 7814 - DNA, 465 bp, Triticum aestivum
  unsure (1)..(465): unsure at all n locations
  Clone ID: PAT_TA_7814
cttgattcgttgaatcatggcgccaagaaaggctaaagtcgagaagactgagnaagttgtacaactcggcccacaagtcgctgaaggtgaaaatgtcttcggagttgcccatatatatgcgtcattcaacgatacattcgttcatgtcactgatctatctggcaaagaaacaattgtacgtattaccggtggaatgaaagtgaaggctgatcgtgatgaggcttctccttatgctgctatgttggctgcacaagatgttgctgctaggtgcaaagagattggaatcaacgccctccacatcaagttgcgtgcaactggtggaaccagaaccaagactccaggacctggtgcacaaagtgcactccgtgctcttgccagatctggaatgaaaataggacgcattgaggatgtnactccaattccatcagaccacacaagaaggaagggggccgcagaggacgacgt

SEQ ID NO: 7815 - DNA, 1120 bp, Triticum aestivum
  unsure (1)..(1120): unsure at all n locations
  Clone ID: PAT_TA_7815
gcggcggcggctgtaccgggaggtgacgctggcgctgcgggccgggctgcgcgacgccggggccgacttctccttcctccgcgcgcgggggctccgcggcctgctcggcttcctccgcgccaccgccgccgcgcccgacgactcgcagcagcagctgctcctcttccgccactcccagtccatccccgatctccaaggtattccagttctctttcagaattcattgcatcaaccaaaggatcccgctgcgacactggaccatatatttggagtcgaaccaaccaagattacgagcccctcaacagattccgaaattgctctagctcttcgagttttggaaggttgctgccttttgtatagcagatgcactgctctggcccacaagtacaaggctgtgcaggtactgctgaatatattagccagccgaggtccaactgagcaaggggtgtgcttagatgctctgatatcgttgatgttggattcaccttcgaatcagattgattttgaggaatacagtggacttgaaaaggttgctgagcttttgaaggatattcaagtggaagaacacataaggttgaaatgcggggaatttttactgttgctcatcgggcatgtttatgtgaaggaaaacactcccatacatgagcagatgagaaacttactcggggagcagtgtgcgtcactcatatgggcagcgagccggtttggatccaccctcgatgcagagcagaggcagatggccctgcaaatacaagcgaggagagtcgttgaatccctggagccctactagccaggacaaccgcaccgctgtgttcctggcgatgaatgacatgtcaccggtctcagttgcatgcttcattctttcccggagaaaatggtgtatgtagccttgcatcctccattttgccgctcatcgcaaagccttttgtctttctctttttgtgcaaagcgattcttaagtttgctgcttgtgtaagtttatccgaaaataaattgttttgcctttgtaaaggtggtcctatttaggtttgtttgatgacatgtagaggaagtgagtttgggtttaaacggttgaagctgtgtgtttggtcccatttgaagaccatgggnagaagggnaa

SEQ ID NO: 7816 - DNA, 559 bp, Triticum aestivum
  unsure (1)..(559): unsure at all n locations
  Clone ID: PAT_TA_7816
gagaagagaaaatatccctcccacctcgtcaacccaagcttcctccgctgcctcaccacagcccccccaccaccccgccccgcgcccccccgcacgacgccccctctcccctccccccagatccgaagcgactgccgccggctcgcgatcttccccgaaccgtacaagaacccggccgtggcggcggccgcggcagccacgtacggtggcgggcgaggggtgtatgaggagcaggaacgactgcgggaccgcgattcggagcaggagccggtggggcaaagtgcggctgacccgcgcctgagcgagaaggccggtnctgtgtgtctggtgggattcgtgggggggacggagaagaaagaaagaaagaaaggtcgatcttgggaagcttccactacgggctccgagatgcagaacaacgatttacgcaagaagagtgcagcggaaattgatttctttactgaatatggcgatactaatcgatacaaagttctggaggtcataggcaaaggtagttatggacttgtatgttctgcaaatgatacacaaacaggagagaagg

SEQ ID NO: 7817 - DNA, 803 bp, Triticum aestivum
  Clone ID: PAT_TA_7817
ctgtgttgagttcccatgaaaattgcttgctgttggaggacgatatgatatgttgatggaaaatgcttgggataagacacataaaaccaaacccccgggtgctgttggtgtgagcattgcacttgagaaattccttcctaataatccttcatctgacgttgggttgccaaggattgaaaatagcatcagtgtacttgtatgttcaaagggtggcggcggactcttaaacgagcgcatggaacttgttgcagaactttgggaagctaacataaaggcccagtttgttcctcaggaagacccaagtcttcaagaacaatatgagtacgccagtgatcatgacatcaaatgccttgtatttatcactgaagcaggtctttcgcaaacagatcttgtgaaggttagacatctcgatgcaagaaaggagaaagatgttgaaaaggaagaaattgtgaagttcctgtctgaagcaatatctttacagttcaaaaatcctacaatctggagttgattggcaatccgctccttagtgaattttggtcaggtttgctattccaaaggatcgatcgatatcagactttttatctacctgtcctggatataatcttcctaggctgtgagccgtgtgccctctacaatctgtctcaccttcaccatgcgcactcatgatgccacgggacgggggtgctgggtctcgggccgcttggcgcaatctcgggtgcccctgcatgggccaagattatgcggtgtgtcctcagttcaagaaaagtgatttgatttgacggcttgttgtaagcctgattgtc

SEQ ID NO: 7818 - DNA, 507 bp, Triticum aestivum
  unsure (1)..(507): unsure at all n locations
  Clone ID: PAT_TA_7818
ccaaaaagtagtgctgggagtgctctcgagagccagcaaggaaggcagcgcggaggccaggccaccgtcgcgtggcttcccaccaccaccccatcggatcccgcggcgcgcagatccgccagccccggcaatggcttccacgccggcggacggagcaggcgagccggtggaggccaagggcaaggggaaggaggagggggagaagaagaaggcgggaggaggggtgctggggaggatggtggcgcggcctcttcggcggccgcgaggactacgagaagcgcctgcagtacctgtccaaggaggaggccgccgtccacgcgcggatgcgccgccggacccagttctcccgccgcaccgtccgcaacatcatcgtcctctccgtcatcgccgaggctgtagctgttggttatgctatcatgatgacaagagacgaanatctcacttggcaaatgagggcaattcgagtgctgcctatgtttgttttgcctgccatatcntctgtggtnt

SEQ ID NO: 7819 - DNA, 887 bp, Triticum aestivum
  Clone ID: PAT_TA_7819
gcttgcgtgcaaaacccatgcttcttcccgctcaccaccgtcaacacgtgaataacccgaaccgtcatcgccgccacctcgaccccggccggcgagatcgatgatgactccgactccgagcagcgtcatccaggccaagctggtgggtgctgctgggggaccgtggcgccgggaagacgagcatcgtcgtccggttcgccaaggggctctactacgagtgccaggagtccaccatcggcgcggccttcttctcgcaggcgctgcccgtcagcggcggcggcgaggacgccaccgtcaggttcgacatctgggacaccgccggccaggagcgctaccacagcctcgcccccatgtactaccgcggggccgccgccgccgtcgtcgtctacgacatcaccagcatgaatgttcgattttttcgctgcgtgggtgtcaggattcgtacatccgggcaaagaggtgggtggacgagcttcagagacaagggaacccacatctggtgatggcgttagtgggcaacaaggtcgatctggaaaaaaagaggaaggttggcacacaggaggcgcttggagtacgcggagcggaacggcctcttcttcctggagacgtcggccaagacggcgcagaacgtcggcgagctcttctacgagctagccgagagactggtgaaggtgcggccgaaccatccggccgggatggtcctgcacgacggccagcgcggcgtcggggggcggtggttctgctgctccgggtgatcgacgatgccgctgcgtgtcgcgcgccggcggcggtaggggaaggtgtggtgtgagtaggattctgcatcgtgcatatgccgctctctctgtacgtataaggactcgactgtacttgttgggcgtgtgttg

SEQ ID NO: 7820 - DNA, 520 bp, Triticum aestivum
  unsure (1)..(520): unsure at all n locations
  Clone ID: PAT_TA_7820
gcaggacccggacagcgcggtggtgtggcgcccgtgatcgggggcggcggggcggcccctgtgcccgtgtcgccggagaccgcggcggccctggccaacgacgtgtcctacggcgtggtgtcgctgcgggtggtgctgctcggccgcgtgcggttcgtgtccgggccgttccggaccgggtggcgctccatgtacgcgcgcggcgacctgctcgtcggcgtccggaaggccccgggcaacgtcggcgccgccgctgtccccgaggcgccgctcttcggcaacccctcctgcaacgtcgatgtctgatataccggcagccccgcccgcgccataattacattgcatcggacaaacaccatggccgtgcgtccgcgtgctcccttcacccgtcgtgtttgtatgccaaaaaatgtactccaataacatgcaatgtttacttcataaagatctcaattcgtttactatcaacgacaaaaaaaaaaaaaaaaaaaaaaaaaaaaaaaaaaaantnaaaaaaaaa

SEQ ID NO: 7821 - DNA, 744 bp, Triticum aestivum
  unsure (1)..(744): unsure at all n locations
  Clone ID: PAT_TA_7821
aggaattcggacgaggctttgataccaaagcctcttgcagagtgtaggttctcctgtactgcagaaaccagcccaacgaatacagccgtccttatattctttagggcgaaaaataccactttttgaccgtgtatgtgcttgtgaaggcggctgggaaggttggcgtggctgtggcacaaaaatcgcagaagatcgggcgcccgctgcagcatcaggggccgatcgatccgtctcggatcgtgaatccgcaggcccatcatgggccgcgacgggtgaatcggggcggcccacttccattgataggccgccacttggcgagccaccagcaacgcacgcggaatcgaccacgtcctccactcgggggcgcccacctggtgaagcgggggccgttcgctcctgggccgacccgcacgaggcgcgaggagcagtttccaggggctcccgccgcgtcagggtgtcaggtacagatcccgtggcagattcgctgccatccagggaagcgccggatcccgtgcgggcaggtgagtccgcttggcttgccgtgccttgatctgctgtggctatttcatcctgcataaaatcatctccaaaagcactgttttcgaaactgtgaacatcaacagtattggaaattgacaaatgatcattacgctcattattcccatgatttaaaggagtgaatggattgaggagattttgtggtaatagaaggatttctgctcgaagttgtgncgccggncatta

SEQ ID NO: 7822 - DNA, 669 bp, Triticum aestivum
  Clone ID: PAT_TA_7822
ctgagaccggccctcccggccgccgtcagttccactctcccactcttctcccatctcgccgccgtccgccgtcggtgctcaatcgccgccacgggcatggcaggagtctccgccgcctctcccgccgcagcacagatcggcagcttcctctccaagaagccctacgcgccgccgtcctgggcctcgcacctcgccctcgccccatcccacactttctccctcggccacttcccaaccccgattcaccaatggaatctgccaaatctgccggagggcactgaagtgtggatcaagcgggacgatctgtcgggtatgcagctgagcgggaacaaggtccggaagctcgagtttctgctgtcagatgccgtcgcgcagggtgcggactgtgttatcactgtcggtggtatccagagcaaccattgccgagcgacggcagtggctgccaagtatctcaatcttgactgctatttgatactgcgtacttccaagcttcttgtcgatcaggaccctggtttggttggcaatctccttgttgagagactgttgggcgcgcacattgatcttgtctcaaaagaagagtatgggaaaattggcagtgtggctttagcggacttgcttaaaaagaggcttttggaggaaggacggaagccatatgtgattcctgttggt

SEQ ID NO: 7823 - DNA, 1245 bp, Triticum aestivum
  Clone ID: PAT_TA_7823
ctcactgttgtgtcatgcctggatcccaaaagttgtggcattgacacttcacggcttgatcatattgagctttttgcagtggcggaactattgctggtcttgctttaggatcaaaattgagtagcttaaaggcaaaagtatgaactttctttggttattttcttaccctgtcgaagtttaaatactaattatccacttgtaggataggtccatgcattctctgtttgcgatgaccctgaatacttctacgattatgttcaagaaccccccacgctcccgacaccgcccctcccccacgcctctccctccactctcccgcccttctcccgtcccgccgccgccccccgtcggtgcccaatcgcccccccggccatgccaggagtctccgccgcctctcccgccgcaccacagatcggcacctgcctctccactaggccctacacgtcgccctcccggccctcccgactcgctcccgcgcctgattgatggactacaatctggcttggactcacatgatatagtcagcattcaaaatgctaagggcttaggttgatgccatgaacacagggtgaggagcttaagtttgttaaagatatagctacagcaacaggcattgtgcttgatccagtctacagtgggaagggagcatatgcaatgctgaaagacatggctgataatccatccaagtggaaagggcgaaaagtcctctttgtccacacaggtggccttcttgggttgtatgacaaggttgatcagatgtcatctttggctgggagctggcgaagaatggatcttgaagaatcagtcccacgcaaagatggcactggtaagatgttctgattgatatgctccagaaaccgctccattatgggctggagtttcagaaatgtcattcatcttaagggtatatgctcttacatttgtaaaagaaaattcagaatagacagctagcatggaatgttgatatacaagaataaagtgcatcgttctgccatttgagaataaagttaagcattaagagactttaagcaaaaaatccatgctttctctgtttgcgatgaccctgaatacttctatgattatgttcgtggcctgactgataaatttagctatttgtatttatatttaaatgccatttgtttctttttagtgctatgtaatcttgtgtatatttatataaaaatacaggcctgcatcttcctcccatttgaaataaagctatctggtttatttaaaaaaaaaaaa

SEQ ID NO: 7824 - DNA, 1526 bp, Triticum aestivum
  Clone ID: PAT_TA_7824
cggcacccgttcacgtgcaccgtctcgttcttggtactgttgcacgtcaccgcgccgtgagtatccctcggcgcagtggttgtcctgggcacgcggggcttcatctttttgcgcttgggctgcctgctgccccgtttcttccgttccgctctgcgaagtcccggtccccaccggcgccggttgcctagggtgcgtgttcgcgggttggtgactcttatgagcgggatggcgttccacgtgctgcgcggccctctgctggtgttggtgaagaggaaggagtagaggatggcaaggacttcagtagtgatgatagcagtgatgagcaaatggaaaacttagcaaaggaatttggcataaaaagatataactggcttgtttacatggacaaaaaggtcaaagaagaggagaagcggcagaaagaaattattaaaggcgacccatccattaaaaaaatgagtcggagagatagaaggaaggcttctcaatctgagagggagcgagagagggaggcagtacgttctgttggaagggtatcttatcgtgacccttatagggaacaaaggagaagcccatcatatgaagcatattcaagaggcagaagatcaaggtcgcggtcaagatctcattcaccttcatccagacgtcatacccgtggtacacatgctgatagtaattaccgaagcaaggctaagcctccaagagttgaatacatcactgaatttggaggttcagaagacgccagtgatctgaaagttacagggatctctccgccttcgtctccaatacgagctgacatacctaaccggtcatcaggtgtccatattctggaggcacttcacagtgatcctgcatcttctttatccatggaacaggaaaaaagtgctaaaattttgaaaccacctgccagcacatcatcagcactagcgaaactaaagggtgcttctggaggacttggtaaaactccccaggctgaaaagaaagaaacaccacaggaacgccttaaaaggataatgagcaaacagcttaacaaacaaattcgaaaagatactgctgctgagactgcaaagaaacgagaacaggaacggcaaaggcaggaaaaacttgcagaagtaggtcgacacagggctccgtagcaggagcagatgtctttgccgttctccaccaagaaagcgccatcttaccactcgccatagtaggagccggagcccaggaagtacccgtggactttaactgtctcgcccaaggtcacccggtcactctccaaggtacagaagcagatcaaggcactgaaagtatctcagagctcattggttgtctatggcacgtggtgcttcatttttatttacttgggcttcctggtgccctgttacttatgtaccgatcagctatgtaccgatcagcgaagtcctggatcccatcattgttgatagcgtagagttagtgtatttgtgattgtgatatttatgagcagaatatcgttcaaaaaaaaacctgcccgggccccgctcgaaatcattagtgaattc

SEQ ID NO: 7825 - DNA, 466 bp, Triticum aestivum
  Clone ID: PAT_TA_7825
gaggaattcggcacgaggcttggaggtaggtgttcatatgacctgagatatcatgtgttgctgaggaggtgagccatcggtgtgagtttcaggaagagatgacaacacaagtgagcttgattgttacaaaatacaggacggtttggtcaaaggttcagaccacagcgactgcaggagcatgcatcacctcatgcgctctccccacctcttctacatgctgatgaccgcttgccacatcaatgctgaggggaggggggcatatgatcggtgcatcacaacacaagtaaaatggatggcaggcgtgtctacagagatatctatgtaattttctactatatagtttacaacaatgttgtgtaaaaacagtgtacataagttatccagaaccaccactatggtgtctttttggtgttgtactgaaccttgatactttggtatcatgctacaaatttatataaaataaaaa

SEQ ID NO: 7826 - DNA, 1134 bp, Triticum aestivum
  Clone ID: PAT_TA_7826
gcgatacttcccatccagatcataagaattggtcagctggttatcttgtgtgttcctggagaattcacgacaatggccggcaggcggctacgcgatgctgtaaaaaatgtactgataagtggcagcaatggtgattttggtacaaatattcatgttgttcttgcggggctgacaaacacatattctcagtatgtcacaacatttgaagaataccagatccaaagatacgagggtgcatcaacattgtacggtccccacaccttgagtgcatacattcaagagtttcagaaacttgccacagctatggttgaaaacaaagaggtccccacaaacatccaacctcctgatatgttggagaagcaaattggactattgccaggtgttatgtatgactctactcctcctggtgttcactttggggatgttagctcggacgttgcagcaaactcaaacttcaggaagggcactactgtgaatgctacattctattcggcctgtccaaggaatgaccttctaactgagggcaccttcgcacttgttgagaagctcaatggtaacgactggattcctgtctatgatgatgatgattggtcattgcaattcaagtggtctaggccttcaaaattcagtccaagaagtttcgcgacgctggagtggaccattcccgaggatgctgcctctggtgtttataggttgaggcattctggtgcctctaagccattgatagggtcaatcaagcattttacaggtacttctcgggcatttgcagtgcgttaagcaatgcacaatgcttttaatggtatacctgccagagtttacttcttggaatgtaatccgttattctacatgattccccccttgtatttacgtcccggaggtgtaaatttgtaagtgtccgatcatacaaaactgctgctctatatgcttaagtagttaagttataaggatcaaaatatagtccaagaagccccgcaacgctcgagtggaccattcctgaggatgctgcctctggtgtttataggttgaggcattctggtgcctctaagccattgatagggtcaatcaagcattttacaggtacttctcgggcatttgcagtgcgttaagcaatacacaatgcttttgatggtatac

SEQ ID NO: 7827 - DNA, 921 bp, Triticum aestivum
  unsure (1)..(921): unsure at all n locations
  Clone ID: PAT_TA_7827
tccacaccatggcggccgcttctccaagttctcctactgcccgtttaagccggggacaagcctgtacagctacctccggtttggtaacgacatccctagccgtccaccggcgggtgtgcaccgccagagcacgcctgtccttgcgccggccgagaacagagaggcctacttcgtcaagctcgcggggatcaccatcggngncaaccgactgcgcagcgtcacgccggatatgtttcggcgcaccgcgcacgggacgggcgggtgcgtgatcgacatcggcacgaagatgacgtcgttcgtgcacgcggcgtacgtccacatcgagcaggcggtgcggcaacacctggagcaccacggagcacatatcgtggtggtccgaggccacaagtgcgtgcagcacccagcggcgcacgtcctcccgagcatgacactccatttcgagaatggtgcgtggcttcggatcttgccggagcatgtgttcatgccgctcgtcgtcagcggccaccattaccagtgccttggcttcgtctcgtccacggacctgacggtcatcggcgcccggcagcaagtcaaccatcgcttcatcttcgacctccatgataccatacccatcatgagctttaatgccgaggactgtcacctagaaggcgcctgacctcggcaacatgtatcgtgcagcgctgcttcaactagatctctgctctagagtctagacatctggagcagcagaaatttgtggcgagaaaaactcatttaataattaaggcaggcgcgatcttgtctccattctcgtgccgaattcctgcagcccgggggatccactagttctagagcggccgccaccgcggtggagctccagcttttgttccctttagtgagggttaagtcgagcaagggantaaangnttaaannnancncnc

SEQ ID NO: 7828 - DNA, 1115 bp, Triticum aestivum
  unsure (1)..(1115): unsure at all n locations
  Clone ID: PAT_TA_7828
tcgacccacgcgtccggttagagatgctctcactgagcgacccccggccgttcgccccgccggccgatctgcctcgccgacgactgagctctccgtcggtcagccacgacggagccggcctcgtgccctaccgccgtctcggctaccatgccaggctcacctccggcgcaggctctccctccagcacccaaacccagagccaagcgccacctccttctcctcctcacggcgccgtccctcctcgccctcgtcctcgccgtgctcttcgccaactcaagcaacccactgccacgcctcatccacctgctcctcagatcgaggtcttcccttctcagcccaccggagccagtctccgcggccgatacctcggctgacgcgggacgcccaccatgtgttctatggatggcccctttcgcctccggcggcggctactgctccgaggcctggtcctacgtcgcctcgcttgacgagaatgccgctgccggcgtcggtgcgaacttcacgctctcaatcgcgcaccacggcgacctcgagtcgccggagttctggcagggcttgcccgagcagtccaagaacttggcgtacaggctcgccactgcgcagtgtgagctctctcgggccgtcgttgtgtgccacagcgagcctggcgcgtggtacccgccgatgtacgagtctctgccttgcccgcctactgggtacgacgagccggcgttcgtcattggccggacgatgttcgagactgaccgtgtctcgccggagcatgtcagacgctgtaaccagatggatgctgtctgggtaccgacagatttccacgtctccacattcgtgaagagcggggtccatccctccaaggtcgtcaaggtagtgcaggccgtcgatgtcacgttctttgatccggccaagcacgccgcctttcctcttccgattggtttctctgtcatggcgtctgatgattctacacagaatactgatagctccaaanncaaannntttgtgtttcttagcatgttcaaatgggagcagnnnannngctgggatgtgcttctgacagccttcctgcnnnngttctctggagctgatgatgttgtactctacctactgaccaatgcctannn

SEQ ID NO: 7829 - DNA, 344 bp, Triticum aestivum
  unsure (1)..(344): unsure at all n locations
  Clone ID: PAT_TA_7829
aacctatggtgggtctccatttccgaggatgtcttctctgtggtgctctctggctgccgtgtcttgggtaacttatatctgtcagagattcgtgatgtggattgcctcagcattagctcgccaagtctcaggatcatcgtcatcagctatttgcttgagggcaaaggagaattgctcattaaggaggccccttgccttgtaaggttgctattaagctgtccaggcggtgagattattcgggttcttagggcgcctaaattggagatatttgggccttttgtctccctgcattncagaaattgatattgctaatatagtcttcaagggatcgatcccatccaggt

SEQ ID NO: 7830 - DNA, 2145 bp, Triticum aestivum
  Clone ID: PAT_TA_7830
ccagcagcgcacttgccaaactacacaccctctggaactatgggaaggattgtgacgtctagttttttgttctggacaggtgtaatatgaagtggatcttgaaagaaaggagccgaagtagccaaagcattcgatgcttcaagtttccctgcgatctgtatcgacctggaagctgtgttaccttcttgtgaacagactgcggagtggcggcaaactttgcattctgatgtagtggtgtatacttgaggctgccgtcgatttgggcataatgagattggagagccatccgtcagccagcctaaaatgtgcatggtggatacgaactacgtaagggcagtggccatatatccagccacacgctaaagatttggatagtgctccagtcaaaggatcgacaagatccccaggaaaggcagcaccatccagaatcagatctactatccgagctgaacagatagattcttcacaaggcaatgactttcttcctgctggcctacaatgaagtccaaagaccagatttaacttatccgaaacacccgagtctcgtgaaagatcctaagaagtgttggtgatagcccctgataacaaaagcagaaagtttcattcctaacaggtcggtctataaaggtgttggatctctctgtgcatactgattggacctcgggcagcgagagctgaagagatttggtgaagcccttgtttttgcatctcaaatagtaccgaggaacaatggtgagtttaactacgccaggattcgcctgctgaccgctacgagggcgctcggtcgtggcagcatagatgatatcatatatgtgggaagggccccatctgcagccacagctacaggtttctattgtgtacatgtgcaggagcaaaccgagctggtgaagaaggcgctgcagcgagaccccatcaagtctccgttttgaacatgtagattctttgcatagtcatcatgactgctgattttggagattttagaaatggggcctcaagtgatatttgatcagttcattagtagcggagaggcaaaatggctccgccagactgggcttgttgtctgccttcctcatggatatgacggtcaagggcctgaacattctagtgcgagaatggagcgcttccttcagatgagtgatgataacccctatgttatacctgagatggatccaacactgaggaagcaaatccaggagtgcaactggcaggtcgtgaatgtcacaactcctgcaaactatttccatgtgctgcgtcgccagatacaccgggatttcagaaagcctttaattgtgatgtctccaaagaatctcctccgtcacaaggactgcaaatccagtctatctgaattcgatgatcttgctggtcaccctggatttgataagcaagggacacgcttcaagcgtctaataaaagaccggaatgaccataaggaccttgaggaaggaatcagacgtctagttctttgttctggaaaggtgtactatgaattggatgaagaaagaaagaagtcggattccaatgatgtcgcaatatgtagagttgagcagctctgtccattcccctatgacctcattcagcgcgagctgaagagatatccaaatgccgagattgtttggtgccaagaagaaccgatgaacatgggggcgtatacctacatcaatcctcgcctgctgactgcgatgagggcgctcggtcgtggcagcatagatgatatcaagtatgtcggaagggccccatctgcagccacagctacaggtttctatactgtccatgtgcaggagcaaaccgagctggtgaagaaggcgctgcagcgagaccccatcaagtctccgctctgaacatgtagattctttgcatagccatcagaacttctgatctcctaccatgcagaaaaacaacaggtctaaattacatctcttcagccatttggtgaataatcgttacgcatgtgtggtgccgcacattagaaacggtctgaggtccattttgagtgcataattttttcccgtcaaagcttttttgtctacatccttttgtttttctgggtgctaaggttaaacaagctgtatccagttctccctttgccaataaagaagtgtacccagtactgatgtgcatgtatgtcctacgagacggtccgtccct

SEQ ID NO: 7831 - DNA, 527 bp, Triticum aestivum
  unsure (1)..(527): unsure at all n locations
  Clone ID: PAT_TA_7831
gagaaacctgaccccaaatttgtaaagtctgaatgtagacgctgcattttatgctacagaaggtgctggtgccacagcagcggtgattaaagatgataaaggggtctttctagcagcacaatgtattttcattccttatgcttctagcgtggttaccactgaagcccaagcaatgagggatggactaaattttgcaaactctttgggattcctgcgagtggaggcggaatcagattcattgatcgtaattgaagcatgcgaggggcaatcaagatggtgggacgaagttgctgcaatttttgcttagttgtgtggatgtttcagttttgattgggaaggtcaaatttaagcattgctttcgtagttcaaatcaagcgactcatgtgctagcaaattatagtttttgtaataagacttctagtatnctggcacggtatgaatcgccgggcatgtactagtttcgcaaacttgtggatgatgtaattcctatctaagttaataaagctagccatgatggtcttccctaa

SEQ ID NO: 7832 - DNA, 618 bp, Triticum aestivum
  Clone ID: PAT_TA_7832
ggccttttgaggtatctgtcctaaggccgggtaacagttttgacttctgtgcaactatcaacgctgaagtgattgacatgagcaaacaaaacagatggccggtacccaagaccaagtggatatatccagataatgaatatgatgatgaggggccccttgttcgaaagtgctcccgacctgactatcgatatccttcccccgatgaggacgagtccacacaagattgtgatgaagagtgaggagtaatcttgtagggttagtaaagacaagttgagatcttcttgacaactgaaatgaaagtataaaaaacccgaaatgaaagtctatgttgccagatttatgtttggtactccctctgttccataattcctgttgtggttttagttcagttaaaccatggcaggaattatggaacggagggagtgttaaacagaatggtgtagctaagtttagcctgatatacttttattttagttaactttgctgattagctagctattaactttacttgataagactggggaacaatataaatagaaaactttctgatgtgagaatttatttagtggggaaaatatcatgtgataccaacactcacatgaccacacaaaaaaaaaa

SEQ ID NO: 7833 - DNA, 304 bp, Triticum aestivum
  Clone ID: PAT_TA_7833
gtgatcattcttccatgtctcataacattttctcaggctcaaagatctgatgatatgaatagcagcaagatccaaatttgcttgtgccaaaagaatcctccaccatgcccaaatggtttgtgcttctgttgtgcattggagcaagataaatgctttagaaccagccaagaatgcatttgtggttctgcttgccctcctttagaagcaacctcccctcatcccctccctttgccttaagacaccatgtcagctgattgttgccatgaacatcttggaataaaaaaagttgtaatcaaaaaaaaaa

SEQ ID NO: 7834 - DNA, 448 bp, Triticum aestivum
  Clone ID: PAT_TA_7834
gggtaaacttacaatcagaggatggggaatttcctcagcaagagatcatgggagtcttcaacaagaactgtatgatcagttactcccagtacaggaacatcttccccatttgggcgctaggcgagtaccggtgccgagtgctgggcgcgggcaagaagtagtaccatcttccgtctctttggctgggttacgtggtggaacagtgtgtttctgtaataatgtagctaggtgcaggtggagatctggtagccgtatagatttttttttaccatttgatgagtagaggaataaaatggattgtacatctgaatatggggatacgctaccgcatgttggagaggtgtatatatctcgcttgtaggacctgtttggttggatacctgaacaccgtgcctggagaaatggactgcctggattgagcccgagaagattgaaaataaaaaaaaaa

SEQ ID NO: 7835 - DNA, 656 bp, Triticum aestivum
  Clone ID: PAT_TA_7835
aggaattcggacgagggctgccgccggttgaacctttttatatcgccggttgaagctttttttttagccggttgaaactttttttgtcaccggttgcagcttccgtggttgcatggtgggcggtcctcgattcccgtcgtctccggttgaagctttcgacaatgccggttgtagcattatcgatcgtcggttgcagcttttaatgttgcgcagcggccgacccactttctcgtcgccggtcgtagcttttctcgtcgccggttgcaacgtcgtcgtctctagtcgtagcttttttcgtcgccggtcgtaacttttctcgtcgccggttgcaacgtcgtcgtctctagtcgtagcttttttcgtcgccggtcgtagcttttctcgtcgccggtagttgcttttctcgtcgccggttgcaacatcaccgtctctggtcatggcttttcatctccaacaccggtggcatcggatgcgagggcgcgggggatttgttgaggaggtggcgtgggaggcggcggcctgctcgctggaggagaaacaggtgaggaaatgggaaaaggccaaaagggatcgcccccatgccgacgggaaggggaggccgatgactccatgacggcctgcggacgagatccgacaggggaggcaagccgacttgg

SEQ ID NO: 7836 - DNA, 1219 bp, Triticum aestivum
  unsure (1)..(1219): unsure at all n locations
  Clone ID: PAT_TA_7836
gggacaaggaccatcccaatggagtatctcaaggaaaggatggacatcgagcaacaatttttcgcctatgaccggacatactgggaagacgtgtggggcagcaggatcggacgttgcggtagatttatggatacaaccatactgagccctatgcaatttacacactacacacctggtggcatccattcccctgctgctgtcggcggtactactctgcagatctattcagtcaagataaaggatttaagaggcttgaactggccactcagagtgtacggtgtgattgctgctcgagacactgtggatcacaaccgcaacattttattctctcggtcagagtttaactaccaagaactcaatgaacaagatccttgcttatgcttgactggtccgtctcgtgccattgttgtttcgggacatattgactttgaagttgaacttcaagtaaccgatgcagcacagtcccaaacattgatcagctgtagagagcgttacggcagtacagatgattttttttcttccttggccagcgtcactgatggtggtgatggacggacttttttgctctccaaccagagctgtacaactgaggtaacccttgaccaacttgatagatcactccaagctaccatcgtgggtgtacgtgttaccaaagggcattggccttttaagcatggatgccgagttgtttgctggtggtcttctgctgctccgatatgttcccgtgacaccacttgtaggcgagttgtgctgtttgatcaccgtggtaaaggaatgcgtagaggatcagatgggtaccttcatttgtaaggaaagtgatttccgtagaatcatatgggacactgagagtgagcattgaagcttatggcaagtctggtcgccatattgctcggaaggatagtattgactttcctgttcagaagtgtcaaacaaagacgcttacttgtccagttggtgatggtggcgccaccgtggaggttactgtagcttggtcgttgcttgtgaaggaaaagatgtatctctcactcgttgattgtcctatgtaaggtgtatcaccgattgccctgccanatagtaatgtaaggtgtcaaactgacttgtgtctatcatcagatcatataactatctatgtcggagatcatataacgatctatgttggtgctgacaacaatttatatgttgnaatcattctatcnagcagtttgagggccaattcaga

SEQ ID NO: 7837 - DNA, 702 bp, Triticum aestivum
  Clone ID: PAT_TA_7837
ttcggcacgagggatacctaggacacttgaagcaaccgcttagtacttacaatggcaagagaaattgcaataatactactcatggccgttgtgcttgctgccgctatgatggtggcgagctctatggacatcactgatagagacttgacgtcagaggagtccctatgggcactgtacgagcgctggtctgggcatcacaatgtgaggcgcgaccttcgtgacaaggccatgcgcttcagcgtattcaaggagaacgctcgcatgatccacaaattcaaccaaggggacgcaccctacaagctgagcctcaacctctttggtgacatgaccgatgaagagattgaccacacgcacggtcgctgctctgacctcctgtcagatggcgggaagccaccccaaggccggttcacacggggtgccgttgccgcgcgcgccgacctccctcccttcgttgttgggcggttcgcggggttggcccagcgcccgcccccagcgccccgcccggggacccagcgagcctgcggagcttcctgggcctgcgcgccggcgccggctgtggggcccttcaactccataaggaccacgagtctgaagtcgttgtctgtgcagcagctcatagactgtgacaagagaagttttggctgtcgtaacggcagagtgccatcggccttcaagtacattatcgacaacggcggcatcgcc

SEQ ID NO: 7838 - DNA, 746 bp, Triticum aestivum
  Clone ID: PAT_TA_7838
cccaaccccgccccgctcccgacgctcccccctcgccccccccggcccgtcgcctccaccccgccgcccccacaggtgctacgttgctagatgatggaggatcgtctgcttcttgctggagtcggactgggagaagcaagagaaaggtccctctttcgttccgtcttcggatccgatcaagaaacggttcaatttcgatttgtattagaataaggagttgtttttataggtctgcctctcgtgagatgatggtaaatcggtcggtttacggcttctgtaccggcctgaagacgattcggaaacctcctccttctctgtcttgggaggagggagtgggagcatgagttctttgacttgtaggattggtggaggctatgcctacttcaggctggccgttgactcttgtttccagatcatcgtttcaatacttactttgcttattgcatcgccatggagcttaataggggttgctgcggccgacgtgattcgaaaagagaagctagtaccgggggctccctaagcgagctgccttatgaagtacaagcttgtaatggggacaggctaaccgagctgcctgctgacctgctgctcaacattctggagagggtgggtatgcttgatgcaataaaaacttgcaggctttcgaggaaaatgcagaagctgcccactatgctctcacagatcgtcattgatctcagctctcacgatctagttcaaatgaatggtgtcgtggctgatgtgacaga

SEQ ID NO: 7839 - DNA, 575 bp, Triticum aestivum
  unsure (1)..(575): unsure at all n locations
  Clone ID: PAT_TA_7839
atgtgcatttagtaggaacacttnccatgccttgttttgctatgttaagttcctgtagcatgttgatttcgtgctctgaacatttctacctgatgctgatttctgccatgtccagtttttcaccaagtctgtgaacctgtaatctttttcacttttgccatgcttgtttgagcttgatatgttgtgaactagacgtagctcagtgttcctcttttgtcaagcatcttctgtagtttactgtcatgtgcgttttttctatgttggggtgctgtagcattgttacttgttgcattttatgtgctatcttgctgtttatcgcagattaatgtcatttttgttttgcttgccatttgcaaaccgtgcatccgattccggtgatctttatatcgatttcgaccgaaatcgtctcatctttctagtggcatgcttggttttccaagttactgccatgttcatcattttccttccagagcacgcctatgcatcgcatatcatatcttgcatatcatacatgttnngcatcatgtngcttgngcattnctcgntgntgattgnggntccgntngnttgngttc

SEQ ID NO: 7840 - DNA, 661 bp, Triticum aestivum
  Clone ID: PAT_TA_7840
tacacatgtcactacacgaacacatggcacatatgcacccatgcatgcaacactgaaacgtacctttgcacgcacgcaacactcgcacgcctgcatgcacacaacacacgaaacaagacacacgctcaacctatacgtgcatgcaccctttgttaaggacatggattgttacaggtattaatcaatcttatctgtgataagcagaacattgatgtttgcagcggtctttatgaatcacaacgtatcgaacgggctatcaacatagtaggcttatctacatgaaaaagatgacttcacactcaatgaacaatcatcggtttatgaaatgcctgcttctgaccgccctggcccaccaaaggttcctctattgtgcgctgcctgcgttgggtcattaacatgcatgccatgtacccaaagagcccacacatcagtggaagaacgacgcggtgtcctaggtcagagtcgagggcgccactcgctgcacgcccggctgaacacgcctccttgccgcattcaaacgcctccatgaaacccgcccgtgtggaagccgagaaacccactgtggacacacgtccgttcatgaccgggctggcattaatcgcaatgccagccgagctcctcccgtccgccgtctatttaatctcctatttaaatgaggcca

SEQ ID NO: 7841 - DNA, 687 bp, Triticum aestivum
  unsure (1)..(687): unsure at all n locations
  Clone ID: PAT_TA_7841
cccccccnttgccccttgtatngtanctnatacttccttcccgntgntaaattgttncttgggaangttanctttttgnccggngagaacccggcggcggcgccggagcggcgccnggtccgggttcnccgtgttggttgttctccgttggctttcgccaaacgtaatcgcggcgcgcgtcgccgactcgatgcccgagcgggggctccagatccccgtctgggtggtccctcgccgccggcatcggcgtcgccttctacttcttcttcatccgcgagggcgcccgcgatgtggtcgccgggcagcggcgggaggcggagctccaccaggtgtccccggagcagagggtctgaggcgaggcgagctcgagtcaactctgccatggatggatggaagatgtagtatagccattgcttcgttttttcttaattgtgtaaactttttttttaagcttgttattttcggcgagctgctggctgtggctgtcagtcgacactcgacgacgtgctggggttcgctggaatcactgacgtgtggggctgcaaatcagctggcccgcatgtcagttttacactaggtcacctcagccaaatctgaacgccatactcggtgtaacatttgttttcttttgctgtaaagtttgaccgacgtgtgtatctattcgaccacgtcttcgtaaaaaaaaaa

SEQ ID NO: 7842 - DNA, 1117 bp, Triticum aestivum
  Clone ID: PAT_TA_7842
cccacgcgtccgtcttgatccagctgcaaaagctgctgcagcttcggttttggcatctaagctgggagcggattctggcttaagagtacatcttggggaagaaccaaattctgatgcagcagtggttatgagcaacaatgctgagatattgccatcagatgggctgagaaacaggaagcaacccaatgcaagaggcagcaggactggtagcactacagctgctcatacttcggcacaaggtgctgaatctagcccagctcttaatgctggcctggaaaacgtacagcttacaagggctgtagaacattatcaaggctctggggcaagtgatggtggatggattgcaaaaatcgctgccttacttgttggggaggacccgtcacagtcgtacgctttgatctgtggcaattgccatatgcataatggtttggcccggaaggaaagattacccacacattacatactattgcccacattgtcatgctctaaacacatcaaagaactcgatggggcaatactcaggctccaactcaggcccatcgaccccagttgctcctgctgatgtgatatctgctaccagctcagtagtagagagtgaattgattaacatggctacagtgcaggagttgccaaaggaagaacacgcagagaaggaagtggaggcaagttgatgctggtccgtactattactgttgatctttgtgagattagttcatatcgccgtgtttgaactggtttgagccgcagatgtagcactgttgtaaaattggaaataggtgacctatatgatccacagcaaaaccagtacaataattgtttagccagtttgtccatgaacacttgagaggacgaattttgttggcaatgggcactgccggagtggagaatggcaacgtgctgcctggcaagtcgaggttggaaagctatgaggtggaggcgaacaggtgagatcagtcgggtgacgttgcaacatggcggtggtgtaaaaacatagatatgatcgacgcttctattttacccatatttgtgtggcagttgctccattggagatgcggaagttttgacagtgtttggacatttacggtcacagcttctttttgtaatcttgatagcgtta

SEQ ID NO: 7843 - DNA, 403 bp, Triticum aestivum
  unsure (1)..(403): unsure at all n locations
  Clone ID: PAT_TA_7843
cacagcacgagtgcaaaatcggccgtcgaagcgtcgatgttgccgccggcgacgctgttcgcggtggggttcctgctctgcccgttccccgccttggtgccgtccggccgcaacctcaccgcactgctgccggagctctgcgacctcctcggctccctctacacccacgtccgggacgacctcgtcctgccgctcactgtcgcggtgacggccccccgccggcgccgacggtggcgctctttgagataccgatgaaaacttacatctcagttctctcacatagtctcttgaacttggatgtatgattatgtgcatgatggtgtactcggggttccggtatgtaaagaatgtatcaaatcaaatgtgcttgttttcnaaatngtncctaantaatttggttctt

SEQ ID NO: 7844 - DNA, 651 bp, Triticum aestivum
  Clone ID: PAT_TA_7844
gaagaagacagtgctactagaccggaaacttatagttgagctcgtcgatgagtacaaaaacggcacattgagctggaccgatttctcctcctctgtgaaggcatcacacacgagccgcatgggcgcgccgtccaggaggcaggtgattcctgacaaacccaaggaagaggactacttctatgccaatcctcatgagtgcttgcaccaaccagatgagctatcagctttatgataccctcggatatacacacattctttccagagccatggcctggcctggattacatttcttgagtaggcataattggagatctagctgcaattgcattgatggggacaggcacctgagagggataaatggtgccttttgttaggtgataatatacacagattggcatgattttgccagtttttcatcgttgttgttgtcggaataagcagcatgtgattttgtgttgtacatatgagcatagggcttagaagaaaaccacacgcacgagttggggggtttcggtttctgtattgagcttgcatgtgatgtgatgcatatatactcgtacattctgatggtggtggtcagaagctcttattccgttgtacagaattgggatgatttggttgaactgatgatattggtgtttaaaaaaaaaa

SEQ ID NO: 7845 - DNA, 1049 bp, Triticum aestivum
  Clone ID: PAT_TA_7845
gcagcggcgtctacaacttcttcggcaagggcaagtacgagggggactgggtggacggcaagtacgacggctacggcatcgagagctgggcgcgcggcagccgctaccgcggccagtaccgccagggcctccgccacggccacggggtctaccgcttctacagcggcgactgctacgccggcgagtgggccggcggccagagccacggcatcggcgcgcagacttgctccgacgggagctcctatgtaggggagttcaagtgcggcgtcaagcacggcctcggcagctaccatttccgaaatggcgatcgctatgccggggagtactttggggacaagatccatggcttcggtgtctaccgctttgccaatggccattgctacgaaggctcctggcatgaaggcaagaagcagggattcggaatgtacacgtttcggaacggcgacaagcgatccggggagtgggacttcgggactctcaagagccccctgcccccaacagatccttccgtcgagcgtgccgtgcaggctgcgcaacgggccgcggagaacgccttccacctgccgagagtcgacgagcaggtgcacaaggtggtcatggccgcgaacagggcagccacggcggcgcgggtggcggcgatcaaggcggtccagaacaggatggacgggaaattctgcgatacctatgtgtgaagcgtgtgtgttcaagaaaacatgcccctttcctctaactgtacattagggtagtggaggccaataacactaatcggtgagagtttcagacgacggcgacgacgacgaccggggcggcacaaccgcgtgctccgagtccgtgagagagaccagcaacaaggcgggagcctccgaggagcggagctgacaagttttgcatttcaaaaacagctcagatcctgcgacgatcgcgatcgcgatcatcggcggtcccttccttcccccccttccttccagcaagctgtaaattgtacatagatccaagttgtatcaatggaagagtgagcctttccagttcaaaaaaaaaaaaaaaaaaaa

SEQ ID NO: 7846 - DNA, 1178 bp, Triticum aestivum
  unsure (1)..(1178): unsure at all n locations
  Clone ID: PAT_TA_7846
gatgtccgaggcaagtcccatacacgtatgggctagggaagggccctgacatcttagcaacccacttctcagatacactcaatcacttaggtattacaggtttgtggtggttttgatgtacatcgagagaggattgagaggagccagaggtagaagaaagagagccagaagaagccgccgccgccaagcctgatcctacgcggatggtctgctcgttgcttcctcccaggtataagtagctgcagcgcttgagaatttccagccgtgccaggcccaagtgatgtccagaggcaagcccacatacacgtatgggctaggaaggtccctgacacggaggagaggaaagggatcgaccggagttgcgggcgcagcatccgggtccagcctaggtgcagcggcgctcgatacagaggatgcgacgcgggatacagaggagcgggcggtttgtgtcgatcgagtggaggcgcgggatccagctgaggcgatcgaggggaggcgcgggaggatgctgcccttcccttcgcgccccactgccggcgtcgccgccgccggccacatctagccccctcagaacttatcgccctcacgtcttgcttcatatcttcccatccccattcgttctgcagccatgttcattcctaaggttggcatcttttccactccccctcctaatcgatttggttcctgaaaccaatgtttgctactatagctgagggattggcttgtttgcttcggctgctcgcctgctcggtaaggccaatccattttagtttattccagaggtccacgttgcattgcagtgattcgttccttatttgcgtccatctcacttgattaggatgtgctcgacggcgcgtgcgccaacgcacggtgaggtcaggtagctggtagagcatattggttagttgataaagactgcaactgcaggggaacatataggaagcacgtgcaactccagttcagtgtggaccgatcggtcaccctccaccggttccagcctgaggcagaagtagtctttgcttgctctgcttcacaacgatgcttggtccatgtctctcccatgacaaccgcctagggaaaacgataaccatctggaccatgttggcactacatggtgtagtgttaacgtagcataacttgtgtgtatttcctgatgccnctcagccctatacgtacaa

SEQ ID NO: 7847 - DNA, 614 bp, Triticum aestivum
  Clone ID: PAT_TA_7847
gcggggtgtgcccgccgcaccttgcgccacacctacgtcggcgctgcgggccctgtgcgtggtcccggtcatcgtggtgcgtggcggggccggcccccgtggggtggtccgtggtgcttggtggggtgggcgcgcgccctgcggtcccggcatcgtgggtgtgccctgctgtgctccttcggcgctggcctgcccgtccctccggccgcggggggccgtgggctgcaccggccccgccgtgctgctcccgccgcccggcgccggcgccggtcgcccccacctgcccgtgcctcccgcctccggtggcctccggcttccgccagcgcccccacctcctcacgacgctctccgcgtgtggctaccgctgtccgccacgctatgtcccgccaccttcgacgggacggcgggtggtccggtcgtcgctttagaccaagaaactgcagccgcgctctcgctggtgtctgtcacacatgttggccgttctctgaatgcttcagcacacatgatagcactatcttccgagtttcatgttaatttttgtattgtgtattctgctccggattccaactgggaactctatattgatgttcgtaattaataacgtcaaagtttct

SEQ ID NO: 7848 - DNA, 641 bp, Triticum aestivum
  unsure (1)..(641): unsure at all n locations
  Clone ID: PAT_TA_7848
gaggaattcggcacgaggcccctcatggaggtcttggtgccgtcctcctcgcgaggcttggcccctcacgagggtcttgagttgttgatgctgaagctcggccataccaggccgtcgatgaagccacgctgtgggccgcaggcaggcaagtctgggtatcctcgttcccagaacaccgacagtagcccccgggcccaagccacgctcggacttggcttcgaggcgaatccagagggcaagggcgaagcgctgcgggccctaaccgcctgcagcctcggtcgatgcgtggcgattgatggggcgtgggcgtctccacttccccatgctgcctcggcaatcgttcctggctgacaaaaaggatggtgcctgctacggagccttcattgcccccccttcgtcttgctccagatccccttctccttttgcccggaaaatctccagatctaccgaatctcttccccaagcccgcgatggccaccaacaaggcgaagtcttctgccacggctgtgcgcccggcctcttggttcgagcgggccctgagcgcgtccaccatcactgaagagaagcacctcgccgctgcgctccagctgatggtaagcagcagtgacaaggggggagagatggcgctctgggtcggctnc

SEQ ID NO: 7849 - DNA, 442 bp, Triticum aestivum
  Clone ID: PAT_TA_7849
gccggccggtttgggcgtcgccgagtccgctaggttttccagctctcccgcacccgccgccgccacctccccactccccaccaccccctcagccatggcggtcgtcgagccggtgcccgggggcgacgtgaagctattcaaccgctggaccttcgaggatgttcaggtgagcgacatctcgctgaacgactacctcgcggtgacgtcgatgaagcactacaccttcctgccgcactcgggcggccgttactcggccaagcgcttccgcaaggcgcagtgccccatcatcgagcgcctcaccaactccctcatgatgcacgggcgcaacaacggtaaaaagatcatgggccgtccgcatcatcaaggacaccatggagatcatccacctcctccctgacgccaaccccattcagatcattgtgtgcgccattattaacagtgg

SEQ ID NO: 7850 - DNA, 636 bp, Triticum aestivum
  Clone ID: PAT_TA_7850
ctcccccctgaggagggtgaaccaggctatctaccttctgaccactggtgccagggagagcgccttcaggaacgtcaagaccattgctgagtgccttgctgatgagctgatcaatgctgccaagggctcatccaacagctatgccatcaagaagaaggacgagattgagcgtgttgccaaggctaaccgttaagatggatgtgcatctgagggtctcgcttttggctggagattttgaagtgaatgtgttttacaagatatctagaactgttttagctatgctttaagttttatggaatgaacatttcgatgtagtggcaagaacgtgcctgatgcttgtctttgtgaaacctattcctgttcagacatatttggatatgttgaatgtcgatgtgttctctcaaaatataggaaaaaaaaaaaaaaaaaaaaaaaaaaaaaaaaaaaaaaaaaaaaaaaaaaaaaaaaaaaaaaaaaaaaaaaaaaaaaaaaaaaaaaaaaggggcggccgccgcaatctaaaactagcagggttcaaaatttaaatgcttgatgtatggatccatccatgtctgcaacccgaaatggttttgtttggaacaaaaaaaaaaaaaaaaaaaggggggccgttttaaa

SEQ ID NO: 7851 - DNA, 2091 bp, Triticum aestivum
  Clone ID: PAT_TA_7851
accagctctgtttgccgtcccgccccccccgcccccactaggttttccagcctctcccgcacccccctcctgcacctcccgccgccccccccccccccccccagcgcctgcagagccggggccggggggtggagtaggtgctcgacctccgctggaaccgccgccgccacctcccctccccccaccacaccctctgaccatggcggtcgcggagccggtgcccgggggacgacgtgaagctcttcaaccgctggaccttcgaggatgttcaggtgaccgacaatctcgctcgaacgactaacgtcgcggtgacgtcgactgaagcactacacatttcctgccgcactccggccgcgacgataggcgaagcagatcatgccgcaaggcgcagtgacccaatccaccgagcgcctcaccaacctccccccaatgatgcacgggccgcaacaacgggatagaagatcatggccgtccgcatcatcaagcacaccatggagatcatccacctcctcaccgacggccaaccccatccaggatcatcgttgatgccatcatcaacaggtggtccacgtgaggatgctacccgtaattgggtctgctggtgttgtggaggaggcaggctgtggatatctcccccctggaggagggtgaaccaggctatctaccttctgaccactggtgccagggagagcgccttcaggaacgtcaagaccattgctgagtgccttgctgatgagctgatcaatgctgccaagggctcatccaacagctatgccatcaagaagaaggacgagattgagcgtgttgccaaggctaaccgttaagatggatgtgcatctgagggtctcgcttttggctggagattttggagtgaatgtgttttacaagatatctagaactgttttagctatgcgttaagttttatggaatgaacatttcgatgtagtggcaagaacgtgcctgatgcttgtctttgtgaaacctattcctgttcagacatatttggatatgttgaatgtcgatgtgttctgtcataaaatgtattacggtgtccgcgtgtggaaaaggctgcagtcgctcgtgaatctgttcaagatgatctcggagcagaagtctcctataaccaggaggaaaagccggtgagcagggacaaagtgtttggcacaatgttctatagtatcagtttgctctgatgatgttcctgttggtgggctagtcttttggctgtcgtccccaaggcgcaagtttggtggggatcaggttcagagcaagggagcatgtgtctgaatgtaaaacgccctttagaacgattgcttatcctagaaagtgaagatggcaatcgacgatgtaagccctggattggattttcacctgcttgaatgtaaatgtttggtatgtttgctgtgactttcatactagcctagcaccacggtcttggctgtgctgttttttcgggcgaccagaagcgtgccatcaaaatagcatctcaactacactgtggtgttgcagcaatcaatgactttgcttcaagttatatgtgtcagtctttgccctttggtggtgttaaagacagcgggtttggaagatcgctggcgtggaagcttgcgggcctgctgccttgtaaaggcagtcgtagaaacaggtggtggcatatgtgaaaacaatgatccccaacccattcatatcccgtctcagagaatggatttcattccagcagctgctcgtcgagactctgtatggcatcagcgtgtgggacaggctgcagtcgctcgtgaatctgttaaagatgatctcggagcagaagtctcctataaccaggaggaaaagccggtgagcagggacagaactgttctgtgcaatgttctatgggtatcagtttcgttggtgatgttcctgccggtgggactagtcttttggctgttgtcccaacgtgccctgcctgacggggccctggttcaggccaccgcagcgttttcctccctgtaccccgcccttcccgactagtgcgtttcctagaaagtgaagatcgcagtcgccgatgtaaatgtgaatgtgtttgctggacattcatctagcaagcacctcacctca

SEQ ID NO: 7852 - DNA, 880 bp, Triticum aestivum
  Clone ID: PAT_TA_7852
ccacgcgtccgaatcgcaaaagatcagccccatatgcaggtgcctttcttgtgaaggatgaagagggtactgaccctagtattgtagccagtccagattcatcagacaataaaaccattgatagtctcaaagggaaggagttgttgaagcgtcttcatgaagttggcactctggctcagataactagcatacaaggggatcaggtagtgcttcttggtcaccggcgtttgcggataactgagatggttgaggaggacccacttacagttaaagttgaccatctgaaggaaaatacctacaacaaggatgacgatgttataaaagcaacctcatttgaagttatatcaactttaagggaggttctcaagacaagttccctttggaaggatcatgttcagacctacatacagcatgtaggtgatttcaactacccacggctagcagacttcggtgctgctatttccggcgccaacaagttgctttgccaggaagtgctcgaggaattagatgtagataagcgtctaaagttaactcttgagttagtaaagaaggacatggagatcagtaagttacagcaagcaattgcaaaggcaattgaagaaaaaattagcggtgatcagcgacgttatttattgaacgaacaacttaaagcaatcaagaaggagctaggtttggagactgatgacaagacagcattgtctgaaaagtttagggaaaggattgaagcaaagaaagacaagtgtcctcctcatgttttgcaagtcattgaagaagagctcaccaagctacagctgctagaagccagttctagtgagttcaatgtaactcgcaattatttggactggctgacggtattaccatggggaaattatagcaatga

SEQ ID NO: 7853 - DNA, 638 bp, Triticum aestivum
  Clone ID: PAT_TA_7853
gttttgtctccgtataatccagatatttcccccacgcctccatctcccaacctccagtctccagattccaatctacgccggggtcatgcccacctcgcgcatcgcccattccccctccctgtgcggtagcagccctaccccgaagcgctggcctccgccgctaactccgtccaccgtcgattccctttctcgtccatcgcaacctcggtagtccgagcccgtcggcgtccgtcgtcctcaccgtcgcaatgccgggctcctcctgatgttgtcctcaccgtcacctagccgcatccactttggtgtcatacgccacctaaagatctaccgcgtgttccgtcgctacaccaccccgcaagcatcttccgcctccggcccgtcaagcaggttcgtgcgcctcttcccgaatcttgtgccccgctattttaggagtatataacccaacctattggatggccgactcatgtcaccctgttcgccttggtcgccgccacttaaacacatggtggtgcacaccagtgcaagcacagtggcggcttctcttgcctaggtttgtgggtacggcacatatttggaggttcagctcctgcctgcttgtgcaaaaagttcatgatttgcatctctaatataacatggta

SEQ ID NO: 7854 - DNA, 623 bp, Triticum aestivum
  unsure (1)..(623): unsure at all n locations
  Clone ID: PAT_TA_7854
cacgttcatcactagctagctagctagctatgcagatggcccgcgccggagctaccctcctcggggtcctcctcttcgccttgctggccggtttcgcggccggggaggaagactgctaccacgacatcataagatgctgcaacgagacgatcaagaaggagggtccgtacatctcccccaagccaggtctgccgccgcgaggtgaggaaggcggacatgccctgcgtctgccacatcctcaccgcctacgacgagcgggaccgtcagcccagagaagctcgtccgctgcgcccacgactccggcgtcgaccttcccgtcgggagcatatgcggaagtaagcagacccgctcctccaactggcgccatctgccgccgccgccccactaccaccacccgcctacttcttggaacagtcagtcgtttcgccatccgccgccgccgcccccacaccaccacccgcctacttcatggaacagtcagtcgttgcgccatccgccgccgtcgtcgtccccacaccaccacccgcctacttcttggaacaatcatgtcgtttngccatncgccgncgtcgtcccnacaccaccagccggctacgacttggaacggncactcgtttcgncat

SEQ ID NO: 7855 - DNA, 413 bp, Triticum aestivum
  Clone ID: PAT_TA_7855
tcgcaggccgccgcgggtccgtcgcaccgggttgggcggtcagtccggcgctcctgggttgcgggtggggcgcgggctcctgggaggcagcaggcgtgcagtgggctgtgtgcacccaggccttcggccggccgttcgctcctcggctggctgccgccgctcccggcatccgcgggcagcggcggcgcgctgggaccgcctgcagcgctggcgccggcggacggtcctccacccttgcgaccgcgaagtgtgctccaccctgccgagcgcgcttggagctttgccttgccaagtgcgctcgttgcttccaggtgtcagtgtttggatgtgataataatatgcccggtctcggcgagtcgcggcgaaaactgcttaaaagcgaaattcatagaagttaaaaaaaaaaaaaaaaa

SEQ ID NO: 7856 - DNA, 429 bp, Triticum aestivum
  Clone ID: PAT_TA_7856
cccacgcgtccgaggtgtgctacctaaatatttccactcggagtggtctgttgctcaattcaggctccatgagggtgagcaatacatcgtcgcatttggccatgagaagaataccgtggcagttgttggcatggacggaagcttctaccggtgccagtttgacccagtcaatggaggagaaatgcagcagctggaatgccacaatttcctaaaaccatcagatcaaccgtagcaagataataaagcagcaactatttgtctgcattgtgtgccatggctgtctgtacagtatctctgtaagctctcggctcacccgagggctaatgttatgtgtaaatatatgcctttggtgacgatgccataatgtgctctgtggagggtcagaaggagccttgtgcagatgaacaatgatagaatgcatcttttatc

SEQ ID NO: 7857 - DNA, 1580 bp, Triticum aestivum
  unsure (1)..(1580): unsure at all n locations
  Clone ID: PAT_TA_7857
tcgaccaggactacggctgcttctccgcgttgaccaatacgggctttcgcatctacaactgcgaccccttccgcgagatcttccgccgcgacctcggcccctcccccaccgccgttcctggggaagaggccgcccaggccctccaccagcccgccgtcgcgggcggcggcggtggcggcatcggggtcgtcgagatgctcttccgctgcaacatactggcgctcctcggcggcgggcgccgacgcgccacactacccgcacacttgtgaggatgatctgggacgaccaccagagccgctgcatcggggtagctctccttccagaccccccgtgcgcggcgtccgcctccgtcgcgaccgcatcgtcgtcgtcctctatgaacaagatcttcgtctacaactttgccgaccttaagctggtacaacagattgagaccgcgcccaaccccaagggcctgtcctctgtgtcgcagcagcccgggaccattgtgctggtctgccccggtgcgcagaatgcgccgatcagggtcccgcactgtggtgcctggaagactaagtttaccgctgcgcacgcctcccgtgttgcgtcgcttcgcgttgtcacaggatgggaggctcattgccaccgcgagcaccagggggacgcttgtcaggatctttaatgctgcagagggcaaccttctccaggaagtaaggcgaggtgccgacagagcagcggtacatagcttggctttctcaaataatttacattatttggctgtatctacgtgataaacggaacaattcattcgctcgacgcttaagttacatgttggttggatcgcaagctgataacccccgcccgcccccaggggccgatgttccccatattagtccatcatttgcttttattaaaggtgtgctacctaaatatttccgactcggagtagtctgttgctcaattcagcctccacgagggtgagcaatacattgtcgcatttggccatgagaagaatactgtggcagttgttggcatggacggaagtttctaccggtgcctagttcgacccggtcaatggaggagaaatgcagcagctggagtgccacaatttcctaaaaccatcagatcaaccgtagtagcaaaataataaagcagcagcaactatttgtgttccttgtgtcccaaggctggctgttccatcccttgcagttggtcatgagaagaataccgtggcagttgttggcatggatggaagcttctaccggatgccagttcgacccggtcaatggaggagaaatgcagcagctggagtgccacaatttcctaaaaccatcagatcagccgtagtagcaaaataataaagcagcagcaactatttgtctgccttgtgtgccatggctggctgtacagtatctctgtaagctctcggctcggctgagggttaattaagcagaggctaatgttatgtgtaaatatatgcctttggtgacgatgccataatgtgctcctgtnggaggctccaagaaggaagaacccttngtgcaagatgaaccaatgattagaatgcaccttttatcaaaaaaaaaaaaaaaaaaaaaaaa

SEQ ID NO: 7858 - DNA, 639 bp, Triticum aestivum
  Clone ID: PAT_TA_7858
gaacactttcagatcaggagttgttcaaattcttaagggcattgggatattgaactgcagatagctgcggcaggtttgttaggctaatataaagtagggacctttgctacataatgatacaaagatgataccgaaggttgttttgcaactagcaagtttcaaggtcacatggatgctgacagctctcaggtgtatggcctatttgttgctgggtattgttgcctttcttcctggtttatacagcggaggatcctgagttgatgcatatattggctcaaaaagtaactaggctctgaagtgcagattgacaagagccatccagggggccagggcgattagatgcccatcactcacggcggcaagaagttccgtgtcgagttgatgaaccagcaccagctgggagcccggatgaagaaggttgtccccgcggagaaaaaggagaagtgatgagatgtttttgacagctaatggatgatcttatcttactctgtgaatttttgttttggtcgatttagaaaccttgtttgatgtctgaagatccctttttgcccactgttcaaaccatctcttcatttttgtgtaaatggtaacaatacacttcaaacaattaagttgtcatcccaaaaaataaaaaaaaaa

SEQ ID NO: 7859 - DNA, 410 bp, Triticum aestivum
  Clone ID: PAT_TA_7859
ggccggagaaaaatgtagccatcgtgtgtacaccaaggggcagggcctctacgcaaagctcttgtgctcttccttggtgtgtgtgtgtgtgtgcgtgtgtgtatgtagagtttctccatggtgtgtgttcatgagagatgagaggaagaagaagaacggcgctgcgcggaggcggcggcaacatttggtatcatgagctcggtgtcttgggcgtgcttgccgtgtcggaggcgtggtggcggtggcggctgttcgccggcggctgcgcggtgaagctccgggctatgtgtcggtctatggaggtgcgcggcgcggcgaggaggccgcggtggccgctgcggactcggcgtgcgcggactacatggaggcatatgcggacggtgacgttgttcgtgctgcgagcgcggatg

SEQ ID NO: 7860 - DNA, 651 bp, Triticum aestivum
  Clone ID: PAT_TA_7860
acttaaaaacattttaagaacccagaatgctctttagaaaagttcatcatttttgaactagtttagaacctctgacaaaaatggtgcacacctttctaggtcatttatggatttttgaattaaatcataagtatttgcatttggacatttaaatcctataaataattttaaatgtctagataatcttgaaagtattttaaggttgttggtaataatccaaacatatgccacaatcattttcaagatttttgaaaatgaattagtatttttactaattcaaaacagaataaaagtaatagaaaaactgaacagaaatggaaaagagagagagagatagtacctggccacttacctcagcccgccactgtagaggcccagcccataggggcatgaccgtcttctacctctgccagtaggcagagccagaccagagcacgacgccggctgtgccagctcttgcttcgcgctggcgagctctcctttccccccctcagaccctcaagatgtgacgcagctccctggcccactccctcactctcctcgtgctcttcccctcctctctctcccgctttgcacctcgtgcccgagcaccaccatctccatcgtcgacgtttggtcgtgacctccgatctcccccatgcccagctagct

SEQ ID NO: 7861 - DNA, 634 bp, Triticum aestivum
  unsure (1)..(634): unsure at all n locations
  Clone ID: PAT_TA_7861
atcctccccaccctccctgcattgtgtgctgctatcccctttccatcttctccccaacttcccaagtgatcccaagaggatgggctcgatcaggaggcgggagtacgcttacgacgccgacgacgaggacgatttctacatccggaacgatgatgaccttctagaggccccgaccctcaccagtgagcaaatggcgcgcgccagggaggaagctctgtacgtgctgaaaaccaagtcccctgaagaggctttcaagattttcaccgagggttcctattacaaaattgatggtccgccactggcaccggagaaggaggacaaggccccgaccaccgcaacgcctccaacagccaccgccaatgtgaaggagcagccccagaccaccgtgccgccatcaggaaagtgagcgtgagcatgagcaatccggacggttcaagaagttgtagtaactgccccccgttgtagtagcgtcctgcccatctggtcatgttgaaccatgaataatcgtgtgtttgtttgctcgctggtatgtgaacctaagggggacctgtattcctcctccgtgatgttccgccgaacgaaccatccatttcgtttaatgctatggcgtttactttgttcgttccaaaaaana

SEQ ID NO: 7862 - DNA, 649 bp, Triticum aestivum
  unsure (1)..(649): unsure at all n locations
  Clone ID: PAT_TA_7862
aggcggaggaggtgtggtgcagtgcgcactgggaggcagcatggccatgaagggcgcggctggtcgtgcttgccggggaagtaggggccctgaacagcgccggggattcaggcgtggggcgtgccaggagcctgaggggcgatggcgtggaggatctcaaggggtgcatggatctggggttcgatttgcagcagcagaacccccacccctccaaccccgccggaagcaacacaactccaccacaacaattgtatcgcccgcgtcaagtcgccagaacctgtggaccaacgcgcgccgttgcgaccttgcaccctcgtccgaccttctccgctcctagatttggagcgaggtgggactaaatcacgacatggagattgagaaggttacaacgaaggaggtaggagaggactcgcggcggcggacagggtcacagcggcgccgttgctggaaagcgagcgcctggacaagataaaacagaggattgcggattgaattcttacaaatgtagtttttttttgtaaaaagcgaaatattttctcagattcactcaaaaagggactgtgggttgaattttcagaaaacacaaggacttttctgtaaaaacacaaacgacgtatgaccagaagtaatcaccgctttantattaggg

SEQ ID NO: 7863 - DNA, 799 bp, Triticum aestivum
  unsure (1)..(799): unsure at all n locations
  Clone ID: PAT_TA_7863
ggagaaattaggatatatttttactgctttagatgcaagcatcttcttttcctgggcctgcagctatttgtttggaaattaagttgaagttaacgacatttgttattctgcatgggcagggatgcagagtattaaatatttctaggacataaagtacatcggcaatttaagtatttaagtagtgtatcaattttcactgtattctcagttttaatcttagtgtagcttatgcccagatctttagtatatgattaatctcatctatttcttgtgagatgccgactgaataaggaaaccagtaaagtttcccgttcttagatctaatgcttcctctctctcaatatgataaccatctaaattgttattattatttacactgtgatgctaatcttatttgttttgaaaaagatgaatctacatgatagatatgaactcagtgaataaaatttgggactaacattcaagcacaataatgtgaatacaacatatgcctgctggtgtgctggaattcaccagttgtatcaagaaaacaaaaagtaaaacaggtatgccaaatgagtgaaatttcttattctactctttacagctaaaagcataatctgccttatttttctaccaagatacccgaatagttatagtcaatatattggttttcttggttttgacccggaaactcgatgtagttgtaacccccggtatgattgaaaatctaaaattataatttcacatgactaaatgtccccattaaatttatttctgttgtctctagaattaacagtgcttcaaatgataattnnnn

SEQ ID NO: 7864 - DNA, 677 bp, Triticum aestivum
  unsure (1)..(677): unsure at all n locations
  Clone ID: PAT_TA_7864
atgttgtgctgtcttacaaggatatgagtnacacaaattcttatgggcttattcgaggtcttcagtttgcatcttttattgtgcagtactacgggctggtgctggatctcctacttcttggtttaacacgagctagtgagattgcagggccgcctcagatgccaaatgagttccttacatatactgacactaaagttgagacaaggcatcccatcaggctgtattctcgatatatcgataaggtgcatataatgttccggttcactcatgaagaggcaagggatttgattcagcggtacctgacagagcatcctgatcctaataatgagaacatggtcggttacaacaacaagaaatgttggcctagagatgcaagaatgaggctcatgaagcatgatgttaatctgggaagaagtgtattttgggatatgaagaatcgcctgccaaggagcattactacattagaatgggagaatggctttgtctctgtatacagcaaggataacccaaacttgctttttagcatgtctgggtttgaggtccgtatactgccgaagatacgtatgactcaggaggcattcagcaacacgaaggatggagtatggaacttgcagaatgagcagacaaaagaaaggacagctattgcatttttgagggttgatgatgaacacatgaag

SEQ ID NO: 7865 - DNA, 544 bp, Triticum aestivum
  unsure (1)..(544): unsure at all n locations
  Clone ID: PAT_TA_7865
agggctttatcctgagcttgacttctattctatcgtcgcgctgactgagaagaagtttctggacaagtatgtgcatccttatgagaagagtattccaggccttgctgcgacttatgcatcttactgtgctgagaaggtgccgaatgaagtttctnacctgaaaagacaaaatggaaaaggagactctgtgcatgcttagtctgggagcatgttgctggattgtcgtgttggaataacattttaaggcaccagctggtagcctgaaaaccaagaaatggaagggcttctggaaaactatcaaggtcttctgatggttgatttgatctgcgcaacaacagcgaattcagactggacaaattttgtttggtagatttagtttagtgggggatggctgatggagtaatagtggtgctggtgcacatgttgagttgtattttactgaaattgtcttggttgacgagcgagacctaatcaacttttttttttttttgaaacaaggcaaaagatttgccattttcattgattaaaaaaaaaaaaaaaaaaa

SEQ ID NO: 7866 - DNA, 909 bp, Triticum aestivum
  unsure (1)..(909): unsure at all n locations
  Clone ID: PAT_TA_7866
ccccccgtccgcgggctgattccagccgttgcttgcgtcggagacgaccgcactgacgcgatggaggtgccggcgccgatcaagacggggtcgtggagccctgaggaggacgcgctgctggtggccctcgtccggcagcatggcgcgcggcggtggagcgtgatcagcgccggcgtccccgggcgcacgggcaagtcatgccggctgcggtggtgcaaccagctcagcccggccgtgcagcatcgccccttcacagtgcaggaggatgcgcttatcatcgccgcgcaggcacgctacggcaacaagtgggccgacatcgcgcgactcctccccggccgcaccgacaactccgtcaagaaccactggaactccaacctccgcaggtgccagcgccgcgccaaggccatggccgctgccactggccgcagcgtggtcgcccgcctcctgcctcgttcgtctggatcggctgtgagagcgaagatgcagcaggaggaacaagtcatggtgatgaacaggtcgccaccagccgtcgtgcatggtgcagttactgctgttattgatgacccgatgccaatgctgtcactgaccttgagcctgggcctgccccagatggccgcagataaggcctcagaggaggcaaaggcaaaggcaaaggaaaagacaccaccaccagtggggtgtgggggggcaatgacgtgcgactaatggcggcgatacggcaggtggtgagggaagaggtggagcggcaggcagggcagctcttgtactcggttgtcatggccaccaccgctgccagggtcgacggggcatcatcgtccgatcacccaaccaacggccaccactaaggtgggtagtcgtatcatatatggatggttttcagtgtaatntnctgtcattactatttgtgtt

SEQ ID NO: 7867 - DNA, 710 bp, Triticum aestivum
  unsure (1)..(710): unsure at all n locations
  Clone ID: PAT_TA_7867
ggccgcccggggccgcggccgcgcaagcacgagggccggctcaatcctcgccggctgacactgctccttttcccccaggccaagaccccccatcaccaccaccaccaccaccaccaccagaagaacgaaagaaaattaccgaccgcttaattacttacagccagccagccagccagtgacatatatgggtttgtgtgttttgtttgaaccccttgcgccttcggtggggcggcgttgcgaccatgcatggtttttgcgcctgcagcagcagcagcagcctgtatcagtgacgaacatgtataggttagagacggactgaagggaaacggtggccagtgcctgccggccattggggagttactgccgcttcctatgctgggactgtgctgtcacgggttacccgggctctgttcttaattatttgcctttgtgtttccgaccgcttgttggcgtacggccagccaggcagccagtgacatatatgggtttgtgtttttctgtttgaaccccttgcgcttttggtggtgctgcgttgcgaccatggtttttgcgcctgcagcggcagcagcctgtatcggtgacgaacatgtataggttagagacggactgaagggaaatggtggccagtgcctgccggctattgggagttactgctgcttcccagcgctctgctcttaattatttttctttgtgttttgtactctagnagt

SEQ ID NO: 7868 - DNA, 826 bp, Triticum aestivum
  Clone ID: PAT_TA_7868
agtcggcacggggcgggtggtggacccggaagagagggacagaggtgagggcgacggcttcggagctcgtcggggcgcgctcccgtcggccgtaacgcgatcgtcctgcgcggggttggaccggccgcggcgacgggcggccgaccgtggcgccacgcgggccccgcgccggaggccgcgcgggggctcggaagtgctgcaatggagcagcacggcggatgggtgggaagctcgtggccgtgcaataaaaccagtggggtactagtgaccgagtgtgagctccataattgctcatttagtctgagtctatctggtattctggttactccttgccatttggtttttcgttttccctaaagacgggcgcttcggcgtctgctccttccttatttgaggaagagaactgcttcatgaaacttcctccccgcagctggccatctccgggtaagtcgacgggcagcctatcgtgacggtgcccaagggccgcggcgagggcggcgacgggactcggaggtgctgcaatggagcagcgggggagattggcgggaagctcgtggccgtgcaatagaacgggtggggtactagtgagcgagtgtgagctccgtaattgctcacctagtctgagtctatctggtagtctggttactccttgccatttgttttttctttttccataaagatgggcgcttcgtgttctgctccttcctgatttgaggaagagaactgcttcataagctacctccctgctgaaggacagctattgcaaagtttgcacaaactccttgctttccatggaatcaaatgtgaatgccgatgaaattgtccg

SEQ ID NO: 7869 - DNA, 913 bp, Triticum aestivum
  Clone ID: PAT_TA_7869
aaaaacaactcattccacctcgccgccgcctcgcaccccggtatctccacgcgcggcggatcctcgctgccgccggtgggcatctcactaccgatccggtcccgtgctgctaggtaggtccgtcccaagccatcctcaacgatgcgtccccgccgcagcccctccgccggacgcagttcaccggagtccagcaacgcgtcacaatcaagtggcagtcaatctagtggtgggatgaaaaatccggatggttcgattcctatccccttcaccatccatcgaggtaatccagaccggctaaccggattgggctcttcgtatttggagatgccttccggtcaggagaatatcaatctgactaaagaggattatccaaagcttgtcctcgttataaaagatgacgacgagaaccaacaaatgtgtctaaagattatgaaaagcttgactcatgagaatgtccttggagtgcatttctgggaaaaggttgaagaaggaccatatatccgagttcatgtggagccttacacagcatcgatttcaacgatcattagcgaagctgaatctcttgtcgatcgtaggtcaaaattggttccatctccggcctttgaagagatagtgagtgcatcaattgatggcctagactacattagagagagtggttactaccatggtaacttctcatgggaaactactctgtaccatcaggaagctgataaaatagtagtcaaattggcgaacttcgaaataaaaggtccttctctggtggaatgccaggtggaagactgtatctctctggcagcctctcttgagtgggcatctcaaaagttgaagaaggagtatcccaatgtcaagccacacacttgctacataatagatgacctcataaggattttgaagtcttttactatgaattctg

SEQ ID NO: 7870 - DNA, 830 bp, Triticum aestivum
  unsure (1)..(830): unsure at all n locations
  Clone ID: PAT_TA_7870
ctgcaggnaattcggcacgagggcgaggtagggtagggcagctgagcagggcgaggcgacgagagctgtcggcccagcctccaggcaagcggcggagaggcgccggcggcagtgagcctgaagggggctccttggaggagcggcgggtggagcggtcggagtctaggaggaggaggcggcggcgcggaggaaactttcgcccactactcgatcgggttaggtcttttcatcaccatcaccttatggaagcgactgcaatctacgatactcggcttgggacctgggttatgttgtctgatggagaagattcgacaagtgcggtcttcgatcggctcttgtcacatgtgtttaggttgtatcgaggggtggagagcgttctctgtgttggagcagccttcggtttgtgctgggcagcttggaggtactacgagcgcaactcgtgcctgcgcagctacggccgtgacatgacctgcagcaagcaggcagccaacccggtggtcggccgcgacagtgagattgaccgcgtcgtctccatcctctgccgcaagaccaagaactgtgccgcgctggtcggtgctgcaggagtcggcaagacggccatcgctgagggccttgcacagcgcatcgctgccgggaaggtccctgcggcactcgccggggcacgcgtcgtggaggttgatctcgcggcaatggtttctgggactctgttccgtggcatgttcgaggaacgcataaaaagcgtgataaagcaggcggaggactcaggtggcaagatagttctcttcatcgacgagatgcacatgcttcttggtgccggtgatggattgggg

SEQ ID NO: 7871 - DNA, 571 bp, Triticum aestivum
  Clone ID: PAT_TA_7871
atttcttcctcttccttttttcccatctttcccctctcaccttcctcatcttcattcgcaacgcaactgttgtgtccacgggagacactggagacgatgcacggctgggtcctgctgcgaagcttccgtcgcctgggcgctccgatgctgccggaggacgcggtgtcgtgctcgcctgcacaagctgcgggttttgcaaggcaggggcttgctgctgctagcccgcacgagcttctccaagggcagccccggccttttttttgtaaggtgaccagaaacatggttgctacagcttgagggagtatatcccggtgctcctccggagttactcacgcgacgcggtgagtgctgttttggtggggctgaaagtgatcttgtggttgcgaatctagtggcctaaatcattactgtattgacgcattttctattcctcaaggggtcgtcgttctccagctgattggattgtgcttgcttgccttctaatccccttacctctggttgttgatgcctcaagcagccgctgccgagtgtgtgctctggttatcggatatcagttgttccaaaaaaaaaa

SEQ ID NO: 7872 - DNA, 353 bp, Triticum aestivum
  unsure (1)..(353): unsure at all n locations
  Clone ID: PAT_TA_7872
tgcaggnaattcggcacgagggtgcctgctggctcttgttgtcatgtctaccactctcttgccctctcatgtagaaggaatgatcatggatatgaagggcacgacggtccgcacgtcgtgtgttgttatgaaacattgcacaatcggtcaatgccagaaaaactgttcagcgcgtggatatgatgaggatagaagcacttgtgtatccttcgaaggtgacaactgctgctgcttcaagaagggaacaccgctaccaagatgatatacaaaccatnccttgctaatgtcaaataagactatttgnatgtaactgnatgtataaataaactttaaacttcactccaaaaaaaaaa

SEQ ID NO: 7873 - DNA, 812 bp, Triticum aestivum
  Clone ID: PAT_TA_7873
ttcggcacgaggcgtcgttctagatctcggtgaagcgaggagaaggagaccaataagaatcctataagaatcgaggccggcgaagatccatggcggcggcgcttcgatccgcggcgaggaggctctggctcggccgtggctccctgctccagcgaacgcaggcggaggggctcttctcgccaagcagaagcaggctcgtccacaccagtgagcatgctcctacagaccttacgcgtgagatccaggagaagagagatgaggtacgaaacttggtatctaaggcggtgcagaagaaaagggagttgtatgcgttgggtaaggcagacaagaattgtgagactcttggtgagcatcacatgcttccactagcactcccatatctttctcggcaaaaagtcgttccaaaaccacatggcactctcaggaccttgatgcggttcgctacaagggctaacgctttgctggatgcagctgcccacgcgacaatcttcattttggttactactgcttgggttagagctaggggcggcattggggtaaaagcccaaactgttgatgaggaaaatcagggaagacaagattgaaaattgagaaccaaagatggctccgccagcttgttttcagttaagttatgatgacttacagtttggctagctagctagcactatgacattgttgtgatattgtgtgacatgatatgttatcgtatctctatctatccgagtagattgcatgtatgaatgaaaggcgtacgatatttttgttgtgctgtttcccaaaaaaaaaaaaaaaaaaaaaaaaaaaaaaaaaaa

SEQ ID NO: 7874 - DNA, 418 bp, Triticum aestivum
  Clone ID: PAT_TA_7874
cccagcccagctacggtgttagcgggcaaacgctcttcccgtcgttcccttccccctcactccctccactgcgtcctctcgctgccgccgccgccgccgccgccgcccgcccgatccctcgatccggctccgccgcgatgctctccatgtcgagggtgctcgcgaggcggctcttctccaccgccgcgcccgagggcgccgccgccgcctcgacgtcgctggcgaggaaggcgcagaaccccctcgaggagttgttcgaggtcgagcggagcaccgaggacgaccagcccgctccccactacggtcgtggttggaaggcttctgaattacgcctcaagtcttgggacgaccttcataagctgtggtatgtcctgctaaaggagaagaacatgctcatgtctcaacgccagatgctggc

SEQ ID NO: 7875 - DNA, 870 bp, Triticum aestivum
  unsure (1)..(870): unsure at all n locations
  Clone ID: PAT_TA_7875
gccccccccctcccctcccccccccccgggcacctacgcgtccggccgccgccgccgcgcccgccggcatctcccttcctctcccctgatccgtccttccgcaggttgcgcgatgcttgccctgtccaggacgctcgcgaggcggctcttctccaccgccgccgcgcccgagggcgccgccgccgccgcctccacgtcgctggcgaggaagccgcagaaccccctcgaggagttcttcgaggtcgagcggagcacccaggacgaccagcccgcgccccactacggtcgtggctggaaggcttctgaactgcgcctcaagtcctgggacgaccttcataagttgtggtatgtcctgctaaaggagaagaacatgctcatgtcccaacgccagatgctggcttcagagagcatgcgtttcccaaacccggagcgcatttccaaggtaaggagatcgatgtgccggatcaagcacgtgctgacggagcgggccatagcggaccctgacccgaggaggactgcggagatgaagcggatgatcaacgccatgtgaccgacccgcgccgcgccgtgcttctactgtccgtaagcagcagccgtagcagcattagcatctatctagtggaaagaacgaatttgctcgcttttccttcttgggttgtatgcctccccccgtgagatgcataagaccagcaatccttgagacgccgtcgcccccgacagtcccacggatggggcgaacgtcaatgggacttgtgttcgaataatccgcaaccgtcctttttttcttttgcatgtgtgtgtgtgtgtgtgtgtggcaaagtacatccggctgtttgtttgcacaatgtgttatggatgtccattggnttc

SEQ ID NO: 7876 - DNA, 1018 bp, Triticum aestivum
  unsure (1)..(1018): unsure at all n locations
  Clone ID: PAT_TA_7876
ccacgcgtccgagcatctcgatattgtggcaagaaacaaggaggcagtgcagcaactcgggtaactttcaagtgcaatcggtcaggaagagtaatttatgaagaagaacatgcggctcgggggaagaaacgacgtgacacaaggncaacagaaaacaggacaagagccctatcgcaacgcaaggaagaaaaaagcaaacaccattgcaataacagggtgtaaagctcagctcattgtcaccaagaaggatgagaagtgggtgataacaaccataaacctacaacacaaccatgatttgagtcctcacacagaagtgaaataccttcgttctcataactacatgacagaggaggagaaactcctaatccgaactttcaatgctgtgaagctaccaacaagacaaataatagcaatcctaagttacttgagaggcgggaacactccttacaccaaaaagcatgtaagcaatgttagaacagccattggcaaagagagcaatcaaaatgacatgatgcaggtgctaacatatttcaggaagagacaagctgaagatccacaattttactatgcgttcaaaacaactaaagtctctgatgacgcaagtaaagttttgtgcattttctgggctgacgggtattctaggaaaatgtacgagctgtacggagactgcctcagcttcgacacaacattcaagacaaacagatacaccctcccatttgctccctttgttggtgtcacaggacatggccagaactgtttgtttgcttgctctatcatagagaatgaaacagctgccccctttcaatggttgtttgagacattgttgcatttcatgggtgggaaatctccgtccccaatcataccagacgaggatgatgggatgaagacaactattcctatagttttcccgcatatctgccacatgcgttgttttgtttcatattaaaaagaaggttgaggaaaaatgtattaggacttttgcagcacataagacactgcatgatgattttagtgcccc

SEQ ID NO: 7877 - DNA, 1202 bp, Triticum aestivum
  unsure (1)..(1202): unsure at all n locations
  Clone ID: PAT_TA_7877
gccctcctcccaccccccgccgccacccagtgctctgctcgcatcctctccgtcgccaacaccgccgctcgtctgaccccttcggtcgatctcgaatgcttgctcccatcgtctgatcgcacgccgtagcttgattctctctctctctgtctcgtgatctcgcttggggatcggagcaggtcctgcagaagctcgagaagctcaagcacaagaagaagcgcctcgtgcagtcccccgactacttcctcatggatgtcaagtcccagggctgcttcaacatgtaactgctgcaaaatgaaacgaccgtgttcagccactctcagaccatggtggtgtgcccaggttgggagacggtgctctgccggcctacaggaggaaaggcgaggctcactgagggatgctccttctgccgcaagggcaacaaaggaatatcacgctcttcgtatggcgatctcatctaccactgcaacggatattgtcacaccatcgatgtgttcaccggtgtggaggtttcaactccacgtctcccatccagtgccaaatgtgggaaaaattctatcagaatggcattctgaaagccccccttgcatcacccccaactcacatctccttgtcagttcctaccgactcctccctgtttgattggcatgttggaagtgactcttggtctgaagtgcatatcctgatctggtggtaatagaccagattgtgggattcaatgagcagttccttctctcggagggctttgggagcatctagatctgcagttggcccctcagcttggtccggaggagataacacccgcgatccaggacaggagtgaacaccaggattaggaaggatggcggctggtggtttgtggtgacatgcttctcatgcacaatgctaattggctctactgccttaacatgtcaatcaagcctgcggtatggatggttgtggagaagctgaacaaactgggcagtcgtttggggggaggaagtgaagagcgcgccactttcttgcatgagcccggaactatgggccatggggcaggatgcaggagaagcaacattgtgtactttacccgtaaatctcaaacttggatctctctgggctatgtggcgagccgcatccacccggcataggaaaccattgttctactctggcggccaatgatgcggtccaaccaccacttgccgcggtactaactnctnctgaat

SEQ ID NO: 7878 - DNA, 600 bp, Triticum aestivum
  Clone ID: PAT_TA_7878
gcaggaatgcggcaccccgcctcgccatggacgactccagcgacggcggagccccgccggcggcactaagaagaagccttctgcggcggccgccaaggggaaggcgacgggaaaagggaaggccacctccaaggcggcgcccaaggccaaggagagcagcctcctcaagcagaaatcgcccgcagagttcttcgcggaaaacaagaacatcgctggttttgacaatcctggaaaatctttgtacaccacaatgcgggagctagttgagaatgctcttgattcagccgagtccatctccgagctccccgatatagaaattactatagaagagatcactaagagcaaattcaacacaatgatagggctagttgatcgagagcgcgttgatgaagcactctatgatgattttgaatcatctaaggctcgtgagaaacgcctagctaaagaagcacgtttccaagaaacacaagccaaaaatgctgctcttgggaagaaagttaaggacactccagctgctcgcggaaaaggtcggggcgaggcttcattttttagagtgacttgcaaggataatggcccgaggtatgcccgcatgaagatatc

SEQ ID NO: 7879 - DNA, 498 bp, Triticum aestivum
  Clone ID: PAT_TA_7879
tgcagccccgctaatcgaccctcacccaagagaaaccacaagccatcaaccatgaggaccagcctcctccttgtcgtcggcgtcggcatcgtcatttcctccatcatcatggccgccacggcgatgtccatgcctggggcatgggagtactgtaacgtcgacgccctgaagatgcaggagctcgggaagtgggcagtggcggagcacgtcaagatggcgaacgacggcatccgattcatcgaggtgtggggctgcgaggagcaggttgttcaaggcgttaactaccgcgtcttcctccacgcgttccacaactccggcgagaaaggccgattccaggcgggcgtgtacgagggggcgtcgagcagtgtccgcaagctcgtctccttcggcccggtcatctaaacgaggttttctcgtgtttctgtaactgcggaggtcgtaacaaagatatatttatcaagcgtgctgtcggttctttgaaaaaaaaaaaaaaaaaaa

SEQ ID NO: 7880 - DNA, 1150 bp, Triticum aestivum
  Clone ID: PAT_TA_7880
tgggaacccccacaaatgaaggcactactgcattctgttccagttggccgaatgattgttctcgatctgtatgctgaagtaaaaccagtatggatcaattctgatcagttctatggtgttccctacatctggtgcatgcttcataattttgctgcggattttgaaatgtatggtgtcttggatgctgttgcttctgggcctattgatgctcgactaagtgaaaattccacgatggttggagttggcatgtctatggaaggtatcgagcaaaatcctatcgtttatgatcttatgtcagaaatgagttttcatcagagacaagtggatcttcaggtatgggttgagacatatccaacaagaagatatgggaaatcagttgttgggttgcaagatgcttggcgaattttgcaccaaactctatacaactgtacagatggtaaaaatgacaaaaaccgggatgtgatagtggcgttcccagatgttgtgccggttgttcggcacgcgccaggattgtatgcgagaactagcaaaaattattctacactggcatcagagaattctgtcgtgaaggatgcatccaatgatgcatatgatcaaccacatatatggtatgataccgttgctgttatacatgccctagagcttttccttgaatatggagatgaggtatctgacagcagcaccttcaggtatgacctcaggtgctcatattgcttaatttttggcgtaaaattgttactcttttggttaatgtttcagtattatgatattgcaggtggtagtattttcacattttgttgtttcattgatcagccttcaatatgctcagcttcttagtgacttgtttgatttaattcgtccctatagggcgcaagataagtatgccatttgcaagctaaaaaggtgttaacttcaatgggctttgtgctaatgctatgtcattggcaagttcaaaaaagtattatcttcaacaggctttgtgcatgctaactattctgaacggctgaattaaaaaacctccagaactttgtccgactattatcttctggcatttcagaacctttgatggtgtagcagttgtttagtttcttattcccatctagaattgtttttacctgaatttctgatatgttccttgttgctttctatt

SEQ ID NO: 7881 - DNA, 473 bp, Triticum aestivum
  Clone ID: PAT_TA_7881
ccgtaggagtgtggtggacgacgaagaagagcttattactgaaactgagtgtgtatctgctgatcatcgccatggctaactgctctagagacatccctgattctgtttctgaccaccctcccgggtacatcatctgtggtgagattactgcgacgtggggaaagcatctgtgcatcaagcacggcacctgcaacaagccgtgccgggcagaggggtacgactcaggctactgcgccccattcccctggtcgacctactgctgctgcaaaaataattgtggcgagtctgtgtaacctcacaggagcagctttatatgcggtgataatagtctacattattaactaagtatacataccatgtatggatgcatacaaggttagtgaaataaatctcatttccagccgtgtgtgtacctacctgtagaagggaaaaataaccgttctcataatgtgtgggaactgctatttccaaaa

SEQ ID NO: 7882 - DNA, 262 bp, Triticum aestivum
  unsure (1)..(262): unsure at all n locations
  Clone ID: PAT_TA_7882
ggnctgcaggnaattcggcacgaggtagagttgaactgtgaattcatgtggttttattgactcttttgttttaatgtcgtcgttaataatcgttgttgttttccaggcagtgagccctgcctgtactttctttttctttcttattatgttcattggttctgtggatatgttacctttcagtcaccaaaactggtggagcagtagttgattaataacatattcttttgtagaactagtttctatttgttgggtaaaaaaaaaa

SEQ ID NO: 7883 - DNA, 637 bp, Triticum aestivum
  Clone ID: PAT_TA_7883
ctcttgccctccgtcgatgcagaactcttgcccttcgaggatgcagaactcttgcacttggacgatgcagaactcttgcctttcgacgatgcaggatccggaagcggcggcatgaagatataatcttcgtcctcgctctcctcagtccataaaaatggattctttgctgcagtccttctgaaagtttcactctttggctccactaccttcttccacctttcatgcaacctaaaaagttctttacgtacctcctcataggtcctttcacgccacccagacctacgtaattcgtgagccaactcattcattatggtgtcactaccggtgagttcgtcccatggaactatcctattgtccatcctgaaatcggtggctagccttagaagacatctgctcatcccagggtgaaaactacgatcgaaaggataatgggacatcttgactacactacactggaccgcttatccacctccgtgtgaagggggttttataggtagagaggagaaaatggcgggaaagaacgactgcggtatggcgggaaagggttggcgggaacatatggcgggaaggggttggtggaaacgggtggcgggaaacgagtggcgggaaagagttggcgggaaaatattgagggaaa

SEQ ID NO: 7884 - DNA, 956 bp, Triticum aestivum
  Clone ID: PAT_TA_7884
cagctcggcccctcgacgcgacgcctcgtcttttctctggcggatgctctagacgacctggttaactccgccatctgcttggagaagctcgaggacactcgagtcgccgttacgcctgatggccggataaagtttgtcgaagccattttcgtggagagaaaggatctgcccagcctaagggagttcaagatcagggtggcagagaattacaacgacctcgccggcataatcacccgctacttgtctcccgtgtcgcactgcatcccggcggaggtcacgcatctgctctacttgatgaggaacaagagcgtgggagatgaggtatctgatcacctaccactctgccacagtgcctctggggaaccggtcggacctctttctcataatgcatagctatgtgtgggaggtgctgagaaagactgaccctggggggtatgagtatgtcatggcaagtcttgagtatgatcctgattggaggaatgcggtcgttaataacgagcatttgcagaagtactactatgcagacggaggcgggttatatgagagcaatgcacagctgcagggagacgagcatcgccaagtgatgaggttcaatcatgatggccagagtcaccctctcgagcatgccgccgactcatcagcaccaagtgggatgctttacaatccggtgcaattgggccacatgtatcacgccaacttcgcacggcttacatactcgatgcaagcagccctgcatgccattgatcgcctcaggtgtgttgggatcaagtctctcttctccaacgattcaaaggagtatcaagagatacggtagagggtgttttgctgatgatggatgtagatgctacatcgtccgtagtagcaagtaactctcacaatctgtaaatgttgtgatgcttttggttttagtttgttaattgctactagtacggatgtggcgactgtcctttattaac

SEQ ID NO: 7885 - DNA, 546 bp, Triticum aestivum
  unsure (1)..(546): unsure at all n locations
  Clone ID: PAT_TA_7885
gaaagtatgcatatttatcttccaaggagacnagtaactagttgacataattatgtggngttgntttgntataatctcatcccttttgtgttcacagactggaaagtatgcatatttgtcttccaaggagacgagtaacttagtttgtgtcaccttgcagagggggtgcaatgaagataagattgaggatttccaagtacaagatgttaggaaggagccttgcaagagaagtaggagctgcgctgagcctcttcaacctgctaaggtaagtcactgtatgcaactcaacagttcaattccttgtttgtttcaggcatagttaattttctcttttcaattgctttatttgtcctcggttaatgagatgcccaaataatcatgcctaatgttcggtacttgtatcactattagttgacataattaaaggccttaccatttaattactctgccgaagtgtgcctgaagctttgaagtctattaaccaactattattgcatgaggctcacaatcttagtttatactacgctaatgattgcatagttttgc

SEQ ID NO: 7886 - DNA, 729 bp, Triticum aestivum
  unsure (1)..(729): unsure at all n locations
  Clone ID: PAT_TA_7886
cttcgctggtgactccgctgctgctgctacggcggctccgcctcctccggcagggcctgcaggagcagtggcgctgcccagtgtccatcctgccgcttactacctgtgcgcttacccggtgaccaacgacgttgaggccttcgccgttggcaacactgatcctgatgtcatcccaccggagattgtagtgggagacgtcgccatcccaccggagattatagagggaaacgtcgccgatggcaacggcgacggcggacagcagcagcagcagagcgaaaaccttggtggtaatggtgagagtgtggtggtgtcgcaaagcaatggtgtgcaggaagatggtgcagatgggatgtttctgaaggagatcctcatggatgaagacctgatgtttcccgacgctgagctttttccgttggtgggcgctgcacctggtccagaggatttcatcgtcgaccaagatgttctcgacgacgtcttcgccaacccgagcagcagcgcaagcagcgactgaaccgaaagaagatcagagcgggacgcagcatcggttgattcatctatcgtctctcgacctgctactctatgctagccgctatatcggttaataaatttgggaataagtttgtgttcgtgcgtgtgacatggactgtatggttcgccctgaatttatcgtattgcaatatatagccgtgattgtgtgtactcctcaaaacactcgagtatncnccggca

SEQ ID NO: 7887 - DNA, 663 bp, Triticum aestivum
  Clone ID: PAT_TA_7887
tcgctcgcgcctcgcggatctcagttctataacttgtcaacttggctttggtaattcctgggactgacggaaccactgaaaatggtggttctggcagcttctataatatcaaagtctggaaaggcacttgcttcaaggcaatatgttgacatgtctcggataaggatcgagggactgcttgcagcatttccaaagttggttggaactggaaagcaacatacttatgttgagacggaaaatgtccgttatgtttatcaaccaattgaagagctgtatctgctactcatcacaaataagcagagcaacatccttgaagatctggacacactgaggctgctctccaaaatcgtacctgaatactccccttctttggacgaagagggtgtctgcaaggccgcgttccaacttatatttgcttttgacgaagccatttctcttggaaacaaggaaaatgtaactgttccacaaattaaacaatattgcgaaatggagagccatgaagagaagctgcacaagctgatcatgcaaagcaagataaatgacactaacgatctcatgaggagaaaagttactgagattgagaaaaacaagattgatagaggcaagactggggaaggatttgctccaacaagaactccaaataactttaatgacatgaacatt

SEQ ID NO: 7888 - DNA, 842 bp, Triticum aestivum
  unsure (1)..(842): unsure at all n locations
  Clone ID: PAT_TA_7888
ggcaccggcaccacagcttccatcggatcggatcccttcgccacctgctctccccccaccccccctcccccccaagatctctcgccatgtcggccgccgcgcttagggcccgactgaacaaccatgtcacttcaatgttcgccacggatacggtggacgagtatttccagtacctgcagtcggtggacgaggacggcagctcagcgccgggcttggttgccgaggtcatcaacctcttcatcggcgacgccaacagcatcctcaacggcatcgccagcctgctgaaccagaccatggtagatttcaacaaggtcgacgacctggtgcatcagctcaagggctgcagctgcagtgttggtgctaagaaagtgaacctctcctgcatgcacttccatcagttcattgaggcaagaagcaaagaagggtgcctcatggcgttggctcttcttacgaatgagttctgcgatgtgcgcgacaagttccagaccatgatgcagctggagcagcagatcgcggcatgtggtcctaagtagtagcaaccgaagcaaaaagagcatagccccgtgtgatcccacccatgatggggtgtatttatctctgaaggcgcaaacaatgttcaacatgtgtctggctttcaggcggttataaaataagatgatgaatcttgtgtaggaactctagtctggcaaatcttcaaaaaaaatcgttgtcatgtgtctatgtctctttcaagtctatatcaggttgtacccgctgggcttccccggcccatgcaatttgtgaactctttacctggttggttggttaatgaaaaaaaaaaaaaaaaactcgagggggggggn

SEQ ID NO: 7889 - DNA, 919 bp, Triticum aestivum
  unsure (1)..(919): unsure at all n locations
  Clone ID: PAT_TA_7889
ccgccgcctccccgcggatccccgtcgtcggatccctccggcgcctcccaaccccaccagccgccgccttcccggtagagctgacacgccccctccgctcccggcctcgccgtccctgtcgagcagagccaggtacagattggttttgtgatggccggctccgagggcgtgaggggtttggcagcatcagtgggagagctacacatggaggcatcaccatcgcgggaggaaggaaccaatgggcatggcaacggtgatgctgctgctgtggacgatgatgtctggggtgatgcctcagattctccagggcatgattctgacttgaaaagagaatgggagcacaggcaggagcagtttcataagatgggctatagggatggtataaccgaagggcagaaggatgttgcccaagaggggttcaaccttgggcataggcaatctgcggatgtcgcattcaagtggggtctcgttcgggggattactagtgcattagctagtcttcccgacaggttaaaagaaaagttgctgctcgacgcccagcgtagaggaaaacttgaagatttgcacaactctgtgcaagaaatttcagcacagggtgccctgcagctgtttcatgagagtactcttcaggataatcgtcgaccagaggaaagcaagatccaaactattccaaaggaccttctgcttttgttgcaggaatgcccagatgtgcatgttagtgaagagttgaaacgagttccgtaagcaagtttgtaaatgtaattgcaagcaccacttgtttcgaagtcttgccggatcgcttagactgagttcttctgaaggatgtaactgtaaatcctgtgatactaagattttctctatggtgtcaccctttctttgctctnaacacctgtaaattcgcagtanaanacaacaataa

SEQ ID NO: 7890 - DNA, 809 bp, Triticum aestivum
  unsure (1)..(809): unsure at all n locations
  Clone ID: PAT_TA_7890
tagttgtccgcgaccaaccccctccccctcccgtcgacggaggccgacgccgatggcgagtcggcgggaacggaggcttccgcccgcacccgctttccagatggagaaccccttcagcgtgaaggttcttcaggtcttcaccggcgccggcgtcggctgcggcgtcggaatcggcgtcggccgccccatctacctaggtatgataccgggccttcagcaagttatgagtgccacaagaggtgcaaccgattctttttctggtgtcacgagacatgttaattctgctctaaggaaagcagggttaaagaacattgaagcgggcattggatgcggagttggtataggacatggttttgggataggaattgccttgaaaccacgagcaattcatggaattcaatcatcgattgcagaagttttgtccaagttaacttcaaagctgagggattccagtggggagacagctacagcagatcttacctctggttcgttgcctaccagtggacaaacacccaatggtatgtccatggatctagaggctaaggcattcaaaagcaatttccagcatacttcaagcaatgaaatatcacaangtacagcccgactcatgaaattgccgtggccaagaatggggatgcagcaaagagatgataacaggtggnccgaactgaaaaggcattggccactttccgcnagancccctgttccaagaacgatcnanaacggcatcaagggangcacctgtaatttncatgggacggtatgcttanngttgggggntggaacacaaangnttcggaagaattcga

SEQ ID NO: 7891 - DNA, 479 bp, Triticum aestivum
  unsure (1)..(479): unsure at all n locations
  Clone ID: PAT_TA_7891
tcggcacgagggaagttgtgaatgacatactgcaagnaagttgacaccgataaggatggcaaaattagctacgacgaattcgtggcgatgatgaagacgggcacagactggagaaaggcatcacggcactactcgagaggcagattcaacagccttagcatgaagcttgtgaaggacggttccgtcaaattgggcgtggagtaaaagccatggtgtttatttgtgcatgtagttaggcatttgggccccactaagcagcagctcctttagtttttgtcatggtcgttttgcgtggaaatttagataggtggaaccccctctgattggctcacatgtgtaattagttctcctggatcagtggcagtcgcacgcacgcgctgacggatgtaccaagagcagtgcgcctgcttttctgaaccactgatgttaagtgttgtacaatgttttgccgtacacaaatacagtttctaaaaaaaaaa

SEQ ID NO: 7892 - DNA, 842 bp, Triticum aestivum
  unsure (1)..(842): unsure at all n locations
  Clone ID: PAT_TA_7892
gatttcattggatcgagcaattggtcatggcgttcaacagcgctcaactgcttgctgccttctccttggccctgctcctcatttcctcccgcgctaagctgaaagattgtgcccgtattgatattggtgaatgcaaccaacataaatgcattacggcctgcatcaaattaaactacaatacggctatctgcgataatcacgcaaccagcgaagacagcggaggagacgtttccttgaacgagatggggttatacgggtcgtgcgtgtgttgttagattttatgggcttcctcctcgtaaaattgtaaacctttggccctgtcagataataaaaacccaaggccgcttccggcctgggaaagaaaccctcgggccgtccacttatttgcgttccaaggtcgggcgaaccctcgggcgtcgtttggcgttctgctccgtgcngaatttcggcaccaagggatcgagcaatttggtcatggcgttcacaagcgctcaactgcttgctgctttctccttggccctgctcctcatttcctccggtgctgcgctgaaagattgcgcccgtattgatattggtgaatgcaaccaacataaatgcattacggcctgcatcaaattaaacttcaatacggctatctgccataacgacgcagccagcgaagacagcggaggagacgtttccttgaacgagatggggttatacgggtcgtgcgtgtgttgttagattttattttatgggcttcctcttcttaaaattgtaaaccttgccctgtcagataataaaaatccaaggactctcctggctcgaaaaaaaaaaaaaaaaaaaaaactcgagactagttc

SEQ ID NO: 7893 - DNA, 415 bp, Triticum aestivum
  Clone ID: PAT_TA_7893
cccagacggcccgccagacccagcggtcgcttactcgcatcgcagcgcactcgcgccacagtcggcatcacagaccagatccctgcgggtgcggcggccatggccgagaactttcaactccagggccggcacggcaagtcccgcgtccgcgtctcccgcgtctggcgccgcccggccgcggcggggggcgacgtcatcgttgagtggaacgtcgccgtcagtatcgtcttcgactgcctccccttctacaccttcagcgacaacttcggcatcgtcggcacagattccatcaagaacaccgtgtttgtcaaggcgaaagaatgcacggaagtggtgtccatggaggaaatcgccgggattcttgggaggcatttcacctcgctgtaccctcagggttcagaggccacggtgacta

SEQ ID NO: 7894 - DNA, 1430 bp, Triticum aestivum
  Clone ID: PAT_TA_7894
cggccgctcgaggctgccgccacttccgccggggaccgatcgattcccacttcgcacagcacgcatccgcatccgcagcaactcaccgcagatcggatccccaccccacccatggccgggcgcttcgacctgcagggcaggcatggcaagtcccgcgtccgggtctcccgcgtctggcgccgccccgccgacgccgggggccacctcttcgtcgagtggagcgtcgccgtcagcgtcgtctccgactgcctcccctcctacacctccgacgacaactccgccatcgtcgccacagactccatcaagaacaccgtgtatgtgaaggccaaggagtgcacggaggtggtgtccatggaggaattcgcggtcatcctcgggaggcatttcacctcactctacccgcaggtctcagaggctacagtgacgatcgtggagcgcccatgggagcgtgtggcagtggacgggaagccccattcgcatgggttcaaacttggttctgaaaagcacaccacagaggtcaccgtgaagaagtctggaagcctacttataaattctgggatacaaggatactccctgctaaagacaactcagtctggatttgaaggattcgtgagggaccgctacactctttctccctgaaaaaaaagaaagaattgtgccaacagaagtaactgcttggtggaggtattcgttcgaaaatatttcccagctttcggcaaagccatttttcttcacacaaagataccacggatgtaaagaaggatcttgcaagacacattctttggtccttctgatgttggtgtatatagtccatccgtgcagaatacattattcctcaatggctagggaagttcttaccaggttcccagacatagcatccgttcagcttaggatgccaaacctccactttcttcccgtgaacctaggggggaaagaaaatccaggattggtgaagtttgctgatgatgtgtacatgccgactaacgagccgcatggaaccatcgaagcacactgagacgcgtgccatctcaaagctgtaatttcacttgatgcttgtggccaggctcatgatttggtttggtttcttgaagatcacaatcgccaataaacaaagtgatagggggaaagctagcacaaccaccccttgcaaaagggtaaaaggacgtaaactttgcatatgtattcagctaattgacttgtacatggctagctagagttcccccatcgtaaattttactgttgtacaaaaccttcaatgtttcgttgtctccacaatgctataatatagcctgttttttctataccacatatccagtactcaaaagttacatcctttttttgcttgttcttgcgcttgtcgtagaagtgcaagagtgtcgtgtactttatatgtaacttctaagttatcattgtaatttagttttccttat

SEQ ID NO: 7895 - DNA, 1275 bp, Triticum aestivum
  Clone ID: PAT_TA_7895
tcgagagaacagaaccctcggcggcggcggcggcggcgcgcgggcacaggggcgagcccaccggcggcggaggagagagagagagaggggaggcgagatgccgcggccggaggtgcaggcgccgccggagatattctacaacgaggcggaggcgcgcaagtacaccacctcctcccgcatcatcgaaatccaggcgaggatctccgagagggcgctggagctgctggcgctccccgacgacggcgtccccaagatgctgctcgacatcgggtgcggctccgggcttagcggcgagacgctgacggagcacgggcaccgctggatcggctgcgatatctcgcggtccatgcttgatgttgctctggagcgggagacggagggtgacctcctgctcgcagacatgggcgagggcctaggcttgcgcccaggagttatggatggtgcaattagtatttcagcagtccagtggttatgcaatgctgacaagtcttctcatgaaccaagattacggttaaaggctttctttggatcactatatagatgcttagcaaggggagcaagggccgttctacagttttatgctgataatgtgaaacaaaccgaaatgctcgtgtcttttgccatgaaagctggatttgctggtggagtggtcattgactggcctcatagttcgaaagcaaagaagtcctaccttgtcctcacttgtggtacatcttctgtcgcatctcttccaaaggggaaaggtgaaaacggtgagatgtgcagcagtgatgatgacgatgatggtgatgaaagcaacgatgaccaaacagttggcacatatggacggaacaggtcgaacaagaggcagaaggtgaacaagaagaacggcaggggcaaggattggctgctgaggaaaaaggagcagatgaggaagagaggccgcgacgtccccgccgacacgaaatacacggggcggaagcggaaaacccgcttctaagtcggtgtttggcagtcatttagtttagcttgtcagaagcagcaagagtgtttacgcgtgaagagttggctgtatcgcgcttccgttgtataccaccgagagctagtcttaagatatgcagcagctttggcaaatgctagtagtgtcatgtttgtgaggatatatgtaatgatgacatggttggttgtttcgtgtttgcatggatttgtggaagtatgcacaattttgtaacggcagtaatcgtgatgatataccctttgtatatttgtaagcatgggtgtagatgctaaacaaaa

SEQ ID NO: 7896 - DNA, 637 bp, Triticum aestivum
  Clone ID: PAT_TA_7896
gatcggcacgagctcgtgccgtctcgctctgccagtgccctcccccccctccccgcttgctctccccgccgcggaggaggcccgccgcgtcggcagcccggccgtcggggcgcctgcccgtgtcgcggggaggttttctttgggggaagaaaggtcggggttttcggctggttggttgggattttggttcttcatttgagcggcgatttcggttggttttctgcgattccgagtccctgtgctgtgattcctgccgccccgcgcttccatttctgttccccgcaagcaccccccggaattcagagcggccgaggcggttcttcgctccgggcctccgtccatgtaagaattgggttggagttggaggcgtcgatgcggagattcgaggtcgaactttgagcgagcgagagatcaacaactgttgctcgaaggtcgatttttatccgtgaacccggttttcagattggttgttgcgaaggctgcaagtggaggacgactgtcgtttttggcgaggatttgagagctgtggtcgaggtcaaaagagatcaatggcgtcgctgtccgaaagcgaggggacgaacagggggggcatgtgggagctggatcagaaccttgatcagcccatggatgaggaagc

SEQ ID NO: 7897 - DNA, 379 bp, Triticum aestivum
  Clone ID: PAT_TA_7897
ctgcaccgcaagtaacccaacactgtcttccaatgcaagtgactgccccgacccatcatgcgccaggcgaatcaaaccactacctgatttgtttaccccccgaaatttgccgtctcctcgtctcgctcctctccctgcgcagcccccagatccggcaccgcccgctcctcgatccccgcaccccacgcccgcaggccgggaccggcggggtcgcgcgccgggtaggaggaggagaagaggaagggtggtatggcggcgccgccggcgagggccagggccgactacgactaccttatcaagctgctcctcattggagacagcggtgttggcaagagttgcctcctgtcgcggttctctgatggttccttcactacaagct

SEQ ID NO: 7898 - DNA, 3640 bp, Triticum aestivum
  Clone ID: PAT_TA_7898
ccctagaccgtcgctcgcctgcttccttcaccgacgcgacaggcgaatccaaggtttcgcggcggttgcggccctagcacgcgctggatctgacgcggcagctcccggcggccgcgtactactgcctgctcttcgctgcgtcggcggctgtcctcgggctcctcggcggcgtcgcgcgctatatgcttccccggaagcgggagatcgtcgccggcgaggtcgaggacttgcagaagaagacccgcgccggggagggggaggtcactagggaggaaggagacgcagccatggcagggagggggaacgagatcgacgaggacctgcacagccgccagctcgccgtctatgggcgcgagaccatgaagcgcctcttcggctccaacgtcctcgtctctggactccagggtctcggtgctgagatcgcaaagaaccttgtccttgcgggtgtcaagtctgtaaccttgcatgatgatggtaacgtggagctgtgggacttatcaagcaacttcttcctctcggagaatgatgttgggcaaaaccgtgctcaagcttgtgtacagaagctacaagagctgaacaatgctgtcctcgtctctgccttaaccggtgatttgaccaaggagcacctttctaaattccaggccgttgtcttcactgatatcagcttagataaagcaattgaatttgatgattactgccacagccaacagccacccattgcgttcatcaagtctgaagttcgtggtctttttggcagtgttttttgtgactttggtcctgaatttactgttttggatgtggatggagaggaaccacatacaggaattgttgcatcaatcagcaatgacaatccagcacttgtatcttgtgtggacgatgagcgtctggagttccaggatggtgatctagttgttttctctgaagtccatggaatgactgagctgaatgatggaaaaccaagaaaagttaagaatgcaaggccttactctttcttcttggaagaagacacttcctcatttggcgcatatgttagaggtggtattgtcacacaggtcaagccaccgaaggttattaaattcaaacccttgaaagaggccatgtcagagccgggagaatttctcatgagtgatttctccaaatttgagcggccacctcttctgcatttggcattccaagctttggataagtttaggactgagttgagcagattccctgttgctgggtccactgatgatgtgcaaagggtgatagagtatgctattagcattaatgatactctgggagataggaaacttgaagaaattgacaaaaagctcctgcatcattttgccagtggttccagggctgttctgaatcctatggctgcgatgtttggtggtattgtgggtcaggaggtagtgaaagcttgctcagggaaatttcatccactttatcagttcttctattttgattctgtcgagtctctccctgttgaccccttggagcctggtgatttgaagccgaagaacagtagatatgatgctcaaatcagcgtatttggatctaagcttcaaaacaaactggaggaagcaaaaatctttatggtcggttctggggcacttggatgtgagttcttgaagaacctggcactaatgggtatttcttgcagccagaatggaaatctgactctgacagatgatgatgtcattgaaaagagtaatctgagccgccaatttcttttccgtgactggaacattgggcaacctaagtccacagttgctgctacagctgctatggtaattaatcctaaacttcatgtcgaggcccttcagaacagagcaagtcctgagactgaaaatgtgtttaatgatgccttctgggagaaccttgatgctgttgtcaatgcccttgacaatgttactgcaagaatgtacatagactccagatgtgtatatttccagaagccacttttggaatctgggactctgggtgctaaatgcaatacacagatggtcatccctcacctaacagagaactatggggcttcaagggatccacctgaaaagcaggcacctatgtgcactgtacattcatttcctcataacattgatcattgcctaacctgggctaggtctgagtttgagggtttacttgagaagactcccactgaagtaaatgctttcctgtcaaatcctactacatacataagtgcagcaagaactgctggtgatgcacaggctagagatcagcttgaacgtgttattgagtgtcttgacagagacaagtgcgagacgttccaggattctattacctgggcccggcttaagtttgaggattacttctccaaccgtgtgaagcagctgacgttcactttcccagaagactcgatgaccagctctggtgctcctttctggtctgctccaaagcggttcccacgacctgtggagttctcgtccagtgatcagagtcagcttagctttattttggctgctgcaatattgagggcagagacttttggaatacccatacctgagtgggccaaaaccccaaacaagctggctgctgaagctgtcgacaaggtgattgtcccggattttcaaccaaagcagggggttaagatagttacacatgagaaggccactagtctgtcctctgcatctgttgacgacgctgctgtcattgaagagcttattgccaagttagaagaagtttccaaaacactgccatcagggttccacatgaacccaatacagtttgagaaggatgatgacacaaacttccatatggatgtgatagctggttttgccaacatgagggcaaggaactacagcattcctgaagtggacaagctcaaggccaagtttatagccggcaggatcatcccagctatcgccacctccaccgcgatggccactggcctcgtctgccttgagctttacaaagcccttgctggtggacacaaggttgaagactaccgcaacacgtttgcaaacctcgctatccctctcttctccattgctgaaccagttccacccaagaccatcaagcaccaggagttgtcgtggacggtctgggaccggtggactgtgacgggcaacatcacgctgagggagctcctggagtggctcaaggagaagggcctgaacgcttacagcatatcctgtggcacctcgctgctgtacaactccatgttccccaggcacaaggaacggcttgacaggaaggtagttgatgttgccagggaggtggccaagatggaggtgccctcttaccggcgtcatctcgacgtcgtggtggcgtgtgaggatgacgacgacaatgatgtcgacatcccacttgtgtcggtctacttccgctgaagaagcgctccttctgcgtttaaatgatcttgtggttggtcatgcttgatctactgatatgttatgagtgggggcttaagccacattaccgactgattttcctttcaaccatctttgatgtcgatcggatcattgggggctgatctcgggttgttaccagacatcatgattcacgagactaggcacaacatcatcttgataattgttgcatgatgcgtttacagctaaaattgatcgttgtgggattgaatgcatgtcttaatctgtttgtccaataaaaaaaaaggcaacagaaagaaaaa

SEQ ID NO: 7899 - DNA, 4888 bp, Triticum aestivum
  Clone ID: PAT_TA_7899
gtccctccccagcccagaaaccctagaccgtcgctcgcctgctttccttccccgacgcgacaggcgaatccaaggtgagttccgccggatccgccctccccgcgcccgcttcccagcgctccccgcctcaggacgcgccggccggtgcaggtttcgcggcggtcgcggccctagcacgcgctggatctgacgcgcagctcccggcggccgcgtactactgcctgctcttcgctgcgtcggcggccgtcctcgggctcctcggcgcgtcgcgcgctatatgcttccccggaagcgggagatcgtcgccggcgaggtcgaggacttgcagaagaagacccgtgccggggagggcgaggccaccagggaggaaggagacgcagccatggctgggagggggaacgagatcgacgaggacctgcacagccgccagctcgccgtctatggccgcgagaccatgaagccgctcttcggctccaacgtcctcgtctctggactccagggtctcggtgctgagatcgcaaagaaccttgtccttgcgggtgtcaagtctgtaaccttgcatgatgatggtaatgtggagctgtgggacttatcaagcaacttcttcctctcggagaatgatgttgggcaaaaccgtgctcaagcttgtgtacagaagctacaagagctgaacaacgctgtcctcgtctctgccttaaccggtgatttgaccaaggagcacctttctaaattccaggccgttgtcttcactgatatcagcttagataaagcaattgagtttgatgattactgccacagccaccagccacccattgctttcatcaagtctgaagttcgtggtctttttggcagtgtgttttgtgactttggtcctgaatttactgttttggatgtggatggtgaggaaccacatacaggaattgttgcatcaatcagcaatgacaatccagcacttgtatcttgtgtggacgatgagcgcctggagttccaggatggtgatctagttgttttctctgaagtccatggaatgactgagctgaatgatggaaaaccaagaaaagttaagaatgcaaggccttactctttcttcttggaagaagacacttcctcatttggcgcatacgttagaggtggtatcgtcacacaggtcccaccgataaattctaacccttctgcttcctccgctgtcgccgctgctgttatcaaacacacgcatgagatctattcttaactccctttacagacctcatgcggagcagatatgcagcttattattcatcggtggtaagtagcaccgctcgcgggcacgtccgtacatatagaggcgtcgatccacacacacacgcacacactggtaacgcataggagggcaaatgacgacacgtctacggcgttcgtgcctggtcgaggcgatgctgcgcccagttcttcacctcgtgcgccttggagtccagcttcgcgcccgcgtggtccaccgtgtcggcccccggcggcgaggacgccccgtgcgacaggtacttgtacatccacgccagcacccccaccgccgccgcgccgaacgcccccgacgacacgaacccggccgtcagcatcgtgacggcgatggccgcgggcaccagcacggggctgaagagcaccagcagcggcgtcgccacgatcagcgccagcaccgtgcccgtcagcgtcagggccgacaggagcagcatcgaccccgccgccgccgccgcggccacccccttcgcgagggtgacggccgccggctggttgtggccctggccgtgcccgccgtagtagtcgtcgtcgccgcggatggcccgcatgtagtccggcccgatggcgctgccgcctccgtgcacgcctccccggtggaacgcttgctctccagccatgccggtacccagatgcgcacttgaagcttcgctactccgaaacctgagcctcacctgagaaatgcgatagctaaggacgtgttagcccagttggccagcatgagggcctgcaacgacagcattcctgaagtggacaagcaaaaagccaagtctatagccggcaggatcatcacagctatctccacctcgaccgcaatggccactggcctcttctgccttgagctttacaaagcccttgctggtggacacaaggtggaagactaccgcaacacgtttgcaaacctcgcgattcctctcttctccattgctgagccggttccacccaagaccatcaagcaccaggagctgtcgtggacggtctgggacaggtggactgtgacgagcagcatccctcttgaggggtctactggatgtggctcaaaggagaagggcctgaacgcttacagcatatcctgtggcagctcgctgctctacaactccatgttccccaggcaaaatgaacgaattgacaagaaggtagttgattttgccagggaggtgttcaagatggcggtgccatcttaccggcgtcatctcgacgtcgtggtggcgtgtgaggatgacgacgacaatgatgtcgacatcccacttgtgtcggtctacttccgctgaagcgtttacatgatcttgtgtttggtggtgctgggtcaacggaaatttcatgagttttatcagtgcttctaatttgattctgggcttaagccactttagagtctctccctcctttctaccatcttgatgtcgatcggatgactgtgggtctgatgctcgggttgttaccaagacatcacgattcacgagactaggcacaacatcatcttaaaatattttggcatcggttgttggcaactagaatacgagttcttgaagaacatggcactaatgggttatttcttgcagccagaatgaaaatctgactgtgacagatgatgctgttgttgaaaatagcaatctgaatcgccaatttcttttccgtgactggaacactgagacacctaagccgacggttgctgctacagcagctatggtaattaatcctaaacttcatgtcgaggcccttcagaacagagcaagtcctgagactgaaaatgtgtttaatgatgccttctgggagaaccttgatgctgttgtcaatgcccttgacaatgtgactgcaagaatgtacatagactccagatgtgtatatttccagaagccacttttggaatctgggactctgggtgctaaatgcaatacacagatggtcatccctcacctaacagagaactatggggcttcaagggatccacctgaaaagcaggcaccttgcactgtcattcatttcctcataacattgatcattgcctaacctgggctaggtctgagtttgagggtttacttgagaagactcccactgaagtaaatgctttcctgtcaaatcctactacatacataagtgcagcaagaactgctggtgatgcacaggctagagatcagcttgaacgtgttattgagtgtcttgacagagacaagtgcgagacgttccaggattctattacctgggcccggcttaagtttgaggattacttccccaaccgtgtgaagcagctgacgttcactttcccagaagactcgctgaccagctctggtgctcctttctggtctgctccaaagtggttcccacgaccctgtgtggtccagagctccaatcatattggctgctgaaatagtcgagaaggtgattgtcccagattattcaacctaagcatacccatatctgagtgggccaaaaccccaaacaagctggctgctgaagctgttgacaaggtgattgtgccggatttccaaccaaagcagggggttaagatagttacagatgagaaggccactagtctatcctctgcatctgttgacgacgctgctgtcattgaagagcttattgccaagttagaagaagtttccaaaacactgccatcagggttccacatgaacccaatacagtttgagaaggatgatgacacaaacttccatatggatgtgatagctggttttgccaacatgagggcaaggaactacagcattcctgaagtggacaagctaaaggccaagtttatagccggcaggatcatcccagctatcgccacctccaccgcgatggccactggccttgtctgccttgagctttacaaagcccttgctggtggacacaaggtcgaagactaccgcaacacgtttgcaaaccttgcgatccctctcttctccattgctgaaccagttccacccaagaccatcaagcaccaggagctgtcgtggacggtctgggaccggtggactgtgacaggcaacatcacgctgagggagctcctggagtggctcaaggagaagggcctgaacgcttacagcatatcctgtggcacctctctgctgtacaactccatgttccccaggcacaaggaacggcttgacaggaaggttgttgatgttgccagggaggtggctaagatggaggtgccctcttaccggcgtcatctcgacgttgtggtggcctgtgaggatgacgacgacaacgatgtcgacatcccacttgtgtcggtctacttccgctgaagaagcgctccttctgcgtttacatgatcttgtggttggtcatgctggatcgactgacatgtcatgagtcgcattagtgattgtaagctgagtgggggcttaagccacattatcgactgatttttcctttctaccatcttgatgtcgatcggatcattgggggctgatctcgggttgttaccagacataactattcacgagactaggcacaacatcatcttgataattgttgcatgatgcgttcacaactaaaattggtcgtcgtgggattgaatgaatgttttaatctgtttgtcctaaaaaaaaaaagtcgacgcggccgcgaaaaaaaactcggggggggcccggtacccaattcgccctatagtgagtcg

SEQ ID NO: 7900 - DNA, 635 bp, Triticum aestivum
  Clone ID: PAT_TA_7900
cccacgcgtccgcccacgcgtccgcccacgcgtccggagaggcacccagcagcagcagccggctaggccaccgtacgtacggactccgatccggagcagcaggcatggcatccaccatcatggccgccgcctcccgcgccgtcgtcgccaagacgccgttcctcagcggccagggccgcgccgcaggcgccagccccctgcgcgacatcgccgccgcggccaacggcagaatcaccatgggcaacgacttgtggtacggcccggaccgcgtcaagtacctggggcccttctccgcgcagacgccgtcctacctgaacggcgagttcccgggcgactacggctgggacaccgccgggctttccgccgacccggaggcgttcgctaggaacagggcgctggaggtgatccacgggcggtgggcgatgctcggcgctcttgggtgcgtcttccccgaggtgctccagaagtgggtgggcgtcgagttcaaggagcccgtctggttcaaggccggctcgcagatcttctccgagggtggcctcgactaccttgggaaccccaacctcgtccacgcgcagagcatccttgccgtgctgggcttccaggtccttctcatgggcctggtcgaagggttccgc

SEQ ID NO: 7901 - DNA, 867 bp, Triticum aestivum
  unsure (1)..(867): unsure at all n locations
  Clone ID: PAT_TA_7901
ctgnagtgtgcgctcgctcgcagggcaacgacttgtggtacggcccggaccgcgtcaagtacctggggcccttctccgcgcagacgccgtcctacctgaacggcgagttcccgggcgactacggctgggacaccgccgggctttccgccgacccggaggcgttcgctaggaacagggcgctggaggtgatccacgggcggtgggcgatgctcggcgctcttgggtgcgtcttccccgaggtgctccagaagtgggtgggcgtcgagttcaaggagcccgtctggttcaaggccggctcgcagatcttctccgagggtggcctcgactaccttgggaaccccaacctcgtccacgcgcagagcatccttgccgtgctgggcttccaggtccttctcatgggcctggtcgaagggttccgcatcaatggtctcgacggtgtcggcgagggcaacgacctctaccccggcggccagtacttcgacccgctcggccttgccgacgaccctgtcaccttcgctgagctcaaggtgaaggagatcaagaatggccgtctcgccatgttctccatgtttgggttcttcgtccaagctatcgtcaccggcaagggcccattggagaacctgttcgaccacctcgacgaccctgtcgccaacaatgcatgggttttcgccaccaagtttgcgcctggatcttaggctggccgacgttgccattgtaaagtgtaaactactcccatgtgtgtgtgtgtgtgcaaatagcaacgaatggtcgatgtgatctcgaaatttggaggattttttggttcaaaatctgatgtgtgtccttatatatttatcttgcgatgtgcttagctctttnttggtggtt

SEQ ID NO: 7902 - DNA, 1926 bp, Triticum aestivum
  Clone ID: PAT_TA_7902
accgactgcacccaggggcagcggcccagcagcaacagccggctaggccaccgtactacggactccggagcagcagacatggcatccacgatcatgcccgccgcctcccgcgccgttgtcgccaagacgccgttcctcacgcggccagggccggcgccgccacgcgcccagccccctgcgcgacatccgccgccgcggccaacggcagaatcaccatggggcaccgactttgtggcagcgggcccggaccgcgtcaagtacctgggccccttctccgcgcacgacgccgtcctagcctgaacggcgagttccccggcgactaacggctgggacaccgccggggctttctgccgacccggaggcgttcgctagggaacagggcgctggagctgatccacgggcggtgggggcgatgctcggcgctcttggctgcgtcttccccgaggggctccagaagtgggtgggcgtcgagttcaaggagcccgtctggttcaaggccggctcgcagatcttctccgagggcggcctcgattcccttgcgaaaccccaagctcgtccacgcgcagagcatccttgccgtgctgggcttccagggcctcctcatgggtctggttgaagggttccgcatcaattggtctcgaggggtgtacggcgagggcaacgacctgctaccccggcggccagctacttccgagccgactgaccccttgccgtgcggcaacctgtcaccttcgctagagctcgaaggtgaaggtagatcatgaatggccgtctcgccgatgttcttcaatgtttgggtttcttgcgacggaagctatcgtcaacccggttaagggcccattcggaaaacctgtttggcaccaacactccatgcgtaccctgtccgccaatcaacggcatggggttttacgccggccaaagtttgcgcctgttatgttaggcttgctggccgacgcgccgcggtggtctgccattgtaaagtgtaaactactctccaatgtgtgtgcaaatagcaacgaatggtcgatgtgatctcgaaataaggaggagaattttttggttcataagaagaggtacgtcgctcagctgttacgatgtgcttagcacgtttttggtggttacatgttggcaagccaggacggtggcgtaactgagctgcctaactaccatgtgtgggtgatacccgtcgtaccggtcaattcggaccatgacacccgcgcagcgatctacgcgcgagggttcatcggcacttacccggactcgtgcgatgccttcccgacgcacccgaggacctacgaccttttgcacgccgacaatttgttcagcatctaccaggacaggtgcgacataacggacatcctcctggagatggacaggatactgaggcccgagggcacggcgatcatccgcgacacggtcgacatgctcaccaaggtgcaggccatagcccagcggatgcggtgggacagccgcatcctggaccacgaggacgggcccttcaacccggataaggtccttgtggcggtcaagacgtactggacggccgacccatcggagcacagctgagctgcagctctctgagctccgaaatggcttgtccggtaactaggcgtgacgcgatgatggcgtcggttttcgccatctcggtgtgtgtgtgtgtgtgtgtgtgtgtagtaagcagtgtgtgaccacgtgcgcagtcgcttgttcctctcgccttttttgtctaattctttgtagttcgggtcgaaatggaaaccaaaaaaatacgtcgagcagatcataggttctttttagcttgtacgaccagagattgttactatgtagtactaagattgacttactggaaaaataggccttttactgagcgtgcttgtgtagtgatatagtggcaaagttctgcgtctttcgagttcaaaaaaaaaa

SEQ ID NO: 7903 - DNA, 1688 bp, Triticum aestivum
  Clone ID: PAT_TA_7903
actgcttcaacacctggtgatttgtctatggctccgaaggttaccgcaccaccatccttacaagcttctcctcatcattctgccactatttcagcctcttcacaatccactaattttctgaggcctagaagttcagctccttcaggcactcgatctccatacactacaggatttggagctgctttaaatattgaaactcttgttgctgccgcagaacgaagagatacgtcagttgaggcccctccttctgaagttcaagacaagattttcttcatgatcaacaatatttccaattctaatttggatgctaaggcaagggaatttaatgaggtttctcaggatcagtattatccttggtttgcgcaatacatggtcatgaaaagggcaagcatcgaaccgaattttcatgacctgtatttgaagttcttcgacaaagttaactcaaaaacgttgaataaggaaatggtgaaagctacatatgagaactgcaaggctttgttgcaatcggatcttatcaaatcaagttccgaagagcggtcattgctaaaaaatctgggtagttggctaggaaagctcactaccgccgggacgcccacactccgggccaaggaaattggcccgaaattcttattgtggaggttatgggaggagaggattatgattgctgtaattccattcacttcaaagattctcgaaccttgccattcaagtatagcatatcgtcctccaaatccgtggacaatgggaattcttagtctactttctgagatctataatctaccaaacctgaagatgaatctaaaatttgacattgaggtcctgtttaagaacctcagtgtggacatgaaagatgtgaaaccgacttcccttcttaaagatcgaggacgtgaagttgagggaaacccagatttttcaaacaaagatgttgcttcgtcccaaaccccagtggctgcagaagtctcttcaggtgtcaaccccccaataaaacatgtagacctgcagcctgaggtcaatagcacttcccgtaccctgagccttccaactttgtatactgctcctgttcgtctccctcctaacagtatggtggaggatgataaaattgctctaatgatgcctgagcaagttccctctcacaccttgacccaggtctcatcttcacaaacaccattagtatcactatcgccatcgccactctctctaactcagcttttgtcgctgattccacatgatgagatacgcttcaaaataagctcaaaacttttgccttttggctcacagttgcagttcagcaaaatcatgggcgtggctttggataaggctatcaaagagataatactccctgtcattgaaagaagtgtctcaatagcaagcaaaactacaaaagaaattattctgaaggattatgcaacggaatctgattacagtgccgcaaatcgctctgctcgtttaatggtcgggacattagctggaagtctagcccatgttacttgcaaggaaccgcttcgtgttgcgctactgtctcatctccgaagccttactcaaaaccttgctagcaacagcgaaactcttgagcgaatagtacttgttctgatcaacgacaatttggatcttggctgcgcaagtatcgagtctgtagcggcgcgcaaggctgttgattcgattgagggtgaaataactcaatccttttc

SEQ ID NO: 7904 - DNA, 551 bp, Triticum aestivum
  unsure (1)..(551): unsure at all n locations
  Clone ID: PAT_TA_7904
tgcaggnaattcgagatccataaattaacctgaagaggacgacaggctagacagccatgttcttctccacaaagacatgcattgctacgatcatggtgctggcgctggtgctggcgcatcaaggcaccgttgactccagccgcctctttcccaactcccatggttgtccagatggctatcatttgacatgctacgttcttcgtagttcaggagtctgtaggtgtatgcgagatcatcgacttgtggatcacgaatccacggtggcgaggaacagcctcgtgtcgccccagatagcgtgcccagaaggccaagtgtggattggcaagtttgggcactgctccgtcaagtgacgcagctagcgtgcccacaaggcaccgatcgtgcatagtactagcaataagtgttgctgctgctcatgttgttgtaaagctactgtgctgctgctcatgttgttgtaaggctacctcctgtcctgtatcagtgaataagataaagtccagtgctatatatgcaggcctttttacacaaaaaaaaaaaaaaaaaaaaaaaaa

SEQ ID NO: 7905 - DNA, 662 bp, Triticum aestivum
  unsure (1)..(662): unsure at all n locations
  Clone ID: PAT_TA_7905
ggnctgcaggnaattcggcacgaggctcaaataaatccaaggtttgtacctctgtcggctctgccgcatgcccgcctcgtctccgttggccctatgacaatgagggcgcggtgaatcctggcaagggccagcgagtgggctccactgttagttgttcctttgagatttgttatggtttgtgtcctgctcaggaaggcgagatggcagcggtccctgaaaataaaataaaggtctctcgcctagctcccgtcctgttggtgcatctagcatcgttggtgggcctgtggaggtgtgtctccggtggatctatccttggtggatttgctcggatctggttgttattcgtatatattcgtgtgtcttcgggttggatcttttcaatcttcgttattcttcatcgggagtggttgttattctggtgcgctggtcctatatgcccttagcatgatgacttcccgactgtctactacaacaagttgtgcctgactccggcgagggaggggcgatgatggcggcgcgccttcggctcgttgtagttcttgtagtcgtcgctaggtggtctacggttctggatgtatttttttattatttctggagttcgttgtactgccatgattgaagatgaatagatctgacggtttcgcgcaaaaaaaaaaaaaaaa

SEQ ID NO: 7906 - DNA, 1065 bp, Triticum aestivum
  Clone ID: PAT_TA_7906
ctgcgcgcgcgggccgggccgcccccgctccccccggtcggcgccggcctgccgcggccccgccagcgcgcgcgccgtcagcagcgcctgcgccccccccccctggggcgcccgcccccccgggcgatcccggtcgcgccctggcctcctgccggaggaaattaaggccgtgctcctgcactgcgccggtctccagaacgcgatgtaggcgagtgaaccccgggagacaagaccgccaggacggtgatgatcatcatgggcaggtctctcctgactgtctggtcaggatgatgctagatgtacaaaaactttgtgctgttccgttcctttttaccagtttcttggacaatcttcatgggatgaggctcgccatctccctccccgcagacatcagaccgggatctcggtcgatcttgtttctctctgtggtcgtgaacctgtgtgatgtcatggttatcttttcctaccgttgaactatcctccggtcagtcccccccggcccctttccctagccccagcggccagcaggcgacggtggaggtgaggatgagggaggggcaggcggtgaacatccacatgttctgcgcgcgcaggccgggcatcctgctgtccaccatgagggcgctggacagcctcggcctcgacatcgagcaggccgtcatcagctgcttcgatggcttcgccatggacgtcttccgcgccgagcaatgcagggagggccctgggctcctgccggaggaaattaaggccgtgctcctgcactgcgccggtctccagaacgcgatgtaggcgagtgaaccccgggagacaagaccgccaggacggtgatgatcatcatgggctctctctctcctgactgtctagtcaggatgatgctagatgtacaaaaacttgtgctgttccgctccttttttaccagttccttggacaacttgatgggatgaggctcgccatctccctccctgcagacatgagaccgatcttctctctggtgctgtgaacctgtgtgatgtaacagttatcttttcctaccgttgaactatctccagtcagtcggtcctccag

SEQ ID NO: 7907 - DNA, 892 bp, Triticum aestivum
  Clone ID: PAT_TA_7907
gggccgacgcgcaagagagggcagcaccaagtcgcctctatctccccctcacccaaagctcccacctttcgctcacccttctcctccgccttcccaattccccaattcggagcgcccgaggaattcggcgtcgatccgacgcgaccgaattcgtcccgattcagctgctgctcttggttcgtccgtcctgcgggccggcctctttgtctgtctcaactcgatccacgccgttgcggcacgcttcctccctgcggggtttggcctgcactgatctggcctggaaatactcctactctagtttcgcggatttttgtgttcggtcccatttctcggttttcccagtggttcgtgctgatctctgtctctgtgtactatcttctcctggcccgattgttgatgggatttggcctctcacgagtcggccagggagaattccctgcttggcgaagcttctgctgaatttgctaaccatttccacgttttacttgggtctaagaaagctccagttttctccaaccaatcgctctgatctcttcttgtctagatctaatttttctttttgggtttggtgtcttaggtcttcacccaataggtcagaaattatcaaccatttcccgtttctctgctgaaatttctcttcatttcttgctctttctaccctcggttcttcctgatctgattgttcaagctcggggtttgtctcagtttgccttgatttgtttacccgtgtgggagtcaaatggcgcaggagagctgtgattctcaacaaaggacgaggccgagttcctgaagccatcctcctccacaccctcgcccccctccccccccaccccaccaccaccaaccgcccgttcacctcacccgcaccctcccccctcgccaccacaaccac

SEQ ID NO: 7908 - DNA, 1868 bp, Triticum aestivum
  Clone ID: PAT_TA_7908
gtccgattgaatccatcatgatggtaatccagcgtgcttgtgcatttatcacatacacatcccccgccgacgcgtggggagagagcccgatagcgcgtcgtggtcgtctaatcgaatcgaggcctcgtcccgtgcgctctcttctcgctctcgctgcccctcggcgactgcatcggcggcggcggcgggcgatggcgcaccggctgctgcgggacgcgcaggccgacggctgggagcggtcggacttccccatcatctgcgagtcgtgcctcggcgacaacccctacgtccgcatgctcagagcagaatatgacaaggaatgcaagatctgtgcgcgtccttttactgtcttccgttggagacctggtcgggatgcaaggtacaagaagacagagatctgccagacgtgctgcaagttgaaaaacgtctgccaggtctgccttctggaccttgaatatggtctgccagttcaggttcgcgatacggcactcgcgatcaattcgaatgatgcaattccaaggagtgatgtcaaccgtgagtactttgcagaagagcatgatcgtaaggctgcacctggggaagattatgactcttcatatggaaaggcccgtccaaatgacaccattctgaagcttcagaggacttcaccatattacaacatgaagcgggcgttacatggcaccgcctcggaggcggtacccatccaaataagctccataccggcccatagcgcgccgacccgactgacaccagccacttagccctgcataacatcaaagcgggatcctatgcaggtaatgcaccagtggctttcaagcttttcgttatcagcagcgacaaccggcgtcggcagccaccgaactgtgggagcgtaggatctcaaaacaatggcaggctattgtaaacccctggctggttttaccggcttttgtattcccaaaatttgtgattagcagttaaacctttcggagtgttgttgcttatctggatctattaaaactgacagctatagtgggtttttatcgagccactagattttttttgtcatcaacaagctagtcatcaagggtgtgcgcctgaagctcatgtggggcaagcctcaagccccaaggccagatgatgatgaggctgggaggcaaggccatgtatcccacggaggattgctccctagggctgtcatatcccagcagcatagcagcgaccagcctcagccacctgggatggagggacaacagcaagtggcaccaccaggaacgggctacttcaacatcccaccaccgccagcggtggatcagaggatgtacccttcaatggacccccagaggatgggcgctgtagtcaggtcgcaggagggcgatggcagcaagccagggccacagcatgccgggcaagctcaggcgtcaagcagctcaggacagggctatcctatgcgtccgccgctgccgccttactaccagggtgctcagtaccctccatactacccacccccaccatatggcggcggttacatggccccgcctcgcatgccgtacccaccccagtatccgccataccggccaatgctggcacccccagcgcaccagcaacacgggagttcatcccagcagccggcaccaccgccggcagggcagcagcaggctcaagcacctcctgctcagcagcagccaccggcggcggcagctcagaactgaagaagcggaggatgtcaaacaactgcaggcgattgtaaacccctggctggttttaccagcttttgtattcccaaaatttgtgattagcagttaaacctttcggaatgttgttgcttatgtggatctattaaaactgacagctatagtgggtttttattcagccactaaaaaaaaaaa

SEQ ID NO: 7909 - DNA, 704 bp, Triticum aestivum
  unsure (1)..(704): unsure at all n locations
  Clone ID: PAT_TA_7909
ctgcaggnaattcggcacgaggcccaaagccgcacgcccctccctcccgcctcactcgtctcaggctctcagccgccgccccatgaaccctagccgcgcccctcctgcatctctcctcttaccccctcccatggcctgccccgagctcctcctcctccgtcctcacatgctccaccacgagcacgccggcggcgaagcgcaccgcgaggacccggggcaactcagcttgtacagagccactccgtacaggaggaaccccgtgaccagagcagccaacaacggtgacgcgtacggcacgaggaggtgcgcaagatcggcaccgacgagggggtgctccaggagaaggtgcacggctccgcctaggaccatgtgtgtggtggcggggacatgcgaccactggcatattttggggagcggcacgaacatcaagcaatggctgaggtgaggttccccgccccgccgctccgcgctctctctctctctctcgctctctctcgctccctgctgaccatctcattagctgctcccccagttctggtcatgttcgcggccccgttgggcttgcaccgtcgtccgtggggtacgcgtgccaagaccttggctactaccttgggttctccttccgatcacgtagttcaggtgctttggtttctgggcttgctgccctctgtcttgatgtttattttttggaaatctagctagcg

SEQ ID NO: 7910 - DNA, 470 bp, Triticum aestivum
  Clone ID: PAT_TA_7910
cccacgcgtccgctccgctgggccaccagctttgaccgccgcctcccttcccctccgctactgctcctccccaccccactcccccgcaggagcggcggcggcggcggcgaggtcgtaccccacatcggcgagcggcggcggcaccgccggaggcaaaggcaagatgttcgggcgcgcgccgaagaagagcgacaacaccaagtactacgagatcctcggggtgcccaagtcggcgtcccaggacgatctcaagaaggcctaccgcaaggctgctatcaagaaccaccccgacaagggcggtgaccccgagaagttcaaggagctcgcacaagcctatgaggttttgagtgatccagagaaacgtgagatttatgatcagtatggtgaagatgcccttaaagaaggaatgggcggtggaggatcccatgttgatccatttgacatcttctcatcattttttggaccctctt

SEQ ID NO: 7911 - DNA, 527 bp, Triticum aestivum
  unsure (1)..(527): unsure at all n locations
  Clone ID: PAT_TA_7911
cggccaccagctttgaccgcctcccctcccctccgctcctgttcctccataccccacccccccgcaggagcggcgcggcggcggcggcggcaaagccaaaggcaagatgttcgggcgcgcgccgaagaagagcgacaacaccaagtactacgagatcctcggggtgcccaagtcggcgtcccaggacgacctcaagaaggcctaccgcaaggcagctatcaagaaccaccccgacaagggcggtgaccccgagaagttcaaggagctcgcacaagcctatgaggttttgagtgatccagagaaacgtgagatttatgatcagtatggtgaagatgcccttaaggaaggaatgggtggtggtgggtcccatgctgatccatttgacattttctcatcattctttggaccctcttttggaggaggtggtggaagcagccagggaagaaggcaaaggaggggagaagatgtagtcactcacttaaagtttcctggaagantttaaatgggatccaaanagtctcctttgg

SEQ ID NO: 7912 - DNA, 689 bp, Triticum aestivum
  Clone ID: PAT_TA_7912
ttttttttttttttcatgcgaagaaatgcaactgctgtttatagaagatacgcctgcagtctcagagatgaaggaatgccctacagagtcaagatctaaaagattaaaacactcgtgcgggtaattagcatcaagcgacggcgaactcatcaggttcggagcacagatctgcagcttgccatttccaagtctacttttttccagtacggggctttcctttgacatcagattcctgcacgctatgcagaaagatatttgtctttgcagtagaaggattatgcttctcggcgcccttgctccaatcatagcataccgcataagcaaagattgagccatcctgattgaatgtgctgcatgtgatgggtgatgggcacttactaaaagccttcagtctttgtttactgtccttgtcccaaaagttgaaacctccatcagagcctgcagtagcaaatgtatggtgcacaggatgaaagttcagcgagttaacagagaatatatcattgccctcgcggtgacatttgaatgtgaaattcttgctttgattagaatcatctacatgatgaacaccaacgcgtccctctattgatccaaccaagaatccttgttgatcagggaaggcggcgatacaccttgtctggaatttcaaaggtgacacgatcctcttgaattcagcctgtggattctgcaga

SEQ ID NO: 7913 - DNA, 914 bp, Triticum aestivum
  unsure (1)..(914): unsure at all n locations
  Clone ID: PAT_TA_7913
aantttgaaggnatggnnggctttngtatacnccgttggaaagggatttctcaagggataagttggtaacgcaggttttccngtcagacgttnaacgaggccgtgngcggggtaatagactcctntaggggaattggtaccggccccccctcggcgcggccgtggttcagttggtaatggctgcacattgaggaatgcagaaacaaattacatttgacatcatgtttccacaagtgaggtttgctcggcaggagaatcaaagaatcaattgctacttacacggccgcaccaggcatagtattgccaagttacatgtatgatgtactacataccatcatgcctaggacaagctaaatcttctgaacatctaacatccatgacaaaaactgcctcacaatgggcggtcgccgacttagcatcacctgtccccaaatccttctgcttcagaagaaactcgtagcatttggaacttgtaacttatcaattcaggcatcaggcatctatgtcatgccttcagcaccaatcttggtcacaatcagcttgattgctgtcaaattcacggacaaatgcagactgttacttgcgctgttgcattatgcaaactttgaacaaatggagcctgttgcttctttctatactcagtcatggctggcggatagtgagtgaaccatacttctccacgccatgttggctacttgtcacgttcctcacttgatgctttcctaagactcaatattactccaccgctaagacatgtagtaacaacagcaagggaagcttcagttggtatatgataaccacaaaagtcaaagatcatctttgcccctatgaagcccaaaacgataccaacagcaggctgcagatactccaactcagacatgctctcagaaatgagtacgtagagtgacctcagg

SEQ ID NO: 7914 - DNA, 1050 bp, Triticum aestivum
  Clone ID: PAT_TA_7914
gtgtatacatagcagatatctatccgttaaaccatgatctgacatcttgttatagacaagtgaaaagtttacttgctcaaaagcaataacataacagttgtacacatccatacacgcaccactccaaattttcatccatcacctagatacatatcagttcataagtttccaattcatctagactaccaatcatgttctcaaaatcattgcagcatacagcgttgcccttgcctacatggttgtgcatagaaccatcctccaaaagctaacatgagatgaatgggtgttcccttgcaaagtcatgtacaacatcaatgagaactaatattgaaaaattcaagagatgatgagcaacatcaagtagatacagaatcaatagaacatacatcatagtgtgcatactaccgtccatacctacaatattgatgctctcattactgttagcattaagaaaattatgttgtaaggtgcttagaaacacaatctgttccacttgttgataatttaaataccaatacacttcattgagaaaaacacttgggctaatcaagatagaagaaacaaatgtcacttagtattttctttgtaaatttgagatatggcatatggcagcacaacaatcattgattgttatactatattttagtgcttttatgaaaaatgaataagagtaattaacactaaaaatgcaccagtagtttcaagttggaccttgcgcccattaggacgcattcttgtccggtagcagggctggtacgcgatagagttgacggacgacacatgtggagctattaaaataaaagaggaactgaattggtggagagcttaatacattaatccctgctattatgtgccagtatgagaaaacagatctaaacatgttctgcagatcatggacttgaactctacaagtgcactacaaatgacaatactgtgaccggctacagtacaaagaagataacaattgcagagtattgaagttatactttcttatacattttttaccagaacgaactgaaccccggacacagagggtgagagaggaacccg

SEQ ID NO: 7915 - DNA, 1399 bp, Triticum aestivum
  unsure (1)..(1399): unsure at all n locations
  Clone ID: PAT_TA_7915
ctcgtccgactccggcacaagcacaagcgcactctagcaatggcttctgaggttgtccgccctagcgacgccgagctactaaaggcacaagccgacatatggcggctcagcctctcctacctcacgcccctgtcactgaggtgcgccgtggagcttggcatccctacggcgatctaccgccatggcggggctgcctcagccgctgagctggtcacggcgctgtctctcccctccactaagctgccgttcctccgccgcctgctgcggctcctcgccgcgtcgggcgtgttcaccgtcgacaagcagagctcggaggaggagcggtaccgcatcagccccgtgtcctacctcctggtggacggcatccctcacgaggaccacatgaaccacaccgctctgggtgctcacctgcacctcgacgcgctacatcgaggcggggataaggctggcggattggttcaagaaggactggtcactcacgttcaaggagctgcacggggcgactctgttcaacgagaggatggggagcctcaccacagatttccacgacatgcgcgaccgaggccttgataagtccgagacgaattaggcatcgaggcagccatgcgggagttcagggacttgttcgaggggatccagtccatgacctactgctgcggtaacttcggtgatgacaagggtgccagggccattgtcaaagccttcccacacataaaatgcactgtgctggcccctcccaagatcattgccaccaaaccggccgatggagcgatgataaactatgtcgaaggtgacatgttcagtttcattccacctgctcaaactgtcgtgctaaagcttgtgctgcaccacctgaccgatgaggagtgcgtcaagctcctggctcaatgccggaaggcgattccttcacggaaggatggcgggaaagttataaccggtgatattatgattgaccactctgggcctatgctggaaactcactcctgatggacatcggcatgatgaccatgacaaaaggacggcagagagatgaaaaaggatcgcgcgagctcttcaccaaagcagggttcgcgtgaccagttgctcctgttcgtattcttcgcccgtacatcctccgaagtctatccgtgccgctgcacctggactggtcctgcctgcttgcgtacatatttgtatgtgggggggtgccttccatcgcttgccgggttgacctcacttggcatgtgggcccgggtgcttgcggacgcatggtgccccccggtcggagcaaatgncttggatgctttctaaaggtcncggggntttcaaattggaaaanctgtaaanaattancccatcagggtggngttgnttgaagacttgncngcttgaatttgggaaancggaacnaaaaangggg

SEQ ID NO: 7916 - DNA, 664 bp, Triticum aestivum
  Clone ID: PAT_TA_7916
atctgtgccttccagtccagcgtgccgcacggtatgcgtctgccggccgttctcattcccctccaaacttaaagccctaaacccatcttgctcccccctcgtctccactgctctgctgctcctcgcgccgccgcagcgacgtaatggcttccgccgcggtgctccggaacgccggctcccggcgcctcttctcctaccctactctccgcgccgctgcgatatatgtaccttctgcgctacccgatgcgcccgcggcggcggcagcgccggcccagccgccaccgacggccgggaccctctgggcgaggtctatggccaccttcacgcgcacgaagccccatgtgaacgtcggcaccattgggcacgtcgatcacggcaaaaccactctcactgctgccattaccaaggtcctggccgaggcagggaaggccaaagccgttgctttcgacgagatcgacaaggctccggaggagaaagccagaggaatcaccattgggacagcttacgtcgagtatgagacggctaaaaggcattatgctcacgttgattggccaggtcacgcagattatgtcaagaacatgatcactggagctgctcaaatggatggtggtattcttgtcgggtcagcttctgatggcccgatgccacaaactaaggagcatat

SEQ ID NO: 7917 - DNA, 966 bp, Triticum aestivum
  Clone ID: PAT_TA_7917
tcgcgagcgcgggcgttcggcaccatgctctcccacatcggttacggtctcttctagctcttcgccggctgggcggtcatcatgcccggcggcgttggggttctccatctggatctccgggaccggccgcgcgtggtcgtgggggcccctggggtggccggtgcccagtgagatcttcacgttggagatcacgcccgccgggcagagccgcaacgtgtgggtagacatcctccacaccttagtcttcgtgcaggctttcctcaccatgttctcccccattgcagttaggcctcttctacttctccgccggctgggtggtcgatcatgactctcttccatcgcgctcttccttgccgggagacccaagcaacgtgcccatcagaggagatggtgctcgtctggaaggggcactggttctggcgcaggtacatcggagacgctgacgtccacgtcggcgccaacaacggcaagggcgccgccatcgcatagattccttcctttcctagctccgtctccctcgtgtacattaattgcttttcttcctctcttccttgtttgtcctcgtactttgatgcatgcttaggtcaaaccgtgtgtttctcttctgtatgtgcttcaagattcttgcattaattaagatggtaccatcaatcataaaaaataaaaaaaaatttaacaagcaactcacttagcttgagcatcttgtgccaagaaagaccaacattagtgatgctcacagtctggagctgtgggacatagcccaaacagaaagggtcatctcgagataaaaacccattaaatttcagtactgcgggctcgcggaccccctcgtcggcgcccccctcggcacggccgcccccatcccctagttcccggccttgccgggctccctctcccacctgtgcctgcccccccggccccccccgccagaggcgcaagaactctagttgctgtcgacgcggccgc

SEQ ID NO: 7918 - DNA, 683 bp, Triticum aestivum
  unsure (1)..(683): unsure at all n locations
  Clone ID: PAT_TA_7918
ccattccttgtttcattcacccctcccctcccctcccctacccatctggcctactcatctcatctcatacgtagagaagagatatagtgtggggaagaaagtgaccagaccagaccagagcagaccagcagctagcctaggtccagcccttcccctcctctcctctcctcgcgccaccgcccgccggaccacccatccggaccggagatccacccatcacatatacctaccttccttccatccttccatccttccttcattcctacaagcaaagcaaagcagcgcagagcagagagagatccagcacagcagacaagtagaagcaagatgttcgccgacgccggcttcagcttctccgcctactctccttccccgcagccgcagggctactcatactcgcccccgctcttctcccacccctaccccgaccactcctccttctcctctgcccccaacaccgctgctccggcgcaaccgccgcaactccctctccctctccctctccctctcttgcaccagcaacaccaacaacatcaagccgccgctgcacccgacgacgacgacgcctncgncgncatgtaccaccacctgggagacatggggcagccatccctgatatcagagtatgaccttggagcagagggcgacctgttcaaggccccggagcccataatcgaggagcc

SEQ ID NO: 7919 - DNA, 2033 bp, Triticum aestivum
  Clone ID: PAT_TA_7919
acgagtgcgagaaggagctcatggagaaggcggcgctcgaggcgaccggtctcccccttcattcaccctcccctccacaacctactcatctcatacatagagaagaggcagagagatatagagtggggaagaaagtgagcagctaggtccaggtccaggtccagccaccctcccctccccgccggcctacatagacaacaacccacccatccacagatccatccgtccttcctttcttcctacacatacaagatgttcgccgacgccggcttcagcttctccgcctactcttcttcgccgccggggccggcctactcctactcctactcatactcttcttcccccacagtcttgtcccacccacaccccgaccactcctccttctcctctccaccatcctccgctgctccggcgcaaccgcccaacccgtacaggactcgaagatccagaggaactttggcgaaagatcaagtatcttcaggaaggctccggccgacagccagccgagggtgcgtgggaggttcgacaagatggacgacgccgacctgcccaagccgaggaagtaggcggggccatctggtccgaggctagggccaatgagcaaccacagacgagaggagaggaagcgagagcataacagggacgcggagaagaagatccagaggaactttggcagaaagatcaagtatgcttgcaggaaggctctggcggacagccagccgagggtgcgagggaggttcgccaagatggacgacggcgacatgctcaagccgaggaagtagacggggccatggaggccgccgcgaagccgatgaggagggaagacaaaggttgttgccaggagggaattatgctgctgctgctgctgctgctgctgggagatgctgccagtggctttgttggcgtctagaagcttctaggtgaggcggcaccgccttctagggtcatggctgccgtgccgcgctgcgccgcccgtcggaattcatttcagtcgctccatcaaatccgttccgttcctatgggtgacattttctattttctgcgttcgtttgtagtagtagtagtgataataatatgatgatggtcctcctccctgcggtgcaagagagtggagagccctagccaggcaggctcctcttcttcttctgtgtacaaaggcttgaacttgaagttggtactactaaataaataaaacccaggcgaaagatcaagtatgcttgcaggaaggctctggctgacagccagccgagggtgcgagggaggttcgccaagatggacgacggcgacatgctcaagcccaggaagtagacggggccatgcatggaggccgccgcgaagccgatgaggaggggccgccacctctgcctctccctctccctctcctgcaccaacaacatcaacatcagcatcagcatcaagccgccgccgctgttgctactgcatccaacgacgacgacgacgacgccatgtaccaccacctcggagacatggggcagccatccctgatatcagagtatgacctgggagcagaaggcgacctgttcaaggctccggagcccataatcgaggagccgctgctggccctcgacccggtcgccgccgccatctcgatgatgtccggcggggacaacgccatggacgacagcatcaaggtctccgacatggggctgagcgaggtgctgtacgagtgcgagaaggagctcatggagaagtcggccatcgaggagaccatttccgagctgctggacgtcaagatccccatgctgcaggtcgaggacgtccccggggagctcagggcctcctcatcatcgacagttgccgccggcaccggcgagtgctcgctccagaagagcgtcagctccgggtgcctcagctcgggcgactggatgaacgggtcggcggtgaggcccaacttcctcgacttccaagggctcgacttcgaggccgccttcgggctccggcgagcctacagcgagggtgacattcagaagcttggtgccaatacccctcggcctgggatcgcggcaaatgtg

SEQ ID NO: 7920 - DNA, 750 bp, Triticum aestivum
  unsure (1)..(750): unsure at all n locations
  Clone ID: PAT_TA_7920
ctactttgttgctgtttttattcgttagtcacataagcagtggtggtcggtcggccggcgacaatgagcggccgtgtgttcgtcctggccgctgccttcggcgtgctgctcgccgcagccgccgtgtcctcgaggcccgtcctgactccgctgggtactagccgccctgctgccggcgacctgtccgtgtacttccacgcggactcgtgcccgcagctggagacgatcgtgcggtccagcgtggacgcggcgctccagcagaacgtccgtctgacggcgggtctcctccgcctcttgttccacgactgcttcccgcaagggctgcgacgcgtccatcctcctgggacaacggcgagcgccggcctcccngcccaacgttggggctggcagcaggaggccgtgcagctgggtgggaaggacatccgcgggaaagggtcacgccggcgttgcggnccaccgttttccttgcgcccgacatcaacggtgctggcacccgcgacgcccgttaccctgttcccggcggcttcctttcaacggtgccgctggggccgctgganacgccggccngcttcaacaacgactgttcacgccnccgcccgccgaacgngaccgttgacactgcttacgcttccggganaaactttcgnaccggcngactgatggncttctggcnccaacgtgngaaagnccnngcaatctttggaattgcggccggcacgacaagtaaccgtctgcggganttttcccgcc

SEQ ID NO: 7921 - DNA, 637 bp, Triticum aestivum
  unsure (1)..(637): unsure at all n locations
  Clone ID: PAT_TA_7921
cccaggtgggttggcttctcctccccctccggttcgggttcgggttcgtgaggttctccggggttcgggttcgtgggtgagcggatcgagatggcggcgtcggatgttgagtaccgctgcttcgtcggcggcctcgcctgggccacggacgaccactccctccacaacgccttcagcacctacggcgaggtcctcgagtccaagatcatcctcgatcgggagacgcagaggtcccgcggcttcggcttcgtcaccttctccacggaggaggcgatgcggaacgccatcgagggcatgaacggcaaggagctggacggccgcaacatcaccgtcaacgaggcccagtcccgcggcggccggtggaggcggcggcggtgggtacgtggtggcgtggaggccgcggctacggcggtgcgggcgccgtgatgcgtggcggctacgcgtggcgcgctacgttgcgcgcgctacgtggtggtggcgcgctacgcgtggaacctggcgcggtacggaatccgacggaacggagaactaccgtgggcctccggcaattacccgtccacgtatttaccatcaaagttactctcttctttgtgtccacggtttatcagcccttatntagcggtaccgtnaaacaaaa

SEQ ID NO: 7922 - DNA, 622 bp, Triticum aestivum
  Clone ID: PAT_TA_7922
gaggctcgatcgatcacgaggaacccacggccggcgtcgccattgttgctgtaacttgcaagctttccctttcgcctttttccttccacctccctcgctcgtcctcgtgtgcgagctatatatatatatatatataaaagcgcgccgatggagcagcagcaggtgagggggaggaggaggagaaacggcgtgctgcaggtgcaggacggctcggagatccgttctctcgtggagaacaaggaggcgttcactaggttcgtcgacgaccggttccggaagctcgacgccgatggcgacgggaggctgtcggtgaaagagctccagccggccgttgctgacatcggtgccgccatcgggctgccggcgagagggtcgtcgccgcaggcggaccacatctacgcggaggtcctaaacgagttcactcgggggaagcaagactcggtgagcaagccggagttccagcgcgtgctgtccgacatactccttgggatggcggccgggctgaagagggacccgatcgtcatcctgaggataaacggggaggacctgagcgagttcgtggagagcccgaggtactagccttgtaccgtggccatattttcgcatgccggggggggcccta

SEQ ID NO: 7923 - DNA, 1092 bp, Triticum aestivum
  unsure (1)..(1092): unsure at all n locations
  Clone ID: PAT_TA_7923
cgccccccgccgttcttctctcccctcccccgccgccgccgccgccgctgccgtattctccgccccatccgatggcttctgctaggatggaagaccgtggagcgttcgggaccaagaggtcgcgcaatgacgtgtctgtatgggagggtgactggaattgtcttcagtgtggtaatgtcaacttcagttttagaaatgtttgcaaccgtggagcctgtggtgcacctcgtccatcaccgagtccaagcccaagaatgatgccagcgcccgctggtggtggatatgatcggtcgcctctattttacggtagcactggtgcccccccgcctcacattcctcttggatcagctagctatggtgctccatatccgcatgttggaatgcggtatggttatggtccaccagttggacctcatggctcatatggtctcatttcttcttatggccaacctggtccaatgggggggatgggttatgcccacggacctgagttgggtcgatatggacctgagttgggtcgatacggctatggatttagaggatctccaatgccggtttctagcccatggtctgatggagcattagtggaaaataataacagcactgcttcacgaaagcggcgtggaggcccacatggactgtctgagggtgactgggaatgccccaagtgtggtaatgtaaattttgccttcagaaacacttgcaacatgaagaaatgtgaagaaccaaggccgactcctggagctaattcgagctcgtcgtctcgcaaagacaaagataccccagaagggagctggacctgtccggagtgcaataacctgaactaccccttccgcacagtgtgcaatcggaaagggtgctcatgtagtaagccagactcatcaagcaactagtcctagcttctcaaccgtgatgtgaactatcgtccaagcattgttgtaccctagctatacaagcttactgtaaactgcacagatgtgttttctgttccctgtgaacaaacattcatatcgactatgcagcttccnaggaaaatattgacctgcgaaattttagtcgtgctttacaaaaaaaaaaaaaaaaaaaaaaaaa

SEQ ID NO: 7924 - DNA, 362 bp, Triticum aestivum
  Clone ID: PAT_TA_7924
tttttttactagataaagtttaaattttattgaatcttcttcatcaatcacgtcgaatagtcttatttgacatccgtttttgacccttatcatatccggttgcagcaacattggttttttgtgaaagatatgcagtcgctttgacccttatggtatccatgtgctaaacattgtttctcgcatagatcgagtgtgcaacgtttcataacaaaacacggcggcttgccggccatcgtgcccttcgtatctatgatccttccttctactagagagggcaaggaagtggtagacatgacaacaagagccagaaggcacatagcctgcccgctgttcttgataagcgccattaggagtacttgagc

SEQ ID NO: 7925 - DNA, 671 bp, Triticum aestivum
  unsure (1)..(671): unsure at all n locations
  Clone ID: PAT_TA_7925
ttctcgacctaggcatgtcgatccaattgtcacttgctctccctccaacaagctaattaaggccggtcatccctcttctagctcgtttcattatccatggcggaggagaagcaccaccaccaccacctgttccaccacaagaaggacgaggagcagctcgccgccggcgggtacggcgagtccgccgagtacacggaggccacggtgacggaggtggtgtccacgggcgagaacgagtacgacgagtacaagaaggaggagaaggagcacaagcacaagcagcacctcggcgaggccggcgccatcgccgccggcgccttcgcactctacgagaagcacgaggcgaagaaggacccggagcacgcgcaccgccacaagatcgaggaggaggtcgcggcggcggcggccgtcggctccggcggcttcgccttccacgagcaccacgagaagaagaaggacacaaggaggcgaagaggccgcggcgagaagaacacacttcttcggctgattgatctccctatctctcctccctttgctatcctcctgtataatacctcctcccccctgtttccggtactctttccccttgcccccggtagcacgctcgctgctacttancaccttgtaactgnttatcagnctgttnatctgacaagacaaaatttnaancn

SEQ ID NO: 7926 - DNA, 640 bp, Triticum aestivum
  Clone ID: PAT_TA_7926
tttttttttttttttttttttactacgaaaaatgctatccatatcatcaagagttcagactaaagcaacatcaaaatgatttatccagaaacgaggcaaaacagctaggtacaaataagagcaaataatacagtcttcttcctgaccaatcatcatcctagatactaaaatatgatgctttgacagacacaatgcggattaacttagctattcatcgatgttaaacttaatcagacatagtttcacacattatcctcatccccatcaggagctcccatggcgtcttgctcctgttcaccaaccgcggatgacatcatggatagctgctgctgctgcttcttgtgaggatatgactctagctgggttcctggcctctttgggcattccttttcacctaattatcttggtttgtgcattgcaggtgtactccctccgtccggaattacttgacgctcaaacggatgtatctagcactgaagctgcagctgtcatattgagatggctggagatggtgctgtagaatagtgttgtgcatcttccgacctgaagaagattgactcctttcagcttcttcatctccatgtcgacagcaatcgaccaaacttcactgtccgccatatggtgtttggccaacaaacag

SEQ ID NO: 7927 - DNA, 417 bp, Triticum aestivum
  Clone ID: PAT_TA_7927
gggtgaaaatgcaatctcatatcataatctttaatgagctccaaccatctcctctgtctgagatttaactccttctgcgtgaaaatgtacttcaaactcttgtgatccgtgtacacctcacaatggtttccgatgagaaaatgtctccatgtcttcaatgcatgcaccacggctgctaattccaaatcatacgtagcataattcttctcatggggtttaagttgtcgtgaagcatacgacacaacttttccttcctgcataagcactgctccaagtcctcgacgtgaagcgtcgcaataaacttcataatccttgcgttgatctggcagaatcaacactggtgatgtaaccaatcgtttcttcaactcttggaaactagcttcacattcctcagtcgaattgaatttggtgtccttc

SEQ ID NO: 7928 - DNA, 394 bp, Triticum aestivum
  Clone ID: PAT_TA_7928
ccttctactctccgttgcgacccactcttttcggacgcgtggggtgaatgtgatattctcgtccaaggcgtttgttgctggcttcgtggcatatttgctggacaacactattgacaggcatgaagcttcagtcaggagagaccgaggctaccattggtgggacaaattccggtcgtacaggaccgatacaagaagcgaggagttctattccctgccattcaatctgaataagttcttcccatcggtctgagcttttgctgtggttaatgtgagatgctcttgttactctggaactgcccaccccctgttctccggcggtggcaccgtgatctggattttctcggtacatgaaaaaattactgtatattaaaacccgctcagctcgggtttcacc

SEQ ID NO: 7929 - DNA, 642 bp, Triticum aestivum
  Clone ID: PAT_TA_7929
tcggccaacccgccgcttcccgcggaggatcccaaccttaccgcggccatgggcgacatccctttcccgggcctgccacaggcgccgccggtcgtggcacctccggaagtggcgagctccagcggcgcgggtgggtggttcgggggactgtttggcaagaaggaggaggagaagaaacccagcgcgggcggtggcaagtcggagatcttggagagcttcgacacgcccagcagtccgataccatcgttcgagtacaagtgaggaaaaggttggctgatgccttggtcttgcaatgtggtggtggtctggaattggtgatgcatgtcagcaatagaataaccgacaggacaagagatggattgttcgataacttattcctgcgccgctctgcctcgactggctcatatctatgcgtcctcttgtgtatgtataagccttttttcaaaacgtggcagattggctacttcttgagatgtagtttttgtagaagcaaagagcagtagtatactgcctatattatagcattcgtgttgtgtgcaatgtaatgcacatgagaatccttgtgcggttgtgcctcggcctggcctcagaagggacgacattttttttgagttcttaaaaaaaaaaaaaaaaaaaaaaaaa

SEQ ID NO: 7930 - DNA, 1021 bp, Triticum aestivum
  Clone ID: PAT_TA_7930
atgttgttcgtcgtactaaccggattagaaaaccaacattaaaaccacggagtagttaatccatcagaagcaccatatcatggcactgataatacatcgttagcaaccaagagctaaacaaacaccacacaaaatagaatgccatcataatatcaacagcggttggtctttcacaagcaccacattaaagttttctggggtcggtgtaacagaacatcgcatcgcaagcaatacggcacgacaaaagggacgatggacctaggaagaagcatcaccatctaacacacgtcgagacgtccattcgctagaccatcaatgcgagagcacatctaaccaacacaccatggtccagaggagcttaactgtgcagtgcctcatggtagtcatcaacattgacacgcagaacggcaagatcaaactgagactaaggcctgcccgcaagatcaaccaaggcaagatttccaggaaagtacttgactaccatatcgtccgttctccgtaaaaaaatccatgcggcagttcagtagatcaatacggtcaaggcaaatgcatagctgttgtctgtccctggaggacaatcttttctataggagagaacttgccctggagcttcttatggaagtctatcatctcagaagtgtcatcatttatgtaccaccgacacgatgcacttccgctcgcaccccttcgaccttcgtaggccttcaccagagttccaacaaatagtgcaaccactggttcagtcgagcctagctcgataatgtagtctccctgaaaggttgtagcacgttcgccctagagcacaacagttatctggcaccttaggtccatgatacttgatacaacgctttgtggaaggcttgctcctgctcgagctatgatactgaacaacatcggatacaccagtgataacgccgagcatacaccaaagtcaagcctatattccttttctgcatcttgatgttcatccgtgcctgaactccaaagagactagtgaagcaacctcgagcaccagcaatgc

SEQ ID NO: 7931 - DNA, 765 bp, Triticum aestivum
  unsure (1)..(765): unsure at all n locations
  Clone ID: PAT_TA_7931
cactaaaaaggcttcctcttatctggaattttatactactacacatggttttcgagtcgcgactcatgcgagtcgctctggggcagcgactcggaagaagtcgagcctgcgttgtgactagtcgcgacttagagtcgcgagtcgacactaagctgagtcgaccatatttttgtgactcatagactagctcgagcgactcaaaatccatgctactacattcagagctctttctggtacaagcgcggatggctacaaaactccaactcggtgttgcttgttcttgaggtatgtttttgatagaacccttttcccatacatgtggctttgcattgcagcagcgtgtggcctaatagcctcgacaaaggtggtatgtagcggacccttgcaatgttcaagtgctgtttgaataacaaaattgccgtactgatccaccataatatgctgcaactggggatcgttgataagttcttggatgattttgtcacgcatgtgctggggcgctcgcttcagacagttttccaccacatggctaccacatttctgaattgacagatacccaaagtgaccctccagctcatcaactattttcgatgccgcccattcaatgccgtggttgagaattgactgaataacgtagtttcccaaatcgctcatcggcaagggttagagcactggatataatattgcttaacaagntgaacttntgttcatcatctgaatgttcgatgcatttttgaatgctacaacagccttgttgatgtgntg

SEQ ID NO: 7932 - DNA, 663 bp, Triticum aestivum
  Clone ID: PAT_TA_7932
tttttgggggtttccccgctgatgctctcggctgaccattgggccaccacggccccggctttgctcaaaatcatttttcggccctactagttctcttttacaggaaccacgactcatggtgcctcccacaaagtgtgttccaacaaaaatgctgatacaatctatactgatattagatatttggggccttccggttcatctttagtttccctccataaatcggtaggctgtagatggcaaaattgatgggcatcatcacgcattgcttgcagctagcccgtttgtaaaccgatgtgtgactgtaaagaggtctggatctctgtaaagtggtatcccaccgccgagttctttcagcttctttacccatatcatgcaacccctcaaaagtgagcttggtcttgtgcattgaattcctccctcacttgcggatgcactctaaaacagcttcccagcaacttgtggagatgggatcggaatcattctccatggcactgggtattgctcgcacagtttcaaatactcaatggcaagatcagccgggtctaaaccaccatctccgtcttcattgccatcttctttccactcctttgtacggaaaccagcaaataatgctggattttccaaaagaggttcagctgaaagcacgccatcagcaccagtgtg

SEQ ID NO: 7933 - DNA, 713 bp, Triticum aestivum
  Clone ID: PAT_TA_7933
ttttttttttttttttttttagtgcgcaaaagccacttgttcatagtgaaacataaatgatgggcgcagttgataagaacatttcccacacaatttatccaaatgttgtactcctgtatgtaagatatgttcagcaaagtttgccctgtatgctggcaatgtgaaaaacaactatagtacctcgatatcttaagacttacatgtattatttcacagacaacaggaaaatttgcaaatatctatacggataatctttctttctcttcttattactttactgtaaactaatcttatcctgttgtatatatatatgatgcatctaattccaccaaataacctccaaaatatgcagccatcttcacaaattggagtaatgttcttctctttaattgaatgatcatcaataaggaaaggaccctgtcaacctcatatgatcaagggtacttctcaagccatattgttcaaccgcttgaatgcctgcccgaaaaccatccccatattccacggatgaatctgtttcgatctgattcttgatgaacgccccgagtttcttctcaaattctgtctttgctcctttctttgaagaggtaggagctgccgacgaagacgatgatgatgccgaactggaagcagcgttgccactagcaccggcgatgatttcagactcaagccacaagtgggataggacttgacagatgccttcttcaacctga

SEQ ID NO: 7934 - DNA, 521 bp, Triticum aestivum
  Clone ID: PAT_TA_7934
ctcgtgttttttttttttttgtttgttctttttcattgtagtatcagactagcacaaaattgttgcataccagaatgggttacaaaagatgaaaagagaaacagttccaccataacttttaccccaaagctttataagctactaaaatctgaagaaactactccagacattcccccgcacccccatattacactcagcagtataatctcaagtgcaatctcctaatacaaaaaaaaaaagccgtctcgccgctgactgcttcccgctgctcccgcttatctgtgcatccagcttgccgttgcgtcccacttcctgggtcccgcttccagcggtcggcagtccaccctcaggcccctgccccgggtctctccagctcatccccactcccctgcccccccccgctcctcctctcctcctcgtcagctataagggcagcgggagtgctttctccatcaaagaggatttcaccatcatcagaatcacccttcatgctcttcttcttcttcttccccttattcttc

SEQ ID NO: 7935 - DNA, 648 bp, Triticum aestivum
  Clone ID: PAT_TA_7935
ccgcacgtgccggtccggattgaccgactcgtcccacgcctcctggcgttgcctaagaagatccagaggtctagtcttggccagcttaaaagattttcactacgagaattacaagttgcaacagatggcttcagcaataagaacattcttggaagaggtggatttggcaaagtctacaaaggacggctggcagatggatctttagttgctgttaagagactaaaggaggagcgcacgcctggtggagaattacagtttcaaacagaagttgagatgattagtatggcttgtacacagaaatctattgcgtcttcgtggattctgtatgacaccaacagaaaggttgcttgtgtatccatacatgactaatggaagtgttgcgtcacgtttaagagaccgaccaccagcttgaaccgccgctggattggcaaacgagacgaagaattgcattgggttctgccaggggcctctcttatttacatgatcattgtgatccaaagatcatccttcgtgacgtgaaagctgcaaatattttattagatgaagactttgaagctgtagtgggggattttggtttggccaaactaatggattacaaggatacccatgtaacaactgctgtgcgtggaacaattgggcatattgcac

SEQ ID NO: 7936 - DNA, 1023 bp, Triticum aestivum
  Clone ID: PAT_TA_7936
ttttttttttttcgtattgctttttcgattagcggtcgttccccccgtgggtacatttacatttggtgactggcaaatacaactcgtacgttggaaggtactggctggaattcttatctcctggccttgtggttcaacttggcatctgcaagcaaacatcacagcattccatcccactgaaactgcacaatcatcacgctgttcttgtatgtgtgcttcctacgcatgatagttgcaaatgttgcccgaatcccatgtattcgtgccgcgccatcttgtgagtcgtcttggagatgccgactccacctagagaaatcgcgctgacgaagatcatggaggacaatatgaagatgataaatgatgcccgccctagccaattgaccagcttccttgcgacccgctggccaacaatcgcggcaacaaatgtcaggctagtgaagaagagagcgtatggtacagggaaccgtttcagcaggtagtattccacggccgccatggaagatgagaacatcatcgcaaagctggccgtcgcacttgagacctgcggatggataccgagctccaggaagagaggccccatgacgacgcccccaccgaccccaagcagaccggcgaggacaccggcggtgacaccaaagaagcagtatactaatatctgatgagctttcgggctggtctggttatttgctcttgatgatagcgccctcttcccctgcaccaaacttgctgcctggtacatggacactccaactgacaccgggatctggagtacggtcaaaacccagtaccatgtggaacaagttgccacgtagttcttggtgacttgaagtgtaaggaatgctacccaaacggaggccagaaggccaaactccttccagtaaatgttcttccaaatgcataccgcttcatctgttggtttttttgtatcagctgcaggatcgggtcctataggcggtggcgtatatctagtatcttcattagatttctctagttgttttgcctttgcctcccttcttatcattg

SEQ ID NO: 7937 - DNA, 674 bp, Triticum aestivum
  Clone ID: PAT_TA_7937
gattccggaaaatttaaaattcaaaaagttgtgagttttgaaaaaatatatcgggaaatcataaaatgttcatgaattcaaaaaactgtttgcatattatgaaaaaaatcacgatttaaaaaaatgtgaaaaaaaaatgttcatgattttgaaaaaatgatcgtgtattcaacaaatatttggtaatttgaaaataatgtcagtgaaatttaaaaaatgttgacaaaaattaaaacagacccttaaataacgaacaaaacaaaccatcgcttacgtagaggtttattaggggatctgtagaggtcattttatgattttattttttcccccgcgcgtcgcgtaagaaaaaggtttccgtgttctctacaacgttgagcctccaaaaattgacacaacttcctatggttcgtttttgtaagctatatgaaaatgactaaatgtttattttgcctccataaacaactatgtttattctggtgccacggtttttactggttatgaaaaacaccgctacgctaggtcaatacaagacaaatcattcatcggtctagctcaggcatggtccatcaatgcagtttgctcagccaaaaaatatttcgttgtggcgccttacgaaatcaagtcttcattagaccatcacattttcagtttttaagatgaccttttaaatgtct

SEQ ID NO: 7938 - DNA, 885 bp, Triticum aestivum
  Clone ID: PAT_TA_7938
cccacgcgtccgcccacgcgtccgctcccggttcttcccctctcttgcgacgacagggttgggtaacgccgctcgccgccgccgccgccatacgcaggtgccgaggccttcgtcgatctcttagccgtcgacaagcacccaagtgcaggatagaatgagacggcaggggcaatatggtgaagcggatattaactctatggttgctgcccagttgcatcactaccaggcacagcaaagggtacagaaacaccctgagaatagctacactggaagagatcctgcacaagcttctgcggagcatcagtacactccccctaaagcaagacagagtcaatgggatcgaggtggaccaaatgcgccaagccaggttccatcatatgcatataacgaagcccaaggtgctggaggtgcgcaatccttttatgatgggcagagatctgatacaaaggttggtctagaaaagcagcccagcaaggagtctagggaccaacctcgtactgatcggactgaaacaagatacgggatttataatcttcctcggacttttgaaggtcttgaacaaagttttcacgaagacattattttgctatccaaggaactacaggatgcagaggatgctgaaaattctagacacatggagagattgaaggagataaatacacagtaccaggagaaactattagcacttcgagctcggcaagcaaactatagagatgagttcctgcataaggaatctctagcacgccagcagcaataccagcatgccagcatgagccattatgccaataattctgcagctggggaacaacatggttatcacccaacagccttgcctggggagcagcatggttataatccaacacctcctgctgctgctggaggtgc

SEQ ID NO: 7939 - DNA, 728 bp, Triticum aestivum
  Clone ID: PAT_TA_7939
tttgaacctggaactacatcgatactaggggcaatgtatatatttacactttccttggtagcaacatcgacgttcttttctcgatatcctaagtgtgcacaaactatatagcttgcttctcgctcaagagcttcagtagagcctaatccttgtggagatcgctctctggcaaagggggcaaaccttcagatctttcccgcagtcggcgcatgtctggtgcccacatccaaaagccaggttctttgcttcagaccagcagattggacaagtctgctgatcacccacatcactgtcctgtcgaggtgctgatgcattcttctgtggcgacccatagctggtgccaggcgattgagtctgcttgacagttgagcatccagagggttgtcgatagacactcacaggtggaggtaacactgatcggtgcggaaatcctctttgtttgccaagaagctggaggttcattgttgccttgaactgagctgggatctccataagtgctgaaagagcaaattctgcctcctttttgctagtaggaataggccttgacatgatctctgtgaagttaacaaactggaaattatcaaatgcacgagaaggtatgttgtcatcaaattgcctcatcatatcccagggcccatcaccgactccaacaagcacaattgacaaagggtagtcacttgctttcacaatggcatctatagtttccctttcctgtgggctcaactggc

SEQ ID NO: 7940 - DNA, 291 bp, Triticum aestivum
  Clone ID: PAT_TA_7940
gttctccgaggcacgcgaggacctggccgccctggagaaggactacgaggaggtcgccgcagagggcggcagtgatgacggtgacgaggaggaggaatactgatctgcttgcatgaatctgtttggctgtcgagccaggttgtggtgttgaaaaacctttgtttgtgtcctggcccccctgggtaatgtttgggtgtttccttccatcatcacttgctgaactgttctagtatttgcatttgtaatttgaagtctgtcgctttaagcactcttggttctaaaaaaaaaaaa

SEQ ID NO: 7941 - DNA, 531 bp, Triticum aestivum
  Clone ID: PAT_TA_7941
agggaccgtgatcgctcctcacggtctagggaccgcggcgactactatgaggtagcttggaccgtggcgactatggtgactactaccaccatagccggaggagcagcgagaggaaccgcaactatgacagtgatgggagcaggtgccggcgacacaggtccaggactaggagccccgtcagggagggcagcgaggagaggagggcgaagattgagcagtggaaccgtgaaagggaggcgcctgccaggcagggcagcgaagagaggagggcgaagatcgatcagtggaaccgtgagagggagactgctcaggcgtgagatctcctgtctgactgcaggttgaagtgttgccttgttcaccggatgttctgcttgcttgtctgatcgtgtaatggtagatggagttagaatttggtcctagtgaacttgcttggatgcctgatgtaacatcttcagtgttgttcttgttgaacttcctctatggatttgttgatggaacatatttggtgttggacttgttattgttatgatt

SEQ ID NO: 7942 - DNA, 1975 bp, Triticum aestivum
  Clone ID: PAT_TA_7942
ttccattaattaattttttgtactggatttaatgtgctgctattttgaaggttttttctgccggaaattttcacatcccgaatcgactggaaattgaagtagccatttgatgctgttacctgggttcataagttgttagacttgttgttatttgtttgttaatcctatagctattgcatattgtgtgccgatccgccctgctccaccttctgctccccctccggctacggcggcgctgatctccggtaagccgtcgccgcctcctccgcgcccgtgccgatacatcgcctagtagatctatacatgcatgtgtaggttcgaaaggattgggttatccgtgaccgcggatgacgctcgttcgctttgcctctcggtgcgaacgggtcggggcgaagcaccttgctttcatgtgtcgtctcgagcaggacttatcgggccgggagataggttcttcccccccttgctgaccgacgggataacgctgctcacggcttcgtcttgctcttgtttagttccgttcgcttccgctctgatccgtaattcaagtgcctgctgtgatcgacggtttcgtcagtttccaccggaattgggatgaattgcatgcagtatcaagttcttgtcccctctcctttgaattatctggaatgttatcccgttaatcttggctgcaacttcgtgtgtttgatttgtgattcgtgtggtgggagtgcagagatctctagcttgcgaatccagggtgcgccgccatggccgagcacctcgcgtcgatcttcggcacggagaaggaccgcgtgaactgcccgttctacttcaagatcggcgcgtgccggcacggcgaccgctgctcccgcctgcacaacaagccgtctgtctcgcccacgctgctgctctgcaacatgtaccagcgccccgacatgatcaccccgggcgtggacgcgcagggcaaccccatcgaccccgtcaagatccagggcgacttcgaggacttctacgaggacatcttcgacgagctcagcaagcacggcgaggtcgagaacctgcacgtctgcgacaacctcgccgaccacctcattggcaacgtctacgtgcagttcagggaggaggaccaggccgccaaggccctccaggcgctgcaggggaggttctactcgggccgccccatcattgctgagttctcgcccgtcaccgacttccgggaggccacctgccggcagttcgaggagcacaactgcaaccgcggagggtactgcaacttcatgcatgtcaaggagattggcagggacctcaggaagaggctgtatgggcacctgcataggtccgggaggagccacagcaggagcagccggagcccgagcccctaccgtcaccacgccagggaccgtgatcgctcctcgcggtctagggaccgtggcgactactatggaggcagcctggaccgtggtgactacggcgactactaccaccatagccggaggagcagcgagaggaaccgcaactatgacagcgatgggagcaggcgccggcgacacaggtctaggactaggagccccgtcagggagggcagcgaggagaggagggcgaagatcgagcagtggaaccgtgaaagggaggcgcctgccaggcagggcagcgaagagaggagggcgaagatcgatcagtggaaccgtgagagggagactgctcaggcgtgagatctcctgtctgactgcaggttgaagtgttgccttgttcaccggatgttctgcttgcttgtctgatcgtgtaatggtagatggagttagaatttggtcctagtgaacttgcttggatgcctgatgtaacatcttcagtgttgttcttgttgaacttcctctatggatttgttgatggaacagtgtgttcaatcttcgccctcggatgtgtatttggtgttgaacttgttattgttatgattatatagtgtgttccctgaatgttcctttgctcaaaaaaaaaa

SEQ ID NO: 7943 - DNA, 720 bp, Triticum aestivum
  Clone ID: PAT_TA_7943
ggcctctccggaggttccatatgcaaagcttctgacatcgatcaacaatagcaagaatggtgaagctgggggtgatcttcagtcgtatccaaactacccagacagcccaattgggcgcctgatatctccaagctcgggctgttctggcacatcctccccattccctgaccctgagatgctggcttcctcacgcagcgctttacgctcgttcccagttcgtgagccccctaagatattggatggcgagggcgttgcgacacagaagttgatacctcgccatatgcgcaacggtgggtccctcttggatggccacatctcagcagctgtaccagttgttgacttctctgcccgacttcaacccaatgagcacgctatggatcaccgggtatcgtttgagttgaccgtcgaagatgtcgcacgctgcctagagaagaagactgcaatctctggggattccggcacggcatctttccaccttgcgcctaccagcaatggtgatcaccacagagaatctaatgaggcaagggcagggctatacgttgacgaaacataccatgacttgcctgagaaagcaaggcggtccctatccctgcgcctggccaaagacttcaacttcaacaacgtcgacgttgctaatgtggagccaagcgtgggatctgactggtgggcgaatgagaaagttgctgggatgacatctgagccaaaaaagaactggtcctt

SEQ ID NO: 7944 - DNA, 1542 bp, Triticum aestivum
  Clone ID: PAT_TA_7944
ggcacgccgcaaccccacaaccgcacgccaccaacgcccccgccgcatccgcccgcccgcccaccgacgaaaccctaaccctagcccttccccccaccgccgccgcacgcgctcccatggcggggcgccgaggctgctgagcgccagcccccgatcgcgcgcgacgatggattgagcccgccgggacccgaggcatggggcccaaccctagcctggacatgctggccgccgcggcggggatggagtcggcggccgccgcggcagcggcggaggcgcagccgaggggccgcgtggtgcggatcatcgtgcacgacgccgacgccaccgactcctcctccagcgaggacgagtcggcgccgccgccgctggccccgatgccgacgaccaaggaggagcgccggagggagcgcaagaagcgccgccgcgtcatggaggccgggaggagggacgactcggggccgccgcagccgcaggcaaccggggcgcgcacgccctcggtgcggtaccgcggcgtgcgccagcgccgctggggcaagttcgcctcggagatccgcgacccgatccagggccgccgcctctggctcggcaccttcgacaccgccgaggaggccgcagcagcctacgacgccgccaagatccgcatcagcgggagccgccgcccggctgacggcgccaccggcttccctttctccttcccgccgccagagcctgccaagccgaccgtcttgcgtcttcccatgccgcagcctgccaagccgaccatcctgcggcttcccatgccacagcctgccaagcggattacctcgccgccgcctcctcctcctccgcctgagcctgccaagccggccatctcgccgcctcctctgccagctaagccgttcgccctcccgttgaagctgaggctgaagctttccttcaatgcacaggtcaaggacaagggttggaactggtgctctgcaggcgatgtcaaggaggaggaggacggggattgtgatggcgaggcaaaggttggggatctgagcattgcaggcgaggtcaaggtggagggtgggggctgcgcaggggaggtcaaggtagagggcgggggctgtgcagatgggtcgaaggaggccggcagtagctctgaggtcaaggcggtcaagccgatgtgggcgatgatcaccgggaaacgaaagaagcggtcaggctgcggcacccgtgtcggcgccctccacgcctcctccgtctgcgtcgaggaagttggtggaacctgaggcagggtccaactatccccgtaattactatcgttagatcttctactcttctgcctagcgtcgtcgtcccatcttctttggtattgtgtaatttttgtcaagtactaaactccttgatgtgcaaactcatgaccatcctgtgatatgattgtggatgatttaatgtatatacacccttcaatatggtcgatagtcgatgccaaggatatgccactttgatgtgcaatgaaactgatgtactataatatccaaactaaaattctttattgagataaaaaaaaaggggggg

SEQ ID NO: 7945 - DNA, 3588 bp, Triticum aestivum
  Clone ID: PAT_TA_7945
ggggcgcctccccccttgctcatccccctccctccccccgccgcccgccccacgaatcagtaccccctcccgaagctcccacgcccccccgcgccgaaacctagccgaccacgcgtcgcgcctcctccgatccctgccgtcccccgccccggaccaggtgcgcgccccacacggccctgcgcgccatgctcccgtccaagacggccccaggtgccgaggcggggggagacaacgtcggcggtgggggcaccggtggcccgtccacggcaagctggcccgcgccggaggtcgtggagtgggttcgcgcggcaagggacgaaatcgactacaacctctccatgcggcacctccctgctgtacaacaacatattcgcgaggcacaaggacaggctgcccaacaagttggtcgacgtcaccaggtaggtgggcaaggtggacgtgcccgagtaccggagggacctggacatgggagtggcctgcgaggacgaggacgaaaacgacgtcgatatccccctagtgtctgtttacttcagctagacggtccgcgaaaaaagacaggtagctttgtagcatatccaaaggtgcgttgccttgctaaacgcatctcaggtagttcagccgaagctctcacgctgctagcttctatcttggtggctgtaatattccctgatacattgttggacactggttataaatttgatggttattgtcacaaccaccagcctcctatttcctttatcaaatctgaagtctgaggcctttttggtagtgtcttttgtgactttggaccaaagtttactgttcttgatgttgatggtgaagatccgcatactggtataattgcatcgatcagcaatgataatcctgccctgatatcctgtgttgatgatgaacggcttgaattccaagatggtgatcttgttgttttctctgaggtccatggtatgacagaactgaatgatggaaaaccaaggaaggttaaaaatgcaagaccgttttcatttagcatcgaggaggacacaagtaactttggcatttatgtaaaaggtggaattgtcacacaagtgaaggaaccaaaggtgctatgcttcaaggcactaagagatgccatgacagatcctggagaagttcttctgagtgacttctcaaagtttgagcgcccccctgtgcttcatctggcatttcaagctctggacaaatttaagaaagaccatggacgctgccctgctgctggttgtgaggaggatgctcatagttttctgaagattgctgctgctattaatgaagcctcagctgatcgcaagctggacactattgatgagaaactattccgacagtttgcaagtggttctcgagctgtattgaaccctatggctgcgatgtttggtggtattgttggtcaagaagttgtgaaggcttgttcagggaagttccatcctctcaaccagttcttctactttgactctgttgaatccctgccaacatatccgttggaaccccaagacttgaagccatcaaacaaccgctatgatgctcaggtctctgtatttggttccaagcttcagaagaaaatggaggaggctaatacttttgttgtagggtctggtgctcttggatgtgaattcctgaaaaaccttgcgttaatgggggtgtcttgtagcagcaagggaaagttaaccataacagatgatgatatcattgagaaaagtaatttaagccgtcaattcttgttccgtgactggaatattggacaggcaaagtctactgtggctgctacagccgctagtgctatcaaccccagccttcacattgatgctctccagaaccgtgcctgtccagataccgagaatgtcttccatgacacattctgggagggcctagatgttgtcatcaatgcacttgataatgtcaatgccaggatgtatatggacatgaggtgcctgtacttccagaagccactactggagtcaggtacattgggcgcaaagtgcaatattcaaatggtgattcctcaccttactgaaaattacggggcttcaagagatcctcctgagaagcaggcgcctatgtgcacagtccattcttttccacacaacattgatcactgcttgacatgggctcgttcagagtttgagggtttgctcgagaaaacgccaaatgaagtgaactcttttctgtctaaccctgctcaatatgctgctgcaatgaggaaggcaggtgatgctcaagcaagagaattgcttgaacgtgtctctgagtgtcttaacaaggaccggtgcagtacatttgatgattgcataagctgggcccgactgaaatttgaggattatttctcaaaccgcgtgaagcagctcacattcacttttcctgaagatgctgccactagtatgggtgctcctttctggtctgcccccaagcgcttcccccgtgcactgcagttttcagctgctgatcaatctcaccttaacttcatcatgtctgcttcgatattgagagcggagtcatttggggttgctatacctgaatgggcaaaggatactagtaagctggctgatgtagtaaacaaaattgcagttcctacgtttgagccaaagcaaggggttaatattgtgacagatgagaaggcatcgaatctttccagcacctcagttgatgatgtcgccgttattgaagatcttctggctaagttgcaagaatatgccaagatgctacttccaggattccaaatgaaacctatccaatttgagaaggatgatgacaccaacttccacatggatttaatatccggattagcaaacatgcgtgcaaggaactacagcatcccagaggtcgacaagctgaaggccaagttcatcgcaggcaggatcatcccggccattgcaacctcaaccgccatggccacaggactcgtgtgcctcgagctgtacaaggtcatcgccggcgagcaccccgtcgaggactaccgcaacacattcgcgaacctcgccctcccactcttctcgatggccgagccggtcccgcccaaggtcatgaagcacaaggagacgagctggaccgtgtgggaccggtggtccgtccagggcaacctcaccctcgccgagctcctgcagtggttcgccgacaagggcctcaccgcctacagcatctcgtgcggcacctccctgctgtacaacaacatgtttgcgaggcacaaggaccggctgaccaagaaggtggtcgacatcgccagggaggtggccaaggtggacgtccccgagtaccggaggcacctggacatcggcgtggcctgcgaggacgaggacgagaacgacgtcgacatccccctcgtgtcggtttacttccgctagtctgggtctcgagataagaagccttgccgcatctccagaactctgttgtctcgcgaaagccactgatgtagtagtagtttagccgccgctctcgcgctgatagctctatcatggtcacctaagatgttctctctttgtggtatactggtcctacagttatctgctggttggtcgcagtcaaatagttggagttggaggaatgaacaacagacacatcggttacggttaaaaaaaaaaaaaa

SEQ ID NO: 7946 - DNA, 1815 bp, Triticum aestivum
  Clone ID: PAT_TA_7946
gcatctaaaaaaggggcggaaatagcgatgaattgattgtgaatctcaggaataaaatctcctgttttccaaacaaaaaagttttgttgaataacctagggtgggcatgcatcagtacagcccattggttccctacttcgacacattgcattcagcagaatttcaggttgtcgcagcaactagctgatataatgaatgtaccatcttggcaattagaaaaatccacctgctgcctccagcccagggacacctgggatcctgcgagcttatagggtgctgaatcacgtctgcaacagaaacactgggatttgaagcccggacccactacacacacccacagtgagtgcggcgattgccatacaatcagaaattcaatcggttgggctgcacttcgccctaatcacgagcagcgtgaccaaagctgttgtcccaaaatcggattaagggtgcagtatgtatagcaaggttctttggtgccctgcttgctagcgcctgacgcgggggtgcatccgctcaacggttctgttgatggcatcccgagtcatcacgagggtgtcatgctgcaggatgctgtagacattgaggccaatcgaaggaatgacatttcacgtagtgcaagattttgagtagccagctttaactccttatcattgtcccctccatcctgctgtacacattcaggccaatcgaaggaatgacattcacgtagtgaagattttgagtagccacctttaacttcttatcaatgtcgcctccatccaccaataaaatcttcttcgtatcgtccatctgctttatgtactgcacaatgtttttcgtcttgtggctagggacttccaagtcctcaaagatgcagagcttcccctcagctgttctagcaggacaaagctatcttaagtcccaggacgtcgtactttcttctgcaacttgaatgcatggctccgtggtttcgggccatgcatagttgcacctcctcgaaactgacaaccacgcaatgttccatgacgtgctcttccggttcccttttgcttataaggctttcttcctgtgccgctcacttcactgatagttttagttgagtgtgtcccctgttgccttttcgcaagctgccaccttactaccctgtgaacaatatccttcctaattggaacgtcaaaaacatcaccatccaaaaccatgaatcccttgtcctcgttatggaagtttgttactctagctactaggtcctcatactgcccaagctctcggtctggtgtccagacagtcttgctagatagaagttctggtggaatcagcacttcatttgctggagccataagagtagaatacccattggagtagacatttggcaaaatcttggcgaggagcgtggtgtcgcggccggcaacgccgagctgaggcgggcaggccacggctcggcgcaggagggacgcggcacgtgcaagggcgtgcatcggctggccgcgtcctctccgcccggctccagcaaggcgaggtggtggaagcggccagggcatctctggacctggatgcggcgatgagagatctgatggacatggctgctggcgattaagctttcccagcggcagcagcggcctctacggcggcgaggaggcgcgccggtagacggagatggacggcgacggggtgcagggagtggcgcgccagcggacggaagagggggcaggaggggatgacggtggaaatggggaggagggaatggataagggggggtgctcacctccgcagcggagatggacgcctgacacgtccggcggcggcgacgtgtgcggcggcgtgatctgggagcgggag

SEQ ID NO: 7947 - DNA, 1086 bp, Triticum aestivum
  Clone ID: PAT_TA_7947
ttcttcatatcccgaccttataacaactgaaattcgatgatgacagaaggacaaaatccatgtcgaagcaaccccggccaccaggctacccgggtgccgacgccgacaccaggcgaaaatccatgtcgaaacaacacaggcaaacaggtcaacctggtgccaactccagaacaaatcaaagtctcaagtctaaattaacatacaacgaaagataacaattcttgaagaaaaattgtctgcgcatttcaggttccatccatgcaatgccgtcgccaatgctggaaaacactcatgatgttacctggcacgggacggtctcacagcaagctgtccgttttcgccggtagcctcccccagcagtgggcgcgaccatgcgaaacggcaccacgtacagcaccacagcagcgatcaagcagaaggtcacaaagatagcagtggcccttggatcccgccagttgagcagggactgcagcctctcaccttgtgttgccaagtcaccaactgccccctgcaccccgcctgctgtgctccgccggcggcctctccccttccgttccccagcctccgcccgcggtctgcgccctgcctccaacgcccctgcgtcctcctcaccgctgccggtcgccgcctggggcacgggaggggccgtgtgtggcggccgcctcggcctcctccgctagaaccagaccccaatcaagaacagatacagggaaacggtcggaaggatcagctctggaaacataaccaaaatgatgaacaggagatgaatcaacacagtggtcagcggattcttccacgcacgcgtcgtatcaaaccattgagcagttccaacaaggggggtcaacactttcataatcctgaagaagtttgccttgctcttcctcatgctccacatgtgagaatccacatccaacatgtactcaacaacttccttcctgagaggtggctcggcacggctcaatttcgtcgagaccatgtgagtagcctggagcctcagaacatcaagctgcgtgacagacagagggtaaacatagtgcatctttggcagcagcggctgagaatacagctgcatcatcggacgcgtgg

SEQ ID NO: 7948 - DNA, 681 bp, Triticum aestivum
  Clone ID: PAT_TA_7948
ggcgtggtcgcggccgtggtcctttttttatcccctttccttttcccctttgacccctttgccttaattaatttcacattaatgtcatctcttcttcctctgtgcaatgatctcgtctgttgcgctcttacactgggtcttccttgcacttggcactccacttgcttatgcacattttaccggttggttggttggctggctggtgcatatctgaaacttcaacgtttccaaacaacaaagctctgcatccaaatttacatacaattttgagtccgtgtccaggtggtacaattgtgggcccgggtccgtctcctggggaggcctcggtccgtctctgcggggttgggccggctgtccctgcatctttcggacgttcttgccctgaagcttcagtgcaccagcgcacgccttctttgcatccaacttcccattaacattgttcaatatcctaatgatgtcatctaatccccctgaggctcgcggcgtgctgctgccgggcccctgcccatgccctcgctgcctccaagtccccattagcgtcgggcccttccccaccgttggcagctctcccccgggccgcccgctcctgcttcccactctgcccgggctgttctctcgctaccaggaaaacagaaatagggacaggcccatcaacaccgttagtagcactcttcatattcg

SEQ ID NO: 7949 - DNA, 699 bp, Triticum aestivum
  Clone ID: PAT_TA_7949
catacaatgtcacataattttagcaccatctacaagcagagctccaatacttaaaaattcatttcaacccacaattccatgaatgcctcgctggtatcctcaacacttaatgttgttcaaccatcacttgtaagaaaacaagcgactaaaattttaatatgttattggttgttgattgcatgtagctggcatgaagtactgctactgttgactccttcatgaagcatctcatttgtcaaaccccccgctgtcgtcgctgccctttccttgtccacggccacttgccgttcttggagtgctgctggcgctgactccctcaggtgccggctcatgtctccgcgccgacctataactttgattgtagctgctatcaaagccaccaacatgttgctagcttcaatcctgtattgctggatgcaaactactgttatcacgaattacctccaaaaagaagcagcagtctatgtcataggagttatgccctcaccaccttcaccaacatccatgtcctttccattgggcaaggtcttgtttcccgtgctttcagcatctgtctgcttacttgacttcctcttgctatacttcttctcataccgatccaccttatgccaatccaccaaactattatgttgtttagtctcaggaagacctttcctttcacctctcggactctcctgagggtgtttacctttacactcc

SEQ ID NO: 7950 - DNA, 430 bp, Triticum aestivum
  Clone ID: PAT_TA_7950
tacgcaattgctctagtacttccattatatcttttagagcatggcggtggttataaatagttgcactctcatgcttcacttatatctttttgagagttgataatagtaatgacaattagtgtgggttataaatttggtcctaatgtgataggtgttcaagtgggatataatacaaactttcatgtagatcactgaaaatgataagtttgattccttgcaatagtttgcgatataaatgtggtgatatgcgggttgtgctagtgagtaattgtggtttagtaagaatattggtgttaaggtttgtgattcccgaagcatgcacgtatggtctctcgttatgctatgaggttgcatcatgattttttattgtcttccttatgagtggctattggggacgagcgatggtcttttcctaacaatctaaccccct

SEQ ID NO: 7951 - DNA, 708 bp, Triticum aestivum
  unsure (1)..(708): unsure at all n locations
  Clone ID: PAT_TA_7951
gttgaattacttgcagtgtnaaggtacatgagcagatagtgagcatgactcattatgatcatttataaaagttagaaagaaaagtgaatacataatttacaaatagaagaaaaaaacattttttgcaaaataatttcgattctttagaagacgcattacttaagttctccaatgctagagttcccaattactcgaacttgtccagaccctgaaacaatctgaagattaatatgggtaacaaggaagaaattagttttgcacctcattgtctcatgatattcagcaaaagaataacttgaaacattgttttaaataaaagaataatatgaacttttgagaaaacatcagtttcgatgccattgtaacttgtaaagtacttccagacgtagatgcctgtgttaactgattcccttgtttccaactttgtcactttcatgtgccttattccaaaactctgaatgttgaagaaagggcaatgtggatagcttgcaatgaaaagcatcttgaaattgtaagacactgctgaaatttgtgttagaattttgtctgaatctctctcaggatcgagaatgtcaaagctcatatcaatgaaattcgcaacaacaagaaactaataggtaggtcctttgggtttgttgtgcactgggaaagggctatgcaccagtccagctctctctagcctatatccaacactgacctctgagaaaa

SEQ ID NO: 7952 - DNA, 739 bp, Triticum aestivum
  unsure (1)..(739): unsure at all n locations
  Clone ID: PAT_TA_7952
cctcgaacggcaaatatctaccggagcgcgtctcggggaggagagagaaagtcagatccgtgttccgtgtccgcgtccagtgtgtccgctactccgctccccctcagtcctcagttcctcacctagcggtagcgtgcgcgcgggagacgtagatggcggcttcggaggcggcagcggcggcggcaacaccggtgacgccgacagaggggacggtgatcgcgatccacagcctggaggagtggagcatccagatcgaggaggccaacagcgccaagaagctggtggtgattgacttcactgcaacatggtgtcctccgtgccgcgccatggctccaatttttgctgatatggccaagaagtccccaaatgttgttttcctgaaagttgatgtggatgaaatgaagaccattgctgagcaattcagcgtagaggccatgccaacattcctgttcatgagggagggcgacgtcaaggacaggtcgttggcgcacaaaggaagactacaaggaagttggaactacacatggctcgtagttcagtgatgccctaatgtttatccgcctaaacaagaggacgctcgcctcaacccgaagaaactagtgctccgtgatggnaatcgtatagaagtgcccttgggnggactctcgnantanataacccgnctaatagtgcctgcttggctttnaacangttgccntcacnagggtancgnaatcgngcatanctgaattntacntgc

SEQ ID NO: 7953 - DNA, 803 bp, Triticum aestivum
  Clone ID: PAT_TA_7953
ttttttttttttttttttttttttttttcttaatacaaatttccattagtactgtttatttattattatgttgacaaagtaaacatctactaatttcccgccacgtacatcattcatggtgatgggtccggagcagtatcgcctcttggggagacagcaacaatggggctccgcacgacatgcttctccgatacccagctcaagcttccctccacgtgcagttcctcgctcaagccgtggctgctcacggacaccctgaaggtcttcttctctccggttttggagaatgccagcgtctccggggagacacgcactgtcagtgatcttggcgcgtccaccttcactgtgaatgtcgagtttgctggcccaacgtttgtcacagtccgctttactgtgaatggcgtcgatgtcgctgacacggttatcgtcgggtagttaagctgcacggcgtggaccttgggcagctttgcacaggtcaagcttgagttgcgcacgatggttgctaggccgctgtcacctaggagccagcagatgtagcccggcgtagtcagtgacactgaggtcgtacaccaagccaggatctgcggctctggtcgggttcacatggccggcgcctgtgtcgtacacgccggccttcctatgttgctcgtccaagattgagccaccagtgctattaacgatgtccgacgtcgttaggatggcagacttgatggcggctggcgaccagtcaggatggatgcttttgataagtgcagcgacaccactgacgtgtggcgtcgccatgggatgttcctgatatgatg

SEQ ID NO: 7954 - DNA, 829 bp, Triticum aestivum
  unsure (1)..(829): unsure at all n locations
  Clone ID: PAT_TA_7954
naacatgntatttccactcccaaggaaaaagagagagaaaaaaggtagtaggcggcaatccaacggcgggggcctccgcccgcctccggncatggaaaaatcgccgcgggggccggcgaggggggcagcttcgtcatttccggcgccctcctcctttcctttatctctctccccacgcccccacgtttcgccccccatttccaagcccaccgaattccctgcgattcctctcccctcgcctcctcgtctccccctaggggatcgtcggagaggaatcgcaaagagggccgtctcatccgagttaaggaagccatggagcacaaggaggctgggtgccaggcccccgagggacccatcctctgcatcaataactgtggcttcttcggcagcgcggcgaccatgaacatgtgctccaagtgccacaaggagatgataacgaagcaggatcaggccaagctggctgcctcctctatcgacagcatcgtgaacggcagcgacgccgtcatggagccggttgttgctggcagcaacacggtagtagctgttgcccaagttgagttgcaaacaatgaacgtgcagcagcccgctgatgttgccggacccagcgagggggtggcggcgatctccaaagggggaagtaggccgaaccggtcaacgcctgcaagaaggaggttcgacttacgggatcaacggccggtgtgggactcgtctgccaacgacggtttccgtgaacacggtggttccgctgcggttcctcgaggccccgggcagggtaatccgcggattggancaactcanaaattaaggggttccnagttggttaggaaat

SEQ ID NO: 7955 - DNA, 1101 bp, Triticum aestivum
  unsure (1)..(1101): unsure at all n locations
  Clone ID: PAT_TA_7955
ttaaaagggacatttncccagttnacatggtacgaggtacacgtaaatatacatatgtaaacataaatttattaacaaggtacttgacaaacgaccccagaaaaccgacgtccaggtcggctcaagcaactatcaacgcccttaaaataacgaattttgggcaggcaacaatcacaactcatctcatgcttttgcaacttgcagagtagcatgtgattagaaacaagagaaccgagattaccacgtgctgatgagaagctagaatccggcccatcccgatggctgatctactttcttcgctgcccccgtgctcaatctctgggaggaactcccctgggcattcgttctgttcatctgtgctgctgctgcagtgctaccagatgatgtgccgaaaccccacgcatcagaggaaggccccgcattcgtgttccgtattaggttttgcctcccattggttgcatggtcgacctttggcctggcctgagctttcgcctcagggaatgcctgccatgtcttggcctcagagctgggtgccgaggagttgcctgagagcattccttgctcaagttcccacaccgttccttcaatcctctccttccgctgggatccaagttctggcatccttgagctgactttacttgaaggcggtggtgtagtctcagcaacagtgcgcttcaactcttgaatttcttggcgctgggagcggcagattgccgacagcttttcatacttggctgtcatctcagccttctccgacgtgggtttcttcaactgctccttcagattggacacttcagcttcaagctcagatgtcttaccagtagcagtagtccctgagtgcagattgtttgcatcaaaatctgtgacaaaactgttgaaggggtcgttcccagatatagtcttgctttgtgactgtgatgctttatttttcacataaccttgtggttccatgaaaagatttatgtccgaaccacccttaagtccattactggatacagtgttacttgttgtatttcgcaaagcctgaccagaatgaccatgcctatctccaggggtagtggtgctgatatccaccctactttggttatactttgatgaagg

SEQ ID NO: 7956 - DNA, 1071 bp, Triticum aestivum
  Clone ID: PAT_TA_7956
gccgccccccacgccccccccgccccccccccccccccccccccgccccgccacgcaggccgcccgcccggccggccctccgccccccgccgcacggacggccgggcggagctccccccgccggtgcccatggcggctcccgcgtccgagaactagccagtgcccagggtggcgccgaaggcggctgaccatgcaggtcagcacgtcgatggctcgacggtgccgatggtggtgccagaggcggctgttgacgcagagcagcatgtcgagcgctcgacggtgcccatggtggtgccagaggcggctgtcaacacggaccagcatgtcgagggctcaacagcgcccgtggtggtgccagaggcagctgtcaacgcagaccagcatatcgagggctcgacagtgcctatggtggtgccagaggcagctgtcaacgcggaccagcgtgttgagggctcgacagtgcctgtggtggttccagaggaggctgtcgacacagaccagcgtgctgacgccgtggcagcgcccatggtgatgactgaagcagatgtagatgcagaccagcgtgctgacagcgtggcagcacccatggtgacgactgaagcagctgctgacgcggatcatcctatcgaggatgcggctacccaggacaggaagcacggggatgatgacggagttgtcaatgttactcctgaggaaatgagagccatcatcgaagttatagctgagacggggaagttctggcacgactggagttttctcaagagattgttgtctctccaattgatgcaggtcttgggtgaatattctgaggctcaaatggtgatccgagaggacgggcagcaacagaattccttgtttagagagacgcactcagagctgtttagccagctcaatgatgctctcttgaggtttgaagagggtcctccgtttacacttcaaaggctttgtgagattttgttggatccaaaaggaacatacacaaaattgtcgaagcttgctttggccttggagaagaacctcctagtcacgtctaccataactaagtgtactgaaccctaccctactgctcat

SEQ ID NO: 7957 - DNA, 958 bp, Triticum aestivum
  Clone ID: PAT_TA_7957
cagaggcccggccgaaggaaaacaattcttgaaaccaggcatgggtccgcaggggggaattgggggaccttctggagaagccaaggacctgcctggggggaccgggcattggaaccaaccggtccctctagggctctaccagccagcccccggtgggagatgtggaatcccattctctgcgcgtatattcccacaaagggacagcccaatgggatgcgcctagggaggttgaaggcaaatcgaaggatgaggcgatgactgactacatctccaacggtgaagcagctccagtaggagggctgccccctctcatacgtcgataaataagtgaatgccagaaggcaaacaatccctgataccaatccatgcgtttgcatgaggaatattaggagtaccctgaaaaggcaaaatcctggcctcagtgcacgagtaatgggaacaatctttttctctacggactgtaaaagcaagccactgttcaaaaattgaataacgaccgtcctggcatattctaccagaaggacagggccaaatgggatgcatggaaggctgttgaaggtaaaccgaaggaagaggcaatgaatgattacatcaccaaggtgaagcagctccaggaggaggctgcggctgccacttcttaaagtctcttaatagttgccaaacagctattgtcagctgagctttatgccatttgttcgtgagaaatagatcatttgatccactggggatctgtgaactatgtacctgcttatgtaactggttaccaatgttatccatctatctacatgtgaagacttaatatgtctgtgtaaaaaaaaaaaaaaaaaaaaagtttctaggaagtgcgcttctgctggccaaacgggtagaacacgaagctgtttttccaaaataggctgttttcatgtagtataatataattatcgcacaccttggacccaaacaaaaaaaaaaaaaa

SEQ ID NO: 7958 - DNA, 509 bp, Triticum aestivum
  unsure (1)..(509): unsure at all n locations
  Clone ID: PAT_TA_7958
ttggaagtgggacggttacaaacggggtttncaaaatggacggcaacccgaattcttagacacccctgtgccgggcatcttagtccaaagtacaccaaaggcacttaaaagttctcttgtcacaaacagactcttactacacatacttccatgctacctgaagacgtttttggttgccccccgctagtcatcagttagctttctctttctcttcttattcttgtttgcatcggtatcangattccatcttgcctacattgataacttcttctttttgggcctctttcttttcctcttccccctggttctctggttccacctttggtgccacgaaacatctgatgcggcccttctgtccaattttgcattcgaccatgaggggatgtgtcttcgagagaaagagcttcacttgaccagagagggtgaacaccttggcgaaggtgttcaagtacttcggattaaaggccagtctaactggttctcgcacatctattttaaagatagtanta

SEQ ID NO: 7959 - DNA, 844 bp, Triticum aestivum
  unsure (1)..(844): unsure at all n locations
  Clone ID: PAT_TA_7959
aagctaaatttcattatnctccatatttgttccaaattcagnactaacactccaactacacatacatacatacacatatccatacaggaacatgaacaagaagcatggcaagtcaagcctttatggcggccgtgccttcctcttccttcttcttctcggccacctcgtcctcgtccatggcctcgacgagcgcctcgagcacgaccgacttggggttcaccatgggcgggcccttctcccggccctcgagctcgtcgacgccgaaggtgatgagcctgtcccagttcccgccctcgaacagcaccccgaccttcccatcggtgacgcgctgcacgatgccgcagtacatgtggtacgcgttgttggggttcttgacgagcaccaccatgcccgggaggaacagcggcagctccggcggcctcggcctccccgccgggaccacggcggaggacgctttcccgtccgtctgggttctcttggggggaggaggcgggttcttggcgacgaagtccttgagcccgacctcgcccccggggaagccgcccgtgaggcccatcatctccttctcgaacgcgtccgggtccaccgccggcgggtccgactcagcgcttcctggtgaggagtctcccgagggcgtggatggaggaggtgagggcggggtgggcgacgagagctccttgcggatgccgacctcaccattgcagaggccgcggccgccgaggatttcggagaggcggaaggacgcggagggaggaggggcggggaggcggatgcggtgggggtgcagcggcgggggccggaggaaggagggggtggtgggcgcgggcgccattggagggagaag

SEQ ID NO: 7960 - DNA, 996 bp, Triticum aestivum
  Clone ID: PAT_TA_7960
acgaggcaagactgttgtttctcaatatggacaacagatcctagatcttttactagctgagacacaaccagcgaaggtctgttctcaggttggtctgtgcacttttgatggcactcatggtgttagccctggatctccgttgcgtgcggcttcctggtcccgggggagcatctgccgggctctgggccggccctgggtccaggccccacgtggcgtgcccctgcggtggctgcaggtccaacctgcccccagcgcggcacaggcgctcggccggtgctgcactagccgccctgggcagcggcggcctcgccccctgggagatcccgccgccgcctggccccctctggggcccgggcctggctttccgggcaccctcccacgccggctgcgccagccgtaaactgaggcagtctttcgtccatgcctgattctcccatcggactcgttcatcagctgcgaagctgtcttccgtgtcccatgggagaatcagccgtggactgtggcagtcttgcgtccatgcctgacattgcgttcaccattggaggcaagaagttcaagctgaaaccagagcagtacattctgaaggttggtgaaggacaggctgcccagtgcatcagcggattcacagctatggatatcccaccaccccgtggccctctctggatcttgggtgatgttttcatgggagtctaccacaccgtcttcgactatggcaagctgagggttggcttcgcagagtcggcctagggatatggtttggcagcaacccgtccagaggcaaacgcgtaatttgtgtgtttatgcgaccggcgatgtgtgtatatatgctactacatgtttagtgatgctttcccgagacctgagacaacgcccgtctgttttaacgtggcgcaagaataattctggttccggatgtattctccgtacacaaaaacgaatctgatccgatggggcccatcttgcggttgcgtgtttgaaaaaaaaaaaaaaaaaaaa

SEQ ID NO: 7961 - DNA, 660 bp, Triticum aestivum
  Clone ID: PAT_TA_7961
gccatgcgccccgcatattgacatgcgcctcgcatgatcatgaaatgctcatatagcttggtcagacatcagtccaagacacctatagtaattgaaacatgacgcaattaccaaaagtaggcgatttctgaaatcaaagttgacaaaattacaaagacaagtcttacagttctaaaaaaacgttctaggtgtattgaagttggtggaatgatctgcttccctaccagcagattcactcatcatcgccgccaaatgcgtccacgtcgcgtgttgctgtccttttgctcaaacacgcgcctttgaacgctcaagaaattcagcagccatgtcacggccttcaaaggatgccaaggccaggtctgatgtcacaaactccttgccgtaccgacatattcaagcaatgggaataagatcaatcagttgagtggtcctcagcttcaagctcccagggtttgtatcggcaaacaatttccaggctgcaaggcatgactcaagagcatgcccactgatataaataactcgtgcagggtctctattcagctttgacagatcctgataggtgtcaacctcatgttagatgcgcccttggcaccgcgcggcagaacttcggtcaccttcatactcaggactcatccctttgccgcaataaaatatgttact

SEQ ID NO: 7962 - DNA, 1227 bp, Triticum aestivum
  Clone ID: PAT_TA_7962
cgcctcgacctctgctgcaacccccactaccacaggaacaaactacttaatcttgcgaagccgaagtctcgggtactctctcccgcacgacccaacagcccccgtcccccgccgatagccgccgtccgcctcgcccgcctgccggccgcccgcctgcccgctcgctcgcccgccaggtttcgcttcgcccgctagccgaggcatcggggcggattggatcgccggcgatggactggagcgcggtgacggcggaggacctggtggccgcgctgcgggaggtggactggtccacgccgccgcgccccgtcccggagttcttctcccgcttcaccgtcccccgctcctactccaagtggaccagccgtctcaagtgcaacctctactactacaggacaaactacttcatcttgatcatgttcattcttgggctgggtttcctttggaagccagttgctattcttgcagcttttatgactggattcagcattgcatttcttaatgacagttttgctgtcacttttaatgagaaagtcacacgaactgtcaggcagttctcaccacatttagctgcaaagatgagaccaccgataacccctgttattctgttgtcgaccaagctcgaagagatcaattcatatttgtggtcggcctcgctggttgtttgttcttttattttcggcagttagctgcatgctctggttgacctcatgcagtctcctcacggttctaatgggccgcttctcaatgctctgacttaacaacggtacttcatgccatgcttcaggaacacctaactttgaaagcacgtctgaattacgttcaagagaggaattccgagctttatggcgaaaatatagtgatctcgagatgtccctcaccttgaagttggtacgatgtgtttagtggtgaaattaacaaaggtgatatgcagttgtgattactggctcatttggaggtggacctagactgggctctctggggtgatggtacgcctcggtccgcggtcctcctaatcacagtagttttttcctttggacttctccctataaccaacgctttggaggaagaacagcatgtaaaggatgtaaacaaagtattcagatcttagacaaaaagcatatgttgtttgttgatacgcctgcttcatgctctgtctatacttcaaaaaaccgttgtggatatattttccgctaagctccaaaaagaaaaaaaaaaaaaaaagcttgt

SEQ ID NO: 7963 - DNA, 404 bp, Triticum aestivum
  Clone ID: PAT_TA_7963
aaatcttaaaactaatccgtttttgaaaacaacacacacacttgcctcggtataccacttcgtcatcaggtggttacccatctcattatctccctcgggcataagtggcacccgacggggtttccgaaaagtcttttgaaaatactttgtctccatcaccatgcacattcccgtcccttattgtgtagcaactactttagcatcctatctactcccaccggcataaccctcataagaaggtagggtcatgcccaatgcaagtatcaacaaggaagaaatggaggcaacccaccaaagtggctaccatctcatcatgattccgatgcaacaataataaagtgctatatgaaatgcataaaaatggtttcatagacatggtcaaagggctgcttgcctgttttaac

SEQ ID NO: 7964 - DNA, 554 bp, Triticum aestivum
  unsure (1)..(554): unsure at all n locations
  Clone ID: PAT_TA_7964
agctccttccttccatccattcctccctgtctccgccctcttctgactcccgtaggccgtggtgccgccgccgactgctgggactgccctacaccaagtgcccaggtcatcttcgggccattcgccggcgacgagcaccaccaggtgtgccaggttgaccgagctatggacagcctgtggcatcttggggacgagctccgcgggcagcccaaggtggtggaggaccgccagtggtctctcatgacgtccaagctggcggagatcaccaggtccaagggcgagaggatgaacaccgtccctgacgccaagcagtgggacaagacgtcctaccagcttcacgacgacagcaggatcgggcacatcggcctcatgaacctggatctcaagatgaacgaggctgccgccatgaagctccccttccgtggcatgccgtataacatgaaccagatgtacctcaaggggagcaatgccaattcaatgtcaatgcgttaagatgaatgttggngtcaacaagtatccaatatccaaacgggaaagacgccatgggaaaaaan

SEQ ID NO: 7965 - DNA, 490 bp, Triticum aestivum
  unsure (1)..(490): unsure at all n locations
  Clone ID: PAT_TA_7965
atccaagaaccgtcggcggcggcggcgatgagggcggccggggcagccgtggcgctgctcttcttcttcctcctggccgtccccggcgaggcggcggcggcgctgccgaggttcgctgaggcgccgcagtaccggaacggggcggacgcgtgggcggtgacgggcgcgggggtctgcgacccgggcctggtgcacatcgccatgacgctcgacgcgcactacctcaggggctccatggcggccatctactcgctgctcaagcacgcctcctgcccggagtccatcttcttccacttcctcgccgcggagggcggcggcgcgccngccgncgccgagctccgggccgccgaggccgnctgcttcccgtccctgcgcttcaagatctacctgttccgcgcctacgcggtcgtcggtcttatcttcagggtccgtgcgcgcctcgctcgaggcgccgatcaactacgcgcgcaatcaccttgccgacctgctt

SEQ ID NO: 7966 - DNA, 698 bp, Triticum aestivum
  unsure (1)..(698): unsure at all n locations
  Clone ID: PAT_TA_7966
gtttataccaaatttgaagttgacaatngcaagtttgtgccatcgcagcggattcggctgcttgtgcacttgaactgttgcagtgtactccagcttaaatacaatatacatggtaactgtagaaagatacccgtcatctacggaaagaatggtgaaacatattacttgtacaaaagaatggcctttgaccagtattggagcgtagtctccatggattgaagcagccgccgtgttgcacagatcaacgagatgctttacactattgttgtactgcgacgcaacctcatgaataagttttggtaaagagagattgtgatgcttccactggatttactcacaagtttcatcctctaagaacatcgcgaatttgtggacaggttactcaaatcggccggccgcccgggctggtaccgtccattgaagagatgtgaacgagtgaaagccgaggagggtccgaagatacccgatttgcccaaaaattggcaactttaacaaaatagtgattaccgttccacacaaccacttcccctccttgtagaagaccagttggcaggagtgttagtcggcatgtcaactcgttgttggcaagacaacgccccggccgcgcccgcgctagttcattaatactgacgatggactccagaagagctttaccagcgggtgcagctaagtgatcgctgtcaacaactgttttaaga

SEQ ID NO: 7967 - DNA, 606 bp, Triticum aestivum
  Clone ID: PAT_TA_7967
aatttagctaatattgttattaattataaatattaaatatatgaatatgctaggagtacaaatgaaacactctgcttcaatgcttcctttaaaacagtattagtacctggtgttactgagtaatggcaattgaccagtgtattttggtagtgaagcttgcagatgtatggtcatgtggagttactctttttgtcatgcttgtgggagcctacccgtttgaagatcaggatgatcctaaaaatattagaaagaccattcagcgaattgcagcaattcaatataatatcccagacaacattcgcatatctgatgattgcagacaactcatttcacgtatctttgtcagcaatccattaaggagaatcaccatgagggaaataaaaagccatccatggttcctaaagaacttgccgagggagctcacagaggcggtgcagttatcctacttcaggagggacaacagtgtctctgcattttcagaccaaacaaccgaagaaatcatgaggattgtcaaggaggcaagaaccttgccaaaatcgtcgagatcaggctatggttacagtgaagaatgctcagatgaggaggaaaaggaagtggagagcgaac

SEQ ID NO: 7968 - DNA, 583 bp, Triticum aestivum
  Clone ID: PAT_TA_7968
cctggctcccccccgcgccatgcctgcttcctccttcgcacacccacccgcctcgcctcgtcactgcccacatgccctcctcctactctccacctgacagctcccatgtcctccgcctaccctctctggtgcgagggctcgggcctccgcctcgcctcccctgtgactgggctccggcgcaaccgggtcggcggcccactcgcgctctcgcgccccagtttgctgcacgccgggctggaccgctccagctgccccgggctgggggtgcccgttggtgcggctgcttgtcccggcttccccctcccccctcccttccccctcccggcgggctggccgcggcctgtcctgttcctgtgctgctatggtttatggattggtagccatgcccgtaatagcaaccggacatgaacccagcggcctgtgtgccttcgggttcatgatggctccatccagctaaactgctgtagtctgcgaactgggggtagtaataagctgaagactgaatctgatcaatgtcgcttttagcctgctcatttgaaaatcctccaaagtaatctgtctgtcttccagatgttgaattgcc

SEQ ID NO: 7969 - DNA, 725 bp, Triticum aestivum
  unsure (1)..(725): unsure at all n locations
  Clone ID: PAT_TA_7969
atcgagtacagtcggctaggtaatctggtggtacgacgacatggcggccaccagcagcaagtcgtcgtcgtcctcgagctcggcgcagcgggcagctgccgcactgctcgtggccgccgccgtggcggtgtccgtcctggtggtgggcgcggcggcggtgtgcgacatgagcaacgagcagttcatgtcgtgccagcccgcggcggccaagacgacggacccgccggccgcgccgtcgcaggcgtgctgcgacgcgctggcgggggcggacctcaagtgcctgtgcggctacaagaactcgccgtgggatgggcgtctacaacatcgaccccaagcgcgccatggagcttccggcaagtgcggctcgccacgccgcccgactgctagcagtgtgctaaccaaccaagccaagcaggaaggcccccggcattgctactgtacgtgtctgtgtgtgcatctgcaacaaggtgcaggcaggggcccgtacgtacgtgtcccttcctctctatctttaacgtactatcaaagtgttgtgtctacaattaaatttctgtctctctcgtcatcatgtcattctctgatgtcataagtttgcccgtcattgattaaatccggtgtaaagttgttaccaccggtaagtgctttctcggaactcaaacgatattncttataaaaacggcgccgggcccagtcccccatgaccccaggggatcagccagaacgtn

SEQ ID NO: 7970 - DNA, 344 bp, Triticum aestivum
  Clone ID: PAT_TA_7970
atattattaaaacagtttttataacaacaacaacgacgacgacgacaacaacaggtttagttcttgaaccattattacaacacaagtttttactataagctgaaagttgcagagagtaaagaaaacccgaccatacataggccagggtcttttctcgaataaagacaagtctagttcttaaaccattattgcaggttcttttattgtaaatagcaagtcgcaagtagtaaagtaaatataacaatatactccctcggttccatagtaagtgtcgtggttttagttcaaatttcaactaaaaccatgacacttattatgaaacggagggggtatattgcagtaac

SEQ ID NO: 7971 - DNA, 588 bp, Triticum aestivum
  Clone ID: PAT_TA_7971
acacacaaaacttattaggctctgggcccgcagcaacatcgcaggcggtccggcctacttccagatcgatatcgtcatcggatccaggatagaaaaggaaagtacagcgagagttgcgctagctacaacgaaactcgaagaaggaaaaattaaatgagctgaaaatagacatcgaattccaggaataacttttccttcaaggaacggctagcccggcctagctaattgcccagatccttcaatgccgcggagatggagcaatccccgccgtccggtgggacgcccaccgccagcccttggcgccggcgcggtggacgtctggtccgatctcctctgcgcgaggaagcgctccagcgacctcagcagcggcggggactcccctatggcggcggcctcctccagcgccatcttgaccccgcgtaggatcgccctcgcctgctcctccgtccccgtaaaaccaacggctcccccttccttggcgacggcggcggcgacggccttctccagctccacgaggctttgctggtccatcgtgaagcctgcaagggtctggacagagagagggagggagagagaaacaaggtcctg

SEQ ID NO: 7972 - DNA, 637 bp, Triticum aestivum
  unsure (1)..(637): unsure at all n locations
  Clone ID: PAT_TA_7972
ctccttcaaacactcgggtttggcgaacaagaagactgtgacgatccagccagctgcaaaggactcggctgtggtcctctctactaccaagaccaagaagcagaacgcacctgcgaagctcagccacaagtctgtgatgcgcaaggagttccgcaagatggccaaggctgtgaaaaaccaggttagtgacaactactacaggcctgatctgaccaagccagctcttgctaggctaagctcggtgtaccgcagcctccaggttgccaagtccggtgtcaagaagaagaacaggcagtcctaagcgctaagtttgtgttctgtcagggggcatgttggtgctcgtagtcccagcttatatttatctatgttccaacagttgagacttgttagaactgagcaaaccatgttaagatgctgctgtgtgtcattccttaaaaaattgccttgcacttgtgattactgtctcgttgctgtgtgtcattctaatgacaatcgtttgtcgcttgattgtgcnttgtttggtaaactgcttgtcgtgacaagcactgttatcgcattttgattgggtcctggtaaacaatatccgataaacaggattagtatcctgcacggtgcaggttaacctaaaaaaaaaaaa

SEQ ID NO: 7973 - DNA, 1394 bp, Triticum aestivum
  unsure (1)..(1394): unsure at all n locations
  Clone ID: PAT_TA_7973
aggggtttagaatgtgaaagnatcttgagcttgttgtcaactatgatgttactaatcattatgaggactatgttcatcgggtcgggcgaacgggtcgcgctggtaggaagggctgtgctgtgacttttatttctgaggaagaggaacgctatgcaccagaccttgttaaggctttggagctatctgaacaggccgttccagaggacctgaaagccttagcggatcgatttatgtcaaaggtcaagcagggaacagagcaggcccatggaacaggctatggtggaagtggtttcaagttcaatgaagaagaggaggaagcacggaaatctgcaaaaagggctcaggcaagggaatatggatatgaggaggacaagtcagattcagattctgacgatgaaggaggtgtgcgtaaacagggaggtgatgttgcagcacaagctattgctgctgctcaagctgccgctgctttggctgctgccagggctactagtaatgcccagcagcaagtaccagccacaacggctggctccttgcttcctctgccggtcgcacctaaccaacaaaacaatgaagccacacaacgagcacttgatgctgcatacaacttacagaaaaatttggcaaggatacaggcccatgcagttccagaacactatgaagcggagcttgagattaatgatttcccacaaaatgctcgctggaagatcactcacaaagagacattggttcccattcaggaatggactggagcggcaattactacaaggggaacctttattcctcaaggcaaaattgttggtgctaacgagcgcaagctgtacctgtttattgagggccccaatgagtcttccgtcaagaaggcgaaagcagaattgaagcgtgtccttgaggattgtgccaaccaggcactgaatcttccaggttctgctcaaaccggaaagtattctgttctttgatctgcagtttttataacaaaatggataaagtatgggagatgttgaaattttcttgagaagcttaccgtggtttgcagatcacaatccaattgttggacttcagatatgcaactattttttaaaactttaagccattatattaggcagctagcagttacttagtgccatgtggttattgtgaaaactgtctagcttggaacgttttgacaatttctataattcttttgacaaacttttattgcctttggacataaggcttagaatgctggtcactgttgtgaacatgcagtttactgttgtgaacactaaatggagaatgctgccttccttcttaaaattcatgcaggttttactgttgtgaacactaattggagaatgctgcctcccagatatgcagtttactgttgtgaacgcagttttactgttgtgaacgctaaa

SEQ ID NO: 7974 - DNA, 637 bp, Triticum aestivum
  Clone ID: PAT_TA_7974
ctcgtcgtttttatttgtcaatcgcaactgcattattggtggtgtgttagcacaactgaatcgaaatacatctttcaaaaaccaacggcatggtagaatcttgcgctgtacaagggcccatgtggggtggtagccccaagtttctatgcatgaagaaacacttctcctttccaacaccgaacaaatacagagactgcacacaaccaaaaccaccccaaaaaaacctagaatccatagcatcatatcgacatggtcatcggaagaatcttctgagacgccggttgcggcttgatctcccatgaagccttctcaaccgactccccagggagaatgaaaggcagcgagatctccttgatcatcaggtcgccgcagaaggggcactcgctcgccacggcgtcgtccagctgtgacctcagcttgtcgactgttggtgcgctgctgacagtagattcaccgttcccggtcccgccgttgtcttttgctgctttcctgtccatcaagcttagctgcttctgaaggttcagtattctcgcagcttgcacttggctggtgcagcgagttacatgggcaatcaaacaattcgcgtggaaggcgtgtccgcagggaaacacatagaagggggccatgtgcccaacag

SEQ ID NO: 7975 - DNA, 1920 bp, Triticum aestivum
  unsure (1)..(1920): unsure at all n locations
  Clone ID: PAT_TA_7975
gccccccccccggggctgcccttgcgtgctcccgggtcgggttgtgctctgcccccaccaggctccctggagggcgctttggtgctccgtcttccccggggagggcgcctcgcggctcagctggcggggttcgcccctgggcttcgtccagctttttctggtcggctcctctggccttatttggccgacgggctttgctcccccctcgcgccagagcttcccatctcagcacgcttctgcgttgaatgtgtcgcttagcgcgctggcggtgcgcttcttgcccgtcctgctcgggggcggcctgcggacttgtctcacgtggttcaggccattgggtccagctcctgctccagcattcatgatatcacctaaggcatctccatctacatcatctgccttaccaaaaatgagttagcacaccagcagtagcaagcacttgagcctggtcactgtcatttgcatatgtattggtgctctaattggtgtcctggtgattgttctatttatttgcttctgcacatttaggaatggaaagaagaaggcgcctcctgttgaaacacccaagcaaaggacaccagatgcagtatctgcagttgaatcacttcctcgccccacaagtactaggttccttgcatatgaagaacttaaagaagcaacaaacaactttgaggcttcatgtgtgcttggggaaggtggttttggccgtgtctttaaggggatactaagtgatggcactgctgttgctattaagaagcttactactggggggcaccaaggagataaggagtttctagttgaagtggagatgctgagcagattgcaccaccgcaatcttgtgaaactcattggatactatagcaaccgtgaattgtcacaaagccttctttgttatgagcttgttcctaatggaagcctagaagcttggcttcatggctcattaggcgctgactgccccttggattgggacaccagaatgaagatagcacttgatgctgcaaggggattagcataccttcacgaggattcacagccttgtgtaatccacagggatttcaaagcttctaatatattgctcgagaatgactttcatgctaaagtgtctgattttggtttggccaaacaggcgccagaagggcgcttaaattatctttcaactcgtgttatgggaacttttgggtacgtagcaccagagtatgcaatgacaggacacttaattgtaaaaagtgatgtatatagctatggagttgttctacttgaactacttactgggaggaggcctgttgacatgtcacaatcttcggggcaggagaatctagtcacatggacacggccagttcttcgggataaagataggctacaggaactagctgaccccaagcttggtggacaatatccgaaagatgattttgtgagggtgtgcacaatcgcagcagcctgtgtttccccggaggcgaaccaaaggccaacgatgggcgaggtggtgcagtcacttaagatggtgcaacgctccacggagttccaagaatctgtaccgacaccgccagctcgtcctaatgcccggcatactgcaacgacctatgaatctgatggcacttcatccatgttctcatctggacccttctcgggcctcagcccctttgagactgaaaacatgtcaagaacggcggttttctcggaagatcttcacgaaggtcgatgatcttgagggtggttggtgagtagatgtttaaggtagagcctctaaccgcccattcaaaggctggtggtgttagtgacctggtcggtcaccgggaagcagtacctgtaaattccatttttcgtcaccacctgcaaaagactagatcatcgtcacaacatttgatggctttgtaccaaggaaanattttgctcgaggtttctgtcacacatttttggcgtgtg

SEQ ID NO: 7976 - DNA, 1596 bp, Triticum aestivum
  Clone ID: PAT_TA_7976
tcgactgagcgctcccccggctggagatcccaacccatgggcggacaccggggcgatccgggccacctcctcctcctctccgggctccgggcgtagacgcattcttcgctgcgatccagcggaaagggggggagatcgatcggtccaccgatcgatccgtcggccgggaagatgaactccctcacggccaccggcagcagcagcggcgccggcagcagcggcgggggccgcggcggcgagatgcgggcggccgacggcgaggggtacctgcgggccgacggattcgacctcgtcaacctcgacatgcagctggagaagacgcgctccagggtctggctggatcagcagcggggcgcgtcgcccgcgcagccccggggagctcctcgagtgggagatcgacctcgccaagctcgacatccagaaccaggtcgccagcggcaccatggggcgtcgccgaccgcggcacctacgacggcaacgacgtggcagtgaaggcactcgagtgggggggcgaaggccaggggtgctcgtcgaggcgccgcgaggggttggagaagggggtgggtgtgcggcagccgctcgaccactgcgattgtgcgtagttcgtgggggcgtcgatggggacgtcccagctgaagatcccggcgtcgaagaagggcggcagcagccacgggccaggccagcgctgtgtggtggtggtggagtaccagcatggcggcaccctgaagacgctgctgttccagcaccgggacaagaagctgccttacaagaaggtggtccagctggcgctggacatggcgagagggctgagctacctgcactcgcagaagatcgtgcaccgggacgtaaaggcggagaacatgctgctggacaggaagaagtcggtgaagatcgcggactttggggtggcccgtgtggaggcgcaggacgacgacaacatgacggggcagacgggcacgctggggtacatggcccccgaggtgctggaggggcggccgtacgaccacaagtgcgacgtgtacagcttcggcgtcctgctgtgggagacgtactgctgcgccttggcgtacccgaactacagcatcgcggacatctcgtaccacgtgggtgaagctgggcatccggcccgacatcccgcggtgctgccccaagccgctgtcggagatcatgacccggtgctgggacggcaacccggaccaccggccggagatggccggaggtggtggcgatgctggagaggatcgacaccaccaagggcaagagcatgacgcccgccgtccccgaccacacctcgcagggctgcagctgcttcggcttctccaagtagtagtagtagtcgtcgtcgttgtgtgatgcggctcgtgctgctgctgttttttgtttccctttcgttggtgcggtcgtgcggatcggtgaacgctttggttggtcgtcgcggcgtctctggtggaagaagaattgtgtaggttgcctactgccgctactcgcttgtggtcgtgggtgagatgatggtttattttgctttgcataaacactgtggctcgtcttgtccacaaccggtttgatgttttttgggtttgggttcaaaaaaaaaaa

SEQ ID NO: 7977 - DNA, 1329 bp, Triticum aestivum
  Clone ID: PAT_TA_7977
cccgcatccccgttcccaccacccccaccacctacctcccccggccgccgctcccatggcggagctacggcctcgccctccctgccggcttgccctcctagccggcctggccttcttctgcctggccccgccgcccccccccccgccccccgccccggcccccgcggcggccccaacaaacaagctacgcggtccgaagggctcccccggcggcctcctccggcgcaccgcgggaggcagcacaccctggagcgcaggaggcggcttgcgtcgtggctgtggtcccggtgtcggcgcaccgctgacctagcaacaacggcgcccttcctaacttgaactgccatgggtcgtgcggatgggactcttccgtcgggcctctcggacttgcaccgggatgcccctcgcggcaggtcagggcagtggattcccggcgacggtgtggcgccccctcactccgctgccggtcctcccttggcccccgttggttcacgttcacggcctaggagaagaggaacgcgcggccattcctgccgccggaggccttggagatgacagccacctggaggcggagctggttgcggcagtggcagcggcgggatagtcccggggctaccgggtccgacaggagacgaaggaagtcaggccgaggttgatcccccctgggaccaagggtgcgagtgatggttgcgccgtgggaacggaagggggaggcgggagagaggcgcgaggcacgacaaggtgcagaagcacaggggaactgtcgtggtgaacgaggagtgatgaaaagggaggggaagagcggagaggaagaacgactgaggttgcttgcaagaatggggggactttgtggacttgagggtagatgtcggccccctttgcgcttcttttttctccccatcgaccgccccttcattttcgctctcatgcgatggtccttgagtatagggtttgtttctaatgcttgtcaactcagagttctgtcaagaacagtggatgtgttacaaacaaaaaaaaaaaaagctgtacacgcgcgggccgaccatttgcgccatctatcgatctatctccttccttggttgctccccggaccaggagccccggtggttcttgctccttgggtcctcctcctcgttgggcacggcggcagctgggcggtggcgtgcagattggaattgaatgcgcggaagccgccggcggttgggactgcgagcagccggccgggcgggcgagaaggaaggaaggggaataatcgggaaggaaggctagaaccaaatcgccatgcaaggagtttcttcttcttccgtccgtccgtcgatccggacgcgtggg

SEQ ID NO: 7978 - DNA, 614 bp, Triticum aestivum
  Clone ID: PAT_TA_7978
attcggacgaggtgctcctgcctccagcctcctttcgccccacaagctcgattcctcgctcggccatggcttcacccgcggaggagacgctcgccgccgaggatacggcgtcgccaccgccgccgccgccggcgaggtccccgggcttctggttccttggggaggacaagtctgtccacaaggctctcggcgggggtaaaactgctgatgtacttttgtggaaagacaagaagacctctgctgctgtagtcggtggtgcaactatcctatgggttctgttcgaaattgtggaataccatctcctgaccctggtttctcatgtgctgatcgttgcactgaccatcttgttcctatggtccaatgccactgtctttatcaaaaagagtcctcctgatgttcctgaagtgcagatatctgaagatcttgctgtgaacattgcgctagcattgcgtgctgacatcaacaaggcacttgccttgcttcgggagattgctctgggccataacctgatgaagttcctaggggtgatcgttgccctttggattctatcagagataggagagctctgtgaactcctgagattcatgtacattgcggtcttgatcctccatacg

SEQ ID NO: 7979 - DNA, 703 bp, Triticum aestivum
  Clone ID: PAT_TA_7979
tttttttttttctcttgtgacataaggaccactatttgctggtctggaagagtttacagacaagttacatccatgagcacaaagtttctaatccaaaagacttgaagcaccaaatggtccaaaacacacataagattcatgatacaatggaagtaggctgatccaaaatacgacaaacagccaaatgttgcatgacactccaagtcctcacatccaagcgctaggtggctacgtacctctatgcactggcggaggctcatggaggacaaacaggggtgtgacgccaccttctctgtcatccatttatcatgtcgttctgcgccccactaagcattggccgacggcttgctgctgcatctgcacgccacgaatgttaatgcctgtcgtattgtgcaccaccgataatcaccagcggcttgttgttgcatctgcatgccagcactgctactgccccgctcgcctgcgccggccccggccttccggtccgccaccgatcatcaccagcggcttgctgctgcatctgcacgccagcactgatgctgcccttctcgtcatctaatgctcctgccgtattgtgcgccaccgatcatcaccggcggcttgctgctgcatcttccttaagccgcacctgttttcaatttatcacacatatttttctttaagtttgaatttggcgccacttggttgcttgtcacgctccacc

SEQ ID NO: 7980 - DNA, 493 bp, Triticum aestivum
  unsure (1)..(493): unsure at all n locations
  Clone ID: PAT_TA_7980
aagtancnaaccanttgaattggntagttgttgagtaggaaaagcntgccccaattatattgagctgcntgggattccntgccnaattnttntgnttgagctggcgaacttctatccaatgttgntnttgaacgacgatgcgtgcacaatgttgtggatggccgggnatcgggacggttcattgatntgtgcaagttgttgacaacattgtagacgcttcaantggcagntattctgttgcgaggtctttngtcggaggaacgggatcactgactggagtaatgacagtttctcctccgggttgcactgttgcaggaggaactccttgcacacgttcaattgttgtttttcctccacagaaggttgttgttgtggcaatggttgctcttgcgggtatggttgttgtgttaatggttgttgatattggggaaagtggttgtggntgcgggaattgtggtttccgttgctgttgtagcgggaatgtntgttgttc

SEQ ID NO: 7981 - DNA, 484 bp, Triticum aestivum
  unsure (1)..(484): unsure at all n locations
  Clone ID: PAT_TA_7981
taaaaacnatnacaaccgcatatgacaactcaggttaaatgctcgtttttagcacaacataggctgccatgcgagtgctcatcagttacatgccaaggtggcaaaattgcaatttcccaacgcagtacagcacgattttggcagcagccataaaattggcacgcaaaaaactcatcaagttctgttgaaagactgctgtccagcagacgggggttgtgtaggggggggtggggggagcgacatctgcatttgcatcaccataggtaactgttcttggatgccccttccgtcgccacgatcagcttggccttgaaaatccctaccttgcatgcctggattcatcgagctgtctggcatcatcccgaaaccagctggcatgaaggccatgccgccacctccctgagatggattgcccatcaaccccatgccccatgggcngctgaagcccctnaggcaccgacgctgaaccttgatctgatccggc

SEQ ID NO: 7982 - DNA, 851 bp, Triticum aestivum
  Clone ID: PAT_TA_7982
tttctgcctgggctttcgcggggcctggtggtgtgctcctcccgggtgagatcctcggtctaactgtctaggcgtggtccagctgttccgccgtgtcgccttccttctcaggtctggaccttgtgttgttcttctcctccctcaacgtcagtgtccacgtctcatcgcccggaccttttttaccgtgcggggcgcgtccctcggccccccacggggcttggctccggaggctctacaaccgcactgctcctctgtcgacgtgccgtcctccctgttgcccgtgcgctcgccgcctgcaccgcgcctgctggccactctgtgcctcctgggtgccgcttcccggcactgctgatgagttcatccaaacaggcagtcgctccagtgctcatccataactcacggcctcatgccctgccatctcatggctcagcaggccaagcatgtcgaacacctcctcagcctgcggatctccccggcccccgcagacctacccgcccacggccccgccgtcccccacggcgctgcggcctggcctcttcttcactccccggactttcatcaggccccggaccatgcccgcgccatcccatttcccgacgccggcgtagatgtttgacagcagcacgtagtttgagtcgccgccagggtcctgctcgaggaggtactgcatcagctgctcagccatgtcgacgtccccgtgtatccggcacccagcaagcaaagctcccagcaccacctcgtcggccgcatcggcatggtcgccaccacactcatggcctcgtccaggcgccctgcccggccgagcaggtcgaccacgcacccgtagtgctccatccttgctgtgatgccat

SEQ ID NO: 7983 - DNA, 576 bp, Triticum aestivum
  unsure (1)..(576): unsure at all n locations
  Clone ID: PAT_TA_7983
gaagttaggccttcttgtccgcttgtgttggcggcggcgatggcgacgtcggcgagcacgtccggcgagtggctcaagggcgcgctgcaggaacttcgggagcgtaagggcagctcgctggagttcgactcggatctcatctcgggcctcgtctccttctgcgagctcgcgcctccctccgacgccaccagctatctcgagaattttattgggaaagaagctgctcaggacatcattcaagaatacttgcggaggaggggtcacattggttcctcaaatggaactgagagctttcagtcatctaaccttcagccttatgttaagccttcagctgatgcagcaactacacaaacaaagaaacaaacacgcacgcaaaaagattcagcatcttcttctagtcagagttccaagagtcaatcaggaattgcagaatcacaacttccttccaaggagagggtcaanatagaaaggagcaanggcanttcctcgcngnggagcaaaaggtctattgnctcaagcaagggaaacttgttnaggcangacggaacatacctgcagaactggtacaggggaaat

SEQ ID NO: 7984 - DNA, 184 bp, Triticum aestivum
  Clone ID: PAT_TA_7984
gtcgacccagcgtctttcgtgctgtatcctgttattcctcttttcggattcaagttgtcagtgaagactgtgatcaccgttgccatccgctcggaagtattccctaatttgaactgcaaaaacggcttatattagtgtactactccctccatttcaaaataaatgactagtacaaagttggatc

SEQ ID NO: 7985 - DNA, 788 bp, Triticum aestivum
  Clone ID: PAT_TA_7985
cccacgcgcacgagacaagctcgatcacgattcacgcgccgcgcgttgtcagtgcgaagcagctgttgtgcgctctgcagagacgacccatggcctcgagaacagcggcggtgccggaggtggccctgcggtccggcgacgcgaggcccatgccggccatcggcatgggcaccgcccagtccccggtggtgccggacaccaccgtgaaggccgtgctggaggccgtggaggtgggctaccgccacttcgacacggcctccatgtacgcgacggagcggcccctgggcgaggccctcgcggaggcggtgcgccgcgggctcctggcgtcccgggaggaggtgttcgtcacgtccaagctctggtgcacgcagtgccacccgcacctcgtgctcccgtccctccaggagagcctccagaacctgcagatggagtacgtggacctgtatctgatccactggccgatcagcctgaagcccgggcccgtggtgttcccggtgaagcgggaggacgccgtcccgttcgacttggagggcgtgtggcgggcgatggaggagtgccaccgcctcgggctcgccaaggccatcggcgtcagcaacttcaccaccaggcacctcgacaagctcctgccggccgccaccgtccctcctgcagtcaaccaggtggagatgaacccggtctggcagcagaggaagctgagggagtactgcgcggagaagggcatccacgtcgcggcctactcgccgttggggaggcagaactggtcgggcgacggcaacgccgtgctggac

SEQ ID NO: 7986 - DNA, 2145 bp, Triticum aestivum
  Clone ID: PAT_TA_7986
ttccacgcgttcgagtggaacacttatttgtggggagactcacaaaggctagctgtgtcaatcaagaggagtcagatgatattataacggtttggggcataacgatctttgtggtgacgactaggatgaatgtggacagtaccgccatatagcattattgatgatgctgcattaaatagggtattggaccgtgaccaagtccacgaggaagaatatttggaagatgaagaagatgacgaatttctgaaaggtttcaaggttgcgaacttcgagtacatagatgaagctaaagctttagcagcaaaagaggaggcacgcaaaaaagcggaagctgaagccgcatccaataaagcaaactattgggaagaattattgaaagacagatgcattgagcaagaagtagaagaaattgctatgggaaaaggaaaaagaagccgcaagcagatggctgctgctgatgaggatgacattactggcctgcacgagttaagttctgaagacgaggattactcctatgatgatgatgtgtcggataatgacacgagtttaccagcaaatgtttctgggaggaaggctcagtattctaagaaaaactcacgtaatgtagattcactccctttgatggagggtgaagggcgtgctttaaaagtttatggattcaatcacgttcaacgaacacaattcctacagacactcatgaggtatggttttcagaactatgattggaaagagtatcttcctcgtttgaaggggaaaagtgttgaggaaattcagagatatggtgagcttgtcatggcccatcttgtagaggacacaaatgactcaccaacctatgcagatggtgtgccgaaggaaatgcgtgctgatgagacattggtcaggctagccaaaatatcacttgtggaggagaaggtggctgccatggagcaaggaaaaattacaaaactcttccccaactacttgatgtatgaatttactggcttatcaggtggaagaatatggaaaggggaacatgatctactgttactgaaagcattaataaagcacgggtatgccaggtggcagtacatatcagatgacagagataacgggctatttgaaactgctcgacgggagcttaatcttccttctgctaatgaattgattagttctcagtcaaacaatgaggcaaatggaaatctggaaagcacacaggaagtgcaggtgaacccaacgagcttatctcaatacagggacatccagagaaagattgttgagtttatcagaaagagataccatattctggaaaaatgcttggacattgaatatgccgtgataaaaacaaatactcctgttcctgatgatcttactgaacaaaatgttcctatgggacatagcccagctgttccagatatcagtgaagtgttgagagaacttccccctcttgtaccaatttctgccaaagaagtggcttctgatggctcaactgaccaggcacacctttcccatctttacaacaagatgtgcggtgtgcttgaggacagcggcccacgtgcactcaattcgttctgcggtgacaaggcagcctctgcgagtctagccaacagcctccatcagtttgagaaagtatgcgaggacgttgatcgggtcttgagagtccaagagaacggtgctgctacccccaaagaacaagtggtagatgccagcgtcgaagaggccaaggctccacaagtgccttcacaagatgcaggcgttgtggcggcgaacgttgtcgggccttcgacggtaaagccggaggacaaaatggaaatcgatggttgatgtttagggataagaactgtatcggaccccctcttcagtttagttgctaaactggttctagtctaccagtagtcagtactaatgattacctataccaaattttcctgtcccgtatgcttgcgttgttttattgagactttgagaggctaccgttgtttatggtgtactctgttgctcgtcaggttgtaagctgtatccctctgcgcacgcaatccaaagagcacaactctactcgcgctcttcagattgcaggattgtggcaagggaaaaataagtcttatccttttcgagaacctttagcaatacaaagacgcgctccctctctcctgtcttaaaaaaaaaaaa

SEQ ID NO: 7987 - DNA, 1318 bp, Triticum aestivum
  Clone ID: PAT_TA_7987
gcgcccacgcgtccgcccacgcgtccgcccacgcgaccgcccacaagacaggctcaatcgctctgcagagacgacgcatggcctcgacgacaggcggtgccggaggtggcgctgcggtccggcggcgcgaggcccatgccggcgatcggcatgggcaccgccacgttcccggtggtgccggagaccaccgtgaaggccgtgctggaggcggtggaggtgggctaccgccacttcgacacggcctccatgtacgcgacggagcggcccctgggcgaggccctcgcggaggcggtgcgccgcgggctcctggcgtcccgggaggaggtgttcgtcacgtccaagctctggtgcacgcagtgccacccgcacctcgtgctcccgtccctccgggagagcctccagaacctgcagatggagtacgtggacctgtacctgatccactggccgatcagcctcaagcccgggccgacggtgttcccggtgaagcgggaggacgccgtcccgttcgacttcgcgggcgtgtggcgggccatggaggagtgccaccgcctcgggctcgccaaggccatcggcgtcagcaacttcaccaccagccacctcgacaagctcctcgccgctgccaccgtccctcctgcagtcaaccaggtggagatgaacccggtctggcagcagaggaagctgagggagtactgcgccgagaagggcatccacgtcgcggcctactcgccgttgggagggcagaactggtccggcgacggcaacgccgtgctggactccgaggtgctcgcggagatcgccaaggctagaggaaagaccgtcgcacaggtagcgctgaggtggatctacgagcaaggggtgaccccgatcgtcaagagcttcagcaaggagaggctcaaggagaacctcgggatcttcgactgggggctcaccgacgacgacctgcgcaagatcggccagattccgcagaagaagatcgtcagagctgaaaccgtgctgttctcggcggagggcgagttcacgtcggctgacctcgcagacatggaaattgtcgaggaataaaataggcaccgagaatgcctgcttcgctgtgtgacgtaaactgcagtagcttacataaagagtggggatgaataaagaagtgatccgtgctatatcccgttattcctcttttcggattcaagttgtcagtgaagaccgtgatcaccgttgccatcgctcggaagtattccctaatttgaactgcaaaaacggcttatattagtgtactagacatagtatgttgtgctgcaaccgaggttccatacggcgcatcgttttc

SEQ ID NO: 7988 - DNA, 666 bp, Triticum aestivum
  unsure (1)..(666): unsure at all n locations
  Clone ID: PAT_TA_7988
cggacgcgtgggccagagataggcgtcttcgtactcgcctacctccgcggctcaaacctttcccccttctcccaattccttccgccggccgccgctccacccgtacgacgacaccatgagggagtgcatttcgatccacatcggccaggccggtatccaggtcggaaacgcgtgctgggagctgtactgccttgagcatggcattcaggctgacggtcagatgcccggtgacaagaccattgggggaggtgatgatgctttcaacaccttcttcagtgagactggtgctgggaagcacgtgccccgtgctgtttttgttgaccttgaacccactgtcatcgatgaggtgagaactggcacctaccgccagctcttccaccctgagcagctcatcagtgggaaggaggatgcagccaacaactttgcccgtggtcactacaccattggcaaggagattgttgacctgtgccttgatcgcatcaggaacttgccgacaactgcactggtctcaaggcttctcgtcttcaacgctgttggtggaggaacggctctgggcctgggtcctcctcctaagcgctgtcgttactcggaagaaatccagcttgggtctcgggtacctcccaagttcactcgtgntngcataaaaagtnnncacatccccnggaa

SEQ ID NO: 7989 - DNA, 689 bp, Triticum aestivum
  Clone ID: PAT_TA_7989
tgtattccaatttatacatgaccgcagagtctagtgccaaaagcaaacaggtttctagtagaggccatacacacacaaattcataggctatttaggtagattggtagactgaacatcaattgaacatatgttcagagggcgtggacagtgagatgcctaagattactgtactgcttgaaggcgaagtagattgaaaatgattttcagagggcgtgcattgtgagaggaaggcgactgtagcagcgcttgaaggcgaaggcatatattattccttccttcatattagctgcatggaagaagtatgcccagcctttggtttattctgttatcaactcatttgatgaggtgggctttgatacacatatttccatctgcagattttattggcaagtcataaagctttgggcgaatatagcagcggagatatttgtcggtgaaattgaccgagatatacagatacatgtgctccaggatttggccatagatctgcaggctgcagcagttgtagcatggagccggctgtcagcatggatgagttcacagtagcagtgcagggtccaatttcacacaatgaaccccattcaaatcctgtagtggcacaagcctctggatcgaagaaagtggctaggcagtgaccaggatgacaaggagaggtggcgcctcatacaaacaggaagaggtaatcagaa

SEQ ID NO: 7990 - DNA, 900 bp, Triticum aestivum
  unsure (1)..(900): unsure at all n locations
  Clone ID: PAT_TA_7990
aagaaagctttggcactgggtctgaccacattcgtgagaaggatggcatctgggctgtgcttgcatggctttcaattattgctttcaagaataaggacaaccttggaggagataagcttgtcactgttgaagatattgtccgtcagcactgggccacatatggtcgccattactacacacgctaggactatgagaatgttgatgcaggggctgctaaggagcttatggcaaacctagtaagcatgcagtcatcactttctgatgttaacaagttggtcaaggagatccggtctgatgtttctgaagtagttgcagctgacgagtttgagtacaaggatcctgttgatggctctgtgtccaagcaccagggcatccgatacctctttggagatggttcacgactggtgttccgcctctctggaaccggttctgttggtgccaccatccgtgtctacatcgagcagtacgagagggactcctctaagaccggcagggattcacaggacgcccttgctccgctggttgatgttgcgctcaagctctccaagatgcaagagtacactggacgctctgcccccaccgtcatcacataaattttgaagagtgttttagaatgagttgaggcgcttacacaaactttcattccggcctcttgttccatagttttcttgcatgttacatctcaccgatgaataaaatgtatgtatcagacttgtctcgtttttttgcccatccaagcagcaccttagccgctgggcacagcatgcggtaataatcttgtcacagtgctgtaatttgggagcgtttttccttgttagaagtgtttcctggtttgtttgggcctttgcggatcgatttntctttcnnaagantatataancatttnactcacntgtataa

SEQ ID NO: 7991 - DNA, 1502 bp, Triticum aestivum
  Clone ID: PAT_TA_7991
gccaccgccccccgcctcccctcgcccccgcgcgggaagcgaccagaaagggaccagtacccgagccaccgccccccgcctcccctcgcccccgcccgcgcggtatcctccccgccactccaccccgcggccgcagcgctccgcagatcgacccctcacgcgcgcgcgcgcgccatggcgtcctcctccgcgacgtccggcgacgaccggccgccggccgccgggggcgggggcgggacccccgcgcaggcgcacgcggagtgggccgcctcgatgcacgcctactacgcggccgccgcctccgccgccggacacccctacgccgcgtggccgctgccgccgcaggcacagcagcacggcctggtggcggccggggcgggggcggcgtacggcgcgccggtgccgttccccatgtaccaccaccccgcggcggcgtactacgcgcacgcgcacgcctccatggccgcgggggtgccttacatggccggcgagtctgcgtcggcggcggggaaagggaagagggtggggaagacacagcgtgtcccttccggcgagatcaattccagctccgggagcggcgatgccgggagccaggggtcatcggagaagggagacgccggcgccaatcagaagggctcatcatcatccgcgaagaggaggaagtccggcgctgcaaatacagaaggtgagccatctcaggctaccacagtgcagaatgctgtaaccgagccgccattggaagacaaggagaggtctgcatccaaactgttggttttggcacctgggagggcggcactcaccagtgctgcaccaaacttgaatattgggatggatcccttgagcgcttctccatcctccttggtacagggggaggtgaacgccgcagcttcttcccagagtaacgcttcgctgtctcagatggatgaacgggaactgaagagggagagaaggaaacaatccaacagagagtctgcaaggagatcaagattacgcaaacagcaagaatgcgaagagctagcccagaaggtaagtgagctgaccgcagcgaacggcacgctcagatcagaactcgaccagcttaagaaggactgcaaaaccatggaaacagaaaataaacagctgatgggtaaaatactaagtcatgatgataaaatgcagcagtcagagggccctagcgttgtgactaccctgagcatccaggtcgaagcgcccgagccgcatcagggaggacacggcaaagcttcataagaaaagctcaacagcaacagcgaggggttggatcgagtgccaaccagtaagtagaagtcaagaagattggtggagttccctattatctaaccctgccatcgcccgatagggtttcaccccccttttgaagctccataatcatacttggtttttggtcttagtcatggctggccaatgagttgtttgtaaaactatggtgtacataaatgtatgatagattactatatttcctgttatattttggtgtactaaca

SEQ ID NO: 7992 - DNA, 776 bp, Triticum aestivum
  unsure (1)..(776): unsure at all n locations
  Clone ID: PAT_TA_7992
attgaggaatgnaggccgtgtntccgcgggatgggttccccggtttcccggccccaggtttccgcgccgtgggcggggcagtccctctctgcgcctgttggccccgccccccccccgtgcacgccagcacccgtagggactgctcaattgcggcaacgtgggtcattttgtggggaattcccgtatggagaggagggaggacaatcgtggcaactcatctgaaagcacaagcccaagtcattccccaacaagatcacttcaccaagaggatcctccccaagacattggttgtacaagaagagtacaatgaggatgatgaagatgatgagtcggttgccatggcctccgttgcccttgcgatgactgcgcgggtgtctctcttcgattcgcgcaacgagaacatcaccgccaagtgcctcatggctaaagccaccaacaaggtaacccccaacatcaaaattaccgtcattaatcatccttctccgatggatagcattaatgaacttgagggacctaatgtggaggctaacgagtttgaggcctttatgggcacactcaagggaaaatccaagaagcactttgttgctctcttggaacaacttggtgaagccaatgacatgatcgaggctcatgaagacaccatctataagatggaaggtcatagtcgtgactgtgcgatgagatatcggatctctccaatgctcttggggaagagcgtgttcatcatttgactcttgaggagtcacacaatgatgaccatgccaaattaaagaaag

SEQ ID NO: 7993 - DNA, 2121 bp, Triticum aestivum
  unsure (1)..(2121): unsure at all n locations
  Clone ID: PAT_TA_7993
ccggcacgcgggcagggccgcaggccgctcgcgcgtctcgtctcgtcgcagtaaaaactggggagaacggcgcgggcctcgtctcgtcgatgtccaaacccggcagccgcccccgcccccacatgcttgtagtcccactccctcctcctccccccttccccggcgggcgcggccgcattcctcgccgccccctgcggaggggggagcggccgcgtggctagctgcacagggcggaggggggatcggtgggaggagcggtgcggctgggtgaatgtgtcgggatggcagtatcgggggcagccccagctccgctggctgctgccccgtgctgctcgcgccgccgcgcttcctctgcggatcagccttcgccggagcttatctttcccttcaccgacacggcaaaatcaccttaacagcggcttgtatattgtagactccccatgagtatgttgaaaatccactggattttcaacttccagcagttcggactcatactggctcattggcagcagctcagacggctactggcacatgaattggacatccggtcgctggggggggctgaagcctcagtgcggtcaatatcatcaacatgctcaactgcgcctccacattgcttcaaccccaaatggacgcctcataaatgacaccgcagctgtcctggggaatgaaattttacaatgatttgctcaatcaagctggtccgcttggaaacgcgcagtcagagctactcatgcggaaggactcagagacttttaccttccaaaaaggatgggcgtttccacggcgtgtgtacttcaatggtgataactgtgtcatgccgtctcccgatgattatccatggttccctagtgcaagccctctaacaaaacaaccatggacactcccactcttggtattctggactgcgatggctactttgctggcttattatgtctgatgaatgagttacaagagaacccgcgagctccaagtcgctgtcatgttccatgaggtgcgcggcaacaggtcatttgttcattcaattcctcggttgcatagaagacatgggtgccgccctgaggaaagttgatacgtgtgtgtgtcttgttagttaacaagggccgaaaatgtctttcttgttttagtagataccggccacgaaaatttggtgaacttatttacccgatcttagtccattatggttgcaccttctatttcatagaccagtggaagataaatttattgaaacaaatggcagactgaaagtcaccatcttctaacttctaaactaccgcatgaattatacagactggaacatggttgcccagcatcctaacttcgataatatcacaaagctgttcagcttcaactataagccacttaccccatatggaggccgcataaatgacaccgcaatgttctggggaatgaagttctacaatgatttgctcaatcaagctggtccgcttggaaacgcgcagtcagaactactcatgcggaaggactcagagactttcaccttccaaaaaggatgggcgtttccacggcgtgtgtacttcaatggtgataactgtgtcatgccgtctcccgatgactatccatggttgcctagtgcaagccctctgacaaaacaaccatggacgctcccactattggtgttctggactgtgttggctactttgctggcttattacgtatgatgaaatgagaccaagagattcagcgagcttcaaggcgctgtcatgttccacgaggtgcgcggcaacaggtcatttgttcattccattccacggttgcatagaagacgcgggtgccgtgctgaggaaagctgataagtgtgtgtgttttgtaagttaaaaagggctgaaaatgtgtttcttgttttggtatatactggccatgaaactttggtgaacttagttactcgaatttaggtaattatggttgcaccttctgtattttatagcagacgcagacattttaattgaatcatatgactgcctttcttgtagtgattgtatgggttacataataatgttttgtacaatttgttaaaccgagaggatgctgttggttgagagaaaaaaaaaaaaaaaaaaggcccctacgggggggaagagggagaggngggggggggag

SEQ ID NO: 7994 - DNA, 876 bp, Triticum aestivum
  Clone ID: PAT_TA_7994
ataacccttatttgaatcagcataggtagcctacattttaggtcttttgacataacacctgcatttacatgttctgatacaaaaactccctgtcagtcttcttggaatttcttcgaacaccttgtaggcattgagcatcaacatatcgtgcttctcctattcgcctcccttcgtcgtcgggcagacgagccgcgtcatgagagcacgattgagccgggcgtctctgcggcccgccctgcttctgtagaggaagacggcttctctcgctgcccaggcccagtgccacgccccgccctgcgcccctcctccacgcgcctcctcgtcgggccgcagcaagacgcccggccaccgccacggaccaggacgtcgccgcagcccacaccgcagacggcgacgacccatgagggcaggcacgccagggaccgaccgcgcatccggagctgcagaggacgcggagcacgcgccgccgtgggccgcggcagcaagcacgggaatggagccagccgggctgcgccgcaaccggccgccggcaccgacggcagggcagaacgcagagacgagagagcgcgacgccagttaggaggcggacatgagcgagagagtgcagcaggagaccgcggcgaccgccccaagacggcggagcatcgccggcgacgaggaggtcgagcaccccgaaaccctagacgggtaaaaccgatgcgggcaagcacgggagggtgggatcgacgagtcgatggagtggagcatatagagcacgaggagaggaggagatcggtagccagaacgatggctgagaccgccggatttcgtcggaaccggccggcgaaggcggcggcggcggaaaaagagaaggcgagagagagagagaagcgagac

SEQ ID NO: 7995 - DNA, 929 bp, Triticum aestivum
  Clone ID: PAT_TA_7995
atagtttgttcttttaacaggaaatgtcaagttattaaaaaactaacagtatgaagcaataagtccataacatgctagggaaccattcaaatcatgatggcataaaggcacatgaacaacagccaccaattacccccaccattgcagaaactactagaaataactcctacaaagcagcaaatgactaacgagcttaccatacctacatcatatgtgtggtgtatgatatctactttcctcggaaatttgtaatcagatttcggctatccatctactgagtactgacaaccacctgttgtatctgatcagcaacaatccttgccacaacctctggcgaaaacctctcgaccatgtcttcccttgccttcctcccttttctccttgcctcctcttgatcaccaaagacgcgcctcatcaaagctctcagatgatcaactgatggctcagcgcagaaatggcccttgaatggcccttctgtgacctcagtcagcctgtccacgtccagtgggtatccattctcttgagtcaggtactccgttgggcctgaccaattcgtcacaatcactggcagttccatggccatggcttcgaccaccggcctgccccacccctcgccacgggaaggtagcacaaacgcatctgcagccttgtacaaccttggaaggtcggactgtgggacatgctcatcaaccacccggacttctgcccatcctagcactggctcctcaatgctggagttgttcacaaatctgtggactttccctccaaaatctgtgtcagagtggtaggcgttggtcagtaggtagagcacaacatcatcagctccagagaactcctgcagaaaggctgtcagaagcacatcccagcccttcctctgctcccatttgaacacgctaagaaacacaaaacctttgcctttggagctatca

SEQ ID NO: 7996 - DNA, 517 bp, Triticum aestivum
  unsure (1)..(517): unsure at all n locations
  Clone ID: PAT_TA_7996
cttacaaggcaacaggncattaaattagnataatactgctagcggtttgttaattaacaacaatgaaaacagccacttattccaacaaccactgcacgtcgaggacggtggggcggccttcgagggcggcggcaacgctgtcttgcaagaggacggccgcggccagctcgatgtaggtggggggcctcgacccgcgcttctccttgatccggcgcaggccagcagcgatctcggccagccgctcctcccgatcggacagcgacgcgaaccgcgaggtcaagcatgagatctccgtctcctcccccgtctcgccaccgctgatatccatcgcgctgtactgcctcgcgaggcccgcctcttgcgccgccgggagatatgcggcgccgcctgctaccccgtagcatcctttcgccgccatcgccgggggaggtggggtttctcagggttggggagatctgcggaagacgacgccgtcgccctgtaactctcgcctaacctttttactgggtaggtctcc

SEQ ID NO: 7997 - DNA, 441 bp, Triticum aestivum
  Clone ID: PAT_TA_7997
cctccacctccccgctcgctctcctgcctccgcgcgggccgcggatcccttcactcgccacagcaagcgctagaagagggaatggagcccggcctcgcatcccgcgtcgcccgttcagccgctcagccgctttccggctgcctgtcgcggcactcgctctcgccgtggctcaagatccagaaccacatttatccgatgccaagtctctgtcacaaggttcctagcacggcaaaatgccacacttctatgacaacaagttacatggaaacatcagatgtcactgatttggactgggaaaaccttggctttggcctcatcgagactgactttatgtatgttgcaaaatgtggaactgatggaatcttttccaaaggtgaagtcctaccatttggtcctatagcactgagtccttcagctggagtcttaaattatgggcaggga

SEQ ID NO: 7998 - DNA, 444 bp, Triticum aestivum
  Clone ID: PAT_TA_7998
caccacacatggggtcattctttaatgaactgtcaaatcgagtgtactgatgggcttaaacgggctcgactgttcgccgtgggctttgacgggcaaaggcatattgccgatatatcagtgaaggcttacactcgctccttcaccatccaattttacaagtacaacaaggttaacaggtgacaagaactatgtagtgaaacaacagtagatccttgcaagagcggtccttggtgctctcacggtgccgaactctggctggccgctctccatcggaggcccctggcgtccgggatggtggactctgatcaacgtccataggcgcgcttgctctgggaggcgatggcggctgcacctcgaagtccggataagcagctttgtaccttgcccccggcccgtcggccgccccccgtgtcccgtccgcctggttgccaagagagatccatc

SEQ ID NO: 7999 - DNA, 584 bp, Triticum aestivum
  Clone ID: PAT_TA_7999
ttttgaaccggccctttttccgagcccacctttagccatttttgtggtgcatgatgagtaaaaatgtcatacaaacatgaaagaaaatactgcgctgcacctaactcccccctaccagcctgtgaggataccaaccacaatttgaataaggcaaggccgaaaatctggagaatggatctaatctttccacttcatgacataaggtatacactgcatagaaaatggcatagctgtttttttttctctcttctgatgccttgttcagcttgctttcatgcttctggtaaaatgccatcaaaagtatgctggatgataatcttcatcgtcgcattccatgagatttctggcaatttgatccattgttggcctcttgcttctttcatcaaggcatgaaatagctatcttcaccataactgttgcttgcttgtgattgaaatgccctttcagtctagcatccactatatccagttcagccccattagcgagcatctgtttcacggcctgaacaaattgcatgaaccccaccccttctccgccttctgttgccccactgggaatttgcatcaagcccatctcatcttcgc

SEQ ID NO: 8000 - DNA, 621 bp, Triticum aestivum
  unsure (1)..(621): unsure at all n locations
  Clone ID: PAT_TA_8000
gnaactagtaaactgttagacacaaggcatgcactgctaactgaaactagcaataaactaggttgcatccatattcctctctttcagacaaaagccagcacaaccatcaggtatcaacgtaatctgcaaacgaagcaatcaatgagntaggccattgacagatcacagatatgcttctgaaagggcgtctaccctatctacaaaacaatagctgaaagggtcggcaattgacaggtcccgggtatccaaactgccaaaccaactagcagaactgcttccaaatttcaatcgggcgtgttgagaagctctattttccgcttctagcagcatgagttggtcggtcatccatttcatgtcgatatcaatattcttacacactccaaagttgatttcctttaccacttccgcattcaaaacgaagaactttgcaaatccaacatcttcctcaccaccttcgtaatttatcagcaccagtactttgagatggctctcaaggcatttgatcggatctagtggctcatactgacgcacatttttcatctctgccttcacataatcgtcccaaatgacatagagcttttccaagcaggggaagcatctaaggacgtcaagaactgcatc

SEQ ID NO: 8001 - DNA, 682 bp, Triticum aestivum
  unsure (1)..(682): unsure at all n locations
  Clone ID: PAT_TA_8001
cccacgcgtccgctcgatcgatctcactctcagctggtcgctcactcttgcagctccacccttcactcagtcttaggctcttagctctaggctctagctagccgcgccactccttcgtgtagccatcagccttctcatcgccaccaatggccactgccgaggtccagaccccgaccgtcgtggcggccgaggaagcgccagtggtggagaccccgccgccggccgtcgtgcccgaggagtctgcccccgccgaggccgaggctgaggctgaggctgaggctgctgctcctgctgatcccgaggagcttcccgcggccgagcagcaggcagccgccgagcccgaggccgctgctcctgctggtgccgaggagcccgcggcggccgaaccggccgctgaggcggaggctgctgctcctgctggtcccgaggagatcctgcggtcaacaagaggcagccgccgaggaagaggctgctgctgtcctcctgctggtgccaaggagcccgccgcggccctcccccccgagaagggtctctcccacaccccccgccgcaccgggggccggccctgtctgcccacacggcccgaggccgcggcatggggcctcagaccacaacgcacaagagccctcagccaggcgagccaggatcccaggatggttcctcggggtatcccccgnangtt

SEQ ID NO: 8002 - DNA, 968 bp, Triticum aestivum
  Clone ID: PAT_TA_8002
tggcttgttgttttcttagtcgatggttgcacgttaagaacaaattttgtatcgcaacaaaacaaattacaaccataaacaaaaggaaggttggcataaaagttaacagtccagcaaataaatgcaccaccagaagttcagaagctcagttcatttgacctggctgttacgttttcatgttatactgtcagatggagcaccataaccttcgtcttcatttctcctaggctcctgaagaacatagcaaatgtctgatagtctggttcaaaaccatgcatatcttgacgacatcgaacaatggatgtccttgtttcacaaagggtctctgttagagaatggacttgtgtctgaagcgcagatataacattgttttgagcttgcatatcttgctcatgaggcagtttggtcgtgtttgccctaacatccctccctgttttccgcagcagcgggctgctcgctctgttcgtggtctggttcgcacccactgcaactacagctgtcatgccggcggtaggtgccccgtcaccttcacaggctggcggttccatcctcctccccatggcccgaacctcggctctgtcggccggactcttgcccttcctcgcgctggtgtcccaggccgcgccgtttccctcgccttctggtccccgggcctcctgatcctcgcggcctttgctcgggagtcccgtttctctaccttgctctcccgggcctcgtcgaacaatgtctctccttgtttcacaaagggtctctgttagggaatggacttgtgtctggggcgcagatacaacattgttttgaccttgcatatcttgatcatgaggcagtttggacgagattgccttaacaaccaagccagtattacgcaggaacgtgctcttgctgcagtgggtcagtacctgtccactaacagtgccaaaagcacgttcctgcgtaatattgccttaacaaccaagccagcctcgtgc

SEQ ID NO: 8003 - DNA, 822 bp, Triticum aestivum
  Clone ID: PAT_TA_8003
gactcgcgctccctcggcaccactgaaaaaagaaagacctgtgctccctcggccgacgccgccatcgggagccggccggcgagcatacccatcacagtcccctcccctgctccgacgccacgcgcggttgccggtgagactggggatctagcgccctcaccgccaccagctctgcgctgctgttgatcggcaccacgcacacgcagatctcataccccatctccaccgcttctggagatggggttcgacgccttcgcggcagcgtgttgtgctattccagtactcgtatccgttctcgccgtccgcgtcgcctacgtgctttgccgcagcggcctaccgccgtcgaggtctcgtgcctccgggctgcggtgtctcatcgtcctcgggtctggagggcatactgcagagatgatgaatattgtatctgagcttcagaaggatcgctttacgcctaggtactatgtggctgcacttactgataacatgagccttccaaaggcacaggtctatgagaagtcattgattcatgtggagggtgatagagaaatgatcatcgagaacgcccagttcatgcagatttatcgtagccgtgaagtgggcccatcccagaccaagcaccttcagaagaaaagctgacgcacatagagggatgcatgtcccgggaccattgcaaaatatcacttgtggtctgattcttattattagccacatagcatgcaaaatagcacacagtgttgttgcaatagaggtaatgtaggattggcccacttcacggctacgatatatctgcatgaactcggcgttctcgatgatcgtttctct

SEQ ID NO: 8004 - DNA, 1145 bp, Triticum aestivum
  Clone ID: PAT_TA_8004
aggccagccagatggtgcccctacgcgtctgccaccgcctcgtccacctgcgcggcctcccctcctcgcttcggcttcctctcccctccaccatggcggcgccccaacccggctgcaaaacccttcgccccaccactacttcttcgccgtctcctgccggcccggccaccaagaggtccaggacaatggccacggacgcggcggcttctccggcctcggcggggtgctccgccatgaaggccgagttcacgggccacgccgagtacctcaacgcgctgaatgataaaagggaaaggcttgtgaaagcaagtcgggatgtgacaatgaacagcaaaaaggtcatctttcaggtccacaggatcagcaaaaataacaaggaggaagttctttcaaaggcggaaaatgaccttgctgctgtggttaaccagtacattggaaaattagtaaaagaactacaaggaactgacttctggaagctcagaagagcctatacccctggtgtacaagaatatattgaagctgcaacattttgtagattttgcaagactggcactttattgggtctagctgaaattaatgattctttgcttgctctaagtgataaatccattgagcccttgcagataaatgtgcttgactatcttttaggggttgctgatttgtcaggagagctgatgaggcttgcaattggacgtatatctgatggggaagttgaatatgctaaaaatatatgtgcatttgtacgtgacatttatagggaactgacccttcttgtgccactgatggatgacaataatgagatgaagaagaaaatggaggttatgcttcaaagtgtagtgaaaattgagaatgcttgcttcagtgttcatgtgagaggatctgaatacatccctatgctgggatcatctggcgagtcagactatgccttcttcggtgccgccgactatgaccaatgaagccagaccgcctaacagacatgttcggggacctatctcaaaaaagaagctttgaacatgactgtattatttattgcttgtgcacatcacaccgtagaacatgtaatatctgtattctgtagcattgcaagactaacctagcattcttcttcttttatgcactggttgtttctgtttctttattttctg

SEQ ID NO: 8005 - DNA, 541 bp, Triticum aestivum
  Clone ID: PAT_TA_8005
gattatgttatagtcctcaagctataaccaaatcaaatgatggtttactaaggttgaagacaaacaaagaaactattggtgggttttcacatgtaatgttcgcaacaggtcgtaaaccgaatacgaagaacctcggactggaggaggttggggttaaaatggacaagaagggggctatagtggtcgatgagtattctcgaacctcggtggattcaatttgggctgttggagatgttactgataggatcaacttgactccggttgcactgatggaaggtggagcatttgcgaaaactttattcggtgatgaacctaccaaaccagagtacagagctgtaccagctgctgttttttctcaaccacccattgggcaagttggccttactgaggagcaggctattgaagagtatggagatcttgttgtctacttgtcaaacttcagacctcttagagccactctttctggattacctgatcgtgtattaatgaagctcattgtgtgtgctactacgaacaaagttgtaggagtgcatatgtgcgg

SEQ ID NO: 8006 - DNA, 970 bp, Triticum aestivum
  unsure (1)..(970): unsure at all n locations
  Clone ID: PAT_TA_8006
gagagagagagacagagcgacatagatggggcagctcacggcggcgcctggaggcggcggggactgcctgatcaagctgttcgggaagaccatccccgtgccggacgccggcgacaaggaccttcagcacagaggcagcagcgccacggctgaaccgaaggtgcaagaaatcgcccctcaggactccacgggctcgcctccgcagcagccggaggttgtggacgtcgaggacccatcgctgccaagaactcggcagcagatcaacaagatgaagagcagggcgacacggcgaaccagaaggagaagctcaagaagcctgacaagatcctgccctgcccccggtgcagcagcatggacaccaagttctgctactacaacaactacaacatcaaccagccgcgccacttctgcaagaactgccagaggtactggacggccggtggcgccatgcgcaacgtgcccgtcggcgcaggccgccgcaagagcaagagcgtatcggccgcctcccacttcctccagagggtcagggctgctctgcccggtgatcctcctctccatgccccagtcaacaccaatggcaccgtgctcagcttcggctccgacccgtccaccttagacctctcaagaacagatgaagcacctaaaggataagctcatcccagcaacccggaccgagaacaccgatgccccgccagtcgggtcgtctgctgaaggatgggcgaaggcagaagaatccaagccaaacgaaccccaaggagagagttgcagcagagagatctcgcaaatggtgcccaacacccatgcatgaacgggggagccatgtggcctcttggcgcgccgccaccgcctgctcgcctcactcctaccatcgctcttccactccggcccgccgccgcggctgctggtgccgcagccgggcgccgcggggctccgcgcgccgggcgcgccccatgcaacanctacacaagct

SEQ ID NO: 8007 - DNA, 657 bp, Triticum aestivum
  unsure (1)..(657): unsure at all n locations
  Clone ID: PAT_TA_8007
ccacgcgtccggtggccatgtgtacgnnntgaaaacngnngatataataatgtccatttcgcttgnnnnataaaataaaaaaanaaaggcgtaaactcttctgcatggaatttgcacaatttgctcgacatatgtcctagtataatggtataagtcagccattgtactttgtacacgtctgccagaatatttacaggtttttgcagaggaagaaccaggcgcccagactgaccttatcaggggaatccagttggagaaaatcacctgataagctcaagcggcagactgatgacacaaaatactagcgactcaatgtacatacgctgactggaaggaggaggtgaaaccattgaggcacggcaaagcaataagttactgaacacacatcgccaggccactgccagaaaggacgcaaaatttggtagaaatcaccagcctccaaagagtcccaggaagaacatttaccatccccaagaaacgaactctcttgttccagaatgtcctaatcatcatcttgttctctatccacaggttgggcctacagctgtagatttgccgacaactgctggctgttgctggggtgtgcgaggggcggttgcctcttcanctaanaactgatcccactgnacttntgntgctgttctncacatatntgna

SEQ ID NO: 8008 - DNA, 825 bp, Triticum aestivum
  Clone ID: PAT_TA_8008
ccgcgggcgcgtgtacctggtggacctggccgggtacaagcccgggccggcgcacgaggcgacgcgcgcgcaggccatccgccagttcgggctcgccggggggttcgacgacgacagcgtgtggttccataagcggatgatggagcggtcggggctcggggaggggcacgcacttcccggggtggctgatgagcatcccagtggacatgtgcctccagacggggagggacgagtcggaggccgtcgtgttcggcgtcgtggacaagctgctggccaagaccggcgtgcgcgcggaggacatcggcatcgtcatcgccaactccagcctctacagccccacgccgtccttcgtgtgtcgcgatcgtgaaccggtacccgctccgccacgacgtcgtcagccacaacctcagcggcatgggctgcagcgccggcatcatcgccatcgacctcgccaagcacctccttcaggtgcacccggacacgtacgcgctggtggtgagcacggagaacatcacgctcaacgcctacctcgggggcaaccgccccatgctggtcaccaacacgctcttccgggtgggcggcgcggcggtgctgctctccaaccgccgccaggagcgggcgcgcgccaagtaccagctcatccacaccgtgcgcacgcaccggggcgccagcgaccggagctacggctgcgtgacgcaggaggaggacgacgcggggcacgtcggcgtctcgctctccaaggagctcatgtccgtggccggcgaggcgctgcgcaccaacatcaccacgctggggccgctcgtgctcccgctctcggagcagctc

SEQ ID NO: 8009 - DNA, 877 bp, Triticum aestivum
  unsure (1)..(877): unsure at all n locations
  Clone ID: PAT_TA_8009
cggccgctcgagccggccgggcagctggtgcccggtgcgcacgcacaagggggcggacgacaaggcgttccggtgcgtgtaccagcaggaggacgagtcgggcaagcggggcgtgtcgctgtccaaggacctgatggcgatcgccggcggcgcgctcaagaccaacatcaccacgctggggccgctggtgctgccgctgagcgagcagctgctcttcttcgcgacgctggcggccaagaagctggtgaacgccaaggtgaagccctacatcccggacttcaagctggcgttcgagcacttctgcatccacgccggcggacgggcggtgctggaccagatggagagcaacctgcagctgacggagtggcacatggagccgtcgcggatgacgctgcaccggttcggcaacacgtcgagcagctcgctgtggtacgagctggcctacgccgaggccaagggccggatcaggaagggcgaccgcacctggcagatcgcattcgggtccgggctcaagtgcaacagcgccgtgtggagggcgctccggtcggtgaacccggccaaccccagggacgtcgccggcaacccctgggccgacgagatccaccggttccccgtgcgcgtgccaaacttctccgccatcgatcctcccactccatccagcgacaccacccagcaataaggatccagagccacgtacgtacgtcttttggtcgcattattctgtagctgcttggttggggttgcattgcagcattggtactaagtagtatctggtagcagtgagtcagtcaagctaggtatgcttaaatntagnntggggtttgccattattgtatctgatatngatgatgaaaataagtcctttggtgatcccaaa

SEQ ID NO: 8010 - DNA, 1706 bp, Triticum aestivum
  Clone ID: PAT_TA_8010
gccggcgcccacctcagcgagccgtggcagccgcagcgcaccccgtaggtggccgagctgatccgcgtccacctcccactcgacgggctcccggtgcaaccccagtcgcacgctgtcgtgatctcgagggacgtcgtcgcgccccacctgtcgcacgtgaggcggcgggacgtgcgggtccccaagtgcctgttcctgatcgggccggcggcggtcctgccgtgcaaccggcggcgggtgggggcggcccgccaagtgtaggccgggccacatcgtgtgcacgtccaggagctcgccgggctgcgcccgccggtgcgtgtaggacggaggagggccacgaggggcacgcaggcatctcgctccccggggcgcgtgtggccatccccggcgaggtgctccggtccagcatcaccaccaggggcgcgctggtggacgccctgtcggacgcggagctcttggtccgccgcctggtcgggcgcaaggacatcaacaacaagttgaagccctacatcccggacttcaaggtggcggttcgagcacttctgcatccacgccggcgggcgcgccgtcatcgacgagctgcacacgaacctggagctgtcgccgccgcacgtggaggcgtcgcgcatgacgctgcaccggttcggcaacacctccagcagctcgctgtggtacgagctggcctacatccgaggccaagggccgcatgcgcaagggcgaccgcgtgtggcagatcggcttcggcagcggcttcaagtgcaacagcgccgtctggaagtgcctccgcaccgtcaagacgcccactgacgggccctgggacgactgcatccatgcgctaccccgtccacatcccggaggtcgtcaagctgtgaggcgtcatcgacgacgagctcagctctccgccgccggccgtaccctgcatctgcacgtacgtgccccccaaaacctggagctctgtgggggtcccgaccaaattaaaccaatctctctctcctttgctctttcttcttttccttcttcttttttctatttactaaattaaattacatggatattcgtgggatgcgtcacacaaggagggggtcattcacacggagattaatcggctacccatatatttatattgggacgacgctaacgtgggggatggcttgttaaattgtttgtgtcatggatttcgactggcggggaagggatacttacactggcgctcaggacttgtcaatcaacttggttccagttgtcttcatcgacgacgtgctacacgttcgcctgcaccacaagcaggtccctctggtaagagctcacctactgcgaggcctagcggccgatcaagaagggagagcgtggcgggccgatcgccttcggctccgacttcaaatgcaacagcggcgtgtggagagcgctgcgtaccatcgacgatgctggtgagagcccatggacccaggacctccatgtcctccccgtcgacgtgcccaaggtggtgcccatcgacgagacctcttaccaagtcccaatctagctagctagctagctctctggctttgcttccgcggagcatgcatgtatcaccaattttcaggcttaattaatcaggcgagagtttttttatgtcttgattattaatttgattttcatgtaaatctcaacgaacgggcaacaaaattcaatcgattcatcttccagcgttagtgttgccaccgcca

SEQ ID NO: 8011 - DNA, 287 bp, Triticum aestivum
  Clone ID: PAT_TA_8011
tgaagcagtcttcgccgcagccggtggtattggggcctgacgagatcagaagcttgcataccctgtcagtccccgctgatgtgccgccttgtttgtagatatgtgtgctggaaacagagaacaacctgcctgtcatgtctttcgctctgctgatgtgcttcctagtggagtatctgttgcttagtttcgttatgtgctctgtctggagtatctgttgcttagtttcgttatgtgctcggtctgtcgatgaaatggagtaggttcactggattttactgctgttaaaa

SEQ ID NO: 8012 - DNA, 1631 bp, Triticum aestivum
  unsure (1)..(1631): unsure at all n locations
  Clone ID: PAT_TA_8012
gatagaacatccttcccagccacttctacggcgtcggaaatcttgccaaatccatcaagcgaagcaagaataacctctccaggcaataggctgaagaacttcttgccagcttttgagttaaccaatgagcttgtaacagagctagtaagcttcacaactccagacagtattccagttgccacgcgtccgaccccaccaacccccgctcccccggccccgtcggcgctgccgctctacccgtcgctcacccccgctggcatcgcgccacccctgatcccgcggtcccccgagtaccccggccccgccgggccctccgctctacccctcgcgcaccacgccggacctggcgccggtcgagatcccgcggtccccggcctcccgcgggccgccggcgccgtcgccctccgcgcgactcgcggccgccgccgcgcagctgcagccaaagcgccgccagggcccgtacactctccccccgcccgcgccgtcgccgccctcaagccgggcccgcgacactgccccttccgccttcgcagccccggctcccccgcggagccggcccccgagcggctccaccacggcctcactctctccgtccccgtaccccgcctcgacgccctgctcggcccccgcaccagtttctccgcccactccgtggccctccgggcggggctcgccggcggggtccgcggcgaggtcggggctgctgcgcaccggcacccggtcccgcccaacgtcgaggggtacggcagcgccgtgggcagggccggcgcgtccggagctgagaacctggccaaccggatcctgcggcgcggagggatgaccgtcgtccggcaccggtgtggtcaggacatgctccaccgtggctgccagccctgtggctctgatgctgtggttcgtcgtggagtacctcggccgtagtttcgtgatgtgctcggtatggagaatctatagctaagtgcagctagaagactggcttgtgtagtaaaggttactagctatgttacaagctcattggttaactcaaaagctggcaagaagtttttcagcctattgcctggagaggttgttcttgcttcgcttgatggatttggcaagatttctgacgctgtagaagtggctgggaaggatgtgctatcaacatcgtcaacggtgacaaccggtctggtatctcacaagtacggagagaaagctgctgcggcgaccaacgaagggctcgatgcggcaggccatgccatcggaacggcgtgggccgtgttcaagctccggcaagcattgaacccgaagagtgtcttgaaacccacgtcgctcgccaagtctaccgtcaaggctggagccgcggaactccgggcgaagagcagcagcaagagcaagtagggttcgaagtcgagccggtcgtgtcagggatctgaccatcagaagtttgcatctcccgccagtcccagttgatgtaccgtcttgtttgtagatatgtgcactggaaaaggagaactacctgcctgtcatgtctttccctcggctgatgcgtttctcagtggagtatctgttgcttggttttcgttaaaagctctgtcagtcgnatgaaatggagtaggttaatcactggaaaaaaaaaaaaaaaaaaaaaaaaaaaa

SEQ ID NO: 8013 - DNA, 643 bp, Triticum aestivum
  Clone ID: PAT_TA_8013
tgatcgactgctacgtccacaccctcgccaaggtcctcggcagcgaggaggaggccaagaggaagatttacaacgtctcgtgcgagcgctacttcgggttcgggtgcgggatcgacgaggagacatccaacaagcttgaagggattcctggtgttctctttgtgctccctgattcctatgttgaccctgaacacaaggactatggagccgagctgtttgtgaacggggagatcgtccagagatctcccgagaggcagaggagggtggagcccgtgccgcagagagcgtcggacaggccgaggtacaacgacaggacccggtacgcgcggcggagggagaaccagcagcagcagcgatgatccatcacacgaacgaggccgaggccagagccggaggcaacctgctgtgcctgtttcaccccctcgacatagcgagtagttgttattgcttggttttagtaatccgtttcgtgttgccactttgttatctgtatgtatttgactacttcgaacttgaaactaagaatcttgatagcataaacgaattttagagctgtgagtcgtgtacttgtgctaaaaaaaaaaaaaaaaaaaactcgagattagacctcggccgcgaccacgcttaatcacttagtgaattc

SEQ ID NO: 8014 - DNA, 727 bp, Triticum aestivum
  Clone ID: PAT_TA_8014
gaattcggcacgagctctgctccgctgctcgcccgatggatcccaaggcggcggcgaggtcgaagcgctcgcacacggtgcacggccgccggacccaccagacccccgcggcggtcgcggcgcacaagcagaagcgcgcggccgccgccggcggaggcggcggcggctcctcctcttcctccgcccctcgcagccgcaacctcccctccaactgggaccgcttcgaggaagaacccgaggccgacgacgccgtggaatgggccggcgaggtggcgccgcggagcaagggcgccgacttcgccttcctgctcgagcaggcccgggcccagcccctcgaggagcggggcctcggcgcggccggccggctcgcctcccaggactccccatttgattttatgcaggcttctacatctatgcttgaggctaaagcggaagggatcatgtcctggtttgaagacgataatttcatattagaggatgatttagcaccagattttgaggtgccttttctctccatggatctccatgcattggccaccaaactctcaaagattaagctctcccagagactttttatggaagaagatctactacccgaggatatggctgttgcttctgaagacgaagatgatgaaatactgattcaactgggcacaacattggagtctgatgctaaaggcagtttggttcaacataacttcagggacataaagcctgggaaagatgc

SEQ ID NO: 8015 - DNA, 979 bp, Triticum aestivum
  unsure (1)..(979): unsure at all n locations
  Clone ID: PAT_TA_8015
agngcgncgtaatngggactncacttataagggcgnagtttggggtaccggggcccccncccttagcantattgatgattatgatgcatcannttgggatggaaaaacaaacccttgaaagaaaaaaccaacgcccaacacgcaaacaaaatagggcagactttcttgaatcagtgcggcattcacatagcacagagagcatgaatctcgtacacttgtttcagacgacacacacttgcctaaacttcagagagcaacagagttcaacatagatggatgaagatcctttggcaaaccagcaaggacggactggtccataccatcttccggttccatgactcaagacagttggcccgcagagatgaactaactaaattagacagcaactaagttaaagactgcgtcatcctaaggcaaggcagggcagggcaggggcatttcctcccgcaggctggtagagacgcggtttggcaccctgggagggagggagggagacaccgctacttcttctcattaattgtccactgccatggcattatcagcttgttcctcggcatctcgtatggctttttttaaatcataccacaaacacggatatatcctctgaacttccttattgacattgaggttaggaatcttctccttgagttcattctcatgcgaatacatcccacttatgaaccttagaaactcttccacatcggatgcgttatatgatccaagtccattatttccacggtaaatcaacatatgtttcataagctgaccaggtatcaactcatgagttggccatgttgccgtccatggcaaatctggcatagatggagattccgcaaatttttgcttaactagatcatttttgaagacttgcggtacatcataggcaaagaaaatcttcttcctcttgctgttccaaaaaaattcatgatctttgagctgaagtttcattgtgtgaacagaattcacagtaaaagacttc

SEQ ID NO: 8016 - DNA, 734 bp, Triticum aestivum
  unsure (1)..(734): unsure at all n locations
  Clone ID: PAT_TA_8016
gcaaaatattatgatactgctgcataaacgagcagacagtaacaatgtatgatccgtctgacagaactagaaaaaaataatcagaaaacaaacttagtaaagagaaaccggttggaagttaatctcgtgcaaaaagatctagttgcatcggtgttgaatgcatctcatgcaccacgagcttatcgacgatgagagtggagccggtagcattgttgaaaacgtacagcccagccgcctcatagatggcctcagtcgggtacactcgggacgtcgccgtcaatctcccgcccataacgaagctctccacaatggaatgatccacaagaatcctagcggataaggcctctccgttgagcaccggaacagtgctgcccaccacacgcttcacaacattcctggccagcgatgactgcgactcgtcatggcagaagtgggtccggaggtccccgtcaaggctcctagacatgtagaagtacattgccatttgttcactgtgaccgttggtgaggaggaggccgaaggggccgagcgcaccccggttggtggcaccaccgctagtgctgcagttgtagccgatgtcggcctcgttgtgggctgcgatgtcagaagtgttgaggcggaaggaggcctctatgtcgagctgagcggcttgccggagatgcagggggaagacggagccagtgctgatggtgatgccactgaggtcagttgcattatgacgganggtctcaatc

SEQ ID NO: 8017 - DNA, 721 bp, Triticum aestivum
  Clone ID: PAT_TA_8017
ttcccttgaccgtcgcctaaagcagcaccgtgctttgtgcctgacctgccttcttccttcttctttcttggttccggctcgtctttcgtccagtgcctcagcgcacttccatttctccagtcctctctcgcttttcctgtcgcctcctgcatcttcctgcgccctcttgttcttcctgctccccttgcctccctcctcgggtgtgcccctcctcctcgcgtgcccgccggcggcccgcttgcccctgcatgtccctgctgcggctggggtttgttggcctccgactccctctcgctgtgccggattggcttcgtcactccttgcagtgcaaggtctttgatgcggatccggcggcccgctcccgccgcacgtgccctcccggtgccatgccgacctctccaggactggctggtcacgtcctttttgtgggcgcccgcttcccactccgactgcaggtgcctgtcggttgtctccccaaccttcccgtggcggtgctgcatcggcctctgtggggtccccctcttcactcgcctgctgcgcgtccgcgaggtctgcctccttagccatctcgtcccgccgctgctgcaccctctctcgtgcccctgccaccttctgcttgttgcgcttcggcgaggccccccccgtggccctccccttccgcccgttggtgcgcccggtctccctctgctgctgccttccgatattttctgtttgttgatgc

SEQ ID NO: 8018 - DNA, 541 bp, Triticum aestivum
  Clone ID: PAT_TA_8018
tgggctcatgttggcaaccaatggatgtatcttttttattcgtcttgcaaaactatgtgagactattttacttttattcggcttgtaaaactatgttatttttatttggttgaaactatgctatttatttggttgtggactatatgtttgcttgtgaaataatgcaaaatttgtgtatgaagtagtgcaaaatttgtgctatttgttgaaaaagggcggtcagccgaccatgccggcatatatgggtcggcgcgttgggcacactgccgacccaaatctcaaatgggacggacgccgagcgggtgaccacccaaacggataaaaaacggacaaaaacaccgtccgtttggtcggcgcgttggagtaactagttcaacttctccgaagagagcctaacgcccataagagcatgacagacgccacggcgacacaccaaaggccgaatcccttgtgtgccaggccgccccatgacccttcgtgctcagccttggtgtagcgccgacgaaggacatcatcaccagaggagcctgccctgctgctg

SEQ ID NO: 8019 - DNA, 720 bp, Triticum aestivum
  Clone ID: PAT_TA_8019
aacaaatctccgacggagcagcccatcaggatcacgatcttctccaagctactcatggatattcaacttaaatggcatctctgagatgtacaagtcatatgaagatactaacctatggaggattgtagagaacgtaccacgcggggtacacattaattttctcaaggccgaaagaagtttgcatagatgggctcttgaagaccttcagagaattcataccgcggaggaggtggctgcggacgcgtgggcggaggcgtggatgcatgtgcttgaagatgctggacactgggttcacgcagataaccctgacggtctcttcagaatcctttcgtcaaccttccgcatcgagaccagcctaagagggcgggagtgagggcacagagctccgagcggcaccgccacatctctattttaagctggcgggcctgccatgaacaacaatacatatggatcacatcccagtgcctgcattccagttttgtagaatcgcaaaagagaggtaaaaagcaaactgcgggcgagcgacgacggagccgaccgcgatcaccggcgtggtagcgcattggttcattcattcgtttcatgcaccgtgtatataaacatacagtcgggggtgcagttgtactgtaacagaaccaacatgtaattatcggtctcgtcatacactggataaaccagtccccgtataaatggtggagaactggaagctaggcagtttgt

SEQ ID NO: 8020 - DNA, 251 bp, Triticum aestivum
  unsure (1)..(251): unsure at all n locations
  Clone ID: PAT_TA_8020
tagctgagagagcaatacancgcgnncatcccattacatcacatggtaagcaaatgtgcagaataggtacgcaagcgcgtcgcgcaatcacaggccaatcgaatgcccaacatcgagagagctacgctagaggcgcaccaagcaggtgatttcttttgcagacctttcaaggctttttctgtacattatactgaaccaggnnagtcggtgcaagntntttttccagaccccagacacagagctttgtttta

SEQ ID NO: 8021 - DNA, 255 bp, Triticum aestivum
  unsure (1)..(255): unsure at all n locations
  Clone ID: PAT_TA_8021
cccanagttcgggttcttacatgatagngnntgtcactttattttttaaccgctacaacgaccaaaccatggactaagaaaacggtgtatcatatatctactactagagttcttctcttctcagttagtaccgaagatgccaactggagcaatggtgcaatatggagggatatagacattntacattgcaggtagcgtctctaggggnaggttccttatttttttaaactggggcagntgntgaggctgnacaaa

SEQ ID NO: 8022 - DNA, 650 bp, Triticum aestivum
  Clone ID: PAT_TA_8022
ctgccgccgccgtcctcgtgctcgatccacagttctgtcgccggcctcgcgcaccacccgtcgtcaagccatcatctcggagctcgcactccgccgcggccgagctccaccccgacatacacccatccttgcactccgctccccctcccctcgagctccatcccgagatcgagcggccgtcctcgcgatccacatccagccgccgtcctcgcgatccacatccaaccgccgtcctcgcccctcccctgacatccagccgtcgtcctcgccaatccccgtccctgctactgccgggctccatctctgggctcccgcagctgccgcacctgcttttgtcgggactccatatccgagctcccgctgctgccagatctgctgctactggacctgctgctgtcggggctgcatcttctgtgctgcgcccctcccgaagacagccgtgccctgagattgctcggtccctgatacacttgatgaaattgttccaacaccaaggggaagagctctttgttcctgcatattttcctatattcaatggtttagttgtgaatatatgtttggggaaatccatatacgtgaatagcaagtgactatatatgttaagggacttaattgtttcatatcggtcatgttacttgtgatgccagatt

SEQ ID NO: 8023 - DNA, 563 bp, Triticum aestivum
  unsure (1)..(563): unsure at all n locations
  Clone ID: PAT_TA_8023
nnnnnnnnnaatgaaactaatatattgattcaaaggcataatttgttacattgcaatgcaagtatcgtctattaggactacatcaatttcctagaaaatgaaccattttaaagcatataaatttctaaaattctgtgaactgtcttcactctcctccaagtaccaaagatcagcataaattatccaaggatccaagtaatcacctagtattgaacttctcatcaacctgttttctaaaaagcataatattagaaattttcaatccatgagtgcattctcagaacctgtagagggaacaacatgaaaaaggaacacatcatcagatttggggcagttggcattgttaactgtgaaatggaaaaggggtgttgttggataactttctaatccactctgcttgccatcatgcctggcctgagcccctgacgcagccttgctggatagcatgattatactgagccgctataggaagtttggttccactctgaccgcaacaccaccacaatcttactctccgacgatgtagtaatctgtacatatctatctgccctgaagcctcgtgc

SEQ ID NO: 8024 - DNA, 737 bp, Triticum aestivum
  Clone ID: PAT_TA_8024
ttaacaagaaataaatccctcagtgtccatcagcaaccaacaaaacgtacatcaacactcccctcacatgagtgaacaatataccttacatcaataaaccccataactcatcaaacatcagctgtacagaggcagcacatgccacactcatatctatgcataaatacgcatagtgggacgaaatcattgcgactgaacaacccctgggactgacctcgccctcggcacgttagctaacccccgtgcatcacgtttgatcccgacatcactctcttaactccgcgagactcggctgactccccaagccacactcatatcttaccgtgatccatcatggcccaacgatctcgcaccgagcaaagtgctgcgggaggaagaggaagcagatgctgcaactagcacacggcgatgttgagcgccgatagcttgtgggcatggttcttagttgggctgcttcttggatgagcttgctgtgggatgctcctgctgctgccgtggcttgctgctgctgctgtggcatttgcagttgctgtcgtgtctgtcgcggcttgcgcggcagcagggcctcgtgctctcgctctcctccgatgagtgcgaggtgttcatggccgccttcttcctccccagcttcggtgacttgggacggggtcgtgggcaccttcttgtattcagccttgggagaaggtgcctcatggtagaagcttgggatgggtgtggctttgaatgtcaggcttttc

SEQ ID NO: 8025 - DNA, 567 bp, Triticum aestivum
  unsure (1)..(567): unsure at all n locations
  Clone ID: PAT_TA_8025
accttgtgggttaaanttnaaaacnncccgcgggaaacaaggtaattcncancccccacatcatgtactaatncaagaatcgttgcttagcacggaaggagacatatgcagcagcatatatggaggcagaaaatgttactcggcaggcaagacactcctcagcctagtgtcttgtggtaggagtaagtttcttggaccagcatcaagcatcaacaaagagacaccagatttttacgtggaaaacccctcaacttgaggggaaaaaccacgggccgaagccacccaaatcctcttccactattatcaaatgtgggatactacaagttcttctctagacagcactagaggatctcatacatcaagatttctgaatcttggatgaacacaacaagatttggggctcaagaactagggattggaacaatctcaccaaagatggtggaaccgaagcttgaaggaggcaaggtagtggatctggaccctcacaaccttgggggggggcgcccgggccccctcctgctttctccctcttcctcccttgctctattggttttctctcttcttctc

SEQ ID NO: 8026 - DNA, 1349 bp, Triticum aestivum
  Clone ID: PAT_TA_8026
gcacgagacggcacgagaattcctgcccccgtttccgtccgcgatggccctgcaggtcgccggcggcgcgggatgttgtggctgcctcccgctcctcggccagcggcgaacagcagcgtttcgcccgccccgcgcggtggcgtccgagggcgcggcggtggaggacggcagcaaggtgatgctgggcgggtccggcgtggcggtgaccaagcttggcataggggcctggtcctggggcgacaccacctactggaacgacttcgagtgggacgataggaaactcaaggatgccaaaggagcattcgatgcgagcgttgatagtggaataacctttttttgacactgcggaagtatatggtgcaggggtatcgggagcgataaattcagaaagtctactaggaagatttatcaaggaaaggaaagaaaaagaaggggtcgaggtggccattgcaacaaaatttgccgctcttccatggaggtttggcaagggaagtgtaatttctgcactaaagggctcactttcccgccttggtgtctcctcggttgagtcataccaactccattggccagggatatggggcaacgaaggttacctcgacggccttgctgatgcttatgagcaagggtcttgtaaaatccgttggagtctcaaactacagcgagaaacgtctgcgagatgctcacgagcgcctcaagaagagggggggttccacttgctttcaacccaagtaaattacagtctgatttacaggaaccctgaggaaatgggggtgaaggcagcttgtgatgacctgggtttctctgtggctgctccctcccccatggccctgcctgctttgcccgcactatccactccggcctatccaccttcccgtcctcgccgtcgcatatacacttctgatttcctgtccaagctccaaccgcttattaacaagattagggagattggaggaagctatgacaaaaccccaactcaggtggttcttaactggcttatttgccagggcaacgtgattccgatcccgggggcaaagaacgcagagcaggcctgggagtttgccggtgcgctagggtggctcttgacggagcaggaggttgaggagctgcggtccatggcgcgcgaggtgaagcccgtcatgggtttcccggtagagaagctgtaaatcgcggccaagttaccctcgtggtttactgctacacaggatttccgtgatcctagatataggagttgtagttctgtgaaaaggtgtggagttgtaaaaagaacaaagacgtagaaaatcataacggaagtaagtgtatattcaggctcacgatcaaattatatcaaaacgatagttgttttgttc

SEQ ID NO: 8027 - DNA, 2049 bp, Triticum aestivum
  Clone ID: PAT_TA_8027
ccctcccgtccccccacccgcccgcggccccatgggtatatccaccccttcggttccgagtcccccccacccccgaaaaaaagatcaacctagggttagggttgcggcggcggcggcggcggcggcatcagctttattcccgatcccggtcgccgtgtccaccggagtcgcgccagagctggaggaggagaccgccatggccacaggagtcgcgccagagccggagaagaagaccgtcgtcttccccggttgggtgatgctggatcgcttcggccgcacctactgccacggcgacctagacgctgcttgtgaggaggccaataagaagaagaccgccgttgaagtcgtcacgtccaccggccaccactgcttcatgtcattcaccttctcggatcataaactcgatgatctcttacctcgatctacactagtcgaacccgtggtcccctcccgcctgcccgcgtatccctacgtccgggcaactgacgaggacctcgtcctcttcgaaatcaacatcccaagacagccccacgacttgccgtcagatctgttcgtctacacagctggtcgtaccccctcggtggatcagctccctctgtacactgagcccatggtaagcccgtttctgatgtcaaaattcgacacaggcatcctgcgcctcccggcacaacagctacatcgtttccgacatcaaggtctaccataaagagaatggccctgacaattatgaaaaaaggagggctctcacgattgttccatgcttgccgagctctgtgtcttcaactccgagactgaagagtggaaagtcatcgaggaggtgcccgccccgcagccccaggaccagagcaatggcggccagttccccatcctttggtcaaccgacgatgtgctcgcttgtgacggccgtttcctctgctgggtcgactacttgagtggtgtgctgctgtccgacttctccaccatagactccccggtgctccacttcgttcctttccctggaggaaaagagtacagtgaggaggtactcctctcaaggtgctttgcggggagattccggagtgtgtccatcagccatggcataatgcgcttcgtccacattgacaatgactttcacgagagaatccatgttgactggcgtcggcgtctcgagagaagccaaggacaccagcagccgccccaaaagatcaccatatggactttgaacatgaggggtggtaactccaagtttgagtgggagccacaccgtgagatcaacctggattgtctatgggcgcaatgtgattaccgggctctggacataggtcagcgtcttccccaattcccagtcatctgcgtggaggaccctgatgccctgtgctgcctgttgagggatgagggaactcctggaaaggcgtggatggtcatgcttgacatgaactatgcatatctgcggtcatgtactccatatatcaatcaacacccctacgatgctgggcgtgtggatgtggaaactcaccaaaacttcttctctaatgtgccccaacttccaaccgtcttctccaactaccttgaaaggccatcagtgatacgacgggatggcgacaaggttgcatctaaaccttcaaagaaggttaagctggcaagtactcctccagaagttgcaaagaaggctaagcttgcaattcatccaccagtgcaatgtgaagacctggaatctgatgactggttggactttgggcccgttcaagtcaaagacgatgttcgtcgatggtgccaagtcaatagcgcaaaaattggcattgatgggatgaagatggtgtactgatgagtttctgtttattactcccgctgtccgtgtgtactggtgagggtgctgggctggatcctgttttctccccccccccggcccttggtctctctaggctgccgggtgtgtgcacccttttttgtttcacatatgtactgttggaactctaaatttcattttgaaccttaaatttgctctttgtaagctgctgcttgttcgaaaggcacatcaagcaacgattttgcaaggatcagcggcaaaac

SEQ ID NO: 8028 - DNA, 678 bp, Triticum aestivum
  Clone ID: PAT_TA_8028
tagcacagagcacagaacaagagacaaacatcagtcatcaccgtctctctgaatccaggagaagaaaagaagaaaagaaacagcaagctcgctccctactcgctgggcgttgctcttgcttctggactggtcagtgccaccgctagttgcttcccgccgcgccccagcacagcgcccgcggcggcctcctgtcctcccccgcccccggctgccgtgccgggggtggcggcagcaggcccccgccctacgcgccggcgctggcgcgtgctgcgccgggctgtcggggccgccgcggatcggccagggcgcgcccgggctgcgcccccgggggctccggtagctcctgggcctgtggccgtggggcccgtgctggcggacgaagttggtgatgctggcccagccgccgaagccgaagccgaccaccagcacccacaccaccacgaacgcgttgatcacgtacgtgcccgtccatcgccccacgaaccgcggcggctgctccacggcgctctcgcgggcgtgtgcggagcggtaggtgatcatgtgcgcgagcgccgggatgatgtagacggtgaagctgacgaggagggagccgacggcggagttgatgggcccgaagaaggggaagacgatggcgaggaaccagatgggcacgaccacggggaggcgcgcggcggcgcg

SEQ ID NO: 8029 - DNA, 430 bp, Triticum aestivum
  Clone ID: PAT_TA_8029
gccccacgcgtccgcgccctcctccccccttttctctccatctcctcactaatatctctccctttccctgtcccgcactgcaggacgccatggccatcgagcaaagctccgtcggaccttcccgaccagatcgacgatgacgacaagcggatctgccccccacgaagaggtagaaagcacgggggaggcggcggcggccccagtgggcgccgacgaagcccgccagcgccgccaggaggatgagccgcctaggatggacacgggccagcgcgaactccaacccccgcccatccccatgcgtacgcgatcagacccccgaggcgatgacggggacgacgcagaatgtcgcgtcacgcccaccgtgatgttggggatcacccccatgtctggatgctcaagctgtgctactgctgctgacccagactgtata

SEQ ID NO: 8030 - DNA, 762 bp, Triticum aestivum
  unsure (1)..(762): unsure at all n locations
  Clone ID: PAT_TA_8030
gtcttnctttgggttttttacagtgtgaacaataagcgtcttcacaatgaagagaaaaaatcaatactatatatacacgtgttttttgatgttctctcatcttctgctaaaatccagtaatctggccggcatgaaagcaaatagtaaaactgcactgcatgccttctaaaaaaagcaaagtgcagtgcaccggacttcttttcccgaacaaataaatcgaacagcactgcactagagatttttttcttccaaaacaaaaaaatgtgaacggcatgtcgacgccctcggaactgcacgcacacagccagccatggtactccaagccactcgagagggatcctcctgcgttgcgttctcgtcggtggcgaggtagaggtccgagggcccggctctgcccctcggcctgccggggaggcctagcctgctggcgccgggggaagcccgtcggcacgtcacctggtcaggtccgaccggtggagacgcgcgggaccatccatccacttctgtgttgtcggccggaggcgcgggcctgcgtggcggagctccccctcggctcgtccgtggccggaggggggcgcgtgcgacggctgctgctgttttccactgccggcgcgcatgcggcgggcgggcgtgcaccgttccgggccgctgctcggcgcccaggtgcctgttttgttttccagtttcagttgaaggcactctgtcactgagccgttggatgaaaaacagatggcaccatgatgtgccaacaaacttattagc

SEQ ID NO: 8031 - DNA, 631 bp, Triticum aestivum
  unsure (1)..(631): unsure at all n locations
  Clone ID: PAT_TA_8031
ggagagagagagagaactagtctcgagtttttttttttttttttttttttcaccatctacatggaacataacgtagatcagataaagtggctcagcaaaaaatagctggcctggccgtttttgtggagaatatcttgcagaaagctatgactattgctacggtggaatattcagctagtggaaaaaatagcaaaaacttggctacaaataactagagtcaatgccactgctatctgtttgatttccgacttcgacggcggcagtcaaagcactcggagcatggatagtaggtcttcactccacttgtccgatccggttgtaatttagctgggcgaaatcttaagttcctctatgagcacctgacgcagcttttcattctcgtctcgtaattcttcgataactctttggtgcttcagcaccaactgaagtacattatccgtcccatgcaaatttacagctgcatccctgatgtccgtttttgtatccctctggaacaggggactctgcagaaagttggcaatgaccttttcagttcgaccacctgntatcatctnttgctgcatnccattctnnncacncaattnatnannnnnntgnncttgnnatatttcattgctnnaantatgctgna

SEQ ID NO: 8032 - DNA, 638 bp, Triticum aestivum
  unsure (1)..(638): unsure at all n locations
  Clone ID: PAT_TA_8032
agagccttccaccaaactggatcgtgtgtgctcctcccagtacaatttgagggatgagtgacgacggcgactctgacatctgcgatggatgcatcgaggcgatctgctgcgcctttttcgtggattccctcggcggcaagacactcttccgcattgtctgtgctatcgtgatcttcgccgtcctcgccaccggcttcacgctgctcgtcatcgcgttcgtcacgcgccccgtcggcgtcacgtcgaggacgcggccctcgcccgcctcgccctcgccaacaaaaacgccacggccacggcgctcgcctacgacttctcgctcgccgtcgccgtgcgcaaccacaactggatcatgcgcgcccagcacacggcgccgctccacgcggagctgctcttcgccggcgctcgcttcgcccgcgtcgggctggcgggcgcagggggccttgtacaaccggggaacaaggaagtgtaccacgccacggcggcggccgacagcgcgagcgtcgcgctggggagcgcnnnggtggccgagttcgtcagggagagcacggcgggggtctttcatttggagctcnnnnntctcnnnnnngtcnnnnaccagccgcgccaccacctgcacaggctgcacgcgatctgcc

SEQ ID NO: 8033 - DNA, 703 bp, Triticum aestivum
  unsure (1)..(703): unsure at all n locations
  Clone ID: PAT_TA_8033
gcgaggatgaacaggtgcttcttggaccctgcccggccggctgccctggtgtgtaggctggcgccggtttcggcacgggcgcggactcgctccacgcacaaaggtgcctttttttttttttgcagctaggcttgtggcctcactgcaactttgaggacgaacccaaacatcgaacggacacaagcacaagttgtttcttatacccagctcggcctgccaggagagacaagcttaggtttattcatggacacggacacggcacacgcacaaaggtgccagcatgcatgcagctaggctactagcggcagtgggtggtgcagaagcagcggcggcgggcgccgcggcacttcccgtcgggaaagccctcggtccggcagacgttggcgcagttgtggccgcgcaggcagaggcccgcgaacctgtggctcagcgactcgcacctccgagcttccgccaccgccaccgggcctcccatctcccccgtcgccgcgagcagcagcaccaggaggagcgcggcggagacgagcttgcccatcgatctattacagctagtgtacgagtgtgtctggtgccgtgtccctgcagcccgggggatccactagttctagagcggccgccaccgcggtggagctccagcttttgttccctttagtgagggttaatttcgagcttggcggatcagaaanttannggntnnaaannc

SEQ ID NO: 8034 - DNA, 682 bp, Triticum aestivum
  Clone ID: PAT_TA_8034
tcaagagcccgtggcaacgcacgggcattctactagtaggtcttaaggtcatacttaggtgttacatacttttagtcacatcccatgcacataaatcgctggttaaaaccagttttctgcgcccaggggatttttcaagcgatgcaaactgaaacctcagtccttcatttgcgcaactactaatagcacgatgacagcctaaagatttggggagccagcagtcgggcttttcagggatcctactttcatgctcatgttcaggtcatcaatctatgatcacgtcacacgcgaactctggaacgtctcccttgttccccttcatggtcacaatttcataggcgagctttgcgcgcagaccatcaatctggtcctggcttagtgttgagcggaggtacagcccggtgaagtcagtgtagtagtgtgtgatgtacactccgctgtcttccctgctgcacggttcatgctgcgccacctatgggtataggaatttccacccatctgtgtcaaccaacccgctgccgaaaaagttgttgaagagagagcagaaccttcgctgcaacttctttgcatggttctcgtgttttattttcatctcatccatgacatcggtctcggttgggtcaagcaccatcaccgtcttttcatccttgtccagaaggtacattgatcagcagtccataaa

SEQ ID NO: 8035 - DNA, 1425 bp, Triticum aestivum
  Clone ID: PAT_TA_8035
ctgtcccccccgcaccgtcgccgccgccgcccccgcccccgcactgcccttccctccgccttgcccccccgacggctctcgcacccccctctcccctacagccccgtccccccgcctccccaccgcccccgccgccgcgcctcggcccatgacgacgcgtaccacgcccattcccaaccgtacccccagccatgtccccatgccaacactgccccctaccacccccgccacgatccgctcgctctctcccacctccaggaacctatctttccggccccctctcagcgggccccgggcccacctcccgccgaagcgggcttcgccgcgcgccagagccccccggtgtgatccgccgctcgccgccgtgccacgcctgtcgccgtcgagacgtccccaaggatggcgtcgccagggcgtggccgtcgcgaggggagatcgagcgaacgtcaccttcgtggaagggcggcatcgactccgctttggaggccaggttgcgcgcgtcctactgcgccttcctccgctgcctcggcttccgccttgggctgccgcagacgactgttgcgacggcagtggtgtattgccatcggttctttttccacagatcccatgcctgcaacgacagatttttggttgcgactgcggcattgtttctggcatcaaagacagaggaaacaacatgccttttgaatactattcttagggcttcttgtgaagtttctgaaaaccaagaattcaacctccttccttacatgtcgcgtggtcaaaactggtttgaactgtaccgagaaagtgtaatacaggcggagcagatgatactgacaacacttgattttgaacttgaagtggcccatccatatacttcactttcatctgctttgagcagactaggactttcacattccgttctatttaacgttgccttgagtctgattaatgaagggcgtcggagttctctttggcttcagttcaaacctcatcatattgcggctggagctgcattccttgctggaaaattcctccgctatgacataacctttcaccaaaatttctggcatgagttcaaaacgacaccacatattgttcaagatgttgtccaacagttgaaggagctactttagaatcgtagattccatatgcttgctttttataccaacatatccttttacatggtttagtggccacttttatacaaatatgtatacctggatatggtggcaacacgtcttgaactactggacagcattgatagtttgaaaatatactcgaatcggttttcattttatttctacgactaaagggtgttgccatgtccaaaaaggacaaaagttgtcatttctgttatcatttcccttttctgtaagtagtgtgctaaatgtggacgtatgcaagttttctttttgagcgtgatacacatttaatgagttc

SEQ ID NO: 8036 - DNA, 483 bp, Triticum aestivum
  Clone ID: PAT_TA_8036
gaattcggcacccacgcggtcgcgcctagcctccagagctttccccccttcctctttcccttgccacctgccccgaaaccttcgaccccgagagcctaaaaaattcgagccaacaacacacagagagactgcgacagccccccggcgccggccgccgggtcctcgccgggctgcgggccgccagcgcatggcatcgtcgcgggtgatggccgcgtcgtcgcagccgccgccgtccggctcctccgatctcgcgcgcttccggagcgccagcggcatcggatccatgaacatggacgacatcctccgcaacatatacggcgaggcgccccccttcggcgccgtcgccccggcggaccccgcccccgcgccgtaggccgacgcccgccgcacggatgacgaggtctggaaggagatctcggccaccgggggcctctccgcccccgcccccgccaccgcccccgccggcgccggaggcggcgaggc

SEQ ID NO: 8037 - DNA, 716 bp, Triticum aestivum
  unsure (1)..(716): unsure at all n locations
  Clone ID: PAT_TA_8037
tttttttttttttttttttttttttttttttttttttcngcacacgccaaactcatgatcgctccctccttacttagctcggttcagttccacgcacgacattattacaggtcgagctcctccctgctacacacgtacggataccatatgcataatttatctcgtacttaggagaatcaaatcccacgcatcaatcaattgaaaatattgaatcgcgccccgccggaatggtctaggcaagaatttcgttgagagacttggtggccgccggcatgggcgcggcggcgaccgcctgctgctgctgctggagctggagctgctgctgcatcagctggtccttggcctgcttcttgcgcttggcgaggtcgaggtcgcgctccatcttgcggcggtacatctcggcgaaggtgatgggctcctccagtatgggctcctcccccccccgcgccgccagcggccacaccctcgcgtccggcgccgggttctggaacgtcgcgatcgacagccggctgctctgcccgttcaccaccgnctggtggtccgngttcttgaacctgccgttgctcatgaagtggccgnggtcgccgaggttgacgacnaangcgccggagatgggctggacggngatccangtcttgccgncgcgcgggtggnctgaaggccnncgacnaggtcctggangaggagggnnatggngcccgngnncnnnnnngnnc

SEQ ID NO: 8038 - DNA, 933 bp, Triticum aestivum
  Clone ID: PAT_TA_8038
caagaatcttctacgcacgttccttcgtctcgcacatgcatctctagctagctacctcgggcagtggactgccgcggcccctgcccgcccacgccagcgcctccccgtaggcgatcatggcagctgctccttctgcctctgccgtttccgtcaggcagaggaatgccgcggcagcatcgctactgctccaggatcagcagcaagaaaagcatgaagccgtggatccggtgccgccgccgccgccgccgccacgatcgacgctgtaccaggcgctgacgtcgacggcgagcctggccaacctgctccccacgggcacggtgctggctttccagctgctcgcgccgaccttcaccaaccacggcgcctgcgacgccaccacggcgctgctcacgcggatcctcctcgccgtcctcgcgctctcctgcctcctcgcctccttcaccgactccctcaagggccccgacggccgcgtctactacggcgtcgccaccctcaggggcctctggctgctcgactacccgcccggcgcgcccacgccgccggacacgtccaggtacaggctggcgccaatcgacgccgtgcacgcggcgctgtcggtggccgtattcggggtggtggcggccagagacaagaacgttgtgcggtgcttctacggcccgtcgccggcgagagagacggagcaggtgctggacatcgtgccgctcggcgtcggcgtgctctgcagcttgctcttcgtcgcgttccccaccaggcggcacggcatcggctaccctgtcaccaacggcgccgctggcagcagcacctgaataaattaaacttacccgcgtattacaaagctcaagaattactctggttacagtagtactcctgctaacttaagagcattgtatcattctatcatttcgatttcttgcttatttgcctgtgggatgt

SEQ ID NO: 8039 - DNA, 1361 bp, Triticum aestivum
  unsure (1)..(1361): unsure at all n locations
  Clone ID: PAT_TA_8039
acgcacacgcgtacgatcgactccgccgttccaacgattatcctctcctccagccatggccgcttcctcggctcctctcctcctcttactctacctcgccgtcgtctccccggtggcagcgcgcgccgaggacctcctcgccgcggcccgcgcgccggagaccgccgcgtggctgcgcggcgtgcggcggcgcatccaccagcgcccggagctggccttccaggagcaccgcaccagcgagctcgtccgccgcgagctcgacgccatcggcgtcccctacgcgtggcccgtcgcgcggacgggcgtcgtggccaccatcggctccggccccggcccggtcgtcgcgctccgggccgacatggacgccctgcccgtgcaggaactggtaggttgggaatacaagagcctggaagatgggaaaatgcatgcctgcggacatgatgctcacacagcaatgcttctaggagctgccaagctacttcagtcccgcaaggaagacctaaagggcaccgtgaagcttgttttccagccagcagaggagggcagcgggggcgcctactacattctagaagaaggcgttctcgacgacgcgtcggcgattttcggcctgcacgtcgatccagctctgccggtgggtgtggtttcgtccaggccagggccatttgccgcgacctcgggtcgattcctggcgacggtcacaggaaaaggtgggcacgccgctggcccccatgacgccattgatcccattgtagcagcatcgtccgccgtcctgagtatccagcaaatcgtctcacgggagatcgatcccctccagggtgcagtggtatccatcacctttgtgaaaggaggagacgcttacaacgtcatccccgagtcggccgcctttggtggcaccttgaggagcatgacagatgaagggctgtcatatctgatgaagaggatcagagagatcgttgaagggcaggctccagtgcaccgttgctctgcctccgtggacttcatggaggaaacgatgaggccgtacccggctgtcgtcaacgccgaagggatgtacgcacatgccaaggaggtggccgggaggctgctccggggaagggaacgtcagggtggctccccaagctcatgggctgcgggaggatttcggggttctaccgcgcagagggattggcgggcgccttcttcanccaatagggagnttggcaaacngagaagcaccatggagccgcgccccgccacgcacgcccccccccccgtgatcgtcggagttgcgcgcccggttgcgcctcccttcctggccgccgtggccattgagtacatgaaaagcacgcatcggcgtaaaactaaccnaccaacacaaaaag

SEQ ID NO: 8040 - DNA, 732 bp, Triticum aestivum
  unsure (1)..(732): unsure at all n locations
  Clone ID: PAT_TA_8040
ttttttttttttattcaaaaaccgataaattcttatctatgctcaaggacacaaatnatccatnctctacaaacatggacagtacatctcacactaaataacattttctccgcacaacatgtcttctttttcctgcttgcaacatgaaagcaagatcaggaaaataagacatacgactcatgaaaaactagaatacatactcatcgaacgaaaattgcaccgctcagctctcggcaaacccaagaggcctcttgcatgtgttccgccggtgtccctctattccgcagttcttgcatttgcctggtttccgtggcttcttcggagcatcccctcggtctggacatgttgtcctcttgtgcccctcgcggcggcaaatgctgcagaacctggttctcttactcagcccttcgtatggtgccttctccctgctgctcgtcggcctgccagcagctctacgcttttctggtgctgcgaggcagcgaagttcattcatgcccacagaattcacagcactattgcattgctcatcctcctgatctgcattagcaatctggcccttgcacgctgcaccaccattcccactgtcaaggagacgatcctcgaatgccaatccatcccgcacgaccgccagaggcgctccaccccgcagcagggagtccagtccagaattcatatactcatagcatgcagcacttgcgtcccccatccgaacagcttccatggctttaaaat

SEQ ID NO: 8041 - DNA, 1177 bp, Triticum aestivum
  Clone ID: PAT_TA_8041
cttgctcttctcccccctccgttccccccgatgctcgccgccaccaccgcctccctcccccccccgctccgccgctcactgcgcacaacccccctcgggcaccaacatggcagcgaggctggggcccgctaggtcagcacgcgagcccacgcaggccggactcaaacgtggcgcgcggagcgctagcactgcgatgagctcgctcgccgccctccgcgcctgcatgctcgggacccgcggcgctcccgcagccaagggtccgaggagacgcggcgtgacaggggggcgacatgggggagttcggcgggacgtacacgaggatggacgtgttcgccatcgtctccttccctgaccttacctgacgtggttgaccggggtcttcgcgtggctcgacagcggcagcaacggtcgtatctgctctacgcggccgtctatgtggctccgtagcttaccacgatctcagctctctccccgtccgacagctggctgcccatcgtcagcagctccatcatcacctgcaagagattcagagagttgggccagagcaaggttgttcttgacagcgtgtcgccgctgcgcctcgccgtccggctcaaaagctcgtccgactcggacgaccacttcgtgcagcgctgcgacggacgcggggccccctcgacggcatgctaccttcttggcatgatcccgttctactgcctggggagccgggggtcgggagcggcgctgatggcggcagcggcggtgggtggccaccgggaggcgctctactcgctggccgtcatccagttcaacggcagcggtggcagcaaggacgaccgcgacctccgcgcgggcgctgcgctgtgcgcgcgcgcggcgtcgctcggccacgtcgacgcactccgcgagctcggccactgccttcaggacggctacggcgtgcgccgctccttgctcgacgggcgccgcctcctcatccaggcgaacgcgcgggagctcgccgccgcggtcaccacgtcggcctctttgctccgcgcggcagccggcagcggcaaggcctcgaggaggcactcgtgcctgctcagcgacttcggctgccgcgccgcggccccccgcggcccggcgaggcgcatgccgccaaccggtttcttgttcgagtggttcgcgtcgcggcccgctgggcgcccgaagagcaagc

SEQ ID NO: 8042 - DNA, 616 bp, Triticum aestivum
  Clone ID: PAT_TA_8042
ttgttgatcatatcacccctcttctgctggtttgaaggcccgtctgtctgtcgtattgccacatgcgcggattctagtgccagtcctccgggtgccactttaccggcgcttcagaccgtgggtgccgcctcactcactccctgacctcccggcaggcccaggcccactgtccggccttcgcgccggcgctgccctcctacgtcgccttgctccgggtcggggtccagctccgcctccctcttgactgccactggaccttcccccttgttgacagccttgttctcttgaaccgaggcagacgcattgctcttcacacccatgagtttgttgaatttctcttggcgctcccgatcagaaaacagattcgaatcccactgagtgcttgtctctgtagggttactcttttctattgccccaaagcagctttttcttctggtcaccggaggcccgcccggtgccctccccacaccctacaatgggcctctgccccccttcgccccctctcgctcctgcgtctgttgcagcgctctgggcgctcccggtctcgtctctgtttcctcccccggtgtccgcttccctctgctgggcttctccttctcctgccccaaagcagctt

SEQ ID NO: 8043 - DNA, 302 bp, Triticum aestivum
  unsure (1)..(302): unsure at all n locations
  Clone ID: PAT_TA_8043
antaggaccatgactntacaattatagtaccataggacaaatccatcaatccaggaggcaaaatatgagtgaatccaaagaagcagaaaggaatacctattttgatccagaggggctcatgagcatggccatcttccgtaacaggttggccctaacgcaccctggatcagacgcgctgggagcttgtagcttgtcatctagatgatgttcgcagcaatgaagatacataccgccaggcaagcatgtgtgcgtgcttcaccggtgcatgcatcactgtagtagccaagaaagtagagtaggcg

SEQ ID NO: 8044 - DNA, 485 bp, Triticum aestivum
  unsure (1)..(485): unsure at all n locations
  Clone ID: PAT_TA_8044
cacgccgccctctcttcttttgctgccgcaccggctgtctctctccctccaaaccctaacccgcgcccgcctccctgccccatcgtcgtccagatccaaccccacgccgccgtcatctccttcgcccagtcggctgccgccgcaccgcacgaggtgggatgccatgccccagccgtctcctcggtctgcttcaccgtcgagctcgctcgtcatgtcgttgggagggaaggaagatggtgttgctcttatcgaggtgcaccgccgtgacgtcaacgggaggaggccaagcgaagcgcgacatccactcatccacatcccatcctctcttcctcacaccatcctatctccctcccagatccaccacgcagctctgtagctcgctcgggcgctcggacgccgacgccatgggagggacgccgctccaacccctgctcctgttcgttgcccccgacgccatggagggacgnccctccaaccctgctnca

SEQ ID NO: 8045 - DNA, 840 bp, Triticum aestivum
  Clone ID: PAT_TA_8045
attgatagcatagttaaatgtccgaatgcatcacaccagcaagcgttgatagcatgggaatagaaccttaaccgtcttacttaactgatgaaatggtggtcatcagttggcgtcacaaataaccatgcaaggctgctatatgcatgcaggttaattaacaatacgattacactgacaattaattttcttcattttaccagcagctcgagctcgccctaactaccaaagtctactactacagtactagttgagtacatggctaaaccaaatgatgctaattaacacatgggtctttctttctgccagaagcaatgcaagagatccactgagcacaaaagaacatcatctgggggcgattgagggctccatggaccacaagtgtgccctgaaggaagcagatggtgctagacgatggaacgccttttctggctgcccccggcccgtgccagattggacccttggagcaaggctgggaaggtttagtcgcggtggcgccatcttccttctttggggatggaatggggctcaaagcctgggcgggccagcccaaggtaccactggcggaggaggagagactgccgcgtgcgcatggaggggctcgaagcctggcggaccggcccagcctgctgaaggctgctgctgagagctgtcggcgacatggcttgacacaggagaccaatccctttcagcagcaaatgatgaactggctgacacagattcaggcagctgagacgtttgagaagcagcagcatcagttccctgcccccgataatcctctgcgtaagctgattcagcagaatagcacggcggccaatacgacgatgttggcactccaaccgc

SEQ ID NO: 8046 - DNA, 1388 bp, Triticum aestivum
  Clone ID: PAT_TA_8046
gttcaagtaccgcgtcgagctccgccgcattcctctactggtccgaccgggcaacgcgtcgctccccgcactggagacctgccgggccgccgacttcgcgcgggacgtctggtccggccggtggacgcggctcgccaggaacgacaggtgcgtggatgtggacgacgccggccgctaccggtgcctggagccggagcacccatgcgaggcaccgtggtgcgacggacccctgggcgcgctcgagagcaacggatgggtctactcggcgcactgctcgttcaagctcttcaccggcgacgctgcgtggcggtgccttgacggcaagtggctcttcttctggggcgattccaaccatgtcgacaccatccggaacctcctgacctttgttcttggcgttgaggacacatccgcagtgacacgccgcttcgacgccgtgttcaccaatcccagcggcgagccgggcaccctgcggatcacaagcatcttcaacggccattggaacatgagcatgaactatctcggcctgcattccctccggcacaaggggttccggcagcttgtccggtcatactttgcgggcgatgatcgtgtccccgatgttgtcatcctgaactctggcctccatgatgggtgctactggagcagtgtccgcgcctacgttcaggccaccgagtatgccgcgcagttctgggccggcgtaatggctaaagtccgggcgcgtgggctcgccgtgcctagggtgttctaccgcacgacggtcgcgactggcgggtatgctcgggacctggcattcaatccaaacaagatggagctattcaatggcgtgctcgtggagaagatgaggcagcatggcgtgctcacaggcggggtgatagacaacttcgacatgacgttcccatggcactacgacaaccgttgcaacgacggcgtgcactacgggcgcgcaccggcaaagttggtatggcgggacggcaagatcggccaccagtacttcgtggacctcatgctggggcatgtgctcctcaatgccatctgcaatggatgaaactctgctggttccatgctcggtaagtttgtgcagctcaattgtgtaaactagggtaggatagccacggaactgaggttgctgaggtgaaattgtggtatcagtttatgtgtaccgcagatatcgcgggcatagctgacccgttttatatggtgagaccgtctgatcatttagctatgtcgctgttatgatcctgctctagccggccaggaaggtcgaagttcgttcgatcggagctagctacgggtggatatcaggtccatgtaaatatatatcccaatcccgttttgggggcgtaatgcatatgcaatttgagtgggtcatgttatgtccaaaaaaaaaa

SEQ ID NO: 8047 - DNA, 831 bp, Triticum aestivum
  unsure (1)..(831): unsure at all n locations
  Clone ID: PAT_TA_8047
catagctcagcctcccagcccgacctgctcagtgcgctggtacactacccccacaagctcgaagaagcggtggtgctttgacatggctcctctttcgtccaaggccgttgcactcgttgcactgtcctccctcctcgtcacctacgcctctgccggcgccgggaacttcaacgactccgccttcaccgccgaccccaactgggaggacgccagggccacctggtacggcgcgcccaccggcgccggccccgacgacgacggcggtgcgtgcgggttcaagaacaccaaccagtaccccttctcctccatgacatcctgcggcaacgagcccatcttcaaggacggcaaggggtgcggctcctgctaccagatacggtgcaccaacgaccagtcctgctccggcaacccggagacggtggtcatcaccgacatgaactactacccggttgccaagtaccacttcgacctgagcggcaccgcgttcggcgccatggccaagcccggcctcagcgagaagctccgccactcgggcatcatcgacatccagttcaagaggtcggtggcatgcatttcatcactcgttgcacgaatcctatctggccctacctgaacgatgaacagtctcatactctatataaccagtgcttttgttgcccaacaaaactttcacgacggcgaccggtttaactgggacccaaatagattcgcagcgaataatactactctattttgagtaccgtcgcctcacacttatttgcncgtcgtcccggctcggttacgaagtaagctacaatggcccatgggttgctgattgctgctgatgatgattga

SEQ ID NO: 8048 - DNA, 643 bp, Triticum aestivum
  Clone ID: PAT_TA_8048
cccacgcgtccgaacgcggtgtacatggcgatcctggtggagtacgagaacggcgacggcgacgtggtgcaggtggacctcatggagtcgggccgccggggagggggaggcgggcggtggacgcggatgcgcgagtcgtggggctccatctggcgcctcgactccaaccaccgcctgcaggcgcccttctccctccgcatccgcaacgagtccggcaagacgctcgtcgcccgcaacgtcatccccaagaactggaggcccaacaccttctaccgctccatcgtccagtacagctagacctctccctccattgacgagagctctgttttggcttggcgggagtcgatgcatgctgttttggcgggagttttcaattaattaattaattcatattctcaagttgtatcgtgggaaatagaggaggcaccctaccgtgttcaagcacgctggctctcccgcccactttattagtcgtcgtcgtcctcgtcgtattaacgttttcagactttgcggatgcatctgcaagcatgctctgtatccatgatcacatttatgtatgtgtgaatcatgcatcatccatgatgtgtcatcacatcggtcggatcagactgagcaagctatgtataaatgttcctggctttta

SEQ ID NO: 8049 - DNA, 1283 bp, Triticum aestivum
  Clone ID: PAT_TA_8049
ccccgcgtccggtccagacagcacagcagagcaccactactactaccacccccagtggcaaccctgacaaggctctagcagcttagctaaagatggctgggctactctctgtcaaggccatcgcgctcgccgccgtgcttgctgccgcgtatgtctcttgcgccgccgccgagcagccgggggcggcggacctcgacgcctccgccgtttcttacagctccgcgtggcttccggccagagcgacctggtacggagcgcccaacggcgccgggcccgacgacaacggcggcgcgtgcggcttcaagcacgtgaaccagtaccccttctcctccatgacctcctgcggcaaccagcccctgttcaaggacggcaagggctgcggctcctgctaccagatacggtgcagcagcgacaaatcctgctccggcaaaaccgagacggtgatgatcacggacatgaactactacccggtggcgcagtaccacttcgacctgagcggcacggccttcggcgcgctggccaagcccggcctcaacgagaagctccgccactcgggcatcatcgacatcgagttcacgcgggtgccgtgcgagttcccggggctcaagatcgggttccacgtggaggagtactcgaaccccgtctacttcgcggtgctggtggagtacgaggacggcgacggcgacgtggtgcaggtggacctcatggagtcgcgggggccgggcggcggcaagtggacgaggatgagggagtcgtggggctccgtctggcgcctcgactccaaccaccgcctccaggcgcccttctccatccgcatccgcaacgagtccggcaagacgctcgtcgccaacaaggtcatcccggccaactggaggcccaacaccttctaccgctccttcgtgcagtacagctgaacccaccatgattccgttgctcggagtactggtaatgctactacgcggctagctgctacggtcaagtgagtcagtcggtcattgggagtgtacggtcgtttgcgttgagtcgttgtaaactgtatcgggttgggggtgtgtgtggtgtcggtgcgtctttctaggtgagaaaagtttggctgggtgtgggtctgggtcactagggctgtgatgagtcgtgtattggcaaatgggaaaaggctgtgtgggaaatggaggaggcaggcgtacaagatacgctctcccgcccactcttgccttttataatttatatatcattcaaggcggtgatattaatcgaaagtatattgttactactactactaaaaa

SEQ ID NO: 8050 - DNA, 1184 bp, Triticum aestivum
  unsure (1)..(1184): unsure at all n locations
  Clone ID: PAT_TA_8050
cgttgcggtcgcagttgctgtaatcctctgcatcctcgtcgcccatgcccatggctgctacgccaagcaccacgcggctccttccgcggccaactccagctggctcgatgccaaggcgacatggtacggcgcgccacatggtgccgggcctgacgacaacggcggcgcgtgcgggttcaagaacgtcaacttaccacccttctcctccatgacctcctgcggcaaccagccgctcttcaaggacggcaagggttgtggctcctgctatcagataaggtgcttaaagtcagaccaccctgcgtgctccggtgtgccgaagacggtgatcatcacggacatgaactactacccggtctcccgctaccacttcgacctcagtggcaccgccttcggagccatggccaaggatggccgcaacgacgagctccgccacgccggcattatcagcatgcagttcaagagggtgccgtgcaagtacccggggcttgacggtgacgttccacgtggaggaagggggtcaaacccattctacatggcaatcctgngtggagtacgaggacggagatggccgatgtgaagcaggtggatatcatggagtcacgaccgaacgctgtcaatggtggcaagatggctcaactccgggtcgtggacgcccatgcgcgagtcctggggctccatctggcggatggactccaaccaccgcctccaggggcccttctccatgcgcatcaccagcgactccggcaagaagctggtggccaacaatgtcatcccggccaactggaggcccaacaccgactaccgctccttcgtccagttcagctgatccgcgacgccccgaccggcccatgggcggccacgtgcgcctgcatcatgcatgcatgcgctctggcggtctggcccctctgctggctacgcaattaattgctcggccgatcgaaatcatttgccttattttatcttttgtattttgcgtgggatcaaggagctcgagatgccgtctgtctggtgtcatatgtggggtcgtcgtcgtctagcgtcttgagcatgtgtgggaaatgctggaggcatagtttgcatgtgctctcccgcccactgactctgtgtagagcaccatacatgagatgacactaccggtgtgtaaccaaatccaagttataaattatatacgtacagtttttcct

SEQ ID NO: 8051 - DNA, 1597 bp, Triticum aestivum
  Clone ID: PAT_TA_8051
tcgttcggtgccctgccagtacccagtgctaacggttttttttcaggtgcaacacgggtccaacgcgaactacctggcgatcctgggggagtacgaggacagcgcccgcaacgtgtaccaggtggacataatggagtcccggctgccggacagggcgcccacggggtactggacgccgatgagggagtcagggggctcgcgtccgcccacgtccgcccacgcgtcgcccacgcgtccgcccacgcgtcgcccacgcgtccgcccacgcgtccgcaggaaccgagcagaccatcactcactccccaccgccactcgtcagatccacacgccacagcgcgcggcatgggctccctccccctcccctccctcgccgtgctcgcggcgcttctctgcttcctcgccgtcggcggcgccgtggacctcaacaccaccgacccctcccccttcgacgtcgacctgaacgccaccgacgccaccaagtactggggcccctggaccccggccagggcgacttggtacggccagcccaacggcgccggccccgacgacaacggcggtgcctgcggcttcaagcacaccaaccagtacccgttcgcgtccatgacctcctgcggcaaccagccattgttcaaggacggcaaggggtgcggctcatgctacaagatcagatgcaggaaggacatgtcctgctccggcaggacggagacggtgatcatcaccgacatgaactactacccggtggcgcccttccacttcgacctcagcggcacggcgttcggcaggctcgccaagcccggcctcaacgacaggctccgccactccggcatcatcgacatcgagttcacacgggtgccgtgcgagttcccggggctcaagatcaggttccacgtggaggagtactcgaacccggtgtacttcgcggtgctggtggagtacgaggacggcgacggcgacgtggtgcaggtggacctcatggaggccaactccgggtcgtggacgccgatgcgcgagtcatgggggtctatctggcggctggactccggccaccgcctccaggcgcccttctccatgcgcatcaccaacgagtccggcaagacgctggtggccgacaaggtcatcccggccaactgggcgcccagcaccttctaccgttccatcgtccagtacagctgaagctgctgaacgaactcatcatttggaatcatgcatgcattggcttgatttggtatttgtactatcatggatcgttttgcatgggtactactgaggaggtttttgattaaggttaaggttgggtcgtatcgggtgtcatgtaggcgtcgtcgtgcatgtgtgtcttgaatacgtcggtgggatatggaggaggggcacttttgcatgtgcactcccgcgcccaccgtcactgtaccagtgtgtaagcagaccataagttattactgtttgtgtgtactcctgctcctccgtcgacgggtcgcggcacagctctgttttggcgggagttgatgctgttttggcgggagttttcaattaatttctgaatgaatgaacgaacgaatgaattgtgtactacctatcgtgggaaatagaggaggcaccc

SEQ ID NO: 8052 - DNA, 1681 bp, Triticum aestivum
  unsure (1)..(1681): unsure at all n locations
  Clone ID: PAT_TA_8052
gccggccgttctatcggtcgcgcgccccccacccggcttcgcaatccacccacccatccacccccagcagcggccaagaaggagaagaaaaggagaaaaatccccgcgacggcacagccacaggacagggtggaccaacctcccctccggcgccgcgccgcccctcccctccgcccgcgccaggcagaccgccgcctcggaccccaccccctcggccgcggcgcccgggccgcgctggggcgccggcgacaccctccgggccatcccccccaccctggcgcggcccgcaccgacaacagaaaaccccatcccgggacctgcgcgctacccccacggccagcttcgcgtgcgagtgcacgcgacgccgctccgattcgacagacgcagggcagggatggacgccttctactcgacctcgtcggcggcggcgagcggctggggctacgacacgctcaagaacttccgcgagatctcccccgccgtgcagtcccaccccaagctccgtttacctgaccctatgctttgccctggccctcatctgccgtgggtgcttacctgcacactcgcccttgaacatctggtgggatgctgacaattcgcgtgccgtgtatcggctcccgactcgcctggagtgttctctgtgccgagtctatggtgcagcggggagtacggtttgggctgctgatgggatgcaggccgtcctggcaaggggccgcttcagcttgggacctctgattgagcttgccagtagtacgttggacccaagccatcctcgtgacatcgggtttccgcttggaaccggccatcgccatttcgaggatgcgttctctcggcgccgccatcatcgccaagcagcagcgcactacctgtacctcgccctggcctgctctcctcccggcctgccgatcctgctctggctgcagtttcccacgtcccatctttggccacgcctctggcagcttcatgtttgatgtttactttggccacttggcctttctgtgctacgtggtgtacgacacgcagtaagattagctgagaggggcgcactacggtcaacttttgactacttcaagcgcgcgcgcaccttcgtcacgggactttgtcgcctgtcttgcggatccgcgtcctcatcatcatgctcatggtacgcaggcgacaagtcgagaggaggacaagaaaatgaggaaggagtaggtcctgaacgtgttgtcctctggcacatccttagataccatcaccgccgcctccgctacttaggttacctacctccactgctaagtacttgtaggaattaagctggcgcagtaacttgtcgccgtgccacccttgttaattcgcgatctgtgtcgtgtgaaccttgtgtgagtttgctgctgctgatgaagcttttgcagacgctgtctgcgttccggatctcttgcgttcctgttactgtctcgataatcgaaacctgagacgatttggtttggttgcgaagaacatggctacgctcgattgtggctcgtcggttttaaccttgtgatgtgtctcatttcttttgaacaaattgtccaacacatgttggtactgcggccgcccccacgctaaccccttccanctgggtatacaaangccgcacatnncttcaaaaaaccactaagaaaaggccccattcggatacccgggtttgngtaccactacg

SEQ ID NO: 8053 - DNA, 377 bp, Triticum aestivum
  unsure (1)..(377): unsure at all n locations
  Clone ID: PAT_TA_8053
ggggaatggcgttgctcacagnagcacgtccatcgacaaaggggatgagtgtgcctgcacgcttcttgcatgatgctgctggcagcaggatgcatcgctttgcagacccaggcacaccctacgtgacacataataattctggattggcattgtcaccaagatcagcgccggtgaagaagtcgctgttgaacgggtttgtttcgtcttcactcaacagaccagttaggcagtcttcaccaagtaagcttgtgggcaattcatcgaggagaatgtcaagtccatcccgcccaaggaactccatggggacgagtgcgtcaacgtgggatcagcagggaagaaattcgtctggttacggtaggaggtgggttgggggtagt

SEQ ID NO: 8054 - DNA, 683 bp, Triticum aestivum
  Clone ID: PAT_TA_8054
gcgcctctaaaccctagccgccggcgcggcctatattcccctccctccctcctccgcgcgtccctccccgcgctcggggccgggcgagcgagcaagcgagcgcggagcatcccccggcagattcgttcttctgggcaggtgcaacagtcatggatatcactcagattctgctagctgctcagtctccagatggcaaccttcgctcagcagcagaaggcaacatcaagcagttccaggagcagaatcttcccaacttcctcctatccttgtcagtggagttatcaaatgatgaaagaccaccagaatctagaagacttgctggtattatccttaagaattcactggacgcaaaggattctgcaaagaaggagctgctgattcagcaatgggtcagcttggatccgtcaatcaaattgcagattaaggagtcattgctgataacactaggatcttcggtgggtgatgcacggcagacatcatcacaagtcattgcaaagattgcatccattgagataccccgtcgggaatggcaagacctcattgccaaattattgagcaacatgacacagcctggggcctctgcgccactaaagcaagcaactctagaagcattggggtatgtgtgtgaggagattcctcctgagcacttggagcaggatcaagtgaacgctgttctgactgct

SEQ ID NO: 8055 - DNA, 2961 bp, Triticum aestivum
  Clone ID: PAT_TA_8055
ggactaccgcaacctctatgttgtgcaacttctaatatgagggacactgacatctccatgcatcattaagatccttgccatgatagtgactgcacccactcgaatcccttcctctgcgtgcagattgcgctgacggcgagcgtgtcgtacgttgccctgctggcccccggggtgcggctacgcccggcgccaggaggcggcttccttctctccaacctcctcctggaccataggcccgtaacaaccagctgtttggaagggggcactcccaaccgcccccgccaaacgaagagcccgtgatgattgtgggggcgtatcctccaaaattttttcgtttgtagtgtaaacctacctgcagcattcggctggcttgtgccactccccccgtcgcgcgtcataacccttggggcaaaatggtgagcccagccgtgctactaccagatggggaggtattgccagctgtgatctttgggtcggctggcaatacccactttattggaaatataattcatacttgagatttatgcaccatttgcggatgctggacagagctgttgttgcaatctttgtacactgctcctttggtaaattgtacaatcgtttggagtctttggtaggggtttgtacgcatttgtatcgtcgacaattttaagttgttcaaagggtgcagtggcgtttgttgctcctactgaatatatggttcggccaccaatgccgccttcgtatttctttcttattgatgtctcagtatctgcagttcgaagtgggctgctcgaggtagttgcgaagaccatcaaatcatgccttgatgatcttctaggctatccacgaacacaaattggattcttaaccttcgacagcacattgcacttccacaatttcaagtcttctttgagtcagcctcaaatgatggtggttgccgatttggacgatgttttcctgccattgcctgatgatctcttggttaatttggtcgattctagacgtattgtcgagtcctttctcgataacttgcccaatatgtttcaggacaatgtaaatgtagaatctgctcttggtcctgcacttaaagcagcattcatggttatgggtcaaattgggggaaagttgcttgtcttccagagtacattgccatctcttggtattggccgtttgaggcttcgtggagatgatgtccgtgcatatggaacagacaaggagcatattctgaggataccagaagatcccttctataaacagatggctgctgagttcacgaaaaatcagatcgccgtggacatattttctttgagtgacaagtattgtgatatagcttccttaggttctctggcgaaatatactggtggtcaggtgtaccattatccatccttccaggcaactactcacggggagaaacttaaacatgagcttagcagagaccttactcgggagactgcttgggaatctgtaatgcgtatcagatgtggaaaaggggtgcgtttcacaacatatcatggtcatttcatgctaaggtccacagatttgttagctcttccagctgttgactctgataaagcttttgcgatgcaactgtctctagaggagaccctaatgaccacgcagactgtttacttccaagtggcgttgctatatacatcatcttctggtgaacgacgtatcagggtgcatacggcagctgcacctgtggtcacagatcttggtgaaatgtatcgtcaagcagatactggtgccattgtgtcagtgttggctagaatcgctgttgaaaactcactgtctgataagctggacagtgttcgacaacaattacagttaaagcttgtgaaaagtttaaaggaataccggaatctatatgttgtacaacatcggataggagggagactgatatatccagaatcattaagatacttgccattatacatcctggccctatgcaaatcccttgctctgcgtggtggttatgctgacgtctctcttgatgaacgttgcgctgctggtttcagtatgatgatactgcctgcaagaaggctgctcaattttatttatccatctctgtacaggcttgatgaagtattgacagtggaaccagatatgattgatggggccctgaagcggttgccattaaccttgcagtgcctagacactgctggtttatatcttcttgatgatggcttcaccttcctagtatggttgggtaggatgctccagcctgagctcatgaacgacattcttggagtcagcctctcaaacttccctgatctatcaaagattcagttgagagaatgtgacaacaatcactcgagaaacttcatggcagtactaagagccctaagggagagggattcttcatgttaccagctgccccgtgtggtacggcaaggcgagcagccaagagaaggcttcctacttctgtccaacctcgtcgaggatcagatggcaggaacaagcagttacatggactggatactccaaatccaccgccaaacacagagctcgtgatgatgtacggcggatgttccagaaatttttgtttttgtgtaaactgctgcagattcggctgctgtgccagtccccggtcgccctcataaccattggaacaaaaaatggcgagccagccgtgttctacaaatgccatcctgttagcagcagcagcgctctcgctgtcggcgagcaatacaaactttattgttaatatatttcgttcttgtgattatttttcgtgacgagaaaaggatacacagctgttgtaccagaataagtaggcagcacctttggtaaattgtacaagcgtttggagtctttggtaggggtttgtacgcatttgtatcgtcgacaatttttagttgcaaagattgtgtaaactcttgtttgactgttggtactgatctggatgcaatgggaagcacctttttactcaaaaaaaaaaaaaaaaaaaaaaaaaaaaaaaaaaaaaaaaaaaactcg

SEQ ID NO: 8056 - DNA, 768 bp, Triticum aestivum
  Clone ID: PAT_TA_8056
ggggaagttggggtatttggctcaggggatgtcatcgatctccttccgggagggagagatatcgctgtcgatagcaagaacagaggccagtacatcgatctgctgatccaaagtctcttcatggccagcaccaaagaacaactaactcatttcgctaaggggttttcctacatgctcgtaaagccggagttacggaaacttttcttcctgagcttgcatttggaagatcttgacagtatgctgggcgggcgcatcggcaccattgatgtgcaggaatggaaagaatataccagatatgatggggggtacacccaacaagatgatcagatcaactggttctgggaggccgtgacaagcatgatggttgaagagcaacgacgattgctcttcttctggacctccgtcgagtatctgccatttgacggtttccgcgggctagaccttggcagtggtctagtcatatcaaaagcatcatcgaagatctcggagcatctcccttcatcgtccacctgcatttaccaactgaacctaccaatgtatacctccttcgccatgatgttgagccggctacagaagatcacccaggagcatgtgagcaacagcttttggtgagatatgatcttcggtgatgatcttctccgggaaagaactcaaaaggtgttcacatgcatttgcagactaaattaagagtgaatttttgtttttcccctaaattgacagttgtgacattactcatccctttagtataatttcattcggtatatccca

SEQ ID NO: 8057 - DNA, 784 bp, Triticum aestivum
  Clone ID: PAT_TA_8057
attcggcacggggctctaagctagtgagccgtgagcccgtgacaagtttgtttctctcccgtagtcccacactcgaacgagatggctgacgagtacggccgcggcggctacggcaggtccgctgccggcgacgactacgacaacaagaccagcaacgagggctacgaccgccgagaaggtggctacaacaagtccggcgccgacgactacgagcacgagcgcagcagcggccgcggtggctacaacaagtccaccggcgacgacgagtacagcggcgccgggtacaagaagtccggaggcgacaactacgacaccggttacaacaagcagtccagcaacgaggagtacggccgcaacaagcccggcagcgacgactacgaccgcagcgccggcgggtacaagaagtccggcgacgatgagtacagcggtggcgggtacaagaaggcgggtggcgacgacgagtacagcggtggcgggtacaagaagtcggggggcgacgacgagtacagcggcggcgggtacaagaagtccggcggcgacgacacagagtacgggtcgtccagggacgagaccgagaagtacaggaaggaggagaaggagcacaagcacaaggagcacctcggcgagataggcaccctcgcctccggcgccttcgccatgtacgagaagcaccaggtgaagaaggacccggagaacgcgcaccgacacaagatcgaggaggaggtggccgcggtggcggccgtgggcagcggcggttacgcgttccacgagcaccacgagaaga

SEQ ID NO: 8058 - DNA, 663 bp, Triticum aestivum
  Clone ID: PAT_TA_8058
ttcggcacgaggccacgccgtctgatctgtgcgccgccgccttggcttctccgatacggccgccgccggtcgacttggatatacggggtagagcgagcagaccagactgccgcccacctcgctgccgccaacttgtttgacttcctcgtcaactggttggacgatttcttcatggatcagggcgatctccatcgcaggatcagtagaattgttctgaagataagaatcgatgacttatttttgcacggttatgttgctgattgtgacgcacactccgctactgtagtagcctgctcgaaaaatattccggtgtcattggtgaattgcacggtcacattggttttccctgacggaagaaaattttcccctaataagcacgatatcaaaatatgggataatgttgcttcaatacaatgttattttcctggagatgtgcttaatacaaatctcgtgcagtcacttgaagtatgcaggacaccacttttaatgtctgaaaacatttatacctatagtgcatacgaaggtgactacacaggcatcataacccctggttatctcatttcaatacacgagaactatttccaccacaacagttgtgcaaatatatattcaggagatggagcattggtcattaacaaaaatggagaattggttggactgtgt

SEQ ID NO: 8059 - DNA, 826 bp, Triticum aestivum
  Clone ID: PAT_TA_8059
ccttccctttccccacgcccaggcgatcccctcaaatcccccgcaccatccccctctccttcgagcggatccgcccgcccgcccgcctgccgcaccggtcgatcgacgatgacgctgggcagctccggcgccggatcgagcgtcgtcgttcctcggaacttcaggctgctagaagagcttgagcgcggggagaagggcattggagatggaacggtcagctatggaatggatgatgctgatgacatatacatgcggtcatggactggcaccattattggtcctcacaatactgtccatgagggtcgcatctaccagctgaagctgttctgtgacaaggactaccccgagaaggcaccatctgttagatttcattcaagaatcaacatggcttgtgttaatcacgagaccggggcggttgacccgaagaagttcagtgtgctggcgaactggcagcgagagtacactatggaacatgtcttgacccagctgaagaaagatatggcggcgacgcagaaccgcaagctagtgcagcctccagaagggacattcttctagcggggtgttttcctgcccatctccagttccaacagcagcgatctatgtcactcccatgggatttgaaatgtagattcagcgtctgctgcctgcagatcttttcccagttttatgtgaaaccgtgttcctcgcgatctgcccgattgccgttaaggagatggaatgaaacatgtaccggtttggcgatttggtggtactaattaaggtctgtaattgaagaaacaacccgtgtcaaggaaatataatatgtgtttgtgtgtgtccacaagta

SEQ ID NO: 8060 - DNA, 1007 bp, Triticum aestivum
  Clone ID: PAT_TA_8060
ggaggccgcacccgccgcagcttccctttccccacgcccagcctccctttccccacccgccgggcgatcccctccaatcccccgcacgctccccctccccttcgaccggccccgcccgcccgcccgccctccgctcgggtcgatccggcgccgccgcgcgcctcgccggtcggtggaagcttcggcgtgccagggaaggtcgggcagcgagagtagtttgagcgcggagatgaagggtgcattaggagaaggaacgatgcggctaaggaatggattgatgctgatgacatatacatgtggtctatggactggtcactgacttataggctctcacaatactgtccgaagagtgtttgcatctcacaagactaaccctgttctgtgacacacgactaccctgagaaggcaccatctgtaagattccattcagataaatcaacatggcttgcgttaaacacgagaatgtggcgggtgatccaaaacagttcatgttgggtagcaaactgggcagcgggtgtactactcatggaaaatttcttcagccaggtagaacaaagatatggcggtggacgcagcaaccgcaagctgagtgcagcggtggaggacccggacacctccatgctagctggggtctttgctagcccaactctccactttcggggtgtcagctatccatgtccctcctactgagaatttcaaattttgattctggcgtctgctgccgacaggtattttcccggttttacgtgaagcagatttcctcgcaatctgccctaataccggtgtggatatggaatgaaacatgtgccggtttggcgatttgatggaactaattaaggcctgtaatttaagaagtaatacttaaggtactaaaattaatgtaacaacctgtgtcaaggaaatataatatgtgtttgtgtgtgtccaaaaaaaatggtctcgcacctttgtggctccagccgccacatcagatgtataggtttcagatgaacattactccattatta

SEQ ID NO: 8061 - DNA, 498 bp, Triticum aestivum
  unsure (1)..(498): unsure at all n locations
  Clone ID: PAT_TA_8061
gcaaagttcaaaccaggcccatccttgcaaagcatgaggcctcgggtgctgctcgtcgcgtttgccgtcctcgcagcactgcccctcgcccacagccaagtggcgaacccatggccgtcctgcgacaactgtgactcgtgcaccaagtccaactctccggggtgcacgcgttggaattacttaagctcctgggttttttaccgtcgaccaagtgcaagagctgtgtcatgtccgccatcaggccacaagagcttccagtgcacaaaccgcatcaacgatttctgcgagagctgctgcacgccggctgctcagagctttagctccctttgcatctggattgatgcggagaagaaatgaacgttacaataagcgcacaagagcatagtctatgctcagaatcttcagttgaaccttttgtgtagtttgttaaaaaatatcaatccctatgtaagtttggttttaaaagtttcagtatcgtattcacggngaaaaaaaaaa

SEQ ID NO: 8062 - DNA, 664 bp, Triticum aestivum
  Clone ID: PAT_TA_8062
gcatcctcctcgcgtcgtggatgcacacgtcgtcgtcaacatcctcctcgcgtcggggaaggtgcggccgccgttgttcctccgcgcgacctgagatgccgaggccgccgttcttcctccgcacagccagggacgacgcaaacaccgacgcccccgtcctcaactacatcagttcagcagagagatttgcaggtgtagtgatataagtacttctacatgaggggaaaagaacttgccagacaacgcagtgaaataaatgcaggattcttctactccaacactgaacaaggagaaagtatggtttcttccgagagacgtcaagttgatgaacatgtcaataagatcattgaattgaaaataaggttcttagaattttattcatggatcaggaaattctaacctgtgacttggtgaatctaaatcacgaaaataaattgacgatgcatggctaagatgttgactgcatggttaagaatggggctactacaagataataagaatgccatttcaggatcaaaaaaattagaatgacatttttaggatcaatgtttcaaacattatagttgattgcaaggtcaagaattgggctactaatagatatagtttcacctcctgtaatcttggatcatgtcatttgtaatacactatactcaatttaatatat

SEQ ID NO: 8063 - DNA, 766 bp, Triticum aestivum
  unsure (1)..(766): unsure at all n locations
  Clone ID: PAT_TA_8063
tgcaggnaattcggcacgagggtcgagccccttcttctcctcctctccaccgctgtgccatcgatctcatctgcatcggccccaaatccctcgccggagctcactccgtccgctgccgtggctctccacggacatggggcggatttctccacctcccgcccaacctcgtcgcggaaccatcgacgtcggtgagcaggggaggcggccaccgtgagaggaggaagagggggaggaggagcattagggtcgcgcgtcggcacgtccgcgtcgtcactcccacgccgggggacccgtgcggaagcgaagggccgaaggggatgcgcgccggagcggcaggggacgcggggccggctctgttacggtctgtcacaaagggtgaagccatatatctgcacaatgccgttgtagcttgacggcggttggaacaacattcagttgaagctctccgaccggatgaaaagaggaggagctgccgcccgagttcaagctctaccttccagttcttcagatatggtggagggagagaccactgttcgtggcttcccaggaggcaggagccccggtgacatcgacgcgtatcgctgcgacatccattagcgcatagatatgcataaagtatcagaatgtttaattgtacgctagttgttgtctgaattgacctgtgtaaagatgtcgctaactgaacccttgtccagtactgtacctgccggtgcaagtgcgtcgttgcaagcaaatgccatacgggccaccccggtgccgccttcca

SEQ ID NO: 8064 - DNA, 807 bp, Triticum aestivum
  unsure (1)..(807): unsure at all n locations
  Clone ID: PAT_TA_8064
ttcggcacgaggccccccacccgcgccatccaatagctccactcccccggacgcatcttctccgccaattttggaggccgagggtgctcatttttccccagatccgtcccaaagcttcgcgagcggccttgtagcaggcggatccagttggttccgaccccggtgagcctcggaatggcgcgagggacaaacgcacacgccggtgtcacggccaaggggtttgcccgatttgctccagtgggcgtatgagaagaaaagggtggcacttgattccggctggcggaattgcatccggggaagatggatgcttggagttcttcgtcgtcctcttcgtcatatgattttgacatagaggagatgattttggacgacgatgtctacaacctagtgttgttgcatctaatggacaaatttgaaaagggccctaagagaaagcgttgcggatccacggttggccggctttgcattccgcgcaaccgagctcttgcggacaagatggtcatgaaggactacttcgccaagtcgctgcctcggacgagaccatactgactcggtgggaggctacatcaatactgttaggatacgatgacagttacagaaaagaaggtacagcctggagagcaaaaagcaggagttctagatgagacaatgaagggcgagggtggcgcagcttaaatcaattattccttagcatgcttgtctactcagatatttatgatgctgcattctatcgacaaccatctatttctttatatatattttttgtttgtacctagtattatttattgcaaccanatcaaggctttg

SEQ ID NO: 8065 - DNA, 991 bp, Triticum aestivum
  unsure (1)..(991): unsure at all n locations
  Clone ID: PAT_TA_8065
gcccggggcttcggcccgtgggtccgtttgggcagcgggtgcatcggctggccctcgccacccccgtctcctcctccttcttcttcgtcgtcgtcgtcctcctcctcctcagtgaagtctcactcgccgccgccgacgccgatggggacaaccccaaggtcaagacgttgtgcgccggcacgcccttcccggagctctgcgcctccatgatcacgcgcgacaacgagaacgtaagcgcaaacgacgagagccttgtggggatggcggccctcacctccgccaagctccttcttaacgcgacggccaccgcgagcccggcggtccagagggacagccacccgggcatgagcgacgcccacccgggccgctgcgaggccggcgtcatcggcctggccaccgccgcccagacactcgacaagctgtgcacgagcaaggtgcagctcccccaaatcgacaacttcatcaagttcaacgaggagtcgcatgtcgagtggaattgcgagcggggtcgccggggggaagccaagaacatcgccgacgatgtctccaaggacaacgaggccgggaaggccatggctgtcctggaggcgctcgtcaacaaagtactaaccaaataaaagaaaagaataactcattgagtactagctgttgctccctgtgtgcttgctttccttttctgtcttctgggcatcttattcggtcccttgggcatcttattggtttccctggcgtgctatgcccactgctatttgcgcgcgtgctatgcgcacggcgatttgggggcagatttattgcacgttgttattatgtaagatgcacatttcttctttttcttgtgggtagcacaaacgtttatttttttcttgaaagaaatagtctttgatatctggtataatgttaattgcatgctaaacttcttgagcactcagagttggagtaatatggtcattggattgacatgttttgaggttaagattaatnaatttgcccc

SEQ ID NO: 8066 - DNA, 1835 bp, Triticum aestivum
  unsure (1)..(1835): unsure at all n locations
  Clone ID: PAT_TA_8066
ggaaggatctctcattggcactagtcaggtagaggtagacagcatggcccaaatacaaaaaatgccttcttttgaagtttcaagtgataaaagccacaaggcaatgggatgctggcgcatccagtttccatggagcaggagcagcattcaagcactgtccggaagttcacaagttacgcgtgggatgagagggaaagatggatttggagttcatttcatgagtctcaactggcttacaagaagaacattcaattaggaagtttggagaaatttgaacttgttaaccgttcttctccatcttatctatctcccctgtttgtaaaacatgaaaaggtatactctcctcaattcacagttggcccggttggtaatattctgtgtgtattggagcatgaggtttctagcataatagcttgtgctcttgccatatctgaggagcgtcggcaggataccacagtcgtgaatgaggcggaggatgccaggagggagcatactaaaacaatggagaaatcttatagctttctatctgaaagttctattggctcatcaccatggtcatctatagattctgaagcaagcatttcatcttctatttcgtcatattcatctggcgacctttctggttatgatacatcgcctttattatccttggtgcatccagaaatccctgtgaacggaaaagtatctctcagaggcaaatattcagttactagtatatatgctaatcaattctacatccttcgaagaaagtgctgcccatctgagcttgcatatattacttcattaagccgatgtaagaagtgggatgctcaaggtggaaagagtaaagctttatttgcgaagacattggatgacaggttcattataaagcaaatcaagaagacagaatttgaatccttcataaaatttgcccctgattacttcaagcatgtttaccattccttagacactggaagccaaacttgccttgccaagtaaccaggaatctatcaggttaagcagatgaggcatggcaatggggaacttcaggatctgatagccctgacactgtttacttggatcgaactttgtggaggacatgaatgtatctccaatctatattggtggaagaacaaaacatctcttgcagcgcgcaatctggaatgacacatcttttctcacttcggttaacgttatggactattctctgcttgtcggagtggacaaacaaaagaatgaacttgtgtttggcattattgattatttgaggcaatatacttgggacaagcaactggagacatgggcgaagtcttctttggtaccaaagaatgttttaccaactgtaatttctcccaaggattacaagaaaaggtttagaaagttcatgggcaagtactttctcgcagttccagatacttggagtcctgagaattcttctgggccatacaaatcctttggtcatagcaataacaagttggcagaagcccacaatggcgataacctgcttcagcatccaattgaggctgatgcaagaatctagttctgttcagctgaggcatgtgcctaattctgtccggactcctctgacagttctttgaagcctatccgtttgtggttgttgttgttgttattggctaagtttcgctttgtaaaatggtgtgcatatgaaggtctcactattgatctttccagaagtttgcaatttttaggcagattgctggggcaagtgaagtccacagtacatgtacctatacaaatgaaaattgtgaatttcacaattattatagtgaaatttacaaaattgatatgattatttttggacctaaaaaaaaaaaaaaaaaaaaaaaaaaaaannn

SEQ ID NO: 8067 - DNA, 1184 bp, Triticum aestivum
  Clone ID: PAT_TA_8067
atatggctggactccacccgcaacaaatttgggttaatgtggagttcgatggtttttatagggatcacaatttagatatcgaagattacctattaaaattaccaaaagattatcctattgcctacatatcctcgccagatatttcattcttgaaaagtattggtggaaagcttaagggcagggctaagctgatttttcggtgtctcgctgataatgttaccgagacaagcgtcaagaaatcatatggagaaatattgaaagatctgaaatccatcaaggcttttgcatcaggaattatggtccccaggaattatgtttggccagtgaataacaatctgtacttgctcccacctaccagtttggtcaaagatgcacatgcccttgggctggaagtgcatgtaggatcgtttgccaatgatatccttacgagttacaactacagctatgatcctgccgcggaatacttgcagttcataaacaacccagacttcactgtagatggtttgatgactgacttcccgcccactgcatcaggagctgtcgcgtgcttggcacataatgaagcaaatgctcttgcggcattcggcgcgaggccccccattataacgcacaatggcgcaagtggcgtctacgcaggctgcacggaccttgcctaccaacaagcagtgaaagatggtgccgacataatagattgctcggttcggatgtcaaaagacggtgtggccttttgcctgggctctgcagatctcattgccagcacgacggcagcaaccactttcatgacaaaagttgttactatcagtgaaatacagagtaaatcaggcattttctcgtttgatctttcatggagcgagatccaaagcttgaaacccgagcttactggtccatttgctcaggcaggcctgaaaagaaatcctgcagcgaagaatgctggcaaattctttactttgcccgaattccttgactttgccaaaagtagcaatgtctctggtatactgatcgagatagaggatgctccataccttgcaaccagaggtcttggcctggtagatgcagtctctggtgcactggtcaatgccagctacgacaaggagagcaagcagcaagtgttcatcgagtcagacgactcctctgtactttcagcattcaagaagttcccatcgtttaagcgtgttctcactgtt

SEQ ID NO: 8068 - DNA, 714 bp, Triticum aestivum
  Clone ID: PAT_TA_8068
gcaaaaggtcgaaaaccctagccgccagcccttctcgtccaccccacgccctccgcctcccctcctccccactccctcccctcccacgccgaacgccctcaatacgccgccaggccgtcgacacgccgggaataggcagcgatggagcgcagcccgagcccagcagaagtccactcctaatcctaacaagagcgggcagcggattggatcgaggaagccctcgtggccacgccgccagcgccttgatttgctagccgtcatgtggagtcgccctagccgccgcctatatcaccgttgtgggtcaacctcaccgctgccgccaggaatcccatcccggcaagatttcaacagattcatacgactctgaatgttgttctgtaactgatgactcaaaatgagcgtacactgaaactgaagcctttggaagttgagacagaaaccttacttgagagcaggcagaggcgcagagccagcggtatgctcttggatcaatattctacaggttaaacaacattcatatgttctagcatctatagatttacatttgctttttaacagtctaattctccatgtaaaaactgcatccattttgttattgtgatactgcaagtgtaaattaaggaattagcctttatggtctagcttcggtatctgtaaatcatgggtatgtacatactacataaaaatggagcatccttatgctaccaaattatt

SEQ ID NO: 8069 - DNA, 1164 bp, Triticum aestivum
  Clone ID: PAT_TA_8069
gcccgcctctcccctttccccccccggcccctccccccccccccgccccgccccacgccgcccaagccctacgcgctcgtcgccaccgtcctcgcctccacctgcacccgggatgtacgccgacagggtctccggacggaagcgctccgtcggggaccccctcggcgcgggaggcggcggccgaggccctcgcccgcggccgggctccgcgaaaacgttgcgccaggttgatggggcttggaggcgtgcgctctacaaggattctgtaggaacccaaagttcatctgtacctgcttccagaaatcttcaagcaatccaaaaatcacatatgaggcaaagcactgtggatgtgaagaaatcatcagttccagatcttcgcgaaaagttatctggaggccagcgccctcaactcagtcgcacaggtcgcatcccactgccggtggctagacctcttcagttccagctcttcccggctgctgctgcggctgctgttgctgcccgtcctgtcactgaacaagtaaatgcaccagctgcgccaaagcaatcccacgaaaaggctgatgcctcacttgacagattgctgaagtctcttgatctggagaagtattctataaatttccaggctgaagaggttgatatgaaagcattggttcacatgaatgaggaagatatgaagtcactaggaattccaatgggccctcggaagaagatactatcagcactggcttcgaaaagaaagaagtcctcaagatcattaccgcctaccagctgaatgcatcttaagccgtggttagttagacgacttgtcatcttggggagtaacttaaggcgagccagattcctacctacctagactatgtataaatatagaactccatgatctcggggcggcgttggccggcgtgagttcgaccacttctcggctgggcggctccctctgggcccgccagtttccggccgcccgtgtccctgtataaatatagaactccatgatctcggggtgggtgttgtaatgcaagataactaacagttcatgggagagctgctccatctgtgacctagaatattttggatgctagtttaccaggcctttgggagtgttccccgtttttcggttgttcggtttctccccttttccgtaaacctaaaaaaaaaaaaaaaaaa

SEQ ID NO: 8070 - DNA, 1071 bp, Triticum aestivum
  unsure (1)..(1071): unsure at all n locations
  Clone ID: PAT_TA_8070
attcggcacgagagctcgaatacactgatgctaaagagagcctcttgcaagcagcacggaaagcacccactgcagctcgtggattccgcatccaatgcaacaaatgggctatactagtaaggctacttttaggggagataccagagagaactgttttcatgcagaaaggaatgaaggcggctttgacaccatattttgagcttacaaatgctgttcgagttggggacttagaagtgtttagagctgttgcagagaaatttgggagcattttcagtgccgacaggacatccaatttgattgtgaggctgcgccacaacgtcatccggactggactgcgcaacattagcatttcctactcacgtatctcccttgctgacattgccaagaaactgaggctagatactaagactgctgttgctgatgctgagagcattgtagccaacgccatcacagatggggcaattgatgccaccatcgatcatgccaatggttgggtggtgtccaaagagactggcgacgtgtactcaacaaacgagccacaggctgcgttcaactccaggattgcgttctgcctgaacatgcacaacgaggcagtcaaggctctgaggttccccccgaattctcacaaggaaaaggagagtgcagagaagaggcgtgagagactccagcaggaggaagaacttgcaaaacacatggccgaggaggacgatgatgacttctagattccctcctccatgctttcaaggtgctgcctgttcttttacgaaagaagctggtactacccggtccatttcaggggccgcagtccaatatccctgcanggggacaatctgaatgattactcggtgcggttttttatgttcgtaggaagcaccttatttttcactgcaaattcttatatcactacaaattggtaggaagtgccttatttttccatgagatactgtaatcgaggaactgagagagcttgtcggaaactgttttgcactgcatcctgtgtttgctttgtgggaagctgattgaggactagttccatgtgctgccccatttgcgatgtacgtgattcatcat

SEQ ID NO: 8071 - DNA, 1000 bp, Triticum aestivum
  Clone ID: PAT_TA_8071
gttggtgctggcatgcttgtgggtcgagcgacgacccctcgcgccattgctgcctcccatgcgactggtgccgctccctctctggctcctcgggccggggggcgtcgtgctggtcttggcattcttcctggccccacggcgccggcgcacgccccaacagccacccaaaagactgttgatggtccttcaatgaaagattggagaggaggacgtggtgctggtcaaaacataattcctagctccactggtgcagcaaaggctgttgggaaagtcctccctgagttaaatggaaagcttaccggcatggctttccgagttccaacaccaaatgtctctgtggtcgacttgacctgccggcttgagaaaagtgcctcttatgatgatgtgaaagcagccatcaaggcggcatcagagggtgcactgaaaggcattttaggctacacagatgaggatgtggtatccaacgattttgttggtgacacaaggtcaagtatatttgatgctaatgctggcatggggctgagctcttccttcatgaagctcgtgtcgtggtacgacaacgagtggggctacagcaaccgggttcttgatctgatcgcccacatggctcttgtcaccgccaagcactgatcagccacgagtgctactaataggctgcaattttgccggttcttttcttttcagtatttattattgcctttgttgtgccttttgagcacaagcagaaatgggtactcggatccatgacttgcttgtagcagtggacgaaatttacaccgtagcgttatgagcacgtcgtgggatttgtttgagcgaatctcatttgtatcggtggtttgatttgttgctaaagaaagaaatcacaaattgttccctttgggcatctcatgtatgatttcttcatattctgtttcctcaacttgtatgaatttacccaagtttgactcccacgtcatctgaacctattgttgcgaacatttttttttgagattcaatgcaa

SEQ ID NO: 8072 - DNA, 886 bp, Triticum aestivum
  Clone ID: PAT_TA_8072
gcctccggtacggaaccgcagtttcgacccacgcgtacgcccacgcgttcctccccgcttctgactctctgacgactcgctagctagctcctccggcccaacggaagctagcgatcgccatagcctctgcgactgccagcacccgcactcgaacaagaagaagaagaagaatccgaagcagaagcagaattattagaggcgcaaaggcttgcgtgcggtctcaaggaaccacgaaaaggccgagaagaaaagaggataaaaggtagatagttgagtagtattgcacgcgtccatgggttgcgggctgtcgacgccggacaacgatggcggcgtgcatcgatggcgcgcggaggaaacaggggagcgtcggcgatgtcgtcgtcttcgcgccgggcctccggggcgcccatgggcgtggacttgttccctcccctggcgctccgcgggcgcacaatggcccttgggacgttgtcccaagtgctccgcgcgtggccggcctagcgcgccgtggagaggctgtcgcccctgagaccccgcgtcctcgacatgccaatccaagaacccgcactgctcaccaaccccaggctctcgcccgctgcctgccagggctcttgcaatgccactctcacgcaggcgccttgagcctccgcgccccttttgttaggactaaccaaaaacccccgcccgttgaggcgcccagggcggttgctgggtacgaggtgctgtccgtgctgcatttgatggccatggtctgcttgctgcaggccaactccctgctccttccaagggcttacggcgacggttacgggccacgggtctctgaagagagcagacgtgcaactgtcgatgttttcttgaaagcatctggctacttggactgcgcaat

SEQ ID NO: 8073 - DNA, 674 bp, Triticum aestivum
  unsure (1)..(674): unsure at all n locations
  Clone ID: PAT_TA_8073
cacgaggggagaatctctctccttactcagggatttctttatcttcgaggcgaggcatattcatatgtcgaagaagggggaagtgtctccatttacgctcatagaacccggaaaaaagaatataccgtcgtttaaggaccaaggatgcgatgtgagaagcgtaggtcggagtagcaggagtatgcgacaagcagttgcatgtttgatgtgggtctgtaacgagatgaattagaacacttggaatcctcgcggatatagctgccacgagggctctttcccacttaatagattcattccttcgttacggcggttgagggtaccctgccgttcagagatgctatcagagtaggaaagttagccaagttatcctgcctagtttagataaagcaccccgatcataccagacgcaacccgatcattgtatacataacatagttgaatttgagtaaattctctctgcctttcccatttccaattcaaaaaccactaggcatagaaggaaatctttcccggtagaaggttctcagtaatcagcagtgggaataagcccttccagtctttttcgcctaagaaggttttggaggaggaacctatgggaacggcagtcctgcatcgagattattagttgcttaccgctgcacattttatcaagatcaacctgnggaatagccgtc

SEQ ID NO: 8074 - DNA, 821 bp, Triticum aestivum
  unsure (1)..(821): unsure at all n locations
  Clone ID: PAT_TA_8074
ggnctgcaggnaattcggcacgaggaaatctctcctccatcccctttctttctctctcccgacgcatctcgccggtcgccgcagctccggcccctctgcctcacgcccaggaaccacatcgccccacgaatcacgacaccatgccggcgcgtgcgtgcatcggttgtacgatgcgcagcgatccatcgagctcgcctccctgcgtcttggccgacggaggggagagccgaccagggtcctacgccgctgaccatcccggttttcttcgcatccaaagaggagcaggggtcgtgcctgggaaggatagctccagcactagtagaaaacggtccatttgtcccggttccagagggtctttagtcccggttctggaaccgggacaaaagggtcgggactaaagcccaaaccctttagtcccggttcgcttaccaaccgggacagaaggggctccacgtggccactgtggggcgcccaggcaggaggcatccacgcgtcagcagctggcaggagctgaggtttttgtttttttcaaaggggtgggtttagggggttttggggcttaattttgggtgctagctagctaatagagagatgtgtcctctcttatctccgtgcttggtcgatgctagctactatacgcatagagagaactcgacacgctagctagtaagcaaatgaaggaatcattaattacaagatcgccatgaacatatacagagaggagtgacctctctttctccgagagattggtcgaacaacaagtttttgtatatctatccgacgctactaggtacatatatacaatataagnncnctcacaa

SEQ ID NO: 8075 - DNA, 796 bp, Triticum aestivum
  Clone ID: PAT_TA_8075
gaggagacgagccggcggcgcatactctgtttccaggttgaggcgacggcggcgccccggcccgcgcttcgccctcaccgacggcgactccggctgcagctcctccgcggcggcggccgcccccggtctagccgtcccccccggcggcgggctgtcccctcccgcagcatcgtccttcctcaccagcacggactgggggtaccacctgcttgtggtccaagactactcgcgcaccaagcaagccactcccaccggcgagtggatcagctctcgtcctttcatggtaggaggccataaatggtgcatcgactactttcctaacggctacacggagagttgtgccaacttcatttctctatttgttaaccttctcgatgacgacgctgaagagcctgtgaaggggaagttcaatgtcagtttcatcgacgaggcggagaagcacaagccaatgtacatttcggactgaagcattcaatttccactctgagtccatgctgggctacaacatgttcatggaaaaagatgtccttgaacaatcatcgcatctaatgaatgattgtttcaccatccggtgtgacatcatgttgttcagctccaaggatgccggtggcgataaggtgctcatgtctgaaatagaccaacatttgaacaatctccttcaaactaaggtgggtgctgatgtgacattcgaggtcagcggcgagatgttcgctgcgcaccgatgtgtgcttgccagcccggtctaaagtcttcatggcacaactctttggccccatgaaggagggcactactacat

SEQ ID NO: 8076 - DNA, 529 bp, Triticum aestivum
  Clone ID: PAT_TA_8076
gctgcttcctcctttctctctcctctcttccccacgtagagagagagagggaaagagaggaaggctccccactgtcccctctttcctaccaagaaccacatttcgccctccaatcttcgctgcggattctagcacaccttttgatcggtttttctccagagtctcagtttgggcaatttggagcttcctgggcaagtttccgcgctgatatttgtcttccttctgaaacaaaggttgcatctttcttgcattggcactcccaatcccgcatctttcaacaagttgtgtcatttgggtgccttggtgttgccgagacgtactgtaggttttctcaagctaaatgttgcatatgaattttgatgaacattgatcaccaatggctgcgaaaactggtgtgaggtctcaagacttctcgcagcggttctggtacaccttgtcccgtgcgatctgtgagctctgcgtgatcatattgctccatgtggctgctacaacgtcatatgtggccacaaggttggcacacatcagcagg

SEQ ID NO: 8077 - DNA, 466 bp, Triticum aestivum
  Clone ID: PAT_TA_8077
caaaaaaggagaatccagcatcagacgacggcgggtccacgggaattaagggactgcttgagtccccgagatcatattatgcattgtctggtggagctggaaaagccgtgtcaacaggaagcaagattgcgctggagagtccaaggacggcggagaagccatcggcaggcgacatcgtgtcgatggtgatgaagaggaggcgtgcgatgccaaggagcgaccaacagccctctgaagctgggcgcgtaaaagcttctggtgggatttttggatacatgcgagaatccagtggtaaacaagagaaggagaaggagggcctggcatcatctggggagggggagaaaacacagagcaaagaaggtgtggtggtggcggctgcttcagggggtggtgaggaaactggggttgctgcagatgcgccggtttctgcagagcaggcaaaagcgggtggtgctgctgttgttgt

SEQ ID NO: 8078 - DNA, 1785 bp, Triticum aestivum
  Clone ID: PAT_TA_8078
cttctcttcacacaggacgaacaagaaccctaatccccaaatcctccagcccactctcagatcttgggacctgatccctaaatcggaccatggatcgactatgcggaagcatggcttgagatcctgtcgatcccggatgtggcgggcagcggcgacgaagcggcggcggtctggaagctcgccggcaggacaggaaaagagcagcggcgtctgacttactagccgtcagccgtagaaccgccgttgatagccacttccattgtggccgctccctgcttcagtagactgattggcttgcacacagatgaaccgctccaagaacggggcaacctccgttgctgaccttacagatgaccttatcatcgagattctgtccctgctgccagtcaagtcagtgtgccgattcaagtgtgtctcccggctctggtacagcctcatctcccaccctgaacaccgcaaaaggcttccccagaccatctccggcttcttctaccccaagcacagactcaatgatgagtatgatgtgataacatttcccacctctgatggcgtcccaagggatcaagagcagctattccctgattcctcgttgcccttcttgacgggatacaggcagattttgccaaaggactgctgcaatggccttattttctgcctctgctggaaggactccccaatagacgaagccgattatgtggtatgcaatcctgccaccgaggaatgggtagtcctgcctgatgctggccatagaagtgatgcaatagcataccgtttgggtttcgatggagccatgtcactccacttccatgtgttccagatcctagaggatgatgaggactatggatatatctcaggtgttaatatctactcatcagagacaggagcctggagttacaaggaaaatggttggggcgacaatgagattcagatagttgacatgagaggtgtctttttcaatggaatgatgcacttgctcacatgtgagtttaagatactagcagttgacacggaaggcaagacatggaggaccatttctttgcttgaaaccatgtgtgttggaaacatttgtttaggtcctctggcttttattggtcaatctcaagggcgattgtattttataaatatgagagacaacgatagctccaaattatcagtctggattcttgaggactataatggtaatgaatggatctttaagtacaacatcagcacttcacaactttttggggagctttttggggagaaggatgtcatgttacaacgggactatgctgatctcttgttgcaaagggactatgctttgatcgcaatccatcctgaatgcaatttgatattctttgtttggaggtgcgaggatgtgttactgtcatatgacatggaccgtggtaaagctcgtgttatctgcagtctaaaagagcactcgtatcacacatttcctccatatcttccctatgttccatctttctcacgcattggcagaccaagagtggaagcctgactccagggtggaggctgacagttgttaccgacaattatatggaatcttttacaagtgttggaccttcagttatcacaactaaaccatagggctacagctttgctatagctctccaatgactcctctttttttttacccctgcaggttttgctttttctttgatttagtcctgatatatctattaaatactttcagtcattagatcctgtaagttgacttgactttgattattcaccaagtctgcttgttttggactagcctgattatatgtgctagtcattggtttc

SEQ ID NO: 8079 - DNA, 704 bp, Triticum aestivum
  unsure (1)..(704): unsure at all n locations
  Clone ID: PAT_TA_8079
gcgccaccgttgcancagcaatggnctacagtactgaagatgagcaccaacacggccatggctatggcgacggtgacgacgcggcggagtggaagaaggtggcggagctgagggccgtcgtcgaggcccaggaccccgctgccaaggaggaggatgacttttcgctgcgacgattcctgcgtgcccgggnaccacaacatcggcaaggcgtcggccatgctcctccagtacctttcctggaggcgtgttgccaagccccatggctccatctcggccgacgaggtgcgcgaacgagatttgcaaaggataagagtccgcatgcaagggcttcgaaccgtctcaatccgccccatggcgtatctcctattgggggcacgacaatttcccctgccccgggcgtgaccctgtcgagttcaagcgctatgtcacctatgtccttgataaaatttgcactaggttgcctgtggggcaagagaagtttgcagcggtgatagacatgaaggggtggggatatgcgaattgtgacatccggggttacgtggcggcattggaaatcatgcagggctactacccggagcgccttggccgggtgttcctgatccacgtgccctacatgttcatggcggcatggaagatggtgtacccgttcattgacgaccgaacccgaaagaagtttgtgtttgtcactgataaggacctcaaat

SEQ ID NO: 8080 - DNA, 701 bp, Triticum aestivum
  unsure (1)..(701): unsure at all n locations
  Clone ID: PAT_TA_8080
tagcgtggtcgcggccgaggtactgtgccacaactgtgaattttgcaatcctgctatagcctaatttgaggtgatttatatgccaggttatcctaatctttatgtttctgatgctaatgccttctcgcgcgcttccaccggtttgcttttccctgtatgtgcactcatgtggctgaagactgacttttgcactcatcgggttcctgtcttccttggattccttccatgttttggcccaccctctctgtttgctgcctcttctgactccttgcatgttgtttcggggtcccgtcttggtggactgttcaactcctcctctccttgggtatggggttgcacgcccctccggcgcctcgcgcgatatgggccccgggttctggggtcgcccccggccccccctatctcaggcccccccccgtcgacatctacaggcatgttgaattgttgacccgatttgacggactatataagtgctcttctccttgggaatttgaaagcacgccccttctaagcatcgcacaatatataggcttatatacgtggtagcagtcattttacaagcatgtgtgcattagaccagaaaaggggtaaattgcctttgatactgatctggtaccccctataagcgtatgatattaaataggtttctatttattcatcaacagagaatttatgtcaatnnatttaatgtcgnatataag

SEQ ID NO: 8081 - DNA, 492 bp, Triticum aestivum
  unsure (1)..(492): unsure at all n locations
  Clone ID: PAT_TA_8081
gcaagcatggnaacgacctcgcctgaggtggctaggaaatctttgctcgccttcacacttatgatacccgaggcgcagcgcttccactccatcggcaacaaaatgaagactgactggataaaatcgagccacctcacggaggatcaggtaaagctcatttttgtgtggcgggttctctcggccctttggtgccgtggggacaacccccctgatggcgaatggagcaaagccaaggacaagctcaaggctctcaatatcaagagccgagctgacgtgtcgcgagccctcgacatggtcaagaacgagggccgctgctccgacctcaggaaagagaagccacccgcatgagtttgtggaacactgggtcgtattgatgatgtaacacgactagcatttgcctacctgcgtggttaatactaaaataaaataaagtactccatgtgtgtgcgtgtctgtacactgggtcatcatgtaaagcatgaaanattgaga

SEQ ID NO: 8082 - DNA, 725 bp, Triticum aestivum
  unsure (1)..(725): unsure at all n locations
  Clone ID: PAT_TA_8082
ttcggcacgaggattttggttcnatggggtgtttgtgcccctcaaaaaggattaatgaggttgaacttgacgaagtgtgtccatggacagtgtcatttcaatattctccatctctagaactcatcatttccagaacttctagaactggtggtggaatttagaaatatgctcacagaaagcccattgtggtcagaacttcttctccagtggcttagggctcttgaaaggttacttctaagtttggtggctacactgggtggttggatttggaaatttacttaaaaaagttcattatggttagaatttctctccattggctcaaggtacaacaaattatggaaatccacccgcccgaggaactggctgccggtgccccacatcgaagcatgcctgccgcgccacgtgtctcgctcgtcagccgccaacccaccctagccgccaccgtcccagagcgaagcatccgcgccccgtcacctatcttcctcactagctgttggcctccattgcggtcttggcgatgatcccgctgttgtttccaggagctggctgtcagtgcccctacttgccgattttgaacggcgcctctgccgctgcttggtgggtcggttcttgctctgttccatgcttgtcgacatcatgtgattttgcttggttccctgatgagtaacaatagatgaggaacatgaaaatataatcatatgtcaaatatgttnnactacttttag

SEQ ID NO: 8083 - DNA, 801 bp, Triticum aestivum
  unsure (1)..(801): unsure at all n locations
  Clone ID: PAT_TA_8083
gcgtccgcaacaccgatgtactcatagggtggcattcgtgtttgcccccattgttgtactttggctcttgagcattggttccgctcgtcgctataatatcatccactggaaccccagnagtatgtcttgccctttccccgcattatattgtgaagttcttcaagataacaggaagagatggttggatttctctaggaggagtacttcttgccgtgacaggcactgaagctatgtttgccgatcttggccacttcactgctgcatccatcaggctggcttttgttggtgtcatatatccctgtcttgttctgcaatacatggggcaggctgcgtttctttccaagaacatgtctgatgtacatgacagtttttacctatcaattccacgtactgtgttttggcccatgtttgtcctggcatctcttgctgcaattgtgggcagccaatcaattatatctgcaaccttctccattgtcaagcagtgcctttctttgggatgctttccacgggtgaaagttgtgcatacatcaaggtggatctatggacagatttacatacctgagataaattggattctgatggtcctttgtttagctgtcacagttggcttccgtgacataaacattataggaaatgcttatggtcttgcgtgcatcactgtgatgtttgttacgacatggctgatggcactggtcatcatatatgtgtggaaaaagaatatcctgcttgccttgtcgttcctcatattcttcgggttaattgagggcgcatatctttctgcatcattcataaaggttcctc

SEQ ID NO: 8084 - DNA, 277 bp, Triticum aestivum
  Clone ID: PAT_TA_8084
gcttgcatattgcgtcaatcatggcgatgaagaaattctcgttgttcatgaagaaatgtatgtatagcttgtgggttcaccagtctatataaattctcaatgcaacctctctcgaagtgtcagctttgctcgttcattttaacatcatgcagtgtacagtgatattccgttgactccttagaagaagagacgatatgttgttgtgtccatgtacttttgaacttgatctatcatatttgaaataataaatataacaaattcagatgtaaaaaaaaaa

SEQ ID NO: 8085 - DNA, 2397 bp, Triticum aestivum
  Clone ID: PAT_TA_8085
cacacattgtgttcagatatagcatcctgaccattatggacagggctgatcccatgaactctccccggtgcttgtttggataacaagcgtcggtgaaaaggcgtatgtcgctggaggcaccgatgcttctggaaacgggtgaggctgagctctgccgagatgtaggcctatgagacaggcgagggaggggacgaggactacaagataggccacagaaggggcgcgcgaggggcagcggcagagggctgcagcagggccagaagcattagaaggggcagttgtaaccaagtggcagcagtagatagagccatccatctatctctctctacagatcgcggctaggagatcagcgagcacgcccagatttctccctttccggatcaatcttatccgagaggataataagccgtcgtccgggagcagcgagcaaagggagggggaggagaagccatgctgctggagggcaaatcctgcctcgtctcgcgctccctgcccagctactgcgacccggactccgactgggcgttcctcctcagcggcaccaagcgctccgcgccggaggacttcggcgcggaggacatggaggaggtagacgccggcggcagcagcgggaagcgcagcaagtcgccttccccgcagccgcacacgccggacatcaccgagagccacggctccagccgccatgcctcctcagggcagcggcggacgggaacagcaaggctgtggggccaatctcattggcgagcttggagcggccctctccgtcaaccgcctgctccggctcccccgggcggcctgccgccccggcccgtcccggaggggcgtcaaagcccctggtgcgccaacggcgagatccaccgacctgcgacggcagcatctcttcgccgagcgcctcctctggctctcctggagggtcctggagtcggacgcctatgaccactctaattagcgctggatgcagcgccccctccagcaaccgcctgctcccgccctgcgctctgacatggagccccgggccctccccccccagcggcttctgctccggggggcgcaccggggctacagacagcgcgcgctggccgattcgtggccccgggctgtgcccctacttctcctgcaatgtcctggtggggcatgcctatgacccctacagggggcgctcgatccaggtgcccaagatgccaccggatgaatgcttcatgtgctctgatatgactctgtgacacacacttggacaccccttcccagcatgaatagggctaggaagatgtgttctggtgtgttcttggatggcaagttctatgtgatcggtggtgttaccaacaacaaccaggtactgacatgtggtgaggaatatgacttgaatcgggggtcgtggagggtcattgagaacatgtctgagggcctcaatggagtgaccggtgctcctccactcattgcagttgtcaacaatcagctttatgcggctgattacagtgagaaggatgtgaagaagtatgacaagctgaataataagtggatcgctcttgggaaattgcccgaacggtctgtgtcaatgaatggatggggccttgctttccgagcctgtggtgaccggctgattgtcattggaggcccaaggacttctattggtggcatcattgagcttaattcatgggttcccgatgggcaaccgcctgtgtggaatttggttgccacacggcaatccgggaacttcgtgtataactgcgccgtgatgggttgctgagtccactgaataaagattggatgcagtggatatttatgaaggatgatagtatgcacaaaggcagcccgttcaattgctccagccctgatcttgtagcgatttatgccttctgcccagttaactggactgtgtcggatttggttcacacacggcaatccgggaacttcgtgtataactgcgccgtgatgggttgctgagtccactgaataaatgattggatgcagtggatatttatgaaggatgatagtatgcacaaaggcagcctgttcaattgctccagccctgattcttcgtagggatttatgccttctgcccagttaactggacatctgctgagcggcagcactcatgtaacccttgagttctaatacttctgttttccttgctaatccatttctacatttgcaatttggatcaacagctcgtgatttcaaagatacgagactatgcaaaaacagtgttatattaataatctagaaacaacttccagaatgctcgcctttcactgttgatgatgaacaacctgttaagcaatacttgatttatctttggctgcaactagagcatgtttatcaattcactgctatgtttcttattcatccagcttgcttcatgatacgcttttcggtggaaaaaagtgtttccggtgg

SEQ ID NO: 8086 - DNA, 651 bp, Triticum aestivum
  unsure (1)..(651): unsure at all n locations
  Clone ID: PAT_TA_8086
ccggctcgagggcttgatccagtaccccttctcctccttcggatcgaggccacacacaccactgagctcctcctcctcctcccccttcctccccacgcgctcaacgccaggtcatgcagggagcgcacacgcaggggccttagtggctgttatcgccgccaccacacccgggcgttgtcgcgccaccgccgcctccgcctccctcctagttcgtcggccgttggtgcccgccctcctgcgtctggcaccgccaccccctctctggctcacctccatgcgtgagggcaacgacggtagcgcccgacgtccaccgtcctaggcccgtccctcgccgacgggagagtattggtctgcggattgtaacctcctattacagaggaactttttattcctcccgtcccccccgccgcgtgcgggttggtctgcagattgtacctcctattacagagaattttancggnggatcatcttcactnctggataatcttgctcnatggctcctgctatgactgtgatgaanaggtgcgattaaaantncantagttaagacagtaacnaggggcgtcagagggcgcgacggatagagccnngaccgcaatagatacncataacatatcnnagnagttaggtactcnatcggaataccgnaca

SEQ ID NO: 8087 - DNA, 619 bp, Triticum aestivum
  unsure (1)..(619): unsure at all n locations
  Clone ID: PAT_TA_8087
ggtgaacaacagnaataccatcggtcttcagtaagacctacgtcacacctcgccgtccttatgaaaaggcgcgtctcgatcaggaattgatcaccctcggagagttcggtctccgtaacaagcgtgaagtatggagggttaaatacactttggccaagatccgaaaggctgcccgagaactcctcacccttgaagaaaaggatcagcgccgtttgttcgaaggtaatgccttgctccggcgattagttcgtattggtgtgttggacgaaacccgcatgaagctcgattacgtcctcggtcttaaaatcgaagatttcctcgaaaggcgtctccagacccaggtgttcaaacttggattggccaagtccattcaccacgcccgagtactcatcaggcaaagacacatcagggtacgcaaacaagtcgtaaacatccctagcttcgtggtccgactggactcgcagaagcacatcgacttctcgctgaagtcacccttcggcggcggccgtcctggccgcgtcaagaggaagaacctccgcaagggagccggaggtggcggtgctggcgctgatgaggatgaggattaagcggagttaaatgtgttnaataaaacacaact

SEQ ID NO: 8088 - DNA, 607 bp, Triticum aestivum
  Clone ID: PAT_TA_8088
aattcaccttggatttcgtagcgtagaacaaggctccgttcgtccgtcaagcatcctctgtcgcaggatgatctaatagctgtgagttcttggtggcatcgatcacactgaagaaggattcaaagggaaaaacgcaattgaaataaagtttcaccacacgaaacctaagcgagaagccgatggcaagcaccgatgatccgaagaacgagccgtcgtcctcttggtccatttttaattggaacaataaaagccggaggtcgagcaaccgagaatgagaagcacccaagagatcctcacaaaatataaattcaacgggctgtaaattgcgctccaggatgctgccgcggcagcggcgcacgcaaaggataagctcatggagcggcaggagaaactcgcgaaaatggttgaagaatccgcagagtttgagagcgaggcggaaaactttgccaccctcggtcagcagatcaggaaatccctggagaccaagagatggtggtggccatcgtgattcataaccaatcatctggtcttcgagcgtgtgatgtagtgtcaaaaacgccttatatattataaacggagggtagtaataccaatgcgtttagcatgc

SEQ ID NO: 8089 - DNA, 1598 bp, Triticum aestivum
  Clone ID: PAT_TA_8089
ttcggcacgaggggaaaatggtcaatattccgctgatgatgttgaacgattaatgcattatacaattcactcaagaagaatatagttggtcatcggctgttaagcgcatacctcttgatttcctagaaggtgagaaattccacgaggcagcagataactatgtcagacctctattaaccaagggagtgccgtcacttttctctgatttaagcccgctttatgagcatcctggcaaggcaaacatattggagcaattatttcttaagctagaagattcaattaggacttctggatgctttcctggaagtttgcagatggaacctccatccacactcatgtggactctgctgttggtttctcagcactatgacagaaggagccagtatgatattgctctggataaaattgacgaggccattttacacacgccaactgtcattgatttgtactccataaaggggaatattttgcaacatgctggcaatttttctgcagcagcagcattagcagatgaagctaggtccatggaccttgctgatcgttatttaaacagcgagtgtgtaatgcagatgcttcaagccgatcaggtcgggctagctgagaagactgctgtcttgtttacaaaagatggagatcagcacaataatctccatgacatgcagtgcatgtggtatgaacttgcttctggcgagagttattttcgtcaaggtgatcttggccgggctctgaaaaatttcttggctgttgaaaagcattacactgatatgactgaagatcagtttgacttccattcatattgcttacggaagatgacacttcgggcgtatgtttctatgctgaagtttcaaaaccgtttgcatgctcatgaatactttcacaaggctgctgcaggggctatcaggtgttacatgaaattacatgattctccattaaaatcatctgctgaggagaatgatgagttgtcaaaactgccagctgcccagaggaagaagttgaggcaaaaacagaagaaggcagaagctcgagctaaaagggaggctgaagagaaacaagaggatgaaacaacttcaaccaacagttcgaaatctgggaagaaacaacaagcaaggccagttgatttggacccacacggtgaaaaattggtccaggttgaagatccacttgcagaagccacaaaatatttgaagcttctgcagaataactcgtcagattcattagaaactcatatactttcatttgaactgaacatgagaaagcaaaaggttttactcgcttttcaggcggtcaagcagctcattaaattggacgaaaataatccagacagtcaccgaagtttgataagattcttccataggataaacaatcttccggccccaggaactgattctgagaaattaatatggaacgttctggaagctgaacgaccagatctaaggcaattacacgggaaatctcttgttgaagtaaatataaacttccttgaaaagcacaacgcttctttgacacacagagcagctgcagctgaaatgatgtacctcttggagccggataagaagctgcaggcgattaaattaattgaagactcaacaaataacaca

SEQ ID NO: 8090 - DNA, 663 bp, Triticum aestivum
  Clone ID: PAT_TA_8090
gttcgctccaagcgcctcgcaggctcccccacccccgatacctccgccaccgccgtcgccgtcgcctccgtcgcctcgccatcacgcccccctctacgccgcatcgccgttgctggccgcagctctccgcacgcgacgactatcccgccccgtgacacccgcccggtcggtccccgtgctagattacgtcttgatctctcaggttctttagaagaaaaggggaaaatcacacatggatatcatgcagacaagtgactcttcacatcatggaattgtagaaaacagcccttacagaactccctatggtagacacgtggaaagtggcaaccttggtggttcatggtattttagtagaaaagaaatcgaggagaattccctttcaaggaaagatggcattgatctgaagaaggagtcttaccttcgcaagtcatactgcacctttcttcaagattttgggatgagacttaaagtgcctcaagtgacaattgctacagctatagtattctgtcatcgttttttccttcgtcaatctcatgccaaaaatgatagactgacaatagccacagtttgcatgttcttggcgggcaaagttgaagaaactcccagaccacttaaggatgtcgtactaatttcttatgagatcatccacaagaaggatcctgc

SEQ ID NO: 8091 - DNA, 720 bp, Triticum aestivum
  Clone ID: PAT_TA_8091
cctgcccgctcgattcgcctcgctggccctggtaaaagtacttttcatcgacctggtaaagatccagttgctcattattttgtatgccgcgtaatggggctaggagcaactgatgagtgggccaggcttgcgcgcgggccagcctcgcagcgacgcggtcggggcgtgcttctgtcgatgaaaagcagggccggttcgctcgtgtgctgcggccaatcgatcgtggggttgtcagggcgttttttaccgtgttcgtttgcacccagtggtggcgcctccgcttcaaccgcgtctggccccatctgtcagtctcgtgggtgcgtggcagtttggtcgtccttggtcatgtgagcacctccgctcggtccgctgggtaaaacagggttttcggcctctacgtgctgctaagcgggattgcttggcctcgtctcgctgcaggtggtccctttctatccttggtcccatgcgttgggtgagttgtgtttctctttaggtttccctagaagttacagcgcctgcgagaggtgtttctgaccgggtgcgtggtttccttctgctctgctctgcctatgtgcctcgcctctctgcccacttcccctcgcctgcgcctccttgtcttctctcatcgagtcgccattgtcgcttgtcgtagttggtcatcgataaccagcggcttgctcgttgcctgcttatcctgtcgtcggcttgtttcttcatggc

SEQ ID NO: 8092 - DNA, 1582 bp, Triticum aestivum
  Clone ID: PAT_TA_8092
cttcttttagccctctcttcccatgctgcccctctattccgcttttccccgtctaatccgctgcatgcatgagccaatccgttgcatgtttagagagaaactagtgggcaatccagcggcatgcaaagcgggccaggggcgcatgcagagaagggccaatccattcgctagtgaatttattgcatgtcagtttccttgccatcaaagcaggggcaaaacagtctaaaaaaagcccagctattgcctccttggtatgcgggctggttcttatgcacagagaaaaaagaatcggagcctcggagggagtatttggaaggtccggtggcatttttcaaaagatggaaatttagtgacattttttgaatacgtgaaaattgcaatggcatctatccagttaacctttttttactctgacccaacggatgttgtgcctcatgttctggacaccgtccatgtttcgctcattggcccttttccactggctgtgggtgccgcccccggccagcctgaacgccgttcacagaagtctgttcctagcactcgtgagctcatattggaagctataaagaagcttaaggagtcttccggatcaaataaaacggccatcgcttcatacattgaggagcaatactggccacctgctgattttcaacgcttactatcaacaaaattgaaggcactggttgctactggaaaattgatgaagtccaaccaaaaatacagaattgcaccgagttcagtctcgttaggtggaaggagcaccaaggtgcactcaacagaagacgacaaacaaaatatttgtattagacaactaactaagcctcaagtggatgctgaactggatatgatgacacacatgaataaggaagaggcagcagcatttgctgccaaggcagttgctgaggccagaagttgccaatgcggaggctgaagaagcagcaagggctgcagaagctgcagaagctgaggctgaagctgcaaaggcttttctcgatgccgtcatgttgactgtgcaaaacaaaaatgctgcctctgcgattcttcgagcttgctgatcttctctactagccgtgccgtgcatttggcttcagtcagcagaagtttgtatgagacaatgcttgtgttgtgccgcaaagcttttgtcgatacatgagtttcttgtatagccttatagatcaaaatgtttcaatgaagggcaggggttttcaacatcttgctgttggtcctaaaccctggctcacccttcagatgatgttatctagtagcatcttcttagataaatatatcatgtaattggcgctgtgttgtgttagccagtcaatgacgcaataacaggagcgaacaggaaagtagtattcaattttcatccttttttcttctgaacatgtgtttatttgtaattaaactctagtccattctccttagttcaagtgatgtcatgaaatagaattatagcgaaagttgctgtggcaagatatttctccagatatgttgagctgattacagtggtttagcatgatgataatatatatgcagtgggatgtgtgccctctgcatccgatttcgaggaaaagggggggaa

SEQ ID NO: 8093 - DNA, 644 bp, Triticum aestivum
  unsure (1)..(644): unsure at all n locations
  Clone ID: PAT_TA_8093
cgacattttgctcatatcataagtgcatacaacactttttcacaactgtgttctctctcttgtactcctggactatcagactatgcacctgcactatgtatacttcactcttgtctgtactgactttacatggacagaatgggccccgcgactcattgttgcagatatgatagacaaatgggatctggaagatacaccagaaacagaagaaaaagttctcaaaatggtgaaagagagatatagaggctggcgatcaactctaagctccacttacaaggcatacaaaacagatgcggcttgattggctaatctgccggaagatttacaaccagaagagtgggaatggatgattgagtactttggcactgattcaaaattttaggttatctttaagatcacggtttgtctattatgtgttaagatgaaatggctagtctcactggttatatctggtttcaatgaattgattggactgtagccaaaagaacgccgataatcgtaagaaacagaagacaaaacacataatcggatcaaaatcttactcgcaactaagttttgatanaggtatgagtcctaagtaaatattgtatgnccttgctgctaactctcatacacacgaagaatggaaccatggtctaacacag

SEQ ID NO: 8094 - DNA, 1043 bp, Triticum aestivum
  unsure (1)..(1043): unsure at all n locations
  Clone ID: PAT_TA_8094
gctagattggctatctgctgngagatttacaaccaaaagagtgggaatggatgattgagtactttggcactgattcaaaatttcaggaccacagccaaaagaacaccgatagtcgtaagaaacagaagacaaaacacaaaattggatcaaaaacttactcgcaactaagttttgagaagagaaacatggaaactggagaagagccagattgtattgttctctgggatctcacccacacaaagaatggaacatggtctaacacagagtcccaggatgtttacgacaaagcacgtctaagatgttgaaaacaaagaaactgaaactcatggtccactttcaagatccaaagaactagctcgattggactctagatcacggacaatttagtcttggaacttaattaggatggctaaattacatttgagtttcatttgatggatatttgctatgagaattatgaattttatgaatctacatattatacatgtggttttaaatattgtaattgaatgcctatatttttttttaggttgcaataggctattgccacaacccacttttccaaaaacacagaaaccaaaaaaaaaaccaaaagaaaaaaagccggcagaaaagacgcaaaaaaaaagaaccaccacccaggtccaaacgaaaaggggggccaaagaaaataggaatccaacccggcaaaaaattcccccacaaacatcaagcccaaaaaagacaccaggtccaaggccgactgcaatttccccaaatgcgctcacacaagcggcagcaaggcaatctcgaatgtataaagcaatggatccaaagaactagctggactggactctagatcacaggcagtttagtcttcgaagttaattaggatggctaaattacatttgagttttatttgatggatattttcgtatcagaaggtatgaattgtatgaatcaacatattatatgtatggttttgaacattgtaattaaaccctggtattttttttacgattgcaatagactattaccgcaaaaaaaaaaaaaaaaaaaaaaaa

SEQ ID NO: 8095 - DNA, 1717 bp, Triticum aestivum
  Clone ID: PAT_TA_8095
gaatggtgcagaacatcaatgcgttcatgcaaaccacgattgtgcagtaaagaaagcgttcttttaatatcacggatggaaagtataatggcatacaaaaaccaacatggacaacccaaatttggaactgcagaacaatctgacaatccagtgtctgcaaatgacatgtgttcccttgctgaatggccatcccatgctcgccgcaaccgtgagcgactacaggatgaagctggtggacagaagaagaaagggcgaggtgttctaaagggttttaaagcatctaagaagcgttttgccaatggatctgcaaagctaaatattacattctctgaaaaattgggtggtacagtaggaatgaactatcgtacgttcaaggatgacgtggttgtcataatgaaaagaaagttaccactcattggagtgaggacttagtcggacattcaccctaccattcatcgactcattgttgcagatataatagacatatggaacatggaagatacaccagaaacagaagaaaaagttcttaaaatggagaaagagagatatagaggatggagatcaactttaagctcgacgtacaaggaatacaaaacacatgaagatagattagctaaacttcctgatgatggacaaccagattaggaggaatagcatgaatgagtactttggctttgattcaaaatttcaggaacgcagccaaaagaacgccgataaccgtaagaaacagaagacaaaacatataatcggatcaaaatcttactcgcaagttagttttgagaagagaaacttagaaactggagaagagccagattgtattgctctatgggaactcacccacacaaacaatggaacatggtctaacacagattcccagaaagtttacgaccaagcacttgaagaggttaaaaacaaagaagctgaaactgaaggtccactttcaagtgagcagaaaaacaatgttttccagaccgcttacaaagacactctggaatgcaactcatcgcagcctcgtgggtacggatacatggccaaaacttcaactggttctgaaaagtttcgtatccagattgaagagcaagctcgtgctacagcagccacccaggagcgaaactctcagctcagccagcaggtcaatgacttagaagatcaactacaagctgaacgtgctaacacacaagagaggattaacttggagcgtgctgagagagaacaacttgaggagaggttaaaagaagagcgtgctgaaagggaaagattgttgcaagaggagcgaacatcaagactggaatttgaaaaaaacatgatggcaaagtttgtagaattgagcaaacagatagaaacccaacagacatctagtcctaataagactccaggttcaaggccgactgctatttcttcaaatgcgctcatacaagctgcagcaaggcaatctcggatgtataaagcaatggatccaaagaactagctggactggactctagatcacaggcagtttagtcttcgaagttaattaggatggctaaattacatttgagttttatttgatggatattttctatcagaagtatgaattgtatgaatctacatattatatgtatggttttgaatattgcaattaaaaccctgtaattttttttacgattgcaatagactattaccacaacccatttttggttgccacatgctagcaccactaaaaatatagtgttgcatc

SEQ ID NO: 8096 - DNA, 813 bp, Triticum aestivum
  unsure (1)..(813): unsure at all n locations
  Clone ID: PAT_TA_8096
atgcgacaatccttgtgagccgctaatggcgccgagcctgactgccagaccgtccccccttccatctcctcgcctctccttcgccaagaaccatcgcctcctcctcggcgtcaggtgcggctccggctcgcccggaagcggcgatgacgacgcatcgccggtcgtcagggcggcggtcagcgccgtcactgagctcatcagggccctctctccccagaagccaaggcaagctgtcgaagccgtcgacgcagagtcggagtcgcttcgcagcgtcgacgacgtggtggctgttcttgaagccgactaccggcgtgcttatttccttactgggaacttcactctgggcatatatgctgaagattgcttctttcttgccccgaccattgtgctccgtaggaaggtctagagatacgcccagaatctggatttgttagtgcccttcttcgacagcccttcgctccaacttgaaaacatagacaagggttcctgggtcggccctcccttgctctttgcctctgcctcattaaggtcgtctttgtcgctcccgtggctgcccctcgtcgccgttggaccgagctctgcgtccccgtttgtggaggacctgtcggtcggtgcgcacccggtgagctgggacctccctcctctgggggcgattggtcggttttgcgtctcgcctccagggcagtcgcgcaccccagctggcgtgtgaccctgcgttctcgcttcctctcccccctcccacgcaatcccgcggcgtgcgtgggtccacacgtatttccgcacaacatgncattaaggngcccaacnacacan

SEQ ID NO: 8097 - DNA, 1580 bp, Triticum aestivum
  Clone ID: PAT_TA_8097
cctttttggcgtctgctccgaccaccgccgcagatcgggatccctcgcggcgtgctgattatcggcttggatcgaaagaggtcctgcttcaacaccaaccacctctgaccatctaaacagcgcgttggagcgactgtcgtgaagattcgagtatactgttggacaatgggaacaaggatgacagtcctgcgacgattgcccatcgcactgtcatcggcattgctcgagtggatcttgatgcttctgctattcatcgacgcagtttactccttcctcatcaccagatttgcccgtctctgcaaactaccggtaccttgtccgttctgctcaaggctagatcatgtcctcggcaatgaggaaccatgcttctacagggaactgatctgcaaaactcacaagtcagagctctcgtccttggccttctgccgcctccaccagaaacttgtgggcgcggaaagtatgtgcgatggatgcagcagtagctcacttgctccaaaagtgacaccaaacaacaatgacaacacagatgagcccgccgtggatgtcgatgtactcaacgctactcaggggggtgatggtgtgttacattctcctcttactagaatgtgttcatgttgtgcacaacattttgaacaacggagtgtatcgcggttttctcagaagagtggagagctccagtatgccaagtcaccaaagatttgcacggattatcctgtatcatggcaactggacgaatcatttgaaaccaatgacatctaccaccagagtgatcatacatctcatgagagatacagtgctctacagatgacatctgactccgaggttgaggttccttgtgctgatgatgccagagattctcaccctcatgaagcctatgatatggaagagagagactttcaggaagatgcagtttttgagataccaggtgttccatcccctgcggtggccaagccatctgaaatgaatgttcaggaagaacaaaaagtgactgactccggtgatgcatgttcggcagatcatgttcggaattatgaccctgacagtgtgattagtgggagccaaatggaagcagaggacatctcgtccagaagacgagcatcacagcatggccctctaattgccattgaagagttatctttagaagatgccactgttccccaaattccagttgcatcagttgatgagttacctaagattatttgtgaaactgaatcatgtcagaggacgaatgacagcagcatcgatccatatacatctcaattcacaatactcgaacaacactatgctgttgcagcggataaaaatataaaagaagctcaggggacagaaatcactgcgatatcaagtgacgtatttcaccagagaagcacattggctaataatccagttacaagtgaaccagtacccaaggactatcattatgttgcttcagaagatacatatccgaaagataatttcagggatgtccccgtttcacaggttagtgccgattcagaaactcttgctgaagttgaagataatcctaaaaaagctgaatggactggtgataccggaatagatggactgacatcacatgatcc

SEQ ID NO: 8098 - DNA, 878 bp, Triticum aestivum
  Clone ID: PAT_TA_8098
ctctccacacacatccactccgctagagccgacaccggtctcagtccgagagaagagggcaagaggccatggcgagcgagcgcaatggcgacgggggcaaggagcgcgccggggagaacggcaacggcggcggcgtgtccttggagctgccggagatcaggtacacaaagctcttcatcaacggggccttcgtcgacgccgtctccggtaagacattcggagaccagggatccgcggaccggggatgtgatcgccagtatcgccgcagctgacaaggaggatataagacctggctgtcaaaggcggtcgaggcggcatcgatcatcttcaatcatggcacatggcctcgcatgcccggatccgaaagaggaagaatcatgatgaagtacgcggacctggtggaggggcacgcggacgagctgactctgctggagagcctggacgccggcaagccgtgcaccgtcaccagggccggtcgacctggcgaccgccgtcaggtccctgcgctacttcgcgggcgcggccgacaagatccacggcgagacgctcaagatgtcgaggcagttccaggggcacaccctgcgcgagcccatgggcgtcgccgggctcatcatcccctggaacttccctgccatcatgttcttctccaaggtcgccccggcgcttgccgccggctgcaccatggtcgtcaagcccgccgagcagaccccgctcagtgccctgtacttcgctcacctagccaagcaggcgggagtcccggatggggtgatcaacgtgatcaccggcttcggcccgacagctggagcggcgatcgcgtctcacatggacgtcgacatggtgagtttcacgggatcaacagcagttgggcggctgataat

SEQ ID NO: 8099 - DNA, 797 bp, Triticum aestivum
  Clone ID: PAT_TA_8099
gaggaccgaccgaaaccaagaccctcgacccgagtcgcctcctgcccgcacccggcacctctctctcctctctgttgtccgccaccgccgccgccgccgccatgagcgctggctggaggacgctgctgcttcgcatcggcgacaggtgccccgagtacgggggaaccgccgaccacaaggagcacatcgaaatctgttacaatgtgctttctcgtgaatatgaacactccaaagatgatatttttgagtttctccttcagtgtgcagaacaattacctcacaagattcctttctttggagttttgataggtttgataaatttagaaaatgaagattttgccaagggtgtcgtggatgcaacacaggcaaacctacaggatgctttgcatactgaaaaccgtgataggatcaggatattgctgcggtttctctgtggcctgatgtgcagcaaagttatatccccaaattccattattgagacatacgagacacttttatcatctgctgcaactatattggatgaggatgctggaaatgcttcttggcaaccacgtgctgatttttatgtttattgtattttggcttcccttccatggggtggttcagaattgttcgagcaagtcccggatgaactcgagagggttctggttggtatacagtcttacataagcatcagaaggcattttgatgatattgccttctcagtcttcgagacggatgaagggcactcttccaataagaaggatttcatggaagatctatgggagcatatgcaacttctttctcgtaatggatgg

SEQ ID NO: 8100 - DNA, 622 bp, Triticum aestivum
  Clone ID: PAT_TA_8100
attcggcacgagggtcatcccggctcaactcgaacaacgcgcaattcccccttcccgcccccccccctccccagcccagcaagcccgccgatccggcccggtcgccggcgaggcgatggaatcggcggggaacgaccggaggggcgcggcgctggggggcctggcggtcctccccgacgagctgctctgcgccatcgtcgacctcctccagcccaccgacatcggccgcctcgcatgcgtcagcagtgtcatgtacatactttgcaacgaggaacctctctggatgagtaaatatctttctgttggtggtcatcttgagtacaaaggttcttggaagaaaacaacgttgtctaggcttagtctttgctccggaaatagtgagcttgagcagaaggctcgtcattttgatggattcaactccttgttcttatacaggagatgggtatagatgttttactactttgagtagttattcctttgacaatggacatgtggaaagaaaggatgacctttctttggatcatttccattctcagtatgatggaaaaggcccagttttgcttggtaagctggctgaaacctggccagcaaggactaaatgggcaattcagcagctggtgca

SEQ ID NO: 8101 - DNA, 988 bp, Triticum aestivum
  Clone ID: PAT_TA_8101
ccacgcgtccgcgctgccgacaaatttccttatcccgtctgccgttccttcacctcgatccccttctctggtccttttctcatctgatccgcttcgcctctactgcttcgcctctcctcgtctccgtgtgattcgccatcaccacctcgccgcttccctactggttgtgacggcggcgctcgctggatggcatggtggaggtggtagagggtggcggaggcggagcagtcaagggcctcggcgccgtgcgtgtggtggggcagaaagtggaaggggaagggtgacgccatccagagaaggaggcataggatctaaaggatcgagcctgcccctcacgcaagctcaagaaggagttttccgggtgtgtggatgatagtttgttcagcagcatggaccatgccatgaaattggtgacggcaagactcccagactcatatgacaaaaaggaaggagttacaggagatggaaccactggtggggcggtagaatttttttctgttgagggcgatagtgtgtaggagcaacctttcctttttaggacaatgtgtggacatgtatttacttttttggggtgtgtgctccaggggactagccagccaacggttgctggctagccgtgtccgaaaggaaatgggcctgagactttttcgaccccgcttttcttgctgtggtgcgcgctccctggcgggctatcgctcaggcgccccttcggtggcgcgaggcacacggacggctccgtcgctgagtgcaagccggcgcgcccgactagaagaaacctgcaccttctcaataatggtgttttttctttggatgaacccaggcattatcaattacgattttatatttctttataaagggagtacccaggaggctgacaatgaatctgaatacatccgagaagaaaggacggagtatatgtataagagagaaggattcaagagcagctcccatgtcctgaatttcataaaataaaaaaaaaaaaaaaaaa

SEQ ID NO: 8102 - DNA, 691 bp, Triticum aestivum
  Clone ID: PAT_TA_8102
atctgggggctctggggccatcgtggttcgccgcttcgccctgggcaggcccccggcatggttggggcatcctgcccgccatggtactgctgcaacagcatcagcagggaatttttcttcgcgcaccacatttgggttgcttctgtggctaggtttccccttcgggagagacaccgatgccttcggcaacagctcgcccatggattctctgaaggagctggtcctcgggaagtgatgaccccatcatcagcaagcagttgaaagcagcggactgtgccggggtagtaggaaccaaccaggaaagcccccctacaataatggtctggtgaccggcaagccagaccgaaccgggccgtggtaataggcttggtaggcatagcatagaggtgaaaattaagaagggcacgccgtggccgacagtcctccggccgtggtgaacgctgaggcgagagtcccaccgaccaccgcagcttgcagaaagcgccgtgggagttcacgtggcagcagaagctaccgtgtggcgtgaccaccaccggcactggccagctcgcttgcgcatccggcagaaagggtacatacagtggagcagtagcagcagatctgttctattcgttgtaagaaaaataaataaaagtttgcatttcttctcaccttgaataaagcttaccggcgctcatgcaggcatgcaaat

SEQ ID NO: 8103 - DNA, 675 bp, Triticum aestivum
  Clone ID: PAT_TA_8103
ggcacatcccgcccttcatcgggtggctcaagtggctcaactacagcttctactgctaccgcctcctcctcggcatccagttccgcgacggcggcggcgtctacgactgcggtggcggcgcgctatgccccgtcgccgacttccccgccatcaaggccgtcgggctcaacaaccactgggtggacgtctgcgtcatggcgctcctcctcgtcggctaccgagtcgtcgcctaccttgccttggaccgcctgcagccgaggtgatttcattcaaccatactgaagaccaaggaagcatccgtctcagccgcccatggagatggaggacgcataaacatccaccatgagctagctagttagctacataagccaaaacggatcactgaagattgaccggccgggcaagctagttagctgattgctcttttgccggccggccgcttcttggatccatgggtatactctattgcgatccagaccagaggcttgaccgttcgagctcgatcttggcgagaatggaacagaggattgttaatggcgatgagtactaataagtagagtagtaccattgtgagtcaatatgcagtactgcttaatctgtactgtatcgattttacaggctgatatgatcagcgggaacaaaagagaaaactgcaggtgcctgccaagagcacca

SEQ ID NO: 8104 - DNA, 888 bp, Triticum aestivum
  Clone ID: PAT_TA_8104
gcacgaggcatggtgctgcccttccgattgtatttgacagacgcccacgcagagagcgagacgcacacagagacggacggacagacagacagagagagggctcctcccaattccgcccgcggcctccgtcgatcgatccacccatccgccgagagtgggatcggagcggcagctccgccctcccctgccgcggcggccaccgactgatgcaaaatggtaactgtacatggatttgccaatggtactaatgatggcactgccaacaggaagattaagcgcctttttaactcatcagagaggaagaaccccaccaatttccaatttgagcgtcatgtagctcgtcttgaatctagacagcagcagcaacccaggcggtgtatcttcacgacgatcttaccgattgagttcttccacacctcatctgaacctacatctccagaagatagccttggcccgtcatcctcctcgccatcaattattttcttgcattttagtgtggcagatgaacctctcagaaaatattcatctaatcaaaggctgctggcagagcgatccacatcatccaatagtatgtccaattcaggtttctcagacaatacctctaccaagacaagggtggatgcaaggcatactacaagaaggaagagcaaaaagaaaaacaagaagcagaagaaacacttcagaaagccagctgatggatctgaaattacatgcgcagagagcaacggctctaccccttcagtcgatatggttgattcttgtgaaggttcgacactttcacctaagcatgttggtgatatactgtttgaggaaaccttttctcctagttcttcggtgaaagaagcctctgaaaaggctcctgacagtgaaaatgataatgagtacaat

SEQ ID NO: 8105 - DNA, 967 bp, Triticum aestivum
  Clone ID: PAT_TA_8105
catgaaccgggatcacctcggcctcatctcctcccccgggggcggtggccactacattgtcgctcagctccagcagatcctcggccatggcaaagccatcctcctgcgcttctcgtcgcgggccggggagtgggggtccgcggtcctccgcctccccccccctgcccgcctgctcgcccccaaccgcgtggtctcgcacgccgggaggctctggtgggtcgacctctcctggtgcctcctcacatgcgacccattcgcggacgagccggtgctgacagccgtccctctcccggagggcaagcagctcaagttcatggaagcttggggagtgctcgacaagtaccgttgcgtgggtgtcagcagcgggaagctgcggttcgcggacatgtactccaggaaacagcgctgcacaggtcagcgtctggacgctcgccgatccggacaccacggagtggaagctggagtacgaggccacgtttgcggagaactgggacgacgcgaggctacaaggcgactggtctgcccaggaagatccccgtgcttgcgctcatccaccccaccaaccccggacgtggtctacttcttcctcgacgagcatctggctcggcggtcgacgtgcgtgcttgcaaggttgtggagtgtgaggtctacgagctggtggcgccgcctagcgaacacgtcgccaccagtttcattcacgcttggcagctgccacgggctctcagctcagcaaagaagaccgagggtgtcgtgaatgacgagctgtgaggcgagaatgaggaatgagaaccagggttaacttcttaacaggtaggggaagtacgtagtacatcaagctatcaggtggcatgcactcgactcagcgaaatcggcaacatggctgaaacgttttgcttgttttcttgtcactgcttaagttcagatgttaccaccgctactctttataattctgctatatatatattta

SEQ ID NO: 8106 - DNA, 384 bp, Triticum aestivum
  Clone ID: PAT_TA_8106
attcggcacgagggaagtgcctgtgtcatgtgcgcaattctagtggcgacgggcgttgccgaaaactggaaagatgctgaaaacgtcatccgaggaaggaggaagatcaaaatgaacgctcttcaccgcaaaactttggaagattggtccaaaagtcgagttgtccagaaaaaagataattaactgtgagctggtttctttcttacatgatatacttcttctgtgaggttagaaccaaaacagagtaaagccatattgtataggaatacctgccattctctatttgaaatattcctccacatgtcaatcatgtgtgacacaaggaaatcctccatttcccccctgaagatgcaggaaagtccttcctttcttgtaaaaaaaaaa

SEQ ID NO: 8107 - DNA, 981 bp, Triticum aestivum
  Clone ID: PAT_TA_8107
acgaatcctgttgagctcccccctgtctgtgcctgtgccgcacgcacacgcgattccactcggctgaacctggtcgccgatcgatttcttcttccggttgagcgaggcgtgcaagctacagcgtgctgcccctagctcgctccccgccgcttggttaactagccggcgaccccggctgccgatcctgcttcataggctccataggcttcctttcttggcccctgcttcagctcccacttctgtctgcctccgaggtgaaacccaagccagagcacaagatcctcactggtactagtggagctagctagcctagcagacatggccaccgcctccaccatgtccctgctccccatctcgcacctcaagcagatgcagcagcagcggcgcacgcggctcgccggcgcgctccccgggaaggtgctcgtgctcggccgccggaggcgccacgtcgtgccgcgggcgcggctgtttggtccggccatcttcgaggcgtccaagctcaaggtgctgttcgtgggggtggatgaggagaagcacccgggcaagctgccgcggacctacacgctcacccacagcgacgtgacggcgcggctgacgctggcggtgtcgcacaccatccacgccgcgcagctgcagggctggtacaaccgcctgcagcgggacgaggtggtggccgagtggaagaaggtgcagggcgccatgtcgctgcacgtccactgccacatctccggcggccacttcctgctcgacctcatcgcgccgctccgctactacatcttccgcaaggagctccccgtggttctgaaggcgttcgtgcacggcgacggcagcctattcagccagcacccggagctggaggaggccacggtgtgggtctacttccactccaacaaccccaacttcaaccgcgtcgagtgctggggcccgctccgcgacgccgccgcggccctacgacgacgagaacgccaccgccgactcccc

SEQ ID NO: 8108 - DNA, 592 bp, Triticum aestivum
  Clone ID: PAT_TA_8108
acgaggcgtccctcgtgagtcgcgatcctagcggaggcgtcgctcgctcgtgtgaatcggaaacgcgtcgcccgtcgcctgcgattcctgatgccaggcgccaacgattccaaatccagtccaggcatgaaaaatttcacgacgccagcgacaagcgattcctgtccctgcctcccgatttcggcagaaaaaacgccttccaatgcccagcactggcgatggtgacctagggatttcggtaccggtaatcagttctggccaactcgattgacaatcgccgtatagactaggtgagttagacggttcatcttattgccaaagattgaaacagattagcaatttttttaatctccaatagtccaaattaattttattcctgtgtgtatcttctgtttcaagagaatacagatttaagtcatcgtgggataacattgaaggtttcatttcaaagaacacaagaggaacgatgatgtttaaataaacattatgcaacttgtagttaaatatgtaagattctcaatatattcgattgttatgtaaattattatgtcatatacattagaatttcttgttaattcaattaaaaaaaaaa

SEQ ID NO: 8109 - DNA, 371 bp, Triticum aestivum
  Clone ID: PAT_TA_8109
cactgccccacgcgtccgcggacgcgtggggccgcctcgccgtcgccgttcctcgcgacctcaccgccggtcgccagccggagcccggatcccagcctcctggcgcccgcgcctctccttcccgcccggtcggacagccctctggtccagccgcgcctccctgcccacgcccctccctgcgcgcggccgtgcccctgccgccggccggaagcctggcgcccctgccctcgcccccctgcaagtttggcggcagccactgccgctcagtcaccacaccagtcttcgggattgaagaccaccctgtcatccgttatgccgccgggctcacggagaagggcgctaccctttcatgaacaccgcatcggcggggc

SEQ ID NO: 8110 - DNA, 1244 bp, Triticum aestivum
  Clone ID: PAT_TA_8110
tagcgtggtcgcggccgagggacaagcacaaccacactcgagaggtttcctaagctgcctcacgtcgcatcaaccggtcattttaatcttgctaacccgcggcccacgactagcgaggtgatcacactttggtatcgtccgcttgaactaatgctaggccccactcactacagcgttggtgttgatctttggagtgtgggttgcgtgttggcggaactccttctcggccgagcctatattccccggacgaacagaggtggaacaacttcacaaggttttcaagctatgtggtactccgagcagacgattactagggataaacttgaagttaccacatcatacattcaagccatatgagcggtgtatggctcagaaatttaaggacctggaaccatctaccctatcacttctagagactctcctatctattgacccagatatgagaggcaccgcgactgatgctctaaacagtgagttcttcaggacagaaccacatgcctgtgaaccatcaagccttccccggtgcacaccgtgtctaggtaccgatatcaaaccggacgctcggaagcacaaaagaaaattgagggcgaacgggtcggtagaacgccagacaaataccagaaagcccgtctcacaaaatcatggtcgcagaagggtatttactccagatgtcaataataagccacatggaaacccaaagtagcgtggtcgcggccgaggtacaagcacaaccaaactcgagagatttcctccgccgcatctggatgcatcaattggtcatagcatagattcctcggccgatgtaacaaccaacgagttcttctcatcatcggttgtggaactaaagaaaatgccgagcctactatttggtcacgtgaaatcttatctgaacagcccgaagaagggaatgcacaaagcgaagccaagcctcacaatggcgccttccacggttctcataggtgcattccggccctactcgcttggccatccgatggaggtgagaagaaagaatagggatcagctcagagccaaaggaaaaattccagtaggtttagtcaaatgacaagctaattatgcccctcttttctaatcttttttttcttctccttttcttacatcccctggtcacagtagctgttcatcttaatacacgatagataggctatacttgtatagctagagagcataataaagtagagttgtgaacaacgattctatgtacctgcccgggcggccgctcgaga

SEQ ID NO: 8111 - DNA, 597 bp, Triticum aestivum
  unsure (1)..(597): unsure at all n locations
  Clone ID: PAT_TA_8111
gcagaaccgcttctcttccttccgcgactgcatctcgtgttccctgtggaggtgcctcgcgcgacctctccggtagccgccgccgtgggaagcacacgccgccgccgccgtcgggagcacgcgccccctcgtccagaccgccccgctgcagggcccgatttcgacgccctgcatgcccccatcaatgagcttccaaggcggtcgtgaaggccatataggtctccgtgaattagctcgggtccgcgcgggtgacggcgaactgcgtcgcgccaggccccatgccgggaagctctatgccgccgcgcttgacggagtagctgctcccagcgctggccgttgaccgcgcctgaacatgcttggatcttgtgcagggtggctgttgttgaactctgcgatttgagtctgattcgtttctttcctggttctgttctgcaatctactgcatgcgtggatggatgaactcacgctccttcagttctctgcgatttgtttctggcaaagcgtgctcaagccttttttttttgtttgagatggagcgtgctcaagcctttgttgtatggatggattgatagatggccattttattcanaaaaaaaa

SEQ ID NO: 8112 - DNA, 905 bp, Triticum aestivum
  Clone ID: PAT_TA_8112
gaggaattcggcacgaggaaaatgctggtgagtccgatgctgatttcctgaaaaggagaatagctgcaaaagtaagtgaacgctgatgggacacccataactgctgttgcggatgtcaaggctgctggtggttcgaaccctgtcgtcaacagggccaaggccatccgggataagaggagggctgacaaaggttcaaaattaacttcaaaaatcaccaaggaggtggttgaaaaactgaactacaagcctttgactgacagcgttgcttctgaagggcaactctctgaggtagccgaggccttcgctgctcttggcgttactgatgctgaaatgccagtggttgcattgcaaattgcaaggcgtgccgcggattccagctcgagcaacgttcaaaattttgaggaatctgcctcaactgccaaggagatttcactgacagatcttttgactgccattaggaatgttaccactttacgtcgtttctgcgctttttacgctcctgacgtgtggaattccatgctgctagaagactcccctcctgcgaattgggacaaaaagggcttcctcttttctgagaggttcgctgcttttgacttcttctatggagttgagtccagggcggcacactacactgatgggcttgttagggacccctccgatgctgaacgtcttgcaaatcactccatcatggaggttaaaatgttcaggatcgaggatgcaaaaagtacctctgctggtactgttgctgaagttactggaggaaaggcgcgggaacgcccttccctcaacattcattagagtgttgagtttaaataaacccactcctacaggtgagcgttatacctgtcgtctttacaaggacgttaaaaacccgatcgagcaagacttaactttgttctcgcggg

SEQ ID NO: 8113 - DNA, 901 bp, Triticum aestivum
  Clone ID: PAT_TA_8113
gcacgaggcttccccccacaaatgaagcggctttcttaaactcgtgggaagagaagcgccgccgtcgccgcggggggagatggcccccgccgcagccgccgcgccggcgccggccgccaccgcctgctcctcgtcggccagctccgcgcgccctccctccaccgcctcctcctcctcccagtcgccgcccaggcgcacggtcccggcgctcctcctcttcacctccctcgccgccctccgcagcctctccgccgccggggcccccgacgccgacgccgcgtccggccgccccctcaaagatgtcagcttcgaaaatccggaggtgacttttgctccctcgtccatgggtggaatcttttgtgagcgaatccgcatttctggaatgccaaggtggcagtttcaaagctacgcaaatcaaatacatgttcgaatgaatgtttctcattcaatgccagaaaagttccattggaaaatacagatttgctttcatgggaatgcttctacgggtctgtgccaatgtgagatgggtgaatggcaagctctgcaaggtggcatgtggaacgctgtgaagtctccatatgccagcagatatgttgatgtgaaactgactgataagaaatctactgtcttcagcctttccattcaggaagagcttcagaagtggcgtttagcttgccttggtattggatttgtcctgttattcctgtcacccatcgttagtaaatgggcacctttttactatagcagctctatggcacttggaatcctgcttgtggtgctgattgtccttttccaggggatgaaactgctaccaatgggcaaaaaaggtttattttaccttacaatttatggatctgtgttggggtgttggctcctacgctgcacactacttctcctcaat

SEQ ID NO: 8114 - DNA, 911 bp, Triticum aestivum
  Clone ID: PAT_TA_8114
gctcgatctccacggcatgtgccacctccaaccactgcttccacagcgccgccgaccagatccggttgggccgagccgacgtcatggtcgccggtggcaccgaagccgccatcattccaatagggctcggcgggttcctcgcgggcagggcgctgtcgcagaggaacgacgaccccggcacggcgtcgaggccgtgggacaaggaccgcgatggctttgtcatgggcgaaggagccggactactggtcatggaaagcctcgagcatgcaatgagacgcgacgctccgattctggcggagtacttgggaggcgccgtaaacagcgacgcttaccacatgactaatccgagaccagatggctgcggcgtgtcggtgtgcatcaggcagagccttgaagacgcaggcgtcacaccagaggaggtcaattacataaatgctcatgcaacctcaacccccgctggagatcttgcagaggtgaatgctttgaagcaagttttcaaggacccatctcggattaaactgaacgcaaccaagtcaatgatagggcattccctaggtgcagcgggcggtttggaggccatcgctaccatcaaagccataaccaccggatgggtgcatcctactataaaccaatttaacccagagtcggcagttgatcaatttgacacggtgcggagtgtgaagcaacaacacgaagtacacgttggtatctccaattcatttggattcggaggacaaaattcagtggtggtatttgcgccatttaagccctaatgtgtgttctatttattgcggtgtatgcgattagggcaggcggccacgaatatgttttagcccacaatggtggtatggtctttcgagtagacttttcaccacccatttcgtcttaggcatggttatgatcttgtatga

SEQ ID NO: 8115 - DNA, 1369 bp, Triticum aestivum
  unsure (1)..(1369): unsure at all n locations
  Clone ID: PAT_TA_8115
gcaccgccccgccgccctccgccgccggtggctcccccccctcacccagctttccagcacgcgccgccgacgccgacgccgcgtccatgggaaatgggcaagaaagccatccgatacgccgtggtggacgccttcgcgactgagccgttcaagggcaaccccgccgcggtgtgcctcctcgaggacgacaacgccgcggacgagcggtggatgcagtcggttgccaccgagttcaacctctcggagaccgccttcctcgtccgcgacttctcccggcgcgccagcgccgcgccgctcttccacctccgatggttcactcccgtcaccgaggtcgacctgtgtgggcacgcgacgttggcctccgcccacttcctcttcacggccgttctcccggagcatggcatgatcgagttcatgaccaagtccggtatcctgactgcgaaaaaagttcccccgccagggggcgcaggcgaggcccacgggaagctgtttattgagctgaatttccccatgattgatttcctgggctgcaacgagatgccgtcgattccggagaccctaaacggcgcaccagtggtcagtgttcacaaatcggcggccgacggtgatctcattgtggagctttcttcagcacaagaggttgccgacatccttcctaacatcgatgaaattaaaaagttgtcatgtggtggtatcatggttacaggaccggcacctgctggatctggttatgacttcttcacacgtttattctgcccgaaatttgggatggatgaggaccctgtcactggcagtatacattgtgtattgggaccctattggggtagaaagcttgggaagcaaaaactgacggcatttcaagcatctccaaggggtggaacgctatacctggaactggatgacgcaaatcggagagtgaagatccaaggagaaactgttactgtcatgaccgggacgctcctggcgtaacatgtcatctaggcatgcttgctttgtagggaaatcactgtcgggcttgtaatatgaacaatcgttgtgggcaattactctaggctgctctgtggtgggttttgaacttccagcggtttcttgaaggtcactccgccggtgtagttcctgtccacggcatccaataggttcctaaaaaagagcctagactcagtggaaaaattcctttggtgtcaaccaaatgacatcttgtttcttattcctactcataggatttgagatacatgtcatctcatttcctacaagattcctattcctataataatcctatcctatgaaccaaaaaaggcctcagggttttttgagggtcactacgccggccgtgtanatcgaacctaaaacaaggagcttaaaatataca

SEQ ID NO: 8116 - DNA, 456 bp, Triticum aestivum
  Clone ID: PAT_TA_8116
gcacgcacaaagggagccaccacacccatgcatccatcacgcacgcacaaaggcctccgtccttgggaactcacgcacacatccatccatacatcaaccacgcacgtagaaaacacatccacgccgacaggctctacgcgcatcagccaaagctctcgccctcaagcacgccgccaactccacgcctcttttttccccttctcaatcttcaccgtaaaagtttcgtcgaccgcggacgacgccgaagctttatcaacatgctgatctttgccaaaaccgttggccttgatggtaagttataagatctgatcgcatcaatgagctttgtgtgatggaagaagaatgatgtctacttggctattccataaatctttatcatggcacgaccgcttcatcaaagtcgaccatgtaaaaatattcaaccatggcacgaccgtctcatcaaagtcgcccatg

SEQ ID NO: 8117 - DNA, 749 bp, Triticum aestivum
  Clone ID: PAT_TA_8117
cccacgcgtccggaaaaatctgcgatcagatttttgagggtggcaactttaacaaggaccaatgttttgcagaaatggcaacaaatagtgtcgtgactcttctcagctttggagatgctgttgcaaaaagcaaaaggtctcctgaaaagctgtttgtattgctagacatgtacgaagtaatgcgtgaacttcaaccggagattgaggtggttttcgaaggaaaggcttgctctgagatgagagaggctgcattgggcttgactaagcgcttggcacaaactgctcaagaaaccttcgctgattttgaggaggcagttgaaaaggatgcttcaaagactatcgttcaagatggaactgtgcatcctctgacaagctatgtgattaattatgttaaattcctatttgattatcagtcgacgctgaagcttctgtttcaggaattcgaaactggtagtgagacagaatctcagcttgctgttgttactacgaggataatgcaagcactacagaataacctagatggaaaatctaaacaatataaggatcctgcgctaactcacttatttcttatgaacaatgttcactatatggttagatctgttcgcagatcataagcaaaggatatacttggcgatgactggattcagaggcaccgtagaattgtgcagcaaaatgccaatcagtacaaacgtgttgcttgggcaaaggttcttcaagcactttccgtacaaggagcgccaggcagtact

SEQ ID NO: 8118 - DNA, 582 bp, Triticum aestivum
  Clone ID: PAT_TA_8118
gggctgttggtagcgggagcaccgggtgccaagcaagagtttcagagccaagtaaatgtttgtacttgatcgtcgacacagtggtgctcatggtgaactcctgtaaagtcggcaagttacacaatctgcaacaggagctagttagaaaagttacgcttttgttgtatgaagtatggagcaaagttagactcttgcagtcatcagctgactgcaccaacgggaaggatcaacttcaaagcagaccatatgagatatctgaagctatttttaggctttcgatggatcttgcttgtccagcccacctggaacctgatgaagtcagaaaaagcttttttggacaaacggaatctgacgtcgaaaagtttgccctgatgtactgggaaaactcaccttatttgtacaggaagagacaaagtggtctggagggggatgctgtgttcactgcattgcataacgcttttgatcttagaacacctgatgctatcgtcgagtcattcatacggggccttgtttcttgccctgctattgcttcggatgaactcaacatagattcctttctcgatgaggttcacgattccttgg

SEQ ID NO: 8119 - DNA, 668 bp, Triticum aestivum
  Clone ID: PAT_TA_8119
gcggggggtttccgtggctccagcaggctgtcagggtgtcccgccggatgtgagggtgcgggcgggcacctgggtcgagatcatgctgcctgctccgggggaggcgggcttgtcgtgcttgcggcggtccttcctctgcacgggcctgggcggcaggcccgcgcggcgtttccgggcctccgcgggcctgggggtggggcgggtggtctggggaagggaagcatcgggcgatgcttacttacagtttagaagagcgcaaaattggtgcctgtgagtcgtgcccgccattgcgaacggctaacaaacaacattgccttcccgagcggcgggcgtcggcctggcccgccctggggtgcggttggagcgctggatcgtgggtggggttccctccgacggtgcctgccgacagtttgcacgtgcggcttgctggtttccgcgtcgtgtgccggcccttccggccgcctatcaagcaacctttccgttccaatcggtgcccttcatgcaagcttgctcttttttgttgatggattgctgaatctatgttgatgtttccctgcaaatgttgcagcagaaataatgcacgttttacctgttagatcattatgagaagtagcttctgggttcttatgaagcaactatctgtagctgatatcctataagcaacctcg

SEQ ID NO: 8120 - DNA, 899 bp, Triticum aestivum
  unsure (1)..(899): unsure at all n locations
  Clone ID: PAT_TA_8120
cgccgcgcgacgcagtaaacgccagaggcggcggcaccacgaaagcgaagccccctccccgtctacagtctctccacgcggggcacagatcaccactcgccgccgcacctccacgccggcggcgcgccggcgcccccgccccgccccgggggccccgccgccggggagggccccgccgccggcggcggcagcgccgaccccggtggcaggggcaggggtggtgaaggggaggtcgtgcaagggctgcctcttctactcgtcggtgctcaggtccaaagggcgcggccccgtctgcgtcggcgtcacccgcggcatcccccaagttcctgatcgtatggttggagaaattgagctgggagctatccaagaaggtcgcaacctgtccaacttcaaatatgcatgtgctggatattccatatacctagatgacaaggatagctctacagtgaagggagagaagcatgcagagctccctatctgtgttggagttgagctattgacagacagagctccaactaaacaagctccagctcacgtgactaaacaagctccagctcacatgaaaaaagatgctactcaagcacatgggcacaaacctgcgctgacacaagccgatttcataaccaaatttcagaggaatgctgggcttgtggccagtggtgtggttaggaacatgaataaagttgggacttacgtcaaagacactgtggatgacatcctgtacccataccgcaagcgtcccaagtaaaacccagctcttgttctccttaaatcctggagtagaatagagaaaaaatgtgggagcatgtaacctattacttccggagacactgggccangagtanccncgcctgggnttctgncgctgtggcggggattnacngnccgtcagttcatgc

SEQ ID NO: 8121 - DNA, 670 bp, Triticum aestivum
  unsure (1)..(670): unsure at all n locations
  Clone ID: PAT_TA_8121
ggtccttccccagtctccaaactccttcgcaggaaacagtactgaaatatccgtttcacattggctgaaaatctgctaaatgaaggcatagggattttgtcgggccaaaggttcataatctgtagcacacatacagattcgacacatatggctagccaaatatctggtaccatagcatctagtggggtgtgctataatgataaacacagaatgccgtgtaagctgaaagcactacgctgcgtagcatcggattgtttaccactagaggtagaggtaaggaagtggatgaacggatatcatatcatcaggtcctttccaaacgataggcattggaaaacgaatgcgaagtccaatggttacctactccaacaaggtccgaatgttcggtgccattcttatggttctcgtagtgccagtgaaactacagagtgcaatattcctgaagatggcaacaatccttacagggattttgatgagcatccaagaggaatgtcacatttttcagatagtcaagttgcagctcaggaaaaaacactatattctactcaagggctgtctaaagcgtgccaatttgtctataatgatgcaaagtttgtgaatgaaagagctcagagtgatattcttttgctttcacgtggcatcacaaggttgaacaaacgtgcatctaang

SEQ ID NO: 8122 - DNA, 628 bp, Triticum aestivum
  unsure (1)..(628): unsure at all n locations
  Clone ID: PAT_TA_8122
atgccgcacgaggaaaaaaccctaaccagatagaactcgtcggagggagcgggaggagatccaaagggcggacatggcggcggcgaaggcggcgttggagaagatgagggcgttctgggactcgcagtgcaacaacgaggagaactgggcggtcaactataaggtgctaaaggctgctggtatatttgctggatccgtcttcctgatgcacaactttggccataatatggtcatctaaacgggactagatagggcaataatggacattcaatggtgtggtgttgcactgcctttttcgttttctcatcaacatggtcatcacacatgttcttagtgtggattaaggagtgaaactgttgttcttagacattggttggtaataatggcagccaaaatagtactttatatgtattactctatcaggtgttctcatgctttgtgaattatcaggcaagtcgtcgcaaacttgttggggatccctttttgttaggtcttcttgaactttgtcctccagctcgggcgcccggtaccccgcccctanagtgagtctatacgccgccantggccncnttaaaacgnntgaggggaaaccggngtnccaactaacncctganaaaccccttcgcag

SEQ ID NO: 8123 - DNA, 1265 bp, Triticum aestivum
  unsure (1)..(1265): unsure at all n locations
  Clone ID: PAT_TA_8123
ggnctgcaggnaattcggcacgagggcgacacctgcctcctcacgcctgctcgacggccgccgtccggtgctgtggccgccggcagagtggagcgacgaagcagagccaggcaggaaatgggaggtgcacgacatggcaacgccctcaccctcatcttcgctcctcctcgagggccgccctcctggcctttggccgccgccggagtggaagaagaagatgaagccagaggaggtaaccagagactgggcggagctgccgcgggatgcgctgctactggtgctcgagaaactgcaccaggtcgacgttctcctgggggccgagctggtgtgtcgtccctggcaccgggctacccgggacgagccgtccttgtggcgccgaattgacttgcggttaagccatctccccgacccctcctcttaccgcttccaccccatgggccacgccgccatccagcgcagccgagggagctgcgagacactgtacagcgagggcgccatcgatgaagaggccatatctctcctgaaagagtcggcgctcttcttgaagagtcttcgactaatcaattgtatattgatcaatgataggatcagccttaacatatcacatttggttatgcttgaggagctagaaatctcaaactatggtgtccacaagttctcttccacatgcttcgcggttggatactcttgcccgcacctgaagcgttttcgtctcagcagttcatgcttcattaaacggcccgtctggggcgcgattgattgcgaagttgaggggatcaccctgatgcgtgggctacgttcgttgcagctctttgctcagactattagcacaactgggttggcagccatcctcgatagctgtgtgcaaatagattctcttgacattcgccattgtttccatgttgagatgggagatgagttaatgtcaaggtgttctaagtttgagactttaaggctcccacatgattctactgacgattacgatcttgagttttcagccccagatatgaacactgagagcccacgaccacgacctgtgcgcaattacggggacgacggctgcgcctttttggaggatgtatattagtgtggccaaagtccaacacattagggctatcgttgttactccagcattccaacttagtccatgaattatgtttttgtgttccctggctagtctgtagaacagctgaacaggcaaggttatgtaaaaatgaggtttattaaatatctgagtctatgaatgtattcctcctacgatccat

SEQ ID NO: 8124 - DNA, 415 bp, Triticum aestivum
  unsure (1)..(415): unsure at all n locations
  Clone ID: PAT_TA_8124
gcaagnagggatctagctcaagggagccgatgagacgcgtgcggggcaaccggcggtccgggggatccagccaaggcgaggcgtctgaggggatccggcgctcgagcggctgcctccaggcaccagttcagtacacgttggaagaaggtttggagagaccgaccccatgtgtcaactacagtatgttcgacgaaatgtggagcgtggttttaaatggagattcttggtatcacgtgtcaggacgtaagtcactaggaaaggaaaagggtgacgagttaacagcttcctgtgcaacggaagcgtgaaatgatgtcgtgaaatctcacgattagcctgttgcgattcaagattagagaagtgacagtatgtatctttctaatgaatgaataaaaaggaattccgctcaaaaaaaaaa

SEQ ID NO: 8125 - DNA, 630 bp, Triticum aestivum
  Clone ID: PAT_TA_8125
ggcgccaccccgtcaagacataaaacatgtcgaaaatggttcagacggaggctggccgcacaatccccaagttcggcgcctgggacgtgaacaacccggcctccgccgacgggttcacggtcatcttcagcaaggccagggatgacaagaaggcccccgtcaacgtgcacaaggccagcaagtccgccgacggcaaggacgccaggcccgactcgaagatgaaccaatcctacagcaactccaggcccaacacctcgaagaaatggttctgctgcgtgtcgccgagccccacgcagccttgagctaggacgaggatgatgatgatgaggaggaggggatcgggcggagtgtcgcgcgaatgcgaatgcgatgggacggaggagaggggagtgtcaatgccgctgcttcgtttataaacaaacgtactactatcgtacatacacaaacacttgccacttcggggatgagatgagacgatgttgatgtaattatgtgatggtcgtgcgtggccctgtcgccaggcgtgatgtaaggcttcgcataagagaaagaaactcgctcgtaccacgcgcccccgccaccaggcgcgttgggcggccgccgcagaagagaacgtgcccaaaaaaaaaa

SEQ ID NO: 8126 - DNA, 844 bp, Triticum aestivum
  unsure (1)..(844): unsure at all n locations
  Clone ID: PAT_TA_8126
gcacgaggatgtaggtccgtgcttgtgctcctgctcctcctccggaccgagnatctcctgtcctgccaccgcctccactcctcgagcaccgcgagtcaccatcacctcgtatcgccgacgtcggtcaccaccgcaaaccagtccccgtgctagatggcatcttctactctaaaaccaggtgtgcctattactttgcaagagctagagccctcctcagagatgttcaagcaaggggcatcccttcgggtaacaggaatccttcagtcatatgatgtggactctgcagttgctgtcattcaagatggcagtgctagactgaagattgatactcaaaacctgagagacattagtttccgcagcaattccacgttccagttcatcggtgaactcctgatccagccaaacaacgatgcgattctacaagcacgtgtgggcaggaatgttgatggacttgacctgaacctttaccagcagtctttgatcatccgacggcaacatgaagccaaactactgagctccaggaggccatgatccaaagctgtgaaccaggctcaaagcctcacttcagtttttctgaagtatggagcatgtgagaaaagaatcacctaactcatgatgaccatgttctccagtttgttatcgaacctacaaagtggtactagtagttaactgagtttcctgagcacagattattcctcgagggccacctcattctcaaggatatttaagctatcaggtccatgagctcatattggttgagggtccatatatctgttttgtgggctggcattccctttcagctcgacggatgggctgcagagnnatatcctattattcnaacaat

SEQ ID NO: 8127 - DNA, 980 bp, Triticum aestivum
  unsure (1)..(980): unsure at all n locations
  Clone ID: PAT_TA_8127
ggtccataggaggcgagctccacatctttcttcttttccccaagccgaagggaagaacccctttctcctctcttctccagccaacctactccgtcctcccttccttccccactcctccccaggtgcctccttgctgcaccacgcccttcaccacctccatggcagccctttcaatctagggcttgaggaagaagaaaaggagacaaggataggaggagaacaagaaagcttccccaactttccccttcaccaaatctttgtcatttgaccatagaggttgcagcaccaatccactggagatagcctcgcaccacctcccttgcaatggttgaggcgagtacaccgggcaacaagagctagattgctcccttaatattatgttcatgttcacattattcctttacattcatgcaatggtgaacatacaactccctagtgtacatttcaatacaccataccactagaatgtgatagggatcggtttttccgggtgcttggtccctcggccccctcctctggttatgctcctctcacttggtgagggttgaaaaggagtgaggtgagacgtcgcccctcctcagcttgccggcaaaagctcagagcctagtcctcggtcttactggggtgcgtcgtcgcccctccttttctcgcccccttccctgcgtgcaagcctcgtctattggggtgccttgttctcgcgcggctcatgctctcgggctgacttgccattttattacatgctttgttgtgtactcgctgagtctttggactcacccctcgtggactttgtttcaggtacatcaccgtgaggctttgcaagtattaggaagggcgtagctcccatgggtgttcactcacacatttcacaccccttccatccacctagccgatcatgataactctcatatttagttcatattcttggtagctaggatctacttgtggtgtataaacttgcctggtngtttccanatcactat

SEQ ID NO: 8128 - DNA, 1043 bp, Triticum aestivum
  unsure (1)..(1043): unsure at all n locations
  Clone ID: PAT_TA_8128
ccacgcccccgctcgtctcccgctgtcgctccccgcccgcacccgaccggcatgggcggcccttctgcgtgggcgtcgacggccgcagctcgtccccgcgcgcaccctccacccctccatactcctctcttccccgcgggtgccgactgaggcccggttgctcggtgccaccagatgccggtgtgggctcctctgctgtgccccccgtgtcctttggttgtttttggcttcggagccttcttgtcacccaggtgggggttggcgctacggggctctctggtcggtccccggacgcttctgcccccgccgccacccccacccgcggcctgaggcgacagaagcgacggccgcgctcgacaccctctttcgcaactcgacgacagcctagcgtcataggcggctcatacggtggtctagaagatggcgacccatttgggtgggcgacaacgaccgcagctggtgcacgcgctcacactcaacccgtccatactcaactcttcctctcgggtgcggactgagaattggatgctctgtgccagcatatggaagtgttgtgaccactgttgttccggatgtgagatttgtaagttttttgcttgggagccatctatttagccatgttggagtaggctatatgattttttcagttttgaccacgtatgcttcttccttggtctgttcaccaagtcatggacaccgactcaaaaaatgaacaaggttaccccttcagctgcaggtgcaggttgacggtgacactgcagatgtagcttctctgaccgctaccgaagacaccgctgaacagcttaatcagacaaagacaaagtgctgttatgtaggcatggtttaaaaactagagcctttggctggtcaagtacccttgccaaagcgttcgtgtaatctcttcaagttgtatgaagcaaattctatgtatgtaacacccaggaagaatattataataattatatagaagcagagaatcaaccttgctagagcgtttgtcaaatatctactcgagtagnccttgccaaactttatctgctgtg

SEQ ID NO: 8129 - DNA, 643 bp, Triticum aestivum
  Clone ID: PAT_TA_8129
gcgctaggtttagagcactccggcgagcaatttgccgtgcctctctcctttttcaccgtcgacgagagatccatggtaggcggatctagctgtggcggccacgccaacactggtggaggtcgaggcggcatggtcatgcggtgcctggcgccgagcaagcgcgcccgccacgaagcccagcaagcgagctcgatccgcaccgttgtgacgctctccagctctagcggcgatgaggacaaagggcagcgcgggtggaggtcgacgcaggcgcaggtgtggacggctctcccggagaggcggtcgaaacgcgtgggatgcgttcgatgtgctcggtgccgcgccgccgacaaagagcgtcttgccgctgagcgcgcggtggcggccggcgaagaaggggctccacaccgcctcgaagccgcctagaacgagcaccggagggttgggttctactatttaatcctttcggtatatgtcatgaacttgtcttcgcgtgaactgtgtttgtggagaactgccccgtgatctcgaacaaattctcatatgatttttttgaattatcttgtatcatttagggtatctgttccgactgaagcatttattacccgtaaaaccatatttgggtatcgctaacggttttacagtt

SEQ ID NO: 8130 - DNA, 667 bp, Triticum aestivum
  Clone ID: PAT_TA_8130
gctgaaggccccatccctattgcatcggccctcgcgagcagcggctgttcccatctctacgggcgcctcgccaaccacgtgggtgctcggagatgggtcgccggcttcttctcccccacacgaggaggcttatgttgttcctgcggccgatgcgctactccgcctccgccaccgccaccgccaccgctggttcttcgcgcgacccgctccacgtgtgcgtcgtcggcagcggccccgccgggttctacacggccgaaaagatgctaaagggtcatgaaggagtgcgagtcgatattattgacaggttgccgacaccgtttggcttagttcgttctggagtggctccagatcatccagaaacaaagattgtggtaaaccaattttctcgtgtagctgcgaatccccgctgctctttttttgggaatgtaacacttggaagtgatttatctctatcagagcttcgaaagacatacgatgttgttggtcttgcttatggtgcagaaagtgatagatcatttggtattcctggggaggacctcagaggaatacattctgctcgagagtttgtatggtggtataatgggcacccagacatgtgcaacttggcacctgacttgacaaacacagattctgctgtggtccttggacaggggaaatgttgcgcttg

SEQ ID NO: 8131 - DNA, 269 bp, Triticum aestivum
  unsure (1)..(269): unsure at all n locations
  Clone ID: PAT_TA_8131
gtgcgagtcgactgggcttatccttgcgcgtagtggacggaatcgtgagttttgaggtcgggctggaactagaaatgtggtcggtttttcttttctcgaatctttttatttttgagttgaagaacctggatcagtgaaacgaaatttgtttggttggcacatgttacccgtgtcaccgtgtgggaccccgttgcagtgtttggcctaagattgtaaagcacaaagtaatcagnaataaactgaagctgttggagtagacaaaaaaaaaa

SEQ ID NO: 8132 - DNA, 340 bp, Triticum aestivum
  unsure (1)..(340): unsure at all n locations
  Clone ID: PAT_TA_8132
tcggcccgcggcaattccccccgcggcgacttcccgtggnatctggaaaggctgtgatcctcgagaagccgccgctggcgcgcaaccagagcattagaggtagcggaggcggcggagagcagtgccggatccgaaacctggacgatggacggagttcgagccccgcccgtcccgctcgccgtggcggtccctcctcgtcgccacccctctcctcgactcggcgggacgaggggagcaggggcagcagccagccatgcctcgtccgtctcgcatggtggcccaaatacggcttcctcgtgctctgtcggcgcccgtcgacctcgatccagctggggcagga

SEQ ID NO: 8133 - DNA, 658 bp, Triticum aestivum
  unsure (1)..(658): unsure at all n locations
  Clone ID: PAT_TA_8133
gggctgcaggnaattcggnacgagggagaggatggacgactggaagtccaagcagggcatctacggcgccgccgaccccgacgacatggacgccgacgtgcccctgaacgacgaggcgaggcagccgctgtcccggaaggtgtcgatcgcgtcgagcaaggtgaacccgtaccggatggtgatcatcctccgcctcttcgtgctctgcgtcttcctccggtaccgcatcctcaacccggtcccggaggccatcccgctgtggctcacctccatcgtgtgcgagatctggttcgccgtctcctggatcctcgaccagttccccaagtggtaccccatcgaccgcgagacctacctggaccgcctctcgctgaggtacgagcgggagggggagccgtcgatgctgtcgccggtggacctgttcgtcagcacggtggacccgctcaaggagcccccgctggtgacggccaacacggtactctccatcctcgccgtcgactacccggtggacaaggtgtcgtgctacgtctccgacgacggcgcctccatgctctcctttcgagtcgctgtcggagacggccgagttcgcccgcaagtgggtgcccttctgcaagaagttcaacatcgagccccgcgcccccgagttctacttctcccgcaa

SEQ ID NO: 8134 - DNA, 716 bp, Triticum aestivum
  Clone ID: PAT_TA_8134
cccacgcgtgcgcaactctagtgtcgtccctcgccaagaactagccaccgccgtcgcctcgcggcctccgcttccaagcctcgaggtctccggcgtcaaccgaagcaacggcagcatgaagcgcctgctcagacggctctcccgcgtgggccgcggccgacgcctgcgcagccgccgcgtaccagccgctccggcccgactccgcggcgaaggcctcctccacggcttcatcttcgtcctcctcgttcttcggcgcgcgaaggctcggccgcggcgcgcgggtgccggagggccacgtgccgttgtgcgtcggcgaagagggcggccccgtggagcgcttcgccgtgcgggccgaggctcctgggccacccggcgttcaaggccctgcttcggcgctgccgcgcatgatgtacggctacgggcaccctcgcgcgcggcgcagcccctgcgccgtggcccacccccactttcctactgcacctcaaccattttaagacctgctgtccttgtgggaattcttcttcttctcctgagggttcctggtagctagctctagatcaagctctcgtagctgcacgaagcctcttcggtctcgcttttgccgcggtctttgaggtctgggggacgcggcatgtaagccgcaaggttggcctcatgtgagtgaaatggatgattttgccactgcaaaagtttgatacaaaaaaaaaaaaaaaaaa

SEQ ID NO: 8135 - DNA, 907 bp, Triticum aestivum
  unsure (1)..(907): unsure at all n locations
  Clone ID: PAT_TA_8135
gcagtagtntatgcttgtctcaaagaggacgccggccacgccctggtatgggccactccgaactgcgtggaggccttgtcgaggtcccctccctcccgtcgtcttgcattcttgtggcgaaagctccagctccccttgaggacggtggcggcgttctgtcgtcgcatcccttcctggaggcaccatccggggtgcatggaagcaaggttggcgtttgctgcaggtttggttgcggttggtggcggctttctgtgcatcttcttccgccggtcttcgttgtgcagtatttttcttcagctcgtgtttggatgtgcggttggctgtgcttgtggcgaggtcgtgggagcgctgcggctgtggtttgagctctggttcctcttgcctaaggtgctctgttggttttgttcatgcggctctcggtgagcttcctacctcccgacggtacgacgcccttcgagccagggcgagaagattgtggtcctctttggagggggaatcagatggcttgctagcaggttctgccggagtaggcgatgtggcgatggccaccgttgctggtgctgctggttgattctctcctgtggccgagctagctgctgttctagatgttaggctgtggtaattcaggctgagctccttcttgtatctttcgcttgcctgtattgttggttggctatgagctgttgtagcactccgtatctttgtcgttccctgttttcctttcttgtaagtggtgtaatcgtggccggttgatggctttgttaattcaaagccgggctaggttcgagcccaaggctcggccatcgcctcttctctagaaaaaagcatttcaagtgtgtaagagaggagcaagtgtcgaattaattcattgtgatcacaaagggcaatatctgtccaaaaaaaaaaa

SEQ ID NO: 8136 - DNA, 829 bp, Triticum aestivum
  Clone ID: PAT_TA_8136
aacgccaacatcgaggagctggccaagtggacctccgacttgtcggaaagccggacagaggccaacgccgccctgcagcagcagcagctgggcgaggccaacactgccctgcgcaccaaggagaaggagtgcggccagctggctgaggagcgcgaccggctggccatgcagctggcggagcagaaggagctgctcaagaaggcccagaaagaggcggaaggacaaggagaccgccctccttgctgaattcgcgtccgagccctcctcctggaccgacaaggaggcgatgttgtcctccggcttccatgagatcgaggatctcgtcgatgacttcttccctggccactcggacgccaccaaccaggccatcgaggctgatcgtgaagggcagagggcggatggcgcgaagatcgccgctgactccccccgaacccttaatgagcagatcctgagcattgaggcttgtcttcggccggcccactggatgttgcgccggcttcaacgtgtcgacgcccaggcgatcgccgccctgtggccggacatgcaggcaccgcgcaccccaagtcggactgccgactggctggaggtagcggctggccgccttgaagcttggaagggctcttcagctcgggatggagcgcgccgggccttagagttcgtcaaggcgtggtatcctgggctgagtctagcccagctagccacgttccggctagaagtgaaggaaatatgccctagaggcaataataaagttattatttatttccttatatcatgataaaagtttattcttcatgttagaattgtattatccggaaacataatacttgtg

SEQ ID NO: 8137 - DNA, 423 bp, Triticum aestivum
  Clone ID: PAT_TA_8137
cccacctcctcctctccctcccgcgatcccctgtgcctcgcacgccgccaccgctcgccctcacgccgcctccgcctcagctcgccctcgcgccgctgccgcctctgcccccgctcgccctcgctccgctgtcgccttcgcctccgctcgccctcatctctgctcattaggaggagcgcggctcaccgctggacctcgcgagagaggtcagggttagggtctcggcccggggtggctactgcggagctcctggcgggctacctgctctgcctgctcgcgcttgcggtggccaaggcgaccacgctgctctgggtcatgcatcgtcgctccactccacgatgccatgttgctcccccgcgcctcctcccggtcctccaggaagaagaggatgcatacgaagtaaggctttggctttcctctcct

SEQ ID NO: 8138 - DNA, 741 bp, Triticum aestivum
  Clone ID: PAT_TA_8138
gttagttgacgttattcaggactggcaaaacggagaggtacaaagcaataatcaaatctggaactgtggagcctagacctggtgttttgcggctgatggatgaagttaagggtgcgggcatcaagcttgctgtttgctctgcggcaactaaaagttcagtggtgttgtgtcttgaaaatcttcttggacttgaaagattcaatggtctggactgcttcctcgccggcgatgatgttaaagtgaaaaaacccgatccatcgatatatattacagcagcaaagaaattaggattagaaagcaagaactgccttgtggtagaagacagtgtcattggactacaagcagcaaaaggagcagggatgtcatgtataataacatacacaccttcaacttctaaccaagatttcaaggatgcaattgcaacctatcctgatctcagtaatgtgaggcttgaggacctgaagctactgctccaagaatctctcgtcactggatagtggaatttcctgctttcggcaggccttattcggttggtggcgatccaatccacagaggggttggggtgatcccgcccctcacccaatccccgctaattcctccacacacacaatccctctactaaatcactgctcggttaaacctcttgcccctcggggagatttgaattgtgcatacctgttccgatgctgcggcatcagtaaaatatttggagtcacagcttacaacagcgacatgccaaac

SEQ ID NO: 8139 - DNA, 800 bp, Triticum aestivum
  unsure (1)..(800): unsure at all n locations
  Clone ID: PAT_TA_8139
angccctaggtccctgttttcccctcctattgantggtcagccacagggntgcncnttagctgaggtnntactgtcgtgcaggtttattncgtttatttccttttccgtgnnctttcatttccctttatgtctaaattgttgttgntttcttcctgnantaatgtgtgtttatggaaatcaggcccagaagttatgtanctcatccnttgtaatctttttaagggnaccatntggntgaccaatngtagtgggttgtgtgccantaggttattttattgaggttttgcttgaaaattcgtccaatcttaaaaattgtgatgaagtgttggaaaggataaatttatggaagtgattcatgatagctccttggaatgaaaaacgggattgccaatgatgttattgtaaattctattaatgtcaattgtgctaataatatgcaaaaccctaagcttggggattctagttttgctatgtccactacttgttgcaatgatcatgattggggtgattcttcttatgatcttgaaaatttatttaagtcccatgatgaatatgagattgataaaaatgtttgcaatattgaaagtgggtttggaatagtgtcaactttagatcccacatatttggagaatgttcaatattatgaaatttttgataaaagtgggtttggagaggtcatgactttagttaatgttaatcccactattttggaagagtgtcaacttcgcatgcatgtggatcgtgttgacaatatgttatgtgatagctataatgctgaatttgcttatgatcccacatg

SEQ ID NO: 8140 - DNA, 1244 bp, Triticum aestivum
  unsure (1)..(1244): unsure at all n locations
  Clone ID: PAT_TA_8140
cctgtccgaacgatccgatccgatctcgtcggattccttccagaattcaaaccgattgcggcagagtttgttggccagccgcctcctaatccaactccccgtcccgcgcgagcctctcttcctcccgctccgtgttggcgcgggacatcggcggtcattatttgatccgcggcaggcgcgtcccagccctgcgccgtcttctagtctagaatggcgggcgtcgggtcggcggtgcggcggctctacctctccgtctacaactgggtcgtcttcgtcggatgggcgcaggtgctctactacgcggtgacggcgctgctggccggcggccatgagggcgtctacgccgccgtcgagcgcccgctgcagctcgcgcagaccgccgccgtcatggagattcttcatgggctcgtagggttggtgaggtctccggtcactgcaactcttccacaaataggatcgaggttgtttcttacatggggcatcctgtggagctttcctgagacacaatctcatattcttgtaacttctttggtcataagctggtccatcaccgagatcattagatattctttcttcggcttgaaggagatgcttggatttgcaccttcttggcttttatggcttaggtatagcacatttctgatattgtatcctatcggtatccttagcgaagttggtctaagctacattgctctgccttatatgaaggtatctgaaaaatactttgttaaaatgcctaacaaatggaatttctccttcgactacttctacacatgtgttatcgccattggtgtctatgttccacggtgggccgcacatgttcacgtacatgcttgcccattaggaagaaggccctgtcaaatgcaaagactgcatgaagttgatatggactttattgttgtggcttgcaatacaaatccgccattcccatcgtgttcgatttgcccggtgggcctctcattttcagatataagtttgccgagagggataagaccctggcataggcaaagactacaggaagttgctgtgagccttgtagctggagcatgcaatgcaaactctccagtctcatgttgtacgaatagctggtgtgagttgtcattgtagagtagttggtgtgagatcggtaattctattcggtgaattacccgacctgtgttgtaacaatgatgattgttggatttcccatggtggaatccatcattgatcaaactctgcattgagccaanattagaccaaagaag

SEQ ID NO: 8141 - DNA, 2080 bp, Triticum aestivum
  Clone ID: PAT_TA_8141
ctttgcaaagaatggagtgctgaagaatttgaagaattgattcataagacattcaaagatgtcatatcagttgaccttgcaacggcttcaaatcttgattcttcaacgagcaaaagacgtctaaatcgaggctttgcgttcgtgcgattttcttcccatggagctgcagcacgtgtactccgtattggttccagaacagattttatgcttggtggtattttgcatccagcaataaattgggctgagagggagtctaatgtggatgctgatgaaatggccaagattaagactgcttttgttggtaatctaccagcaaatgccaatgaggaatatttgaaaaagctttttggacattttggagaggtaattcgggttgcggtctcaagaaaaggacaatacccagttggattcattcactttggcagtcgttcagagcttgacaatgcaataaaagaaatggatggtaaaactgtcagcggacctaaccgagggccatctttcaagatccaggtttcagttgctcgacctgcagtagagaacgataataagagaagtcgtgaagaggtgaaaactagaagatcaaatgtatcaggggccacgccgccgcggtcgccgcgcccgcgcggacatgattcgattgaacggcaaacgaaagctccaagactatcaaacagggtgtctgatgtcactgatccctatgaagcagctgttaattcactaccttcagccgtcaacgaactcttacttcgtattttacgtcttggaattggcagtccatacgacattgacatccattgcataaagagcctcagtgagctccctgagtcaggtgctgttgccgtccttaatcagtttttgataacaggttctgacaaacgcaataaaggagaatatttcctttcattaattgctaagcgcagcggggaggcttttggcgcagcacaaatattacaggatactacttatttgtccagaaattctgaaatacaaaccaagcgataccggcatcaagattacgattacacagcatccgggagcagtagatacagctccctaggcggttatccttcctcctcttatgttgacgatccaattgtgtctcagtcaagaagatatgccgaagaaagacccgctgttgtaagatacccagagccaagactgcggcgagaagaagtactacttgaaccacgaccaaatattggaaggcaactagatcgaatatacacacaagaacagagttataacgaaagatccgcacatgaagccaggcaggacacgggaaggcatctagatcgaagagacatacatgagcatagttataaggaaaggtcggcacatgaacccagacaggacactggaaggcatctagatcgaagatacacacaagaacagagttataatgatagatcagcacatgaaaccaggcaggacactggaaggcatctagatcgtagaaacatacatgagcagagttatattgagagatcagcacatgaacctagacagaacaccggaaggcatctagagcgaagatacacacaagaacagagttacattgaaagaccagccgaagctgttctctctagggaaagaagattggtatctgccacagggtacgccacaaacatagaaccagaattcaagtccaggtcctctgctgaatattctgctgaacatcagcagatgaggtttgttccctacccaggggagccttgcaagtttgatcccttcactggggagcccatcaggccagaaccaagcctgcgtcgctcaggaagcttatactgcccggattgactgaagaagcatgttttggaataaatccccggcccccccccgggaaaaaaagccagtgtgcgcttcacctggctatgatttgtgataccccctgacattatgaaaccctccttccgtttcaaacataaggcgtattaggtttcgttaagacaaggctctgaccaagaattactttgttaacatgtgggttacatggcataaaattggtagccctagattcttattcgaaagtgtttactataatttgtgatattctttttatcatgtatataaccacatatta

SEQ ID NO: 8142 - DNA, 131 bp, Triticum aestivum
  Clone ID: PAT_TA_8142
cctactaggttaaaaccaatgcaactttgcacaccttttcatccataaactcggatctttgtttacaaccacgactagaacatgaaaaaacatccacatgcctttcctgaggttcctgactagttttatct

SEQ ID NO: 8143 - DNA, 1923 bp, Triticum aestivum
  Clone ID: PAT_TA_8143
gaacatgaatgtcgtctctattaatacagatgataatgccaattactccatatttcctactaggttaaaaccaatgcaactttgcacaccttttcatccataaactcggatctttgtttacaaccaccttttgatcattaaaaacggatccatgtttacaccctcggctagaacatgagtaaaaacttacatgcctttcctgagattcctgactagttttatcttctactatctcctaacatttagatatgatcacggagacctccggtgccgggtctcgtcgccttcggctatgctaccctctggcttccacatgacatccttcaggccattcgagatactatggtaaaacttgtggaactcgagggtatcgccattcgacttgcggagctccaccatgtagagtgagggtgtcacttcaaaaacctctgttgcaattgccagctgacctttccttccaggattctctccttgcaacttgagcttgtagttgcgcttctgtacattgaagcccatgggtcctgctgctgcttcaattttcgacaatatttcgtttgctggaagcctcgacgcaaaccgtgtttcacgtttaacagaatccgtttgcttctcaaaaagtgtgccaagattgaggccctgggaggtagagatcaactcgaatgcattcatcactgccggcctttcttcacgtctctcgacaacaagttgtgctgggtccccagattcattgaaaatagagttaatgtcatccagattaacttctgctgtctcaaacctaggaggctgatatcctttcttgaaccactcattgttaataacctcagcaatagttattctactgttaggattaggatctagtatcttcttgatgagcttctttgcgctcgtcgagaaccaagatgggcaactgaagtctgctttgtatatcttcttgtaaagcgccatgagatttgaatcttcgaacggaaggtagcctgccatgaggacaaagagaatcaccccacatgaccacagatcagccttggctccatcataacctttgttgtttataacctcgggagcaacataattgggagttccacaagtcgtatgcagcagcccatcctctctgacttgctgcgatagggcgctgagtccaaaatcggacaccttgagagtaccgttagcatcaagcagaagattttcaggcttgagatcacggtgatagacgcctctgctatggcagtagtcgacagcgttgatgagctgctggaaatatttcctggcgtcgtcctctttgagcctcccacgcgaagcgattttgtcgaaaagttcgccacctgtgacaagctccatgactatgtatatctttgtcctgctggccatcacctcgtacatgcggatgacgttggggtgcctgatgagcttcatggtggagatctcgcgctttatctgcgcgatcatcttgtgcttgaggaccttgtccttgtcgaggatcttgatggcgacattctcgccggtctcgacgttcctggcgaacttgaccttggcgaacgtcccttccccgagcgtcctccccagctcgtacctccccacccgcgtcctcccgccgccgccgccgccgtgcgcgctcatcttccctcccgcgctcgaatcaaccattcagccaacacccaccgattaaaagaattacccgataaacagatctgttcctgcgggcgcgggtcgccggcgactaggacctcttcttgtcgcagggcctccactgcacgaagagctccttgttgtcctccccttgctgccgatgccgcatggagtctggtggtagttagttctcagcgaactcgtagagtcgcaggcatgggagtgggatcaagattcaggaagagaggcagtagtagtggcggttggacgcgtgggcggacgcgtgggcggacgcgtggg

SEQ ID NO: 8144 - DNA, 1648 bp, Triticum aestivum
  Clone ID: PAT_TA_8144
ttcgccgcgccgcacgacgcgaagccgatcggggccgtactgctcgcctgcccacctccgccggagaggagcaggaagaggagcaatcgcccgtaccgggcctgcacgccatggcgcgcagcggagggggctgctgcccctccatggatctgatgcggtcggaggcgatgcagctcctgcaggtcatcatccccaccgagtccgcgcacctcgccgtctcccacctcggcgatctgggcctcatccagttcaaagacctcaacgcagacaagagcccgtttcaacgcacctatgctgcccagatcaaaaggtgtgccgaaatggcccgcaagctgcgattttttaaggaacaaatgtcgaaagctggaatactagtttctcctatgcaatcaaccgaaactcctctggattttgatgacatggaggtaaagcttggagaactggaagctgaacttactgaagtaaatgcaaacgatgaaaaattacaacgggcccacaatgagctgctggagtacagtactgttcttcaaaaggctggtgagtttttctattcagctcaaagaagcgctgcagcacaacacaggcaaatggaagcaaatcagtctggtgagacttccctggagagtcctctgctggaacagcacgtggtaccggacgcatcgaaacaagtgaaacttggctctttgagtggtcttgtgccaaaggaaaaggccatggcttttgaacgtatcttattccgtgccacgaggggcaacattttgctcagacaagagtctgttgatgaacctgtcactgatccgcaatccggagaaaaggtgtacaaaaatacatttgtcgtattctactctggggagagggcaaaggccaaaattctgaagatatgtgatgcttttcgcgcaaaccgttacccttttcctgaagaccttgctaaacaaacgcatactgttcaggaggtatctggaaagatatcagagttaaaggcaacaattgacatgggattagctcatcgtgacagtatactcaaaactattgcatcagagtttgagcattggaaccatctggccaaaaaggaaaaatcaatttaccacactctaaacatgttgagcgttgatgtgacgaagaaatgcttagttggtgagggctggagtccagttttcgcagctaatcagattcaggatgcacttcagcgtgctactctcgagagcaaatcccaagttggctcgatttttcaggtccttaacacaaaagagtctcctccaacatatttccaaacaaacaaatttacctcagccttccaggaaattgttgacgcatatggagtagctaagtatcaagaagcgaatcctggtgtatacactattatcacttttcctttcttatttgctgtcatgtttggagattggggtcatggaatttgcatattacttgcgacactctatctgataatccgagagaagaaattcgcttcacagaaacttggagacataatggagatgatgtttggaggccgctacataattatgatgatgtcaattttctcaatctacacaggattaatatacaatgagtttttctccgttccatttgaactttttgctaaatcagcctatgcatgccgcgattcttcttgtagtgattctactactga

SEQ ID NO: 8145 - DNA, 323 bp, Triticum aestivum
  Clone ID: PAT_TA_8145
gctcagccgggccgggtatgttcgccatgtaggacaactcgactccatgcctggcgcggccgtggcgtgcatagagcatccttccaggtacatcctggagagcaagaacaagggagcagtacgcgtggtctcgccggcgaacaacaacacacggcgtggagatcgatcgtgcctgcagcctgcagccttccaggtactgcactgttttctcatgttcccttcgccacgttaggcctgatatgtggagtccaccagtcagatctgctattagaatctctctgcccataagtcaatgaaaaatgttttatctgtcaaaaaaaaaa

SEQ ID NO: 8146 - DNA, 969 bp, Triticum aestivum
  unsure (1)..(969): unsure at all n locations
  Clone ID: PAT_TA_8146
atctgatgtgttcagctttggtgtcttacttctcgagatccttagcggacaaaggaattctggtttccatcagcatgaagactttcttaacctacttggatactcatggcagctctgggaaggaggaagatgtcttgagattctagaagcatcaattgctaaggagatccatgcagccgaggctaggaggtacattaacattgcactaatgtgcgtacaagagcatgcagatgatcgaccgactatgtcaaatgtcgttgcgatgttaaacagcgagggtgttattcttccagagcctaagcatccggcatacttcaacctaagggtatctaaggaagatgaatcgggtagtgttctggacagtcataatgatgtaactatctgcagtaataatgacgtaaccatcactgaggagccagatggcagatagttggtcactttgcttcagtccttcagttgttaatggaagtgctagcaatcagacagctggcaggcataccaagttagcataccagcctgtcatattttggttctgatgaaggattgcgacccggcgtaccctctgtagagcttgcttggtgtccgtaggctatattgatatgcaggttaattctgtatttagccttttgtgcacctcaccattgttttccactggtggctgctgctgtagactttcaaagaagacttgaaatccaaaggattaatctcaatctgaaagtagctgcattaactgaatcctgctgggcgaagtatgtnccgcatctatgtgcgcctttcatgttttcctctaggttaattccattggtgtgctagggttgtagcagttccatactgttacaaaaagaagcatttttttgtagagttgtcacgataataccaacattgacggtggataaattcattgactgtaccactcactcattgctgctaagaacaggnagtttnatttacagtttcaagcaaaattta

SEQ ID NO: 8147 - DNA, 727 bp, Triticum aestivum
  Clone ID: PAT_TA_8147
aattcggacgagggagaagcaggggaggcccttcacctcctcaattccctccaggaactcaacttttggaagtgttggaagctgcagcgcctccctgcagggctaaccaagcttgccagcctcaagatattacacatttgggggtgtccagccatccaattgctgtccaaggacggactaccaagctctctgcaagaattagagatcagagactgtcctgccatcaaatctctgcccaaggacggcctgccaagttcactgcggaaattacaagtttctaatggcatcagcaaggagcttaaaaagcagtgccgcaagttaaaaggaaccattccaataatcatagactacaacaacgacgactactaacccaagggatcttctttgatttgtacattcttctagcctagccttgtagatccagttctttctgcatccaaacacagttcaaagagtatacttctctgtacaactaatccaagaggtcttcttggacttgtatattcttctagcctagccttgtttgttgttccagttctctctctatccaagaacagaaggttccagattatagcacccatccattactaaactggcctctgccatggagttgtaaaagttcttctatccttaaagtttttgcatacacgtacagttcggacgccatggccctgggtggtatcacctacataaatatgggatctgtcttggagttgttcattcttag

SEQ ID NO: 8148 - DNA, 1348 bp, Triticum aestivum
  unsure (1)..(1348): unsure at all n locations
  Clone ID: PAT_TA_8148
gggagctgcttcaacttgccgtcctacgcgtgcatccgcgaggggccagatcatgcgccccggtttaaggccacggttacttttaatggggaatcgtttgagagcccagggttctatcccaccttgcggcaggcagagcatgcggcagctgaggtagcgctcaatgagttgtcgaagagggggccatcatcatcgcttgctgcaaaagtcctggatgaaactgggatctacaagaacctgctccaagaaactgctcatcgggccggtttaaaactgcctatgtacactactattagatctggaccagggcatacaccaacattcacgtgtacagtggagttagcaggaaggatcttcactggcaatcctggcaagaccaagaaacaagcccaaaaaaatgctgctatggtggcctggtctgaattgaagcagctgcctctagtaggtgaggcagcatcttcatcttctccgtccgatcatgacgaggagcaggaacaggtcacagttacccgcactcttgaaaacttgaaccgaaaaaatgaaggcaaggcatcacatcaaaaggaaaaacagcaaagcaataaccgcccgcagtctcggagatcttatcctaaaccctatgtgtcattttacgggtcacacttacaaaatcagatgtacccaaatgttgcaccagagcaagcaatgtaccatatgtggaaccatggtgcaagcagcacatgcagaagccccatcttccgatggttccagctatgggcaacacaaggtttcaaccgccaccaactatgcgctccatgtaccctcctccacctagagggcagtttgccgtgccagccagcctagatgctttagagctcttcttccatgttttcctgaagctgctcctgtccttcctcggtacttctcgccttaccctgcctcctacgtgccaagaagtccattgccagttactgtgcacacaatgcacagggaaaggcaagggtatactgaaacagttgagcttcctgatgcctcagttttatccggatacactgctctagattcctctagtactccagaaaatgtcggtccaagtcaggttcaacaatggcctgaaaatgggaaagaggtgtatacagagagtagtgctgcctccgtggaggagaataaagctcctcaaaccctgtcaagctccacagcacatccaccgtcgcagaaggtggaaccaaatcaagatgacaaagagccaaagaacccagcggaacagccaccaaagccgtcattgtctcgtgctggtnnatctgttgtacaaagctgtcnaanganaggtcaccaaaccntgttaaanagggggacctaccaaaagaat

SEQ ID NO: 8149 - DNA, 918 bp, Triticum aestivum
  Clone ID: PAT_TA_8149
ggcggcacgtcccacaatcaggagactggacagtgagaggaagctactaacatacagccaggaagctccaacagaacccgaaaagccggccgaagaggagaaagaagaacctacaaagcttgaacaagaaccggtgcctgaccctacgcctgagcctgaacgacaaactgctggcaatggaaaccactggagatttactcaacctggatgaggaggtgaatccctttgtcgtggatcttgatgaacacaacgcgcttgcactcgctattgtgggaccaggagatggaagcaaagcatcaacttgtcaaaacttgttttctggcagcacatctggatgggagctggccctcgtcgctgctccaagccgcttcaccagccaaccaatggagaccaaattggctgggggctttgacataatgctactcgacagcctatacgaagacagtgcgaggaggcagcagatcaccccgcgtgacctacaatggcagccttggacaagccaacaaccccttcgaaacgaacgaccttttcgccatatccaacagctttgcgccgccttccaacgtccagctggcaatggtgacccagcagcagcaatacttccaggctcaacaacatcagcagcaatgctactaccagccccagctgcagcagcagcagcagtatttccagtctcagcagcatcagcaccagtatttccagcagcagcctcagtattgtgtgcatccggccggaacttacaatccgtttggtgaccctttcactgaccttgtaacactggatgctcctccaaaacaaggcaatttaactttgctctgaattgcccggccctgtttatgatctcagtcaatatagatgggtactcccattctcagtagagcaaccagtacaaattgaattgcttcctgttgggttaag

SEQ ID NO: 8150 - DNA, 941 bp, Triticum aestivum
  Clone ID: PAT_TA_8150
gtgcatctcaaggtggtctgggccctcgtgtcgctccgccacccctgccccctctgtcgagatcgagtgtccagtcggtggaggctacggtctggccgtcgctggtgccccgcgactccaggtggttctcaaggtggaagagggaccggccgagctctgcatcaccaggcggtttggggtggtggatgatctggagcgccggctccagttcgccatggtggcgtacgttgcgggttcaaggcgagttctttcgatggatcgggtgaaggagatgctggagagcacgttggacatcgccccagagctaatctcggtgcaccgccactgctcggaggattttctcatggtcttttcctcggcggcgctcaggaacagggtctcggcctgcccctccatcgaggaccgcggggatcgtctggttttcaggccctggaacagacagtcgcaggctgtgcattcgataccggggttcaaggtgtggctagagcttgaggggatcccgccccatgcttgggatcgtttggtggttgaggatctactgggctcgtcgtgcaagctcgatgccgtcgcatcgagacagcttcccgcacggacctgtcctcgttcaaggtcatggcgtggatggcagacccgcagtgcatccctacgctgcgctggttggcggttccggagccgggcgaggagcggcctccgacattgcttcagtacaaggtgctcatacacctggatgcggtgatggatctgagggacggcggcgagccgtggttcttcgagggctcatcggacagcgggcaaagcggcatgccagatcaggacggaggcttccctgggtcatgtgcacagatgcgtaggttgcaatagcagttcggagtcaggaaaagcatgaacataatcttctgtcctattctccaagatggacgggccttcattatttgagacca

SEQ ID NO: 8151 - DNA, 954 bp, Triticum aestivum
  Clone ID: PAT_TA_8151
ctcggccatggcagaagcggcggcgcagaggcttcttgcggcgagcacgaagatcgtaggggccgggcgcaactacatctcccatgccaaggatctcggcaaccctgtcctcaaggaacccgtcctgttcctgaagcccacgtcgtcattcctccacgccggcccgacggccggccccatcgaggtgcccgagccgctcgagtcgctgcaccacgaggtcgagctcgccgtcgtcatctaccggcgcgcgcgcgatgtccccgaggccttcgccatggatttcgtcggaggttatgcacttgctttggacatgtcatcaaacgatctgcaatcagcttctaagtctgcaggtcttccttggactttgggtaaagtacaggacacctttactccaattagtgcggtggttccgaaatctgcaatcgctaatccctatgacctagaactgtggctaaaggtagatggtgaacttaggcagaagggacttacaagtgatatgatattcaagattccttttctaatcagttatatcagttccatcatgacattaatggagggcgatgtgatattaactggtactcctcccgatggcgttggtcctgtccgagtgggacagaagattaatgctggtataactgacctcattgatgtagagtttgatgttgagagacgcaaacgttcattttcttactgatgcagtaagcaagaaatatggaaataaaattctgagagtaccggagaatcattctcgaggaatatttggaatttgaaggattttggggatgcaatttcaacctctgctttctaccgatcctggtgaatatatctgttcctgtggttgattacgacccgtattaagttagtgccggatgatggtgccacttggagctacgcacatttacgtttttcagtccaccctctgtcagacatgtggcaacatttggcaattgctgc

SEQ ID NO: 8152 - DNA, 771 bp, Triticum aestivum
  Clone ID: PAT_TA_8152
ggaaatccgtagatctacgaaggaacgccaaaagcgaaggcagctctctgggtccctaccgacgctgggggtgcgaaagcttggggtgcgcacaggattagataccctggcttgtccttgccgtaatcgatgactgttcgcccttgtgctacgcggattccgggccccgcttacgcgtgaagtacttcgcccgaggagcacggtcgcaagaccgcaacccacaggaataggccgccgccagcacacgcggttgagcattggggttgaaacaagacaagcaagagcaccgctcccccccgcgacatacaaacaccacaatctttcctttgcagcccccggctgtttggcattttttgcatcacagcaaggtgtctgtgtgcctcacaagccatgggatgtcgcaaggagagccagcatgaagcagcagcggcagcagccacaacgaacaggaagatcctaatcctggattcgtgtaaaaagttttgtacatcatgttcttttgccgcagaccacatggttgtgtataagtagccttgtagccttttttcttgtttgtcacccaatatgctatgctggcgatgttagtaggtggccattgatcctgttggctgaagaatcaggtaggcacgcacttggttaaacaaagtggaaactgggaaatgcagttagcaaaattcttggtgacttttacagaattggatgttactgaaatttgtcttgtcttgttatgaaatcttgcttcgttaaaaaaaaaaaaaaaaaactcgaact

SEQ ID NO: 8153 - DNA, 697 bp, Triticum aestivum
  Clone ID: PAT_TA_8153
gcctcgtgccgaattcggcacgaggctttcctggttctctgcttcttttggtaatgctgaagggaagagcctggggccagtcccgggctcctgtttgggatttcccttggatctgaaaggaaggttcgggtggcgcggtgccgacgctgggagtggcaaccccgacgcgctttccgtcaggtcgcccgtggcgttgacatcagtgggaggggatgcggccaacaccacgccacaactcgagatgggcacgtgtcttctaacgtcaaggctcccgggggcgaccatgctctctgtgggagggtttagagagcatggtgcccggcatggtggtcgcgccaaggtcttcgggtggtagtgatgcggacggcaccgacaacccacgatgcgttaagaacagggacgaccgtttcgacgagtcgtgtttgccggtgactccgtgccacccatctggtcttacggcagcgtcaccatccacgtctgacctccagtttcttcctccatgtcggggagcggcgccgccctgatcctagggaggcgccgaatcccagctgtgcgcacctccggccccttcgacctcttcttgcaggagatggacaggggcaaaggcgtaacggagcacttatcttttttcaatcttaaactagccggtaattgccaaattttaattcaaataatgaatctctcaagtccatctttg

SEQ ID NO: 8154 - DNA, 1476 bp, Triticum aestivum
  Clone ID: PAT_TA_8154
gaggaattcgccgccgcccgcagccgcgcttgaggatgggatgctgcagggtctgggggacgaagatgatgtccgtgcgccgctgcctgtgaggcgcgagactctctacggcgacacaccaatgattgtgactcggcctaatgcgacggttgcatttcgtaactttgaagaggaggcaagacaatctgcttgggattctgaacagaatgccacttccagttctcgtgataacctggcttctttatatcgcccacctttcgatttgatgttcaatggaccatttgacaaggcaaagttagaggcctcttctctagacaagtggctcttgatcaatttgcagtcaacagaagagttcagctctcacatgcttaatcgagacacttgggcaaatgaagcagtggctcaaacaatcaggtcaaacttcattttctggcaggtttatcaagataccggtgaggggaggaaggtgtgcacctactaccatttggtctctgttcctgccattctcctaattgaccccatcactggacaaaaaatgcgtggttggagtggaatggtttacccggacagtttgctggaggatttgatgccttacctggagaaaggtccaaaggagcaccatgctgctcaacctcaaaaacgcccaagaaaagttgaccaggaaacctctatggttaggcaaggtaaaacagctgtagagagtgaagatgaagaactagcacgggcggtggcggcttccttggaggagaacaaaggagccgggggatcggatgccgctgatgagaagtctaatcccgtggaagagacggagcccagcttgagcgtgaagatcgagtatccccctctccccgaagagccgaaagtgagcagggaccttctctgcagggtcgccgtccggctgcccgacggtcggaggatccagaggaatttcctccacacagacccaatcaagctgctgtggtcgttctgctcctctcaggtggaggaaggcgagaagcgggccttccacttcgggcagcccatcccgggcgcggccatcaacaagctgcagtacgggagcgagcagaccttcaaggaggccgggctggccaactccatgatcaacctcttgtgggactaggcccatgttaacaaggccccatcatcttgcaaatcgtgccattccttggtgggcttcgtatgtttagttccttttcgcgaggattttaatttaacttatcgcctcttttttttcactccctgtggtcgtagacttggtaggcttgcagctcaagtgtgaaaaatgtttcttcgtcgtcgtgtcgcgtcggtcatgttttgtttatagacccccctcctccctgtagtaggactttaacttgttcgacttgatgcacatattattcatagcgactcgtgctagtaccgagtgctagtggtttttaccgactgatcctctttcccaaaaaaaaaaaaaaaaaaaaaaaaaaaaaaaaa

SEQ ID NO: 8155 - DNA, 685 bp, Triticum aestivum
  unsure (1)..(685): unsure at all n locations
  Clone ID: PAT_TA_8155
ctgcgatcctcgcatcgcggcttcccgtcacatcttgaccgaggaatttctgtggagccgcccgtggagtcaccggaggcttcttctgcggtgtccagggcggctgggtcgtgtcccgttcggggttgatgcgcggcgtctccggcgccactgctgcgacgtacggccagactggtgcttcagatcgcggagccggcccggggttgtccttccacttgctgtggctgtggttggggatcggtggtggggagtaaggcctggggagtgagcagatggaagaggactgtactttactattctcgctaccacttggatttcgctccagttagagagtagattagccttatcttgcttgccgatcagagcttagagtggtctggtcgtgctcgccggagcaggttcttggtggtttttgggagcagttgctcaatcgctgcaagcagaagcataatcgggagttggtttgtctgaggaaccagtctgtgtgtggtggaatcgcgcaaatccagctttgcagggttgctgcagctggatatggtgcatgcgaaagaatctggagagcttgttcgattgctttgcgtcacacaatgtctcggtgcttcccattcccgcctcccgggtatgaggcaaagcccaggagtgagcataaggatctgctaaanaaggaaaatcacaaggcaaanaa

SEQ ID NO: 8156 - DNA, 703 bp, Triticum aestivum
  unsure (1)..(703): unsure at all n locations
  Clone ID: PAT_TA_8156
ccgaantcgggcacttngtgcggatgaatggccggntcggngacttggggcctcgcgatgctgtatgaccacactgccgacccggagacctcggcatgttgttggaaccatagggtacctagccccggagatcggccgcaccagcaaggcgaccatcctgaccgacgtgtttgccttcggcatattcgtgctggaggtcacctgtgggcagaagcccatcatgcaaggttcgaaggatgatcagctcatgctggcagactgggtggtggagcactggaacagaggctcactggttgagacggttgacaccaagctccaaggtgaatacgatgtcgatgaggcgtgtgtggtgctgaaggtggggttgttatgctcccacccatttcctgaagcaaggcctactatgcggcaggtcttgcagtacgtgaatggtgatatgccggtgccggaactagttccggcgcacctgagcctccagatgctggcgttcatgcagaatgaagggttcgattcatacatcatgtcgtatccttcgtcggtggagagcattaacagcctcactagccttgtgcacgagagataagatatgatgttaacattggtttctttgcatgtattccttgtctcttgtatatgggcaattaagctcatactttggaggggtattttctcaccaatatatatgcnnngnctnaaaaaaaaa

SEQ ID NO: 8157 - DNA, 848 bp, Triticum aestivum
  unsure (1)..(848): unsure at all n locations
  Clone ID: PAT_TA_8157
ggcacaatgtaatcttttctgatttccttgatctttactgacacgtggtgagcttgatttgctgactgatgtccaacggcaagccgacatataacagtgactcttcttacatgtcgagcataccggtctgttgctttctcagggcaatgcagccgacaagtagtttacttcgctggaccggtgatctccataagatcttcctggaagctgtagagtatcaaggaggcccctatggtttggtttcttgaactttgagcagacgatgtcaaacaattcattctctgttccttggatctgaaacttctcgatggaactgatgctgtgctactcaaccgtcgcaactccttagaggcgaagccaactgcggtgaaggagaaaatggaagctatgggagtcacaggcctcacaatctggaacataaaaagccacctccagagatacagggagaagtgcaatttaggacctgaacctcctcgggatgtccgaggcactgcatcaccaaggaaggcaggagataatgtgtttggttctttgatgaaaccatctcaccccgaatacagagtaaaaagcgatgcagcaatgaatctgactggaatggagatggcgacctatttgcttatggatgacacggagatggtggataccgcattttctgcggatgagttgcaggtgatggagaaggaactgatgaatgcgatccgggcatgaatgtattgtcgagcattgttctcggaaaacctagttaccatctttgttccttgtaagatggggtgcgccggcccctgttnaaaataaataaatttaacgangttgtgtgcacatgtcccacatatcaaatattaataaac

SEQ ID NO: 8158 - DNA, 761 bp, Triticum aestivum
  Clone ID: PAT_TA_8158
ttcggcacgaggacatcaatgaattctgcagccgaacgagcccattgaatatatgcaaaccagtgagagcaaggtgtttgttgactataactactaccagctgcaacagcagaaacaggcacacgaaaggagtatcaggaaggctgttagaataaatagaagaaatcaaccagcgcaaccaaactatcaaacagataactagagaagcatccaactatctggaagaagtgcatgatgcatcaaacaaaattcatggtcttgctgccattgccttggaccatgtttcctcagtgtctctttttgatttcaggcaggctattctagagattcatgatgcagttgttgcacttcaaaacactacatctactgcacgtgtctcactagaggaaaaaggcatgtactcagacgatgatgtggcagatccagtctacagtggcgtttctggtgatgaaactgatgaatactatcatcatgatgactatggtcactatgtgcgatccccatgagcatgttgtccagcctgctgagctatctggtcaacatgtgaagctctatatgcatagcttcaccacgaaggcttgcttcttcttagcaagaaccagtctggttactatgtttagtctactggtttatctaaataaaatgtgaagctctatgcttacagcttcactttaggaactgtctccttttcagactactctctggtcatgtataaatatgggatctattgtactatctaaaaccaatgtaatttatatatg

SEQ ID NO: 8159 - DNA, 527 bp, Triticum aestivum
  unsure (1)..(527): unsure at all n locations
  Clone ID: PAT_TA_8159
tttgccatcaacttgttgctctcagcaatcctttattgattttccaagcttacttatgtttaacgagatactacagcagtgcacaagggnttctaggtaatcaattccaatctcanncccagaanaactcctaaacagcggnatcgactctcnaacagaccccctaagacaagggnaaaaaaagacacctatatatatcacgtgcttacagtacacctctcntctcatgactataacaacaaatctataattttcaaccgagggaaacangaaatggnggnaatcaaccggngaatgcagggcaaacaagatctctataaactggggtcgggccggtgnaaaaaacaaactgtcgcccggctgttggtttgggcatgcgatcgggcttcccttccctgactcccttctgcgctgccctctccgggcccttggtgagctgccattcttttgtggcccgagcccctcctccagcgccccccggggtgggccctcaataaaggattgcttagagcagcacanaanaaaaa

SEQ ID NO: 8160 - DNA, 620 bp, Triticum aestivum
  unsure (1)..(620): unsure at all n locations
  Clone ID: PAT_TA_8160
gagaactagtcgcggnacggtaccttgcagtgcattggaaactcaagagagctgaaaaccaagtacggaggctcatatgtgctgacgataacgaccacggcgggtgaggaggctgaggaggaggtggcgaagctagtccagtccatctcgccggctgtgagcagggtgtaccgcatctctgggacgcagaagttcgagatgccgaagcaggaggtgaggatatcggcggtgttccatgtcatggagagcgcgaagagcaggacgaccgttcttgcgtggggcctggctgatacgactctggaggatgtgttcatcagagttgccaaggagagcgaggtatcctctgtcacctcatcggcaagataatccggcccagaagagtcactgtttgctgttcatcacagttgcagcttcagagatatcgtcgtgtggcaaattggcagtgcatgtagctttaaggcttcaaatgagtttggactttggactatggaaggtgtagctttagattattagatatatgtcactgaagaactcagggataaggatttctaaacgataagaaatatgtttcaagttaggtagcttgaaaacaaaataaaaaatttgacacaaaaaaaaaa

SEQ ID NO: 8161 - DNA, 669 bp, Triticum aestivum
  unsure (1)..(669): unsure at all n locations
  Clone ID: PAT_TA_8161
gctgccntggnacccggtgagatccactgtcacctcttctccagcgccccgatgtgccgtgcccctgccctccggtggttccccggcgacggatccggctgggtctagcccctagccaccttcctcctgccctcccgtggtgcccccctccgccgaccagcgcgaggtgctcacccggtgtggtagtcgccaaggcgtcccctcccacggatccggcggccatggccgcccctggctcctctaatgcttcctctatgcagttcgacagagctccgatggctctccatccacggattcggccgtcccctgaccaccggaccactgatggcgagttcctccggtgagatcttctctgacgtcctgcactccgcagctgctcccgcgtgtgtgcagtgcacgaagagtgcgcgtgcagtttctttggcgtcgcagtgccgctctcttcttcatcccgaacagtcccccctgcgccctacctccaactatagcatgacgagggcgatgggcatccccgccgcctccatgcggcgacctccctccccaagctcgtcgcggtggcggaggagcgttctcatggcaaggggaggtgcgtgcgcacggggctccactggcggcatctgcagttcactccatgcaagatgaggtgctcctcctcgtggacgaacagtt

SEQ ID NO: 8162 - DNA, 1213 bp, Triticum aestivum
  Clone ID: PAT_TA_8162
cgtcgcagggtattcattttgtgaaaacttgccttgatgcactatcgaatggttgaggctgagttcagtaagtttggttcaatcaagcctcgtggtatacaagttgtacaccgtcaggctgatgggttctgctttggctttgttgaatttgagtctgaaaaatcaatgaatgcagcaatcgaggtatttaaagttcgttttggctcgtatgtgtcttatgtcgaggagaagcgaactccaaaacgagttgttaatggagtcacccatagtgagtacaatggcaatgctcggggcagtcgggtcctgccagacagaggtggttaccatggcgacaacttcaggggacagggagcaggctttgtgaacaatggcaactaccgtgatggcgacaacttcaggggtcaggggccgagctttgggaacaacaataactaccgtgatggtgaaaacttcagaggacggggagcgggctttgtgaacaatggtaacaactaccgtgatggcaataacatgaggaatgataacagaaatcagaacgagtactcaggccatggtcgaggaccgcaggggaatgactaccgccagaatgactcccgtcagaacaggaatgactaccgtcaggacgggaacggctaccgccagaatggagacgactaccgccagaacagggacggctaccgtcagaacggagatggcttccgccagaacagggacggctaccgccagatcggagatggcttccgccagaacagggacggctaccgccagaacggagatgactaccgccagaatgggaacggacaccatcagccacgccccgtccacaacgggaacgggaatgcgaatgggaggcctggccgcttcaatggtcccaagcaaatagcagttaccgcatagtgtgtgcaatccagcaaagtaggaaactagagtgttcgcctattgatactgtttcgcaccccctactcctttaggaatctctgaaatcatccgcattctatcgcatgttcaacctgatgataccaagtttcggctggtgcctcttttgtggctggttgctgcccgcattttgaatgctctgacctgtaaacatcatgcggagattttatgtagatgtggttcggtttttgtgcgaatcctaaatcattgacgctgtttggtgttagttcctgggggctttagcacaattcttttatggcaggctggaactcgcttg

SEQ ID NO: 8163 - DNA, 308 bp, Triticum aestivum
  Clone ID: PAT_TA_8163
tgcaatgcattaaaatttctatgctggcttacattgcttatcgcctagcaatgttccgttataggccggagggcctgactataatcccagttctgtggtgtaaaggttcataaggcaattaaaattcgaaaatccttactgcaacacaaagattttgcttggctccgtgctcttgcctaagaagatgatggcctctggtatggtatgaatgtggcatgctagtttggtcattggtaacacttgatgaagctagtaattagattcatgagtactgatatgtccacggcatcataaaatttctttgaatg

SEQ ID NO: 8164 - DNA, 680 bp, Triticum aestivum
  Clone ID: PAT_TA_8164
gaggctcctgccccgcgactccttcctcccctcgatctgccagcaccgccgccggccgccgccgcctcccttgaagcccagcgtcgccacctcccctcgacccgtttcgagtccggcgccgctgcctcccctcagtcatctcctcctgatccagtcgccgggaaggacctcgccaggatgtaccgccgaagccgccgacgaggagcagcaaggcccgtctctggatcaatctcttccgcctccatcaagcccctcctgcagatctcgatctgatctgttcttgctctgtttcctttacactgcagatccaaacagaatgagtgccacacagacctagcagctagctacctctgaaggaacaaaaacttgcggccatcatgccagcagcactgccgccgacgctccctgaggagcttgtcgaagagatcctcctccgcatcccgcccgacgagcctgccggcctccttcgcgcctccctcgtctgcaagtcctggagccaggccgtctcccatcgcggattccggcgccgcctccaggatttccaccgggcaccccccgtgctcgggtttctccatgattgggacgacgaggacatccccgactttatctccgccactgtgtcgcccttctcccttgctgtcccagacagctggctctggcaggccgttgactgccgccac

SEQ ID NO: 8165 - DNA, 640 bp, Triticum aestivum
  Clone ID: PAT_TA_8165
tgaagaatacgttcaggtggtctgatgccgaagcttgcgttgctgtgcgcaagtatccgagtgtgttgaggaagtcaaaggaatctctgaagcgcaggtctgagttcctggtctctgaggtgggactggaacccgtgtccattgctcatcaaccggtagttctcagtcttagcttggagggccggctcagaccccggtactatgttataaagtttctcaaggaaaatggactgctacatcgtgacccgagcttctttactgcggtcaagatcactgagaaggtatttgtggagaaactcatatcccctcacaaggaagctgcaccacacctcgctgaagactatgcaacagcttgcaaaggggaagcgccaactaatttcatatttagatggaccaggaacaggctatgaaaatccgtaacctgtgtatggcgcaagaaagttttcactctgtgtagtaagttggtaactcctgccttggtgtttaggcctaactggatgttcactatcttttctagtgtgtttgctacttgccagtttgctcattgctaactcttgatgtaactagtgataaattgatttctgaaccctgataggctgttgttgtcattccttagagaagatccttcaaaatatcagtc

SEQ ID NO: 8166 - DNA, 1106 bp, Triticum aestivum
  unsure (1)..(1106): unsure at all n locations
  Clone ID: PAT_TA_8166
catccccacccacccaccccaaaccccgcccaaaaccctagccgccaccccgccccgccgccgccgccatggacgccgccgccctggaaaccctcatcctcgacctgcacgccatcgaggcggtcaagctcggctccttcgtgctgaaatccggcatcacctccccgatctacctcgacctgcgcgcgctcgtctcgcacccgcgcctgctggcctccatcgcctccctcctctcctccctcccggccacccgcccctacggcatcctctgcggggtgccctacacggcgctccccatcgcctccgtgctctccgtcgaccgcggcctccccatgctcatgcgccgcaaggaggtcaagacccacggcaccgccaaggccatcgagggcgccttccgcgcgggggacacggtcctcatcatcgaggacctcgtcaccagcggcgcctccgtgctcgagaccgccgcgccgctccgcgccgaggggctcgtcgtcgccgacgcgttcgtcgtcgttgaccgcgagcagggcggcagggagaacctcgcggcgaacgggatcacgctgcactcgctcatgaccctcaccgaggtgctcgccgtgctgctgaagcacgggaaggtcaccgaggagaaggccgccgaggtgaagcagtttttagatgccaacaggaaggtcaccgtgccaggcgccgcaaagcccaaggtggtcaggaaggggttccctgagagggcggccttggccaagaaccccatggggaagaagctgttcgaggtgatggaggccaagcagagcaacctctgcgtctctgcggatgttggcacagccaaggagctcctcgagcttgccgaaaaggttggctctgagatttgcatgctgaaaacccatgtcgatatcttgtcagattttacacctgactttggcgccaagcttcgctcgattgctgagaagcacaactttttgatcttcgaagaccnnnagtttgctgacattggcaacacagtaactatgcaatatgaaggaggaatattccnnntattggaatgggctgatattnnnaacgcccatgtaattactgggcctggaattnnnnatggcttgaagctt

SEQ ID NO: 8167 - DNA, 1170 bp, Triticum aestivum
  Clone ID: PAT_TA_8167
cgctcaccaggcggccgcccctgcgggctcgtgcgcgggtgcccgcgccccccgttcccgtccccgccccgtgcccgccccctgctccccccccgctcgccctgagcgcgccgcttggccgcggctccccgccggggctgggcccggcggcggactggctctgcaccggctccgccccgcctcccccgggcggcccggtggcggctcgcccgctcgcccccctcccgccgacgtcccctgcttggtgccgcccgggttgcgctccgctggccccaggcggctcccggcgggctatcgcgcggtgctcccgcgctgcaggcgggcttcagtcccgcttccgctgccgaggcccgctcaaggcccgcgcggcccgtgcgtggccctcccgcttggctcccgcgtgcatctcccgcccagcatctctgtcgcgtgccggtgtgggccgtcccttgagtatgcaagatttcttcatgatcttttcacgcctcttcatggtctcctctgcgtgcccgtcgggcccggcctcggcgttggcctgggcgctgggtgtccgcttttcagcactgccatcgcgcggcgggctgggtgccccgccccttgccccctgcctcgggtcccaacgccagtcgaaccacaaagtgatgatgggctctttctttcatgtaccttcaaacgacacggagctcatcatcaggttaatcgccggtcggttcccccgcggctgccccctgccctgtggcaggccctgcggatgcacgtgcgcagtcgcgaccgacggcgggggctgcgttcccgccgatcttggtgcccgcctgtgtggcccgcgggtgggttccggccctggcaatcctcccgccatccctgcccgcaccttggccacttggccctcgcgccgggccgggcctcggggccctcgtggttgcccgggaccccggggttcctggggggcccggggtccggggggggcccctccgcatggtggtgccgctcatgtcggtggcggcgctgacctgttcgtctgggcggtccggttccacagtgtgggcgggttccacaccgtgggcatgctcttggccttgtttcctcgcttcgggcttgtacccccgcttcgatcgtgcatgtcctcttgcatcgtacccgtttaagtctagcaaatcaatgtccttaact

SEQ ID NO: 8168 - DNA, 855 bp, Triticum aestivum
  Clone ID: PAT_TA_8168
tccgggtggccgcccgggggagtgcaaacgcgggcccaggggatgcaccgagctcttttactagaagttgctggtgttgagctaggctttaactatcctatgcccatagtagaacttcacctggctcgggagtgcttagatgatgccatctccacgaatgtggcaattggctacagccgaaaaacttgctcaagtcgatggtgaggttgttgaagacaatttgagccatatctagagttttgatgtcccaaaagttgttttgaaggaactatctccacgtgctcctcactgtgatcaaaaagtgcccactgatgatggcaggaatcttgagttacagcctaaggaactgaagggcacagataaacagaccatttgtgttgatgtgatcaaggcctcaaagatggaagactcaggctccatggcaaactctccgatatcaaggaaaagatccagcagcgggagtgtgtttaatgtcccatcttattcatcttcagtcgaagtgcgctcacggaatcagcatcctggtggttatttagttgggtcgtcaaaatatatcctgcagaaagcagagaggaactgtgttggtaaggctgaagatgatgacagtgccgatagctgtacctggcccgcgaccgcgctacggaaacctacgacctgcctagcggccgcgtggccgctcgaatccccgggccagcggggcggccaagcgcaacgctcccatcttccggcgccccccccgcgccctatgctagatgtggccggtgtgctgcctggctttttctgtcctatcccctttatatatgtaacctataattagttgcaacacttggaccaaaaaaaagtcgacgcggccgc

SEQ ID NO: 8169 - DNA, 1406 bp, Triticum aestivum
  unsure (1)..(1406): unsure at all n locations
  Clone ID: PAT_TA_8169
gtcgacccacgcgtccggacagttccatcttccctctcgcccaacggagcatctctccctctctctcgcccaacggaacagacgcacgcgaatcgggccgccgcggcgggtgcatcacgatggccggcaacgagtggatcaatggctatctggaggcgattcttgacagcggcgcgtcgggtggcggaggcggaggcggtggcggctccggtgccggggccggcggcggcggcggcggcggcggcgggggtgacccgaagtcgtcgtcgagcccccgcgggccgcacacgatattcaaccccacaacgtactttgtggaggaggtggtgaaaggcgtcgacgagagcgacctccacaggacatggatcaaggtcgtggcgacccgcaacgcccgcgagcgcagcagccgcctcgagaacatgtgctggcgcatctggcacctcgcccgcaagaagaagcagctggagattgagggcatccagaggatgtcggctcggcagaatgaacaggagaaggtgcgccgcgaggccacggaggacctgtcggaagatctcgacgagggcgagaagggggacatcgtcggccggccggcgccgtctggggcccccgggaagaagttccagnaggaatttctccgaccttagtgtgtggtcggacgagaataaggagaagaagttgtacattgtgctcatcagtgtgcacggtcttgtccgtggagaaaacatggaactgggtagtgattcagatacgggagggcaggtgaaatatgttgtggaacttgcgagagcgcttgcaatgatgcccggagtgtacagagtagacctgtttactcgccaagtgtcatcacccgacgtggactggagctacggggagccaacagagatgttaacctccggttcccacgacgcagaggggagcggtgagagcggcggggcatacattgtgcgcatcccttgcggccagagtaacaagtacatcaagaaggagtccctgtggccttacctccaagagtttgttgacggagcccttgcgcacattctaaacatgtcaaaggttttgggcgaacaggtaggccatgggaagccagtgctgccttatgtgatccatggccactatgccgacgctggcgatgttgctgcccttctttctggcgcgttgaatgtgccgatggtgctcactggtcactcgcttgggaggaacaagctggagcagattatgatgcaagggcgtatgtccaaggaggagatcgacgcaacctacaagatcatgaggcgtattgagggggaggagctggccttggacgcagcagagcttgtgattactagcaccaggcaggagatcgatgagcagtggggattgtatgatggctttgatgtcaagcttgagaaagtgttgcgggcacggac

SEQ ID NO: 8170 - DNA, 925 bp, Triticum aestivum
  Clone ID: PAT_TA_8170
tcaagtgaacctgcagaaccagaggagcaagaagaggaatcagctcaggaaatgtttccagttgaagacgaaggtgcgcggctcgaggcggaccaaggacaatcagctctgggcatgtctgaagcgaaagatggacctgcagaaatggaggagcaacaggaacagtcagctctgggcatgtctgaacctaaagatgaacccgcagaaatggaggagcaccaggaacagtcagctcaggacatgtgtggacctaaagatgagcctgcagagatggaggagcgccaagaacaatcagctctggacatgaccgaagctgaagacaaacgtgtagaaatggaggttcaccaagaacaacagtcagctctagatatgtctgaagatgaaggcggagctgcagaaatgaaggggcaccagggcaagtcagctgaggacgtgcctgaattgaaagatggagctgcagaaatggaggtcacgcctgaacctgccaaagaggagcctgcagaaatggaggagggccacaagcgaccagctgatggcatccatgaagctaaagaagatcctgcagaggcgcatgcgcagcaggctcaggctaccatgcctagaatggcatgaggggcagcgccaggctctcctgcttgactttgcgcccgtcacccccgagatctccgcggcgtcgtattttgacttagaccatgttccacctgtatgactatgaccatagccgttgcagcattttgagggagcgcatcgacaagagattgtcgagctccctgacccacgttcctatagtggttgtcttatctgtgggctgtggaagactgaatgaacagccctgattattttggtggtagtattaccttgtaagctgggacttgcatatgaagcacgcaccatgtcaacctctagtcaccgtattaattactgt

SEQ ID NO: 8171 - DNA, 366 bp, Triticum aestivum
  Clone ID: PAT_TA_8171
gctcgcactgaacgcgacgctgaaattacaaggcccgttttgtagatggatgcagcagggatcgataaaacggtttagtagctgctgtgtgtgctctttctggttgttattattagctgggtttggtggttgatgcaggcagcgtctcaaacgttgctttctataccttcctgagcataatcttctgatgatgcatggtctgaggctccggtctgtggctcttccagatcgtgatcagcctacgcgagatgatctaggatatatctaggtgcggctcttttgtttcctgtccagtagctgtaaaacatattggggtttctgataaatgaaatcggagagagctctactttttttttaaaaaaaaaa

SEQ ID NO: 8172 - DNA, 1073 bp, Triticum aestivum
  Clone ID: PAT_TA_8172
cgctacgcatcccagaaggccgaggaagggaaggagggcgcgagtgagatggcggacgccgctgcggggaagaccgaggatgcgcccgcggacaaggccagggagagcgagggcgccgccgcggagaaggccaggcagcacgggcacggcgtgcggtagagggcgggggagaaggcggatacagcgtggacgagaacgaggaagcccggggagggggcgccggcgaagccgaggatagcgagggcgatagggacggggcagggggggaacggggcgagcacggggggcggcaggcggcggagaggggcgaggaggttgatgagcgcagggacgaacggcaggaggaggggcgtgggtagaggggagggcgccaaggcgtacatggtggacaagaaggaggacgcccggcgagcgctcgccggctcggtgaaggatagcaagggcgagacgaacgagtcggcgtggcaacaggggccggacgtgcggcggcgggcggcggagaaggccgaggaggttcgtcagcggacgcaccaaccgccggaggaggggaggtcgaagtcggcaacggagaacatcttggggtcggcgcaggggttgacggaggcgttcaaggagaagatgacgatgccgacggacgtgatcgagcggaaggtggctgagaggaaggggacgccgacggacgcgagcaggggcgaggcactgaacgcggacgacgtgatgctgcgtgtgaaggaggccgaccagatgaccggggcagggtttaacgacgtcggcaagatgggcgaggagggcaccggcatgaaggcggcactgagggccgacgacgaggaggacgtgatgctgcgggtgaaggcggcagaccagatgacggggcaggcgttcaacgacgtcggcccgatgggagaggagggcacgggatggggtccggcgttgagggcgcggaaggacgcctgagagcgttagacacgtgcatgcactcctgttgcgtgtcagcgttttgtgtgacactttgtagtagtacaagctactcctatagcaaatgaataaattatgcccggcaactttttattaat

SEQ ID NO: 8173 - DNA, 538 bp, Triticum aestivum
  unsure (1)..(538): unsure at all n locations
  Clone ID: PAT_TA_8173
ataagcaaatttcaaagtgtctggcaattgttttaattcaaaaacaggatcacctttaggtggaggaggacctcctagagtttcaatacgcaaattgtgtttaagtagaggacgttgttcaaagaaaatattatctatttcatttctttcatgcatatgtaaatcatcttcatgatcattttcaaggtgtgataaaagttatcttctccagatcctcaaccaccatcttaatctgatgataactagaataagtatccaggaaacatagcctctcacaacccgtcgttacatcaataatctggtcgatacagggaagagaaaaaggatcagctagacacgccttattgagatctgtgtaatcaacacacatacgccacgtgccattcttttatgggacaggcatcatcttgtggggaccaagaacttgaaaatcagtagggattttactttcccacacaagacttcaacatctctaataatcccacaaggtgatatggtgcntattgcagttaangnacattngtntcaacccgggggg

SEQ ID NO: 8174 - DNA, 967 bp, Triticum aestivum
  unsure (1)..(967): unsure at all n locations
  Clone ID: PAT_TA_8174
gnaagtcttgtgcaaaggntgtaggaagcccagcaaatgtggatgaaggaagcctccatgtgcacgtggatgtaagaagctcgatgcacgaagatgaaagaagcctgatgcatgggggtgaagtaagcctgatgcagatgggtgaaacaagccatgtcccatctactctgtgcacaaatcagccaattgaagttcctgagttctctgatcaacagcttgaccaacagcggcaaatggacgttgaagctacacctattgtggataagtgcaggaatgggaaagggctcgaaagactcactaaagagttaggctctaagattatcatccaagtggctgaggggaagaaacgcccggacaaaccagcataggctgcaaagcttgcatcccagggtggggtcgctgcgaggtagcatctaccactccttccccacttcaaggagtacaaggccaatgggcatcatattgacagtttcattggcaaagttgctatcaattttgatatggacaccccacgcgtccgcgtgaagtatgcatgcattgacatcctcaagaccgcgttgaagaataggcgccaccatctcaagaagaagcattttgacaatgtaccggccaatctagtgagtgtcaaatctcttgataagaatgtgacagatgcggagtggcaaagactggtcaagatgtggtctaccccaaggcacaaggaaacctgtcagtcgaacaaggagaaccgttccaaagttaagttccatcagaaaactggttctcgcccctacatttcccatgtgcatgctttgaaagaggctcgtaagggtgaagagttgactgcattgtatctattcaaggagtgccacaatggcaagaagactggattctcttggccagttaagaaggctatagctgacatggaaaaagctattggacaaggcgttccagaaggtcgaggaccaaagaatgttgcttgctgtgt

SEQ ID NO: 8175 - DNA, 1004 bp, Triticum aestivum
  Clone ID: PAT_TA_8175
gaacactattctcgtggaaaaccacttacaacgctaagtagtaccacactgcctgatgaatcaagtcgtcaaggttcatgtatcagattttggcctgacaaagaaatatttacaaccacaattgagtttgacttcagcacgatctctagtcggatccgggaacttgcatttttaaatcctgagctgacaataacactgacaaaggaagaacaggatgcacaggttcaacacaatgaatactgttatgctggtggcctggttgaatatgttgcctggttgaataatgacaagaagcccctccacgacccaatagcattcagaaaggaattggatggaataattgttgatgtctccctgcaatggtgctctgattcctactctgatacagtgctaggatatgccaacagtatccgtactgttgatggtggtactcatattgaggggctgaaaacttccctgacaagaacaattaatagctttgcaaagaagtcgaagattatgaaggataaagatattagctttgagtggggagcatgtaagagaaggcatgacatgcattatttcagtgaaggtccctaatccagagtttgaagggcagacaaagaccaggctgggaaatccagaagtgcgaagaatagttgaacaatctgttcaagaaaatctaactgaatacttggagttacatccagatgttttagattcaattctgtccaagtcccttaatgctctcaaggctgcattggcagccaagcgggctagagagttagtgaggacaaagagtgtcttgaaatcttcttcacttcctgggaaacttgctgactgtgcatcttctaaccctgcagaatctgaaatcttcatagttgaaggtgattcggctgggggtagtgcaaagcaaggccgggataggaaatttcaggctattttgcctctgaggggcaaaattctcaacattgagaggagggatgaagcagccatgtacaaaaatgaagagatccaaaatctta

SEQ ID NO: 8176 - DNA, 502 bp, Triticum aestivum
  unsure (1)..(502): unsure at all n locations
  Clone ID: PAT_TA_8176
gcccgctcgtgcctcttcttcctcaaggaacagagaaagagaaaacaccaccgagnagcctcgccgttgcttgcgtggttggaggtcaccacggtcatctccggtgtgccatgttcaggttccaaatgttctaaacctctgcatgttcaggttcgattcagaatttgagaagcaggtgcttacggtgtcacgcagtacagtgaaaagggcgttcagatatacttaacaggtccatcatttcagctttcggttcattcatctatctaaactgtgaggaggagctatcaaggctagggatgtgtatacatcactcctagccaccggaagaagtggccagttttccctgtacacctaattgtctacaattttgattgatttatttatttttgcaagaatttgaaactgcaggacgccggaggcatccaatagttgtaatttcctgtttgcttttgtcaaatatcttcagaattgtataagtcacttgccctatttaaacctttca

SEQ ID NO: 8177 - DNA, 1214 bp, Triticum aestivum
  Clone ID: PAT_TA_8177
gctcccctcccctctgctccccaccccatattaaatcaccgcgcacctaccttctctcctctccaattgatttcttttttcaaagaagcaacttgcgtttcggccttgcaaagtggcgtcgaggcaagatttggagcggaattgtggccgcgaggaggaggagggggacgaggcggcagccatggcgcaggattcttgggacgcagacaagatcagcttggatgtgtacatccatgactacctggtgaagcggaacttgcagaacactgcaaaggcgttccaagccgaatccaatctttctccagatcctgttgcaattgacgccccagggggtttcctcttcgagtggtggtcggtcttctgggacatcttcatttcaaggaccaacgacaagcattccgatgttgctacttcgtacattgagacacagtcgattaaagctcgagagcaccagtcatcattgcagcaacagcagcaacatcctcattcccagcagtcagcacagcagatccaaatgcagcaactcatgctacagaggcagcagcaggagcagcaacaacaggagcagacccaacaacagcaacaacatcctcagcagcagcggcagcagcaacgtcgccagcagaagcaacagcagcgtaatgagagcagttatttgcccacaagtccccagaatggttcagtatctgctgatcctccaacacaaccaaatactgtaacaacaagttctttgtctgcaaaggcgtatgaagagagaatgaagatttctgcgcagagggacaccttggatgaggcatcagtaaagcaaaggtttaatgaaaacgctgggcagcttctggaatcaaatccggcatctttgctgaagtccgcagcattctcagctcaggcttccgggcaaatatttcaaggatcagctggtggagtgtcaggtactttgcaacaagctcaggccaggaacctacagcttcagggatcaacacaggaaatcaaggcagattcaaacgccactctaaatcttaggggtgcaggagcagacggatcattacttggagtaccaggcactaatccagcagggcacaatatgaccttgaaagggtggcctctcacgggtttagatcagtttcgatctggatttctccaacagaaatcttttatgcagaatccccaagcattgcaacatcttcagtttctcactcaacagcagcaacagttgc

SEQ ID NO: 8178 - DNA, 611 bp, Triticum aestivum
  unsure (1)..(611): unsure at all n locations
  Clone ID: PAT_TA_8178
aattcggcacgaggcgacgctgaacgacatcctggacaaggacgtcgagaacgactccgtcaagaagcagggcagccattccgggaacctgcgccgggtccggctcggcctcggcctcatcaaggccctcttcgagcagttcctcgcaaccgagggcggctcgttgtatgatgctgcgacgacggcctacggccaggtttgcgccccgttccatagctgggcgatccgaaaggcggttggcgccgggatgtacactctccccagcagagagcagttgataatgaggttgaacgaaactgattgctctgtgcagaaggagatgaggagatacattgatgcatctagtcccattatagaatacatcgataacctgttcctctccaggaacattgtcctagattggtgaactgaatcgaggatcatgcttgcagctctcctcacgagctgctaatgatgtcattgttttattgtttttctctcgtagctttctagccttggtggggcggtgaatgctcccccttcgcactgtctcttgtactgtacgattatatcaaaaatctaattctaaacgaagaggctgttctagtacnaaanaaaaanaanaggggggg

SEQ ID NO: 8179 - DNA, 550 bp, Triticum aestivum
  unsure (1)..(550): unsure at all n locations
  Clone ID: PAT_TA_8179
ttcggcacgagggcaagatgctgcaacggcggccggcgagcttcaatgacgtcctggactgcgcgtcgcgggatgctgcaatggcgccatggcaagctggaatcgtgcgactccctacaccgcacccccgtgtggcgtgctgcaactggacgtagaggagctacaaccaccgatagggcgtgctgccaccagagacgaggagtgttaccacggtcatgcggcaagcaagcacagtgccaggatgctggaaccagagatccattttgatggaagcaacatttttttcctggaaccggccttctttcccagcttgcaatggggctcggcgagctaggtgctacaacttgtgatcctgtttgctagaaccaaatgatttcttgctggaaccaaattctcttcttgagctgcgacggtgaggtgaatttttgctgcatttgttgtttgtaggatttttgctggaaccagnattaaattgttgctagaaatgtnctgtgtgttttgctacaatcatatttttacagagatttgttgttttgtgagaaaaaaaaaa

SEQ ID NO: 8180 - DNA, 461 bp, Triticum aestivum
  unsure (1)..(461): unsure at all n locations
  Clone ID: PAT_TA_8180
gcggagaccacccgtctcgccgcttgccactccgggccccggcgaccattcccctccgttggcatggcatctggatctcgcaatcccccctctgtcacatactcgatgcctcgcgagcggccaatggtgtccggcctggggctctcgggctctcctggctcggcgtgctcctcgtcggcggatgcggtgcaggcggagatggcaacttcgggcttggaggcggttttgcgcaagcccgggccttcttgcaaggccatgtggcgtcggtgtcgtgcgctgcggcgccagcaggaggctggcctgcggggcaggtcggcgtccccttcttcctccgagcggcgtcaaatcctgtcggatctctacgggctttgttttcggtgtttcaaggagggccatcagaggcatgattgtatgaacgacccgctgtgcatcagatgcaggatgtcggggcanaaaaaaaa

SEQ ID NO: 8181 - DNA, 433 bp, Triticum aestivum
  Clone ID: PAT_TA_8181
cgtccgcggacgcgtggggcgcagacctggcgagctcgatcccacgcgatcccaacctcttttcccgtccaaatctcgctcgcattcgccccaacgattccggccgatccggttcgccacccgcctccggagaagccgacgacaacggcggctaaacagtgtcacggggaggcgagaatacatgtgaggccgcccggagacggcgcggacaatgagggccgccgccggggcatgctccggcggccgcaaggacaccctggcggctttcttccttcactgcatcctcctcttgcttctccctctcacctgctctgtatatcctctacgccctgcatgccattctgtactctacataccctcctgaacatgatcggcttatgggagcactattctttttaacacttaccgtgcacatccttatatcttctactcc

SEQ ID NO: 8182 - DNA, 538 bp, Triticum aestivum
  Clone ID: PAT_TA_8182
gctaatgagatgggcccaaatacccgtgttaactgtatagctcctgggtttgttcctacacgttttgctggtttcctcacaactaatgagaccattagaaatgaacttatcgagaggagcatacttaagagattgggtagtgtggaagacatggcttcagccgccgctttcctggcatccgacgatgcatccttcattacagctgaaacaattgttgttgccggaggaacccaatcaagactatagatacgttttgagggtcaatcagctacagtgtcatgatcaataaaaatagtgatactagtaggtctagtatacaacatttcaagcgcgctgagatataaacaagatgcagtgtaataaatttgatgttggggcgccatacaatcttgcgaggacgaattatagtctattggcattgtcgtctgaacatttattgttgtatgacctgtgttcatgtataggaattgcggtgaagtgacagaggaattgcggttgatgctttatctataaagcggggtgaaagcctgtttcgaag

SEQ ID NO: 8183 - DNA, 932 bp, Triticum aestivum
  Clone ID: PAT_TA_8183
cgtccgcggacgcgtggcaacgcacgcttccatcgggaaaagacagcggcgcgtagcaaacgaaacacggcgaggccggcgatggatgtcaagtgccggcgtctggaggggaaggtggccgtcgtgacggcttccacgcagggcatcggcctcgccatcgccgagcgcctcggcctggagggcgccgcggtcgtcatctcctcccgcaagcagaaaaacgtggacgaggcggtggagggcctcagggcaaaggggatcaccgttgtcggggccgtctgccacgtctccaacgccgagcagcgcaagcacctcgtcgacacggccgtcaagaatttcggacatattgatattgttgtctccaatgccgctgcaaatccttctgtggatagcatactagagatgaaagagtcagttcttgacaagctatgggatattaatgtcaaagcttctattcttctacttcaggacgccgcaccacatttgaggaagggatcatctgtgatacattgaagtttcaattggacaacaaagagttcgactctatattattacgggtgttaaggaagatactgttttcgcacctcaaactaagaaagagatcagtgagatctcatggcacagaattgatgatcttctacctgctagtgatgatgcaatatctcgtgagtgaatgggatgaagctttatatttgcaccatttttgacgggtctgaaatcatggataggcacacatcggtcccagtatcagaagccagatacatctgctactgaagccaaggtgagatttaggctatctattcttagttcggtggtggggcgaggagattccgttcgacagtgctggggcctggggctctagggttacaacgttgtcagattcgttacataggagctgcaagtttcaatagatcggcactctacagtggaatttc

SEQ ID NO: 8184 - DNA, 1322 bp, Triticum aestivum
  Clone ID: PAT_TA_8184
ggagccccgcgtccgggcgggcgagcgcgagagcgagtgggcggcggcgggcggtggatggcgatggcgggcggcgggggactgaaccggtcatcgtcgcgggggcagctgccgccgcaggagctgctcgacgatctctgcagccggttcgtgctgaacgtgcccaaggaggacctggagtcgttcgagcggattctgttcctgctggagcaggcgcactggttctacgaggacaactccgtggagcacaacccctccctcaagtccctctccttcaaggacttcacctccctcatgttcaacagctgcgccgccctcaggccctaccgcgcgcacctcgacgacatctacaaggacttcacccactacaagttccgcgtccccgtctccggcgccatcatcctcgatgacaattatgacaggtgcttacttgtgaaaggatggaagtctagtgcaagctggagttttccccgtggaaagaggagcaaagatgaagaggatcatacttgtgcagttagagaagttctggaggagactgggtgtgatgtttctaagcttttgaaaatggatgaccacattgaagtttcaattggacaacaaagagttcgactctatattattacgggtgttaaggaagatactgtttttgcacctcaaactaagaaagagatcagtgagatctcatggcacagaattgatgatcttctacctgctagtgatgatgcaatatctcgtggagtgaatgggatgaagctttatatggttgcaccatttttgacgggtctaaaatcatggataggcacacatcggtcccaagtatatcagaagtcagatacatctgctagaggtactgtgtggaaagcgaagaatccctcgggtgtctttgtgcctgtggagaaccctgttattactagagcagggtctgacgcgcagaaccctgttattactagagcagggcctggcacgcagaaccctgttattactagagcaggatctggcacgcagcacgtccacaaccgacctgacaatgactcctgatgcttcaggttcgatacggccagtattctgcagtcaatggatgcttcctttctgcatacctaggatcctgacagatcatcaactcctgtacccttgatgtgtatagactatggaatggcgttgtcgctcgttgttaactggaatccacgacgccacgatgtttcgtctccccgtgctgtgtttagttggtgtctgtaatctagaacactacaattgtcacacctttcttgagctgttataaatgtcatgtcttttgcgaaagaagaaaacttcacaaactcaaa

SEQ ID NO: 8185 - DNA, 1834 bp, Triticum aestivum
  Clone ID: PAT_TA_8185
cccacgcgtccgggcgggcgagcgcgagagcgagtgggcggcggcgggcggtggatggcgatggcgggcggcgggggactgaaccggtcatcgtcgcgggggcagctgccgccgcaggagctgctcgacgatctctgcagccggttcgtgctgaacgtgcccaaggaggacctggagtcgttcgagcggattctgttcctgctggagcaggcgcactggttctacgaggacaactccgtggagcacaacccctccctcaagtccctctccttcaaggacttcacctccttcatgttcaacagctgcgccgccctcaggccctaccgcgcgcacctcgacgacatctacaaggacttcacccactacaagttccgcgtccccgtctccggcgccatcatcctcgatgacaattatgacaggtgcttacttgtgaaaggatggaagtctagtgcaagctggagttttccccgtggaaagaggagcaaagatgatgcggatatccggcatcgccgccgtctctcacataaacgcacgcttccatcgggaaaagacagcggcgcgtagcaaaggaaacacggcgaggccggcgatggatgtcaagtgccggcgtctggaggggaaggtggccgtcgtgacggcttccacgcagggcatcggcctcgccatcgccgagcgcctcggcctggagggcgccgcggtcgtcatctcctcccgcaagcagaaaaacgtggacgaggcggtggagggcctcagggcaaaggggatcaccgtggtcggggccgtctgccacgtctccaaagcccagcagcgcaagccccttctcgacacggccgtcaagaatttcggacatattgatattgttgtctccaatgccgctgcaaatccttctgtggatagcatactagagatgaaagaatcagttcttgacaagctatgggatattaatgtcaaagcttctattcttctacttcaggacgccgcaccacatttgaggaagggatcatctgtgatactaatttcttcaattactggctataatcctgatgcagctttatcgatgtatggtgttacaaagactgccctttttggtctcacgatgtctcttgctactgagatgggctcaaataccccgtgttaactgtatagctcctgggtttgttcctacacgctttgctggtttccacacaactaatgagtccatcagaattgaacttatcgagaggagcataattaagagattgggtagggtggaagacatggcttcagctgccgctttcctggtcatccgacgattcatccttcattacagctgaaacggcatctgttgctgggaggaacataatcaagactatagataagttttcgggggtcaatcagctacagtgtcatgatcaataaaaatagtgatactccgtaggttcttagtatataacatttcaagcatgcttaggttataaacaagatgcagtgtaataaatttgatgttggggcgccatacagcaaggacgaatgatagtctgttgtccgaacatgtattattgtataatctgtgttcatgtgaatggtctactgtcaaggtattgttgaaaactctgtttttatgtacaggatttacgtataggtcatcaagtccagtgccccaggtaattcgggtgtttctgtatctgtagtgcctcgttgttaactgggatccttgacgccacggcatttcgtcttccccatgtcctcttcttttggtatctgtaatctagaacgcaacaattgtcgcatctttcttgagttgttattatgtcatgtctttcttgctcttaaaaaaaaaaaaaaaaaaaaaaaa

SEQ ID NO: 8186 - DNA, 660 bp, Triticum aestivum
  unsure (1)..(660): unsure at all n locations
  Clone ID: PAT_TA_8186
ngaattncccgggacccttggagggccccntnaatggntgcggccctcccgcccccccagcgcgcccgctcccctgtacgacctcatcgtcggcctccaggccggcgcggcggcccctgcgccgggcggcccagaagacgacgccgatggcacggcagcagtaacacccagcgatgaaatcgaggagcaggatgctgaaatcactgacgatgtcgacgaggaggacgacgggttctgcgtggtgcacggcatcaccatcgcgctcgagttctccggcggggaggaggactggatcgtggtctgatctcagatttcaatttgcaaataataagacgtgcaacagaggtcagccgtccgcatccccccgcctctgctgctgctgctgcgcaattcccttccatccgcatctcctctgttcctgttaattgatgatcgtgtccctgtgtgtatactgctctgttctgctgttaattggtcgtgtccctgtgtatatatctggtgactgtctgtctaatttgtcaaaaattcatggattatcatgacctgaatttatcaaccatgtgtgaataaaattaatgaagaagtgattcgttcgtcttcgccccctggcgctcccaatctccaccatcccccccgcgcgccgcccgccctccgcctccg

SEQ ID NO: 8187 - DNA, 1271 bp, Triticum aestivum
  Clone ID: PAT_TA_8187
tgaccctggtatgaagggggtgttggcaactcgtgtgtctggatctgctgatctctaccaggtgaaccagcggaagcctcatcatggtctgcacgttataatagcacatgatgggttcaccttatgtgaccttgtttcatacaacttaaagcacaacgatgctaatggagaaggtgggcgtgatggatgcaatgataattttagctggaactgtggtgttgaaggagaaacaaatgattcaaatgtattggctctgcgttcgagacaaatgaagaacttccatgtggcattaatgatttctcaaggcaccccaatgatgttgatgggagatgaatatggtcatacacgttatggaaacaataatagctatggacatgatacctgcataaacaatttccagtggggacagttggcggaaagaagatatggccatttcaggtttttctcagagatgattaagttccgtcagaaccacccaatactgaaacgggacaggtttctcagtaaaaatgatgtcacttggcacgaggattgttgggataacttggaaagcaaattcttggcattcacgatacacgaccacaactctggtggagatatctatttggcattcaatgcccatgactattctgtggatgctgtgattcccccagcccctcaacaaaaacactggaaccgtgtggtggataccaacctggaatcaccaaacgatattgcaccggaaggggtgccacttactggatcagggtatagaattgctccattctcttccatcttgctcaaggcaagcccatagattggagtagacaggccacagtctgaaggaagcatgagaataatgtcagtttcgactcattttggtgagttgtcagttggtaaaaacagtacgcggatcttactctcctagccctggacaacgcatgctgcaaagcgtgacaaactcttgagctgggagtcgggcgcatctctgtgaaatcgactacagttgcaactggtatatagagctttgtctaataatggcacactttgtttccactgttccacatgtaagtagactgaagttgctagtcatttagttggggataagaagtctggagggaatctagtccatagctgtctgttctttcattcttccttcgaccagcgaatggctaccaagctctttgttcctataataatgtgggcacggaaatgccctccgtttgcaactcaatttgtgcctttgtgacattataacattctagaataaagatacgaggggtgcatttgcc

SEQ ID NO: 8188 - DNA, 863 bp, Triticum aestivum
  Clone ID: PAT_TA_8188
taaggtctaaaattcccgggccgacttgtcatgcgacccgctgcaccatgcgtcgttgaagaatagccgtcggcacctggaattgtagcagatcttcatccagcgttggcagctctagcatgatcattgttgaaggggggactgccgcccgcagctgagagacatgaatgaccggatggatccgagcttgctccggcaatgccagtctgtatgccacctcgcctacccattggagtacctgaaacggtccaaagtaacgaaaggctagtttatgattagctcttgccgccaccgaggacagtgcatacggctgcagcttcaaatacacccaatcatggactgcaaaagccctgtccgagcgatgttgatcagccttctctttcatactttgtcgtgccctgttgagatgctaccgtaacagagccaccatgactgccctgtcccgagtccactgggctaagtctgtcactgttgagtcagccacattagtgataccaaagaatcggggcttgtggccatacaatacctcaaacggagtcgacttgagagtagagtgatatgaggtattgtaccagaattctgccaaggaaatccactcgacccacttgctggggcaattgtgcacgaagcatctgaggtataactccatacactgattcactcgttccgttgtgccatccgtttgcgggtgccgagctgaggatatgttcagtttgatgtgagtgagcttgcagagttcttgccataccttgctggtgaaaattcgatcacggtcggaaaccattgcctctggaggtccgtgtaatttgaagacgttatccatataggctttagccacttgcagtgctgagaatggatgtcgc

SEQ ID NO: 8189 - DNA, 719 bp, Triticum aestivum
  unsure (1)..(719): unsure at all n locations
  Clone ID: PAT_TA_8189
cctggtgttgcgccccacggcggctcgctcgttcggaggctggcctgtcgtcccaggcttctggaccctgaagaatcacccccacgagagcacacagatacggatgtttgccttaagttgcatgaaaggttctcaggcttgttctgatgctgctcttctggttaaaaaagctgccctgctgggcattacaattgaagctggcttgatgactcggaacctgagggataagtattatgactccaacgtatcctacctgaacagattgatccggcgctttgccttagaagttgtaaggcaaaaatttgacggatctcttgaacattctgctcatgatgattatcggtatgattttgttgctagacttgaagaagatgctgagaatcattgtagggacagccttgtaaactctgatccagcttctgaggagaaaggaaatgttgcatcatgtgcctccacatgcagcaacggaaactgaggaatggatggtgccatgaaggagaaagggttaggaaagatggatcgcgatttcatttatgctcccttccaattggtgtactgcatgaagcggacatgcttttcaagctatgtgttgggttcaagtttaattgtgtcaaacatacctttaccaatctagcttatatatttggaccaaaaaaaaaccaatatatttaagttgatacctattatcctctctttctctttcatatctgngaaataag

SEQ ID NO: 8190 - DNA, 1751 bp, Triticum aestivum
  Clone ID: PAT_TA_8190
cgccccttccccctccgcgtccgcgtcgtcccccgccgccccgggcctgctctccccctctcgcacctccgccccggccctgccgctcctcgcctcctcgcccctgctgccctgccgctgtccggcgccagcccagcgccaccagcgagcattgcaccgtcgcttggggtaaggatttgccagtcataacaccatgctcagcatcatgtcgcctttgagtgcgccggaggaacaggcaccgagttcgcctttgagtacgccggacgaaccgacaccatgttcgccggaattcttggtccagagaagcactgtgagtccaacggtggctacaacagagatcccaaagactgatagaactcaggtggaggccaaggagattcggctctcggacatgccaccagtaacacttgatgatagcaacatgcacactaaaacagatggctcccccgtgatgaccccgcgcgagccggcccctagcccgccggcattcttggcccagagttccgcttcgggtcctttggagacatcaccaatgtcaccaactatgtcaacatctaatccagtttctgaatgttttgaatcaattgtgcctgaattagataatcagatagatcatgaatcgttggtgagcgttttgaaggaggaagcacattagggttttcttcgtaccgaagcccgaggtgttgtgcttgcagatgcacgtcaattcatccttcccgttgcaacgcacgggcatatgtcctggtcagcctcttatccagttgctcgagctctcgattcgggggggcctgtatcagataatcagatagatcatgaaccattgcaatcacctccatcaccgtctagctcgacattaactcctgttttaatattacatgatgtcaagggaccagatccaaataaagggatcaaagttgatgagacatatgattatctcccacaagactatacattgaccgatcatgatctatgtgctcatatagcaatagaatcatctttgagaaaacagttgctcgttcagatagatggaagttgtgtcttgcaaaatcaattgatgtgcctgctaaatgaaaaggagtgggtaaatggatgatgtgatcaatgcatatatatgtttgtatgaaggaccaaatacatgtccagaatgataataaattaaagtatattttgagagtccatttgttacctcactatttaaacgagatggcaaacttggaatacaaaaagatagtgccttcatgacagagaccgtcattgaatatatgcaacatgacatgattaaacttccaataaatgccaacaacacacattggtatctagctgtcgtgaatacaaaaaaacatgaggttcaagtactggactcattgtgctggaactctgaccgtgatgatctcgctcatacgctacgaggagtacaatttcatttggaccttcttaagagtcaaaacttggtaaaagacaattggaaagacattgatctcaccgaatggaagatcacggaacaattacaaaaggcaattcaaaaagacagttattcatgtggtttgtttgaggaggtcgctggagggagtcgcggttgagctcgcgagagcgcatcttgggaggttggttcggggtaattgtggccttttcgtctgtggcctttttgtctgtacgtcctaccaaagagaagatgacagtaacaccatctcaaaatagacttttagacaacaatgactgcgcgctacataggtatgttatttttagagata

SEQ ID NO: 8191 - DNA, 599 bp, Triticum aestivum
  Clone ID: PAT_TA_8191
tcggcacgagggtttgcctagcgcaactatttgctccaatgcgatcatgcatgcaggaacaactgtagatacttttctaagagagaatctggagtggttgagcagggctactaattgggctaaattcagtgcaacagctgggctaggtgtgattcatagaggccaccttcagcaaggtcgggctttgatggccccatacctacctcaaagtggtgcagttggtggtggcagtccatactcggaaggtggtgccctctatgctttaggtttgattcatgccaaccatggcgaaggaatcaaacaattcctccgtgaaagccttcgcaacaccagtgcagaggtcatccagcatggtgcctgtttgggacttgggcttgcatctctggggacagcagatgaagaagtgtttgaagacataaagaatgtcctttacacagacagtgctgtggctggtgaagcagctggtattggcatgggtttgctcatggttgggacagccagtgagaaggccgctgagatgctcgcttatgcacatgatacacagcatgaaaagattatcacgggtttggcacttggcatcgcattgacagtgtatggca

SEQ ID NO: 8192 - DNA, 578 bp, Triticum aestivum
  Clone ID: PAT_TA_8192
gtctgggaatggattgcctcattgttggggtttctcagtatgtaatttcttttactcattttagattcttaattcggtggttcttgattgcaacctagggtcatcctgttcctactcacatgttacattagtgttttgtataatatatccaagctctcactcctgaaaattgtccatctgttctctgatgcacgcacgtcactggagagggagtctggcttgcgagtttcgccgattcgttcacaacggcgatgccaaactatgaggagataccaaaggtgtactgggaggcggtgcttcctggaaccccaatgcgtccacctattatcaacctgctgttagcccagcaaaatggtatctctcttcttccctccctcacccccttccctccttgtggacctcatttaagttgttttgatgcttgatggtaaaacgttcgcgggttgatacctacaaattcttttacgctgtctgtcgctgttatttcatgtttctgaatttaagtcccgagaactaagtgtcggtgtcatcaaactttaatgttatgtcatgtcttgagagtttggtttgtgcgagtg

SEQ ID NO: 8193 - DNA, 1316 bp, Triticum aestivum
  unsure (1)..(1316): unsure at all n locations
  Clone ID: PAT_TA_8193
gaatcggccggatggccggggtgctcttcgcacactgtcaaatcggggagggggccgccggagttcttctgaaggaggaccggggcaatggaggccaagacggggaattcgggcatgctgtaccacgagttgcaggtgcggcagctctgcgggctccatgccctcaacacggcgctgcaggggccgttcttcagcgagggggacctcatggagatcgcggcggacctcgacgcccgcgagcggaaggtgatgtcccgcgccggcggcgtgggggcgggggatttcctcgccgagggccagggatcccacaacgtctccgacaacggggacttcggcgtcgaggttttgaagagggcactagaggtatgggacctccaatttatccccatgtattcccaagctgcagcgggatcccaatccaagcctgaactggaaactgccttcatctgccactcccagaatcactggttctgcattaggaacgtggatggcggctcgtgcaacttcgatagtctgtatccggcccctgagtacctctctcagtttttcctctcagattaccttgacaacatgaggggtcctggctcaaacatctatgtggtaaggggcactttccccagggactgcccttctgataacaacgattttggccagtggctgcgtcctgaggaagccaagatcattacacattcacgcttcaaggctcagcagaaacaacagagcaacactgctatagtgatggcctcgaggaggtatctcacnagtgggggtagccgnnctggcttgaggggcncttgaagttccaggcaccaagactgaagtacctcgtcagcaaccttacgaacaacagggcatgactatgatgcgagagggagggggatgacgacctgaaggcggcaatagctattagcttgatgccatttgaagctccggcgaccagttctcaaccagcccaagaagagagaaatttgaaagatgcgctcagcaaggacaccgccatggaggaacctggctccagcaactctgaagggctgatgaaagaagattaggatgccatctttcttcataatctacataggagcgttcttaaacgcgaaaaaaatttagagtttccattggctggagcggttattgtgaacttgtttttttgacgcgtcaacggcgggcttacgcctgcctgaacctttattgccaaccgtcggggtgttacagatctcagggagaacagagagtacagggggttaaggagggaataaaattacatgtagcgggggctaaattctcccggcaaggggaacaacaggagccccagtccc

SEQ ID NO: 8194 - DNA, 874 bp, Triticum aestivum
  Clone ID: PAT_TA_8194
gcgcggcgggtcccctcccctccccctccctttcggccacaccggtctcctccttaaccacgaagtgggcgcacgcggtgcgggctccggcgaacgcggccgcgcgcgatccagccgcccggcggctcccgcatccctcgcctctccggtcgcaagtcgcttccctaaccacaaattgggcgcactcggggtgggatccggcgaacgtggccgcacgcgatccagcggcccggcggcgcccgtatccctcgcctctccggtcgcacatctccttccttcctacgaagttggtgcacgcagggcggactctccgtcaaccacctccaggagctctgcttccggaaaggcggcatctacatcaagctcggcaagcacatcgcaaactggtgtatgtgccgacgatgagggcgccgatgcaaaagaggtgcccagtttcctcatacgaggacgtctacgaagtcttcaataaagagattggagaaaattgccacaaactgttcaacatgaccacttggtggatacttctgtaatagatatcgccaccgtggatttagtagtgaatgctcttcattatattttccctacatttgactacagggaatccggtccaaactccacatcgctgtcacagaacaaagttggaggcacaattgaaagagaccagctagattcttcttccgggaattaaacagaaaacctggctagagatttcatggcatgtcattccatttatctttgcttgtgggctcatcgtatccgatgacataattggcatttatttcataattagcatgtacttgagcacatgatgtgttttgctttaattatggacaacaaggtatgtttacttaaaaaaaaaaaaaaaaaaaaaaaa

SEQ ID NO: 8195 - DNA, 1559 bp, Triticum aestivum
  unsure (1)..(1559): unsure at all n locations
  Clone ID: PAT_TA_8195
cgctccgcacgcccaccgcccccgccaccctcgcctccgtcccctccgccgtccgcctgcccacccaaatcaccaccgtcgccggcacactacatcccaccctgctctcctcctccccctgatgggtgatccgccagaagctctgcaaaggctgcatcctttccctgcagactgttgtctggagccgaataacgctctcaaacctctccggcgcccccggcgccgccggccgccgccgcccgctcgtctggttccgcgccttgctgctgctccactcccacgacctttcacacgcgaggagttgaagaaccatgtccctcgtcccagtctttctcttcgaacaaccagggatggtgatgtccccccagatgctcggacaaaccggtcactacttggctagctttctagtgaactctttaggtgccctgcgaaagagtctcagcgctccacagaagacctctgaagttgcacccgccaggcgcgacgcgctcgtccccgcgctcgctcgtgctatcgacgcaaggtccgtctacgcgcacggggaggtgtcgcgggacgagggccccgccgcgggcaaggtcaccaaggccataaatgaaggaacgcgtcgaggtgaagtacttctggggcaccacgctgtaccacttggaacgagtctgcccttcaggctcgatgacatcccttccaactgtcgccgtttctgggaggccgtcaaggggtcggaggttaggaaggtgctggacgcgccagaagaggtcaagtgtgtgcctatgaagaatgtgctggagcctggtgacatccccacgcttggtgagcttggactctctgcaccaccggccatggcacaggactcaaaatctgctgctggttcaaatctcattggtggtgaggcagaagccctggaaaggctgaagaaatttgctgcagaatgttgtatgcagccgaataaagctgtgaaagatagtactcagaatagcatatatggtgctaatttctcctgcaaaatttcaccatggcttgctactggttgtctctctccacgtttcatgtatgaggagttgaagaagcatgccattagagcaattccatccaaggatggtgacggaacatccgatgctgggacaaattggttaatgtttgaattgctatggagagatttcttcaggttcgtcacaaagaagtacagctctgcacagaagacgtccgaagttgcaccggccactggttgcacacccgcccctgcgtttgcttgagtatgcacgtagttagccaagcagagagtcagctgctggtttttggttgtgaccaactcatgcaacctttcaatggagtgaattttgtcccaataaatgttgcctgaaaatgacgccccaagtaagctgttcctgcattttggaccaatttgatcttggaagagatccttgtatctgttgacattttttgtaagacttgaatggtatcgtaaaaataaatcctagatgcttctctttcgaaaaaaaaaaaaaaaaaaggcccctagcagttggatataatagganngatantccctggtggaacaa

SEQ ID NO: 8196 - DNA, 549 bp, Triticum aestivum
  Clone ID: PAT_TA_8196
ttctcctccggcccccccatccccctctgcttctcttgctgtgccataccccgccccccgcgctccactacaagcaccggcgaggcacatgcttcgcctcctccagatctatgaggtgatgcgcaaggaaacctcgcatcaaggattcgaggcgacttcacccacaagggagattcaattgtttgcatcgaagttgtttggatttactaggaggaagcggtcagtttttttgcgttcacacctaattgacacaattacagattggtttttgtttttgcaacaatttgacactgcaggacgcatgttcatctttccccaatctacacggtgaataataatagtatttatgatgatacatgagccagtactatggctcatcttgatctgctatgtggataaatacacttctgtgggattttacctctcttagtgttgtttacaggcaagcatcgttacagattcaagccgtggatgattacactttcatggaactgtatttctctccatgtttgcagcaagggattggtacagatccaacgaaattataat

SEQ ID NO: 8197 - DNA, 715 bp, Triticum aestivum
  Clone ID: PAT_TA_8197
gctctgtaccccacatattctctcccatgtttccgtgagagaagtgaagggactaaggagtcgccgtcgtagcagaatccggcggcacaggcaagcccggcaaacacagcaaccacgctttttgttcgagcgacgttgcaaagggaagccatgggcgccttgcaacctaatgaagctatggccgttcatctcctcgtcctcctccctcggcgaggtcagacaccttgcaacccgcgaggctggagatgacaaccgccggtgcttcaacgcgctaacgcttggtggggcggcggatgctgcaaccgttgggcggaggtgctggaaccatctggcgaggtgctacaacgacatggaggagatgctacaaccaaccgacggcgatgctgggaccggccaggggcggcgctgcatccatcgtcggcaaaagcttcatccgtggcccgacgtaagctgcatccatggttggcaaagctgtatccattgctggcgaaaactgcatctgtcaccggcggggctgcgacgacaggccaaaggtgttggaaccggctcgcggaggtcttgttgccagcggtgcggcaagcgcattgatctatcctggaacctcctcagattaatatcgccatgtattttttgctggaacctcttcagatttttgctggaactgtttttcaattttgctgcaattcaagaggaggtggtgctgtcgccgccagga

SEQ ID NO: 8198 - DNA, 556 bp, Triticum aestivum
  Clone ID: PAT_TA_8198
ggattcgtatgcgagcgtcgccggcgaccgacgacaagcggcggaccggcgaagcgagcgccacatcaggggaaggtggtcaccagcaagtccacggggcggggggtgggtgtggtgagttgctcgcgcgcgcgaccagggagaagagggagttgggcgtggcggcggccgacgggggacgaggctctctgctacgtgcacgaacagagaagtcaagtgcaagagaataggcaacataaaatttcaagagccaacatcttctctatcatccagttctacagggaagaggggaggcaagaacatgagggggagattttgtgcaagatcaagtttcgcaacacatggtacaggaggcatttttgcagcttgtatatcacacagggatgtgcagaggtggagttccactagctctagaactaacagaatcatgcccaaaaattagggagggcctttttaccttggtgtgttcacgtgaagaaatttgcccagttctgaaaaattctttgctgaagtttctccatagtattgcctaatccgcaacaaagagttgcagaca

SEQ ID NO: 8199 - DNA, 839 bp, Triticum aestivum
  Clone ID: PAT_TA_8199
gttgaatctcaagcgtgcagaaaaagcgcggttactcgttcaaaagattccaactatgattgacaacttgatagacaagacatttgcctgggaggatgaaagcaatacaccatttctatatgacggggttcgtctggtcgcaattttggaagagcagaaactcagaagagtacagaaggaggaagataagaaacgataccgggaccagaagaagctgcagaatctattgcttaaagagaaggagctgatctttgggtccaagtctgttccgaggaaaacaagcagttttaacaggaggacgagcgggcatcatccaaatggaaacggggctggtttcatgactccgatgccccgccgggtgtcggcgggcagtgccactcctgagcttttgacaccgcgctcgtactctggccggtacaacaattacttcaaggagaacaggaggatgacggcggcaccactcaacttctctacggcttccaaggatgacagcatgtcatccttcgcctccattagcggctccgagcctggttctccattggttttgcactgaggaagaagactttcttggcggggagggttgcggtgaaggctaccgtcaagattgggcaattgtgtgctagccattgaccatgctaatgtgtgaccaagattgggacaggatttagatagggttgcttgtagatacatgacctagcacttttgtggtggtgttttaattccagctgcgagtttgatcggtgctgtggttagggaacatgagaaaggtgtcaatgtatttgttttgtgctaattgttttctctttatagtatttctagttgcgtatcatcatttaaaa

SEQ ID NO: 8200 - DNA, 801 bp, Triticum aestivum
  unsure (1)..(801): unsure at all n locations
  Clone ID: PAT_TA_8200
gggaaatgacatgcgaggacgagtngatgctatgatggtggatacgtcaccctacaaggaagatggctccttggagattgagtactccaaccttctcgatgtaagactagtgaagggcagcgagccggtatccgcagaccttagcactcccattagagaaacagggaaggaaggcaaatcaccggtcggagaaccggtcgccttggacgaaaacaagggcaaagttcatagccagaatggaacctcggtgccagccttggacgaaaacaagggcaaagttcatagccagaatggaacctcggtgccaccagatagcagtaaaggcccagaagcgccaccagagaacacgcgtgataaggcctgggaggcaagcagcgaggtcccaaacggcaagcctgacgatgaagccgaggggaacaatgggtggggagcttggaaacagaacgctagcacgtcggcgtggtcgtatagagcgcagagaagcaccgcccttggtccgaccctcgcgcttctgagaggcaacaatggcagaggaggtggcaggggaggcggtaggggaggcggtaggggaggcggtagggaaggcggcaggggaggcaaacccaacaaccggaagtacggcaagtgatgatgtgttagcacggcgcgttcggcgttcgggagttgccgggtcattttgtatgcgatgcctggccgaacgaagatggcgtcttgttagcagttgtcaaaaccatttgggggtgaaacaagataatgtctgtttaactgtcggttcgggttttaacgaccgcgtaaatgcaa

SEQ ID NO: 8201 - DNA, 1209 bp, Triticum aestivum
  Clone ID: PAT_TA_8201
gctctggctgttccccccccgggacatccccctcatgccggaagctcgggtgtcagtcccccccacattacacagcacggaggagtgggatcgtcctagcccccacgaaaaacgacccaaggatggactgagacgctgcttagccccccacggcctcctctatttcccccccccgccggcaaccggtgggccacatcgccaggccgctccatgccccgcctattgtcaacctgtcgcggactcagtctgcattaggcggcccacttctaccaaaaggacaattccaagatgtgtacagcggtgattggactaagtgacacttcacgtggacctcatgagactaggtcattttgttcatgcactcatgaggagataaacgggtgttgtacaaggccgttgacaattcagattgtgggcacgtattcgcctccgattgctcgtgtcatcgttgtctggctgctactgcagtgacgcgcctgttgcctccgtggctgttgaccatccagagtgtgggcagctgagaggttaggattacgcatgcatatctttgcttataaagaatataattatgcagtactagcccctcgtactatcttttgtctatacgggtgtgtgacctggattttcactccagtgccatccgtttcctacgttactcgcctataggttatccaaagtaatgatggtctatcactctggttgatttgcaatatggtgattatgggtccatatgcacctgagctttgctacttcctctgattaccatatactctccacactggcgcttgccgactccattcccctccgctggtccccgcaccacttattgcttgaaaatatctctcaacttggatagagcatcctgaaaggtccatatttactcaacattatttgttactatgaggacccttacttctagcactaggttttgattgtctgttgttttgtacatcttttaccaatatgattttaatctttaaaaaagatcatattctggactcacaacaaattggatagagcatcctgcaaggtctgtgaggtgcagatgatatttcagtgctcagtgtgcagcttattttgtcgacatcgcggtttcagtttgcaatattagacctacttgtatcaaggtagggttgaccataactgaactttgaatttgtttatacagtattacattatgcgcttcatccaataaaaaaatgaaattca

SEQ ID NO: 8202 - DNA, 1253 bp, Triticum aestivum
  unsure (1)..(1253): unsure at all n locations
  Clone ID: PAT_TA_8202
tttgattggtcatgcacaacttagaatagattgtggtccatcccaaaggcaaacaacgcagggatttattcatgccttagggatcttctcaatgtctcctagcacctatccgctcgaagacgagaatgtcaatcctaccgcgaattggaaattatcagcaccagctccagcaaagaaatcatggatcccagcgggctttggaggcagtggcaagcatgacgccaccatcgacataccattatatgatccgaagaagcgggagcaagagctcttatcatgggaggaggatttgaagaggagggagcgggatatcatacagagggagaatgcaatgaacagagctggtgtcaccatcgaagtgaaaaattggccaccattctttcccgtcatacatcatgacatagccaatgaaataccaacccatgctcaccagttgcaatattcagcatttgctagctggctaggaattgttgtatgtctcagttggaatgtatttgctgtcttagttgaatcaattcacggggacgtgcggcgtctctcccgccttgccatcatctatgcggcatttggatgtcctctttcatacatcctatggtacagaccctctgtaccaggccatgagaactgatagcgtggtgacatttgcccagtttttcgtcttctactcggtgcatgttggattgtgtgttattgctgcaattgctccgccgataatattcatggggaaaactcttacgggaattcttgtggctatcgatgttttaaacacggatatgtttgtcggggtactttatctaattggatttgtattgttcacggcggaatctcttataagcatttgggtgcttgagagagtatacatatattttcgagggcacaggtgaagcctagcaatgagacgatgaaatcattcagggcaactgtctcctcaacagcaagcattctgatgcaaaacacaaagttgacggtgaatgttagtgaactgcttctgccgaattcttgcatattcagacatacagtggaaattgatttaatctcatagtagaaatgtgaatcaagataacaagtactatttgattcaacatctccgaaacagaatggtggtaccagatcccatgcctgcaaaacttgcggcgtgtctcctgccgatgtgccaacggtgaagcgtgttagaaagttcaggcttatgcaggttctccggtcaaagatgaaagcatttaggatctcctttgtttttcatttnatcnataaat

SEQ ID NO: 8203 - DNA, 1003 bp, Triticum aestivum
  Clone ID: PAT_TA_8203
gatcgccgccacagttcctcgctactgcggcgaccgccgttcccaccccgcatcggagaggaagatcgccgcgccagcgccaccatccccgaccctcgaccccaccacgctcggcaggttcaggccgaaacccagaaacccagcagcagtgtgcgacgatcagaagcaggcagaaggaggcgatccacggcaggctccataggcggcaaggcaaggatggatgagcaagatgataaaaacacaaaggctgagctgaaactttgcggtgacatagctgttaagagaaagaattaccgtggcgcgtccgcattctacagcgaggcaattgagctggaccctagtgatgcgacgctgtacgcaaacaggagcctttgctacctgcaaatgactgaagcaggtaaggcattgcgtgatgctaacacctgcataaaactgcggcccgaatggttaaaaggttactacaggaaaggagctgctctcatgtcgttcaaggagtacaaagaagcatgtgacgcattcgaggccggactgaaactggaccctggaaacaccgagatggagaaagtattgcaggaggcagttgaggcgatgaaaaaggatgacatggccaaaaaaagagaaaatgcttcaagccatccagctagagaaaaacaggcacgcaaagggcgtggccgcaacacccgttgagctgctccaacaacgtacgtaggggattgtactaagccacagccagccaccgcttgcatcactatggatttgactgaatttcacacaatattgaggaaatgtacactgtagctgtgagactgtgagattgctttttcaattgcaccgtttgcaatgaccacttccattgcaacttggtccagttttatcaccaaaactggcagctatctgttagcctagctatcaccgatattagcagctatctgtcatcctatttatcgtcaaatgtactcggtatgtatgatcttaggctcatgatgtgctagagctctcagaa

SEQ ID NO: 8204 - DNA, 1398 bp, Triticum aestivum
  unsure (1)..(1398): unsure at all n locations
  Clone ID: PAT_TA_8204
acgggcgaggcgaggcgaggcgtggtgccggaggaggcgaaatatagccaccctctccatccactccaccccgcccccgattgctttgcaccgccggaacctcgcccctccccgccgaccgccgtaaccgcaaggctgctgagtcaagatataggaattgatggatctgtccacaacctctgttatggcggctaaggcctactcgtacaaagcagagtcactggttaaggaataccttcttgcagatgcatatgtttcgtacactgctatgcttgggtgggatcctgatgtgcaagatggtctatgacatcacacacttaagtcaagctcattcttctacaagtgttatggcttctcttacaaaagcccaaaagctttgagtgggacaacaggggcatctccactngtccatgcaattttcatcacaattcatgtcaagtggtaacctagtattcctcccccgcctattcccccctgagttgcttgggccgggacctttcccgagttcaaacctctctaatattacactagcggtatctgttgggtacttcatcactgacattgcaatgatattttgggtttatccttctctaggtggaatggagtatgttcttcatcacttcctgtcacttgtttccatagtctattctgtgaattctggggaaggccagttgtatacatacatggttctcatctctgaaggaaccacacctggaatcaacctccgctggtatcttgatactgctggactgaaaagatccaaggcctatgttgtgaacggtagcttaatggttgttgcatggctggtggcacggataattctcttcatctacttgttctaccacatctacttccactatgatgacgtgatgcagatgcggaccttcagccgcgttctgatatttggcgtgcccacaatactactcatcatgaacacgatatggtttgcaaagatcttgagaggccttaaaaagacgctaaccaagagggagtgaagaggagaagaatagcagatgcaagctcatggcggcccatctacaaaaaccatcatcctgccttacagtcacataaaactacatatactccccgagcaaaactagatagtgcgactcgcagcacaagctaaaatcccatgtacataatccagaagtatgcttgagcacggcctcaaattttccacggatattctccgtcttgtacatataccggtctggatattgcttaggaagcttcaaactgcatgtgcattggatgcttctaagcccccctcgaccactgacactgagatagtcgtcggtcatcaaaagtgacatttgaaaggttgaaatctggcatctgtttttagttacgacttacgactctcaggaatgtgaaagctggtattgttcttgacttnnn

SEQ ID NO: 8205 - DNA, 401 bp, Triticum aestivum
  unsure (1)..(401): unsure at all n locations
  Clone ID: PAT_TA_8205
ccgccacccgttccacggcttcgggcagcagcggcagccggaggcgatgctgctgctcagccagtgattgggaacttggagagggatgagcgccgtcgcctccccccactactgtactgtactgtactgtactgtactgtatgtcggtgtcagcgtgtgatctggatctgaagaagaaaagcgtgtggtgcgaggtcagtggtttgctgacgttgctgaatgcttaggcagcagctcttttcttcctctctcgtgtcgtacttgtacattctctcgatcccacgttccttgagcaacttctgaaccgtgttcaaacaaaaaaaaaatgaactgtgttcctatggtctgaatttgatactagtacatgaatgaacacgggacaacaacttctganaaaaaaa

SEQ ID NO: 8206 - DNA, 474 bp, Triticum aestivum
  Clone ID: PAT_TA_8206
gccacggccaggtcgctggagatgagaaggtctcggctcgccgccgtttcaccggacgctgccgctaaaagcgttggaaagacgggcggcgacgcatcgaaaggctgccattgctgccacaagccaagcaaatctcctgagcactcggtcgccatcgacgtacgagccggcgagcagcgtgaaagcccgacggccgcgacgtgtgcgccggcaaaaaaagtcgaggtcaccggatctgtcaacggtcccgcggcgcctgcttcatcaagcggcgcgtcggtaggatgctgccctcgtgaaacagatagcacggaagcgtgcaagaaaatggctcctgctgatctggtgctgaatatatgtactacctttggtttataagtcctctttgtatattttgtgccgaattttaactagagatttaactaacaaaatatcaatacatgccataaaaaattatatcgttgaaaaaaaaaa

SEQ ID NO: 8207 - DNA, 483 bp, Triticum aestivum
  unsure (1)..(483): unsure at all n locations
  Clone ID: PAT_TA_8207
agtttaccagnataaggtaacagcagataatgagaaaccttctggcattggccctgcagatagtaaaacagacacgtccttattcagtaacaaagatcaagaaccaacaagtagtgacaattttggtgctgccactgagttctcagattcggcagtacccacagaagctgaaaagagtgggaagtctggcatacaatttcttgaagaatctctacctactaatagtgaacctattacagtctcagcgcatacaacaagtatgcagggaggcgttggaggtgttgaaagtgagaagtcaaagcctgacttgcttctaagtaatattgatataagagagatgtctaataagaagctatctgctgctgcacctccattcaatccgtctcctccagctatccttagcccacttgctgtaagtgtcggtctcccaccaccaggtgccgttccaagcggcccttggcctatgaatatctccatgcatcc

SEQ ID NO: 8208 - DNA, 796 bp, Triticum aestivum
  unsure (1)..(796): unsure at all n locations
  Clone ID: PAT_TA_8208
gaggaattcggcacgaggcaaaaaaaaaaacttggcgctgacgctgccggtcggcgtcggtcctntcgaggatggccgctggtcggcggcctggcttggtttgacggagctggaactntcgatgtggccgtaccccgcgccggggtcgaggacggcgcctgcagcgatttgaatcccgagtccaccttgccccgccagggctgcttcaaagttcaagccctagccagtaaaccccgactcggatggagaaatccgcggcgggatcagcaggggcgcggaacgtctccatggacaagtcctttcttcagtcaaactcttgcaagaagcggtgtctttgcgattggatcagcggactgcccgacgaaatcctggtcagcatcctagacaagttggattccaagactgcggtcggcacgagcctcctctcacggcgatggaggcgcttatggagactcgtggaatccttccatttcagtgaggtggttttaccagacaactattgctgggtacgcctcggaccaatgcggtactacttgaacacacatagagatcaccattttgttgagtccctccagtggttcacaaggcttaagagagagacgccattgagaagactgtcccttgtgttctcaggcagtgcggagtgtagcgatgtggtcaacagcgccatagcttctgcagctcagcatggtatcagcgaaattgatatggcaattgttgtaaggatggagtacgagttcccctggtggttgttctctgtttacagaagctcgctgctgaccagcttatccctaag

SEQ ID NO: 8209 - DNA, 294 bp, Triticum aestivum
  Clone ID: PAT_TA_8209
ggaactagtctgagttttttgctggaactggtgcccctgtctgctgcaaccagctggtggatgtgctacaaggtcggtgcctcgccggggaagctacatcgagcagcaaggagtgttgtatccaacgcagttcgaacgtcgggagctgcaatcgtgcacgccggagctgcaaccggctactgggggagctgcaagagagggtggccattttttgctgaaccaattttttgtttttgctggaaccggtgtatttttttgctggaaccaagataattttttgcttcaaaaaaaaaa

SEQ ID NO: 8210 - DNA, 280 bp, Triticum aestivum
  unsure (1)..(280): unsure at all n locations
  Clone ID: PAT_TA_8210
gcttgcactcattcttccacaccgaggnaagaagagcaagaggaaggccggcgcggggaagggcccgaggggcggccatggcggctttgggtgctgcgagagcatcaattagctagttcttggttggtaattcagattcaagtctcgcgggtatatgcgtgcatgcgtgtgtgcagattatatggcatcattaagattgtatgaactggtcgagagagtgaggccatgcacagggttttgtatacgatcaatctttgatgttcgctctttaaaaaaaaaa

SEQ ID NO: 8211 - DNA, 515 bp, Triticum aestivum
  Clone ID: PAT_TA_8211
ggcatcatgtggcaggcaccggcgtacacaatactgggcgccggggaggtgttcgcggccattggcgtgatcgagctcttctacgaccaagcgcccgacagcatgaggagcctgtgcaccgcactcgcgcagcttgctgtcgcagcggggaactaccttaactcggccgtgttgggctccgtcgcgtctgccacgggatggatcccggaggacctcgacgacggccacctggactacttcttctggctgatggcggtgctcggcgccctgaacctgctccaattcttgctctgctccattccggccatgaggcagagcggcaggtagcccggtttcgcgacaacagtccgtgttcatttggagttgagaaattcgcgcatataactcacccctgccacgtccaccaaaatgttcataaactcaatgttagtgcaaattaattcgggtcagctgaccccaatgccattttctcttgaaacctttctcttgaaagtttgcattggttaaaaaaaaaa

SEQ ID NO: 8212 - DNA, 1111 bp, Triticum aestivum
  Clone ID: PAT_TA_8212
cctcgtgccgaattcggcacgaggcatgttcagaggccgtccccacgcacgaatgaatcggtttctccgcatagccgccgcacatcccgctcgtagacgggtagcttggtgcgccgtttagatcatccccacgcggcgaccccgatccagaagagaagcggcagtccgcgaccttgttgtcactcctccgccaaggttccggccggtcgtggcgcatccaatccgcgtgccggccggccctgtacgccatcatcgagaacttcgtcgccaaggcgtggaacggctccggcctcttccctgacccatgcggccagaccgccatccaggaattaatcaatccccagttcagttcctgctctacattttcatgttttgggattcagtataaatcgttgctcacaaggattgcttgcacgtctaattaatggaactgctgctctacaccatacgtcggataccctactgccttagtcagcgccggcgaccttcccgcacactaaaggatgatggaaacagtcccgattgtgtgggcatatgcatatggttcgtgtacataacagtctgaactggccttgccatcgatctaatctacaacttttgtatcatgcgctgttagtgcagggccttgtttcaacggcggcattttgaggtcatgtacatatgaagattggaaatagtgttggtgatgtggaaactgatctgaatgggatgtatttgggatcataccaggtttccctgctactatctctacagagatgggcgagcgacgccgcagtttcttgttcttgcagatgcattattggatcatttcttctgactatagtgaatgcctaatcttacggttatatgagcagcattgttctgatgaactaggccgtgtggttttccatccatgtagcttgattgtattcttcaaatgtggcagagtaacgagttgcatttttttgtgggtttgtgtgtgtgtattgggggttgtattgctcgccttgtggtttacagaaatttagacgggcgcatgaccttgttgggcgttgtattgctggggctcctgaagattgataaagttggggttgctagattgcacgcctattcttgtcattgcctcgttata

SEQ ID NO: 8213 - DNA, 1855 bp, Triticum aestivum
  Clone ID: PAT_TA_8213
gcacggggctcggtcccccccggacggctgtcgcccggggcttctacgccccacctggtgctgtgcggccgctggtggtcccctggccccgctcgtcctctccctggaccgtcgctgggggggttgtgaagctggtctttgatcgcaatcagattgtgcagccagtgtcaggacttggagttatgttgcgggatgacttaccagcaaacagatttttggtggaacaaggccaacaaatatggcggtaccttgttccagtgcaaacagggctcctgatggtaatcagatacattgtgggtcgtcggactgagagaataagagtgttcaagctcgaagacaaggatgaccagctccgctggattgagcaagatgatttacctggtcacaaagtattcatcggtcatgggtgctcaagatgttatgaagttggtgatgaagttcttagcatctacttctatgatgacagagaggagctgaggatgcctcagtactatttcagagatgattcagggattgcaacaagtttggagatttttccgtggccagttatcatggggaagtcacaaattgagagtgtcttcatgggggaatcacaaattgagagtgtcttcatgggggactcacaaattgagagtgtctccgaatgctctccacccgcttggtggctgcacaagtgtcctagagcgtgatatgagttgtaatacattctcgtatcctgcactctatcgtgaagaatttgctggcttgaactttaaaggcagtcgtttgtagagctggctgtgtcttggttaaaaatatctttgagctatatatttgctgtagacatatcaggcttcatactggacgcgttatccctcttccgcagcaaatgtcttctcatgggggaagagttgatgttgaagtgagggtaggtgctatagctggctgcctaggttctcccaatgggtttgtggtggttgctattgtgcgtcccttagatagcccatttgagcgtgcagcttattgtaaccagtcgatggaactgtgggacgattgcgagtatatcggaggtcacaggatggaagatgcagtggggaactacgtgccacttgatgatgagctgctggatgtagtccacagggatggctctttttatctcttgaccaacgatgaagaagttgtgaagctggtctttgatcgcaatcagattgtgcagccagtgtcaggacttggagttatgttgcgggatgactttccagcagacagatttttggtggaacaaggccaacaaatatggcggtaccttgttccagtgcaaacaggctcctgatggtaatcagatacattgtgggtcatcggactgagcgaataagagtcttcaagctcgaagacaaggatgaccagctccgctggattgagcaagatgatttacctggtcacaaagtattcatcggtcatgggtgctcaagatgttatgaagttggtgatgaagttcttaacgtctacttctatgatgacagagaggagctgaggatgcctcagtactatttcagagatgattcagggattgcaacaagtttggagatttttctgtggccagttatcatgggggagtcacaaattgagagtgtcttcatgggggagtcacaaattgagagtgtctccgaacgctctccacccgcttggtggctgcacaagtgtcctagagcatgatatgagttgtaatacgttctcgtatcctgcactctatcatgaagaattttctggtttgaactttaaaggcagtcgtttgtagagctggctgtgcttggtttaaaatatctttgagctatatatttgctgtactattatctataagtcctttaattagacatat

SEQ ID NO: 8214 - DNA, 966 bp, Triticum aestivum
  Clone ID: PAT_TA_8214
gacgagcctcttttaaagatccttgaccttccggtacttgtagtgctggacgaagcatatgttgaattttcgagccttcaatcaaggatgacatgggttaagaagcatgataattggattgtcctccgaacatttagcaaacgagcaggtttagctgggcttcgtgtgggttatggagcatttcctctaagcattattgagtacttatggcgggccaagcagccttataatgtttctgtggcagcagaagtctctgcatgtgctgccttgcagaacccagtctatttggagagcgtgaaaaatctgctactacaagagagggagaggctgtataatcttctcaaaggaataccttacctgaaaccatttcccagtcatgctaacttcattctgtgtgaagtcacgtcaggaaaagatgcaaagaaaataaaggaggatcttgcaaagatgggagtgatgattcgccactacgacaagaaggaactgaagggttatattcgtatttcagttggaaagcctgagcacactgatgcactaatggaaggcttcaaagcactcaaactttgagaatttgccacgatttactttgatggaagcagtgaagagcttattgagtatgtgtctacccattactaggcttgtagtacactggatgcagtctatcaagtagacactgcttccctccaacatcggtaaagtgcattcttcagatttcaagccaaccagggtcagttagttttcaataaaatatctatgtttagctagtgctgtagtccaaaccatttagccataaactctgtttcagcaaagttactgtgcagagcaagacttttttgtagaggttgagttcctgaatgatgttgcttctttctgtctgggcatacatatatacttgcttgtttggttgctcattggaaagttgaaggttctatggtgaataaagacgccattaccataaaaaaaaaa

SEQ ID NO: 8215 - DNA, 1159 bp, Triticum aestivum
  Clone ID: PAT_TA_8215
gccgaccctgacctcgccgccgccgtctgcggtgcggatttcctcctcacccgcctcctggaagacagcggcgacccagggtgggacatcaaggattgccgctgcggccacctcctcctccacaacaggcgcactaagcagatcgctgcctacaaccccctcacgcaggcgctggatatcttcccccacccgccacgagagacctgcggtcctcgctaccttctttaccgcatcatcttccctaaagaggaccagagggcgttccatgtggtttgtttccgtcgccgcaagtcgtgccggggttcgcgacttcggatctctgtcttctcgtcagtcagcagggagtggcagtgtttctcgtgggtatgtgtacaaaacttgacgccgcagcctcggaaggatggaggcgacgtatggtcttacattgctacactggtgagtggatctgaccgattggcctattggaaagacaaagatcaagcatacatggtcgtgctcaacacccccacgccgcatttatctccaatgggtttgccgccaccctcggaagattatgagcttggtcggaccaaggatgggaagctctgtttggtttgcatagatgacgtctatgcaaacaaaggaacacttgctgtttggttttgtagagttgatagtgatggttcggacgaatggatgccgcacaaggttttcccactgagtgcttttattgatgtcaccatgtgttcagaagagtatgatgttatggtgcaagttgtgatggtcttggatggatttgtgttcctgtctgttagttatgcgaggtataccgagtgcctaatatccttctgcctggaaacagagaatgtaaacaagctcttcactcatacattggactgcaatattcatccctacttcatggtgtggcctccttctttggtacgcaacgaggaggattcagataccaaacttactagcgacaatgtgacagatgatggccccgtgggcatagaagcaaccccctctgttttcggattgtgtgaagagaagacaccatctactagtttcatacacttgtagctaggatagcaagggaacgatggagacataagctatggctaatgagtgtaaccattagtatgactatttggcaagagaccaaaccatgagctttatcttc

SEQ ID NO: 8216 - DNA, 585 bp, Triticum aestivum
  Clone ID: PAT_TA_8216
tcggcacgaggggcacatcgccggcgaccccatccggccgccgcggctggaggatgcgggactggaggactgcgcgctcccgcaagagtccatcgccgaggctttctcccttgcagcgttggccgtttcctcccgcctccctcacctctccctctctgatgacgaggacgagggggacgacccgctcgcgcctcgtggaggctgcgtggaggcgggacccacctgcggggccattcccgaatcccttgttggcggagggcgcggcagtgaatgccacgccgacgaggtcatggtcgtcgccgggcgcggagacgaggaagatagggttgttgtggtcgtcggccaagagctgggacaggagaagggttgcgccgaggggaccagagaaggagagcagcggaaggtggaggatgggattgtggagaaggccatcttggtgaaagatttcgcgtgagcttttcttctagcttgatgagaagacatctccctagtatttgttgtttctttgacttgcaatgtataccttgattttaagatcagatgacattatgctaatctctttggtacggtggcaaaaaaaaaaaa

SEQ ID NO: 8217 - DNA, 2131 bp, Triticum aestivum
  unsure (1)..(2131): unsure at all n locations
  Clone ID: PAT_TA_8217
accctcgcaagcaagaagagctcggtcgggttagatgcctgaatttcgacgcgtgtcggtgttccctctcatgctcccggcccttcacagaccgggagggccagggaactaaagaaggtgtgacgtcttctcgcacggtcacagggccatagccgtaagtcagagcatggcgccgccgcggatgctgccccctatggtacccctgctggccgtcagcgcgctgatgggatgctcgcgcgccgcgggatacacgagcgggctgcgccctacgtcgttccccaagggatgcctcatcgggaccgcaacatcgacttgtcaggttggcatgggcgaggcatactgccgcgacctggcgtccctactggagcgaaccccccgtccacgtgccccgaaagcgtggccgggggaagctaaggaagagggcactacagatgtgttcaatacattcacgcgacctgttgatcttccgagaacgcgatatttcgacgcgtatcggttttcaatctcatggtcctggatgttcgcagatggggtggggaaggtcaacaaagaaggtgtaacgtattacaacaatctcatagactacatccttaagcaagggctcaccccctatgtcaatctcaaccactatgatatccctcttgcgcttcagaagaagtatgatggcttcttaagcccaaagaacgcgaccatatttgcggactatgctgaattttgtttcaagacttatggtgatcgaattaagaactggttcacattcaatgagccaaggattgtagcagcactgggctttgatactggaacgaacccccctaacaggtgcaccaaatgcgctgccggtgggaactcagcaacagagccttacactgttgttcataacattctcttgtctcatgctaccgcagttgcgagataccgcaataagtaccaggcaagtcagaaaggcaaagttgggatagttctggacttcaattggtatgaagctgctaccaactcacctgccgaccaagcagcagctcaaagggctagggacttccatgttggttggtttcttgatccactactaaatggccaatacccgaagaccatgcaagatatcgtaaaagagaggttacctagttttacacctgagcaatctaagttagtcaagggctccacggattacattgggataaatcagtatacggcgacctacatggcggaccaaccaacgccccagcaaccaccaacaagctacgcgtctgactggcatgttcaatatatatttcagcgaaatggtgtaccgattggactcaaggcaaactccaattggctttacatcggcccgacgggcatgtacggatgtgtgaactacataagggagaagtacaacaacccgacgatcattatatccgaaaacggaatggaccaacccgcgaacctgacccgcgaggagttcctgcacgacgcatcaagggtcgagttctacaagacctacctcgcggagctgaagaaggcgatcgacgagggcgcgaacgtggtgggctactttgcgtggtccctcctggacaacttcgagtggctgtcgggctacacctccaagttcggcatcgtgtacgtcgacttcaccaccctcaagcggtaccccaaggactcggcctactggttcaagaacatgctgcaggcgtcggggcccggctcctcgaaagacggcacggttacttctggcggcactcaggctggctccggcgtctcagggagcaacatggcggctggcggttcggccacctcgagtagcccccgggttctgctctccctgctggtttgcctgtatctggttcttccctccatcttcatgctctccttctagtggtgaggttattttctcttggtgtggcaactagctagcagtactgaataagcagtggattggaacatcctgaagggtcgggtcctctagttcagtttcacactattgtttgtgtgccaggattggatgatgtgactggcacccagatctgtatgtttgcatagattgagccttatacagctcaccaccactagatttttcctggtatgtaagtcgttcgcgttaactcaagcacatgcctatcctccttagagcaaggttcaaaatgtgccaaanaaaaaa

SEQ ID NO: 8218 - DNA, 851 bp, Triticum aestivum
  Clone ID: PAT_TA_8218
gccccgccggccggtgcccgccccccctcacccccggcccgccccccctccgccgcacggcgtctggtacccacctgattatccataccagcaggcctattacaatcaaatgcagcaatactactctcagcactatggccaaacatccccctcaacatcaccatacccattcatggggttcatgacaagtggccagaatccaagggccggcttctcgccattgcacctgctggctccccccccgccgtcctttccgccggcccccgtgcgatcaaatgcagcaaaactactctcagcagtatggccaaacatccccttcaacatcaccatacccatacatggggtacatgacaagtggccagaatccaagggccggcttctcgccattgcagcagcaagctgcgcaggccgccgttctttcagcagccggccgagggttctttccacggcagcgccttcgctccctcctaatttcaagactccagttgccccctccgtgcaatctcaagggcagtctgaggatgtatccggcccacaaccaactcaagacattatcggaggctggaggctacaaacacaagattaccaatgaatcgtccagcgcctgttctgagtcttattccatgagggaaccacctccaatctgactccctgaactgaaacctccgccaaaatcattccgctgcctgggacgggccggttatggtcccggaggccaaaacggctactactcgactcctctacggctacgccgaatattgtccgcatccctcgatctggcccctccgtcgctccggtgccttcccctcgctaaccacggcagctgtttggggccacccaattttaaaggg

SEQ ID NO: 8219 - DNA, 706 bp, Triticum aestivum
  Clone ID: PAT_TA_8219
ggcggcgggggatgttccagcgccgtctgcattgtccggctggcccaggacgacagggatgtacctcttcgtcatgaacatcaggagcgtcttcaagctcgatgagctcgggtcggaggtgctgcgcattgcggtgccggcgtcgcttgccttggccgccgatcccctcgcctccttggtggacacagcattcatcggacgtctaggttcggtggagatagcagctgttggtgtttctattgccatatttaaccaagtctcgaaagtctgcatctacccactcgttagcgtaacaacatcattcgtcgctgaagaagatgccatcattagcaagtacctagaagaaaataacagcaaagaccttgagaaagccgctcatgtgcattcagatgcctgcaatgtgcccgcatctggtggtgatacgccagtgtgcgctaattcttgtatacccacagagtgtgctgatctctccaatcaagggtgcaagagaaggtacataccttctgtgacatcggctctaattgttggctcatttctcgggctagtccaggccgtgttcctcatcttttcggcgaaagttgtgttgggcatcatgggtgtgaaacatgactcaccaatgctagaacccgcggttcgatacctaacgatcagatcacttggtgctcccgctgttctcctgtctttggcaatgcagggtgttttccga

SEQ ID NO: 8220 - DNA, 753 bp, Triticum aestivum
  unsure (1)..(753): unsure at all n locations
  Clone ID: PAT_TA_8220
gnctgcaggnaattcggcacgaggctgggtcctcgtccgtctccctctgccgctccagcggtgggagctggcggggaccctggctgtttctgtccggtagggatataggataggcatagtttgtcttcagaggtgctgcatcactggtttggacggcgccgcatcggaataatttgcttctgctcttcctccatcctggtggcgctccaatggacggcgtaggggagcatgtggcttgttcttcttgctggtcttcagatctggtaagatctgtgtctgatggtcggcgcgccacactctctcgggtgtcgttggtgcgggctgttgcggttgtgtttggtgtcttgcaacggggcgcgtggatggcggaatgcagcggcgttcctcttctttgatctcatcaaatgaagttgacgacgctgggatctagcggacacggggaagaaccccggccgacatgccacaaagtctcggtctcgtcgcttgcggcggtacggttcatcggctcgaaaagcgttgtatgcaaaggtgctcctctagatcttggtatgaaggcggttcccctctttcttcgacattgcctcggcggtggaggaggacgatggtgggcgacatttgggcgtgaaacaagattctgtcgaagtgaaattctagttttacttgtgaagtcgtttatgctactgcaagacatctatgtatgtcttctgtganactacatgtgtactctttctagtacgtttgtacaataaaata

SEQ ID NO: 8221 - DNA, 2793 bp, Triticum aestivum
  unsure (1)..(2793): unsure at all n locations
  Clone ID: PAT_TA_8221
cccacgcgcccggtctgttgtctacagttgttcaggtcgattagacatactaaggactttgatgtctctctcagctacggcaaagcttctgaattgcccccaggtgtttcatcgcacaagtttgcagagtatgccacatcaggcctgacagaaaccagtgaaaagtatggaagccgcaatttatctgcacccatcaaagcaaatctacatttttctttgagtagaagtggaattatttctcttgatagggcagaagcagtgattgagataactgaatgggttgaagttccaaaagaagaacgtaacactagagactaataccaccgatgagactgtctgagctgaaacccgccgtaaaggaagaagctaacaaggagaagacggactcatcagaatctgtctacagcgagtctgaatccacggaagaagccgtcagaatcggatgcccctgagaagaataacgattcggaaccagaatcccatgacgagttgtgattattagaatcggcttttgaacacccctgagagatactactcaatatactccgagaagatagtttgtcaccaccacagttttgttatggcggacgaaaagacagaggtttgtgtaggaattcacggcaggctagatgctatatgggcgagaagaatttgatgtcaatcgctgtatagcagtattgtggtctctagggcatatgctgtcaagatagcgcctcagaaaggcttagttgtcaggactgagatgactttgtagctacattgaagaacctgcccgggcggtcgaggccatgggcgacccaattcttttcagaatgagtgagttaaaagcccgaccagcagcttgcggaagtgctcgattgtatcttactgagctacaaaagattgttaagaactgggatacaagcaaaccatggcttccaaaaaagagagtagatgaggtcgtaagtgaagcagataaactgaaaacttggttggaggagaaggaagccctacagaagagcacccctgtccacagctcgcctgctttcacatctgaagaggtctaccagaaagttttagccctacaaaataaggtctctagcgtcaataggatcccaaaaccaaaacccaaggttgagaagaaacccgcaaaggaggaagctaacaaggagaagacggactcttcagaatctgcatccaagcgagtctgaatccacggagaagccgtcggaatcagatgcccctgagaagaataacgattcggaaccagaatcccatgacgagttgtgattattagaatcggcttttgaacacccctgagagatactactcaaaatatactccgagcagatagctcgtctccaccacagttttgtttggcggccgaaaagacaattgagttaactgaatgggttgaggcaggatagatgctattcgagcgagaagaatttgataccgatgagactttggcaatagaatggggaacaactgcatatgctgtcggataagcggctcaattggatgttcagggaagggatgctgataattcgagcactaccaatgatgagaccaatgtgcaatgatactattacagagataggtgctgaagaaaagaaccttcagggttccattgaaaggtcactgtaaaaaactgctggtcctgcatcaaccctttcaaaggaactgtattctgaggcaaaaagtaggttagatgtacttaacaagaaggatgctgagcggaggagaactgccgaattgaaaaataaccttgagtcttacatatactctatgaaggaaaagttggaggaaagcacagatatgttggccgtctcaactgaacaggagagggaatcttttacagagaaactcagtgaggtgcaggattggctgtatatggatggtgaagaggctcaagcaaatgaatttcaagagcgccttgatcagcttaaggccatgggcgacccaattcttttcagaatgagtgagttaaaagcccgaccagcagcttgcggaagtgctcgattgtatcttactgagctacaaaagattgttaagaactgggagacaagcaaatcatggcttccaaaaaagagagtagatgaggtcgtaagcgaagcggataagctgaaagcttggttggaggagaaggaagccctacagaagagtacccctgcccacagctcgcctgccttcacatctgaagaggtctatcagaaagttttaaccctacaaaataaggtctctagcgtcaataggatcccaaaaccaaaacccaaggttgagaagaaacccgccgcaaaggaagaagctaacaaggagaagacggactcttcagaatctgcatccagcgagtctgaatccaccgagaagtcatcggaatcagatgcatcggaaaagactaacgattcggaaccggaatcccatgacgaattgtgattattagaattggcttttgaacacccccgagagatactactcaatatactcccgagaagatagtttgtcaccaccacagttgtgtttggcggctgaaaagacagagaggtttgtgtaggaattcacggcaggctagatgctatatgggcgagaagaatttgatatcaatcgctgtatagcagtattgtggactctagggcatatgctgtcaagatagcgcctcgaaaggcttagttgtcaggactgagaagactttgtagctgcattgttgtactggaaactcatttatattttgataacagctactatagagattttatgtttggtatcaaaaaaaaaaaaaaaaaaaaaaactccanantaaacctgcccgggngg

SEQ ID NO: 8222 - DNA, 1788 bp, Triticum aestivum
  Clone ID: PAT_TA_8222
cccggatcacaccgcaccctatccccggccccctcaacaagcccaaagcaccaggtccccaaagcaccctctgcgcccaagagcccagccttcctctcggcacccacggagcgcctgcggctatcaacagtcacagcccgcacagcgctacgaattatgttcctccggtcgatacgaaggcgcgtgcccggcaatcgggataggccgtctctgttgggaatcagtgtgaggctgagtggtttgagctgatggagcagccccttggaagggagattcctgaccggatcgtagatatggatgtaaccctcctgctccgtgagctggtatcagatgcgatgaggcttgcactgacgacactgagcgaggacggtggtcacaagaagcgaaggaaggtggcggaggacgacgatgatgaagaagaggaggctccaagaggccaccgacagaaaccgaggtctttcaagaaatcatcaaggcggtgatagcactcgagtgcagataagtcggaacctcctgcctgatgaccagtagaatccgtacataccgctccacctcgcgaaagctatttatcggaattttgtccttagttcgtccgatgcaccagccatattgttagttactaagttgcaccagcgctatctatgctaccttttgtttgaaagtcaggccactttgagcaaatagccagtatttctctgtttgacacaagattttacatctaatctatatgaatatttcacctttacatcgaactcattctctcatggatgaactcactgactggttacactgctgtaaataaattttcttcctgtgcgcccaatgaactgccactttgtaggcacagagtcggtcttggccatgtcgaacgtggccggtcttagatggagagatcgctgcttctgagcgcatgtgcgacatcgctggcgacggtgatgcagaagaagagccagccgaggagcgctgccctcaccgtctctgccaggcgcgcctccagcctccacggcaccatggcgtccaactcagaggcaccccctcactgaataaagacgcagaaatcccaacggagagaagaggatgaatagttgaagaaggcagaaatccaagtggggaaaagaggacgaagagttgaagggattagagcttaccttgatgaggcggagccttcttccttcctgtctgcttttaacgggcacgaatcttgaccgacctgttgcttggagtagaagagcgtcatataggccgaaagtgaaagctgaaggagttggtgttgcagccgtgcaagtaaagcaacagagacgggactgcggcccggggccgatggtagccatcgcccatccctttcaccgtccaatccatggcaacgaatatctcttgtttcttattccatgctaaaatatcaaagctctaggcgctgtacagtgtacgctgccaaagaaattccgggagtggactcgcaagtgtccgagatgcatatccacaggggacgggatcttatctctacaagagatggtagaaacacaccaagagaggagatgagacataacgtaggaatgtctggcgattttggttgaaaaagcgggtctagcagaatcgtctccctcacttcagtgggatacatgttggggatcgcttcaaatcgagccgttccaaatgatttttttgcctctggatttagacatttattgagttcagattttttatgtcttatctatgtttatctcgaagtggagaggacaaccaagaaataaataatcaaaattcttcttggtgaggtcaaaaaaaaaa

SEQ ID NO: 8223 - DNA, 903 bp, Triticum aestivum
  unsure (1)..(903): unsure at all n locations
  Clone ID: PAT_TA_8223
gnctgcaggnaattcggcacgaggcctggcgaaccgcgtcggcgagtcgtcgtcctcgtcgtcgagcgccagcggcgccgggaaggactcgggcagcttcgagtgcaacatctgcctcgagctggcccaggaccccgtggtgaccctgtgcggccacctcttctgctggccgtgcctctacgagtggctccacgtccacgcgcacttccccgagtgccccgtttgcaaggccaatgtcgaggaggacaggctcgtccccatctacggccgtggcaagacctccgccgaaccgcggccgagctcgtctgaggggccgcagatcccgagcagaccgtccgggcagcggcgcgccactgctccgccgcctgatcaccgtgaccattacccgcacccgaaccaaaacccgtggttccctggtgcaggcgccatggccggcggtcggtgggggaattacacattctccgccgcgatcggggggctgttccctctgctgaacttccaggtgcacgggttcccgccggcgtatggacccgctgccgggattccttacgggtacgggcatgacttccatgggtggcacgggcatggcttcccgccccaggcgccgcagggccagcaggtcgatgtctacttgaagatgctgctggtcctcgtcggtgtgcttgtcatcgctagcttaattgcattttagattatgtgttgtggagggccgtgttggtgtgcttgcatttcaatctgagtgcatcgtaggtagctgagctcccatggttatggtttgatcagtgtggagagcagtagaatgaccaaatttccattgtgtaataacctgtaattgccactgtgtggtgtccccagtgaattnatcggtgcattatttatgcatttacattaaacagctcgtgc

SEQ ID NO: 8224 - DNA, 594 bp, Triticum aestivum
  unsure (1)..(594): unsure at all n locations
  Clone ID: PAT_TA_8224
gcaaggnattgacagnactgagnagctctttcttgattctatgggtggtggtgcatggccgttcttagttggtggagcgatttgtctggttaattccgttaacgaacgagacctcagcctgctaactagctatgcggagccatccctccgcagctagcttcttagagggactatcgccgtttaggcgacggaagtttgaggcaataacaggtctgtgatgcccttagatgttctgggccgcacgcgcgctacactgatgtattcaacgagtatatagccttggccgacaggcccgggtaatcttgggaaatttcatcgtgatggggatagatcatcctgcatgcactggtcgaagctggagttcggttcagaagttggaggtcgtgtaactcgattggtgctcccccagtgcagctcataaaaatttctctgtttagatatgcagtgtagagcatagttgaccggggatgctcaagtgtagtttgtctcttttttcttgaagtattgtgtagtttgtcacttgtgccgtgcaggtttcctttgtctatgtggatcactttgtgaaaaaatttgtaccaaggagttcacgtttta

SEQ ID NO: 8225 - DNA, 1520 bp, Triticum aestivum
  unsure (1)..(1520): unsure at all n locations
  Clone ID: PAT_TA_8225
acaatcaactgctaagcctaccctgatttcagtcgccgccgcaccatcttcgacttgtaggtatcaagggcaactgcaacacttttctaaggaattagagcaaggtggaaggagatgggttttttgttttctaagtatcttgcgaggcgaggaactaggatttcaaagcggcggtccggacagcgcgtcggcggccgtgagcgaaagcgtcggcggcatcacctttaccttgactttgatgactggtcgctcgggtatagcatccgcaaggtagactcatcgcctggctctcgtcgccaatccgctgtgaggcgcttgcctcggcctttcttacgattacaggcgccgcatgggtcgccggagtacttcgcgtcacctttggcaccaacatcttgtcgatgcatcccaggtctacctcttgcaacagcttgttatccgggagcttgtatcctcaccttggacgtccgctcgcggngctatcacgtttggccctcggttggaaaatacgattaccctttgccctcggtggaaaaatccgattaatcccatctatctcgccgtcgacaataagctattcactctaagcaaacactccttcgagatactctccttggatctgctcagccccgtgccgccggatcgatctggcagagtgaggtggtcgtgggaagttctcacgaagcagccgttcaaggttcgcaacgtcacctcctacgcattgaacccctacagccagtccttcctggtgagcaccacgaagaaagctattgcggacacgtttgcctttgacacggtaaagctttcatggaaacaagtaggcaaatgggcgctgcccttccacggccgcggccactttgaccctctcctgggcgcctttgtcgggctctccaaagatccagacaccttcggacaactctacttctgctacatgcccagctccgacactggccacacccctaagtcgaagctcggcaagatgaaactgctcagtgaggacccagccgagaggcatgtaagcgccaccctcgtctacatggggcgccggagcaaattctgcctgatagagtgcgtctccattgagggcgacagtgctgatcaggagctcaaggaagagggagtcatgccccgccccccccccggtctttatcgtttgaccacattctctctcagccatgacatgaacggagacccgaccactggcggcagctgtcgagtgcaatactacaaagtgcccgaagcaaccactccgacgttcttgtttgcagatcctgttgtattttggatgtaaaatgttaaaataatgtcataatgacgacttcctatgtttaattttcactcatttgttattgcgttgtgcctagtataaatttgacattcaaaaaaaaaaaaaaaaaaaaactgcagcccgtagaagaaggtatactgagagagcgcagcgcctaacgctgcgctgaagaanaggaacacacggcctaagctcacactggagatcctcgtgtacctcggccgcgaccacgcta

SEQ ID NO: 8226 - DNA, 678 bp, Triticum aestivum
  Clone ID: PAT_TA_8226
ggccgagccgctgcagcgtgtcgccggccggtcccccgccgctccccccggcccgctgggccgcgccctgcggggctggcccgctccggcaggtggggcgccggcgccgccaggtcgcgcggccccgcgccgtggccctggcccggcgccctcgctgctctgtcgcccagggtgggccgcgcagcccagccccctgcccctcgcctcgccctagcgcacgcgggcgcgctccccccccccctgcgcgcggcccctcggcccccccctccgtcgctctgataggtcgatttccgcagcgccgcaacatagtacagaggttctgcacccggtatccccttgtttttcatgctcaaattaaattgtataaatgctcaggggaggacatttatgtttgagagagagggatggaaaagtccgcatggcgggtccgaagccccctcggctttgcccgcggttcggcccccgtcgtcgttgctgctgctctcgggcccgacgccctcgcgcccggtccgtaccccccagctccggtggctgtctccgctgaacctgaatgaaccctgtcttctagcacatctcaccgccacccggattgatttaatatttgccacactgtattgcctcatagaaactgctatcctctcgcttgaattgatggtctgatggatatcatgtatgtgt

SEQ ID NO: 8227 - DNA, 783 bp, Triticum aestivum
  Clone ID: PAT_TA_8227
cgaataagctcgtcgccgccggctgcatccccgccgacctaaaccaaaccacggtgagggcgaggtcaccaccaccggctactgccctccgagaagcaatcgaggcgtcgccggccgcgtccccccggccgggcccccgccggctccatccccgccgcccgtccccgccccaccccggcccgagctctctcccctgccccgccccctcccgcgccgtggcggaggcaggggagcgcgtggtccgcgacaccaacccctgcccgggccgcccgccggcgccggcggtcgccccccccctgctcaccgacgacctcatcctcgagatcctctcccgcctccccgtcagatccctccaccgcttcaagtgcgtctccggtgtcctggcgccacctcatcgccggaccccgccaaccgcaaggagtgcccccccaccccccctcgcttcggctcctcctccttcaacaaccggcgcgcccgccgcggcgccactgcctcggccgacagccctgccccgttcaacctttccatcccttacctgcacaataacaagtacggcggcatcacccagttggacgcctgcaatggcctccttctctactgtggctataagaagaagatggagagttgggatgatttctgttttctagtgtgcaatcccgccactgggaggtgggtggaactgccccctaggccgcctgtgcccgcaagcagatattgctgtaccacaagtcttgcttttgatacggcagtctcatcccatttcaacgttcttcactttgagca

SEQ ID NO: 8228 - DNA, 816 bp, Triticum aestivum
  Clone ID: PAT_TA_8228
attcggcacgagggagaggcaatcatgtccctccggcgggccgtcggtttcctcctcacacggaaggttctcgccgcgggtgatgcttactactccgggggcatgcatgcactataaacaattctcccgtgcccattggtagcgaaaccctagaattgaatcgaggcaccggtggcggcagcggcggcgagcgagcgagcgaaaaagaaatcgaggataaggcgagggaagaggcaatcatgtccctccgacgggccgtcggtttcctcctcacacggaggctctcgtcgcgggtgatcccaaggacggctcctgcacgctctttccactccttgaaggatctccccatcggcggcgctgctggtgtggccgcggctgcgtttgctggtgtcggagccttggcggcagttcagtatttcaggaaaggctcagatgatgatgagccagctactcgcaagaaaggggagttcatctatatatataaagaggaggagatggaagagttgtttgagaattggatcaaggagttcaacaagacataccgagacaagaaagagaaggctatgcggttccaagtgttcaaggaaaccatgaagtggatcgaatcacagcccccatcttcccataagtctttgtttccaggaaactgttttgcagacttaaaaagcgaggagcttccgtgcagccagtcctgtatccatggtttagatgacccaaacagcgaagagtaccgcgagaacaagtttgtcactgagaatgtgaaaggtggcttcttttgcaatttgtgactttcttctgttgttttggatgtcaaat

SEQ ID NO: 8229 - DNA, 1273 bp, Triticum aestivum
  unsure (1)..(1273): unsure at all n locations
  Clone ID: PAT_TA_8229
gcccctaaattaccctgagcgtgagatnggcgagcgagcggcggcggcggcagtgaagccttctcttctcaacaccccagcccccaaccagggatccacagccggaggcggcggagtggaattctgacaagagatggaggggggactcaggaagaagacggagatcaagtccgggaagatggaggccggccaggggacggagatggaaggggagctcaggaaagagcaggagaggatcaggaagcttcgggaccaactcatcaagagttgtgaatcctccacggacccggcgacgcaaaggatattcttggatcagctggatatactctggagggaggagtacgcactccgcacgaagatgagtaagtccgggatggagattcagagggctcccggttccgataccgattccgattccgattctggcaaatgagatgggcagttcgggggtgcaccccatacctcataaggaatggagtggagactgaggaagaagacggagagggattccagcaaggggaccgagatggagtccggcaaagagcaggaaatggaggggaaactcagcaaggagcacgagagactcaggaaggttcggtcccaactcaacaagaggtgccactccaccaaggacccggcgacgcaaaggatactcttgactcggcaggagatactctggaccaaggagcaagcactcctcacggtcatgaggcagtcggggatggagattgagagggatcccgattccgattccggcaatgagatgggcagagattcgcccctcataagcatggagtggggactcagcaaggggacggagagagacgccggtggcaaggagatgggtctgatgggccatgacggcttggttgttgctctttctagccaccttgaggtgcttaggagggagatctcgttcctgaggacagaggtcacgtcccggggcaatgggttggctggaaatggaaacaaggctgatcaagagcacatcatcatgtctaacctgtccctcgatgacactctactcaagaagaaggtgaatttgccttacctcggttgggtgcctctggttctagcggattgcctgctcggcgggccgctccagctccgcggccgctgcaacccttccgcctctgtgataaacgtgtttaggttttatgatgagctgtaatgttctgcatgtgcaacttctttatgtgtgtgtgtgtgtgtgtgcatttttgttgaacttgatgctgttgctactcttgttaaattatcatgcttgtcattt

SEQ ID NO: 8230 - DNA, 1642 bp, Triticum aestivum
  unsure (1)..(1642): unsure at all n locations
  Clone ID: PAT_TA_8230
ggcacgagggcgcggcccggcgctgtggagaaggtaatctccggtaggtggcatttgtccaagccctcctccccgcccgcctctgtgtcggcaccagtgctggagactcaggtggtcccgcctgagatggagaggtcagggttggttggaacgagaggctttgacactgccaccgagaggccaagggcgttggctgtgagagagctggacggtgccatggagaggccaaggtcagttggattaagagggctggacgttgccatggacaagggggtggaaccagtgaggcctgcatcacatgaaggcagggttggggaagggaaaatcggagaggtgccagaaaggcccaagctgaagctgcttcctcgttccaagccaatcgaatcccctgcaccatcacctacctatatggaagagaagcaggtccttccggtccctgtgatagcgagtgtcatgcaggttgaggttgttcatgaagcgcgccagaatgtgatggtcgccaaaacgggagtggcaggggcagatgctgaaagcagggcaacagtggagcgaccacggctgaatctgaaacctcgctctaatggagtgggtcagtctggtgaaagtgctgcaaaggagaggccatccctctttggtggtgctcgcccccgggaacaagttctcagagatcgtggtgtggatgctttggcaagtgaccttgagatcacctctccagttggcaggcccaaaaatgaatttgcaaaggtcgagcagaaggttgaagctatgaccattaacccttcaggcgaaaaggctgagagttttgcagttggtcacagaggcccaaggaatgctgataggaaagattacaggcgggatacagacagggctgatgcatacaggcctacacgacgcgatgagaacaggaaggtttctagagatgtcgaaaagcagcctgaacaacaacgcccagagcctgaaacctggcgtaaaccagtggagccaccaaagcctgaggttactgcacctcggtttgggaaagcagcgactgccttggagctcgcccaagccttctccaagtccatgtctgatactgtgccgcagtctcgcttgaccagtgttcctagtccaagagttcctccgagcccaggggctagggatcaggttggcttttcaaggctcactgacaacggggcattgcactctggatcttcacagcgaaagattaacggttactgatcctgtggcgaacatacactatgatcccgtgatgacacggttcaaatgtcatggccatcctgaagcacagtcactgctttacattacagccttgttcagttgttccagcactgggaagtcgaattgtgcggtgcaggaggggtgctagtctcattttagcaaacaaatgttcctcttgtaagttggtggcccatttcctctcttgataacaggagatgagaatttataaactttctatttgtcagcctgctacccgcctgtgatataagctgaggaataattgctacccttgtattggcatagttgggcttgccgtgtattgattctggcgtgcttgttttatgatgttgccagattagggtgtttacaccctcttaccaaaatgatttcattgtnatttcgtcagcaaagttaattatgcctc

SEQ ID NO: 8231 - DNA, 1217 bp, Triticum aestivum
  unsure (1)..(1217): unsure at all n locations
  Clone ID: PAT_TA_8231
cgccgccgcgctccgagccgcgttcctcgcccctcccgcggccgccttccgcctcctccctcctcgccgtgtcttcctcctccccctgcaccgcctctcctcctcctcctccccggtcgcccctccttgcgccgcttcctccgactcccagccgccgccgttgcctgccttcatggacgcgcagttcgagtccttccgggcgcagctcgatggctcctccgccctccgcgaccgcatccgcgccgtcgtctccgaggtcgagtcagcctcccgggccgcctccgctgcgctcctcctcatccaccagcccgtccccctatctgatgtgctcggcaaggcgaaggcgcaggtggaggtgatcaaggggctgtactctcagctcgcggagatcctcaaagagtgccccggtcagtactacaggtaccatggggactggaagagtgagacacagtctgtggtgtcgatgctagcgttcacgcactggctcgagactggtggcctgctcacgcacgccgaggcccaggaaaagctaggattgggttctggggagtttggcctggacgttgaagactacctgactggattgtgcttcatgtccaatgattttcctagatatgtagtgaatcgggtcacggcgggtgactacgactgcccacggaaggtgctaagctttttgactgatctgcatgcttcatttaggatgctgaatctgcgcaatgacttcttgcgtaagaaatttgatgggatgaagtatgatttgagaagggtggaggaagtattttatgatgtgaagatacgcggacttgtccctggggagtcaaagcaggaggttgctcagtcatagacggtgagcggtgccgtaccatttacttgcaatcgacagctgtcatgtgttgtcgtcgttaccgatgatgtttatgttggaccgatggttcctagaaaaagctcatgctgtgaggatctctttttttgactgtagcatcgctttaagttcggcactttttcggacccacctagaggttggaaaatgacatgagaattatccggtggtcatgtcatgtggcctatatnctgcgtcctgcattaggttttgtaccgatccgataaatccgggtgaaatggcngccacaancatggttgatttcannaaaggggggcccggaccaatcnccnaaatgagccnataccccccacngctcgtttaaactcnnacggga

SEQ ID NO: 8232 - DNA, 405 bp, Triticum aestivum
  Clone ID: PAT_TA_8232
ggctgacggagttgatggggtccaatggatccggggattcgcgacccgatccagcgcccggaggagggtggcgagctctgccttggcggcggacgacttgagctcctcgcggacgtccatggtggtgttggtgtgctcctgtccatggagaaaggaaggagaaggggtgtggctgctggttgctgctgctccggtgagcacaggcacacggtatggttgcacggaggcgcggcgtccagatcgaactcatgtactgtactgaagtgtaatccgtttggcttgtgaaatatagttttgttttggatctgttggtgtatactgtgtaaatatagtagtttgtgttgtaaaatccaatcattcttggaacagtaaatgtttatactgtggtgttcgttaaaaaaaaaa

SEQ ID NO: 8233 - DNA, 531 bp, Triticum aestivum
  Clone ID: PAT_TA_8233
gcacaaccgaagttcaaagaccagaagaaatatcatgagctggtggacccgcttatcaagagggagtacccggccaaagcgttgaaccaagtggtggccatggcttccatgtgcttgcaagaagaggactgcgtgcggccaatgatgggcgacgtcgtcatgaccctaggcttcctcatgatgctgccgccggatccgcccgccccagagccagagccagcccccgcccccgagccagtccccgagccggcagcggcacccaaaaaggacgacgaatcgcgtcgctctggaagctcgtcgtcctcttcggacgacgacgacggcggcgatgaggacgaagaggaggaagaagaagagcagagttaaggataaattaattgttccgggatcggttttggggaaatggtaataatatgcttcagaattttaatgtcaaagaaccgtgtagaccatgtggtttgtttgatgtgtctgatgtgtaagtagtctatagatgaattgattttggggggtggttcaggaaaaaaaaaa

SEQ ID NO: 8234 - DNA, 632 bp, Triticum aestivum
  Clone ID: PAT_TA_8234
gagaaggcaacatgggcgctcaaatggaacatgagcttgctcaccattgtgtactcggcaatactcaacactgctgccaaatttgtgatgatttcgtgggtcgtcacgcagcgtgggccaacctatccggccatgttttgcgccgtgacggtgttcttcactactattctcgactcgttgcttctcggcaatgatctgtccgttgggagtgttctaggcatgttcatgattctagctgggctctatcttttcctttggggaaagagaaaagaatcggtacctccgagtgaagaaaatccaaaggaacaaatgttgtttcagagtggagacaagaatgataaatcagtagctaatgtatgattatttcatttggcaatattacaaaagggactattcagaagtttgtgtattacgaaaaacagaggaaaaaggtcaatattgtttgtgatgtcctcaaccattcatccaatttgatcatcacgtaaaaaggtcaatatcccaaattgttgattatggtagttgtcttcattttagttagcgaattttaaaccagacagtgaaaatagcaaaatgacacaattagttctaagttttgtagtttctttgttggttttatataagtcctcaagcat

SEQ ID NO: 8235 - DNA, 686 bp, Triticum aestivum
  unsure (1)..(686): unsure at all n locations
  Clone ID: PAT_TA_8235
ctcggccccgcggtgagcaagaaggtacatctgtttctgacaatgctgcaagagtgaccgtgcctgagccgaggcatgtgtcggtcatttcaagtccaatccccgccgtgtcacaagctccgacgatctccaagagcacaccaggctaccaaaattacaccccagctccaacaacatcttcaggcgtaccatcatcagttgttccaccaccaagtcaggcatcctcagctcaacggatgcaacaagcatctcctgctgtcgcagcagctattaagccaattgctgtccatcaatctcggaaagcatctctcgcacgatttttagagaagcgaaaagacagagtttcaagtgtcacaccgtacccattgtcaaagagcccgctagtgagcagcggcacctttggtagtgcgagcactccaagcaggttatctagcgccaagagtctatgagcaaggacatgtacaatggctctagcttagggtggttattgagttggaatgagagatagagagatttttctattgcatgcgattatttttttctttagttacatattttctcacgttatatattttctagtttagttttagtcagactatatttttaggagcaagcttaccattaaaagttagagatagcaataagagataaaccatgttgnataacatatattttttcttctctag

SEQ ID NO: 8236 - DNA, 1157 bp, Triticum aestivum
  unsure (1)..(1157): unsure at all n locations
  Clone ID: PAT_TA_8236
tgcaggnaattcggcacgagggcgagcacgagtctgtctgacaacagcaccagagggcgcctccacagggttggacaagaggatctgaggtgagcccatccccctcgccttgtccttgtgtactcgttcttgctgcttgtgcgccggtctgtttctgtgttcctcgatctgtacgtgcttgtttgttcttgaccgttcagttctggttacctgaagctcatccctgatttgcttcttttcccgtgcaggttggtccactgtgtgcgggtgctcgtggttctggtcggttcctcctgccgcgtcttcagtcaccgctctgcaggtcgaccccttttctccttctcttctcatctctccaggcctgtgcttgcgttcttgcagccgtgtatcttccttgtgctcttattggtagaagcctggcatctaagagcagtatcattttctgcttgtatttttgtgcttcctcaccctttggaattggggatttttgtcacttatctggattatggtggacctattccttttctacgtctctgctatatgtcctacaagtgacctactgatttgcttgttcgaactactcacatgtgccatgttggagctacgaaacaagccaatgttgttccagatgtgatttataaagattattcgttggactgtagttgtagtggtttgctgtcggcaagatgcagtcatttgtatgggatgccagctgttgattttctgttggtcttatgtgccactggttgcttgcatgccccttttctaggtatatttggtagggtctgttcaaaaaagatgtattaattgtatcatctcaggaatgaaagagttagatagaagaggccatgtgggtatgctgataggtcaaggtgatggatcctctttactaacaatctgaatttaagcatcatctccactctaacccccttttcctgcagcttcagaagcaccagcgattatgtgaattggctttggtgtttaacaaaagttattagggagatggagcagttccagcagagagttagttgtcttccaggttaacactgattcctgttctagctgtttcgtatttcctgtaacctgttatggtaaacatcttgtcataggatttatgctttacatggtattgtacgatgngactangaagtacagga

SEQ ID NO: 8237 - DNA, 389 bp, Triticum aestivum
  unsure (1)..(389): unsure at all n locations
  Clone ID: PAT_TA_8237
ttttttttttttcagcatcatgcacagggaaataagtttacttcggtgatacaacaatacaggttttttttttttttgccgggagcaatacagatgtgaaacgtgcaagtaaaataaactagagatcggcagaggctgctactgatcaacttaacatttaacaagagactgatgtcacatatgtacactgggattgggtgcactacacttaagtatttacgtgtgctgaattgcagtcaggcagatgtcacccaaatgtctccccgctgcctgtaacacatgtagagggagccaccctgcttacctttgttacgaatccctcctccctacccatcaaggtacctgtttggggaaggngtttttccacaaacaccaaaancccttccctg

SEQ ID NO: 8238 - DNA, 1032 bp, Triticum aestivum
  Clone ID: PAT_TA_8238
ggagagagagaacttgtctcagtttgcttgatttgtttatccgtgtggaatcaaatggcgcaggagagctgtgatctcaacaaggacgaggccgagacccggaagccatcctcctccacaccttcgcctccttccccaaccacaccaccaccaccaaccgctcaaataccagaaccgcaacctccacagtcgccaccacaaccaccggcagctcaattcttgtccaggccctgtgaagttgttcacatagagacttccaaaaagaggaaacatgctgatgcggtgtcaatggccatggcggctgcgccattgtcgcctgtgctgtttgttaaccgttgcaacgtgtgccgcaagagagttggtttgaccgggtttcgttgccggtgcgagaagctcttttgtccgcgccaccggcattcagaaagccacgactgctcatttgattataaaactgcgggccgggaggagattgcccgggcaaaccctcttatcagggctgccaagatcattaggatatgaggttcatctaagaattatatgaaagacttaaatcttggagatgctgcaagtgtatcatgctgtcattccaaggatgatccgaaagcatgaccactgccaacttgtgaagacattccccaaacaactaagctcttagtagcatacaagcctacattgagcaagggttggttgttgtgggagaatgcttcactcttgttcttcgtccggctatggttcactctatagcatctgaagctaccatgaacacagatgatagaacctatagtgtccagttgtaattctgttggatccaaagatttgttatattgtaatctttctttactattgttcaaattctacttaatgcaattgtgtgttactgaaagctcgtgtgatgtttagtgtgtcaggtcgatactgaagctactcagttctcatacgatctgttgtaacatttcttgtagcaaataatttttctcaaggaagcaaaagatcttcctcatctcattaattaagtaaaaaaaaaaaaaaaaa

SEQ ID NO: 8239 - DNA, 808 bp, Triticum aestivum
  unsure (1)..(808): unsure at all n locations
  Clone ID: PAT_TA_8239
nttttgggtttttttgngaggnaanttnccnatccaagggattattttgacccggttttgnggctgaattgctgtgcatttatgcagaaagataggccaggaggcaaacctatgctgaattgatgtgcagtaaagataggccaggaggcaaatattttctatggtcttggcaaaagcagtgtcacccagcagtgggcaaatcaacagatgctttgaccatttttattttttttgcagatgaggggattagcatgaaaggctgcttaactagcaccttcatcttttgctttaattgattaataggttaagaaaagcttttgcaccaggcaatctgcatgtaaagatatttgcatcagtggtgcattttgaaggagagggacagaggagacaaggacactggccctgagtggctgagctgctgagcttaccttgggtatatgtatgatcatgcctttcctctccttgatgcaccaattattgactccagaaagaaaaacaaaaggctgtgctgtgctttgctcctggccatcttttgaagcaaaacaaaagagcagaaagaagcaatcaagcattcaatcatctttcctacaacggtggagagtattgtaagcagcgatgtcatacaaaatcttgaacagcaacacnccagctaaagaaaatgaacataaaggctgaggattatatctgtattacgtgctttacaaaaataatgtgctaattaattgcttctttagctgcaattatcataattaaggatcacgattacattcgaaaaaaaaaaaaaaaaaaaaaaaaactcgctcgtgcc

SEQ ID NO: 8240 - DNA, 602 bp, Triticum aestivum
  Clone ID: PAT_TA_8240
gctcacaggtgtcatccgactccccaacttcagaagctatccattcacctgaagctcatcaagaggatcaccagagtggggccaagaaagggtgggcaagagggcgagggaagctccatatcgtggcaccgcacagcccgcagtctgctcccgcaggcgcagtcggccactttgacccatcgagccctcgccaggcgtcccagaaatgcccattgagccccaggcaggtttctcagaagtgcccattcagccccaggcagcctccccagggcccgaggatgcccgacgggacacgtgggttcacaatgggccgggggaagccagcggcatcatcagtggcagcccggacggttgctgctcctcctccggctcctgttcttgtctagttcagttcctgcaggttaactgctacctatagtgtatttctgagcaatgaactctgtatctctatggatacaagtggttgacgagccttttttcttaccttcctttttttaagaccctataaataaaactggctgggtgttgccgtatttaaatgcaaggttgtaatatttttactgtttcacggaaagtatgagatctttttttaaacagctgaa

SEQ ID NO: 8241 - DNA, 767 bp, Triticum aestivum
  unsure (1)..(767): unsure at all n locations
  Clone ID: PAT_TA_8241
atgccgtggcgctgctctctcggtcttcgccatgcgaacacttttgtcaacttttgcatctccaggggacatcgtcttccagattcttcctctaggcttctgtagtttacaggaggatgttattcatgcttcagttgatgacatagagagaaggttacaagagatcacagtgagtgacatgtcggaaaaagatgaccatgaatccaatctgatgttatcaggaaaagatatagcggtttggattatggtatcttctgcttcagtagctgagtaccaacacgaccttcgagcaaaagaacacaatgctcgatggaggctagctttgctggcaaacaataaagttttaatgggaaatgtttttgattcaagggctacttctgtagatgcctgtggtaaccatggatttgttggaacacgtggaggtttcttgtatatgtgggaattatcttctgggagaaaacttaccagcacacagtgcttcaactgttctcgagtttcatgtgttgctgttggtgccaaatcaagcgtagtggcagtagctgacgatggctgccagctattactttacgctcaaaagagggtgtaatgtagctgtggccaatctgttgaatgtttgtaactgtacagcgcttacaacttacagttgtcctctgcacttcagctaacagttatttattgtacatagctcatcaaatctcaagttccgtagactttttttttgtctgttttaccatctcccagatctaccanattttaannanagtttg

SEQ ID NO: 8242 - DNA, 962 bp, Triticum aestivum
  Clone ID: PAT_TA_8242
tcgtattatggtggtaattttgtcaaagatgtctgcattgatgacggacaacctcttcctcggaagatttcagaagataaagtagtagatgaaaagtcatctccaaattttgattgtcaaatgatacacgcaaatggtgctccgacgtacatagaaaaagattgtgctgcaaaatctttccacaaacccaaaccagaagcagttctacctgttaattttgctcctgatagtaacaatgagaaacgatattcttcttgtgaaaaacatggtcccgagggcaagagtaaagccactaattttggtgatctcagtgagaagaaaataagtttggaagaattacttagactcgaaagtgcagaagagtgcctgcataaaggtgcaataagctctgaaaccagtaaaaatcatatgctatctttccatggagaagcagtcaggcaggtttcggcaaatgtgggtcatggagtcgaagttattgcatccaaaaccagtggtcttgttaatgatactgtatcaagtaagaacaacattgatgattgctcagtaacaacctctgaagaatgtgatgcagcggcatcatttgatgcgagaggactgaacctaatagttcactataatccttttgttggtcatgggtccctagaggatacatgtaaaccagaatgctctacatcagcaatctcagatgctgcttccactggacctatctgcactttcgagaaaactgatactattagtgctgaaggatttaatgaagtcgaaataactgaacctagggttgatgctctgagttcgctaggttcagagataagatcgtctgcgaagagcaatgatcagaatggaagtattatgggtgaaacaataaccaacaagatgcatgaaacagaagcagctacaacttcatcagctgaaaatgtagagcccaatggagcaaatggggagaatagtaaagaacatgggac

SEQ ID NO: 8243 - DNA, 835 bp, Triticum aestivum
  unsure (1)..(835): unsure at all n locations
  Clone ID: PAT_TA_8243
gctcgtctccatcgacggaaggctcttcctcttcatcaaccgcatccactaccttggcgacccgccagtttgcgaagctgtatatgcacctgcagtgcagaaaccgtgggtctggtcgtcactcgactcgccacgttcgctgctgccgttcacagcttcctgtatgctatgctgtacacccgggatgggcgcaccctcgtggtgtcatcccgtaaatggaggaccgtaaccgaggagggcaccttctccttcgacaccaagaaaatggagtggacgcgccacggcgactggcagctccctttccgcggccaagcacactacgtatctcagctggatgcatggatcggcatgtgccaccataagggtggcatcggtcatctctgttcctcggatgtcgtgccagttgccgccggtgcaacgaccttaccacgatggaagctcctcggagaggaaaggcttttcgacccggattcgccgctgcacctgggtgccaccctcgttcacatgggcggcaccaggttctgtctcgtggaatctatgtggcacaaggccgatgaagacgtgcggcagcgcaagggcaaggagagtggaatgtacgtagggcctcctcaggtcgttattcgcatgacaacgtttgatgttcagtatgacaaagatggtgagctgcttcttcagtcacggtgaactcatggctgcagagttttcaggagagcccatgacaagctggattcgttggctggccccgtggcattctggctataagcatcttgaatgcagatttatttttattagccccgggcatccggctataatataagcatctnaatgcagatta

SEQ ID NO: 8244 - DNA, 1480 bp, Triticum aestivum
  Clone ID: PAT_TA_8244
ggagaggtacctcagcggcttcaccaaggtggaggacaaccgctactccatgaagatattctttgagatccgcaagcagaagtaccttgaagccctcgacaggcatgatcgggccaaggcagtggagatactcgtcaaggatttgaaggtgtttgcctcctttaacgaggagctgttcaaggagataacgcagctgctgactctggataattttaggcaaaatgagcagctgtccaaatacggggatacaaagtcagcccggaatatcatgctcatggagcttaagaagcttattgaggcaaaccctctgttccgagacaagcttaatttcccaccatttaaagcctcaagactgcgcacgttgattaatcaaagtcttaactggcaacatcagctctgcaagaatcctagaccaaaccctgacataaagacactcttcacggatcactcctgtgctgctcctaccaatggagcaagagctcctccccctgccaatggtcctcttgttggaccaatccccaaaacagctggattccctccaatgggtgctcatgctccgtttcaacccgtgggttcaccatctccaaatgcaattgctggttggatgacaaatcccaatccctccttaccacatcctgctattgcacaagggccgcccggtcttgttcagccaccaaacacagcggcatttctgaagcatccaaggactcctacaagtgcgcctggcattgactatcagtctgcagattctgaacatctgatgaaaagaatgcgtgtaggccagccagatgaggtgtcattctctggtgcaagccatcctcccaatgtttacagtcaagaagacctccccaaacaagttgttcgcactctcaatcagggttctaatgttatgagcctggatttccatcctgttcaacaaactattcttctagttggaacaaatgttggtgacatcgggatatgggaagttggttcacgcgaaaggatagcacacaagacatttaaagtttgggacattggctcctgcaccttgccattgcaggtgtctgtggagccctgatggaaatattttaggtgtggcattttcaaagcatatcgttcagacttatacgtttgttcctaatggagagttaagacagcaagcagagattgatgctcacattggcggggtcaatgacattgcattctctcaccccaacaagtccctatcaattattacatgtggtgatgacaaactcattaaggtatgggatgctcagtccggacaaaagcaatacacatttgaaggccatgaggcttcagtgtactctgtttgccctcactacaaggagaacattcagtttatcttttctaccgccatcgatggaaaaatcaagcatggttatacgactgtttgggctcccgggttgactacgatgctcctggacattggtgtactaccatgtcttatagtgctgatggtacaaggctcttctcttgt

SEQ ID NO: 8245 - DNA, 503 bp, Triticum aestivum
  Clone ID: PAT_TA_8245
gcccttttgcattagccccgttggccgccgtcttggacggcatgcccggttcggcttccgcgcgagctccgccgaggcagttaactgggagaagaagcaggagatcagcaacacgagggataagaaagccgcggaggacaccgggttgaaggctctgtatgatgatgggttcgggagcgtcaccatgaaggattacctagaggcggttaggaacatgcccaaggacgacggcgggccacctcgatggttctgccccgtcgagtgcggccggccggtggttgctaatccacctctgctgctgtttttgccaggttggtccaagcgttgtcattagtcaatgatagtatatatctatatccatatgaggtaaatacaccagtggtgcttgaacttgacacggatgtgcaatttagtgcctgaatttgtaaaatacattgaactggttccataacttggcatgaacatgcatatacggttcaaatgacgtttgtataaaaaaaaaa

SEQ ID NO: 8246 - DNA, 644 bp, Triticum aestivum
  unsure (1)..(644): unsure at all n locations
  Clone ID: PAT_TA_8246
cggtagcctttctcggnggagaaactctgtgtgtggcttgtgcagctcctgatggcgcttgattacctgcatgccaggcatatccttcatgcgagatgtgaagtgttcaaatatatttcttacaaaggaccaaaatatacggctcggtgattttgggctggctaaagtattgacttctgatgatttagcttcatcggttgtaggaactcccagttacatgtgccctgaacttcttgctgacattccatatggctccaagtccgacatatggtcgctaggatgctgcatctatgagatgactgcgctgaagcatgcattcaaagcatttgatatgcagacactgataaacaagattaacaagtctgttgtcgctcctctaccgactatatattcgggtgcatttaggggactcatcaaaagcatgctgcgcagaaatccagatcacagacgaagtgctgtggatctgctaaaccacccgcatcttcagccctatgtgttggaaatccaatcgaaatcaagtccggctcgcaatatgttcccagctatacttcctaacagacatgagaaaaacaagacaacatgttctgatgatgaagacaattgcaaaccccaatatattaagagtcagtcatttaaagtacaga

SEQ ID NO: 8247 - DNA, 796 bp, Triticum aestivum
  Clone ID: PAT_TA_8247
gggccgccaagcccgtccggcccagcctgaagccggtctctactccacatcagccatggattcccgcgccccgcatcgcctgtctggtgcctcgcttcccggcgctgtccctgcccaagagctccgtgtggaagcagcttcctccctcctcctccccaacggcgcctcgcacgtcaacgtgcggtccccatggatgaagaccaccggcccatgcttgacggcgtcgccaagagcaagcccgctcccgcccctggatccctcctccgacttcctcaatccttccggaacatctcccttgccgccgccgcctcatcgagtaagagttcaaggttttgaaggtgaagtgtatggtgccattttcatgtggagcattagaaacttgtttttcagcaatgatttttccaatggagaaggtgtacacatcaagttctatgatttctggctccgctggtcctctaagaaatatatcagtttgacaggactaattgtattacatgatgatgagtcaaggatttgagacaaaatggtagattgctcttgacttctgtccactcccgagttagttgcaactttacatcattaatttgcacgcatctaatttactgccacagtcatcatttcgattgctccgttggactagacaccattcttgccatgtctgaagtgtaataatttgaagatggaatgctgcaattttcatgctgtatattttgtgtaagtctacaaaatggttgtatacgaatctgcacttttggactaaaaccagttttaccggtcattttaaggatggttcgga

SEQ ID NO: 8248 - DNA, 1276 bp, Triticum aestivum
  Clone ID: PAT_TA_8248
ctgaactgcaaaagcatggatctcgtgttgtcgagtaggtttcagatgtcagacccatgccatggcttggtgtgcgcctatgatttaaaaggtgctgttgaggtgttgaatccaacaacaaggatacatttgaggctgccagtttcagagctacagtcacttgcttcagaatattttcttggacctgtgccttcaacaaaggagtacaaggtgctctgtatccaccaccgggtgcggttcttgacatttgaagtatgcactgttggcacacagtcatggagggcagtgcgcgaatctgcaggcctcctgaagacaacaaaggcggtcattgttaatgatgtcatgcattggctacttcttgatgagatatcctccaattttactcggaacatcttgtcgttcaacctgacagatgagatgttctcagaaactgctgtcccagatgctgtaaaagaccgtgaattgcacctgttcgaggggggaggaaagcttcatttgctggcaatgcccggtgagggatcagcacctaaaacctcagagatttgggtggcgaactcgacctgtgcagtctgggaccacatgtgcaacgtcgcttttgtgctacctttgggcatgaggccacttttcctgcacaacaataagctcttctattgcaaccaaagaagattctactatgttgatcttcaggatgggagtggttcctatctcaacatgccttttggcgagtgcatcatatcggctgggattttcgtggagagccttgctctacattctgtgactggcctggtcgactccagaacaacgctacaaagtcctcatgatgctagatcatttccaatagggcgtggaccatctgctcgtggcgctggatcgtcctcagcaggccctcgacgatctttcaagaaggcaaagagcaatataaacatgcagtggaggttggcatagatctccgcaaacccctgatatcgttcgtatccatgaatagttctctgttatgtacagcgggattcaagccaatacctaagtacaatccaataaaagtttactgggtgtttgtctgtgtagaagatgaagaagaaatagaccatggggggtgagtctgggacagggtagaacataagttaggaaactaagaaagtgccccggtgtcagtagcttgtccgttggttaccgtatggggaatttatgcgctgtactgggaaataaaaatgaaaactctgaacctgatatactgtatacttgttctggtttgctgtaaaaaaaaaaaaaaaaaaaa

SEQ ID NO: 8249 - DNA, 730 bp, Triticum aestivum
  Clone ID: PAT_TA_8249
gaactccgtagaaaccaagccatagcatataacaacaacaaatatttatgagtttttattggctcaaagtgagaattctgatgctcaccaagaaccaaatgataacgatagacaatcgaaccaattatcatcccaaaagttgatattggtgccatcaccattttgtgtgtataaagtattaaagtataggagccttcgtttatcagttaaaatttctataatcctcttgtacaggtaaagcagatgttgattgctcttctaggcgaatcagagatgagattatctgacgagattgttgagacaatcctggacaagaccttttcagatgctgatacgaatcaggatggtaaaatagacagaacagaatgggagaattttgtgtccaggaatccttccttgttgaagataatgactctttcgtacctcaaggacataacgaccacgtttcccagctttgtgtttcactcggaggttgatgatattgttacatgacggtgatcctcacaaagatgtacaggtaacagaaggaaagaccctatcatcagaatatctgcaacgctgcaacatgcttgatgctggctaatgttgctcgagagtcaagagatagtttttttctgggtggtgttcattaccccgagagttagtcttgttaaatatttatgtatgtttgtgagcttcaatttgcaagtacttggcccaactttttccttgtcgagaatatggctgcttt

SEQ ID NO: 8250 - DNA, 1149 bp, Triticum aestivum
  Clone ID: PAT_TA_8250
cgtggccgcgactccatatcccaccagccaaaaccagaccgccggccgcccgcccccccgcacgcctcccgtgaccgccggaatcccgcgctgacggcccggatccgcccgcccgcccgcttgctgcccgctgcccgctgcctcccctgctggcgctgcggctccacacttctatgcagtgggtggcggcggcggtgatgcgtgattggtcgcggcggcgctaggtgctcttctccggccgcggcgagccaggccatggggtgcatccagtccacgccgaagcggaggcagcaccctgctggctacgaggaccccgtccacctcgcctcccagaccgccttcagcgtcagcgaagttgaggctttgttcgagctgttcaagagcattagtggctcagtgatcgatgacgggctgatcaacaaggaagagttccaggcttgcattgttcaaaaacacaaggaaggaaaatcttttcgctaatcggatattcgaccttttcgatgtcaagaaaaggggtgtcattgattttggcgactttgttcgagctttaaatgtattccatccaaattttccagtggaagagaaaattgatttttccttcaagctatatgatatggatggtacaggctttattgaacggaaggaggtaaagcagatgctgattgctcttctaggcgaatcagagatgagattatctgacgagattgttgagacaatcctggacaagaccttttcagatgctgatacgaatcaggatggtaaaatagacagaacagaatgggagaattttgtgtccaggaatccttccctgttgaagataatgactctttcgtacctcaaggacataacgaccacatttcccagctttgtgtttcactcggaggttgatgatatcgttacatgacggtgatcctcacaaaaatgtacagttaacagaaaagaaagaacctatcatcagaatatctgcaacgcatgcaacatgcttgatgctacctaatgtttctcgagagtcgaggtagaatattttgtctgtttggtgtttctttacactgatgtatgtttctgagcttcaatttgcaagtacttggcacaacttattacttatcgagaaaataacaacataaaaaactgttgttcaccctgactaat

SEQ ID NO: 8251 - DNA, 1294 bp, Triticum aestivum
  unsure (1)..(1294): unsure at all n locations
  Clone ID: PAT_TA_8251
cccgacgtgccccgccccacgcccggcgtcagtgcaagtgtatttggcgtttcaccaacctctttgcaatgttcatatcatcaaagaggaaacagtgtgcccacaatattgctaacgatgcagaggaagttgtatccgcgggaaggacttaagattgaagggatattcaggattaatgcagagaatggtcaagaagtctgcgtcagggaccaattaaacagtggcgtggttccggatgaagttgacttacactgcctggctgggttgataaaggcatggtttcgggagcttccaacaggtgtattggacacgctgactccagagcaagtaatgcactgcaacacagaagaggagtgcgctctccttgcttctatgctaccaccagttgaagcagcattacttaactgggctattaatctaatggccgatgttgtggagcttgaaaactacaacaagatgaatgcgcgaaacatcgctatggtttttgcgccaaacatgactcagatggccgatccattaactgccctgatgcatgcagttcaggtgatgaatttcctcaggactttgatcgtaaggaccgtaagggaaagggaggagttagctacagcatccatgacattgcaatcatgctctgattccccaaatgaccaagacgaacctcagatgccggagcatttggagaaaccgttcgcttgttcaattcaggagagggccgatcaccccgatgattgataaggctatttctgaacagctcctatctgaagctcaacaagtcctccataattccaaaaatgatttccaagaacaagagaagaagtgtgatatggaccacaataagtgccacagtggagttcctccacgtcacaatgatccgaatagcggagtaaccccctccggaaaattagttcacaataggaaatgtggcaggtttgttcgacagattgagattcaggaaaggtgtggagaggctgtgcaggcatcctgtgcttctgttggccagaaccatgaggatggcccaagacgcagcacaggcttgtgcacgaaggggagcgacccgtgcttggggatccccccagttttacagctttctggctcgtagctcatgcgaacggtctccttgttcctccgttgttgctttgtgcccggttgggccgtcccgctcggttctgcgggtggggacggcttgccttgtactgtgtaggtcctgcagatcgcaccggcctcctgttgcgttataactgacgacgtgtgaaagattgcatgggttcctatataagnaacgnaanagtcacag

SEQ ID NO: 8252 - DNA, 623 bp, Triticum aestivum
  unsure (1)..(623): unsure at all n locations
  Clone ID: PAT_TA_8252
ttcaccccctcttcttttccccatggatctcaaatcagttctcacccgtcatcgcccgcgccagggggaggacatggcctgcaccttctccatgctcatggctttgacggggggcggcgctgctaaccactgcatggcggcggccttggggcggcgtggcggagcgggtgctggagacgggggcgtccattggtgctggagacggcgtccagcgatgctgcaaccagccgagcatggcgttgcccaccacgggcacggtgaccacgctgacgggtgctgcaaaccacggtggcaaaacgatggaaccgtggcggaggatgctggaaccggctgagcccgatgctgcgacgaggcggcgatttttggtgtggtgaagtttttggtggaaccaggcatcagcggtgctacaaccagccacaaaaattgctggaaccggcatccaccggtgctggaaccggacgcgccttcccaccgcgaacggttttttgctggaacttgctacttcttttgctacatctactttccttttggattttgcttcctgttatttttgctggaaccggacactcctcgcactgccgacgtgctcttcggctgggttaacgaagtttttacaaangntt

SEQ ID NO: 8253 - DNA, 427 bp, Triticum aestivum
  Clone ID: PAT_TA_8253
cccacgcgtccggccgcatcctgcgtggtgaagctgcgactcccgctcgccgccgtcggccaccggcgacgagcctccgtctccgcctcctctcgcctagcatcctctcccaaaccccaagctaggagccctccgccgctctcccctcccaaacccctcctcgcacccgcccagatccaagcgcccatcttcccctacgccgccgccgccgccgccgccgggccgtccaagagggggagcgagcgatggctccctattaatctccatttccccttcctccatcccctccgccgctgtcccctcccaaacccctcctcgcacccgcccagatccaagctagcccatcttcccctacgccgccgccgacgccgccgggctcttcaagaggcgaccatggtggagctgcccctgggaagggggacccctt

SEQ ID NO: 8254 - DNA, 889 bp, Triticum aestivum
  unsure (1)..(889): unsure at all n locations
  Clone ID: PAT_TA_8254
ttcggcacgaggcgagnagcaaggccgtgctgcgggaggtggccgcgtacctcctcgaccacgacgggttcgccagcgtcgcgcccactgcgctgatcaagatatcccgccccgagatggagacaaccgtggcgtccatccagcgcttcgtggcgcaccactacgacgccggcgagctcggcccatctaggttctccgtgacctccgtgcaccgcgtcggaatcctcgacgtgcgcctcctcaatatcgaccgccacgccggcaacatcctcgtcaagaatccgcccaccagcggctgcgccgtggacggcaagcacgtcgggcggcgccgctggagctcgtgccgatcgaccacgggcctctgcctcccggagaagctcgacgacccatacttcgaatggctgcactggccgcagtcgtcgcgaccattctccggcgccgagctcgactacatcgcgtcgctggaccctttcaaggacgccgagatgctccgggaagagctgccgtccctgacggagccggccatccggatcctcaccgtgtgcaccgtcttcctccagcgcgcggccgcggctgggctctgcctggctgacatcggcgacatgatgacccgcgagttctcgtcggcggaggaggggctgagcgcgctcgaggccctctgcaagaaggccgtggactccatcgacacccagtcgccgaagcgcgtgtcgttcggggtgctgggtggcgaggagtgggtggcgttcatggagaagtttgagcagctgctgccgccggcgttcgaggacaagaagcgcggggctggcgtcgcgctgaattaacgccgacgactgtgatgaaacgtacgtacgatctgcacgcagggtgtaaatgtgtatgcatacgtgtg

SEQ ID NO: 8255 - DNA, 711 bp, Triticum aestivum
  Clone ID: PAT_TA_8255
ctgctcgcctaaccctatggatagcgggatccctccgtcctgttgaaatttccacccgtattccctgctgcgtctgtcgagatcgctcaggcactgatgcgatttggtattgagattggcaggcatggcgacggcgttcaaggcgttcgtgaacagccccgtcggccccaagaccacccacttctggggccccgtcgctaactggggcttcgtcctcgcgggtttggttgacttgaacaagcctcctgagatgatatctggcaatatgacagccgccatgtgtgtgtattctgggctctttatgaggttcgcgtggatggtacagccccggaactacttgctcctggcatgccatgcctccaacgaaaccgttcagctctatcatttatctcgctgtgctagggctcaggggtatctggattccaagaaagagccggaggcccaacagtaaagggtgtggtgtttctgaagtcagaggaaccttgattccgcagccagcctttcaataagtaaaatttgttcctgaagctttgcaatgcccttcatgagaaaaaaacctataaagtgcacacttctatttctatgatactcatgcctgcaatgtagcattacagctttcttgttcctgaatcatggtacatcacatatctttcttgtcaatgcacatagctggggttaaagttatcgaccccggagccgctgcttgatttt

SEQ ID NO: 8256 - DNA, 867 bp, Triticum aestivum
  unsure (1)..(867): unsure at all n locations
  Clone ID: PAT_TA_8256
ccttgcggcgcgcaactaagctccctgcgcctctgcccgtcccaatgcccttggcttgttttctaccaacccccatccccatctctcctcccctaggctcgccttcgccgtcggtcgggctccctctccgacacgccgccgtcgatacatccacccgaggcatggcgacggcgttcaaggcgttcgtgaacagccccgtcggccccaagaccacccacttctggggccccgtcgctaactggggcttcgtcctcgcgggtttggttgacttgaacaagcctcctgagatgatatctggcaatatgacagccgccatgtgtgtgtattctgggctctttatgaggttcgcgtggatggtacagccccggaactacttgcttcttggcatgccatgcctccgaacgaaaccgttcaggctctatcatttatctcgctgtgcttagggctcacgggatatctggattccaagaaagagccggaggcccaacagtaaaggggtgtggtgtttctgaagtcggaggagccttgattccgcaggccagtctttcaaataaagtaaaatttgtttctgaagctttgcaatgcccttcattgagaaaaaaaaccctataaagtggaaatttctaattctacaatgctacatgcctgcaatgtagtcattacagctgtcttgttcctattacatggttcatgatacagaatcatggctacatgacatattttttccttgtcaatgcacatagcccggggttcaagttatcgaccccggagccgactgcttgattttactgttgaataagacaaaaaccgcgttccactaaccctganaacccttccacnntanacaaagcnacatnctcaattcac

SEQ ID NO: 8257 - DNA, 633 bp, Triticum aestivum
  unsure (1)..(633): unsure at all n locations
  Clone ID: PAT_TA_8257
gaagacacgcagggccggcgaggnaaggaaaggaagggatggcatcgttcggcgaggcgccggcaggcaacgccgcgagcggcgagaagatcttcaagaccaagtgcgcgcagtgccacacggtggagcgcggcggcgcccacaagcagggccccaacctcagcggcctcttcggccgccagtccggcaccaccgccggatatgcctactccaccgccaacaagagcatggccgtcgtctgggaggaaaacaccctctacgactacctcctcaaccctaagaagtacatccctgggaccaagatggtgttcccgggcctcaagaagccgcaggagcgcgccgacctcatcgcatacctcaagaaatccaccgcttaattattaccagcttgattcttcttccatcatctcaagtaccgcgcgcaaacaagaagaaactaacgtcaataagtttgccagacacatgcgtgtatatatatagctagctgtctgctgcatgcagtatatatgtttatgtacgatatattgattgattcatccatgtgtacgtacgtgtccatgtaattaaaatggtgatccattttatctacaaaaccgtgcatttcttgtctttttcccctcacattatcaggat

SEQ ID NO: 8258 - DNA, 960 bp, Triticum aestivum
  Clone ID: PAT_TA_8258
ctgatgcacctagtcaagcaccaatgcaacatcatggtcatcacggccatcatcaccatcaccatggtcatgaaagcaacaggcatttggctcctggttcttttccctgtacatacacccagatatgttgctccacctccatctgggtgtccatatggcaacagggcaaagagcagggttcctgtggcgccagctgctgagcctgtagccaatgatcaccgttttactcatcctgccgcttcaccacctcatccattatcaccttcttctgttcgtcatcctccacgtgatcctaatatgcacagtagacctcccgttccgtcccctccagttcttccagagccgcctttgcccagtgtttcttttagtcatgcacaccctccaagtgagcatgggacaggaaccggtccttctgctggaatgtctgtggcccctgcaccgcattcatctaatgctagccggaggctctcctgtcagtgggtcctggtacccctcatatataccctgctttggagcctactatgacagaagagaacccgcggctaaccagacgattcgaaatagagattttccaagatagaggacaaggcgcctctcggttttcttcttttccggtttactacagccggccgggcgggtggtgaagcacaaggcagcaccccctttgcctcaggcacgctgtcgtttgttatactacttgttagtgggatgtaaatatggaatgggtataaggcaagtaatcaaggcaaagaatgggcaagcagctgtgctcgtagtggtcaaagccacagcggtggcaggcccttctctagcacaagcatatgcttggccaggtttgctgtgtactgctgctgttcagaagaggattgttcaaatgtaaaagcttttattttacatgagatggcatggctttttgccaccggtttctgcttatagattgttgcctgtggaaaaaaaaaa

SEQ ID NO: 8259 - DNA, 840 bp, Triticum aestivum
  unsure (1)..(840): unsure at all n locations
  Clone ID: PAT_TA_8259
ttcggcacgaggggcggagctgctcctgctatgaaggaggggcgccactgtgctgcatggggcggccgtttgatgacgagcgagacgaagtcgttgcttcaaagggggcggcgatgcaggctggccggcggcagcagcagccggtgatgctgcaaaccaccctcatcgcggcagtcgacatagttgcaggggagcgggaggtcgcaggcttctccctgtgcacgctgcaatcgatggtggggagaagagctgcgcaacaacggccaaatcaccatgcggcggcgcggtgcagcaggttgacgccgggggttgtagcagaaggtgatgctgcaatagtcgctggtgatgcaggcggagggcgagctgcgtgccgccgacggtctgtgaaggacgttgcaatggagtcgggggctcgccggtttttgatgtagcatcatgagcccgccagagctgcaacgtagcatctccggggaccgtcggtgctgtgattcaacatcgtcgggaccgccggagttgcaatgaagcatttgtcgtgccgccaatgttgtgatgcaatatcgtcggggccgcccggagttgcaatgaagcctcgccgggggctgcccggagttgcaatgaagcctcgctggtagccgttggagttgcattgaagcatcgtggagggccgttgaagctcaccgggttgcaatgaagcgtcgtgggtgatgcgtcgtgcttccatggactgctgtgtgctggactggtggtgtccgatcctgcggctgggaggatctgtttggacggctncccgtggcggcttaaaattgtaacaaatcaaccggnctgatttgtagcagccgc

SEQ ID NO: 8260 - DNA, 1429 bp, Triticum aestivum
  Clone ID: PAT_TA_8260
ccacgcgtccgtgtgcgctcaaagtcctgcttatcatgagctggctctatgaagttagccccccggggcaggacttttgcacgcacaactcttctagcaagacttgaagcacggttaattcaaatgcagaaggattactggtcaggaaatgctcatcggattggttatgttggagctcgctctttcagaagtcctgaaacaggaagagaaaactctcctgaaggttccccaggagcacaaccatcaccaggtcattctgggaaagattatccaaaacagcgcaacgctggtaaatcatattctgcctccagtaagaagagcgggaaaacaagcacaccgtttagttgtcaacaggctgagaagtctgccaggactaagcgatctgcaggatcaatactgcatgggttaccagacacaagtgatgacagtgattctgagtttgtgaacacaccgtcattaagttcaaaatctcatatcctgaatgcacatagaaaatatttccagaatgagaatactagtttggcaacacccgcgtccaatggaacaacagaaaaagaaagaagcataaccaaatcccagttggcggaaccaaatgcaagaagtaacgttgatggacattccattgatgatcatgaacctgtaatcaagcaattgagggatgaaaatgcatcattaaaggaaaggttattgattgtggaagaggcaacgtcacaagagctggttatggagcgggacaaggtcaagtctttgacagagaggctggaggatctgcagagacaacttgatactgcaaacaaggaacaagaagcactgatcgacatcttttcagaagaaagaagtcggcgagacgaagaagaggaaaatctaagacagaagctaaaggaagcatcgaacaccatacaagagttgctgctggagaaatcaaacgctggcaggaaaggtcaaaaggtgtgagaaactcaccatgttgctaccgcctcactaaccagagtgactccagtttcacgttttcacgccctggggcatggcatcacagttgcttttgcaactctagcttgtgtacggccaatgtttagccccgccccacctttgtttagagttgagtggtagttgaatcatctcgtccagggtaagcttcgagcgctttgtgcatagccatgaatgagatgaccaataagttgattcaatgtaaagtagaataaccacttgttcgtacggccgttggcgattccacgtttagcccgtcctaaagttgagtggtacttgcatcatctcgtccagggcaagcttcgagcgtttggtttatagccatgagttctatgtaaagtaggatgaccacttagctgtacaacgaatcgatgccaattttctgaagagtgtgggatcgaggcactagtttagcctaaattcaaaaaaaaaaaaaaaaaaa

SEQ ID NO: 8261 - DNA, 390 bp, Triticum aestivum
  Clone ID: PAT_TA_8261
gggcttgtgtgcgagaaggtcgatccggcggtgcagcggatcatcgcgccatactgtcactgcattctgtcatgtaaatattcagagttcttgcacgattttccatattggtgagaaggtgtggagcttgcccaatttctggcatgtgttccatgcgccctgcatcgacggctggctgatcaagcatggatcgtgccccctgtgcaggaggaagctctagatcatcatcatccagcgacgaatcgccgacgattgatgaagaacttctctgttactagaaaggaggctatggttgctgctttgcatgctctgttgctgttgctaggaggctgacatatctgtagaaccctaaatttatagagctttttattattgcctttaaaaaaaaaa

SEQ ID NO: 8262 - DNA, 673 bp, Triticum aestivum
  Clone ID: PAT_TA_8262
gacacatgttgcactggcttttgaagtgccaggaagctggcttgaatcatgactgtcatgcaggtacatctaagggttgggtattcgatagtaattaatgataagttagtatacaaaataaaagaaaataaattacttactgcagagccattcagttatatatgccaactctgaaggataattcctaaaaaaattaggcgttctttgtttcctcacaatttttttcagaaatgtcgcatggttatttgctattgaacttcctctctgactgttggattatcagcccttttttgatggataggtgctactgaccagctaccatggatggaagaaacctcatcaaaaactaatacatatgttactgattccgagccttcaaagttttcttttgcagtagcatttattttgcacggttcatcttccatgcaaagagaagtcctagaacttttaggtgctggtatggcagttgcagccgtttgggaattgctcctagctgtaaattttctattatgattaacctgagagcaatcctgactaacatcagcatcctcagtgttaccatagtccttgcaatgaacagagagatattcatggatggagctggtaaggccactcattttcatggcagctagggacacagaaacacaagtttgagaaagttactgaaagggaa

SEQ ID NO: 8263 - DNA, 475 bp, Triticum aestivum
  unsure (1)..(475): unsure at all n locations
  Clone ID: PAT_TA_8263
gaattcggncgagggattgactgactgagagctctttcttgattctatgggtggtggtgcatggccgttcttagttggtggagcgatttgtctggttaattccgttaacgaacaagttcgacggcaagatgtcggcgttcccgggccaggccggggacggcagcgtggacgtggaggtgtgcctcgccccggacaccatgggccgcctcctatgcgacgacgagttcctgcagttcgtgtcccatgcaccttcaccgtgatgcagtgcaccgcatctggccgccctgtgcgttgtaccactacagtaccagcgcataagatgtgacatggccacctgtgatcgatgtggtcacctggacatgtcacatgcatgtatgtaacacatgtttgtgcagcagatacgtaatggatttgtatcgttgcgagatatcaatcaagaaatatcatggactggttggctactctaaaaaaaaaa

SEQ ID NO: 8264 - DNA, 666 bp, Triticum aestivum
  Clone ID: PAT_TA_8264
aggaattcggcacgaggcgcgtccgcgaggaaggagatcgcctcggcggcggccgttcatcgagggagatcgcctcggcgcccgccggaaaatcgcctctcgatccgtccgtgtcggcggaggaaggagatcacggagggtggaggagaaggtcagttcctcccttttgtcccctgtaaatctgtctcgcggatcgatctcgcggcgcctcggcggccatggagccggatctggacatggcggccctgagaaagaagctagaggatgaggtgctcggcgcctggctgtgggacagggagctggactccatcctgcaggaacagcaagagcgagacgacgaaggcgattacgagtactacgaatcaagaccaagaagaagaggagctccactatggtgggtccttggggatacgggtataccttcctactaacgaggacgggaacccttattacgtcgccgacatggaggagaggtgggagaatcagatgcggtgcccgccgaccagctcctgcgccaagagatcaagggggatctgggaggggtctcttcaggtccagggcccgtgtcagctcgatccaacactgttatctgctcaaagcttgctgcctctattgccaagatgggaaaaccgttgggtcgacaaaagggagaatgaaccttgtcga

SEQ ID NO: 8265 - DNA, 681 bp, Triticum aestivum
  unsure (1)..(681): unsure at all n locations
  Clone ID: PAT_TA_8265
ttgtgnccggccagtcttccttaccatttggttcatncccaagnatccttgaatccaaaattgggaagctcccttttttttcccaaaagtttgtntcattggattaaccatttttcaagaaattggccttgntgggaaagacacgttgaaactcgaagctgcaaaggatgttctgaaaggtgcacctggatctaagaaacctgggaatgataaatcgccgggtaaagatggtgacgccccgccacaaaaaccagaaatacccgacaatgagtttgaaaagcgtatcagaccagaggttataccaccaagtgagctaggagtgacatttgatgacattggagccctggctgatatcaaagagtcgcttcaggagctggtcatgcttcctcttcggcggcccgaccttttcaagggaggaggacttctaaagccttgccgtggaatattgctgttcgggccacctggaactggcaagacaatgctcgctaaggctatagcaaatgatgctggcgccagcttcatcaatgtctcaatgtccacaatcacatcgaaatggttcggggaggacgagaagaatgtccgagcattgttcagcttggctgcaaaggtggctcctactatcatttttgtggacgaggtagatagcatgttggggcagcgcgctcgctgcggtgagcatga

SEQ ID NO: 8266 - DNA, 542 bp, Triticum aestivum
  Clone ID: PAT_TA_8266
aggaattcggacgaggcgcgattccatggcgattctgatcttcccctctcctcgtgcttgatttttcctccgtgttccttcgatcccggctcccgtggtacgttgctgctgtctctggtggttccccgtttgattttgctcctgttgtggtcatgctttttcagatctaggtgaaattcctgtatgtggattcggatttcgcatgtttctgctcgtggttccctgtagcggttgtaggtgatgttgtgttgttgttggtggatctgtggaaggggtgctcaagtccgtcctcttcgtagttcggcaatttcccctctgctcccgctcgagtgagttgtgttggagcttgcagctgcgggttataggccgcccccctgcttgtagttgtgatttgtagccttagattgctgctgtaggtggtggatgtagtcctagtgattgttgtagggttgatttcactacgaattttctagttggagatgctccatcctaccatcttgtaggtgtgtctgaatttcttcagatcctgtagaaaaaaaaaa

SEQ ID NO: 8267 - DNA, 1309 bp, Triticum aestivum
  unsure (1)..(1309): unsure at all n locations
  Clone ID: PAT_TA_8267
aggaattcggncgaggctccgctttgctcccaccgctccccacgccgccggttagtcccctcagccggcggcgagatgtccttcttcttccgcgcggcgtcgcggccgcgttcgtcgcagcaggacctcgtgcgctccatcaaggactccctcctcgcgctcgacaccaagaccggcgccaaggccctcgaagatgttgagaaaaacatattcaccttgagacaaacactttctggtgatggagaagttgaaccaaaccaggatcatgtcttacagatagcccttgaaatttgcaaggagggtgtcctttctctttttgttcagaacctgccttcgctgggttgggagggaagaaaggatcttgcccactgctggtgcattttgttgaggcagaaggttgatgaaagtcactgctgcgtgcagtatatcgaaaatcatgttgatcttctagatttccttgttgtatgctacaagaacttggaagtcgctttgttctctggcttcatgttgcgcgttggccttttgtgtccctcactcccaaaatatatattggagtcaaatagcttcgagttgtttttccagtatgttgaattgccaaactttgatattgcttctgatgctctgaatacgttcaaggatttgctcactagacatgaagatgcagtctctgagtttctcatttcccattatgaacagttctttgaactctacaaaaggcttttaacttcagataattatgtgacaggaggacaatcagtgaagtttctttcggagtttctgttggaggccccaaatgctcagataatgaagcggtacattttggaagttcgttacttgaacattatgatgggtctactaaaggattcaagcaaaaatatcaggatatgttcctttcacatatttaaggtatttgttgccaatccaaacaagcctcgtgatatcattcaagttttggtagacaaccacaaagaattattgaagttactccatgctcttcctgcaagcaagggtgaagatgaacaacttgacgaggagcgagacttaattatcaaggaaatcgagaagctcgtgctcttgtcagtatagaccctcaagaaattcaaaattaccctttgaaaaaaaaaacagtggtcgagaaaggcaatccatttcttcctgtgtaatgtgataccctgtatagaattgtctagtgttgttatcatatttacagaaacagctcgtcattccacaagagcatgaagcattgctgcatgcatatatggttcaaacaaatctgccgcaccagattcgatatatataccgtaatttg

SEQ ID NO: 8268 - DNA, 603 bp, Triticum aestivum
  unsure (1)..(603): unsure at all n locations
  Clone ID: PAT_TA_8268
gaggaattcggacgaggggatgatntcgcggatggccggcacgatgtgacttcttctggtnaatctgagggagctagcaagcaaaggctcgccacggagctcgctcgaccgcccggtctccgccccgtcaaggttccaccccgtcgaatcagatccgcgcccgagctgatcgactgggataaaacgcctgtacgcgttgccacccggaagggcatggcgttggccgccgccgcgtcgtcggtcggcgtcgcctccgtcgctctgctcttgctcctcatcgccaatgcctcggcttcggatgctagtttggaggcgaggcgtgccttgccaggtcgcgagattcaccttgagccaattgtctacccagaaaatgcacagagcacggtgggctcatcgccatggaggagatcggcggaggagacaccaccgtcgccggcgaacaactcgctcgtcctcgcggcgaagaggacccgccggaacgaccccagcgcgaacaacacgatgtacggcggcgggtggaacatcagcgagatgcattactgggcttccgtgggctacaccggcgtcccgttcttctttctcgccctcgtctggttcgtcggc

SEQ ID NO: 8269 - DNA, 679 bp, Triticum aestivum
  Clone ID: PAT_TA_8269
cggcgactccgaccgcgagaaggaggagggctcgctcgacgcggcgggcgaggccaggcggcgcagggcggccccgacccgcccgccgaggcagtgctcctacgggggccgccacgccgcgcccccaaggagcccccccacgcggcccgcctcgccggcggcggtcggcgccccagagcccggcacggaccgttcgcccaaggcatctacggggagccagggctccacgatgccatggaagcgtacacatgagccgatcgatccaagatggcatggcaatgtacatatctgaggaatgcacttcgtacgtatgggagacaatcgacattggagtgcagagatcatcaccggctctatcgatccatcggccggactcgttcatccctctcatctcatatacagtagatcggatcgagcagttctggaagacgggaaaaggacgaatgaacaggatggtttgatcagctacacattattttactctccttgctctccgcccgacatgtgcattgctcgggttgctgttgtacgtacgtggctactgatttatttttgtaggtacttctcatttactccccgggggaggagacgctcaactctgtggtatgtgtatagccagcgggcaaacacattgtactcattaaattgatttaatctaaccatttctagaaaaaaaaaa

SEQ ID NO: 8270 - DNA, 642 bp, Triticum aestivum
  unsure (1)..(642): unsure at all n locations
  Clone ID: PAT_TA_8270
gcacgaggcgcttggtttgcgtcgcctagctcgtgttctatccccgatatcctctactctagcctcctcgcccatggccgattcctcttcctcttccgaggaggatgaacaagttcctttatggccaccatggctcgttggagctggaaggaagcctgtatggccttcatgatcagggccttgtcttctgactgctcttggttcagtatatgcgatgcaccgatgcatccatcccctttggtgcatcctatggtgttctttgatttatttcgtgctgtctactcatgaagctttcactgaagacgccccaccgtccatccgagacaccgtgtaatcttggccgttgatccatcccccaccagaccggatcgagatctaggcagaaggcgagtcgcccccctcacccttcctcgccctcgtctccgccccaacctccccacgagaaaccctcgccgccgccgaccccgacgccccgcctcaccggctccacctcgccgccgtccaggatgctccacatggaccagaacgcccctgccgctttcttcattggaccggatgggggttgagatcgatcacctcaacccggcaaccaacatgaggacggcccgtgcagtactccccgatgggcnnntgctcaacatc

SEQ ID NO: 8271 - DNA, 610 bp, Triticum aestivum
  unsure (1)..(610): unsure at all n locations
  Clone ID: PAT_TA_8271
gccccaggccctcccgcaaagcggcgtcagctggaggggacggggtcatgaatcgatccaatgcaagtgtcctcggagtccagcctcggagcgagagctgatccgggcggtcctggccaagatgggccgcctggctccgtctactgtggtggctggtgctgagagagttccctctttgatctcctagagtttgggcattgttgtttgatggaaggctttaccctgttcatcgtctgttttgccagcgccccgtctttgctcagctgtggatggttgagcatcttggaacctgaagagtagcgacctgaagaagggtcagacttgcccttgcctatggcagtttactactccctccgtcccataatataagaacctttttgacactaatgtagtgtaaaaaacactcttatattatgggacggagggagtatgttgctgttttctgtctagtgttggatgcgttatgagtatgttgttggttaccaaggttctctatctactatctgagaaaggatttggcttcatttgggggataggattaatctatgtcagtacctgagatgtttcttgataaactatttctttagggaatgtttcatgaanaaaaaaa

SEQ ID NO: 8272 - DNA, 973 bp, Triticum aestivum
  unsure (1)..(973): unsure at all n locations
  Clone ID: PAT_TA_8272
tagatggcagaagtagtacaagtacacaaggattgggttgggtcattcccctccgggaaaaagataacggttgtttttgtcataggagggccaggcagtggcaaaggcacccagtgtgctaagattgtgagccagtttgggtttacccatctgagtgctggggatcttcttcgcgaagaagttaaatctgataccgagcaaggtgcaacgatcaagaatcttatgcacgaaggaaagcttgtgccttctgagatcatcgtcaggctactattaaaggccatgcttgcaagtggaaatgataagtttcttattgatggatttccacgaaatgaagagaaccgcgaagcatacgagaagattattaagatagaacctgagttcgcattattgattgactgctcaagggaggagatggagcggcgcattctacatcgaaaccagggaagagatgatgacaacatggaaaccattcggcggcggttcgaagtttttcagcaatcaactctgcctgttattcagcactatgagaaaatggggaagcttcgaagggttgatggtgacaggcagccagacatggtgtttgaagacgtgaaggccatcttcgcgcaactaaacactcaggcaaaccaaggcagcaacgtgagcagagcacaaactaatccattcaagagctggtttcttgacatattctgcagttgcttcgatgtggcagacagaaggaactgaccatcttctaaagagatgtttaattagtgtggtacccttcagtcctggatcaagaattcaagatggagcagcaagcaagcacagcaaaagaaaccgttagtgttgtgatgtgttcatctggtgtgttgtgagctcgattaagctgtgtgaatttgacgtgcaaacatttcagcaaagattgtcccttccagcttcagtttgtactgaattnatcgtgtaaacattttaacaaggaaatgcaggcttt

SEQ ID NO: 8273 - DNA, 759 bp, Triticum aestivum
  Clone ID: PAT_TA_8273
gcacgagggcacagaggaaagggataataaagtgagtgagtttgaagtttggcaaggtcttgccaacttgtatgctagtctttcgtactgcagagatgccgaaatatgtttgcagcccacgcgtccgctgaaaacttattctgccacaacacttcatgcagaaggtgacatgcatggggtccgtgagcaaacgcagcatgcgctggctgcatacttgaatgcactctcaacagaggtagatcatgtaccatccaaggtgtccatcggtgctctcctgtcgaaacaagggcccaagtatctcccggtggcgaggagcttcctgtcggacgccctaaggctcgagcctacgaacaggatggcctggttctacctaggacaggtccacaagcatgacgggaggctagctgaggccgccgattgctttcaggcggcctcgatgctcgaggaatcagacccggtagaaagtctccgaccgctctgatcggtcatttggaacaacttgaggtttctttttttgtcggccaattttccttctcttcctcctttttttcgggtacatagctgggcagaaatttgaggctggctacctgtatcttgtattcctaggagccactgtgctgctgttgtcgagaaatgctgtaactggttgctaagtaagttgcttgcctggagtggcagtataaagcatatgtatcaatatcacccgctactacaagtaaaagtttatgacgagtcgtcggctaagataaaaaaaaaaaa

SEQ ID NO: 8274 - DNA, 404 bp, Triticum aestivum
  Clone ID: PAT_TA_8274
gcaccggcggcgaggtgcggcccgaggcgctgtgcgcggtgcggacgagggtcgccgagatgggaatctcgctcgacgtcgccaaaggagcgcctggctggccgccggtgaagaagacgagagcgccggcgacgtcgaccgccgatcaggacaggcccaggtcctccctggggagcctcctgtggtcgcaccttgggaagctctcgaataactttggcctcatcaggtcttaggaaaactgttagccaggccagttcattcaccatttgcattgctgtgctttgttggatatgatgtgaggtgtctcagtcagaaagcagtacaattttgtatatatacaaagtgtagtatgttgtcattgcaaatacagttgtcatcaccattttgtttcttcaaaaaaaaaa

SEQ ID NO: 8275 - DNA, 1148 bp, Triticum aestivum
  unsure (1)..(1148): unsure at all n locations
  Clone ID: PAT_TA_8275
tggccctcgcccagccactacctccggcggccntgccctgcccggcaaccnccggatccggtgggatcccgctccacctcccctcatctatcgcctttcaccatgccgtcgcgccggacggatggaaggtatccgatggagcgccatcttcctccagcgccagctccctcccatggccggcccgatatgggctggatctcttctcctaggacggcgacgatgtgccaggagatacacggtggctacggtagcagggatcgtgcgtccagtctggcgcccgtggatgtgcagctcggctgtgtgagatgcggttgtgggtgttaatgtcaagcagttcatgggcacgccggtgatgacaacagcaacggctccgcttccagcgagctcaaccggtcgtccgccggcgggatcctcagttcggcggtgcgtagatgtacagtgcggtggagctgacaaaaacgacgaggagtacgatggtgtgtgacttgtggttcgcgggtactggtgacccccatcttgccaagatccatccgccgccccttcccttccctccctcctagtttgtttggtgcccccggcatgaggttcagccaacttatcttcttgtagttcgaaaactggtctacaaacgaaaaggcatgcatgatttgtggacgactaaggattttacctgtgtgcagctctatttgcagtacttgcgcctcgactgtggagttcgcctggcattttcgttcagtccnctgtgtaaaaaatgaactagatgtntccgcggcctgcagtgagacaatccacttttgttgttgattttgatgaatttagtgcagtaaaatntcaaattagtatgctttgcggcttgtttgagcacagtgaagaaccncctcaanaaattcagaatcccagtcaacttgtcagcgcggananaaaaaacggcgtcaacaacaacacaaatgcagatccaggggtggccgaagctggagtggagttgctctcctccatggcgctccacctcggtggctgtgcgggtcataggagttttttttttctttttttggattttggatgtgcagtgcacacggatcatgcgagcagtgcacccggatcacgcgaggagtnaattgcagcgtgattacagttttggtggcgcggcc

SEQ ID NO: 8276 - DNA, 1378 bp, Triticum aestivum
  Clone ID: PAT_TA_8276
cttccccgctcccctctgctgtgctctaccaccccctcccgccccccaggctctccgacgccatgagccatcgtcccggggactcccgccgcccgtagcgtccggcacgtgctgccaattcagccccatcctcctcaccagctacagccactcgtcgaggcatggcgtcgctccccccgcggctcctcgtcgggcggtcctctgtgacagtggggacgctggtgactacggtggttgcggatgctgccgacctcggtgaaacgctgatagggttatagggaattctctgggttcacttaggcaccgcagatatgattggtgtttttttattttctgctgtgtagcaaggataggccgctgttgtgtatcagttgtatcctttcagttttatcagcttgaccattaaggtttggttttggagcaagatgctagtgcgtctcccggattcaatctcgtgttggttcctttcactctctatgatatataggtgcttttggtgcattggaaaagatgcgagctgaggttgtttggaaattcagttgctttcatcaaattaagagactggccaacaaccttagccatccttggtgttgctgcttcttttgctggaaaggcttatgggcaagtaggacaaggactcccagtggctgcttctggggttaggaatcgtcatgggattgaacctacttgaggtagtcgagctacaacttccctcatttttcagcgattatgatcctcgagctgctgcagctaacttgccttccagtgtacaagcatatcttgctggccttacatttgcattagcagcatctccttgcagtacacctgttcttgctacccttccgggatatgttgccacttcaagagatccaattgttgggggaagtttgttgttgacatatacaactggctatgttgcacctcttctcattgcagcctcttttgctggagcattgcagagtttgctgtcattcagaagatattccacatggataaaccccatcagtggtgcatttctattgggtggaggtgtttataccctactggacaagctgttccctgcgacatcaatggtgatgtgaactgtagagttgtaggccattgctgaacaagagccgctagacaaggatcaccattgttgcacatgccaacatgtcttgcgatgtaaagtagctaaacataaatggcaaggaagtagcatcagttatttctagcttttataggaatgcaaatatgtttacggtaacttaaacatcttgatctcagcagtccacagaaaagtttgaggtttgaccccattcccttcagggacccaaaagaaaacaacaacacctcgggtaaaaaaaaaaaaaaaaaaaaaaaaaaaaaaaaaaaaaaa

SEQ ID NO: 8277 - DNA, 1290 bp, Triticum aestivum
  unsure (1)..(1290): unsure at all n locations
  Clone ID: PAT_TA_8277
aggaattcggacgaggccggcccntgtcgtccttcgactccgtcgctgcctcgccggcgacgacgaagcgctcgcacattctccctttggcatctccgacggctacaacgccgagggcagccggggccacggcatgcatcgcggccaccgcttcgccacgtcctactcctccttcggcaccgccctctccgaggacgacctcgtggggatcgccggcgaggggtttggcaggtgggtatggcgcgtacaccatggcgccggactccaacggcagcggctacatcggggtcgaggaagtgctgatgggcagcctgctccagggcggcatcggtggcagcatcgatgacgacctgttcgtcagggctgtcgacgacagggccgtcctgccgccgccggaggccatgagagacgagggcaccctccggcgtgagtggcgccgccaaaacaggttgaggctgcacgaggaggagcgctaggagagggagcggcgcgccgagatcatcgcggaggccgaggagttcaagaaatccttcctcgagaggcgcaagctcaactgccagaggaggcgcacacacaacagagacaaggagaaggtgttcatggcgaaccaggagaagttccacaaggaggcggaccagcagtactggagggcgatcgcggagctggtcccgcacgagatcccggggctggagaagcggggcgccgccgccaggaagaaggagctggagaagaagcccaacatcgtggtggtgcaggggcccaagccgggcaagcccaccgacctctcccggatgcgccaggccctcgcgaggctcaagcagaacccgccgccgcacatggtgccgacgcccccgccggcggccaaggaggaaaacaaggacggcgacaaggacgccaagaaggacggtggcaagggtccaaagcaggcggaggagaagaaagacggcaagcgggcagccggggagggcgagaagaaggcggcggccggtgtcggtgggaaggctgcgacaggtggtggcaatgctgctgccgccgctcccccggcggataaggcacctaaacaaccggcgacgaagaagtgactgtggtaatagcacctggacccgtccattgcgttgcagttcattctcttcttctagcggtgattttaacttcagctcagtttgtttctgtttcataatatatgttatgcataaactattccgagtttggtcattcaagaattgattaaaaaggttcatcttttggttcatcgagagttgtagagttcacttatatatttttcatctt

SEQ ID NO: 8278 - DNA, 621 bp, Triticum aestivum
  Clone ID: PAT_TA_8278
ctatctcgagtaccaagaattgaccttgcttcaatgatttcatgcgaaatatgaataatgttgcatgaaatcattgaagcaaggtcaattcttgagtattttaacacaggctgctcgccatcatgctgctcagttgagttttttcaggaaagggttgaagtatctagaggctctagaacctcatgtaaaagcagttgctgagaagcagcacattgattatcactcaaacccttcagagtctcttctcaaggagctacaagttgtagaggacatgaaggaccactgtgatcagaaaagagaggaatatgaaaccatgcggtcagcctataaagataaaggacgatcaaggcatcccaaaactgaaacattctccccagaacaattgcaagcgtcctatctcgagtaccaagaagatgcaacattattcatatttcgcttgaaatcattgaagcaaggtcaattcttgagtattttaacacaggctgctcgccatcatgctgctcagttgagttttttcaggaaagggttgaagtatctagaggctctagaacctcatgtaaaagcagttgctgagaagcagcacattgattatcacttcagtggactagatgatgacactga

SEQ ID NO: 8279 - DNA, 1073 bp, Triticum aestivum
  unsure (1)..(1073): unsure at all n locations
  Clone ID: PAT_TA_8279
aggaattcggacgaggcggggagctacntttggttagcacctctgagccctagtcctttagtttgagctctgtagctgcctctggcacgacctctgtgattacaactactccactgcctctgccatctatggcttcttctgctttggggtctagtaaagcattctcggtgtcaccaatatttggcagcagtccaatcacgactgctccatcgtcgtttggcatgccgaataatggttccgctatgtccattagcccctctagcgctgtattttcattcacttcggccacacctacaataccagatccaccatcctcaacaccactatttggtagcacgatcccaactattggcttcagtacaggaactggtcagatgactgtggggaataaccagactctttctgttacggccccaccatttggctttcagagcaattcactgtcaactccagctttcagcggctttcagagcaattcactgtcaactccagctttcagcacgccagccactcaattcgcttccacctcaaccacctcacctggcattttccagtttggccagcagagtcaagcttcgtcaggtgtcttttcaatgggcactgtccgcgacaatgacaagtctggcagaagaattgtcaaggtaaagagaaagaaataggctactctgttcaaagttgattgaggctcggaacttgcagtcaaattggcctgtggaccagtctacattgcaaattgatatggcttccagggctctggcgatcggcgagtgtagtgcagcacatttgttcacttgatatcgactgatctggcatgagattgcccgtggcgtttttggcacagtacctatggtggactctctctagtctatattgttgaactgaattttgttgcatgattttgttccctgatctaccatattacaaaaacatttgtatatcgaagtaatgttttgaggtatctgttcttgttactgcttagtcctatgatccttgcacctttcttcagtcgattcatgcatcgttcatgtagggaaacacaatttggtctgtgtaatagaagggtcagatntgcg

SEQ ID NO: 8280 - DNA, 720 bp, Triticum aestivum
  Clone ID: PAT_TA_8280
tggtttttttgctattgaaacagtactggggggcgctttttgcagagaactcaccaccctttacaactgctatgattattttggcatcagttatatcttcaactgtgtccaatgttttgttaggggagaaggcagcttttattgtcccgacagcttccactctatcttattctaggcatgctttgtggggtagtgagtgtggtattcaggcaactggttgtttggttcacaaagactttcgacttgataaggaaaaaatttggtctccctgctgtagtatgtccggctttaggtggtcttggagcaggtttaatagctctaagataccctggaatactgtattggggtttcaccaatgtagatgaaattctacataccggaaaaagtgcttcagctcctgggatttggctattagctcagttggctgctgcaaaagttgttgcgactgcactatgcaaaggttctggtcttgttggtggcctatatgccccaagcttgatgattggtgctgctgttggtgctgtttttgggggctcagcggcagaattaataaactctgccattccgggtaacactgctgttgcacaccctcaagcttatgcacttgtgggaatggctgctaccctagcctcagtttgttcagttccattgacatctggtctactactttttgaactgccaaaagattacagaattctacttcctctgttgggagctgtt

SEQ ID NO: 8281 - DNA, 1086 bp, Triticum aestivum
  unsure (1)..(1086): unsure at all n locations
  Clone ID: PAT_TA_8281
ttttttttttttttttgggttgggccgcgaacccctgattttactgacaataaaacaagtctgaactgcagtaatacgttcagacaatttgtttcatacagaatcacacaccacagcatctgtccatgaaggagaaaaagacttcttttccaacttacatacagatcaagcataagttatcacacagtcaatgaacacttaaacagccagcagcctaatcgctactgccttcggtggcatcaccggtgtccctgggcttcttcactcggaaattaggacgagtgtctggtcttttcctggcaacaggagggtcggaaggtatccggatcgttgatagcggcaccattatagggtcagactcgggcgccggccctctgatgctcacaagacagagtcccctgcgatcagcttgccttaaaacatttgctcgtctccacttctgaccgattctcacttcaacgggcacccatggtggctttacatagagggcagagaccaacctcctgggggcgtggcccatttcaggactcgctttcctaccgagcagatgcccgcggcgagggtggcccggcccccggacccggccccccgccaatccaccgcctgacgaacccgagcccgccggatgcgccctcgcgtcgcccggaacgcggcggcgccgcgccgcgtcctcgggggcaatactgacatctaacctatcagagttacaagcaaggagccaaggagatcagtcaaacaaacgttaaaccttgcagaacccgaaatctgagatagcttcagaaaagaaataggcagctctagtagtgcctgcataatggaaatttatcatagttaatccctgaaatctgagatagcttctccttaattaatccatgaggcaaatcttttgcctctgtttagaaaaaaaactgagatagcttcagaaaagcaataggcagctctaatagtgcctggctcaatggaaattcatcacagttaatccccgatatgataaatttggctaatgtatattttctaacttgtgtcccctcgtgnaagaattcggcagcccggggatccactatagagggccgtggagctcccact

SEQ ID NO: 8282 - DNA, 632 bp, Triticum aestivum
  Clone ID: PAT_TA_8282
tcggcacgaggcgcaaaacagcacccgttcttcccacagtctaatcccccaattcttcctcgcatcaagctgttcgatcccgccgattcgaggcgggctcttccggcctcgtgtaatttttgccgtttgtcgagggtcaggcggcgattagcgaaggcgctgggtgctcgtcgtctagggtttgctctccgtgaagctgtttgattgggtttcaggggttgcctgcatttctgttgattgggcttggaggtggtgagccaagatgcagactcgacagaaattcgctcgtgtcgatacccaggagctgaaatcccggatcgccaagaagctgggccatcagcgagccgagcagtacttcaacagcctcaagaaattcctgagctttaagctcaacaaggatgagtttgacaagatttgcttgagtgtattgggcaaggaaaatatcaagcttcataatttcctcatccggtcaatcctcagcaatgcttccttgtcccttggaccacctagtaagcagacggtgaccggtaactcacagactagcatggtgtccaatgggccactgggcaatggcgctctgccggcgaagatggggcggtctatcaccagcagggataggaagttcgctgata

SEQ ID NO: 8283 - DNA, 1179 bp, Triticum aestivum
  unsure (1)..(1179): unsure at all n locations
  Clone ID: PAT_TA_8283
tcggcacgaggcacaaaccctancccggcgaaccgagagacgatgccgctcagtaggaggagtagatgattacacggagcaggattccccgcaggcgaccggccaccatggctgccccgaggacgtttcgtcttcttcgccgacgctccccgtcattgcttcaatagcttccgagaagaagaagcagaggcgcgatcgcgagcagcagcccgcggcaagcctccccgacgacatcatcatcgaaatcctgtcgcgggtgcactacaagtcgctctgccgttttaagtgcgtgtccaagcagtggcttgacctttgctccggcctcgacacccacaagaggtcgccgcaggccctatccggcctctacttcttggacgaggaacaccaaggcctcagtttccatggtctgaccgggggtggcccccgtctggtcgatcccgatctctctttcttgcgcaagagctacgaaagcttagaggtcacacaatgctccagcagccttctcctttgcatgtgttggaagaactcgtactcaccgcggggtgaatgtgattatgtcgtgtgcaatccggcaaccgagaagtggactctgttgcctctgatagaatgcatggaccaagcggacgtcgaacgctatttgggtttcgacgcagtcaagccctctagcttcgttgtggttgcgcccttgacagatatttatcaactaatcagaaaagtagcgatctactcatcgggaactgaacgatggacttacgtggaaagtgggtgggcttctgatactatggtgggtgatcaagatgccatattcttgaatggcattgtgcatttgactacctgtggttcttcaatagtaacagtggacatagaaggaaagatttggagagaaattagagtgccacacttcgacgccattgggctatctcagggatgcttgcatgcttggcgtgtagatgttcttaatggttgccaactctctctttgggttcttcaggattatgacagcgagaactggactctaaagcacactgtcaatgttttggaattatttggaagtcattgtcgcaaagatcatgagtcctacatggtgttggccattcatccaaattgtaatccattttccttaccgatggggagatgacagtcttgtanatacggatatccggaaagnaatgttatcag

SEQ ID NO: 8284 - DNA, 937 bp, Triticum aestivum
  unsure (1)..(937): unsure at all n locations
  Clone ID: PAT_TA_8284
atggaaatccgatacacatcacaaaatttaagcaagttgatgttgttagaaatcgtccagaagaaggcaataaactgttatcagatgttccccttcttggggcaaacaacttagcacattctaacattgtctcgaaagttgaaagagctaatgaaaaattggatgtccctagcaaacctccggcagtgccaaataaggatctgaagaacgggtttcctttgaagttggagcctttagatggtcttattccctttgagcagaagatgatggacttgtcacaccaaaagcataaggatgctgcatatgatgactcgggttctgtttcaaaattaatgttcatgggggatattgaggccacacctagcttgcagctacaaaacggctccaagaaccgcaggagaaagcaatccaactctccgaggacaaccccgagggccacagattcgcccgccatgggcacacgccgcagactcggcgacgccacggtcaagggagagatcaagctagagcaaacgacgccgatagcgatggacaagcaagatccagactatgtcccagagaggaggcctgccgggaggccgaagaaggccaagtaacttgtcctggatcctgttcatgggctcgtcgtcgcctctgaaggtggcaagaaatctgcagtattggaggatgatgaactgacagggcgacaggactgccatggaatttcagcgaggactgatctgaatctctcgtagagacgtatgcctgctggacgggttatttagatgtttagagggagaagggaaaggacaacatgcctgccatgtcactagtagtatacccacagtggtttagtcgactaatgtgctagtacatgcatcatggcatagggtgcactgtaaatcataggaattcagttccattttattcatcttgcgnacactgcacggttcggcat

SEQ ID NO: 8285 - DNA, 837 bp, Triticum aestivum
  Clone ID: PAT_TA_8285
ttcggcacgaggcagccaatcaaccctaaggtgacgacaaaggctcatcttggagacgttgtcggcggctgttgatgtgagctccatcaccagatgcttgtgctgctcctggacgacaggcatgacgtagcggcgccgtgctcgccggccgggcgcggttgactgctccccctcctcacgtccaaacgaaaccactcctctctctccccttgacatgtctggcagatcaacaaagccgaggggttctcccaggtgccacgcgccgatgggcgaggacgacgacagcgtcgaagcccatcctccggtggcaaacacgacaaagtcgggggatttgggatgggcggagacggcggcgtggactgctggatctgggatgggaggagaccacggctgccttcatggggaagtttcctttctctttccctattttcagcgagggaggtgttatctggggaagtttctcacgtagattttgctgtcgccatagtgaaaatctctgacgtggcatagcccatcgatggccctgcatttcgcttcgtgcggtggaccaacccttgcgctcgctctccaatcaaccagcacggtgaaatcgacatggaacgagcgaggatgcgacattcatgcgactcttattgtgttccatatttttattcaaacagcacctaacttttatatagaacttcttttcattctcacatagtacttctagttttatttcataggcaaagcaaatgttcgatgtacgttggtttatatcagcggcagataggacctgagagaatatttatcttacctctagctccttgtgggttcgacactccatactaccacatccat

SEQ ID NO: 8286 - DNA, 852 bp, Triticum aestivum
  unsure (1)..(852): unsure at all n locations
  Clone ID: PAT_TA_8286
tcggcacgaggcttggttctgttactgttccagtcgcgtcccacgcgcccggcggaccagtttggtatacacttgacagctcttcaggtcaggtttgtctccatattaaggcaatcaaggttcatgagacttcctccagggctctaaacaacactgccgaggctgatgctcgtagaaggatttccttagacaaacaaggccctactgtagttcaccaaaagccaggtcatttgcagacaatttttgggctccctccagatgaggttgttgaacacagctattcatgtgcacttgagaggtcatttctataccacggtcgcatgtatctgtcttcatggcacatttgcttccattcaaacgtcttctctaagcagattaaggttatgctccctttgagagatattgatgagataagaagaagccagcatgcagttattaatccagcaattacgatatttcttcgaacgggagctggaggacatggagttcctcccttaggatgccctgatggaagggttaggtacaaatttgcatcgttttggaacagaaaccacacatttagagcattgcaacgagctgtgaagaacttccatgcaatgatagaggctgagaagcaggaacgtgctcaatctgcattgcgcgcactcagtagctcaagggagaatcacaaagtcccaacaaaatacattaccctcatcaaagacatgtaagataatgttgtgacaagttctgaacaagtgatggcgacaccgatgactttccaattaaaataggactgtatcaagggtcaactttgagcccttanaaaaaaaaaaaaaaaaaaaaaaaaaaaaaaaaaaaaaaaaaaaaaaa

SEQ ID NO: 8287 - DNA, 570 bp, Triticum aestivum
  Clone ID: PAT_TA_8287
ggtccggaattcccgggatcgacccacgcgtccgtgcttctactgattctcgtccaacacgagcatatattagaaataatatcttctttcacactgcataacacaactattatgtgagtacatctttgtacacaatattcttggtaaatgtcccaacaggaatagctatcatcctttagcggtacaacaagcactttaaagactatttttggatgtagctcgagataaagcaacatacaattgtccatgggaaaaaaggatcagggaggtagactccaacatttggtattgtttgccatgtgccttatttatgagtcataacaaagcatagtctgataggaaattgcttcctcttgaacccaataggtaatatttcatcatctgattggcacaacggtattcgaggtagaaagcctctctttccaggatgttgccccaacacgattttaacatttataaaattttctggaaccacatactaccaacattgttccgttacacaaaccattagttggatccaggtgccgtagcaggatcacgagacaattaacctccagcttgagcacatgc

SEQ ID NO: 8288 - DNA, 881 bp, Triticum aestivum
  unsure (1)..(881): unsure at all n locations
  Clone ID: PAT_TA_8288
ttcggcacgaggccgccgcctcctttcctcccccagtccccacctctgctcctcctcctcccctaatcacccccatcgcctcctccatctccacttttggtcggggcgccgcctcctctccacctcgtgctcccctcctcccactccgccacctccactccgctgaacccagccgctccgaggaccatcgatgaggcgaggagagcggtgccatcggacccgccgacccggagcccgcgccctcctgaccaagcaccgtacgcctcctcccccgtccccggccacgccggccgccatcgcatcatcgcacaaaatgcgagctcggctgatggattgcatactatttggctgagttgttttgttctaaagatacaatcgagctgaagacttcttttgtatggaaattcactatggaaaccgaaataatggatactgaatcaacagttacactgaagtttgatgatgtgtgagtcgcagaaactgaaagaataagcattagtcctctgagaagaggttgacattatatgccccttcagtgctcgcttttgtcttcccctgatgttcattgtctcaaggctactgggctaggagtagtcatatgcaagttctggctatcgcccctatcctctttcctgcagtctgtacttcctgctcaatttgcaatgcatgatgagagagatatggcgagggaggtggcgaggaagtcgttggtgatcttgaagaatggcaacacgccgagcgatgccccgctgcaccaactgcccaagacgccgagcgacgcgcagctgctgccgctgcccaagaagatgacaagcacaaatgatggtttgatctgtgtgtagttgcattgtttatttcttaatcagtggagatcattttna

SEQ ID NO: 8289 - DNA, 477 bp, Triticum aestivum
  Clone ID: PAT_TA_8289
ggcaaggggaggaagagtcatggccgtggtagattctgatgatcgcatgggctgttcctgaagccggttaattctgatgatcgcttatatttgagctaagatttttgcattgccgtggtaaatgttcactgtttctgctggggttactcttggtagctgtatagatgagggaggtggaggatggatgggtcatggatatcacaattttcgtcgagtgaaatagattcttgaattgttattatgtgagtacatttggtgtgattagtactagcaagtttactgtaatgtgggattggattcatatatattctactagaagattttttatctgcgaaacacaatgtttctgcattttgtattcatatgcttgatgctggatgtatcatggtccatgaatgtcctatatatctactctagctttgatgcgaatgtttgcgcatttgttctcgtgaaagcttaatttactgaaaaaaaaaa

SEQ ID NO: 8290 - DNA, 755 bp, Triticum aestivum
  Clone ID: PAT_TA_8290
accccccaccaggcaccccggacccccccaacccctgctcctcccccgcctcgccgttgacgcctccccctctggtgcctcgcccgcgccggcattgggcgcgtcccggagaaggtctccccgtccgtgttggttgtgactctactcaattattgttcttgggccggccccgtcagatacaggagccttcctcttagcgatatcaaccgggtcttctcgcttgctgagttgggtgcgtttcatgcacgtttgcagtgacgaaaagatccccgttttttacattgataagagggttggttgagtgttctctgtttcattcttcagtccggcactctacttctgttgttggtagtttgtagtttgacaacaagactgacaggaagtcttgtcctgtttatggatttgaagacaagccacaactcccctgtttttgttgatcctctcccttcactagccttgcctatgacgtacacaacacctactagcttcccatcttctgggctttacctgaacaccccaaagaagaaacctcttcccagcaagatcgaagaggttcgtgctgccggatggcttgatctgatgctggcctcctcacctcctcgtaagaggcaaagcaaggacttcttaccccatgatgttcaagctgatgatcttgatttgcggtatcgtaattggatggtgaattatccttctgcgttaggctccttcgaggcaattactgagcttgcccgcgggaaaaaattggcattgtttct

SEQ ID NO: 8291 - DNA, 855 bp, Triticum aestivum
  unsure (1)..(855): unsure at all n locations
  Clone ID: PAT_TA_8291
ttccttgcagtgagnggctggtctgacgctgttgttgataatnatccatacctattctggacatggacgaagtacacaccatgtacacacagctttttttgatccgttgcatatcaaagcttcattcagacgatggactgtcttgctctacttcgaaatcaaaacaggggaaaaacaggcggctgatgcagaacaagggaaggagtagcagctatctgctgtttcagttgtttatgtgcgctgaagattgttcatacccgtaccctgaagaaagaagacacaagatagattctagatatacctggaatatgttcatccgggttcagttaataagtgcattagtcaacattgtggtgcaatgacagaatctgttgtccacaacttcacctgccatatccttaagggtcttgatttcctacagagccaaaaaattatgcatagatctggaaataagtttaaaggaaagatttagaaggtgaaggagctgataaagagcatgctaaattctcactgtcttaatcatttttcgtgtacaataccattcatgtataggtttggagctttgtgccgacaagaattctctgattggcatcatttgcagtaactgtggtgatccaggacgctttcaagattacaagttcagtagtggcaacttgaacttatgtaagaataaacagaatgatttttcattctgaagagtttcctaactgttgactttaagccttcatagttacatcgtgggattatgaataagatggtgctaattatactttgagtgaatttctggtgtgtattattcagactggcccttgaactaaataaagaaaagtcaaagataaaaaaaaaaaaaaaaaa

SEQ ID NO: 8292 - DNA, 903 bp, Triticum aestivum
  Clone ID: PAT_TA_8292
ttgatgaagacccctgattcctattcggaatgggtgcgctctaagtcaagcatcactcaggtgatccctggtggatggaaggccacaacatggagcatgccaataccagttgggtcattcactgattggcagcttgactgtcgagttgaagccaatgatgttagcatggataccagcaacccgcatcagtgcaacctgctgtctaggctgagcggcagcaacaccgtgccaatattgccgaaacttctgatggcataccctactatcagcatagatgatgatattgtctactttatttatactaccaaacccaggcacatgggaaaattggagttggtgattgctgtcgatgtgaggaacaaagccctccgaggagtagccgagcttgatgcccagaagaagttcattagcgtgcctgccttttgcacctgtaagatctgcaaatatccgaggaagaatacaggcacagcagtagagcttaaacgaactgaaaaagaagctgttaagcgaactgacaaagatcttggaactggtaaaccaactagggtgcatgtgaaggaaccaacccgcacaaggccgcctgtgaataagagggtattgaagaccttggagttgctacaagcgagatcctggagctgcccaaggagacttggtgaacagacgcccgatgctgaaattgctatcaagtactccctccgttctaaaatagatgacctaactttatactaactttgtactaaagttaatataaagttgagtcatctatattggaacggagggagtagctcgtttaactgatttatgaggattgtgccaaaaataattatcagacatgggtacttgatttatgtggaacttgtataggctcgtcctcaccagagcttaccgtgtccgtattgttat

SEQ ID NO: 8293 - DNA, 626 bp, Triticum aestivum
  unsure (1)..(626): unsure at all n locations
  Clone ID: PAT_TA_8293
gcacgaggcagggtttcaaatcacactgctgccttctccccccaccatggctgccatgtggtctccaatcatcgctctcctcttgctcctgctcccactcgtgccgtcctcctcctccgccatcacgctcccgctccatggcaacgtctatcctgtcggccactactatgttacgttgcagattggtaaacccctgaagcactacttcttggacatccacaccggaagcaacctcacctggctggagtgtcagcacccgcacctcggctgccagcactgcacccaggggcataaacactcatattactcgccaaaacttagcaacttgaaggtgggatgtcaacacatgtactgtgttgcactgcggaaagacctgccaggtattaaccctcaatgccccatcaaggagccacatcaatgccactacaaaattcgatacctcgatgggacgacagaaggtgttctctcccttgacaagatctctgtcgggggaaaggaaaacaatattgcgttaggatgtggatacaaccagcacccacggaaaccatcgcccgtacatggcatccttgcccttgggatgggaacggtgggttttgtcccgcaactcaagttgcagaannnnatnn

SEQ ID NO: 8294 - DNA, 1070 bp, Triticum aestivum
  unsure (1)..(1070): unsure at all n locations
  Clone ID: PAT_TA_8294
gcacgaggatcatgtcatgtcgctgcaagtgtctcgtgctcataagacgaggacaattgatggtacattgcagagcacagggagagccgcaagcgcaaccacttgttgtcgccacatttcggagagacgattcactggccatcccataagcacattgatgtttacagtcagacacaaaacttgcatcacaaaacatacggaggaagagcgtacggaaaaatggtgtggtttatcatacgaggtgacaatgttggacggctgtgaagtgtttgagtgagaaggcggtcagtttgcacacgtggggctgcatgtcttgaaggtcaagatgatatgcagaatttattccttttggatctgtgttgtcggcgggagcttcattcaggccactagtcaagcaacaagcaccgggaggactacagtgatgtgatgaaggactgggagggcttggtcatattctctgcatgtgctaacttgaagtggtgcgaggaggttttgaagaagccaaatcgtgtgctgttctaagtcgaattaccttacttgctgatcgctatactgggtctttgctgcatgaaactgatttttctataatatggcagtcaaatcagagacatcaaggacatcatgcctgacacaataatgaagtagcccatgaagttgctagctgtgcaaaggagtcgaggagatatgtatctccaagcagggcttgccagagaggagaacatgtcaggtgataccgtctttctggtgatacaatgctcggatgcatcctggactgctggaccactagattgtgttcgaatggatgtgatgtgatgcacagcttgatgaacagttcctccaccatgaaatatacagaacacaccctggatcatgttcttcattgagagtgaggccctttcctactactagtataaccagcgtcaagtttcattggttgtcaaaaataagggctctgtttcactttgtgaagacactcaaaccaaatattcctcttgctatttttccatctccatatgaaactanaacatattttatttttcctaggctaaagttnaacaagataaatccac

SEQ ID NO: 8295 - DNA, 291 bp, Triticum aestivum
  unsure (1)..(291): unsure at all n locations
  Clone ID: PAT_TA_8295
attcggcacgaggattcattctgctacaggtgcatagctcagtggggtcaagattgtgtgtggcgagcaagcatgaagaacgtttgtcctctgtgagatgcctccaatagtcaattgcaatagcagctggattgtccagaactattttacacacatttggtttgcccggttccaactttttaccgtncttgcaactcaaggtgcgagagaacacgtgcccttnccatgttttatcccgttaaatcctgtagcgagaaaggcattgcaagtctacttggtttaaaaaaaaaa

SEQ ID NO: 8296 - DNA, 1120 bp, Triticum aestivum
  unsure (1)..(1120): unsure at all n locations
  Clone ID: PAT_TA_8296
ggacggctgctgctagaaatgctgcacagaggaactgctattaccttctccaaccaggggaggcaaacactcctttcctcgctttcatgagaagcctcggcaacgacatcatgaccaacgaaccgccgccaggtcagaatcaaccggtggttgatcctcccgcgcggtttattccgcccgcccagcagggtctgtttcgcgtaatcaacatggtactcgatattatccaatcaggttcttgcttcgagatcctgcatgagaggaatatcacattcaccgaatacttcaacattccgaagctcattgccaataacctcaaggacagttctgccaagggcacgaagagcaatctgacggctctcgcagagatgcttgatcgcgttgtagcaagagcaagctacatatatgacaaaaatagcagagctaacccggaaattcacacactttgattcagcacattaaagggctatcggcaaggtgattcattctttatgacgaggtaccatatgtgtactctgccactgccccaatagatgttttatgtacgttgccatgtatgactacataatggacatcttgaggaacatggatccggaagcatttcattatgttatcagtggtctgcggtatcctgaggactggcacatccagtgtcaacataatacataccttgcattctactacagaaggggaggatatgacccggacgcaacacttattcctgagacaacagacccccggatcgtacctctgcgcttccaccggaatggtccatcgcatgccctggaggatgcggctgacccgattgcagatcatgggatgaggttaacaaggcgagatttgggccatgttttgtatttccagttcactcacttgatgatttcaatggagacaagcctccacttcctgggagcgctctctcatctagatgttcaggatctttttccttttcatgtgaggaagaactaggtgtcagcagctnctagctagtgtacagttgtatatttgttgcctagatgacatggaaagcacagtaactcactgcctttgtataacacaaatgattncttnctttggtttggttttgcggncncaaaccaaacggnctgtnccgtatagt

SEQ ID NO: 8297 - DNA, 807 bp, Triticum aestivum
  Clone ID: PAT_TA_8297
ggttttgaatttaactctatgcaggatctaaactccctctcctttgacaggactggctggcgaaggccgagcagattatctgtccggccccattgccagaggacccagcggatgcccgcctaacggggctgctggctccggcaccccacgtggtgccggagaagaaggccaagaagaaggccacggggactcggaagagttcccgttttcaggtgctatcggatgacgactccgaggccgactcctctcaccaaggtgaggaggagaagaaaaaggcctctcccccagtgggggagagaagaaaaggaaggcctccccaacgagggaggccgaagggtgcaagaagggaaaaactcttcccccggactgctctgccaacgccagtgacgacgacaaggactggcctccaagggccaagcccctggcgagatcgtgagtatccggactcccgaataacttcatggtttttctttttgccacataatgtctttctaatgccgcatacaaccctgcagtccgcccaaggatgatcttcccgcttcgtcgagcgggtccttaggtgcgtcggatatggattcttttccgactgcctccaccccccgtgatgcggacgatgccgaggtgggatcccgggaagggacccaccaggaggaggaggccccggaggtgtcgcaggacaacctcccggactttgcaccggactcggccccggagcccatagtggctctggagtccggcgggcgaccccttcgtaagaagggcaagaccgtgacgccggcaggctccgtccaactggaggggccggat

SEQ ID NO: 8298 - DNA, 815 bp, Triticum aestivum
  Clone ID: PAT_TA_8298
gcacccgttttctgctgaaaaaaaatgaacgtgagtcaacaaacctcgttctccgtctcgctcccaaacgaacccacgcgcaatcttttcccgatctgctcgctgccacaatctcgccaccgaatctggcatcgcccaccccctcctcttccaatcctgtaagttgctggtgagattggcattcgaaatccgtcacccatcgatggcgctttgtgccctccgcaacctgtcacttgcgacggcccgagcccgctgaagcgggcgaccaaaggattcgaagcagcttcaccctcgaccgtagaggagggtgtgggcctgagctcctggcatcccagggggcgccgccgttgggctcttatcgtcaggccgacgtggcgccgatctggtcaccagccacggcccaaccctctccctctcagttcgtgctccccctatttttatcttcccctgttttgttctgtaggtttttgaggtcgggtgcgggcatgcgatagctcgcgactcagagagaaagctttggcgataaagactagacaacttttttctcctggcatcacgtcctccggccatccatggagttttcgggcaaagtcttggcctccaggttcgtctacacatccatgtaacacgaagtatgtaataagcatagttgagaagaagggtatacacaggatcagttttgactaaattctcaaaaatataacactgattgttcagatttttttttcaagcattcatcttttggctaagtagaagatactgtagtagagatgaaggaggtcaattatgatattaccaacagttacagatacttg

SEQ ID NO: 8299 - DNA, 609 bp, Triticum aestivum
  Clone ID: PAT_TA_8299
ccacgcgtccgctctcctccgcgcggtaccaccgcccctctgctccggcagtgactcaactggacggccgccgcctcccctgcgttgacagcgcctccctcctgtgtgcgtgaagccgcctaggccgacgtctccctgcgtgcgtggcatcgtccaggccggcgtctccctcccgcgcgtggcgtcccggggggccatggccttcgcgtgcgcatgccatgtgcgccgcctcctcctcctccaccccggcgccggagctccggcgagatccttctacgcccagccctaccaagccaaggtgggcgtggtggagttcttgaacggcgtcgggaagggggtggagacgcacgccgccaagttggaggaggctgtaggcggcgatctccagaggctgctcgagacccgcacgctccggctcaagaagctcggcgtcccctgcaagcatagaaagttgattttgagtttcgctcacaagtaccgtcttggtctttggaagcccccggcagaagccaggaaggtgcaataaaagttggtttgtttttgaagtgtcgactagggggaactatgtgctgttatttggctgaagcatgttttggacattgataactg

SEQ ID NO: 8300 - DNA, 626 bp, Triticum aestivum
  Clone ID: PAT_TA_8300
aaaaaaaaaggatccagccctcagtctcccctatggcggccttggcctgtgcatctaatgtgcgccgcctcctcctccaccccggcgccggagctccggcgagatccttctactcccagccctaccaagccaaggtaggcgtggtggagttcttgaatggggtcggcaagggggtggagacgcacgccgcgaagctggaggaggccgtaggaggcgatctctagaggctgctcgagacccgcacgctacggctcaagaaactcggcgtcccctgcaagcataggaagttgattttgagttttgcccacaagtaccgccttggtctttggaagccccgggcagaagccaggaaagtgcagtaaagttgatttgttttcaaagtgtccacttggagaaattatgtgctgttattgggccgaagcatgcttggggcatcgaatagttgtgttatcagttattggttggagtaatttggatgccgcggttagaatgttatctgataactgataaactctcatgcacatccaaccaataactggcccacttgatggtactcttttgtaggatttctctttgttaggtttgggcatcatcactcttgttgttctgaagtcattcggctcgcg

SEQ ID NO: 8301 - DNA, 808 bp, Triticum aestivum
  Clone ID: PAT_TA_8301
aggaggtcgtacgacacgccaccccccgtctcccgtccgcgcggtaggcgccgctccctattccaccacggctctcctccgcccgctaccaccgcccctctgctcccacggcggcaccctcccctgcgtggtggcgccaaggacggcggctccctccggggtgtggagccgcctcgcggacggcgccgccccgcgtgcggggcagcgccagggccggcttgtcgctccccgcgcgcgggtgccccggggcccctggccttggcgcgagcatctcatgtgcgccggctcctcctccaccccggcgccggatctccggcaagatccttctacggccaggaatgacgacccaaggtgggcgtagtggagtgcttgaacggtgacaggatgggggtggggacgctcgccgcaaattttgtgatgtctgtacgctgcggcctaaggaggctggtggcgaccgaaacgctggggatcatgaagctcggcgtcgcctacaaggaaagaaacttgtattttgatttttgctcacaagtacagccttggtcattggaagcccccaacaggagcaagggatgggcaataaaagttggtttgtttttgaagtgtctactccggaaaactatttaatgttactgggctgaatcatgtttgcgacatcgaaaaattgttctataatgtcgtctaagcaatcctgttgttcctactatccatcttataactttcgctgttggcgagtgtaaaaaaaattgctttgttgcaggaaccatcatcactctattggactaaacagcgtggtctctcgtccgaatcg

SEQ ID NO: 8302 - DNA, 547 bp, Triticum aestivum
  Clone ID: PAT_TA_8302
gccgcagcagcagccgctcgccgccccgccgtcatcatgaccgccgcgacctcccaacacggatctcgatccacttcttgcaccaccgcgcgcctcgtgccgaatcggcacgagggaactgagctgccgggggaatcctggaaggttctccctgaccatttcgggtattcttctcgtccaccatcgtctcatcaaatcatccatccattgttgtcgctgctgctgctgctgctccagttaaggttcccttttactctcccgttcctgtgatgttcgttgctacttcctgttacggccttgtaatagcaaaagctgtgtgcacaaaaaggattttgtaccgcaagattggtcgaatatagacacgatatccattctgccattgcctcccgctgctgcaaacgaaatcccgttaagaaatttcatctgtacatgtagcacagaagcagtgccatcatatgatgatatgctccccatcttgccagggacatgttccatttattttatctgggtttgcttattaaaaaaaaaaaaaaaaaaaaaaaaaaaa

SEQ ID NO: 8303 - DNA, 513 bp, Triticum aestivum
  unsure (1)..(513): unsure at all n locations
  Clone ID: PAT_TA_8303
gcggagacggagccggcggaggtgccggaggacccgagcatcacgctcgcccggaagatcagttcgcagacacggcaaaatcgacgcgtcaaagcaaaggccgcaaaggaggacaatctcaagaagcggttgcccgccggtgggcctggtggtggcgatgggcgtggcagtcggtgtgcctgtggcggctgctgccagatgagcacgccgacagtacagacagcgtcagtgtggctgaggcggtcgttcctttatataaggtgtatttgttttttgataaaaatccacaatgtaaggtgcgtttgttctaatttctcgtaattccgatcctagccctcaagaaaaaggaaagtatttctccactgattgcatgtatctcttncttgtagagaaagaaaaggaaactatctnctnctncccgattgcgtatatttncttncctttcctaacctaaatgnattacttgccgctaatctatgaattagacaagggtaattttgtccaaaaaaaaaa

SEQ ID NO: 8304 - DNA, 765 bp, Triticum aestivum
  Clone ID: PAT_TA_8304
attcggacgaggctcgcccggcccatgcgccccaaaccctagctcgccgccccgcgtcgtctcgtccggtaccggcggcgccatgcgggcctcgatggaggcctccgcggccgcggcgcgcagatccgcggcgccggaccccccgggcgcggccaagaagcagcggctgctcgcgccgccgcgggaccccgcacccgccgccgccgcggtccgcggccgcgcggccagccggagcggcgccgcccccgccccggcggggcagcaggcgcaggtggacgagctggtggcgcagtaccggacggcgctcggggagctcaccttcaactccaagcccatcatcaccaacctcaccatcatcgccggcgagaacctccacgccgcccgctccatcgccgccctcgtctgcgccaacatcctcgaggtgccccgccttctgctgcccccgcccctccccccgcccgtctccatggtcaggaagctcggaagcgtggctgtccctctggttgcggctcgatgaccggaggggtgctgcgtggccggttgtcaggctcatccccctgctcttacccgctgggctcgcctggtcggggctgggtgtcgtggctcttctccggcgtcgctccccacgtgtgtgaaggggcgcgggtttctttcgtctgctgttggttctccgggcgctccaccgccgcgggccgtgtctccatcccagcgcccgtcccactgcgctctgccaatcccattatatttggaagcaagacagcagct

SEQ ID NO: 8305 - DNA, 736 bp, Triticum aestivum
  unsure (1)..(736): unsure at all n locations
  Clone ID: PAT_TA_8305
cccacgcgtccgaaaaagtgcccgaaccaaacaccccaagcaggcagcagcaatggcggccgagcccgagatctgcgtgctctccaatggcaggatcacggcgaacatcgccagctggggcgccactatcacctccctcctcgtccccgacgcgcaaggggatctcgcggatgtcgttcttgggttcgacacactggagccgtacttgaaaggcatggcgccttattttggttgcatagttggctgagttgcaaataggatcaagacgggaagtttgatctgaacggagttgagtattcattgcctatcaacaatgtgccgaacagcttcatggtggattgaaaggggttgacaagggtgtgggggaaggtgtaaaacgtaaagatgggcgagtacccatcaataacctttcaatatgagagcaaagatggcgaaagaaggttaccctggcgatgtaacccgtcagaacgatgtattctctttccggaggcgtaccactctaagacttgacatggaagctataccagctaacaaagccactccaatcagcttggcacagcatacttactggaaccttgcaggccacaactctggcncatcnttggatcatttcgatccagatctgggcanagcacatcactccagtcaatgaaaacacgattcctaccggagaaatattgcccgtccaggacacacctttttgatttcaccacggagcacaagattggagaccgca

SEQ ID NO: 8306 - DNA, 1357 bp, Triticum aestivum
  Clone ID: PAT_TA_8306
cccgggtccgctgtcctagacacgcggtgccaagtaccctcagccagcacagcttagcaggtttatccagcgaagctagcaggcagcagcaatggcggccgagcccgagatctgcgtgctctccaatggcaggatcacggcgaacatcgccagctggggcgccaccatcacctccctcctcgtccccgacgcgcaaggggatctcgcggatgtcgttcttgggttcgacacactggagccgtacttgaaaggcatggcaccttattttggttgcatagttggccgagttgcaaataggatcaagaatgggaagtttgatctgaacggagtcgagtattcattgcctatcaacaatgggccgaacagccttcatggtggattgaaggggtttgacaaggttgtgtgggatgttgtagagcgtaaagatggcgagtacccatcaataacctttcaatatgagagcaaagatggcgaagaaggttaccctggcgatgtaaccgtccgagcaacgtattctcttccggaggccaccactctaagacttgatatggaagctataccagctaacaaagccactcctatcagcttggcacagcatacttactggaaccttgcaggccacaactctggcagcatcttggatcattcgatccagatctgggcaaaacacgtcactccagtcaatgaaaacacgattcctaccggagaaataatgcccgtccaggacacgccttttgatttcaccacggagcacaagattggagaccgcatcagcgatgttcctggagggtacgaccataactatgtgttggactcgggtgatgagaagaatggcttgaagcacgcagccaagctgaaggacccatcgagctcacgaactctggacctctggaccgatgcgcctggcatgcagttctatactgcaaactatgtgaatggcatcacgggcaaaggtggagctgtttacgggaagcatgccggagtatgcttggaaacccaggggttccccaatgccatcaaccagcccaatttcccgtctgtggtggtgcagcctggtgcgaagtataagcacgccatgttgtttgagttctcggcatgattagatatgctgccggcagcttaaatggctgcaactgcaatagttatagagtggaataaaacgaccagaagaaaaaaagtcaagttgtagtaccaaacaaaaataaaaagggtgtagtgaccagaactgagtgacatgatctcattcagaaaatcatgttcaagggtgtcttatattttggttgtgtatactgtgactgagaagaattgttcacatgcttccaaaatattgaaggtcgtttgcttgatttgcatgctg

SEQ ID NO: 8307 - DNA, 1142 bp, Triticum aestivum
  Clone ID: PAT_TA_8307
caggattcggcacgagattcgatcgctgtccgtccggcagtttcttgatttgacgcaggccagatcgctttctggtgttttcttttccccggagtggttgaggcggtccccgtcctcggtcggagacggacatggcggcggcgaacggaggcggcgcggcgctgttcagcgaggaggaactccgggatgtgagcgggctgcgcctgcgcgagggcttcgtggagatgatgtgcggatgcaccagccgccgctacggcgacgccgtcggccgcctcttaatctacccgtccggcgagctggagattagctgcgactgcacgcccggctgccgcgaagaaaagctgactccttcagcgtttgagaagcactctggaagggagactgcaggaaagtggaggaacaccgtgtgggtcatgattgatggagaaaaggttccactgggaaagacagaatttctcaaatactacaacctgtcaaacaagtctgttaatggctcgaacagaagtcggaatggacgtccattgcaccgtgatgagttcatccgctgtacaagatgtgacaaggagaggaggtttcgtcttcggaccaaagaagagtgccgtatttaccatgatgctcttgcaaaacctaaccggacatgtgcaaatttgacggctgatagcgtcacctgcgatgacgacgaggagcgagggagccgcaaggtgctcaagggctgctcccgcgcggcgtcgtgcgcgggctgcgagaagtgcgtgtgcttcgggtgcgagatgtgccgcttcaccgactgcggatgccagacctgcgtcgacttctaccgcaactccaaggagtaggatgatcatcccagccgccattcgttccattgcattcgttaagaacacctaagaaggccccacccccctccctctcgcccatggcggtccggaggggggcaggcatcgtagctatttcctccctggcacatcaccggggagggaagggaccctattccgattccgaaaacattgttctgttgtttcgttcgttcgtccgtgtcttcgctttgcttccgtttccataagacccacccggggaggcaaagtcggtagtagtacctgttgttaccgcataccgttcaccaactgtttacattgaaatgc

SEQ ID NO: 8308 - DNA, 680 bp, Triticum aestivum
  Clone ID: PAT_TA_8308
cttatctctttctctttcccgcacaccacacacgctcccgccgccgccgccccctgacttgccggccgatttgctcgcgccgccgcctttcccaccagcgatggcgcctccctcagcctccttctagcatgtggtgctccccccacgttccaagccgaaggtgcctcctgaagataggacaagaaaagagggaggcagatccaccgcgaccaagagcaggtcaggcggcggccatggcacgcccagatccgccagcgccatcgtcgtcgagcacctctgctccgagcgtcgggtccacctcgggctccatctacacaaccacgcactcgcaagccgctgccatggaaggttctctatgtgcttgcttcttcccttcccaagacgctgttgctccgacgccatggataatgtgcaggacagagccgccatatggtgtgcgcggtgattctttttccactctgatgccttccgcgctacgtgtccgatggacccgttttttcttccgctccgtcatggcttatggtaagccaccggtgctctcgctcgctcccctgctcgatggcgcctcggccctcgggccttgctggtttttagttgccgccccgatgcttattatcctgctgcggcttggagttgtgaaaagatctagaaattgatggttgtttgaattttattttgtt

SEQ ID NO: 8309 - DNA, 564 bp, Triticum aestivum
  unsure (1)..(564): unsure at all n locations
  Clone ID: PAT_TA_8309
cggccgcgtggggngacggcggtcgtagacggcacgaagttgagccgtggctcaactcgtggggctccttcctgatctgtggctcaactcgtggggctccttcctgatccgtggctcaggattcgtgatactgtcgtctcctaccttaccctgctggattcagtgggtgggagttgcggagacgccgccgccgcccgattcaggcgaatccattgccggctatggaattccttctgcagctgattagtactcctagaagatcccctttggttgaggaggtgtatgggagtcatctctccatggatctgctggataacagacggcgacgtctttcaggaaaatggaagagccgccaccggcatcctttagggcagacgtgcggaactatcagaaacaggcgggcgtggatggacgacgggagagctcggcctagttgtctgcaaaatggatgcaccctggtggtcaaagaggttcgctagaaaaccagaaatctaacattttgcctgtgtctgcttcgttgataatgctgggatcaaagtaatctgggatgagtagatctttgac

SEQ ID NO: 8310 - DNA, 744 bp, Triticum aestivum
  Clone ID: PAT_TA_8310
tcggcacgaggaacggcggttgtagacggcacgaagttgagccgtggctcaactcgtggggctccttcctgatctgtggctcaactcgtggggctccttcctgatccgtggctcaggattcgtgatactgtcgtctcctaccttaccctgctggattcagtgggtgggagttgcggagacgccgccgccgcccgattcaggcgaatccattgccggctatggaattccttctgcagctgattagtactcctagaagatcccctttggttgaggaggtgtatgggagtcatctctccatggatctgctggataacagacggcgacgtctttcaggaaaatggaagagccgccaccggcatcctttagggcagacgtgcggaactatcagaaacaggcgggcgtggatggacgacgggagagctcggcctagttgtctgcaaaatggatgcaccctggtggtcaaagagaaaatcaataccaaacggagtccaaacgcagcgaaactttttggagattttttctggaccagaaaacacctgttgggccaaagaagtatcagagggggggctccgaggggagcacaacccaccaggggcgcctgggcccaggcacgcccaggtgggttgtcccacttcgatggccttccacaccgcctctttgctctataaataccctaatatatctaacattttgcctgtgtctgcttcgttgataatgctgggatcaaagtaatctgggatgagt

SEQ ID NO: 8311 - DNA, 415 bp, Triticum aestivum
  Clone ID: PAT_TA_8311
ggtctgctggggaggatcaatggatcaggatcgcttctgcttcccgctgcagtattcaatcctgacatgtcctaccctgtttaaagctgtgcccgggtgcccgccgctcatgatgccgcggacggacaagagtcaatctgaagtactgttggcgcacatgcatcatggcgccgatggcagcttgagctggcacgggctcgggcagtccatgccttagagcatccctagtggctcgtctaaatttgatagtctatatttacatatacacaatggtgtaaaaagattttcttttagacaacctaagtttttcagcggattgtctacatacatgatgtctatattctctttcatatattttaatagtatcttatagcagctatattttctaaaaatcttatgttggtcaaaaaaaaaa

SEQ ID NO: 8312 - DNA, 424 bp, Triticum aestivum
  Clone ID: PAT_TA_8312
cacgagggagagaactagtctcgagttttttggtttctctgttctttccttggaagaacacaggagggaggagcaggcatggggaaggtgagcatgcagcagcttgcgctagtggccctggtgctggcaagcctcgtgttgtcggcccaggaggccgacggggctcggcccgagtcgaccggcggcgtcatcagctaccgtgctctcgtgcgcgggaatagcgccaacacctccgacgccaacgtccggccttctgcggtggccaacccttacacgcgcggctgcagcaagatcaaccgttgccgcggttgatgcgtgcctgcgtgtgtatctcttgttttgctcgaacgttcgaacgttgatcccgtgtgcaagccaggagtatgatacaacacgctcgcttctttcatcaataaaaaaaaaa

SEQ ID NO: 8313 - DNA, 1443 bp, Triticum aestivum
  unsure (1)..(1443): unsure at all n locations
  Clone ID: PAT_TA_8313
gcgccacgcccctccgtctgaccgcgcagctccgtccctccgccccgcctcatacatcccccccccccctacccggccagctgcacctaccgccaccccccccctccccgtgtgcgccagccccaacccaaatccactcgcctcaacgcccgtgtgcccccgcgctagtccctccacaaccccactcccctcaccgcccccctcgcccttcattcgttcatcccgcacctgcttccgtcccctctcccccgtgtggcgggagagagagtccgcggtgagctaggtccgctctggcgacaggtcccggcgcggccggcttgggtgtgcctgcttcaagcttttgcggtgtcggagctcggcctgccggcccgatcctcaatagatgccgtgcggtgcagcgaggatgcgccgggcccggagcaagaaggcggggatagcggatgatctggctcccttggcttccgttgtctcatgaatgactctggaggttgagctatcggggtcctctgttgccgcgatagactgataatgctgaggcagagctctagtaggaaccacagatcgaaaggtctgaagctaaagaaagctcttcagataagtcttttggttcttgtgtctgtttggttgctctaccaagtaaagcattcgtacgagaagaagacggcatataatgaaaatgatgccaccagtcacgaagccggtgatgagcataaagatggtcagagccaggtgggcgtcataaaattgggcaggaaagacctgccagcaaaggaggccgactcgtcaacactggatgaacgggtcgaggacgaagagaatgaggagatggagcaagtaatgaagcgtgatgagcatgatgatgaccccattgatgagccagacctggacaaggatgaggatcttcctgagcctggggagcactcggctaacaaggatgaagggtcagatggcagggctgtgtttgaggacgaagagcggaaggagcgctctcaggaggaccaagagaagagtttccatgatgatgatgtatccagtgctgtaacacacgaccctccgtcatccgcagcaagatgtgctgacccatccatgcccaagagaagatcttattcctgggattgatgcttcaactgcggttcctccatgaaaaccaggaacctgagcacaaggaggaggaagatcgcccaaggccagggagaagatttctggnggtacatgtttcaattcaattggccacgatcccaatcanancctccccccgacnanaactgaaacatggtagtntttttaaggaccacaattntcaaaagggatanatcccgggncctggantnaaggnacaatgggtctcaacaatgctctccaaccaaatatanacccaaatgtccggaacaaatgtcacncangatttgcacacagctgtaagaaggatcacccttaagcaat

SEQ ID NO: 8314 - DNA, 1076 bp, Triticum aestivum
  Clone ID: PAT_TA_8314
cagcttacatcagctaccaccagtgccttagacactcttgatcttgaacaaccataggaagcaatggcgtgctccaaaaccatagcttgcctgttcactatgctactccttgctccggccatcatggccgcggaccctgaccctctccaggacttctgtgtggccgacctcgacgacaacgcagtccgggtgaacggatacccgtgcataccccagtcggaagccggcgacgacttcctcttctcatccaagctggccaaggctggcaacacgtcgaccccaaacggctcgaccgtgacggagctcgacgtggccgagtggcccggaacgaacacgttgggcgtgtctatgaaccgcgtggacttcgcactggggggcaccaacccgccgcacatccatccccgtgccaccgagatcggcatcgtgatgaaaggtgagctccttgttggaatccttggcagccttgagtccgggaacaagctctactccagggtggtgcgcgctggggagacgttcctcatcccacgcggcctcatgcacttccagttcaacgttggtaagaccgaggcctccatggtcgtctccttcaacagccagaaccccggcatcgtcttcgtgccactcatgctcttcggctccaatccacccatcccaacgccggtgctcaccaaggcgctccgggtggaggccggggtcgtggaactactcaagtccaagttcgccgctgggttttaattttctgggtgccttccctgatttgatatatgcatgctagcaaaaatttaataattcttcagcaaaagacatgtactcaagctccgggttaatctcgcatgcaattgtaataagattgaataagttagccccatggttaagccttcagatccaatatggggaattgtatgtacttctttttattgtcgtctttgttcttttcattaaactgaatatataattagcattttcatataaaaaaaaaaaaaaaaaaaaaaaggagttccccggcgagaacacgcaaggcatctccatgaaaccggtggacttcgcgcccgggggcaccaacccggcggacattc

SEQ ID NO: 8315 - DNA, 850 bp, Triticum aestivum
  Clone ID: PAT_TA_8315
ggcgacctggcctccgttatgcgaagccttgaggaggagatatgcgccgacgacctgacgccgccgcagccagagctggggttcctgctcgaggcctcggacgacgagctcggcctgccaccggccgccagggcgtcctcctcgtcggacgacgccggaggctgggagccggaggagcccgccggcgtgttcggagagcagatctggggcttcgaggacgagattgacggcacctacgctttcggcggcgttgcctactcaccggaggccgccgcggcgaccgctgcggccactgccgagtggggcgacgacggcttcgacgccggcctgttcggcttcggcgacgagtccttggggccgtccgatgtcgacgtgcttcgccaggagaccatgcccgccgtttgatcagtcatcagtgaatggattagccttttctttttttaccattggctaactttagctttaccctttttttaacctacggggatgtaaatattctagatgcaagaaggaagaaaaaactgtggggaagaaacctgaaaaatgtgttgcttcgtattaatgatgtagagagaacaaatatcatctgaaggaaaaaaaaacctccctggattctagaagaaattgtttcatatttatgttcttcttggaacaacttcttttttatgaaagaaataggaaataaacccgctaaagtatcccctattttggtagaaatgtatgctagtagtataatatgaacgagtgtaagactcaacagcagatgcggaattatgatcgttgatggaaatgttcaaaaaaaaaaaaaaaagggcggacactcgcgatctagaactagacggacgcgggg

SEQ ID NO: 8316 - DNA, 1270 bp, Triticum aestivum
  unsure (1)..(1270): unsure at all n locations
  Clone ID: PAT_TA_8316
gccggccgggccgggatcccaccacagcttagcatttaaccaccagtgccttacgcactctcgatcaacaaactctagcccatcagttgcatagcaagcaatggggtgctctaaaaccctagtagctggcttgttcgccatgctgttcctagctctgaccgtcctagccaccgaccctgatcctctccaggacttctgcgtcgccgacctcgacggcaaggcggtgtcgttgaatgggcacacgtgcaagcccatgtcggaggccggcgacgacttcctcttctcatccaagctggccaaggccggcaacacgtccaccccaaatggctcggccgtgacggagctcgacgtggccgagtggcccggtacgaacacgctgggtgtgtccatgaaccgtgtggacttcgcaccagggggcaccaacccgccgcacatccacccacgcgccaccgagattggcatcgtgatgaaaggtgagctcctcgtgggaatcctcggcagccttgactctggaaacaagctctactcgagggtggtgcgcgccggagagaccttcctcatcccgcggggcctcatgcacttccagttcaacgtcggtaagacggaggcgtccatggtcgtctccttcaacagccagaaccccggcatcgttttcgtgccactcacactcttcggttccaacccgccaatccccacgccggtgctcaccaaggcgctaaggatagaggccggggtcgtcgaacttctcaagtccaagttcgctggtgggtcttaattcctgggagcttgccctggaatgatcagtatataatttgatatatgcataccagtgaaatttaataattgttcagcataagacacgtattcaagcttctagctaagctcgcatgcagttgtaataagattgaataagttagcctcgcggtttagccttcagagccaatacgaggaatcgaaatgtactgctttttattgttgtgtttgttcttttcattgaacggaatatataattatcattttcgttgnaaaaaaaaaaaaaaaaaaaaaaaaaggggggttgttttagaggtatgaagtttatgtacgtgtgcatgcgaggtgataggtgttgtatagtgtgagttaaattgaatttattggttgttgtttgtaaatgttgtgattgggaaatatgtggggtttgtggaatttaattgttttgtaggatattgggtttttgttgagttgtggtattgtggtatgaggtgtattaccgacccccccccccccc

SEQ ID NO: 8317 - DNA, 1598 bp, Triticum aestivum
  unsure (1)..(1598): unsure at all n locations
  Clone ID: PAT_TA_8317
gtactactcttttctctcccatcctgtgcgcccttcgcgtttcgcgcccagagtgctctttgttcacgttcacgttcacgttcacgtccgttgccttgcacccacccacccctcgacaggaaacaagaaagagaaggcagaaaaaaagctcgtctgccggacatggagagctcctcctcgtctctgttgctgagttcgtataccggcggcaacaagagggccagggaggccgaccttgacgtggcctcatccgccgaggcggaggccgccaagaggatacggcccgaggacctgctggacctgctcgacgatgacgccgacgccgcggcggccggcgacctggcctccgtcatgcgaagcctggaggaggagatatgcgccggcgacctggccgcgccgcagccggagctgggcttcccgctcgaggcctcggacgggcccgggnaaaaacaaaaaaaaaaaaaaaaaaaaatccaccactgcttagcagcaacaaccagtgccttaaagactcttgatcaacaaactctagctgatcagtgctagctaagcttgctgcatagcaagcaatggggtactccaaaaacctagcggctggcctgttcgccatgctgttcctagctccggccgtcctggcatccgaccccgaccctctccaggacttctgcgttgccgacctcgatggcagggcggtctcggtgaacgggcatccatgcaagcccatgtcggaggctggtgacgacttcctcttctcgtccaagctggccaaggccggcaacacgtccaccccgaatggctcggccgtgacggagctcgacgtggccgagtggcccggtacgaacacgctgggtgtgtccatgaaccgtgtggacttcgcgccgggaggcaccaacccgccgcacgtccacccgcgtgggaccgagatcggcatggtgatgaaaggtgagctcctcgttggaatcctcggcagcctcgactccggaaacaagctctactccagggtggtgcgtgctggagagacgttcctcatcccgcgcgggctcatgcacttccagttcaacgttggtaagacggaagcctacatggttgtctccttcaacagccagaaccccggcatcgttttcgtgccgctcactctcttcggttccaacccgccaatccccacgccggtgctcaccaaggcgctaaggatagaggccggggtcgtcgaacttctcaagtccaagttcgctggtgggtcttaatccctgggagcttgccctggaatgatcagtatataatttgatatatgcataccagtgaaatttaataattgttcagcataagacatgtattcaagcttctggttaagctccatgcagttgtattatcgaccgaatgtgctggtggctgtcaaccgttgggcctggacgagcgagtacaatgtgtgttgctatttcaacctttgtttattttttaacacagtagatacatagacttttttacgtatgtacatacactctcatctttatgaatgaacgcatgcatgccctatttctagattgaataagttagcctcgcggtttagccttcagagccaatacgaggaatcgaaatgt

SEQ ID NO: 8318 - DNA, 1378 bp, Triticum aestivum
  Clone ID: PAT_TA_8318
gccggccggtccgaattccccactgctgagcagcaaccaccagtgcctcaaacactcttcaccaacaaactctttctgaaccactcctagctaagcttgctgcatttaactcgttgcctaacaagcaaaggggtgctccaaaacccttccccatgctcctgcttgctccggccgtcctggcctcgccaccccgaccccccccacccccccccccgtctccagttctgcgttgctgacctcgacggcggggcggtctgcggtgaggcacacatccacgcccaagccgggggccggaccccctcatctcctcccccagctggcccgacggccgcgcaacacgtcccccccggaccgcccggcagtgaccggggcccggcgtgggaccgggcggcccggtacgaacacgcggggcgtgtccatgcaccggggtcggggccttcgcgccgcggaggccaccaacccgcccgcacatccacccccgcgccgaccaccgagatcccgggacggtgaggggcatggtgatgaaaggtgagggccgctcctcgggcagcctcgactccgggaacccaagctctactccagtggtcggtgcgttgctgcgggagacgttcctcatcccgcgcccgggctcatgcacttccatgttcaacgctcggtaagagccgaggcctccatggtcgtctccttcaacagccagaaccccggcatcgtcttcgtgcccctcacgctcttcccgctccaaccccccccgatccccacgccggttgctcacccaaggcactcccgggtggacggccggggtttcgatggaagcttctcccaaggtccaagttaatcgctggtgggtcttaattccctggtaaaatttagcctttgaaatgatcattatatattaatttgatatatgcatgctaaggaaaatttaataattgttcagcagaagacacgtattcaagcttctagttaagctcgcatgcagttgtaataagattgaataagttagcctcgcggtttagccttcagagccaatacgaggaatcgtaaatgtactgctttttattagtcgtatttgttcttttcactgaatggtaatatataattatcattttcgtaaatctacagaagcaaccaagcaaaatttaatcattctcagcagaacacctgtagccaaccttgggattaatttggcatgcagttgtaataaaattgaataagttagcctcagggtttagccttcagaaccaatatgaggaatcgaatgtactactttttattgtcgtctttgtcctttcattggacggaatatataattagcattttcgtaaaaaaaaaaaaaaactcgagaagttacctccccgcccgcccgggggccgctcga

SEQ ID NO: 8319 - DNA, 320 bp, Triticum aestivum
  Clone ID: PAT_TA_8319
gctgtacctagcagggagaattggacgcaggaaggtattcgtcgaatcagatagcatatttgcggtggaggctgttacacgagcaaatgattatatgggtcctgatgtggcagtaatatcagaatgtattcaactcgctatggattttgccagtattgactaaagttattattgcggagaaactaatatggttgctgatagcttacccaaattttcttttatttcgaattcattctgaactctgggactctactatccctgactctattcttcttcacattgtaaacgatatgtcaatggtttgaggagtaaagtttata

SEQ ID NO: 8320 - DNA, 515 bp, Triticum aestivum
  unsure (1)..(515): unsure at all n locations
  Clone ID: PAT_TA_8320
gaaggtgagggcaaaccaccggggccctggctaaacatctcgagacggaccatgctgatgcaccaggctcatcctcaatgcctctacgacaagctgaggcactgtacctctctaaaataaagagaagtcaagctggggcaagatctacctgcaaactaagcagataagctgccgcctacctttgcccccactactactcgcgatctggaaaaccaagaggcagagcaaactattttaggcagacacaatcaagtctacataaacatatcttttacaaagccatttccatttggaaaggctctcttttttagaacatggaaaaatattggcacatgcaagtaacacctacctcaaaatcactcacaagaagaggatatcgctgccaattattgccttacaatatatggccaaactaccttgtaatataaagaaagcagaaggaattaagccacgcgtggtgcgcaatgtggagangaatgtaattatgccaacaagggagaacctttagatcaatg

SEQ ID NO: 8321 - DNA, 453 bp, Triticum aestivum
  Clone ID: PAT_TA_8321
gaggttgcgttgcgcatacgctcagtgaaccaaccgagtcgtggatgcagtgagcgttgggtgctgtgtccgtcggctaagcagcaagccggagctgcaagtcgttgaacatggggtgctactgtgaggatctcatgtctctcactctatgtgtattagtagaccatttcctttctgaatatgagctatgctatggatcttgggagcaggtcatccttagtttgcttacagtggagtagtggcggagaggtggaactgggagtggaggtcaacatattaaacgcacgcaagaactcatctctatgtacaagttctcggcagatctggcctccagagcaaacgaaacggacggccagatctccttgttggaggagggggatggagggatggaccatctcttcatcgtggacggcggcgtgtacgacacctgcgaccacgcctgcaacatttgtc

SEQ ID NO: 8322 - DNA, 917 bp, Triticum aestivum
  unsure (1)..(917): unsure at all n locations
  Clone ID: PAT_TA_8322
atatggttgcagtaaaggaggaaatggaggtccctctggaggtagacagtggtaatttgatccgcaataatattttgggagaggaacatgataaagggttgaaggatgctgttaatgctgcacttaatcctcacacgccaggagacagcatatttgatattggtggaacgaaactggggggcaacatgaagaatgaagatgagggtagctttaggatatttgtaaaggggaaaagcaggcgaaagcaaactctgaggatcccgataagtttgcttaacaagacatatagcgcacgttccttcaagcttgacttcaacagagtagtcagagagagtgatatcttcaagccatcgggcgtttcttctgctgaagtagtttcttctggcgactgaggaatattccaccagtcaaatatttacctatgacattattacccaaagagaattcgatggatctccatttgaaaaatactgaaatgtgactcttatttttatctgagcattcggaaggcagcaacaatgctccttcagtgttccagatctgatccaagctactctgaaaagataaatgtgttttcttttccgacttcaaataaggtgtcgacaattccgtgtggagtgtagcagattgccgagagttttgcgagatccggaaccaataaaaggtggaagtgttagcaaaaaatacatggcagactgattctttactacaattttgatagactaagtagaatattttcctccaaaatttgggctaaattttggtcgtatggaacttaacttctagaaacttagaaatttgtttgctcctgcatcctgaaataatctctcgtgtcttttgtgagagaaactaatgttattcttttgaatgacgagaatagtaataagagcatncnccggcagncncngtctccccaa

SEQ ID NO: 8323 - DNA, 1672 bp, Triticum aestivum
  Clone ID: PAT_TA_8323
ccccaacccccatcaccgcgcgcccctccccccccccgcccccccgatcccaaactcctccgggacagcaggggcaagtttcggcgagtttcgccctcgcgcgggcggccggcggcggcggagatggcctcctgcaccagccggagctcggacgccccggccagccccgtcacgccctcgcgctcctccgcgttccgtcgccctcccggacgccaaactgacggtggttccacatgaagttctgcacgtgggaaattcccttttaactctggaattgacaaataactaaatagttgatggtccccgtgaagttggtaccattgtgaatatgcaaggactgggtttggctggtaatttggttgtcaccatcccagactaatattcgttacctgcggtaaccttaaactcctcacgctcttacagcaataaggatcactgccgtgccgtgaagacagtgggttctctatcaaatcttcagcagcttacagtttctcagaattctttactgtgcctacctaaaagtgttggagatttgtgcaatatgctgctactcaatgtttcgaatttcgccctcgcgcgggcgacggacggcggcggcggcggcaaggggctggtgcagctgccggagctcggactcgccggccacccgcgtcacgcgctggcgctccaccgggatcgtcgccctccgggacgccaaactgaaggcggtaccacatgaagttctgcaagtgggaaattcccttagaactctggatttgacaaataacaagatagttgaggttccccaggaagttggtaccattgtgaatatgcaaaggctggttttggctggtaatttgattgaaaacattccagctaatattggatacctgcggaaccttaaaatcctcacgcttgacaggaattaggatcactggcttgcctgaagatttgggttcactatcaattctcctcaatcttacaaattctctgtaatctttgtatatatcagtttcccctctatctgattcggtaaagaaatcaataaatactaaacatacaaaaaaactaaatgcccttcccgaatcaataggaggctgcaagtccctggaagaattgcaggctaatggaaatacaatcgaagatgtgccctcatcaatttgcaaccttgcttgcctcaaatctgtatcattgaatggaaacaaaattcgtcagcttcccccaaacttgctgaaggattgcaaggctcttcagaacttgtcactgcacagcaacccaatctcgatggaccagtttcagcaaatggatggattcggggagtttgaagcacgcagaaggaagaagtttgacaagcagattgattcaaatgtgatgatgggctccacagccctggatgaaggcattgatttacgctagttttgcgagtgaacttattttttcctcattagtcggaagtaattgtaatctttgtatatatcagtctccccacaatctgattcggtaaagaagtcaataaatacaaaacatacaaaaatgagtagactgtctctttcatgtggatctacagtcattgactatcagcatattatgtactctcctgtctaagcctacaccatcttatttctattggccgagcactttcggtggcagcaagatttgtctgcaatcctacaaaaaaaaaaaaaaaaaaaaa

SEQ ID NO: 8324 - DNA, 703 bp, Triticum aestivum
  Clone ID: PAT_TA_8324
ttgcttccccttttcgccccctcgctctctctctctctctctcttaatgtgtgcatgtgtgtgctgtgttcgtctttccggctccctctctctctgccgggaagcaaaggtcacttgcccttcccccgtctccgcatttctccgccactccacacaagcgggagcagcgcccagcaagcaccgggcttttctggttctgacttccgagggggcggagctggacctgttgacggaatccctgtccaatggggctggattgggcgtcctgtcaagataaatcagtcaggataagtttgtaaaataaactccttcggcaaacggcacaggactctgaatttcgcaaacatcccatacgattgttcgtcagaccaaccgaagataacatgtcgtcatccgacaattccatcaccgcggcattgtcgcggacaacacctgtgtttagcctgagagtatgggttctgattgccattggcattgggatcctgatggcaatcctgttcatcatagtactgtggctgtccatccgaaggaagaacaaggccgtgagcggattcgacactacatcgcaaacagaaatccctattgtgtccaaggaaatcaacattgacaaaggagttgactcacagagtgtgaatgacagcagcgaagtggccttcatgccagtgcatgacaaatacacacagatgaagactgtaccaccctt

SEQ ID NO: 8325 - DNA, 848 bp, Triticum aestivum
  unsure (1)..(848): unsure at all n locations
  Clone ID: PAT_TA_8325
ggatcgtcgtgtctcctggcgatgaccccctcctcactccctctttgttctcatcctcaaggncgtcatcgtcggctcccctcctccgtgattcggccatggctgccactgacgccctcctctccatcgccaccggccagccctcacctccacgtcaccgtctctcaacctccatcgatctcctggatggatctgtcgatgttactagatcgacggaggggggcctccaccatcgccgttcttctccctccccaatctcccattgttgtgctcctcggatccggccatggccagaaccgacactgcattcccggccaccaccgacaacaccagcgaggtggccacggtggtcgataccggatccatggaggagctcaccccgaccttctcctcgtttccccccatggctgggtctcctgatccctggaagtgctttgttacgggcaactctataggaaggcacatcatggagtgttgatatgcagacgaccctgatgaccgcatccccgatcttagttgctcgggcgttcaatttttgtggtcgactcatcctcggtcactccatcctagcctgggcaaatcaatttttgtgaacacgttaaagttctgaatcaggagtccgctgcctcgccctccccgggatggggaatttcgacctccttggcgagcatgtacacacgtactggagatctggagcagaaataaggttaggctgacgcgacgatgcagaagaacaacagccacatgcctctgctacctgacgactcacatgtatcaatggagtgcctagctaggcatatattttattcttcaggttcatgttcactatatgttttttngaatgcaaa

SEQ ID NO: 8326 - DNA, 617 bp, Triticum aestivum
  Clone ID: PAT_TA_8326
gtgcagaccttccacaggttgcactgtgcgtgtggcaggcaatgcgcaaggcgcaatggatcctcggtggctaggcgcgacaagttctatctgaactgtgtcaattacaatgtacaaggtgccaggttttgcgaagtgtacctctgggaggatgacctcgacaggtacacgaaccagcgttaccaatctgctgttgatcttgccaactaccacaagactcgtcacgagaggtacgaggagaagctgaacaaggtttatgaagagctcaaggaggcatatgctgagataaggaagctcaagaggacgaacaaggcactccagatggctttagtggctactgcaccagtggctgcaatcgtagcgatcacgtctgcatgggtggctaagtgagacggatgtcattgacctagagatttggtggcccatacaccatctatttgtatcttagtgctttttaagtgtccacttgttaggagcttggaagttttgtttcctactaaaagctcagtgcctgatgtagtgtatcaagcagtggtagcagttgtcagtcggcaatttatatatcactgtactatttcatttcagaatggattagtaagcattatccaaaaaaaaaa

SEQ ID NO: 8327 - DNA, 863 bp, Triticum aestivum
  unsure (1)..(863): unsure at all n locations
  Clone ID: PAT_TA_8327
cnnnggcttcgaaaangaattttnttntncccggaaaagggnccantcanggatttcttnganttanagagtcntnnctaatggggggaaggaannacattgncatttcttctccaanattggnacttatngntnacaagatgtttaaggcattcnagaggctttaataagaaagttggacttgantgggttttatgcagttactaagtatgaagcctgtgggctnccatagcaaaatgcagtatatggtgtatgggccaaaaaccgtatggaagttacaggtttggctactaanagtttctcatatcnataactccaactgtgtcgttgctccattcattgttgtagtcggattaagccattttaacgatatgcacctttaatgaagtattctggatggtttgaatgatctgcccatttttgtctctatgacaggtcgacctcccctggaggaaatttttgcagcccgaagacaagcgggtgaatgtagagatgataaagcatgcaagatgtgagcagtgctctgcacgtcttcacttctacacactgttagataggcacacatacatatacagttagtctaatatttgaagggttgcgagattgacgacagagacgatgatgttttctgtgttgggtagtcaataattccataatcttgcatggattctatgagcaagatacacaactttagcaagttaattccgggatgctgtcttcagttctgcactgagttcgcttgttgcatcgtatccttcagtgtccaccttctctgtttcactgtgtatgaccagacttgttctcttgtgcagcaagatattacaataccatgtattggaaagtggagtgagtcaaaaaaaaaa

SEQ ID NO: 8328 - DNA, 505 bp, Triticum aestivum
  Clone ID: PAT_TA_8328
gaggaattcggacgaggggagtacctaagagaaacttttcagataaaggagggtgactttctgacatttgacgcattgaggcaagctgctcaatgtgttggccgtgtgattcgttctaaggcagattatggaatgatgatatttgctgacaagagatacagtcggcatgataaacggtccaaactgccaggatggatactgtcacacttgcacgatgcgcacctgaacctgagcaccgatatggctctccatacagcccgtgagttcctccggaggatggcgcagccatacgacaaggctgggagcggagggaagaagacactgttgacggaggaggacctgcaggacatggctcgggacgccatggagatgtgaaacccagagagtgctgtagcctgtagtgcacaatagtcaaagttgctgatgtacaaattctttggctactcgtatgatcacgctgaagcataaattcagtttttagctgcagtttacatgaaaaaaaaaa

SEQ ID NO: 8329 - DNA, 1223 bp, Triticum aestivum
  Clone ID: PAT_TA_8329
tcggcacgaggctcgcctccaccgcgccaatggggaagagcgaggctacgccgacggtgacgaagggggaaggggaggagctggtgctgacgatgctcgaggtggatcccgccaccgaggaccctgacctcctcgacgccatcaggaagaagaacagtgctgccctgacctccattcttgatccccatgacgagctctccgccaaagacagttcgaatgcggctgctgctgtttggtatttcgtcatgaatggccaccacataactggcaatctgaacctgctgacggacctcacgcctgtgtgtgaccgttgggtccgttctctcattgggacagggccgcccatgcaagtctgtgcacggggatctgtgaactgcaacgggatcaagctcgatgacgtatggtatgttcccggggtcacggtgaacatggtggcgggtgcccattttagcaatcaggaaatttcactcactctggatcgcagtgccttttctcttaagcgccctgatggcacagtagtcggcaaaggacgtgttaaaggcaatctgtatgaagtagactttctcgacatcagtagtacaacagctccctggtacatcgtctcgaatgctgctgaacacatgaccggcaacctgcacctcctgagcaacttcacccccacccagccaggccgccaagtccggacgcacaccggtgcgatgctgcaggtgcgcgggaaggggtctctgagctccacccagctctccattcccagcgtcagctacgtcccagggctcaccgagaacatcatctcagtgacccagctcactgacagcggcttcagtgtcgcgttcagtcctcatggctgcaccatcacaaggaaccgcgatgggaagacggtcggctgcgcgtaccatgccggtggccagctctacctgctcgactacctcagggttgctgacagcaagtagcctgtatgagttgccgacagacatagtgaacccagagcagtgaggtaaccagccctatgagttgccaagatgaagaggaaatttagttgcgaagggcttttttggctgcgaacgagttgttagctggtttcctgtatgaaaaacctcgcggatgcttcggttaatgttaagttacgatcctgatattactatgtctgtatgggctatggcatattaccacttaccagttacgcatgggtttctgcaattaccatggatgtggttaatatgtaa

SEQ ID NO: 8330 - DNA, 1093 bp, Triticum aestivum
  unsure (1)..(1093): unsure at all n locations
  Clone ID: PAT_TA_8330
gcttctcttcccttccctctctttgttntctctctcagtggcctcggatcgaccgatctgcgtctgaaattagtttagttagttgtttattcttttgctgctgtctatgtgcagctagcctcacaaatctaattatatatttaagaggtagccagctggagggatcgatcgatagaggttacagcgatttgctgctgttctttgctgcttggttgatcgatcgaccgaggatgtgcaccagaggccactggaggccgtcggaggacgagaggctcaaggagctcgtcgcgcggtacgggccgcacaactggaacgccatcgccgagaagctccagggccgatcagggaagagctgcaggctgaggtggttcaaccagctggacccgaggatcaaccggagccccttctcggaggaggaggaggagctgctcctcgcctcgcaccgcgtccacggcaaccggtgggccgtcatcgccaggctcttcccgggccgcaccgacaacgccgtcaagaaccactggcatgtgatcatggcccgccggtgcagggagcggatgaggctgtcgtccaacagacgtgccacgcctgccgctgcctccaccaccacgggccggtgccgagaaagacgatagccctaggaacaccgccgccggcgagaagccgagacttccggaggcgaataccatggccgccttgctccacaagtaccgcagagaatttgctgcccccttcgcgatcagccgtcacagtagcaaggagggttactgctcatccacgaatgaagatacgaatagatcggtggagttctacgattttctccaggtgaacgtgagctcgagcgacaccaagtgcggctcgagcatcgaggagcaagaggagaaccgggacgaaggcgatcagcaagctgaagggcaggtgtcgctcatagatttcatggaggttgggacttctcatcaatgatttatcttatctatatatgttatggccttatgggtcagtatttaactaggggtggtgcatccaaagcagcttgtaatgctttgtgaggaggccggggcatgcgacatgtagcaatctaacaccaaatatactt

SEQ ID NO: 8331 - DNA, 960 bp, Triticum aestivum
  Clone ID: PAT_TA_8331
aggaattcggacgcgctgggctctctgtcggactcgcaggcgaatggcgaccgtcagccgccgccggcggaggcggaggatgctggggcgcaggtcgaggagggagataccggcgagaagatggagggcgtcgcgtccatcgcgctgctgccctctggcgccatctccggccacttcatccgcctcccggactccgcctgctacggcctccagggcaccccgataccatgcgagagggaatgtagccgaggagatgattaccgccttataaagctctccatcattaattttaagaggaagacagagaaggtggttgtggtggaatgcaggggacatgatgctgctcgattacaaaacattgaccatttgcatggatgggaagatgacgttgttggattggttcaaaagaaacatgggaataagaaagtcttggtctctttcgaatgcgagacgctgaaggccgataaagccgccgaggagcatattagcaagtatatgccaaatctttgcggactggacgcagttgtgaacacggggaagatgagcatctctggcatcaacctcgacgaggacgatgaaccaagcggagacagctgagagcagaaacactgtgtgacggtgtgttaacagccacggttgctatccctagtcaatactgtccacaaatcaggattgtgtctcgctgttaccacagcactgcatgagttttatgcgacaaatcagcgcttgtgtttctgcacttgaaacggtgcgctttgtagcaagtctcgtaacggaatttgtgtttgctggctctgcaaaaaaaaaaaaaacggaatgtgtgttggctgttgctgcctctggcatgatcctgctgaggcgattgtacacccttggacctaggtttggtgttgggtgggccattggcggcgcaagcctttcgtccccgcccgtgctgtttgtcacgcatgtacgggcaga

SEQ ID NO: 8332 - DNA, 979 bp, Triticum aestivum
  Clone ID: PAT_TA_8332
ggccgcctgcatggcctttattgggccgcggtgggcgaacgacgacgcgtacccacgcacgaagccagaggacttcaccgtgccaccaaagtggatccccttcccgtccaccaccgtcttcctccaccacgaggcccggcggatgctcgcggataacttcggtgagaacgcgtcaggcaggtcggacactgaccgtttgtgggacgtcttcgagcgttgctgcctcaccatccaccggagctgtcgcgagctggagcctcgcatgttcaccctcctctctgatctcttgcggaagcccgccgtccccgccgggatccttctaccggaggcggttgaggaccgtgatcaagaccaccggcagagcagctcaggtggcgtcctgcgttggctcgacgaccagcctcctaagtctgtcctctacgtcgcgctgggaagcgaggcgccactgacgctagagaacatccatgaactcgcgctcggactggagctcgccggggtgcacttcctttgggcgctacgcaagccggccggcaccaacaacgagcaggagctgttgccggccggcttcgaggagcggatgcaggaccgtcggatggtctgcacagggtgggtgccgcaggtgaaggtactcggtcacggcgccacggccgcgttcctgacgcactgcgggtggggctccaccattgagagcttcgccttcgggctcccgctggtcatgctccctttcctcaccgacacgcccatgattgcacgggcgatggcgaagagagggatcggtgtggaggtggcgagggacgacagcgatggctcgttcgacagggacggcctcgcagtggccgtgcggcgtgtcatggtggaggatgaaggaaacctgttttcaggggcggagccaggatttggacatagggggggccaagcaaagttgaaaaaaaaataccgcttccttgctatagagtatagacatgtggtagttacattt

SEQ ID NO: 8333 - DNA, 745 bp, Triticum aestivum
  unsure (1)..(745): unsure at all n locations
  Clone ID: PAT_TA_8333
acatgtattgcctattgagtgaccctatgcatttggttgtgttctcaagatgagaacatcgcaaggttttgatcctggccactctgtaagccttcaagctacctgtattcagcggcggctacatgagaggtatgtatccccttgaaagcaaatcaatgaatacgaagcccctctttcagttattgtttctgtcccctagctggctggctttgtctgccacacaagtgggaagtgcaaatcattctgaaagttgattcaagtctgtagtgcttcatcaactagattcatagatgctacacttctgttagtatgctaaacagtatagctgctctgcatccagtacacctgcttaatatttgtagtttccgttgattcaggttatcataggtaattcgcataattgattgtcataaataatttgcatcatgttgtaccaacagccaaagggagtgcatggttctacttctgtttgtttcctttgtttgctccgaatcacctgtgaaattcactactggtactgcaggatccaataagtagaataaatgaacttgggtcaagaatatgaacaaaccactcaaggtacacccgattcttcattacctgtgagtgccaatgaaactaaactgtagcatgcaatctccgtgcaagattgtaccgggtacaatacttcagtactcggccaagcataattctaatgctccggtccanaggaataatcattcaggctaataggttgatccaccat

SEQ ID NO: 8334 - DNA, 709 bp, Triticum aestivum
  unsure (1)..(709): unsure at all n locations
  Clone ID: PAT_TA_8334
ggttccggcactggaaggcttagaaacttaagctgtcgtgtgcttgatgaactggggaatggatggaccaagggtatttataggccgcttcttgggtctcccaagtgtgcagagtacaaatcctacatgaagcaagaataaaggcgtcctgaattattgtagcaagtgattgatggcacggtgcagttggatgctttcttacagaattggatgccttgtagcctggtaggaggtgcaactcaccggacgtgaagttttccattcgaaatgtttgaggtatattattccctgagtcattaacgcataatggcaccaggaagcttccgaaagaataaatcttgtacaagaaggtttgctgcctggtttctgttggtgtctggatgatctccccctccgacgtaggggactcggtatagcttgtgttgcgtttggcaagttgctatgatgtcttttttgttttttgctggttctatgggatttgtaataatttagttgcatgtgtccttgagaagggtggtttgtgctctgtttcgtactctttccgtcccataatgtaagacttttttgacactaaaaaacgtcttatgttatgagatcgtgggagtagttttttaggagattgtattagtgagtgcctccttgtactctgtttcgtacttctttnctgttgagggactgttttttgttgttgttgaggggcgccaacact

SEQ ID NO: 8335 - DNA, 1347 bp, Triticum aestivum
  unsure (1)..(1347): unsure at all n locations
  Clone ID: PAT_TA_8335
ggcccggcggatctgccggccggtgcggcggcttgctccggtggcggcggcgatgtcttgctcatccagttaaagagagagacagggtgtgagggggagaggaaagagaggaaggcatagaaggagaagtgtcgcaagatgagggagggatctcgcggctggtgcgggggcttgctcgcagcggcgtccgtctcgtccagagaaagagagagacagggcatgagggagagaggaaagagaggaagaaaggagaaggagaatgggcgcaaggtgacggagacggtcgctggcggtggcgcctccggtgaccggccgccggcagggcgacctgcacttggaggaggagaactgcgcaagatggattccagcaccctcctactcatataatgacagacctcaaggaacctctgccggagatttgcgtggtgaaggactcgaactgtatctcccgtccactcggccacacctgggttggctgccaacagccctctgattgtacaactgctccgtctatccgagtctctgtcggtcggctgttcttctcggacagcgccatccagctcctcaccagcaacctcatgtgcttctccaccacgagtcaattcccccgctgttgatatcccctattcctctaaggatatgcccatggtaattttttccacaaggcgagtgttgcagtatttgtatgaactggacgtactgtactgttgcagtagtgtacaactgtacatacatggtttgaaaatcctttctttttcacgttatatattagaatggaatttgtacggcttggactgcattttcacaatcaatatggtgtgttcaagtagtgtaaattgtttaacttgctttttggccagtatcccggatatatggggatgtatcgttgctgttctctaccgttgcggtagggtgcttctggtcccgcttggtctgcttttccggtctgtttccctgattcatcgcccggaagctcctcgggatttctataattcatgagcacatatgagcatcaaaagaaaatatcccatgatgaaacgtgagcaagtcttggtgaatgaactgatatttttcatgcattacaggtgaagcaaaaaaaaatcaagctttataagctccgcggcctcaaggccaatccccaggttgatgccaccgctactgactttgccacatccctattacagtttaatttttaatttattagagaaactggatcagtgcttggggctggtgtgctacggttggtttaggcatgtgtccaacaaggcggcggccactataagatactctcctgagttaggacgggtttcgaatttgctgcatgagaaaaaataaaagagaaaggna

SEQ ID NO: 8336 - DNA, 479 bp, Triticum aestivum
  Clone ID: PAT_TA_8336
gtcgacgggcatggggtcgtgaaaagaacaggtttagggagcaagcacatggatcgtttacctaggttcgggccgcgaggatgcgtaaaaccctagtcctgctttggtggatgtattgagtgttcttgagctttctaaactagctacgggggctgtcctgttccaaatagcggaatccttctcctggtcgcctcgggcctccttttataggaaaaaggggctgccacagtggcacacaggaggtggaaaggtgtacagtgtgtgagcttatcgcacggcattaggggacaaagtgcatcaaatgtgctacgtaggtgtccattagctttatcgggggcgggaacgaggcccgtcccatctgtcgccgcaccgcctcgcttcgacacgcgcccaggccagcgatgcgtgcggtgccatgtaggcaggcaggctgctgaggtggcgcggtggcagggtctttacgatgatcccgtggaccc

SEQ ID NO: 8337 - DNA, 910 bp, Triticum aestivum
  Clone ID: PAT_TA_8337
cttcggctcggggcccaatccgaggttgtcaagcgtgtttgggaccacatcaaaagcaacaatctagaggatccatcaaatcccacgatgatattatgcgactctaagcttaaagatctcttcggatgtgaaagcgtaactgctccggctgtttcagagttgttgtcagaccaccttttcaagcaacctaacaagatctaactgctgaaacgtggttggtctaacatcctggtagtaggaactgatgaaatggcagaaactcgccgaagttattaactgcatctttggtacccaacagactcatttacttacgagaaagggctgataggctaatctcattacagtagcaatgaaaaggaatggtagttctgcatattgtctagtttggtcttcccggaagggtcacatctggttaggctgtccggattcgtagcaacagtaagagaaagtgaaaagctgattaactttgatgtaaattcagcaaccatagacgcgtcttatggtaagaggcacctgtcccccctgttgacacatggttggtctaacatcctggtagtaggaactgatgaaatggcagaaactcgcccgaagttattaactgcatctttggtacccaacaggcttatttacttacgagaaagggctgtaggctaatctcatcacagtagcaatgaaaaggaatgctagttctgcatattgtctagtttggtcttcccggaagggtctcacatctggtaggctgtccgaatttgtagcaacagtaagagaaagtgaaagctgatttaactttgatgtaaattcagcaaccatagacgcgtcttatggtaagaggcagctttctccctttttacccagaacattgtgatgttgtaggtgatgtctaattatatgttgtagatcgttatcaaaa

SEQ ID NO: 8338 - DNA, 402 bp, Triticum aestivum
  Clone ID: PAT_TA_8338
tgcgaggccaagggcaggatcaagaagggcgaccgggtgtggcagatcgccttcggctccggcttcaagtgcaacagcgccgtctggaaggcgctcagggcggtcgacgccgtcgccgtcggggacgccggcagcccctgggcgcaggacgtcgacgtgctgccggtgcacgtgcccaaggtggtgcccatcgacgacgaccaggcgtcctacaagacggccgcctagtttctttctcatcctcgaagaatcgaagcgtgcgtgcgtgcacctgtgatcgtctctagctcgtgtcgctgctggccgggactactatatactgaagggcaattcttcttatactaccgtgtaaatcaatatgaaccgatgaatgaactcgagaattaatattcaaaaaaaaaa

SEQ ID NO: 8339 - DNA, 510 bp, Triticum aestivum
  unsure (1)..(510): unsure at all n locations
  Clone ID: PAT_TA_8339
tgagtatgttgcttaccggcggcgtcttgcaggcggaggcggaggtantcggtgttttggggtcgtcttcttcctctccggcgtcggcgttctttggagcttcggcatcaagcaggtgacttccccccgtgcccgcggtcctgggtaaccgccctgcgcgttccttcccctgctggatctcggagcggcggatctagatcaagaaatcgaagttgctgatgttgaagaccggcggtgctgctggcttggcgaaggatggaggctctctggagttcgaggttcgacaacttcccgtccgtaggggatcatcttcgttccaaggtttggaagatgcagcgggcggcggcgtcgttggcatgtctggttccccgccggcgtagcggtgttagacatggtccggtgtgttatttctttctttgtggggtgtccttctgtaatgtctgggctttaatataaaaaggcttggatcaacaaaaaaaaacggcaatgcattatnaaccgcaatgcctt

SEQ ID NO: 8340 - DNA, 1468 bp, Triticum aestivum
  Clone ID: PAT_TA_8340
gctggggcggaagccaaaaccgtcgctccccccccaggccaatcccccctccgccgcagccccggccccggcgtacggcaccccattatttttcgtctctcccctccctctcgcctcgccccccccatgccgcgatcgaggaggcgaaactaatatccgcaccacggaaatcaagaggggatcgacctccccccaggtccgcaccttccgccctgaatcccctgccgccggttcgccgccgccgccgccaccgttgctcccgatggatttggatctgtggatctccaaggtcaaggagggccagcacctcgccgagcacgagctccagaccctctgcgaatacgttaaggagattctcatcgaggagtcgaacgtgcagccagtcaacagcccggtcacagtgtgcggcgacatccatgggcagttccatgaccttatgaagctctttcgccaccggtaggacatgtgcctgatgaccaaactatattttcatgggtgattttagtcgaccggcggcttcaacagtctcgaggttttcaccatccttttgctactaaaagcaaggtatcccgcccacataacccttctgcgtgggaaccatgaaagtaggcagctgacacaggtatatggtatctatgatgactgccagaggaagtatgggaatgccaatgcatgtgggtactgcaccgatgtttttgattaccttactctttcagcaatcattaatggcacggtcctttgtgttcatggtgtgctgtctcctgatgtaggtactgttgaccactattcgtacaattgatccaagttgtgaaattccccacgaaggtgcctttctgtgatcttatgtggagtaaccttgaagagatagagacatgggctgttattccgcgtggagcaggttggctttttggatcacgagtgacaacagagttcaaccatgtgaacaatcttgacctagtttgccgggctcaccagctggtccaggaaggcttaaagtacatgtttcaggacaagggtcttgtaactgtgtggtctgcacctaattattgctacagatgtggcaatgttgcttctatactaagcttcgatgagaacatggaccgcgacgtcaagttcttcacagagacagaggagaacaaccagatgcgtggcccaaggactgccgtcccgtattttctctgacttcagttgtacaattttagaagtcgctgttttaaggtgtaagggttaaaagacggaccggaggtggttattgttgtagggttcagatgatagtccaatctgatgcgttttatttctggctgttcttttaaccacatgtacaatagatccttgggagcatcattgctcctgtattccttctatgacagtgtccaattttgtttctttttattgtttattattattattgttatacatgttgtacgggcgctatttatatgtcacatatatgcatttggcaacatac

SEQ ID NO: 8341 - DNA, 751 bp, Triticum aestivum
  Clone ID: PAT_TA_8341
gatttgtctagggttttctggtcactcgctgctgattttggtctgcagatgctcttggcttccggaccgtggtgctcagggtgactcggctttcttttccctcggttcgcctgcactctatgacgtaggtttgtgtgaggtggtccttatgaagtacatcgacaaggcagatggattccgcgacttagtattatgcttagtgataatggctccgtagttgctctttttaatatattcctgttcttattacctcttatgtgtttttgctttggtatcgaacttcatgtcgaatgtctatcttttgtgttcgtatgaacgcaccgagcttgatcctgccttataaactgatgttgatcttgtactccattgtgttttacttttatcacaatacaagcgcggcggaggagctgtcttctgagttgaccggagagggagcacattggagaggcttctgagatggccaagggtttactgatcgatccatcctgattgggatctgtttgtggtcctggttgactggctggtgcgtcgtgccgttgctggtgcttgaggttgtctcgctggtttccttgcagtatcgtcgatctgtgcatccaggcaccccaagcttttcctcgcgcgatggcatcaggcgcacggagggagctcttctccgttgatgtggtgaacacgaccgtgatctcgttcacggcgtaccggctagcaggccgagacaagcatcctaaggatcagttagaatgatgactgattt

SEQ ID NO: 8342 - DNA, 735 bp, Triticum aestivum
  unsure (1)..(735): unsure at all n locations
  Clone ID: PAT_TA_8342
gccgaggcgaggcttgtgagtgatccggcgccggaggggatcgactggaggcgaggcatccagcctcgatccgaggcgacgtgcgcgaggatccggtgatcgacaggatctcacccgtagcagatgggcgacctttcctctttgccttcaccgttgctggttcgcctctgcctccgacctcggcgcgtcccctcctcccgctcgcctcccctcccccaggaacgaggaggagcagccggtgcccccgccctcgagctcgccgacggcgctgttctccggcgtaagcttgctgatattgctcctcctctcctctgtccgcggcttccccgagcagtaagcagagacctaattcaacaggtcgcttggtgaacggagaggggctgcagggggatgatccaggcaatttcaaatcttgggagctcaagtttttctaaatggacgtgatgctccatcagcttccacatacgacatttggaaaagttgttaatggtggaaaaaatgacgtgggcaattattaagacacaactgagatgcaaaatcatactgatgctcctcagagaagacgaattcactgttacagaaggaagtgagcccccttagatttcctatactcttgaacacgcaatctgcaaaatcgtctgcacgttttgtcttttcttttttgcacaaggtatttggtcttagnttattatgtagattccacaagttaatgttctntgtgattgccacgcgtac

SEQ ID NO: 8343 - DNA, 1948 bp, Triticum aestivum
  Clone ID: PAT_TA_8343
gtcgtctccttcctcgaatcgcccccgctggtagctaccatctcaagcgttctcgccgtcgattgttgtttttggtggggaagtgcgagggagcggaggcggcgatggcgagcggcggcggggcggtgagggaggtggggtcgagggcggagctggacgcggcggtcggcggcgcgcgggccgccgcggtgcacttctgggcggcctggtgcgaggcctccaagcagatggacgaggtcttcgcgcacctcgccgtcgacttcccccacgcgctcttcctcagggttgaggctgaagaacaaccggaaatttcagaggcatatggagttacagcagtgccatactttgttttatgcaaggaaggcaaacctgttgataccttggagggcgcaaacccagccagcctggccaataaggttgcaaagttagctgggcctgccaatgttgctcagtctgctgcacctgctagcttgggggtggctgctgggcctgctgtactcgaaaaggtccaagaaatggcacggcaaaatggatcttctgctgctgaaagtacactgaagaagcgtttggagcagcttgtcaactcccatcctgtcatcttatttatgaagggaaatccagaagaaccaaggtgtggtttcagccgaagggtggttgacattttgaagcaagggatggggttgaatttgggagctttgacatccttacagataatgaagtacgtgaaggactgaagaagttctctaactggccaacttttcctcagttgtactgcaaaggtgagctgcttggtgggtgtgatattgttattgccatgcatgaaagtggtgaactgaaggatgtgttaaaggagcacaacattcctctcacgcaacaaggaagcaaaattgaggagccagtgatgtctgaatctgcaaatgaacagagtcctgaggcaattgggcttacggaagctcagaaagctcgtttggagagcctcactaattctaacccagtgatgatatttatcaaaggttcacctgaggagcccaagtgtggattcagtgggaaggtcgttcatattcttaagcaggagaagattcctttctcaagttttgacattctttcagatgatgaggttaggcaaggtctaaaggttctatcaaactggcctagttaccctcaggtgtacatcaagggtgaactggttggtggttcggacatagtgatggagatgcataagagtggggaactgaagaaggtactgactgagaaagggattatacggaaggagagcctacacgaccgactcatttcctcatccccagtgatgctagttcatgtatggaaaaccagaaactccacgttgtccacgttgtggcttaagcgcgaatgcgttgagtgcagtgagagtagcagggataagctttgggtcctttgacattctatctgatgaggaagttagacaaggtctgaagacatactcgaactggcccaccttcccccaactctactacaaatcagaactgatggggggctgtgacattgttctcgagctggaaaagagtggagagctgaagtccactctctcggagtagcggatattctggcgctatattgtcgttgtcttatggtgtttctgagcatctgtcctatatcgtattgctctattgatggcattgttatgccaatgtatttcgtagatccatcttttaaacttggatatcgtagtgctacgtttgcttgaaatgtgacagctgcagaagaaataacttataagacctcttaagtggcctgttagtcttgtattaccccttcatttttgctgccttggttcaggctggatgctggagaacacaagtattagccatcatttcacagttcaaagacatatgattcgtaaagtttaaaaaaaaaaaaaaaaagctccggccatgcccctgtcatggttgttctccaaaaaaaaaaa

SEQ ID NO: 8344 - DNA, 901 bp, Triticum aestivum
  Clone ID: PAT_TA_8344
cccgcgcgtccgcccttccgccccctcccgacgatcgcccccgctcgtcccaccgcggtgggcgatcgctcctcacctccgtgcgcgcgattcctgaggcgaggcgaccgacaccagattccgccggccggcccacctcccccgcttcgccgatcggatcgcgtgctccatgaggtagaggtgacgataaagcatagttgttgacttagcttgcagtggttctttatcaaagctaaggcagataataattggcgttatggcatatcgaatggtatgcgctccccaagtcattgatcttgagtctgagcgagggcatcctcatgttcattctgaaagtttaattcacaatgggaatgatttgtccgaccaaggcggtcaatatactgtcagagttgtaggcaatgctatgaatgctggtctttctgatacacagggttactacaatatgagcatgaatcatccacatcagcctgttcatagttctctgccaaatttaggcgttgattcaggctttggcttcccatcaaatatgtacaacccttgcatgtcaacatctatgaacagatttgtctctcatgctcagagctttggattgcctttaaaccaagttgtctcaggaagtatggatggaagtactagaaatgaaaatgtcagcgaaactgctagaggattcattaaaaggaaaaatgcagcagttgcaggaagttgtcattttgttaatggatctgcaagctcaagctcatcctctcatacatctcaaaatcccacacataggccatgggatccttctttcgagtcaaatgtttttcctaatgtcacaccattcaacccatcagaatatcatagccacagcacttggccatctgtggaaggatcttccattactggatcaaatgggttt

SEQ ID NO: 8345 - DNA, 715 bp, Triticum aestivum
  unsure (1)..(715): unsure at all n locations
  Clone ID: PAT_TA_8345
gcaggnaattcggcacgaggcttgagcgctacgcgggtgtagattctccgtccggccgtttgcccagccggaccctcgctgatgatcacttgaaacaacactctttctccccatcgccatggccatggagaagaaccaagattccaaagtgatcatgggccggtacaagctgggccgtcttctaggccgtggcagctttgccaaggtttacaaggcccataacatctccaccggcgagttcgtggccatcaaggtgttcgacaaggaggccgtgcaccggtccggcacggtggagcaggtgaagcgcgaggtggacgtgatgcggcgggtgcaccacccaaacgtcgtccgcctccacgaggtgatggccacgcgctccaggatctactttgtcatggaatacgcgagcggcggcgagctctttgatcgcctcgccaagagcacgcgcttcccggagcccgtcgctcgccgctactttcagcagctggtcacggccgtggagttctgccacagccgtggcgtctaccaccgtgacctcaagcccgagaacctcctcctcgacgcgcacggcaaccttaaggtctccgacttcgggctcagcgcgctcgcggacggcgcctcccgccatcgcggtgacgccctcttgcacacgacgtgcggcacgccggcgtacgtcgctcccgaggtgatcctgaagcgtggctatgacggcgca

SEQ ID NO: 8346 - DNA, 804 bp, Triticum aestivum
  Clone ID: PAT_TA_8346
gatgttacggacactgcggcatcgctcgataacttcaatacctgtccgcaccatctcctcttcagtaacgagacccgaggcgagctattatgagtcgcccttcaagggcgaatcaaaaacgacgcagattccaaattttagcaaatacaaaagtgctaccgggacaaatagcaatctagtctttcagtactttatggttggaacgatgggtgctctaacggccgccggagctaaggctactgtaccaagattttctcgtcaacatgtctgcctcagctgatgttttggctatggctaaagtcgaggttgatcttgcggcgattccccagggcaagaacatgctcataaaatggcgtggaaagcctgtttttatacgtcatcgaacccaggcagagattgacgaggccaactcagtggactgggagaaattgcgcgatcctcaaaaagacgaagaccgtacgaagaacccggaatggcttgtgatgcttggtgtttgcacacacttgggatgtgttcctattggcgaagcgggtgaatacggaggatggttctgtccttgtcacggttctcattatgatatctctgggcgtataaggaaaggtccagcgccctacaacctagagatcccttcatatgatttcccagaagaaaattcgctcattatcggttaaagaaatatatacgagatacacaccagtcaagcggtactcatgagaacccggagttacaagtttctgtgtccattcttaggctaccaagattttgtaaaatagtcgtaggcagatcacaatactacgagattca

SEQ ID NO: 8347 - DNA, 850 bp, Triticum aestivum
  unsure (1)..(850): unsure at all n locations
  Clone ID: PAT_TA_8347
gccccgcgtcctcgccttcgcccccgccgccgtccacctcgtcggcgcctgccaggcctgctgcccgccccccggcccctgtggcggacagcgttcgtggcggcgacgacggatggtgtccatgatgctgcccttcttcaacgacgtcgtggggttcccgccggctccgggctcctccccgcccgccgtctccgtgccggtcggcgtgcgcgggggccacgacagggggccccagtgctgctccccttcggcgtccccgccgtcgccctccccggcgccctcggcctctgcccgcgcccccgccgcggccccctgggcatgtacatcgtgcagaagaagatacccaggtggagctcacagtgggtgtgcctacagctgctcagcctcgcctgcctcatcatcaccattgccgccgccgccggctccatcgccgggataatgtccgacctaaaggtctacaagccgttctccacaactgactgatctatgcgtagatggccgtccgcatgaatgcacagatcctccgatggcacaagaatatgcctaaaagctctaattaattaatcaaccaattatcacgtgttcactaaaaattacatgttcaagtaattgttgctctaaacggccggtgtaccagtaccaccggtgctgccgatttcattttcctttggtttgccatccgtccgtgtttaactgaaatcggatagagggaaccaaaatagtgtacttcccaaaggggtgtgattgtaagtccgttaatgagacgcggttgccctcatgatacctacgggggggtattcagttcccnaaaaaaagggggcccgnaccattnccctanaggatcctntaa

SEQ ID NO: 8348 - DNA, 611 bp, Triticum aestivum
  unsure (1)..(611): unsure at all n locations
  Clone ID: PAT_TA_8348
gtattcttgcagagttatcagccctcgttgacctagaattaacgtttgatagagccctggaagaaacaattgccatctacgggacagcattcgcaatcctaaagcggtttcgggtcaactgcaagaacatggcacacctaaccttccaagttggggcaatgcccaagctccagtgcatctctctagggttgaatgccttggggtggaagcaggaaaattacgccacacctacaggtatcgagaacttgttcgcgcttgaaagaatttctgtaacaatcggctgcctggatgctactgaatctgaacagagaagcgtagagtctgccatcaggagcgctatcaacatgcatcctggccatgctcacattacaaccaatattgcacgggaaccataccgtttttgtttcggagagttcacatcctgcccatgctcacattataatccttggtatcaaggcacaaccaacactggtacttgccatanaatacgtaccttttcctaactgaacttggnanttcccggggaaatancggggtgtttaatgtncaatttgggtttnaacccccccaanaanaggnacgtcnccttttnttccaacaanattttccca

SEQ ID NO: 8349 - DNA, 407 bp, Triticum aestivum
  Clone ID: PAT_TA_8349
cggggtctacccggcattctcccgaggcctccaaatctctcgcattttggctggcggaaagaagcagaactgaggcgagtctaggagatggagttccatcacagtaaccacacagggtagacggaggcagaaattagctccaggttcgttgttggaggggggcatcatatggctgctaacatactgacactttcagaagtttcttagtcttgtagacacagggcagtttttcttaggcatttcccatgtatatctcatgctaatacactcttacctctgttactagattgtacgttgcttgtatagatagatacatgcccccacaacagttgcgacaaaacattacggtgcttttagaggcaaagatgaaacagatttttgtgcatgaagcaacaaaacagttcggt

SEQ ID NO: 8350 - DNA, 3044 bp, Triticum aestivum
  Clone ID: PAT_TA_8350
gcaaaatctgctgtggccttcgacccctccgcttcagatctgccggcaatggcggagtcgccggagcagttcaggggccagtcccgcctcccccgcttcgccgagcccctccgctacgacctcgtcctccgccccgacctcgccgcctgcaccttctccggctccgcgtccgccgccgtcgccgtgtcctcgcccacccgcctccccctcccctccgccccccggctccccgtcgcccgcccccccgtccccgtccacgctctccccgcgcccgcccccccccgaggctggcccgccgatctcttgtctgctgctccgcttcccgtcgcggcgcgcggttgcgttccacgtctgggcgccctccgtcggggccctgctcgaggaggatgatatcctggtcctcgggttcgaccgggagctgcccctcggcgagggcgtgctcgccatggtgccctccgcgacccccgacgtgccgaggccgggatgctgggaattcggcgtttccatatcttcttagaagaccgaaaaactccccttctacctccagacaatagaaaggcagcataccttgctgtgatgcggaccgtgagtacctcaaacaggaccggttatgatgttctcctgaaaatctacaaggaaacgtcaggaagcacaggagaagtctcagtatcttaggctcgttgtcttcatgcccatgacaaggatattgtctttgaggcattgaaactttctgctcgacagacgtgggggcggattcaagaacctttttatctccttggtggatattaccttagttcgtcgggatgctccagggggctggcttaaacgataactgggagccacattgtttagacttgggcatcaagctcaatccatagcggacttcgttacttctaaccttccaccgttcaccgctgagggagaaatctcctgaggttcccgagttctttgcgagaactatgggttggtcacttaccgagaatcagctttgctttatgatgagcaattatcgtcagcatccaacaaacaacaggtagcaatcaccgtggcccatgaattggctcaccaatggtttggcaatcttgtaaccatttaatggtggactcacgtgtggctaaacgagggttttgcttcatgggtgagttatttagctgtagaatccatttttcctgaatggaataactggacacaattccttgatgagacgacctctggcctcagactggatgcactcgcagagtctcatcctattgaggttgatgtaaaccatgccagtgaaatcgatgcgatttttgattccataagctacgacaagggagcttctgtcattcgcatgctacaaagctaccttggtgcagagcggtttcagaaagctttggcttcatacataaagaagtacgcatactcaaacgctaaaaccgaagacctatgggctgttcttgaggaggaaactggggagcctgtcaaggatctgatgactacatggactaagcaacaaggatatcctgttatatatgcaaaactaaatgggcaagatttggaactcgagcaggctcaatttctgtcagatggatcatctggtcctggcatgtggatcgttcctatgacagcatgctgtggctcgtacgatctgaataagaagtttctgttgaaaggcaagaccgatacgatgcatataaaagattttgcagccacccaaagtggccaaaatttttggatcaaactgaacattgatcaaactggattttatagagtgaagtatgatgatgaacttgcagctggacttgaaaatgcaataaaagccaagaaactctctttaatggatatgattggtattgtggaagattcttatgctctttctgttgcttgcaaacaaacactgacatcattgcttcgtttgctaaatgcttatcgtcatgagtctgattacactatactttcacatgtaacctctgtatgtttaagcgttaacagaatatcaactgatgctaatcctgacttgtctagcgatatcaaacaacttttgatcaagcttcttctgttagctgccaaaagagtaggctgggatcctaaggatagtgagagccatcttgatgtgatgcttagatcactgctcttgattgcccttgtcaagctcggacatgaagagactataaatgagggaattcggcgtttccatatcttcttagaagaccgaaaaactccccttctacctccagacaatagaaaggcagcataccttgctgtgatgcggaccgtgagtacctcaaacagagccggttatgatgttctcctgaaaatctacaaggaaacatctgaagcacaggagaagtctcgcatcttaggctcgttgtcttcatgcccagacaaggatattgttgttgaggcattgaaccttatgcttacagatgaggtacggaatcaagatgcattttatgtccttggtggtattagcttagaaggacgagaagctgcatgggcctggctgaaggataactgggatcacgtcgttaagacttggccatcaagctcactcatatcggacttcgttaattctaccgtttcaccgttcacctccgaggagaaagctgctgaggtttctgagttcttcgccactcgcgtgaaaccgtcattcgaaagagcgttgaagcagagccttgagagggtgcggatcagtgctagatggatcgacagcatcaagagcgaggccaaccttgcgcaaacggtgcagcagctgctgcttcaggagttttaagctgctcctttgtacgaagaagagattatgtgccatgactgcataataatgttttggaaaggctatattctaatgagtaacaacattaattttctgtggtgtggctttacggtaacgatagtctgctcgttaacgaaacgtttgttttctgtgaggtgtttgtttgggtttttccgaattagtagcaaataaatcaacgttatccttgtgtgaaacagatacatcttttgcatggcagaatggaaacgtcgaactgcaaaaaaaaaaaaaaaaaactcgagctcgtgcc

SEQ ID NO: 8351 - DNA, 869 bp, Triticum aestivum
  Clone ID: PAT_TA_8351
ccagtgtggtagaatcactcaaggaggagcatgaagcgattttgaagaaaagagagggggccggatactagcgcgatcacatggcacgaatacaagtccatggcattcactgctcaggtcacgaacgagatcgttcgccttagtaacgtggcccctggaatattcaggaaaacactaacagatgtgcaagcgaaaggctacacgatccccgccggttggctggtgatgatcagccccatatctgtcaatctgaacccagaactgtatgaagatcccttagcctttaatccatggaggtggcaggatgagtcgaagaagagcactctgctcaagaacttcatgccgttcggaggggggctaaggctttgcgtgggcgcagaattcagcagaattcagatcgcactcttccttcacaccttggtgacaaagtacagatggaaggagataaaaggaggcgaagtgcaacgcatatccgagatcgtgtttccgaagggctatcacatccaaataatccctagggaggaatcgataaactgatacaagaaagcagagcctactttctcgctagcaacttcatggacaatcttaattactccttcaatagcaggggattgacagagaaaatgtaatctctgccatcgcgtctccctaaaatgtagctttgcaacgtgtgtgagtacctcggcactaccgtggctatatgctcacagcctccacacaccatagtgtggagtttctaaactatgtgggtcatttcctctttttactaatatttaaaagaactgatgttacctagaacaaaaacctaaatactgttattgaggagtgtgtcacgtgtaagaaaattggctgtaattgctgccaggagt

SEQ ID NO: 8352 - DNA, 645 bp, Triticum aestivum
  unsure (1)..(645): unsure at all n locations
  Clone ID: PAT_TA_8352
gataaaacgggccggccgcctccctcggccccgacccgcacgccacgcgggactcacccacccaccctcttcctccccctccctcccatcttcctccctaggatgcgcgcctccccccgcctcctccggccggaaccctagccaggcgtgcaggcgcgcagcaggcggggcccccgcgccgcgccgatggggaggccggggtacctgacgctgcccatcttcgcggtgctcgccgcgatcggctacgtctactacaccacggtcttcgtcgccgtcgccggctggctcggcctcgccacggccgcccggggtcgccaacgccgccgccttcacggtcctcgccgccgcctgcctcgccaactacgccgccgccctctcccggggaccccggccgggtgccgcccgccttcctgcccgacgtcgagggcgccgagaccccgtcaacgaagtcaaccccgggggtggtgtgttgtgctattgccccacatgccccacgctacgcccctgcgcacacagtgccgtgtgggcaacatggttgcggaaaagggtcgtcaggtttttgaatctggctggttggcnngaatgaantcataaggtcanttggagtattaatgncaantanttacangttttaaatnttttttg

SEQ ID NO: 8353 - DNA, 1184 bp, Triticum aestivum
  Clone ID: PAT_TA_8353
cccacgcgtccgtggagatgatcgagcgctccgtgctccagcgctaccgcctcaagtccttccacgtcgtggcgcactccctcggctccgtcctcgccctcgcgctcgccgtcaagtaccccggcgccgtcaagtccctcacgctactcgccccgccgtaattcccggtgccggcggaggaggcgggggcggcgacgcagtacgtgatgcggcgggtggcggcgcggcgggtgtggcgcaatatcgatttcggggcgtccatggcctgctgcagcagcaacggccggccaggcctaggactcaccatctgcaggcaccaccgggtctggaacaggctcttcaggatcatctccaaatacatgatgcggacgttcctgcttttggcgttcatgtgccacacccattttctctcttttctccctggtaattaattaattaatgataaagtgtacttatgattaagcctaccaggacgtggtcgccggccagctcagctgcaaggtggcgctcttccacggccgcgacgacgagctgctccccgtggagtgcaccctcgccgtcggcgccagggtgccccgcgcccgcgtcaccgtctacgacaacaaggaccacatcaccatcgtcgtcggccaggagaagctcttcgccgccgagctcgaggccatctggcggagcgccgcccaggactagcctctgcctctctgcctctccctctctacctcaccacatgtacaaccctactactgctactactacttcaactacagcgatcaccagtcagcagcaacggtgcacaggaggaggaggaagagaggaggcgatcaatggcccgtgagaaaggttgcaataacgattaccctgcatgcaagagcagatgccagccctagtaggaggaggacgggacatggcagagcaactctggcaaatcttccaagaactataaatacatacagctgtatcattttcattttcttcttcttcttcttcgttttttctctcttttctccctggtaattaattaattaatgataaagtgtacttatgattaatttgtttgattggaccagcttggccaactatcgtcgtcgtcgtcaacagccacaccccacacaactgtaatataatactgtagtatatatatatatatactatgcaatggaatggaatggactctttcaaggccg

SEQ ID NO: 8354 - DNA, 632 bp, Triticum aestivum
  Clone ID: PAT_TA_8354
gcgcatgatgggtggcaaggcaaacatccccaaaccttgctgacagatcagagcagggcgatggaggtcgtgatacagaaactgatgctgaacagcacatactgatgattcaagtgagggtgctcacggagacttatggcctgcatgaacaccccttgagacaaatataacaagtgaggaagaagtaggtgaagccatactttagaggaaaattttgtggaaagatgaccaatacgcgatggagcgaaagtgccaaccagaaaggttatgttccggcaagctgccccatgcatctctttgtacggcaatacacgaggcttcttttcgaccgggaggccagcacaacctggccacagaggcgtgaccacgctcataaagctaggaaagagtccaaatgttcaaactgtggagttataggggctcatcggaagaacatctgcagcaaccctaaggttacgctgcatgttttggataatggactgcaaccgtgttagtgacctgattaacccatcaggtttcattgtcgtgtgcttgagcaacaattttttttccctatatgttgagggctcagtagcccgtgtgtagacctgaattatttattggtctattgataattataattgtagcacatg

SEQ ID NO: 8355 - DNA, 800 bp, Triticum aestivum
  unsure (1)..(800): unsure at all n locations
  Clone ID: PAT_TA_8355
ggggtggtatttgacagcggtagtacctacacctactttgcggcccaaccataccaagcaactgtttctgcccgcaaggctcgtctcggcgtctcactcgtcggtctccctcttggctggctgccgctgtgcgggttcgggccggtggcagtcgtctcggtcgctgtcgtctcgctcgtcttcaactctcgcttcttgtccgtcggcgagatccctcccgtggacttccccccggtcacctacctcgggaatgtgtgcttaggcatccttggtggtacggttgctgaacggaccgctcctcatcagtcgtgccacctcattgcaggctccgctgtgcaggttcggctgtgagtttgggccgctgggatggggccgcttggatggatccgtgggtcatgcagtagaagctctaagtctattatgtctaactttccatgatcatttatcagatccaaatcattaacctgtccgttcaaacactggctgcacctcaagcactatagggtgccatccaaataaaagtactgtgtgttgtagtgtattaacatgagcctgaggaaaatgaggcagaaaggagaggagaagagccatgcagatgtaggcagataaagttactgatatgtattctcctcctgttcataatgaaatgaagtctatattttaaaaaaaaaaaaaaaaaaaaaatctatcttcccgtgtgcaaagtatacggtgcttgcgtgcttcaaatgttgcaagaactgaaatgctgcacatagggggacgacttaaataaatcatacctgcacataccgangcta

SEQ ID NO: 8356 - DNA, 854 bp, Triticum aestivum
  unsure (1)..(854): unsure at all n locations
  Clone ID: PAT_TA_8356
gttgctgaacttgctacgatggcaggnaactgcaagccctgtgatccccacaggttatcctcatgtgtactttgcccatcccagtacacactttccccagggtccttcaaggcaaggtttcatgtatccacccattgggctcggccaagaatggaggcagaatgtgtacccttcgccgcatagtatccaacaaattcatgcaccacttcatgccaaatactccaaggcagtacagaaacaataggggacgaatgaccgggaatatgatgacttttccccacactgttaactatgtgtcacacgctcagacagctaaagatttcatgtccatgtcccggcagcaattcgctcatgcaaagtacattccacctgatgttatgagcaatggcctggccatccatcacggcggccctatttcgtcgctgaatgattcttttgccagcttgctggctgctgctccacctgaacaacaaagggatatgctcgggaataggatatatccactggtcgagagatatcatcctgatctggccagtaagatcactggaatgttgctggagctggatacttcttatttgctctcgatgctgaattcgcaggataccttgtctgcaaaagttaacgagtgtgtgcaagctctccaagggcagcaagcggcaaaaaataagcctgaggatctggaggccctacaccctggcttcctcgactctaccggtgtaaacgccaactgagagggttcacaaccaggccaagaaccttccattttcttttctggacagggatttttgggaactagatagccgttctttcttattttagtttgggagtttttaccgattggacttatggggcac

SEQ ID NO: 8357 - DNA, 657 bp, Triticum aestivum
  Clone ID: PAT_TA_8357
gccgaggtgagcagcctttgatacgccgtgcaaggcgcccaggagctgccttccagataaatcccgttgccaccgaccggaacgagctcgcttcggccccctcctctccccaactaacggcctctctgatcttgcagctactgcctcatcgccaacctacaacaacaaggaactacaaccgacgtgtgggtgcaactatggttttctggccgtccatgttgcacttttccgaatggcagaacccaggaagatccaagacaatccaactagggatatttcaacagtttgaaataaggaattggaactgcagcatcctgaaatacttgacaaactacaggaagaagcatcaaggacttgctccccatgaaacaactccacaatatcattgtcacatgctgttttatttgctatgagcatcggatccttgcggttgacccagacgaagtgactttagcaaagcttgccctttaccctacaggagttgttcatttttattgctcaacataccacttttgagactataagtgataatgatagtggttggtaagttgtatcgagtctcgccttacctgtccaccctaaaacgtgttatcagccaatgtgtaagtgtatatattgcaatgtaaagctcgttgtggtgtaagtatatacctgcaa

SEQ ID NO: 8358 - DNA, 756 bp, Triticum aestivum
  Clone ID: PAT_TA_8358
attcggcacgaggctggattctgtttatcatcactgatccttgatggccgggtgtttggtgggaagtcaaagtctggtcctgagaatgttgatactgatgaatttctttcatggttgtatgctggatctcctccagtaggagagcagctatcagagtggaactgtatgcttgttgataggacaagtcaggggatgcagattcttgatatgattgacaaggaggcatcttccttgaaaaacttttgtgaaatgaagcatgaacaattgaacattgaggagggtgtgcttgctgtgaataatattatacaagaggagcaacggctaagggaccgtgggggccggtattcatatcaaggatacgaggagctcctgaggaaccgtcaggaggagttgttggagaccagatttcgcagctctgagtacgatgcaatctcaaacgtcttgaaggaagttcgcacctcacactttggttatgatgaaggtttttctgggatgacctcgcgccagtgtgactttgatggggcagcaatagatgattggaggttgcatgactttatgcacccaagcgattcagttgtgccgacgattgttttgaggatgaaggaacacgtagctacggagcttggcaagatagacgctaggattatgcgaagtgtagctctgatgcagcaactggatctcaagcttgaacctgctgctttcgttgactatcgatcaattcttctccccctcctgaaatccttcttgcgaaaccat

SEQ ID NO: 8359 - DNA, 935 bp, Triticum aestivum
  Clone ID: PAT_TA_8359
ggaacacgaattttggttctcctgttatggaagctggaaatcttgagtttggtgaaaaggaatgcactaactatttgcaagagaaaagaagcctgaaacttggtgctggagatgcacatgctctttatcaatattttctccgtatgcagtcaaaagatccagcttttttccatgttatggatgtggctgaggatggacgattgagaaatgtcttttgggcagatgcaagaagtagggctgcatatgagtcttattgggatgtcatcacatttgacactacatacctaacaaacaagtatagaataccgctcgctacttttgttggcgtaaatcatcatggagaatctgttctattaggttgtggtcttctgtccaatgaagacactgagacttttgtttggctatttaaatcttggctatgttgtatgtcatgcaaaccaccaaatgctatagtcaccgaccaatgcaaaccaatgcagaatgctattgaagaagttttccctcaagctcggcatagatggtgtacatgtcatatcatgaagaagattcctgaaaatcttagtgggtatgaaaacattaaatcttcattgtcaaatgtggtgtatgattccttgaccaaacatggttttgacaaagcttgggtggagatgatcaataaatatgatcttcaggacaatgaatggcttgctggattatatgataataaaaatctatgggtaccagcatacgtaaaagatactttctgggcaggaatgtcttcaacaaaaaggagtgagagtgtaaatgctttctttgatggctatgtcaatgctagaacaactctgaagcaatttgtggagcagtatgaaaatgcactaagagaaaaggtagagaaagaaaacaaggctgattctaagtcattccaagagcaaattccatgcattactcactatgac

SEQ ID NO: 8360 - DNA, 1227 bp, Triticum aestivum
  Clone ID: PAT_TA_8360
agagcctcttcctaccaatcaacaggcctacagagaccatcacctatatgcccttgagaagtggctgcacaagaaccaagttcttcatcccaagggtccagtgcttggcttctgtaaggggcatcctgtttatcctagatcttgtgttcaaacactgcaatcaagacacggatggttgacggagggtctgcaagttagagaaaacgagtcgcctgcaaagattgtcatacgaccaaagaggattttcaactcccagtcgcgtgaatccaatagcaacgaagatgaacttcaggcaaccacggaattatatggtaaatggcaactcaaacccctgcaacttcctggtgctgtaaatggcattgttcctaagaatgagcgtggccaagttgatgtatggtcagagaagtgccttccacccggtaccgtacacttgagtaaaccaagaatattccaggttgcaaagaggcttggaatcgactatgctcctgccatgattggatttgattaccgaagcggtcggtgtgctccagtttatgacggaattgttgtatgtgccgaatttaaaaatgccattttggaggcgtacaaagaagaagaggaacggagacaggctgcggaaaggaagcaggaggaagctcaggctctgtctaggtggtatcagctgctctgttctattgtaacgagacaacggttgaaagagtcctacaacgcgcgctcagcagcgcttgcgccagagagaccagctaaagttgataatccccagaaaagcaccagtgatagtcgatgctccggagcgaccacgcccaataatcatccacgtgcggatcggctgccagatcctcgtttctctgctcatgaccatgagcatgagtttcctgaggaagaccagagcttcgacgaagagacgtttgtgcggacgaaacgctgcccgtgtggtttttccttccaagttgaggaattgtagtaacttgtactggaaatgtagtactaattcgactgcctagcgtagggagcctcttcatttgatcaaatttctcagtacaaaactttgctgcatttatttcatccactgagaaagaaagaaagaatttgaatgctcagcaaggggggaatgatgcagcagacatgaaacatgagtactttgcaaccagtatgagtagcaacaacaacaacaaatgacaaggtgtgcatcatagttatgcaaacccttgtgattgtatccaaaaa

SEQ ID NO: 8361 - DNA, 876 bp, Triticum aestivum
  Clone ID: PAT_TA_8361
ggctgcgacggcgtcggctgtggcgcggcggtactccatgcgagatggaggccggcggcgtgagaagaaggcagtcggtggtgtgatgccgccaacagcaggttgcggtgcgataccgctaggaggtcggtggcggtgtgaggccgctggtggctttgacggcgcgaagccgttatgaagagacgacgtggcgatcggcgtcaccaaggcgtcatccatgtcaagaggtggtcgccgggtgcggcaagaggacgtgatgatgggcgcttgacgccgtcgaccacgataagatggtgcgtggttgtgaccggcgctgcgatggcgtcgtccataataagatggagtgcggtggtctgcggcgctgcgatggcgtcgacaagaagctgcgggtgatccgcgtcgaagacctgacatcaaagattaggggggtgaatgttagaactaatcttgatgttttgtatctgcatattggttttaagttttgcatatagtgtagatggtctagagtagctagtccggtgttgcttcgacgaaggcgtaccaagaaggcgagatgccgaactaccgtgcgatgcggcgagcacggcaagatgccgacggcagtgtgaagctgcggtgttacgtgaggcagcaaagtcgtgtgatgcgacaagagcatggacggcaaagcgaaccggctggttggatggactagttagatgcatggaagtggttagctagcttcatgggtgagtttgttagtggccggttgtgatggccgggtcatgcgtgtgtacgtgcttgtggccggtgaacgtgctagtgggttagtgcatggatggattagtagcgtgagtggtgggtcagcttgttgctgagctgcgtgtgtatataaag

SEQ ID NO: 8362 - DNA, 1275 bp, Triticum aestivum
  unsure (1)..(1275): unsure at all n locations
  Clone ID: PAT_TA_8362
ggcggcatggnagctaatttgactcctaaagccgtaagagggttccttggatggtcaataaggggatgatgccaattagtctggattctggaacaatgctaacattcaaatccttgaacttgttggtgcatctgtgctttgagaaaaaaacagttaggtatgcttctcagttctcactacctccgcgtgaaaaccaaaattacaaatctttatttcttatttccaactatattttgtggctgcttggacaatatttccgttgctaacttccttccgttgaatgacttgccaatggtctttcacaatttatagccttttactttatttttgtaactgatatcctttaaattcagtttgttttaaaggttcaccatgtttctttaacaaaatttatccagtgaattggtatgtctgctccactgggcagcagctgcaacctttcaactttggctcttgcaccattgtttcatatgtgtatgctctattttcctgtccagtcatttggtctttatattcagcttgtgtttgtcaagagcttattcggtcaaaggttataagagatatgacattgccgctgttgtgctaagggatacggggtcatgaaaaatcagggtttgttcgtgtttcccaccaattgttttgttatacaccctgttcttactacgtgcatgggacagcccccccagctggctaacccctttctcttctgcttgcccccgacccctgggtgctagtttctgatgtccaatcccttgccgcctcggctgccctgcttttcctttcactcatttttaccttccctttgtttctccttcacttgggtctgctcgggtggctgttcagccttgccccccacctccggtgaatgggcatcccttccctccctcacttgccctactgtaaccaatgctaatttctcttgccatntaaattgctccataacacctagttcgtttatatctaggagttcacattggggtttgtaaaccgatagtcttttttaatcaaaacggccatgcaggtttggagcaagctccaaagtaggctggggaggatgcccaatggttatacttgatgctggtccaaagccatattttttgtgcaggtcctagcgagctcatcgcccacgtaaaatattccttgatggtggtccatattttttgtgcatatttagctcagtattcggccaaacactttaacttgtatatcgtaagaaagaaaatgtacaattttttactgagaagcagtaaatctcttgattactaaaaaaaaaaa

SEQ ID NO: 8363 - DNA, 606 bp, Triticum aestivum
  Clone ID: PAT_TA_8363
gccgggcagcgcgatgtcggacgcgagcgaggggagagcgatccggcggcacgagaatggctccatcggcagctccagcaacttctccttcgccttcccaatactggcggagccgtcgacggggacgaaggagagcatgggcggctaccagcagctgcagaaggagcacgagcagtcgccgccgacgccctcgaaccgcaggtcgcagttcgaggagatgacgacggaggagcggcggccgcagaaggccgggtggtgctggtgcggggagtgctgcggctgctgctggttcgcctgctcatggccctcctgctgctgccaatggcggtggcggtgctgctcctgctcgttgctcctgtccgacctgctgccagtgcagcagctggtgcctctgagaggagctacactagaaatggcgggaaaagaacacagagctgatctttcaaaaaaaccataggtgttgtgaagggaacagtagatgagtagggaaccagcggggtaagaaggattcagagatgcagtgtagtacattgttgacagggaattcaaagtgcagacatgtactgttttgttaggacaaagcaaaaggattcagaaaccatttag

SEQ ID NO: 8364 - DNA, 626 bp, Triticum aestivum
  Clone ID: PAT_TA_8364
ggaggacgatagtgatgaggaggatgtggatgaatatgatggtgatgatgaagatgatgacgatttggatttggaagattttgagtctgatgatgaagagggtgcggggaaatccggcggagatataaggtatgaggatttttttgaggaaagctgtaagcaacaagtcaagaagagaaatggtttcacaaagaaagtccacttcaaggatgaattgcatgaaatggaagtggataacattgagaaggatgatgtaaatgatggtccagcactagaggatgaacaaggtctttcaactcatgaaaaggggctcttgaagatgcgtaaccaaatagacataatggagaaagctagtcttgaacccagtaaatggatcatgcagggagaggttgatgcttccaggaggcccaaaaatagtgccctcggtggggagcttgaggttgcatctagcttgggcatagcatagccggcggggacctccaggcggcggggcaccttcgtttcgtcgctctctcctctgcttcctggaggtccaagtcgtcctctccttcctcgctcgccggtcaagatctccacttcgcactcgcgggcatcctcgggagagcaaactagaagaagaagaagga

SEQ ID NO: 8365 - DNA, 830 bp, Triticum aestivum
  unsure (1)..(830): unsure at all n locations
  Clone ID: PAT_TA_8365
gctgcaccggtggacttgtatgacagtgatatcaacttctcggttatgcgggcagatgatggagggcttggtttcctatttgtatcaaagttcagtgttcaattgtggaagacgaaggtcatttgtgactgttttaattcgtgggtgctgggaagaacaattgaaatggacaagctatttctgctggattcaaaggtgagagagtctccaatgatagtaggatttgctgaggagaataatgtggctctcatgtggacagaaggcagtctcttcatgttccagcttgagtcgttgcagctcaagaagctcgtggaaaccagaatctcttttctatcaaccattcgaaagtgtctatactgcagaaacaagcattggtggtggacatgatggagctgatatcttgcacagcacataagaagattttccggttaggtatgctatgtgatgtactggttgagtaggtatctacatttccattctggtggctgagatgcagaaatggtctgtcgagtatagttccttctatctgtatgctcgacatggaaaactcaacctctatctagcagcatacagtgttcagctctgaagtgaacttgcttgcattttagtttgtgcatgcgtttgattaccttccgtgttgtatcagcatcgcgggatttcaatgttgtactttgtgcgtgtgtttgcttgaatctgtacctggttttgagcttggtaagcttactttggttagttgtgactaatgaatgttgaatcccatcactgtgacctggagatggaagttgctcatgtatgctggaatgcaactgacctactgtcttgccnttgcg

SEQ ID NO: 8366 - DNA, 660 bp, Triticum aestivum
  Clone ID: PAT_TA_8366
gctctctcgtcccctccctggtgctccgccgccgccttctttctcaccaaatctaccccgtcccatcgtcctcatccacggccatcgagtgaaggagcctgagcaggtgagggggtggctctgggagtcgatggtgtctccagagcggtcgagaggcgttgggtcgaaggcgtcgtgcctcggtggccgggattgggcaagtcagatgggaagcaacgatgccggaaattgttcgctgcgcctccaccttgtccccggcccttctacgagcactttctcttgtccacgggagccccctttccaccgagctccagatccatgacactagcagcgaggtgagcagcggcaaaggctaccacctagcaactcctctttcctcctctttcatcctctccaacccgtctggaggtttccccactcgtcgtcgctgctgctgtttggcttcttactgggttgccgctgttctggtgatagtagtttagttttccttttattttgtattgtttctccatactacaaaattgcaacttgtgtttctttggaagcaatattttcatcatatatcaatttagataggctacatggggaccttttgttctgaccagagttgatgatttgtcttaggatacagttgatgatgtagttgaagatgaatggttc

SEQ ID NO: 8367 - DNA, 1128 bp, Triticum aestivum
  unsure (1)..(1128): unsure at all n locations
  Clone ID: PAT_TA_8367
gtgatngatgcttaggttcggacttacgtatgtactactttcgtggcatgtgtaatctgcttcgcatcaccttatcctttcaactcggctacttggttgtattaactggaagtaccaatgctccaaatggtctaattgtcgagcaaacacctttcgtacgatttagagtgtctctatatgttggcaattctatactatgttggttcaaatctggtaattaatactcgcttttacaaatgtgtggtaattattactcaaatagtctttggccttagttggttctaaatcagtcacatgcccattgtttcaatactcggctcgctctcactttttgcgccattggcgcaacgggtttatttgctggcagcttattgttccattggcaaatgtttcttttccttctcttcataaatcagggataagcttattgtcttggttatatgacccgaagtggaatgaagcgtgcatctcttctatcaacacaatggtggaaatcaaatttatttattttaaatctacgagaagaagatgacccgagatcgacatataggtcagtgtgggtagcaactctagagggacgaaagtgatggtcgctgctcctcctgtcgaacagggcaatggctttgctcgcctactataagttgctgtcagcgatttgtttcctgggatctatcttatgtgtggctgtgtgcagcctgtaggtcctttgtcctctttgagagacgtcacatactcaaggaaggctggactataatgggaaacattggtgtttctaagacagatgttctgtgtttgagatcttgccttggtggctggatgccttggtacaagacattcaagcttggaagtaagagtagcctttccgatatcaacggcctatgttgaataatattgttacaacaatgaaaacaacttgcaaaggtggagatggagagaaagttgttgatgctcaagccatgcgatgaagtatgtagcaagaagagacgaatgatgaaactgtaaggcttattcttaggttgtatctgttgtggcatcgaccttagtttttttactgctgctgatgttggccatttgatgaataattgatgaatgctcgattgtttagagtnaatctanaatataccagta

SEQ ID NO: 8368 - DNA, 477 bp, Triticum aestivum
  Clone ID: PAT_TA_8368
acgggcgatttttgccccgcccccggcgtcggcgcgggccaggacgcggccctgcgggcggccttggagggcgacctccagcgtctcagaggtactgtaaagagtcttgtcgacccaagggtggtcttctctttcgaaatgggtgaccttggtgtgctgcacctcgcagccggcagagggcatcttgaagtttgcaagtacttggtggaggaactggggggagacgtgaatgctcctgctcctggagttggagactttgcaggtgtgacaccctttatgacatctgctcagtccggcgatgttttgaccgtgaagtatttgcttgattgtggtggtgatgtaactaaagcagatagtaaaggacgcacagttctccaccatgcggcatgcaaagcctaataccactgtaaccggtttgggtactgccctgatgggtgctcttttgtaccgttcattgaaatgcatgaagctgctgat

SEQ ID NO: 8369 - DNA, 722 bp, Triticum aestivum
  Clone ID: PAT_TA_8369
aaagaaagaagcagcggatagcattcgggtagttagagcttgcaatgcatagatggtctggccagttcagtcgcccattcctttttggtttattgaacgatgggacatttttgtgctaccatgcttattgctatgaaggcttggagagtaatgtgaaagacaattcattttcacctgctggttctgtggatcttgccagtgccagtgattcaagactaaaaaatttgagatttcgccgaatttctgttgacattacattacgagaagacatatcaagtcttgcacgaccgagaatcacaattattaacaatgttggaggttatgagggattgtttcttagtggcacgaggccagtctgggttatggtttgtcgacaacgatttcgggtgcatccacagttatgtgatggtcccattgaagcctttactgttctccacaatgtaaactgttgtcatgggcttatatatgttacatcacagggttttctgaagatatgtcaactgcccgaagcatataactatgacaactactggcctgtccaaaagatccctttgcatggtacccctcatcaggttacatattatgccgagcagtctctgtatccacttatcgtgtctgttcctgttgttcgccccctaaatcaagttctgtcaattatggctgatcaagatttggttcatcacatggattatgatgctacaagtgccgatgacctgcaaaaa

SEQ ID NO: 8370 - DNA, 617 bp, Triticum aestivum
  Clone ID: PAT_TA_8370
gttccgctcgtgcaaccctcctgcgggcctgctcgcgtccccgccgcttttggggcttcgcgcaccgccgccgcttcggcctccacgggcgccgccgtcgctgcggccgacgcttcggcgggggtccggccgggcgcggcggcgtcggcgccccggcccgccgcggcggcttcggcgccggggcgcgctgccgtccccttcgcgctgtggcttggcgccgcccccgtcttcctcttccccggccgcgctgccgccttcgtcctccccgcgcgcctccccgccttggtccctcccgcgcggctccccttcgggtgcgcgcctgtcagcgccacgttcggatgcgggcgcgccgccgcctgcttcccctgcactctcccggccgtcgacttccccgcctctgtgcccgtggcggcctacgtggctggtgatcccccgcccgccgccgggcccctgggcttctgggtccctgctcccccattgcgctctcgcccgctgccggtgctcgagttcttcgcttggtgcgcgccgttctgctcgcctctcctgcggcatttgcggtcctggcttatgagccgcactgcgctatgcccttgggcttgtgggtccttgcagcccca

SEQ ID NO: 8371 - DNA, 1214 bp, Triticum aestivum
  unsure (1)..(1214): unsure at all n locations
  Clone ID: PAT_TA_8371
cgacccccggcctctgcgcctctcgccggagaccggccgacgccgatgccggcaacgtcggcgatcccgttcggctcgccttcctcctctttccactccgctcccctccttctttctccgccctcttttcagcagcgaccacccatgttcgccccgatccatggccctctccttccgcccagtttgggtccgtcgccggtgtccatggggcgagcgccgtgcctcctcctcaagctcatcttttcgtgccgccccgcctgcactacccacccgcgcctcccaagacctcacggccgccttctgccaagctgcgaggtcgatggctgaccaccgccacgaccggcctcaaccttttgcacgccatgggcggcggccatggaggctgcacctcaggccactcgctttccgccagccagtaactccgccaacttctcattcatctagatcaggggcgcgacaccaactactcgacctgagtccagacacggctacctgggggcatccgataaattcacgcctcgcacgcgccgccgccctctgccctcaccgcatcgccggagccgctgccaaaatcgatcccggacgtcactatgaatccatcgacaccccggctccgttgctcatgtgggaactccatcgctgccccgttgttcgcgttgctggtgctcgtcccgctgctgatgccggcgccccctgatcatgctggccggatcctccagcatgaaccttcgctccagtccccacacgaagccattccggcgtcgtcgaccacttgggcctgtcgccgcccccagacacttgatgtgtggccgcccgtcaaccaccctttgtgcgtcactgccccaagtcacctgtgccccgtccgccctgctgctgagccatccttgtaccgttgcacgcatcttcgcaccacccggacagcctctggtgcgcacctctgcttttactagccgcgaaccacgcgcatcacctgtttggtgttgtgcctacgagcgtgttggagaaatctgtgtccagagggtggagaagattgatgcggagaggaagacgatggcgacggcgagcctgtgtactccagcctgttggatttatcacagatgccccactgatttggcttgatgtacaatgtcagattcaagaaaaaagtgttttctagtatgttctagtactacatatcacaagacnctgcgttgtatggagcggaacagaaccaa

SEQ ID NO: 8372 - DNA, 898 bp, Triticum aestivum
  Clone ID: PAT_TA_8372
ggttaaggatggcctgttcccacttcagtcaaagaagtgcgttccttcctagggctggcaggatattatagacggtttgtgcgccaatttggcactattgcacgacctcttacagatttgcttcgcaaaaacactcctttccaatggacagccgctacacgagaagcttttgaagcattgaaaactgctttagtaacagcaccaacactagctttaccagattttaccaaaccccttcatcattgagacggatgcatgtgagtatggagttggggcagtcttacagcaggaggggcatccccatcgcatatttgagcaaagccttgggaccaagaactaaaggtctgtctacctatgaaaaagagtatctagcaatggtgcttgactactagaaaaagggctatagatgggattgacactaatggcgcaccagacaactggtgcgtcattagtatatactaatggcgcaccaccttctgatgcgccattagagttgaaactactaatggcgcacctggcacatggtgcgccattagtatcaatttttttttgaactagtgcgtctgtccaaacatactaatgggcatccacagggtagtgcgccattactagttgtaactagtaatggcgcaccctgccagagagtgcgccactaatgggggtttttttattatttttttattcctttttttgcaaaactactaatggcgcactcgcaccgccggggcgccattactagtttaaactagtaatggcgcaccgggggggtagtgcgccattagtatggttttttttgcaaaactattaatggcgcaccacctggggtgccattagtaacctggattactaatggcgcatttgtggtgggtgcgccattagtaaggggcagcaacaagat

SEQ ID NO: 8373 - DNA, 893 bp, Triticum aestivum
  Clone ID: PAT_TA_8373
gcaaaggtggacatggtggtgctgctaggctcttttttctggagagacagagactgaccgctaaagcctgacttcaactgtcgtcagagccaatgacggcggcacctgcaagtgtccttacattgttgaaggtgccgacgtgtagtcctcggctttcctcccagaaaacttcaagggaaaccctaggtcgaggtcttcccagatcagatgatggcggcgctcggggtcgtgtccccgtggggggcatcatcttgaagttgggcctagctgccaagactagtggttggtggtagttcgttggttgcttgtgtaccggtgggtagcgatgatccgttgttgcggtgtggccttgcgaacatggcgtgaggtggcagtgccagggattcttatcagcggtgcagatgaccgggtcatgttcgacgatattaacggcttgctgcagccatggcggtgcagtgtaggcccatggtgtattgtctggggccagtggtcatgccaagatttaccatcgacaaacacttgcatcggaggcgtgcgatcgttggagcgtctcaatgagattttggcggtaccgtctcttctcgccatttgagctgcgacttggcgtcaccctagcgtcaacagaggttctggtttcgcggagcgtccttggtggatagggtgcttgcatagtgtgtgtgggtgtttagtccatgtggttgtgtccacgtccggattacaagcgcttgtattatggctcaacaccttctcggtgtggattactgttgctccttttttttctatctgccttgacatagctttggtcttgtatgactttgctagttgttggtgtgatttttttgtgcgttcatgttgactatgtgtgcatcctaactatgcagatgccgggtgtg

SEQ ID NO: 8374 - DNA, 1080 bp, Triticum aestivum
  unsure (1)..(1080): unsure at all n locations
  Clone ID: PAT_TA_8374
gcacgaggccaagctcctggcctcatgtcgcgaggaaagctctagccaccgcagactattcttccctcccaccatcctctccttcatccttggaggattctgagaaaacagaccggtcgtgtattagttttccccccaatcacagcgcgctctcgcccttcacctctcctccctctcggggagggagggacacagaggcacgaagtggcgcagagtagacgcttgtagaacagccaatttacctccaccagcttgctgctgctcttgtgcacaggaatccgataggatggagaggaagtccgccattctcatgaaccggtacgagcttggtcgtatgctcgggcaaggcaccttcgccaaggtgtaccatgcgcggagccttgcgaccaaccagagcgtcgccatcaaggtcattgacaaggacaaggtgctgcgtgtcggcatgattgaccagatcaagcgggagatctccatcatgcgcctggttcgtcacccaaacatcgtccagctgcacgaggtcatggccagcaagagcaagatatactttgccatggagtatgtccggggcggcgagctctttgccagggtggccaagggccggctcaaggaagatgctgcaaggaagtactttcaacagttgataggggctgtggacttctgccacagccgtgatgtctatcaccgggacctcaagccggagaacctcctcgtggatgagcatggaaacctcaaggggtccgactccgggttgagtgccctcaaggagtgtcagaagcaagacgggctgctgcacacaacgtgcggcacacctgcatatgttgcgccggagataatcaacaagaagggctatgatggagaaaaggcagacatatggtcttgcggtgtcatactttttgttctgcttgctggctacctcccattccaagactcaaatttgatggagatgtaccggaagatcagcaaaggtgatgtcaggtatccacagtnnnnncagttctgatgcccggangannctatccaggctgctcganncaaatccaaacacnnnnntcaccatggacaagctcattgagcanccnn

SEQ ID NO: 8375 - DNA, 465 bp, Triticum aestivum
  unsure (1)..(465): unsure at all n locations
  Clone ID: PAT_TA_8375
aggaattcggcacgaggccgccccgccagtccggctccagcaagccccgtcaggcagccagaggcggcggcggtgacgtgggcaagtcgctcgactacctgtaccgcgcgtgcaggatcgctcgccgtgaagcacatcgacatcgccgtctccgtcctctccctcttcatggagcccaagaagctcgcgccagcctcgccgagtgacgcgtacgtgagtcatcttgctctgttatgtttctagccatggaggatttactgctagtagtgcgtagtcgtttggatgagtgatttgggtagtcgtttagttcaatagaggttcagatgagagatgagcactgtgttactgtacttnctgattgcattatgtggcaccgaattgttgttgcctagncttacccagtnacgnacttgnaatgaattttggtgcgaatttggttgatcttcttgtgctcaaaaaaaaaaa

SEQ ID NO: 8376 - DNA, 1265 bp, Triticum aestivum
  unsure (1)..(1265): unsure at all n locations
  Clone ID: PAT_TA_8376
gtgtagggaacccccctgcacaatgtgcttggctctgatggtctgggtatcgttgcgtgaccagatttgcaagcaagctcattgataggagatcagggactcgggcgaaagctccgtgaccttcttagaggcatagtcgtagacatcttcctatcctttcatgtgcttgggttctccgggtgagaacctaaactctagttttctggagtgggtggcggcggcgtttacgtcgtaaccatcttcagaggcgttgccttggagggccagcctttggatgccgtgtggggctctttcattttcaagggcggtgtatgtcggggctgcggctctgggatcttctattaagtgtcgaggctgcggcctcgggcagtactgcgacgacagctccaagaggtagggctgcttgtcggcatggcttgggcgaggaccttgaagtgcggaagcagcaaggttgtcagctccgtcaatgcgccccagtcgggactgttggacgacatgttggggcagcggcccaggatgtggtgcagcgttcgtggtctatgtgcggttggcctgagcagcgtgagctgcgggtagctgtatcgtccggcgtagtgccggccaggttgtcgctcatccaggttgccgaccgggaagaggtgtagtgccggccaagacgagaacaaggggaagctgcttggttgtctgtgttcatcaaaggtgctctctcttttccatctttctttttatttacttaatcctagatgggtgactactaatttccatgtctactgggaggaagaaggttggcggacgtatctttgtgactatgtcattcacgtgctttgtttcaactcataaagtggatcctttttaagctatatcaaatcataagacataattttcagttgatttttttttctaattcccagtttattgcttcacatagactattacatatttatgctagccaattcgaagctttgtcccaagggcaagcataccgttgaaaaaataaatacatgtacgacagatcagccaacaacttgttgatctgtgattctttgaaatttgatgttataactgtttataagtcagtattgttcagagcaaagataagaacaatctatttggtaagtgaacacttcagatcaggagagtagaatcttagggcttggatattgaactcagaagcttcngcagttgtangcnatataagngggacttgctacataatgatacaagatgtccgagtgtttncactagcagttcaggccatgatcgca

SEQ ID NO: 8377 - DNA, 1017 bp, Triticum aestivum
  unsure (1)..(1017): unsure at all n locations
  Clone ID: PAT_TA_8377
gctccgaagaagctggtctacagcttcgtggggcgcggcaccacggtgctggccgaccacgccgaggcctccggcaacttcgcctccgtggccgcgcagtgcctccagaagctcccgcccaacaacaaccggctcagctacaactgcgacggccacaccttcaactaccacatccacgatggattcacatattgtgttgttgctaccgagtctgctggtcggcaacttccaatcggcttcattgagagggttaaggaggatttcgccaagaaatacagcggaggaaaagccaaaactgctggtcccaatagcctcaaacgagaatttgggcctaagcttaaagaacacatgaagtactgtgacctgcaccctgaggaaattgacaagcttgcaaaagtgaaggctcaggtttcagaggtgaagggagtgatgatgcaaaacatcgaaaaggtactagatcgtggtgagaaaatcgaactgcttgtcgataagacagaggatctccgctcacaggcacaagatttcaagaagcaaggaacaaagatacggcagaagatgtggtgggagaacatgaagataaagctcatcgcttttggcatcattgtcttgctgatcctctgcatcatcttgacagtttgccgcgacttcaaatgctggtgatgtgactggagagtgcactgctcatctcaccccactgttttaactactgctatagccttcagtttgatgtcgcattgccgaagagaagaacgcaggaaaggaaataagggggaaattgaagggcatgctgctgcaacatatgtagagagcgctgtttccgagaaaacaaccacatagagagtgcgtcaccatcaaccgcgtcgtggtgctagaatccgtcagtgatattatagtttccgctgatcgcattctttaatttagttatatatatnctaggtncccaaggctcgcaatatataacagagtcaatgcccaagtatttattttgncattgttgtaatactagtataatgttgc

SEQ ID NO: 8378 - DNA, 638 bp, Triticum aestivum
  unsure (1)..(638): unsure at all n locations
  Clone ID: PAT_TA_8378
ggtgcaactaacgtggacgtgctctgcgcggagatgcagcggtccccttcgcccattttgccaaggccggaaagtcgagctccagccaccaagggtggcaaaccagcgaagaaaaggaaactggacgtggcaccggcgcggaggagtgcaaggattgcgaagcatgcgaccaccaaacagcaacaagtcctcattcgtaagttgtgtctcgcgcatgagggggaggtgatctctgaggaagcccttcggatgtacgtcgacttattctcccgccccctctcggacgcacacattggcgccgtgttggcgttgtttggttgggagtcgccggctatgccgctcatggaggaggcaccggatgctgcggcgtagctcgcccatgtgaggttgggtggcttggtagtgtgttttcaatgaatgcacaacccctcaatgtgatcgtgtggaatgtccggggcctaaacgctccagctcgtaggaacgcagtgtatcaagtggttgcgtcggtgaatccggccattgtgtgcgtgcaagaaactaagttacaagatgtatccctgtccgttgtacaacagtgccttggtaataaatttgggcagtttttnctatttgccggcggctggactcgngaggaatnc

SEQ ID NO: 8379 - DNA, 166 bp, Triticum aestivum
  unsure (1)..(166): unsure at all n locations
  Clone ID: PAT_TA_8379
ggaacctggctttttcgtctcttattccaatatattttaatgaaggcaattnccagtgggataactgcatttcgtgttactggatnccgccggtacagaattttattagctgtttnccagcaatatcactttcacaaatttagggtacatttttagaaaaaaaaaa

SEQ ID NO: 8380 - DNA, 751 bp, Triticum aestivum
  unsure (1)..(751): unsure at all n locations
  Clone ID: PAT_TA_8380
ccgagacacatggtaacggtggtgaacaactggcgatcaggggttaccagctagccacaggtgttcgagcttgtgcgtgtggtgcgaggcgaggatggcgagctgccggagcagcgcggccgtcgctgccgccttcgtgctggtggccgtcgggtgcggcgtggtggagagccggcgcgtggcctgcggcgcccggggcattgacctgggcggcggggagggcgccgggctcggcctcggccttggtctcggcgttggggcgggcacgggaggggtgtccgcgtccggatcaggttctggctccggctccgtggctggagcgggctcgacctctgagtcgagatccggctcggtttctgttggaggtgccagctcgtctgctgggtcaagcgctgggtccaacgccggatcggccgggtcaggggcggggtcttccgccggttcgggggcgggttacggtggcgggcagggctatggcggtggaggtggcggtggttctggttccgggtctgggtatggcgagggcggagggtatggtcggggaggatcggggaatggatcgggcttcgggtttggggagggccgtggttttgggtctggttcagctggaaacccttgattcgttgccatatnctttgttaccgctgtnctaaaacaaaggtatncttgttactgtatgacactattactcgagtgctctgagtgggagatgaaataaaaagaggaaaactgtttgagcctaaaaaaaaaa

SEQ ID NO: 8381 - DNA, 1150 bp, Triticum aestivum
  unsure (1)..(1150): unsure at all n locations
  Clone ID: PAT_TA_8381
gaggcggttctttgatctgagtgactcccgcatcttcgaggacgacgactacgaccgcgaaggcgatcgtcaactcctttacgccggcctgatctgcgatgacgaaaaccccgcgagctttggcatcttctgtcttgctgcccatggagagttcaggttgcgggctgcggtcttcttctcattcttgggaatgggcggcgattggttcctctccccatggttggatgtcccgcaccatcccaacccccacccggaaggtgacgaagatgacgaagatgacgatggtgacgaaggtgatcttgtgcttgagagcggcatgcgagtgggtaatttcatctactggcctcaccaggatcgtgcgtatgtggttgtcttggaccccgacccaaacaacccgcgattgtttgttgagatgatcccccctctcctgaatctggaaggttttcgcagctcgatccttggccaaattaacggcgataacatgtgcattgcttattcaaatggattcaacatcggtttcatgctgcgtcaagaagatggccttgatgctggggcatgggctaacagcagggtattcaacctgactgatcaagttcgacggaagcttgggtacttaccccagaatgggctgaaaattgcggcaatgcggggtagcatagtgtacttcacaacatcacagatgttccatccgctcgacgccacttgttggttcgcttgtctgtgcttggaaagtcgcaggctggagtggttgtttccgaggacgtataatggtctcttccaaccataccaccattcatcgtggagtacttttctgttaccagagaatgaaagattttatcccttcatatgaggaatgatgacaaccagagaaggatattctgtgaaaagcattgccttgttctcctactgaatcaaaacatccagctaccatccagaactgatctcttctttggacctgcatcacgctgaaggtcctgacgaagttncctcgatattcaggattcaatggctagtcaatcctgcattttgatcgtttatggtaatcgttgttgtnctgctgttaccaaacttaccatttacattgtgggtggattacttcatctgttcccttgacattncaggattncagtgataactcaatcctggtgta

SEQ ID NO: 8382 - DNA, 1042 bp, Triticum aestivum
  unsure (1)..(1042): unsure at all n locations
  Clone ID: PAT_TA_8382
aggaattcggcacgagggtgtgttgccgagcgaccgggtgtgccagccagtgtgaggggcctagaagatgtagtctccgtcgggaccgtgatgtgtgtccggtcgacgtgagagttcttcccggttgtgccgcgtggatgcgtgtgtacctcatgtgtgtgttcgagtcgtagagagaaacaaagccaagatataggcgttggtgcgcctcgccggaaaaatcatggtgtctccttcgtctaccttcatccggcgtttgtggcgccaaaaggctgcccggcgtgtgtcgccggggaggattggtccggggtttgtcccaacagccgcgcctccggctgttgtaagtcgttgaccgccgtctcaagctgagtgcggctgtagctgacccgtcggccctgcccttgatttctaccgtgcgtggctgcggactaaaagcaagatttattattgagatggatgagatggtgaagaattttgtaagctgtactactacttaccaagtccgagcctcaactactacttaccagcaaaattctaaggaagtatgactattgtatatacatggaggaagcacaatcactatacatacatgcatgaactcccgacttactgcaagctgcggactgcttctcctgcgagccaccgctccacatgcagccatcctggctcgcccttgttatacttttgccacaccctccgccggctccagtccgccttatcgtcccaccttcgcctgggcttggttctgctgtactccgtgccttgccccgcgttgttcctgcaagctcctctgccatatgaagaaaaacaacagcagcacaggaaaagaagggagcactgcatgtataaaaaaatcagtcatgaagtgtgtggagctactgactcggaagtgcgagagtcgtcggggccacgttgagcctcctctaccgtgttgagtcgtcgggagtcgctggtctgcctgaactgctgggactatattaagtcgccggtnctgcctgagccgcnnctgtcgcgattgtnccgtcgnccgaaagaancaggt

SEQ ID NO: 8383 - DNA, 749 bp, Triticum aestivum
  unsure (1)..(749): unsure at all n locations
  Clone ID: PAT_TA_8383
ggtctctcgctcgcgtgatgtgggcgcaagaggcctgcctgaggatccgtgggcaaggcgtttcaagccacgcgattctgctatgaatcgtcgtggtgatggggttggtgcttctgatggtgaatcgggtactgatacggttcaaggggcggttccgaagcatggaagagaagtggtcangttgcgttggaggaaatcttgttgacaaaacctcagaagaagtctctggtcaaaactttcctgaagatgaggttcattccgctgctcagccaagcaaatcgtgcaagaaaaggaggcctgcctcttccactgctgcaggttctttcatctcgatgctcggcgacaagcggtggtgaaggcctgcgtatgtgttctagaaattcttgctgaagcagttgtgataggtgactggtgcggctgctaatctttttaactcgtctgatagctctcgattggcctgtcctttcggcgtgaagggaagacaattcattggtgatttgtgtctagtatcctctctgcagagcatcaggctcaagtttgcagatctgcgagagtggaggtgtgatgtgatgccttgtggtggtgtatttcttcagcatctgctgtctgcaagcgaatcaacggttgcttgccacggcaaaaatgtattgggagagtttatactttatactacatgacttttcatgtcacatggatgcaataaactggttgctccttgaaaaaaaaaacctgcccgggcggccgctcga

SEQ ID NO: 8384 - DNA, 1093 bp, Triticum aestivum
  Clone ID: PAT_TA_8384
ccacgcggccgctgcgtcggcacgcccctcaggacacgcggtgtcaccctccggagcgtcggccgtgtcgactcttcgctcaggagtattgatgcatatgttgaggttgaagatgataaaattattgcgcccggcctggcattggttgaggtgaatcaatctgggctcataatggagacaatgattgacattacaccaaaagatccactcccgacaccttcagttggtccacttgacgcagactgttccaaagaaggcttaatcctttgtgacaaagagagaatgaaaggacaccaaggagtaagcttagatgcactggttggtatatttacccgtctaggaagagacatggaggaaattggtgttcaaaaaagcttcaagttggcggaaaaggttgcatctataatggaagaagcacaacctctcctttcacggattgaagcattagctgaagaagttcaacctttgctctcggaggtgcgtgagagtgatctggtgaaggatgtggaaaccatagctaaaggtctggctgaggcatccggcgatttaagaaggttgaagtcttccatgcttacccctgagaacagtgatctaatcaagcagtctattttcacccttatatttactttgaagaacattgagagtatcagctcagacatctctggtttcactggcgatgaggcgacacgacagaacatcaagctgctgattaagtcacttagcagactattgtgatccctcagttgaacaaaacacagttatgtgttgagatggagaattatgagtagagtaggccatccagatgagattgaagcatctttaagagaagctaataattgttgaggtctgtcagtttttttttcctgatatcttttctgcattcttgacacgaaaggcagtattatttgttgttgtcgaggagttatagcaggccggttttttgtgtgtgcagcacggttgtggttgaacaggtgtgtacctcggccgcgaccacgctaattgtgcttatgttagcaatctataaattgtcgatattttgtcccatgaacagtcctgaacatttaatgaactactacttttttcaaaaaaaaaa

SEQ ID NO: 8385 - DNA, 629 bp, Triticum aestivum
  unsure (1)..(629): unsure at all n locations
  Clone ID: PAT_TA_8385
gctcgattccttcntcngttccgaacccttcttccccttctcccccatggctgccgccaattggaatccgccggccctgcccgagtgcgacggttacgacgccgccgtcctcctcgacacgcggtgctacatagccgatcttcacaactgcaccaccgcctggggcaccacgagcagaggctccccgatccaggtgaccttctgcgccgcccgcccgcctctcctctcccacttttgcgtccgctgccccgacctggacttcctccgctcaaagcctatagtcgtcgccaccgacgccgacctcgtgctcctccgcgtccccatcgacctcaaggcgccccttgatgcacggtcctgggactacttcggatacaagccgcaagcccatcagctggacctgctcccgaacccgcaccccatgagcttccacgactctgcgaccgccctcctcagccgcgaagacggcgcctggtacgccgtcgccgccatcagcagttggtgcccagtgtacgagagcaatggtgactcgatcattaggtgggatttccgcctccacctgtaccgctcctccgattccaagggttggaccaccacacctgtgtcagtggaggagcttgtgagggacaagc

SEQ ID NO: 8386 - DNA, 440 bp, Triticum aestivum
  unsure (1)..(440): unsure at all n locations
  Clone ID: PAT_TA_8386
gccatgatgaagaaggggatcattggcaacggtaggcttaccatgaggcacacctccgacggtagcatcctccacggagcaggcagcagcctcagcagctagccaactaaccaggatagctccatcggccatccatcaagtattgccatggttgtgctatacttgaggtttaatataagaagacgagaacgatgaagaagaataaacttataatatatacaagctccagcatgtgattcgattcatttaccgtggatttgaagacagagtagtggtatcgatcgatcgttggttctagtgtactacttgtacttaactagcagagtggcccacaaatttgcgcgggcattggtncttggaaatggattaagcatagtgggtattgttaaaaacctttgtttgttataatcatgtgttttaaagcggtgccnaaaaaaaaa

SEQ ID NO: 8387 - DNA, 462 bp, Triticum aestivum
  unsure (1)..(462): unsure at all n locations
  Clone ID: PAT_TA_8387
aggaattcggcacgaggcccacaaaaattgacatctattgtgagaatggagtcgccaaaaaagttgcgcccgctcatcatcatggcgatgctactgctgctcgtgatggctgcggaaggccataaacattgtccggaggacttgtgtgaaggaccaagtggcaagttcaaaggtgcatgttcgcaggacgacgaatgccaagaaacatgtggggaagagggttttcacactggcttttgtaaagttgggccttttaatggtgcatgtaaatgttgtaagccatgtgttttttaaattatttncccaatgcttncatgaaataattgcttcacgtaaagaatttacctattgaatttaataaattncgagtcttctttcttcactacaacacgctggcttcatgtaagactttacctattgaatttaataaactggagtcttgtttcttcactaaaaaaaaaa

SEQ ID NO: 8388 - DNA, 607 bp, Triticum aestivum
  unsure (1)..(607): unsure at all n locations
  Clone ID: PAT_TA_8388
tgacttcttctctcacttggagatgcatctccgccaggagcatccaccattatgtggaagagatcacatggcctacagatctgcttatttcccagtgaaggatgtaattgatggcgatctctgtgagcagtatccagccctcccagctgatatgcagaggaagattgccgatgagctcgaccgaactccaggtgaaatcctgaagaagctggaagacatcagaaacaaaatcatctagggtcatcgcttagcatgaatgagtctgactgttggaatgcgactgttaagtctgcatcgctgtaaaatatttatcacctcatccagtacagccgttgtgtggcggtcttttttgacacaacacagcattccataattcatgaatcaacggagtggacaggaccggcaacctgtaatcgtcggatctgtagaagcgttgatgttgtcgacactggcccagtttgccttgtagattcaagtgagaacagagaattaaatggctgtaccagagtagtctttttgtacctgttagaacaactgttatttggcctgatgtaactgaacttgtttgaaaaaaaaaaaaaaaaaaaaaaaaaannnnnnnnnnnaa

SEQ ID NO: 8389 - DNA, 1570 bp, Triticum aestivum
  Clone ID: PAT_TA_8389
cgattcggcacgagaaatcatctagggtcatcgcctagcatgaatgaatctgaccgttggaatgcgactgtcaaagtcctcaccgctgtaaaatatttatctcctcatccagtacagccgttgtgtggcggtcttttttgacacaacacagcattccataattcatgaatcaacggagtggacaagacccgcaactcataatcatcggatctgtataaccgttgacgttgttgacactggcccagtttgccttgtagattgaagctggaacagagacttaaacgggttctccagaccttggtttttgtccctcttagatgtttcgttatttggtttgacataactgagttgtgctatgcctttgctgccttccttggcttggctataaacatacaggtcacttcctcttgacaccactctcatgcgacacacttgagtctgctgcgtcgttctcttctgaccagtgctcagaaggtgttgttgctgttgctggagacgctctgcgtattttcaccatcgaacgtctgggagagacattcaatgagacatctatccctctgcgttacaccccgaggaaatttgtgattctaccaaaaaagaaataccttgcagtcattgagagtgacaagggtgcatttagcgcagaacagcgagaagctgctaagaaggagtgccttgaggctgctggtgcggcggaaaatggaaatggtaatggggatcaaatggagaatggtgatggtcaagaagatggtgaggagagtaacgcacttcctgatgaacaatatggttacccaaaggcagaatcagaaaagtgggtttcctgcattagaattcttgatccgaggagcagggacacaacttgtcttctggaattgcaggacaatgaggcggctgtcagtatttgcaccgtgaatttccatgataaggagcatggtactcttctgctcagttggtactacaaatccgccaggagcatcctggccaaagtggagcctcgcacatggctttcatctacatatatttcccttgtcaagatgtgattgagtgccttcgaacttcttcgtatcccgcccttccagctgatgccccgtgcttggtgcccgttgcgcgggcccgtgctcccgggggttgcctcagggcgctggaagacatcagaaacaaaatcatctagggtcatcgcttagcatgaatgactcttgactgttggaaatgcgactgttaagatctgcagcgctgtaaaatatttatcacctcatccaggtacagccgttgtgtggcggtcttttttgacacaacacagcattccataattcatgaatcaacggagtggacaggaccggcaacctgtaatcgtcggatctgtagaagcgttgatgttgtcgacactggcccagtttgccttgtagattcaagtgagaacagagaattaaatggctgtaccagagtagtccttttgtacctgttagaacaactgttatttggcctgatgtaactgaacttgtttgatgcagtgcctccttcctgaagcaacctaataaaacttccaattaccggagggtagaaaaaaaaa

SEQ ID NO: 8390 - DNA, 740 bp, Triticum aestivum
  Clone ID: PAT_TA_8390
ccttgggcatggacatggtgccggaaggggacggcggtggcggtggcgccgtcgagttcgagcgagggagaaggggaacggaaccttccctccctccttccgcgtttcggatggccacgacttgacccgctcatatgtccgtttgtttctgccccccgcacgccgcctctgctctgttagccccgtgctgccatccattgcggggctgcgatcctgcgccggtgctggcacctggtaatcagcaggagcaccgccgtccggcgcatcggattagggtgtcccagatttgaaaggctgaagttaccctttgttggaaaaggctcgccatagagctaggacatggacatggcattgccgattgtgaatgccaccacagcagcgcttgctcgtgtctcagctgcattcaacgctcctcttgcccgcgccgtcgtcttcggggttcatatcgatggtcatttggttgtggaaggacttcttattgccgtcatagtgtttcagctttccaggaagagctacaaacctccaaagaagccacttagcgagaaggaggttgatgagctatgtgatgaatgggaaccagaacctttatgtcccccagtcaaggagaggtcccacattgacccaccaatcttagaaagtgctgctggaccacatacgaccatcgaggggaaagaagttgtaaactttgcatcagcaaactaccttggtttaattggcaacgagaaacttattgattcttg

SEQ ID NO: 8391 - DNA, 1046 bp, Triticum aestivum
  unsure (1)..(1046): unsure at all n locations
  Clone ID: PAT_TA_8391
tgtttgtcatgncctgttcgcaggtttgcatcaaggacagtagagccggggaaccggaaccgaaggcgcaacacctccattctcctgcgccatgtcacgccgtctcgcacctctaacatcctcatcgacgctggcaagtttttctaccattccgcgctccagtggttccctgcttttgggttgagggagattgatgctgtcattattactcattctcatgctgatgcaattggaggccttgattgtcttcgtgattggacgaacaatgtccagccctccatcccaatttatgtggcaccgcgtgattatgaggtgatgaagatgacacaccactatttggtcgacacaagtacggttatacctggtgctgcagtttcaacattacaattcaacattatggaagaggaaccatttactgttcaggatcttgaggtaattcctttgcctgtatggcacggtcagggttaccgttcccttggtttccgttttggtgacatatgctacataagtgatgtcagtgatatacctgacgaaacctataaacttctggaagactgtcaacttcttatattggatgctcttagacctgatcgttcttcttcaacacactttggattacctagggccctcgaggaagtcaggaaaatcaaaccaaaaagaacgctgtttaccgggatgatgcatttaatggaccatgagaaagtgaacgatgatcttgccaggctgatggaaacagaggggcttgacgtccagcttagctatgatggtctcagcacacctgtaaggctctagaactattggacacacacgatatgttatcttttgggcactgttgaacggtggttacagattttctgtagtttcatttcagtaaaatggtcacaacatgtaatccgttgaactcctcacgtcaagctttccttttacttatctttctcccccccacccatcctcatcaacagaggaattatatgtactagcaaatttagtccttacatcgatgatgaaataaagtttcagcacagtggtttgtttcaaaaaaaaaa

SEQ ID NO: 8392 - DNA, 467 bp, Triticum aestivum
  unsure (1)..(467): unsure at all n locations
  Clone ID: PAT_TA_8392
gtgacaacaaagtgttcgaggtccatcgtgttgacgggagatggttccctgacaacggcatgtgcgtgcggctacgtcttcctcaatgaggagagagccgtgaccacacccacgcttgcaggcggcaagcaaagtgagggttggttcctcgacaccggcgcaacgaaccacatgactggttcgatcgacgcgttcgcggagctggaccgcttgttggcactaggtcccgatatacgtcgcactactcgtagacaagtactttnccgtcggagtcgtggacgtggatcgattcttggcttgaagacgtacgtggaaagctagctagttgaaactagcaattagccggcggctacgtacaagtcgccggaaacacagacgagagaacacacgagttgatggctaaaggcccgtgacgtgcctttgtactttattgctttgatttgatctgattacaggcaaaaaaaaaa

SEQ ID NO: 8393 - DNA, 611 bp, Triticum aestivum
  unsure (1)..(611): unsure at all n locations
  Clone ID: PAT_TA_8393
ccacgctctcctctcctctcgcctcccccccccccctccgctgaccttgcgcagaagcagagcccctcatcccaaaagcaaacccaacccaaccgtggctccgagggaagccttccttccttcttccctctgcccagtgatggatacatgacatccatcggcgcgcctgtctgcccacggattcacagatccatcggcgccgcatctgtggcagaaacaacggatctatccactatgcgcaggcaggcaggcagaaacaacggatctagcatgcctgatggcgagcgagttgagacgggaactttgttcttaattccgcttttactctttctctatataatatactatgtatgtttggaagatcttcatcgccccaagcggagcggagctgatccctttgcttgtttgtcgtcgattggttgatttgattgattgtcgtggtatcccatcccacagaaaaaacgagttataatttgctctgcgtgattttcagtatgctttgccaccccacagaaaaatcagatttgcaatccctctgttatgtttgaaaacaattcccccggccatccctcagagaatctgttgcccaacctctgtttaatnnnacaagg

SEQ ID NO: 8394 - DNA, 585 bp, Triticum aestivum
  unsure (1)..(585): unsure at all n locations
  Clone ID: PAT_TA_8394
gcaccaccaggatgccccccctctacgcgtggatccagtcttgccgagggtcccccaagacgaaggaacacagggctgagctgtcggcgcctggaggagaaaacctggggcggagctagccgacaccaggacaagctcgtcgcacctcacccgaccaactcctcccaggctcgctggctatagaggaggagagctcctgctccattcaaggtctagcgtgggtctccgacgccgcccaccatctcaccttcccaggccgacgccatgggctccgatgtggacgaccccctgatgcccctgtcgtgccaccctctacctttcctgttccccatggctggcaagcttgcgatagaaaacatgcaaacactcgccattattatcatccggtgatttgttcagacttgtttcaggaattaagtaggcaagataacttcaggcaaagtgcagagcagccgcagctgaagacagacttaaaagggttgcaaggtggtggagcgtncagttgttattacattnctgtnccaccttttacatgtaatactaattttcatatataatgcagtctctgaacacacaaaaaaaaaa

SEQ ID NO: 8395 - DNA, 548 bp, Triticum aestivum
  Clone ID: PAT_TA_8395
gccaaaagactccctatatattcacccaaacgggcatccctcatttgcattattatgtgcattaaggctagggtcaactcctacaaaccgtcgaaagacctttaggcacccgatctactctgtaccaatgctttctgttgaagtcgagctggaggttatgaaacggttgggtagcaaatgtgtggaaactttgcagcaattgcctacgactgctgagttggatgggaggctggtccattttttacgcaacctacagaacagcactaattggagagtagatgtggagcagtcaagttttggacaagaatttgccgcgtttctccggttccatagcgtggacctggattgtacccacaatcagctcctagttcgactcctgcgatctctggagagatgggaattgacttccgctggagatgtacctacaagatagctcttaccaagtgtgttttgtcctgtaaacgtttgattaatgagctttccttgcaatgagtttaactgtcacaacaagattcaaatatactatttcataaaaaatctttggaaaa

SEQ ID NO: 8396 - DNA, 847 bp, Triticum aestivum
  unsure (1)..(847): unsure at all n locations
  Clone ID: PAT_TA_8396
cagtactccccaatncttcgggtaccgcttcattcggaactgccacctgctcgagtcagaagacgaggtcatgtttgttggtcctgtgttcgcaacaaaagagcccggatgccccaaatccatctgtggcttcgaggtgtacaggctggatgttcatggggcacggtgggtgaaggtggagaggctcgccggcgaacaggcgcttttcgtgagcgatcaatcatcgttcgcgctgcatgcttcagaggtgccagggtgcatgagcaactgcatctactttgtaggtgatgttgacgagtgctcattcagcacttggggcatctactccatggtggagcggaaggtgctgtttcagagccctgttggcggtttgccggggaagtacaaagctgcccggtggttcttccctggtgttgtgatgccacttgcgcgacaatgtacaaacttgggacaaaggagaaaaatcaatggcctttaggtataatctagttcatcatattatgagaatgcagtagcagttctttaaatgttaccacggactgctccttttatgctgatagaaggagaggcgcgcggtattgctatgatgtgacagtaaggtctataaacctccaagggctactatgccgccgatgtgatggcctctgtggcatacctgaaggttgcggttcagtttggcatggctcaaattattctagggtcagattctcagaaactgtacgaagcgctgttcgtgaaatttcagacaatccgacgaagtttatggattgattgtacttgtagtacagttgtgcatgaactcgctaagtttacactccttnggtttctcagatgtattacggggatt

SEQ ID NO: 8397 - DNA, 411 bp, Triticum aestivum
  Clone ID: PAT_TA_8397
gcggctgcttgacagcccacgcgtgcgcccacgcgtccgcatggaccaagcttatatgtgggattcccaacccacagactaaacagatttctttagttcagatcatacttttatgtaggaaaaggctaggctcttaagaaccctaaccaatgctgctttggttttacaactttcattgcttctaacttccaaatcaaactgttgttacacacatatttgttgtatagatgcaccctaaaaattcctacatttactttcttgtagaattgcatttttctggttgtaaaaatagggtgagcaacagctttcttgtcaacatgatggcctcctgaagataattgagacccatccatcacttatttgactactaattttcagcttcttctgtcgatgattagtgagctacttttt

SEQ ID NO: 8398 - DNA, 1084 bp, Triticum aestivum
  Clone ID: PAT_TA_8398
gcacgaggctactgcttcgtgaccggctgcgacgcctccgtgctgatcgcgcccacccgcttcgccaaatccgagaaggacgccgagatcaaccactccctccccggcgacgccttcgacgccgtggtgcgctccaagttggccctggagctggagtgccccggcgtggtttcctgcgccgacgtcctggccctggcgtccagggtgctggtcaccatgaccggaggccccaggtacccggtcccgctgggccgcaaggactcgctctcctccagccccaccgcccccgacgtggagctcccgcactccaacttcaccgtggggcgcatcctcgagctcttcctggccaaggggttcacggtgcaggagatggtggcgctctccggcgcgcacacgctcggcttcgcccactgccaggagttcgcgtccaggatctacaactaccgcgacaagaccggcaagccggcgccgttcgacccgaccatgaacccgggctacgccaaggggctccaggccgcctgcaaggagtacctcaaggaccccaccatcgccgccttcaacgacgtcatgacccccggcaagttcgacaacatgtactacgtgaacattgagcgcggcctgggcctgctgagcaccgacgaggacatgtggtcggacctgcgcaccaggcccctcgtggagcgctacgccgccaacaacaccgccttcttcgacgacttcgcccgcgccatggagaagctcagcatgtacggcgtcaagaccggcgccgatggcgagatcaggcggcgctgcgacgcctacaacgacgggcccaacaccctgtgatcgatgcgcgcatacgttccgccggcgtcgacgtctctgcctaccacgaaacgtgctgcatcgaccattgcatgcatgcatgcttgtgcgcgttgagtttccacagggtggccttgggatatcttcgggtgcgctcaaggttatggatcgggaccggccggtgaagcaagtttaattcattctcgttcgattgagtttttctttttctttgaggggtcttgttcgattgagtaatctctttagtttgtgtgcggtaaaa

SEQ ID NO: 8399 - DNA, 690 bp, Triticum aestivum
  Clone ID: PAT_TA_8399
gctcctgggtattcggcacggggcccatgggtcgcctagccctcccccccttccctctcttcgcgtctgtgcggtggttatcgtcggcaaacgcgctccccgaccgaagcgacggccggagcgctcgtcctcttccacgctggcggccaaaccacccggatccagcttcatcttccactccggcagccgaatcacctcgagtttgcggaacaccggatctgctcaagagtagggtttcattgagactttgagagctacctgccaattgagaggcatatgcaagtaaggtttacacctgggtgattttgatcaatttggcgaacctatgtacaaagctggtgcatatcggagggccacaggtgtacaacccgcccccaaagaggtgatttgccgaaggctccaaggaaattgccgaaatgcacgaactgtggggtggttggacatcgtcgcaatgcgtgtggcactaagaagagcaggccgtttgagccaaacttcctctagttacaatcttcatcgcagtgatggtttatgtagtcggctttgcaatatttgtggcaactatttctattttatgatgcacatgtttcatttgctgcccgtattatcgaaccaggtctccttgccgcgggcctgctgacttctgttgctgctcctggtggggtctgcattggtgtagtataggattgacca

SEQ ID NO: 8400 - DNA, 890 bp, Triticum aestivum
  Clone ID: PAT_TA_8400
accggcgggaacgtggggttgctctcgtgtcctcgcgttgttgccgagcgctccctctcgtctcctcgcgattttttataaaaaggagagaagcgcaatcgtatccccagccagattcacatcgcatcgccaccgacctttccctgccggattcttctcaggtagcggcagcagcagcagcagcttgagttcttgcggatctgcggctgcgaatcccagtctcgtatcaactcagccaggcagaggagaagcaggaggaagatgtccaaggcggcgctgaccctggaggaggtgtccaagcacaacaccaaggacgactgctggctcatcatcgccggcaaggtatacaatgtgaccaagtttttggaggatcaccctggaggtgatgatgtactgttgtcctcgactgccaaggacgcaaccgatgactttgaggatgtcgggcacagcagcaccgcccgtgcgatgctggacgagtactatgtcggtgacatggacacggccacgatacctgcccggacgaagtacgctccgccgaagcaaccacactacaaccaagacaagacccccgagttcatcatcaagatcctccagttcctggtccccctggccatacttggtctggctgtcgccattaggatgtacaccaagtcggaatcggcttaaccggcggcggcactgttctctgagttatggggaaaaaatagctttaaggtgttgaataagttagtagtttgtcgtgtgatgtatccattccaatgtaccgtgtggtgagtttgaatgttgcaacggttttgtcgtgaaactgaaattgaagctggaccaagttttgttgtgaaacttaaattgatgggactgaaattgctccttaaattgatggcactgaaatt

SEQ ID NO: 8401 - DNA, 771 bp, Triticum aestivum
  unsure (1)..(771): unsure at all n locations
  Clone ID: PAT_TA_8401
gggtccccgnantccagtcggnacgctctgctccgggcctttcacgccggaggctccggacgcgcctgatgcggccatcccgcgcaacttaggaagcctatgctcaggcgttgccctgctacggcccctcctcgcacagacaaccacgaacaatctggggcaaaagaagtcggcagcggcggcaagcaatcctatcaggccgcggtacacaagtttaattcatccaccgtctccaattctattttctatacgaatctcgtggattttcttctcgctcccgatcttctctatttgcatcagtactattttagctgggtgtccaaactccttattcagatttgatattttttcctcttggaagtcaaaacaagttgaagcctccttcatcgatgctcatctctgtccagtagcacatgtgctagatgggataaattggagacctggctgccaccaccgcacctacaggacgcctgcttgggaatcttaaaaactctatggtacatcttcctcaacgtaagttcaagcctctaccatggctcatccccttctccttcaggcaccaggtgtgttgggcggacaaaactggagccttcgccgctgctacggcgccaccatgcggcctcctgatccgtagatccgaatcactctacagatacaccttcatctttattagctgttcaaccatgttgcataatttgggattcttattaatccccaatccgttgactcttgccacctacccattcaatttattgatgtaccagattcatg

SEQ ID NO: 8402 - DNA, 689 bp, Triticum aestivum
  Clone ID: PAT_TA_8402
cacccccccccccgcccccccgcgccgccgcgcctccgctccccccctggagagaagcacgccgccgccgatctcgcgccgcatgaggccgacgcgccctccctcctcctcctccttctgggtgcggcgttagggctcggcatggacggcgcctcggccggcgacggcgggtcggcgtcggggggcgggaggtggtacacgggcatgtcgtcggacaacatcaaggggctggtgctggccatctcctccagcctcttcatcggcgccagcttcatcatcaagaagaagggcctcaagaaggccgccgcctcctccggcggcgtcagggccggggttggtggttactcttatctatatgagcctctttggtgggttggcatgataacaatggttgttggggaagttgcgaatttcgtggcttatgcctttgcgccagccattttggttactcctcttggtgctctcagcataatcatcagcgctgtacttgcacatgtaatgctgcgcgagaagctgcacatattcggcattctcggatgcgtcctatgtgtcgtgggatccaccaccattgtcctccatgccccgcaagagcgtcaaattgagtcggtgactgaagtttggggtctggctactgaaccagccttcatgtgttatgtgggtgtagtacttgctattgtcgctcttcttgt

SEQ ID NO: 8403 - DNA, 1133 bp, Triticum aestivum
  unsure (1)..(1133): unsure at all n locations
  Clone ID: PAT_TA_8403
aacacaataaaagatttttccacttgatgtcaccacaatagaattttgcaaggttgagctcatctgtcatacacaactccctcttgaagatggcttttttcttattatttgcaattgtatgtgtcttaaagtcagatttgtactatgatttttctgcagaagtagctatttatcatttgtcttagaaaaatagcaaaatcgaggccataattatctgatcagctttagtgggcgaatcatggcattgtcctcatgatccaaaatgtgacagtgatagacgtagccgggctcggccgtggcgtctaaggggtaggcctcgccggtctccaccatcaagaacttgacgaccaccgtcgtcagatatcccggcgccatcttccccacgttcttccacgtcctctcgtgctccggaacgccaaccgcatccccggccggcgtgcccgctaacgttgcacctgcccgcgtcgttgagcctggccatgcagcgcctgagctcgtccagcccgacgagcccccgggcgcgcaccgcctggaacgtggccaggtggaggtggagcgggtggtcgtccggcgtgaggttgaccacctcccacacctccgtcgcccccagcgcgcggcgtcttccgtcgccgggtcctccagccgcttcccgttgatgtacaggtgcgtcgggccgcccgtcgcgccgtcgtcgtactcgtacatcacgatgtaccgctttcttgttgcctcctcctcagcgaccttcacgtactccagcagcctcgccggcaccctggagtggtcccttgtcttcgctggctcgacgacgaacttcatcaccttgccggagaggcggcccggcgcgttgccgtcggggaacgggtacggcgccgtgttcactagctccacctcgggcgtgttggactcgtcgtcggagaagtcgatgacgacgtcgaacgactcggacacgccgaggagaacgtgggtggcggtgaccggccggggcaggtagctggtgtcgggctggtgccgaattcctgcagcccgggggatccactagttctagagcgggccgccaccgcgggtggagctccagcttttgttcccttnagtgagggtaanttcgagnaggggaatnaannnnnnncnna

SEQ ID NO: 8404 - DNA, 895 bp, Triticum aestivum
  unsure (1)..(895): unsure at all n locations
  Clone ID: PAT_TA_8404
gctcgacaggnaccgcggccgtgcgcacctccgaccggtgctcgcaggcgtcactgaccccaagcacgaggccaagctcaaggacctgctcgtgtccgtctgcaacggcgccgtcgagacgtttgttaggacctcacggcaggtcacaaaggaggcctccatttctcgagctgaagcagcagtggtgcaagaggtctgcaattcaggtcctagctgtgtaatggagagagtatcgaccacattggccatgccaagcaaccggaggtttgtgctggatgtcacgggcagggtcaccgcagagatggtccggtcattcctcgagttctcgactcagcgggtgtccgttggtgcacgaaagagcattgtcgttgcccgtgacgaaatcaccgaaaggggtctcgtcgccgtcaagtacctgagcgccaagtccatggccatcttcaccttatgcctcacaatgtgcatgcacatttcggttggaatgaggttcccgttgccggcctaggcatagcctggtgtggacttcaaggtgacattgttccagttatcctgattgtagttggaaagtaaagtatgtagattgcaaattgatcgtttgctactgctagcctttttctgtgctgttgactagtatttggaagcagaaatctgttggatttgtagttgttggtttgttgtttgtgatagtctgatagggagtatataggccacgaatggataattttgcaactttagtgtaaggtttcatatgtattatggtgttgtatcctagtgtcttcgccgtcttttctgaaggaagtaggtgttagtatcttattgatactgactagtgatgttcttcagcatcagctctctgtgtgggataagctatttcaggcaacaatagcaggaaact

SEQ ID NO: 8405 - DNA, 628 bp, Triticum aestivum
  unsure (1)..(628): unsure at all n locations
  Clone ID: PAT_TA_8405
gccagcctcttcgacgtcggcatcnccgctgcccacagctacgacgatcagctgccaagtcctcagagtgttggaaccaagcttgctcctgctgagaagatactccacacagaccgcggcgacgtgccgctaccaagttatccaggagacatcaggggcagcaacaacaacatgcagatgcaggctgatgagctaactgaccatgtgaagaagagatcaaagttccccaccgggacgtcgctggccgccatggctgcctccgggctggagctggcaatgtcttcgtctgccagcagcatcctggagctcagcatcgcgccccctcgctgctacggcgcggtcgacgccatcaaggtgctgtgatcgacccccggctgccgggcctggccgaagggattgatctgggcgcaccaccaccagcttagctttcatgtggtgtccctgttcttgttgccgtgctaaccttgttgcccgtcgattcgcgtagtagctttttcagctagtgtaaggagtaaaatacataagaattgcttgctttggtacaagttggtgaagggaaaccagagaggatatgtagtagatttgtttgtaatgtatggttaccaaatttaattaatgttatcagtgc

SEQ ID NO: 8406 - DNA, 1459 bp, Triticum aestivum
  unsure (1)..(1459): unsure at all n locations
  Clone ID: PAT_TA_8406
tcgccaccccacgggacaagaggacaaagccaaccacccaccaatctctactctctcccggtcccgcctctccctccctcccccccctaggtccgaaccctccaaatcaagctaccgccaatccacttccaacaatctgccgcctccaccctccgcctgatcggacccgcaacccctcacccccagggacctcgcgacccccggctgcagcgggcgggggaatggaggaggagggcgcgaggaaggcggtgctcttcaggctgttcggcgtcgaggtccgcggcgcggaggaggatgatgacgcagagcccatggagctcaagaagagcaccagcatgcccaacctcgcctgcgcctccaccggcccggttctcctgcccggcgaggccagcaacgacaagggctacgcctccgacgacggcgagctggcgtccacgccgcagctcaagcgccgccgccgcaaggcccaggagcgcaagaaagggattccatggaccgaggaggagcacaggaagttcctggagggtctgaagcagctgggcaagggggactggagaggcatctccaagaacttcgtcaccaccaggacggccacgcaggtggccagccacgcccagaagtacttcctccggcagaccaaccccggcaagaagaagcgccgggccagcctcttcgacgtcggcatccccgccggccacagctacgacgatcagctgccaagtactcagagtgttggaaccaagcttgctcctgctgagaagatactccaccaccgaccgcggcgacgtggccgctaccaagtaatcctagcagcaataacaggcggatgagcaaacaagatccagatgaacaggtgaagaagctaactgaccactgtggagaggaggctcaaagtgccccagccgggaccggcgctggccgcgatatgctttctccgggccggagcgttggcgatgtcatcatctcgcctcctggctcctgcggcgcagccgcgcgcatcctcgctgtgacggcgcgcccgatgccctggacgtgccgtggtcgatgccctgatttgcaccccctccaggctgaagtcatttgtcggatccttcatcgtccacccggcttagctttatgtcgcatcccttctcttgttgcctttctaacttcggtgtccggcgaaagatacaagatagttttttcttttgtatgagatggagtaaggaaacctaagaagagcttgctttgggttttgtttgtaatgtaggattcccaaattatatttattatgtttgtcttctaatgtatagttacaaagttaattaatgttagcagtgcgggcctcaaaaaataaaaaaaaaaaaaacgacgcccccgccaaattcgccaaaggggtctatacnccgcccacggngtcgtttnacgtcngacnggaaaaacctgggtnccactaatccctgaganatcccttccanng

SEQ ID NO: 8407 - DNA, 628 bp, Triticum aestivum
  Clone ID: PAT_TA_8407
gtctctctctccctcgcacacgaaacaggttgcgccgccaccgtcgtcgtttcgtttggctcccacctcctcatggcgcagtccatgcccaccccgttggaatgtcgcctccgtctccgtttagccgtcgatgtcctccatctcttgtcttccgtctgaaaggccaacagagagcatctatttctgggggcggccacgagatccatcaccagatcggtggcgcaccgcacccctcaagcatgtatccaatttttatctggagtccttgggcgggccgctgccagatctgccacgctcgtgtacactatagcgatgcagcggtgagcaacagaagcaacagagagtttcgggcaccgctggcgatgtcgtcgtcatggaacatgttggggctggaggtgatctactaggtcatcgattaggtggaccgccttcttcgcccggtcgttcagcatctacctgcaggtcatcctcaactacaagtgcaagaggtgctccttcaatcccttccgtttgtccttggctatatagtgttcttgggctaaatctgtttgaccagctgtttgcttgttcctcagtctgtgcatgaggattcacttaatcttttccacacaaaagagtaaaaaaaaaa

SEQ ID NO: 8408 - DNA, 1016 bp, Triticum aestivum
  unsure (1)..(1016): unsure at all n locations
  Clone ID: PAT_TA_8408
gcgggcacgacgagatgtttcccacgaccttgcgcactgtgacgggctggtgctggtgccttccgacgccatggtgcgtgtgctcaacccggccacaaggcgtgtcctcgtgcttcccttgaggcctcctcacgctgtcatgtttggttcaaccccttttggattccagggccatcaggctttcggcctcggccatgaccctcgctccaaagcttacaaggttgctcgcttcttctaccgctccatggaagggcccgtggacaaccctaaccactacaccctcgggatggaggtgctcaccgtcggagcggcggaccagcgttggcgagagacggcagcgcctccaccttaccctgtcttgccaggccgaaccgccaccttcttcaaggactcgttgcttcaccgtcgaggagttgctactccgggaagcgccgggattcatccgcttcaagttagaagacgagtcgttcggtgtcctgccagggcctccttgcagcccgagcctggactacgcggctgcgagcttagccgagctgcgtggggagctgtgcgtgtgcgtgcctcgtcacgaggctgactacggcgacggttcgcacgagacgtggatctgccgcgacttggacgacgcgccacaatgggagccacgccatgtcatcgagatacacacttttccacgactccgatgtctacgtccaatagctgcctacactgacgtgctagtgctccatgccgaaccctgctatctctgccgtgaaactcaagaacctgggaggagcaaggaagaagaaagggctccgcttcacatgcagctccagttgaggtattaccaccctgacacgggcgtgtttgttgaatacccaacggagacatgtgcctttcaagtaatctcatacgttccaagtttagttcccgtactagagtgcctttcccacttttctgtagctaggtaaggttttaatactccttaattagtatccgacaaataagatacgttgtaatctcctacttgnatctct

SEQ ID NO: 8409 - DNA, 1881 bp, Triticum aestivum
  Clone ID: PAT_TA_8409
ggggagtacaagtacggcttcggctccgacttcgagtccttctccatccccaagggcctctccgaggccacccgtccgccgcatctcggagctcaaggcggagcccgcctggatgctcgacttccgcctcgccgcctaccgccgcttcctcaccatggcggagcccacctggagcgacaacgtctactcgcccgtcgacctccagtccctctgcttctactccgcgcccaagaccaagcccaagctcaacagcctcgacgaggtcgaccccgagctgctcaagaccttcgaccgcctcgggatccctctcggcgagcagaagcgcctctccaacgtcgccgtcgacgccgtcatcgactccacctccatcgccaccacccaccgggaggcgctcatggccaagggcgtcatattttgctccatctccgaggccatccgtgagtacccggacctcatcaagcgctacatcgggagcatcgtgccgcccggtgacaattactatgccgcgctcaattcagccgtgttcagtgacggatccttctgctacgtgcccaaggacacggtctgccccatggagatatctacctacttcagaatcaacgacaaggagaccgggcagtttgagaggactctgattgtggctgatgagaggagcacggttagctatttagaaggttgtacagctccagcatatgactccaaccagctccacgccgcggtggtggagcttgtgtgcgaagaaggggccgagattaagtactccaccgtgcagaattggtatgctggcgatgaggagggcaaagggggcatttacaattttgtgaccaagagggggcggtgcaaggggcgtggctcgaaaatctcatggacacaggttgagacagggtcagcaatcacctggaagtacccaagtgtggagcttgttggggacgacactgttggagagttctactcggtagcactgaccaaggattaccagcaggccgatacagggacaaagatgatccataaggggaagaattcacgcagccggattatatccaaaggtatctcagcagggaagtcaaggaattgctaccgtgggctggtccagatgaattcaggtgcagagaatgcttataattcttcgcagtgtgattcattgctgattggggacaacgctgctgctaacacctatcccaccattcaggtgggttgcactagtggccgtgttgagcatgaggcaagcacatccaaaattggcgaggatcagctattctactttcagcaaagagggatagatcatgaaaaggccgttgcagccatgataggtgggttctgtagggctgtctttgaacaccttccttacgagtttgcccaggaggtggatgcacttatgaacctgaagctggagggatcagttggctaagttcttggttcaacaagtctgcgaaatatcacccgataattatctgaaataccatacgatggttatctaaggaagtccatgtgaccatgttacagcagcagtatgagactgagaagaataagttacatgataaaaggacgtttcatggcttgtataatcgtccacgacaacgaagagaaccgcggcgcttctcttttgttgtccatttttgtttctggttcctctgctgtgtaaacgagctcatgttcggatgccaatacaagaaatagaaactgtcgtcgtcatgttttccactgtggatctcgcggcgccgtacgttcccgcaaacttgattctgccatattttgatgggagcaacctcttctggggtgctgaacacatgatgtattccagcttcattttgttcatcgccaggcaaacgaggccgctcatagcactggcttggccaaaaaaaaaaaaaaaaaaaaaaaact

SEQ ID NO: 8410 - DNA, 755 bp, Triticum aestivum
  unsure (1)..(755): unsure at all n locations
  Clone ID: PAT_TA_8410
cttcttccccggggcggcgagttggattgtccggtcatctcatccaccccgtccgtccgtcagtcagtccggccacggccacggccaaaccaaaccctccgcatgggcttaaataaacattcgatgcggccaggccacgccggccattactcccgcgggcgtcttaggtgccgcccttaactgccgcgcttgccgagaccgaggccgcccgccctcgctgccgtccgcgtcaaactccacacgctacagcctgggcgccatgggtccatgcatagagatactgctgccgccttaattaagcccagttaggtgagcacagccacgagatgagccatgactgttgagtacgtgacacgactcttcgttacttgccccgcgtcaatgccctggcctggccctggcgtgacggtgatcggatcggatcggctgttgctgctgcaacttggcggcctctcgggtgggggggcaccccaactttggacgggatcgggaattcttttggcctacttgccctcctcctcctccttgttggccatggtcctatcttagtatcctatatagccctagctgtgtgaattgtgacgcaggcttaggtttttggatcttgccaaatggaatatgtgacgctggctggatgcttcaggtacgcggggtttatgttgcgtaccttgtgctcatctgttctgtggattggttgtgagtggttgattgcttgtattgtacataccatataggggaccgactgnatctcaact

SEQ ID NO: 8411 - DNA, 505 bp, Triticum aestivum
  unsure (1)..(505): unsure at all n locations
  Clone ID: PAT_TA_8411
caatggcagcagacatgtgccggttacagtgagcccaccacgccgtccgccgtccactcccaacccagcagtagaagcagccgcagcctgcagggaggtgacccccacatcggtgactgaatcggcggtcaggcagcagcagtccaccccaacagccgcgattggattcctctcacggtttaagatcaagagatgagctcatggatggttgatatcagtgaggtctgactgctaacaggaagcggacattaatcggcataacaaccgagtaagctacttcaaggagcaaatatctgatgcaagcatcgtgagttggactcgtgctttcttctggagtgagatgcacttctatcaatgtgtgacttataaatccaacaatccctactatacaacacaatcaattttggttgttatagccatattatctgctattgctatccccaagttccttttcgtactatgcaggttcttgttggcactcctggctgngtggatattcctagnc

SEQ ID NO: 8412 - DNA, 610 bp, Triticum aestivum
  unsure (1)..(610): unsure at all n locations
  Clone ID: PAT_TA_8412
ttcggcacgaggcgcggctggcctatccccacctacccaaccagnagctacacatcccccgcttccagcttggcacagtagaaccgattcgtcaatccgtcgatccagcggcagcagcacggctcctcgccctcctgctcgcctatccccgaagcgaaatagagctgcatccccgccttcctctccccctcaaatcctactagatccacatagcacaagagcttggagagatcccgaatccaatccaatccccaacggttcgatggagatcaactccctccttgggagtcagactcgacatcttccgagatgtacggaccagatgttgatatccattctcagagagcaccggctccctcaggcatcataatgactcctgccgatgcaaacccaagcaggagcagctgcccggcagctcttcatcgacgcctattccgtccattgcattgcaggccatcgcggaacaattataggtagtgcagttcagatcagaggtagtttagatgaggtaagatgtagtgtagttgagactgagctgcctcaaagaggnattgattgtctcgtnctcgcggtgtaaatccttgtattcatttgtgtttcaataggacag

SEQ ID NO: 8413 - DNA, 961 bp, Triticum aestivum
  unsure (1)..(961): unsure at all n locations
  Clone ID: PAT_TA_8413
cgggtcgacccacgcgtccgaaaaaaaacaacaaccagccgctgaatttcttcccccgacttggacgaaccctagacggccagccgtccctgcctgccggcgccgcccgccgccgccacctgccgtcgcgcctatccagccccccccccccccccctccagtccgttgtccgccccttcgatcccttctgcggccgtgcgggcgtcaggttgtgccgctgctgctctgtccggcgaggcgaggtgctcgatcccttctgcttggcgtccggcgaggtgcttttttgccaggagccctgccgccgcgccgcccccctctcgctggatcaatgtcaactatttctgatcagaagaaacggaccttagaagctattcaacaacggtatgcagcagctaaagctaagaagctgcaagatgaacagcccaagtgcccgaagaacaaagagagtacccccaagcccaagtttgatgcacggaggaaaggaaaaactcctgaatccactcctcgaacttctgggccagctgcctacatttagagctcaaggaatctccagtcatcaacaaaagccttctgcctcctcaggtgggagaaatcaaccctatatactctgagatttcatttgctcttcatgaaaatttgtcccaagatgactatgcggatcccgacagcacagacgtagttcaaagtgtcatatatgatataattcacgaaaggtgggagaagccgggaaaatttccaagggatcgaaaaagttaaagttgggtagagggatcctttgggataactatgttcaaaaggtcctatatantggatgcacaatcacgatcttggtgatcactcnaaacgttaaaagnacattcactgaacacataagaatgtggcantngttacatatnatcgcaggttgctcataacaagcatgaantgaagtttcagagtaaaaatcncaaaacatnngnaa

SEQ ID NO: 8414 - DNA, 666 bp, Triticum aestivum
  Clone ID: PAT_TA_8414
cccacgcgtccgtgccctctccactatggagctcctccgcgcggtcgtcctgctctccctggcgctcctggccaacggccgggacaccgacctctcccgggacagcttccccaagggcttcgtcttcggcaccgcctcgtcggcgtaccaggtggagggcaactccctcaagtacggccgcgggccctgcatctgggacaccttcctcaagtttccaggtgccactcccgacaacgccaccgccaacgtgaccgtcgacgagtaccatcgctacatggacgatgtggacaacatgggagggtgggcttcgacgcctaccgcttctccatctcctggtcgcgcattttccccaatgggatcgggaggttcaacaaagacggcgtggactactaccaccggctcatcgactacatgctcgccaacaacatcactccgtacatcgtgctctaccactacgacctgccggaggttctcaacaaccagtacaacggctggctcagccccagggtcgtgcccgacttcacggctttcgccgacttctgcttcaagacatacggcgaccgggtgaagaactggttcaccatcaacgagccgcggatgatggcctggcacggctacggcgacggcttcttcgcccccggcaggtgcaccggctgccggttcggc

SEQ ID NO: 8415 - DNA, 774 bp, Triticum aestivum
  Clone ID: PAT_TA_8415
gcacgaggacgcgacgaacaggacgacatcgaggcgatcagcccaagggcaagggaataatgatggatttggcggcaacacaagaggaataatccgccgctgaatccttccgatcgtcgtccccatcgatcaccggccgtcttttcgggctccggcggaagacgggaacaaaatggacgagctttcccaggagcaaatccaggagttccgggaggccttcaagctcttcgacaaagacggcgacgggacgatcacgaccaaggagctggggacggtgatgcggtcgctggggcagcacccgacggagggtgagctcaaggacatggtggaggaggtggacgccgacggcagcggcaccatcgacttcaacgagttcctggggctggtggcgcggcagatgcgcggggacgccgaagccgaggaggagctccacgaggccttccgcgtcttcgacaaggacaacaatggcttcatctccctcgacgagctccgcaccgtcatgaagaacctcggcgagaagctctccgaggacgagctcaacgagatgctccaagaggccgacgccgacggcgacggccagattaactacaaggagttcgccaaggtcatgatggcaaaacggcgagcaaatgcggaggaacatggagctggcgatcacggtgggtcggatcactcacacggcggtgggggcggttgcccatgtacaattctctaagaagagaaatttcagggttttcttttgcttttatagtctgaattacagccggaagaagt

SEQ ID NO: 8416 - DNA, 1331 bp, Triticum aestivum
  Clone ID: PAT_TA_8416
cctaagctcaaagtccttgcgagcagtgcggtgttccaaagaaactcccgggaagcggcggagaccgaccgggaacttcttcctcttcttcccccggtccgccccggctccgcgacatgggcgcgaatggcgcgctggagggggaggaggagaggccgcgggccgacggggaggaggaggaggagggcggggcgacggtgttccggggcaccaactactcgctgccgcggacgatcgcggcgctggcgctgtggcaaacttacaggtggtggaggccaggaggcattgttgtgaacattgctgagactaagttgcagctcatcttcatgttcggaaccataagggacaccgatagctttgctcggacaactaggcaggtcggttgttaggaagccatgggctacttcccgattagcttccatgtggaggactacgacgccttcgattccagcagggacttatgtgtttggctatgaaccgcattctgtgctgccaatcggcgtggcggctctggctaatcatgtcgggttcatgcctctgcctaagctcaaagtccttgcgagcagtgcggtgttccacaccccattcctgaggcagatatggacatggataggactgattgctgcaacgaggaagaatttctactcctaccttgcagctggttacagttgcgttgtagtgcctggaggtatacaggagattcttcatatggatcatgattccgaggttgctttccttaattcaagaaaagggtttgtcaagatagctatgcaggctggctgccctttagtccctgttttctgcttcggacagagcaaagcttacaggtggtggaggccaggaggcaaattgtttgtgaacattgctagagcactgaaattcactcctattatcttctggggaagatacgggacaccgatcgctttctcggcacctatgcatgtggttgttggtagacccattgagctgaagaaaaatcctctgcctaccattgatgagataaacgaagtgcacggacaattcgtcggcgccttgcaagaactgtttgagaagtacaagacgaaagccggatatcctggcctccatctgagagtcctataatactttcttgtggagaacaagtttcttgtaacatcacggcaattcaccgacgcttgcggcctgtttgatcattgcacgatcactagtacgaagctggagtttgtccgagttgttaggccatgatgttggtactggcaagtgttgatgatcacacggcgcctttcttgtgacagaattgtcagttcccactggttgctcataatataaagcctcgtgcaagtcgatccttc

SEQ ID NO: 8417 - DNA, 877 bp, Triticum aestivum
  unsure (1)..(877): unsure at all n locations
  Clone ID: PAT_TA_8417
aattcggcacgagggttttgtcttgttctttaccgaanccgaaaccgatcgcccgagtcccattcccacccccacccactccctccaataccggcaccggccctcctcctcctcctcctctctgcgcgatcctattgacccccccccgcgccgctcccgcggcttccgccggggggagaggcgagtcgaggagccaggcggggcggtggacatggcggcggcggtgagggtggacaaggcgacgagcgacctgctgctgggccccgactggaccctcaacatcgacatctgcgacgccgccaactccgatcacgggcaagcaaaggaggtgattaaaactctgaagaagcgtcttcaacacaagaattcatcggttcagtctcttgcattgacgctgttggagactctggtgaaaaattgtggggatcatgtgcattttctggttgtagagcgcggtatattgccagaaatggtcaaacttgccaagaaaaaggcaaatgtgcaagtgagggacaaaattttgacactccttgattcttggcaagaagcatttggtgggcctggtgggaagcaccctcagttctactgggcatattctgaacttaagcaatctggtttagaatttcctaggcgctcacctgaggcagcaacaatattcgcccctcaccttcaaccaagggatcgggaagtccaagccaattcgtccttgagagctgatgggatgatttcatcaagtggctctcctctgaagtttgtcaggcctgcaacgcattttaagtgccgcgggagctactaagtgagatgctgagagaagtgggatccaaatgatcatgaaggctgtgaatgatgaaatttacgcggggactttgggnaacaa

SEQ ID NO: 8418 - DNA, 679 bp, Triticum aestivum
  unsure (1)..(679): unsure at all n locations
  Clone ID: PAT_TA_8418
cccgtnctctgcaccgctctcctagcttgtttccatcatctcctcccgcctagagttttccgtttgatttccactgacatcgagagggaagatggcgtacaagggcatggccaacttcatcatctccatcatatccactgcatcactctacaccagcaggactctcgacaagtcccaccagagggtctactccagaaaggagggactacaacaacttgtccatgaactgcacaccgtgggaggatccactaagggtgtccgcgcactgttgctgctgctgcttcttatatgctttgctgttggtgggcaatgtgatcatcctgggtgctacaggagtagcactttcccaccgtgcaaccccgacaaaaacaggtgttactgctgtttgtataactggacttgttacaagtcgtttgcggaatgcggacctgcttgccatcctccccccctcttcctcctctgtacaatcatagaactagattcttgtagcggattggaaagatggatgaataaggcaataagttgttaagcaaattgtgtacatgtgctatgtattgtgttgtgcctgtcctccctctactagattatagaatctgagcatgcggcttgtgcatgcctcccatcatggagatggttagtccactcctccttatttatacaacactgtaacatcctcaga

SEQ ID NO: 8419 - DNA, 635 bp, Triticum aestivum
  Clone ID: PAT_TA_8419
cccccaccggacaactggctgtgccgccagccatggccatcgcgcctcccccaccggcgattggctgtgccgccaaccatggccaccgcgcttccccaccgtggctgcccccaccccgccccctcactccccaccagtgactagtgctgccaaccaatccccaccagcgctgccgatggcggcgacaagtgatggagagccgcggcggccggcgttggagcgttgcaaccacggcgacaagtgatggagatccggcctttcttttcttggaagcagccccagtttttgctaccaacgcccttgccttttgctggaactagtacacggcggtacaagttaacaacagcagcgagccggagacgggggcggcgagccggagacggggtcgtgggggacgctgcaaccatgaatgacagcgcgctggaccctcctgtgtgtgagttgcgaccatggcaagcggaggcagccgaggcaagtgccgtgcacgagcgacgggcgagcggcaagcgagcgcgggtgacgggcgcagtggcaagtgtggcaagcaagcacgggaagacgaggagaagcgcgggcggccggcgagcctcaggatctggcatatgcgcacaatgcctttttttccttgtttcctg

SEQ ID NO: 8420 - DNA, 600 bp, Triticum aestivum
  Clone ID: PAT_TA_8420
gcgtccgaggatgatgagacctgagaaaccagaaagtgagtcaaaaagtgggtgcagctaccttcttgatatcgcttcgcatgttgatcgggaaagagttaagactttagggactacgccatacatgattgatgctacaagatatgggaatgtctcccgctttattaatcatagttgttcgcctaaccttagtgcccgcttagttctggtggaaagcaaagattgccaacttgctcatgttggattgtttgccagtcaagatattgctgttggagaagaattgtcctttgattatcgacggaagctgcaatccggtgatggctgtccctgccattgtggagctcagaattgccgaggccgtgtttattgagtttgcagggtgaaaaaataaaagggaatgatccattgcttgtagcgcatcttcagaagctcgtagaatggtgatcacttggcaactattaacattgtttttcctagagcttgaatgcagaggctggatcctcattcttgatgcaaccaattgagtgcaggggtggtgtctcattctgcatgccgtcagcaagtagtgtttgtgatatatgattcttacagtagtgacac

SEQ ID NO: 8421 - DNA, 1268 bp, Triticum aestivum
  unsure (1)..(1268): unsure at all n locations
  Clone ID: PAT_TA_8421
ggcacgagggtgaaggctaagacagcatcagcatctcacactaaatgctaaattagtgaaaaagactgataagaaatcggttgcatcaagtagcaatccttcaacatgccgtacaatgaagccggtcttacgaagaacacctggtagttctatagagaagatagtgtcaagtagaaatgtcaacaactcaactcttgatgacattgtggcatatgaggtgcacnnagagttcatccaaactgattgtccatccacagaacatagtgcgacacctagtgatgaaagctgccagagcgctgatgggacacagaaccttccatcgatgacgctcaggaagattttagcgggtgcagtgaagcttcactgatttccagccaaagcagcccaccaataaacagaacaccaaaaaaggaagttgaaataaaagatgagatgaatttgcttctcctaagcagcaagtcattcgttaaccaagcagcacagctcataggcactgacgcatacgattacgaccatctgatcgagcaatacaaggataccggcaaggctgaaatgggagaccatgaactctacgtggacatagcaatggagcagctggaacgaaaacatcgtcagcagaacagcctatattacactggattcaggacccagaaatgcggagcaacaccatacttctccctggaggcattgctaggtgatatcggcgatgggactcgggagctgaagagctacaccgacgacaaagacgaccatggcagtggcaccaaagacagtatgtccatgaagctggagagggatcttggatgcgcggacccgtcgatcaacagcgcgtgggacatggggtggcaggattggatctgcatggaggaaacggagtgctgggtaagggacgccggggaggacgttctgtccttgctcattgaggaggttgctttggaaatgctggtaaactgaccagagaaagatgggaagtaggagaggttcttgccctgtcgtggagatttagctgtagtctgtacatcattggcacagctcgtgctttcagttgctttttctgtaagagttggtcacgtttgttttcctgatgggggctctttgccttggttaagaaactactgtaatctgtgcataacttcatagcaagatgtcctcatcgtttgttcgtgctgtacctctgccagtcgatttctcataattatcatgccataaacactcacgacaatagggcaaccttctattcatgtaagattaagacagaaaatnagacg

SEQ ID NO: 8422 - DNA, 649 bp, Triticum aestivum
  unsure (1)..(649): unsure at all n locations
  Clone ID: PAT_TA_8422
aagaacaagtactgcgcatatcagtagatggttcttttgtgcctgtcatgggcagatttcacggcgcaaattcataaatgttcccgtcgtgagttcatcctattctacaccttcttttttcttctgggaaagagaggggttttgcattttgatgccatcgatccgtacgccaccctgccgactgccccctgcaggtccactcaaatgcagttcagccgagcgtgtgaagatggaaaaaacgtcccgaggtccgaggctttgatggtgattctgtcagaagtgtagattatggtgaagccattgttcgtttccgaatacgccattgtccagtaacgcgcatggtactgtagctagcgcttatccggtaagctgtgatcgtgtacgctaggaagtaaagctcaggtgattagcagtgagagcagactgaagaaagtgtattggatatggaagggggaacttgctagaatagtactactagtaatggttacaagtaggcagattagccctttaggtattgccaagactgtttgttgctccgtgacctgttgcctgtgtaaaaatcgcttgctctgtctgagtgtaaagggttaaaactttgcttgagaagcagtaaatcttgcgcgtgatctnnctgcattatggccccttt

SEQ ID NO: 8423 - DNA, 813 bp, Triticum aestivum
  Clone ID: PAT_TA_8423
cgccgccgccactcttttcccttctccctcgggatccatccaacccacctctttttatgtacgcaaccaaccagcgccgctcatcagtcccctcgcgcccgagacctcatcgcgctgacgaccatggccaggccatcgccctcacctgcgcccttcttctttttcctaccttctcctccctcctttgctctaatcccccccccctctctctccttctcttgcttccacaggaacccaaaggagctctgccccgacgccatggacaggagtcgccgttctctagttccgaccacgtgcgagctttccaagccccaagccgcgtcggatctggaggggatcaccgctgtcgcgcctttttcccgacccccacgaccttctccggccttcgatagcccgccgtcgccgctcctctgcttccgctgcgtcgaacagcagcagtccagacagaggacgccgcctctgcctcgaccacgcctggaactcccctccgtcggtcactggcgcctgccgcgttgttcttcttcgccccggccccttctacttcgaccacgcgagggacgaacatgcgccgctcccgttgaccgtgacgcacaggctcagcgcccgcctggttcgatcggcctaggaggcccagccccgctgtccctagccggttgctctgaagatgggccaaggcccatgggtgaggccacccagcgccccacctttttttccttcttgctgttgggcttgtcccagattcggcccgcttctacatttttcccagtttctgcgaatttatcttttattccagtaaaacagttttgcagaaac

SEQ ID NO: 8424 - DNA, 712 bp, Triticum aestivum
  Clone ID: PAT_TA_8424
ggcgccacgcgggcgctccgcacttccgccggccccccccccgcccccccgccctcccccccggccccccacctccgccgcctcctccgctccctcctcggtcgccgccgtcccccccctcgtccgccgcctccccgccccccccgccccccgggcccgccggtccggcccggcgggggctcgtgacctaccctaacttgctgggcccggttggaattcgtggaggctgcttcttgcttgtcttgattcttgaaggggtcaacctgccccttttcctcgttgcggtgctgcggcaccgcgatgccgtcatacccgtgcgccgcgcctgcgaccgcacagagcgcctgagtcacccctgggtctgcattgccggccgctctcccggccccctggtgctttcccactgccgtgccgcgcgcctggggcctgtgcccgtgcgtggcaaccccctccgttctgtcaccatgcagggcccggcgcgcttggctgcctccgacctgccctcggtgggggcgggtgcccctgcaggccctggcctggaagcgctccccctggagcggctggttgtcactgatgcttgccccaatcaccttgctcactcatgtcccaatttgaggtcactagtccttgttagctgtgaggggttcagcactgatggccttgctactattgccaccaattgcaggtttctcaaggagcttgacttacaagg

SEQ ID NO: 8425 - DNA, 624 bp, Triticum aestivum
  Clone ID: PAT_TA_8425
ctcactggcatactgcattgctgctactgtacgcgtagtctctcacagtgccctgccaagaagatctcccgtagtcaattcgcttgatcaggccaggctactcagtactcacttaagcgagaggagaggaagaaaaggggaggaattctttcgtgggagcgttaggaggagagagagagggagagagagagagcttgtgctacgatcgatcgggccgggaaaggcgatggggcgatcgccgtgctgcgagaaggaggggctgaagaaggggccatggacgccggaggaggaccagaagctgctctcctacattgagcagcagggccacggctgctggcgctcgctgccggccaaggccgggctgcatcggtgcggcaagagctgccggctccggtggaccaactacctccggccggacatcaagaggggcaagttcagcctgcaggaggagcagaccatcatccagctccatgcgcttttcggcaacaggtggtcacccatcgcgttatggacgcccaggcgtaccgacaacgagatcatgaacccctggaacacgcacctcaagaagcggatggccaagatgggcatcgacccggtcacgcacaagccgcgctccgacgtgcc

SEQ ID NO: 8426 - DNA, 425 bp, Triticum aestivum
  Clone ID: PAT_TA_8426
gcatcctccctcctctggcctaatgccatggcgcagattcatcccgaggcgcgcatcgccaggaatcggcatgccgaaagcaccaagcgttgatgcagggtgtcccctggtgagtggagatgacgcggggggctcgccggcgtcgcgacgatgctagggtgcgaaccaacgctcgtcgccatggccgcccgcagctgcgctgctctccatggccgcctcagcagaattttgctacaaccatgttagtttttgctggaactagcccgtgtttttgctgccactcacccacccaaaatctgctatcacggtgatctttgctggaaccggcaaatcattttgctacaaccgttttggtttttgttactaccgacgtttgtggatttttgctatatcaatctccatgacatgtgaccccaaaaaaaaaa

SEQ ID NO: 8427 - DNA, 1340 bp, Triticum aestivum
  unsure (1)..(1340): unsure at all n locations
  Clone ID: PAT_TA_8427
gatctgctgctgcttcatcttcgcccggcttgatcgaaaggatatctgcctccattgatccatcggcgacgaggacagggtaattcaacttggagccatggggtccggcggtttctgaatctgttcatggcgaaccgcccgggctgcatgtattcgctgcgccgcttcgatctgtcccgcaaccagtttttctactcaacaccggaagaagtagctttacatgggcgagtcctgccgccgatacaaagagattcttcatcatccctgagcaaggccagcggcagggtcaagaagcagcaagcctcagagattcggacgattcggttgccgtcaccactcgtcaacatgcggccggcgccatacccgaagcctaagtccgacgaactcagactggatgtgttcgctctctcggaacgcaacatcgtgttcgcagaccgccaaagacacgtcttcacctacgacactgactcggaatgcttggtcaccatgcccaacctccacgctcccaaggttgatccattggccatctctattcctcgtcccggaggtggtgaaggcagcctctacatgatcgagaggctgctatgtcctggcaagagcttccagttcgaggcccttgtgtccggccagcactacaatgagtcccatccctgcaggacctggcaatgtgacgagctcccgctgccgccactggaagaagaaatattcatcgactcctgtgcagtggtgggcaacgtcatctgcatctctgcatctggctttggcagctactgctttgacacgctgagccactcctggagccgtgttggtgactgggtgttgcccttctttggcaccgcgtagtatgttcccgagctcaaccactggtttggtgtctctgatcaggactaccacttgccttgtgcggccgatctctcacctgtcctcacagggcagcggccagagccgggcttgatttgggcggataattacctgccggaggagtggcatcatagcggcctgtcgaatcccgccaaaatggtcagcctgggttctggcaggttttgcatcatcaggtttcttgagactttgttacccagcctcgatactgagcagatatttgtggacaaacagtatgctgtcttcactggtctggaggtggtgttaactggcaagggcaacgggaacggcaaggtcaacgcgaacggcaacgggaacagcaacggcaataggctccgtatggttaggcacaagaccagacgctgcaggaatcgtgagtccaacctcatcgagtgtatgctgctgaagtnctcgtatgcatcaccctttaatttgttgccccttatgtagaatanagtctc

SEQ ID NO: 8428 - DNA, 688 bp, Triticum aestivum
  unsure (1)..(688): unsure at all n locations
  Clone ID: PAT_TA_8428
agaacacatcacatgcacgcaagcttccttcactggtataatagccacggggccgccccccggcccctttccgccaccgccgggagccgaccacccaagcctcgagacgccagccatggccatcggatctctcctcgcctcgcggctggccaggtccggccacgccctcgccacgcgcgccatcgctcaggctcccaggacacatcagcatcatcacgcgacgtctcccctgctctccaggctcggagccgtggcccgcgctttcagctcaaggcccgctgccgccgatgtcatcgggatcgatttgggcacgactaactcatgtgtctccgtcatggaaggaaagacaccacgggtgattgagaatgctgaaggtgcgaggacaacaccctccattgtggccacaaacagcaaaggcgccaccttcatcggcggcgcggcctggcgccgcgccgcggccagtccccaggacgcggctcgtgccgccaaccgcctgcgtgggtcagctcgcctggtcccccgaactctggaggaccccaatacgctgccggacaagaagatcgggcctaccaagggtgtcgccggaacagagggggctgcgaagtcatactccccaagccccattggtgccntttgttcttaccaagatgaaggaaactgcagaggcttaccttggcaagtcggtctc

SEQ ID NO: 8429 - DNA, 497 bp, Triticum aestivum
  Clone ID: PAT_TA_8429
ggggagcaggagtcgctgctcaccaacctgcgcctctccctcaacatctccaacgaggagcacctcctccagctccgccgcctgctctcctcctgagtccgatcctcgtctcgccgacggcttaatcatcactcatcgaggtgactccggtccggtccagtccagacagacgaacaccgcatggcgctgcgaaataatggaggccgatgtgccgtggagctctctgttttttcctttcggcaagagaagaattttgttcgttcgtcttgtgtagtcgatgcagcagcagctccagctccattgccgacgtagagagagctctgcagcgcacgtcgtcgccttcctcaagactccagtccagtagcgttgggccattgactctcctgaattactacaactagtgctggccttgccttttctatctatgtaaatgtaaatccatctactcactgatctgctccaagattattactattacttttacttcaaaaaaaaaa

SEQ ID NO: 8430 - DNA, 1100 bp, Triticum aestivum
  Clone ID: PAT_TA_8430
gagacccccggcgccaggcgccgacgccggagccgtcggaggccgactacgagacggacgagctgtgtaatcttctcaaatcaagggtcgaatcacctgaatttctagaaaagcttgataacattcagaagtcagtataccaacatggtgcagtcgatgaaaccatatcatgggatatagtaagcgcagcagatatatgggatgataagagtatgaatgtcagtgatgattcagaggatggatatgttctagttaagcaagagggatatagttgatgggattgcatgcttcatggctgcatacctgctgtcgctgaaagaaactaaggaattgacgcccaatcaacttcaagaagcccttagcaagacattttcaactaaaaagaggaaaggcaaacttcagaaggcatgggccggaacacaagttatttataatgtagcatcatggagtgcaacagctattggtatctaccagaatccagcgattctaaaagcagcaacagcggcgttcttggacgtcctgccgcgtggctgtccaagttcctgtggaatagtcatgaagatcctgttacacattgtgtgaataataccgccttccctgttacctcccatttgtcgggaagcactgttgtcaaaccctggtcatcataccgtggcaccatgtgatcatcataggttactgtcaacacgtagatcatgcgtcagatcagagtgaataacgagactcgctgatccttggtgtctgcctgatccagctgctgagtgtagctgtcctgtgtgtttttcttatatcattcatcggtatccaaccgccgtctccgacctcctcctagtacataccagctgtccgaccgagacgaaactccgtgttcctctctaccggtaaatacacctctatttgtttgaaaagaaaagaaaattgtaggttactttcaacagtcagagcgggcgtcagctcagagtgaataacgagactggctgatccttagtgtctgtctgatctagctgctgagtgtagcttcctgtgtgttttacttgtatcattcatttgtatccgacctccgattgtgatctcctccttgtatatatcagctgtacgac

SEQ ID NO: 8431 - DNA, 958 bp, Triticum aestivum
  Clone ID: PAT_TA_8431
gcaatctcttcctctccttatctccctcgccctcacaggagaacaaaattgtttagagcggaatcaatttttgccgtctccacgaattggatcctgaatcttctcacgtataaattttggatgctttattgagatcaggtcagagcacacgaacaatgcccatcatcgctgctcaagattctcccactctgcatgaagtttgtctctggtcggttgctgtcattgggcaggatacacatgcatacacggcggacgcgggattaactctaataccctagaggtctttggttgaaaacaatggtctgcgatatactcgatgcgaagattcctggaaaggaaaccaaaaagactaggatgggaacacatgttgcattttattctgatgaagaattgggaataagggcattcaggatagagatgtggcagcattgatataataccggaaaacaatgctgatgttgagcattcagaaatcagaggaaccaagattattcgaagatcaacataagtacgagcacaagcaaattcaggaattgaataggataatagaaaacttcaaagcaagcgctgattgctgatgaagtcattgtaaaccagcataaaaaatttgggacagggagcacaagtcgtgttatgcatcttgatgaagaatcaaaaactaagggatgaaaggaaacgaatgaatcaaaattcatggaataaagaacagtgatgaagaagaccgcaaatcaaagactggaaggttctcaaagtcataaagattccaaactgaggacattgtgtaatggggttgataaacaatcagcgacctgagacattccaaaacatggtgcatcaaggactaaaaaacaagtagcgcattgataaatatttagtgacatttaggatttttcaaaaatgtacatgcacatcagatttgtactaaatgtacatgcacatcagttttttattacaaaaa

SEQ ID NO: 8432 - DNA, 1404 bp, Triticum aestivum
  unsure (1)..(1404): unsure at all n locations
  Clone ID: PAT_TA_8432
ccacacacaaaagcgagccaagcacatagcctttcctctcccgccccaatcgggtcgccccaacaccaaatctccgaggctgcgggaggatccagcgcggcgatgggggaggcggacgagagccccggcggcggggatccgcagtcgctgaaccggatcgccgcgggagcgtacgactaccagaacgacgcgcggggggccgggtgctggtcccacgtccgcgtcccgccccaccccgccgcccgccccggcggcgtcgaccacttcaagcgcaagttctaccacagatacatccaccccgattgggcgcttgagccaatgtcttccacaagtgcgacgcagtccaccagatcagcagcaagttcttcttctacaccatccagcgagcattcccgagctcgtgacacacgatctggtgccagatcagctggtgcatcacaaccagcaccaacagaaaggactggaaactctttacggttcgatggacgaaccatacatttctctatcactgcttgggtattgattgttgcttgtcttggaatccttccaattgtaccggaagatgtcgcaagcaaagcataaagactttcgttgctagcaacaatatgctcgtcagcatattctttatactgcacttatgggaaaccaagagcatggaacatgcctgcaattcagccttggctgcagtctataattgtagccaaggactttgttcatttgatgttctctcttatgatgttcacatcaaatgtacgctttaagattgttctactgcctgtgctttgctgggcacttgatcatgttgctagattcctgaggcgtaattttgcacgctcctctttctacaggaggtacatggaggagccttgtttgtgggtggagacaaacaacactacgatcagcctcctttgttcaaatgctgaaattacccttggctttcttatgatcgtatcacttttctcgtggaaacgcaacataattcagacattcatgtactttcatctgttgaagttgatgtaccatgctcctgtaacatcgggttatcaccagagtgtgtgggcgagaattggccgggctgtaaaccctcacattcttcggtacacgccatttctcaacacgccaatttcagcagtacaaagatggtggctgagatagaaggcatggatggtgccacgcctatgtgtcccttgatcccctctacatatagagagtatctgctacagtgggcttccctcgtcatcgttccgttaagaacatacacgtcacttgcacatcgttctgttgttttcataccctcatttcacgtcttactgagcttttttttccggggattactgagctactcaacggagggcacagcataaatttttctatgcaagcagtaggtctgagntaaaaaaaaan

SEQ ID NO: 8433 - DNA, 1055 bp, Triticum aestivum
  unsure (1)..(1055): unsure at all n locations
  Clone ID: PAT_TA_8433
gcacgaggggacaatgcatcagaaaactattataactagtagtaataaattcttagtttacttgtcattgtaattgtaattagttgttgtccatccggctccgcgccgtgcgcgccgcgcgtcgtcctggcgttgctcgccttggcgggcgatggagccgtcggcgcgaaggtgcaccacaaacacggcaggttcacggcgggcccgtggaagccggcgcacgccaccttctatggcggacgcgatgggtccgacacccgcgccggcgcgtgcggctacaaggacacggtggcggaggggtacggcctgcagacggcggccgtgagcaccgcgatgttcaacgacggtgagacttgcggggcgtgctatgaggtgcggtgcacagacagcccggagtggtgcaaggccggcacggcgcctttgacggtgacggcgacgaacctgtgtccgcccaactaccagctgcccggcgacgacggcgggtggtgcaacccgccgcgcgagcacctggacctcaccatgccggccttcctgcagatcgcggaggagaaggccggcattgtgcccatctcgtaccgtcggtgcgtacggtagcacactgtgccttgcgcgaagctgggcgggatccggtacacgatcacggggaacaaatacttcaacatggtggcggtgacgaacgtgggcggagcgggggacgtggcggcgctcaaggtgaaggggaacaagcgcgtcaagtggacgttgttgcagcgcaactggggccaggtgtggcagacctccgaggacctcaccggcgagtcgctcacgttccgcgtcatgaccggcgaccatcgcaagcacacgtcctggcacgtcctcccgcgggactggcagtttggtgtcacctaccaggcacccaagaacttctaaccaccctgtaagatcgtgctagccagccaggtgtgaattcgtcgaatctcctgttttgtgtccctcggagcatgtatgtccaactccaacaggacgtacatgtgtcaagaaacaagattccctctacaatnacaaggaacaaagaa

SEQ ID NO: 8434 - DNA, 1502 bp, Triticum aestivum
  Clone ID: PAT_TA_8434
ggcctggtggcgtcgcgccgtggcccccaagatgcgcaagctgccgagcgccgttttgctgttcctcttggtcgcgggcctgggccgcccctgggcgctgctccctgccgccccccccccggccctccccgcccggcgctccgactccatcttcagcttcggcgactcctacgccgacaccggcaacaaccccgtcgtcttcgccgccaactccgtcttcaacgttgtgacgcgcccaccctacggctccaccttcttcggccgccccaccggccgcaactccgacggccgcctcatcatcgacttcttcgctcaacgcctgggcctgccgctcgtcccgccgtccctggcgcacaacgggagcttccgcagaggcgccaacttcgccgtcgggggcgccaccgctatcgacgccgctttcttccacgacgggtccgatcccggcaacaagttccctctcaacaccagcctgggcgtccggccgccgcggtccccggcgcccaagccttccctctccccccccgcccgggcgtgcaacgccttcggcgccagtcccccctgcctcctcgccgcattcggcgtcgacgcctgcctctccgccgtcccccccctcggcccgcatccggtaagagcgttcgttccagatgtggtcagggccatctcaatggcaatcgagaggctgatcaagcacggggcgacgagtttcgtcgtccccgggacaatcccctcagggtgcacgccgcagttcagcagctacctcgccaaagacaacccggcagaatacaactccaccaccggctgccgggaagattataacaagctagggatgcaccacaacctgctgctgcaggaggccctggagaagctccggggcaggcacccggacgccatgatcgtctacgccgacctcttcggccccatcatggacatggttgagtcacctcgcaagtatgggtttgaagaagatgttcttaccagctgctgcggagggccggggacacttgtctgcggcgacgaaggtgcaaacctatgtgagaaaccggctgctcgtctgttctgggatgtcgtccacttgacggaggcggcttaccgctacatcgccgatggctggctgggcagcatagactcccctgcagctgcaagagagagcaggtatcagttagtgaggtagcagaagctgctctgcttcatggactgttggctatgtggagtctggcctgtctgaaccgaaatacactggagatgaaatgtaagcatgcaagtttattttggaaaccaaatcctcttcttttcggacctacatttctcggttaagttccgcgcctggttctcctcgcgagtttcctgaccaccgcattgagcctcttttcgcggatcgtaatactgagacacgcggtttatttggaaactatttcctgttcgttttagagttatctgtagttgattggatggatccgatcggaattcgagtactgttcgttcttctatgtcattactcaaat

SEQ ID NO: 8435 - DNA, 768 bp, Triticum aestivum
  Clone ID: PAT_TA_8435
gtccgacaccggcagcctcccatatctccaagccgtcgtcaaagaaacactacggctccatcccccggtgccattcgccactgggctagccgaggaggcggtggagatagaaggctacaacgtccctaagggcacgactgccctggtgaacatctgggggatatgcagaaatgccaaggtatgggatgagcccaacaggttcttgccggaaaggttcctgcatagggagatagagttcttcggtgcagattttgagctgatcgcattcagcgccgggaagcggatctgtcctgggctgcagctctcgagtaagatggtgccacttatactcggctcaatgctctatcactttgattggacattgccgggagaagaagatgctgctcctgtagatatgacagagcagtttggactggtgttgtccatggctgtcccgctacgcgttgtacctaagaaaatattgtaaggccggtcacagtgagagtatcacataaagtataatgcccgccaactaagtagttcagatgaggtgacataaaattgaatgaagaaagaaggattgagtatcataatatgacaccatatcatattaaacaatgtgccactatttgtcatgcataacaataaataagtttacctacaatatcattctatgatactatgtagtatggagatagtatcatgaacttgtatcatacaataccccactacgaccagcatgttacagtgttgtgcatgattaattaatattcccctaggagttgattg

SEQ ID NO: 8436 - DNA, 2325 bp, Triticum aestivum
  Clone ID: PAT_TA_8436
cacccgtaatgataggagcagatgtagagaatctgtttcagaagtagctcatcaggaccaaggaactctgcagtctaggctcaagtttgaagaacttcttcgaacatatgacgaagggaaatccaagttcttatcatcatttattggtcaaaggctcagagtatcagttgtcctggctgataggaattccaagcgactattcttctccatgaggccaaaagaaagtgacgagttgattcagaaaaggaaaagtctgatggctaagcttaatgttggagatatagtcacatgcactatcaagagatttgtttactttgggatatttgttgaggttgaaggggttcctgcgctgattcagcagtgggaagtgtcctgggatgagaccttagatccatcagtttcttacagaattggtcaggttgttgatgctaaagttatacaactggatttcaacaatagccgtatctttttgtcacttaaagatgtaaagccaagtccgccagtaggagctttggaagcagtcattggcgatgaagcgtcacttgatggatctctagaacctgcacaagcagattttgagtggcctgaggtggattcccttattgaggagctgaaaaacatagagcaagttaaagatgtttataaaggaaggttcttccggagcccaggattagctccaacattccaggtatatatggcatctttggttggccaaaagtataaggtccttgcgcggtatggaaacaatgtgcaagaggtgatggtggagacgtcgttagacaaagaagggctgaaagaggcaattttgatgtgcacaaacagggtgagctgatcatcagggtttccacgcgggaactgcacacggccaattttcatgagaccattttatgacatctactcaactcgatctcaccggagaggaagagactcctaggacgaagagctcgcctggagaaagggttgaggtggaacttattaactgcagtgcgaaggggtttgtggtgtcactcgactcaatgataggtttcttaccctatcgtaatctcgctacaaaatggaaattcttagcttttgagacttggttaagaaggaaggggtggtgatccttccttgtacaagcagagtatgagcagtggaggaagggttccgaggttaatgataggagcatagaaccagaatcagtttcagaagtagctcatcaggaccaaggaactctgcagtctaggctgaagtttgaagagcttcttcgaacatatgacgaagagaaatccaagttcttatcatcatttatcggtcaaaggctccgagtgtcagttgttctggctgatagaaattccaagcgactatttttctccatgaggccaaaagaaagtgacgagttgattcagaaaaggaaaagcctgatggctaagcttaatgttggagatatagtcacatgcactatcaagcgatttgtttactttgggatatttgttgaggttgaaggagttcctgcactgattcagcagtgggaagtgtcctgggatgagaccttagatccatcagtttcttacagaattggtcaggttgttgatgctaaagttattcaactggatttcaacaatagccgtatctttttgtcacttaaagatgtaaagccaagtccgccagtaggggcattggaagcagtcattggcgatgatgcgtcaattgatggatctctcgaacccgcacaagcagattttgagtggcctgaggtggattccctcatcgaggagctgaaaaacatagagcaagttaaagatgtttacaaaggaaggttcttccggagcccaggattagctccaacgtttcaggtatatatggcatctctggttggtcagaaatataaggtcctagcacggtatggaaacaatgtgcaagaggtgatggtggagacgtcgttagataaagaagggcttaaagaggcaattttgatgtgcacaaacagggtgagctgatcatcacggtcttcgtgcaaggactgcacacggctaatgttgatgagaccgttctttagacctgaaagcctattatacccgagtcaatctggccagagaggaagagactcctgctgggacaaagaacctgcgagcaggatgagattgtttcgtcgaccactttataatcctaggttggttttcccctaccaaactctcatgaaacttccgtcatccaaatggcgccttatacgagtgaatctggatacagagattctggccagagaattgttgtgcagatgtagcccaatgtcacaaactgtacgcagcggtctgaattcaatcaatcacatttttgttactagtt

SEQ ID NO: 8437 - DNA, 913 bp, Triticum aestivum
  Clone ID: PAT_TA_8437
acggatctcaagcatggcgcgtgcttgctggttcctgcttctgtggcggccgccttctgcagctgccgcgccccaccgtccgagccccaggaagatgatctccttccttctccaaccgaactgcagctcctcgggtcggcgggtgccgccgtcgttcctgcggaggccggtcggaccttgccgcccctggatccagcggttatgctggaactcggacgcggagacggagcgcaggccgagccggtctgccccggccccaagtgtatcgcccgttcggaggggcgaccagatggtggcggcccgattcccccgccgcagtccgcggtttctgcagccctatgatggagagcgtgtgggatctgttcaaacgtgcggccaaaaggaaggcggcaccggcgggtgccgcctctccagcgccccaggcaggcgatccccttcgcctggcaaccgtcgcaaggctcccaaggtggctgccgtgtctgagctgctggatcttcccctctctggtgctccttcgccgctcaccagaggcaaactcaagcagctggctttccactgcgacctcaatgccgatgccatcaacgcccatgctcaagcacaagcctcctcctctggtatcgctcgcctcgcccaggctgatgccaacccaaccgggtcctttgctggtcgctctctcctgaatgtgcaggtctagctctgttctagcttggtcgcagcgctggctgatgctgttagtttcttttatgtctttgcattgcccaaagcccgggccgtctgcagtctgtatccgtgtctgtctggttttagccctgcttgggttcaccatgacttgtgcgtctgttttttagctcccttgatcatgttagatttggttttcgcttgtgtcctgttgttgccgtaacttgtaacccat

SEQ ID NO: 8438 - DNA, 645 bp, Triticum aestivum
  Clone ID: PAT_TA_8438
gctcgagcggtcgagcccccgcctcccctccccgccccccctcccgccccccccgccgcgcaaaaccccgtcccactccccagcgccccaacccctatccaccccaaccagatcgatcggcggcaccttctgctcccaatcccgcggcatcgcccctgagtctcccaccgctgaagcccacaccgagttcctcctcctcctcctcgtctgccgctgccgtcgcctcccgccgaaggacgcatgctacgaggctcggttctcgcgtactttctccgctgatcccgtctgctgctcctggactggcgcggtcatccggaagggacgcgatcccttttgctggctactgcagtttttgatacatatccacctttcaatgcatcgcgtcgggagtgccggaaacacggccggttcaagtcgaccgagaaaggagaagcgcttcacatatgtgctcaatgatgctgatacataaaaagcattgtgctggaatcaactgcttgtcgtacctgaatgcttctgcttctggtacaagtgagtatctttttactgggagtcgcgatggtaccttgaagagatgggaataccaaaatggggatgcaaacttttcagcaacctttgagtcacatgttgattgggttaacgatgcca

SEQ ID NO: 8439 - DNA, 943 bp, Triticum aestivum
  unsure (1)..(943): unsure at all n locations
  Clone ID: PAT_TA_8439
ttcggcacgaggcgatctcatacagggnatgccggtgaggcggcgacgcaggcggtctacgatgggatccagtgtccgctggtcttcccagtggatcgagccgaggcgctcaaggcgatccagcggcgcccggccttctcagtggatccagccgaggcgcgccagggaatcatccttgggtttggagttggtgaccgaggaggaggcggcaccggcgatggcgagcaagccgtgcacgaggccacggcgactccacaaagtctgctccgctctccccgaccctcgacggcgtgctctccgacctccactccctccttctctccacgctcgccgcgtcgctgccctccccgtcaccatggcgacgatgttctaaagactcgaggtcattgaccctcatcaaggcatctaagatggagcgacctgttaatgtcgtggacacatattttctatttgatcatgtatgctcctgtagccatgttcttaagttgttttatgtagtcctacatacaattgaactcagaacacatggtcatgcctctgctaaagttacttggaacttttacatgctaagaccatatcctcctcatgtgtaattttcttcaggtgaccggcccttgtgcccgggcattttccctcaatatgcacatatccccagaaagcaatttggtaatatcgtatttgtttattagaatatgtttgcacaactccataaagttctgaccaatagttagaagtgattatgatgaacatgtgtagctgacaaaacagctacccttgatgattattttaccccatcaaccaggtgaatgctatatgtacctgaagtatttgttcgggatgttttctctctcttatggacacaaatatctagcttctaagaactaataaatatgcacattatgttgtacataaaaatgataatgtttttatgattgagcacatg

SEQ ID NO: 8440 - DNA, 832 bp, Triticum aestivum
  Clone ID: PAT_TA_8440
ctacggctgtagagccaccgacgggcgatggcacgccgcccgaggcgcggccaggcctccgatttcctctacgccagtctccacccaggcctcgcggggctaaccatccgtcgacttcggccgtatttacgcgccctgccactgcgctgcccctcgtcttcttcttgctcctgcggcccctccaccccgcctccccccgcttcgctcgcggcattaatgcggcggcggcggcggtgctggtaaataccgggagcggactggagcgtggcggtgccggtgcctaaaggctgtgccgcttttcgtctcctcctcgtcgtcgtcggcggcggtggacggcttcggggtggcagggacgtagggattcagccgtctgcagtcctacaaccagcctgtggagttgattggaagccttgcaagatgattgaggggaggcggcattcggttgatatcccgatctcgagggctctgggtccccgtcatgaaggtccagatctctgagggacccagacaccaactcgctggccaagttctcggccaagaagaccatctgggaggggtgttccctcgaggaagatgacgtggaggcaagcaattacggcagacacagcttcagctacaacatgtatgatcatgtccagaggaggagggaggagtttggcggccgcctcgccaactctccgatcaacataatcaaggccaacgcgcgggtgaaggcggcgcttcataaccagaactgctgctctgcgatccctgggatgtcgagagctgccaaggacagggctttctctctggtgattgaaggggaagagctcggtcggagtgagccccagga

SEQ ID NO: 8441 - DNA, 563 bp, Triticum aestivum
  Clone ID: PAT_TA_8441
gcgagaacaaccataacgtggactacgctctctgcgtcgcttccctctcggcagacccctccagccgcgacgccagcctccacgggctcgccctcatctcggccaagctggtgcaggcaggggtggagggcatggactccggcattgcagcactccgggccaaggaggcaacgcagtcgacaaggtggtcctgcctcaacgcctgcatggacgtgttccgcaacgccatggccgacctcgacgacgccatcgccgccatcgaggacgggaggttcaccgaagccaagacgaagatgaccgccaccaccgacgcacctgtgacctgcaacgacgagttcaaggagcagggattgcagccgcccatggaaggggatagtcggcgcctgttccagcacgccgtcatctccctcgccatcatctcattactctgaataacaaattattaagcaaatgtcactagtacatattgctctattcagcatacattgctctattcaagtatgtaatgtgactcttttatcatctgtgttgcaagcgacagagggatttatgcagtatgtata

SEQ ID NO: 8442 - DNA, 1930 bp, Triticum aestivum
  Clone ID: PAT_TA_8442
ccccccacccctccgcaaaaaaaaatcctctgcccgctcccctcggccgcgcgcgcgcgtcggcgtcgcccgccgcctccgccgccgcccgctccggcccgacccggcgggggaatggggaacatgacccggtcggactcccccgtctcgcgccgcatcgtcctctccttcctcgacttcctcaactccgttgagttagctcctggggctgaccctgaagctcttgaagtcgctaaggattgcctggagtccctttttagcatcaactcatcatcaactagcgagaggatacagccaggacttctacttgaactctttacttctctgcaagctaatgaacaagatagggcaagaccagatcccgtgtcacgatcagtgtcaaacaaaccttcctgcagtgcaagtactcccagtatccaagaagagtcaaataaatgtacaacatcaaatagtgaaggccaagcggaagaaacctttgacctagatcatgcaggagatgagctgtttgcaaaattctttgccgcgcttgatgaaataaatttcttcaagacatcaccagctggtgctgaggatcctgatcaactttcaaaagcatcacaattcttcgatgatgcattactggaggtgcgcaagtcgggaagaaaagtggcaagcttagtagaccttgcagaattctttaaatcaaaaggcaatgacttcatgagatcaaaacaacacctaaaagctgtagagctgtacaccggtgccattgcattgagccgaaaaaatgccatttactattgtaacagggctgctgcatatacgcttcttaatatgtgcaatgaagctgttgaggactgcctgaagtcaattgaaattgatccgaactacagcaaagcatatagccgacttggatctgcttattttgctatggggaattttcatgatgctctgcacaagggatacttgaaagccgctgagcttgagcctggcaatgaaaatgttcgactgaatattgaggccaccaaaaggaagctggctgaacagcaaactgcaccaggacagaacacacatggacctcattcatggtttggtggccaggcgagcagtggtgctcctttcacagtattccctcctggaagtgctccacctcctcctgaattcttcaatatgatgaaccgtgggtctggtaatgggcaacagccacctccgcactccgtaaatataaatctgaacgacttctttggtcatgcaagcgtcaatgggaatgcccaaggaccaccgtccgggaatccaggcacccataccccatcagctcctttcccagccagcgctggagtccctccagcttttcccttcatgggctcaggcaccgaagcaaaccatgcacagcaggcttcaggcggacatggaggagggcacagtgaaccaggtgcccagacagacgctggcatccacataaatattggggagagcatggtgagcccagagcaggctgctgaggctctgagagctgtgatgcagatgtttggaccgcagatgggccccaatgaaggcggtggtgcgcctagagggccaccaccaccacctggttcaatctgatgtgatgtgatgtgatgtgagaagtgaagccaaaaggagtggagtgtaatgttgttggttgttgttcatagtcagacatgctgtgtgttgccgtggttagctgctcatcaacaagatgttgttgtcctcctggtaaatgttttggctgtttaggtgggtatacatggtcatggacctgcagttgtatcctgctgccataaccctctctgtctgcatatgcatatgtgagagtcaacagtccatgtacctgcagaagatttcctagctgtcagtcgcgttgaattctattctttaccatcgtcgtaaatgaagttttggcaccgacagaagttacctattattaatttgg

SEQ ID NO: 8443 - DNA, 928 bp, Triticum aestivum
  Clone ID: PAT_TA_8443
ggagacgccccggccgtgaagacaaggtataggaagaagagagaataccactgcgccaactagtagcaactcaagagtcgattgattacgttacgtgaagtgcgtcgatcgatccctaggaaggaaggaaggaagcaagcaaggataggataggatgcagggcgaagtggagcagcaggcgccgatgcagatggtgctgcgggtgaagcacccgtcgtcgctgtccagcggcagcgaggaggcgtcggagggggaggggtcgtccaggtcggcgctctccgtgttcaaggccaaggaggagcagatcgagaggaagaagatggaggtcagggacaaggtcttcgcgcagctcggccgcgtcgaggaggagtccaagcgcctagcattcatacgacaggagctggaagggatggccgatcctacgaggaaggaggtggaatcaatacagcggcggatcgacaccgtcaaccgccagctcaagcctctcagcaagagctgcgtcaagaaggagaaagaatacaaggagattctcgaggcgtacaacgagaagagcaaggagaaggccatacttgtcaacaggctaatagagctggtgagcgaaagcgagaggatgaggatgaagaagcttgaagagctcaacaagacagtcgattcactctattagttagacgtaataataatgttaattaccacgcccgagagcttaatttcgctgtgcaatctccgtccgtcccatggatttgaatgtatgtgatctgtacgtgtcagcttgtaactcacaccatgtcgtgagcgattcttctttaattttcgcctttcttcttgcttgcttccttgtgattgacgggtttgttgagtccatcttgttgcactgtcgttgtcgagtaaaactgacgtatttaaacgaaaaaaaaaaaaaaaaaaaaaa

SEQ ID NO: 8444 - DNA, 1791 bp, Triticum aestivum
  Clone ID: PAT_TA_8444
ccctattccggcggcggccgccgccgcttcggcaacgcaggttcatattcctcctccaatttactggtctttggtgtctaaatacgtcgctgggtgttccatctagatccaggcgctactcggattccccttcaatctatcaactccgatttgggatcgcggtaggagccgtcctgtatatagctccggccgacgcgcgagagcaacgcatccgaacaagccaaggtgcgggatggggagaaaggcgcctccttttgctccggccgggcggaaacgcaaaggtccgtcgctcccctttctctcccccggcaaacgccgctttatccccactccggcgcgggcagccaccggctgggcgtccctcccggacgacatagcccgccaggtcgccgcgctggtgctggaatccggcgtcgtggactacattgccttccgcgccgtctgctccggatggcgcacctgcgcgcccactccgcgcgaccccaccctccggatccggtctctccgcccggtcggctgggtcgcgctctgtgacggcgacgccgtccgccccgacgacgcctgccagataaccttcttccacaggcgaacggccaggtgcctccgcgtccgcctgcccgagctccagcgccacaggatcattggcttcaccgatggtcttgtcatcctgctgcacaagcgagccaccgcggtccgcgtgctccaccccttcacgcgcgccgcggtcgacttcccgtccctcgtccccgtctaccaggagctgatccggaaccgcaactgcgtcctccgcatgaacgctgcggtttgtagcagtgtgtcatccaccacctccgttgccgtcgtggcctggttcccttggtcatctgtggtgctcagtgccgatgcaggccacccgagctgggaggtcatccaaacaaacatgtatctgtccaacaccttgcccttccaaggtcagctctacggcttcctgcagtcttcaaggcagattgtgcaagtctaccctcccaagccacccaccggtcctgttgttgctcatgttccacaaaagtttggtaacccgcttttctgcaagtactatctcgtggagtccgatggagacatgctactcgttgtcaagtcgcccaagtttgtacaccccgatgtagaggagtggcgacgttacatcattgccatcttcaatgtgaatataagcatcgtcggccaccgggaactgattcccgtaacaagtctcggcgaccgggcattgttcgtctccttggacaggtgcttgtccgtgtcgtccaagaaccttccgtccatcagcagcaactcgatttacctcacggtatcactcccggatccggtcgtcgtgcattgtttgagcagccgatcgttcgagcggccaacggcgttgtgtcaggtacatgacggaaaggagatgatctgcacatccgtgcggcccttcactcttgctgatcatcttctcacctactgcaatcatcatgaatggtcaaatggactgatgtttcatgagtactactccatacctgagtcttttcaagggctgtggaagaaaataagaacccaggattcccaactgaggatttcacgcatgagagattgaatcagatgataagtaggcatgtggcaccgaaaaaataatagtccctctgtattgtagactactctttgaaaatgagaatattatttaatttctttattcctaatgctttcaatgtaatcaatatgatgatgtaactagaattaagaaaaccttctcctcacttgcttgtatgaagtcagtcttgtttg

SEQ ID NO: 8445 - DNA, 1016 bp, Triticum aestivum
  Clone ID: PAT_TA_8445
ggaactctagggttcctggtccttcatttccgttccccccttcaaagtgttctgaaaaacagaatgcctcaagacagtttcagatcagtggtttgcaggtccctttcaaagagtcacccctccagctccaggagcaaagatggcagctaccttgaaagaactcagtgtgatgccccttatgttgtcacactgcaacccacagtctgccggagctgccaaagccaggattggcgcccctcgcaaagtaaccgggaggagaggtccatcttgtcgcaaagagattacgtgatgggttccacactctcgaggcattttgccgaggacctcctaagaggcgctatggacctccaggactcccttgtcatgcttgagaagttccaaacagtgtcacagagcatgcggcaatcgactaagcagagaaggccagggaacgacgaggaatcattggacgtcactggaatccgtgaagcactcttcgaagcatcaatcgccaagaagctggtccctggaagtgtcagcagtagatttgacgggcaactaaggaattctaccgacgagctgaagagagtgatcaaggacagcctttacagggcgaaactcttgtcagtggcctccaatggtgagcagctggcctccttgagccagtcatcacggagcacgccaaacagtaccgccgtatccaagtctactaaggagaagaaggtggtgccaagatcatcatcctgtccacctgtgcaacctgacaagtccaaatccccaagtttggtaccaacaaataaaaccccgagtttggtagcaaggctcatgggtcttgaaggtttgcccccacacaacggaaataccgccaagaaagacgagacactcaagacagtaagttcaccaagggcgcagtttgatattgacatgcctaggtcaaaaccaacaccagcagaaaagctaccaaggcaatcattaggaaaggactctcagcgtaagggaaaggcagggcaagagatgatgaagacaattcaagtcaa

SEQ ID NO: 8446 - DNA, 778 bp, Triticum aestivum
  Clone ID: PAT_TA_8446
gggagctcgtccggtacctgtgacaactcccaactccagtctgatgcggttccaaattctcccctctagcagccctagagctgccgccgtgacttagcttcggatcaacgccccaacaacgccccccgccctctccctacggcacaatccctcctcgtgcggcgtcgccgaacatcgccgccgttcccgtttccttgctgtcctgtccgttcttggactttgatttgtttacgaggtcaaagggacttatgtttcatgagtactatgttataccttcgtcttggaaggaaatgttgagaaaaattacgttacaggactgtgaaattcaagtttcatgtgtgtgtgaagagaacgaagtgggaagtttgacgtcaaagaaaaagaacctgggaataacaggacgcacacttgccttacactggaaatcgtctcattctggagcatctccagaattgatattactagagcagatttcgtcctaggatggaagatgggagactagagccctgggggacctgtcacactagccatttcccctagaagagctccccaaaataaggtcgctgtggtgactgagcttagggatctgtaataatatcgttaagccggtgttctattatggctttgttctgctgactttgatgtggttgttctatcatgctagtgagtagggctagaactcaaccttcgtgtctggattaagactaatatgttttgagcttagtgaaaccgccctcgactgttctagttcagatcagcactttcggacatccctttt

SEQ ID NO: 8447 - DNA, 502 bp, Triticum aestivum
  Clone ID: PAT_TA_8447
cgtccggaccgtcaaattgatgtgtagtttacagttaagtatcaagtggatgtggggcaatcttatttacccaagaagctcttatttgacaaatcaccatccagtttgctgtatggctgattctgatgcactcaaagtgaacaatgaagaataatgattcttcttataaaattacatgattaattaaacctcagttcctcatgtttacttcatgggactgaaaatatttgtacgaatttatcaatcatgtgtcggccttcatttgcatctcatcctcaaagaaatctgatatgatttaattccattggcaaattattctggttagacttcaagcttgggccagtaatttttattgtgtagataacaacacgtggacctccttcagattaatgagaagaaaaactctgggttaagtggatttgtgatttatgatgttcaggtcaaggacgtcgtgttctcctgcttgctctggttcggaccttttatgctctgtttggcctgt

SEQ ID NO: 8448 - DNA, 534 bp, Triticum aestivum
  unsure (1)..(534): unsure at all n locations
  Clone ID: PAT_TA_8448
gttcttggcgatgggtcactcaggacggctggcacagctcagcgcctggctctgccggagtcctcgtctacatacttgcttcaagaactaaagatgatatgggacgaggttggacaagaggaaaatgagagggaaagaatactggaagagctagagcaagagtgccaggaagtttacaggagaaaagtaaatagtgctaatatgttgcggattcaactgcatcaagcattggctgaatctgaagcagaatttaccaacctacttctttcccttggagaaagatcattcccaggccgacctgagaaaatgaatggcactctaaaggagcagctgaattccatcacaccagccctgcaagaaatgcaaatgaaaaaagaagccagactaaaacagttcacagaggttcagactgaagtacagagaatcgcctccgaaatagcaggacgctcggagaatgaagttgtcacagtaaatgaagatgatttgtcactcaagaaacttgaggagcaccaaagngagctgcaacgacttana

SEQ ID NO: 8449 - DNA, 2315 bp, Triticum aestivum
  unsure (1)..(2315): unsure at all n locations
  Clone ID: PAT_TA_8449
cgtccgcgaattggtgaggttccaacctggcgggagtcggctcggaagataggaggggatggatcccgtggaggcggaggagcagcagaccgcggcggaatgagaggagccgtcgccgccaggtcaccgcagcggtcgcactcgcatctataccttggccgcctgcctcgcgcttgcggatacctggaatgaggcctatcctaaacgggacgccgacgcggaggcacgagaccagccacggcctgcattgcgtatcttggcttgggtagaatacgccgccggcggtgtttcgccccctcaccacttcttcgcgggcgccacccaaccccctccgcagtttccagccacccgcatacatgctgccaagaatatctttgccgtcgccacatagctctcggcagcctgcatctggcggcgcgcctgacagacccccagtactcgccgcgcgccgccgctgccacgctgcgcgctacattcactgctaccccttggctagcttctcagtcacatccaagcccttcgacttcggcagttcatctccgacgcttacctcacaaacgcgcacaacgcactcgcgtggatgggtgtctccggcccggcgacgtccagtcctccctcaacctccaaggacgcccgccatcgtcgagcctccctccgtgggatgccatggagatgaaactcccctcgaccagggaattcaagggcatgtgggagagagaggaggtccatggagaagatgctctgctccaaccctccttgcctcctactagaagatgtcttttttgtgtgtgcttgtattgcagcagccatcagcagcagcagcaggccgagtgacggtggtggctgtgtgcaggccatggaggcgatgatgagcatgaggggaaggctgctgcttcaaccccgtggcggttccgtaagaagcacaataaagtctgtatgaaggctatgagaggatgggcaatacagatattgacagggctggaatatcttcacagtcaggaaccagccattattcatagggatttaaagtgtgacaacatattcataaacggtcatgatggacaagtgaagattggcgactttggtctggcgacatttttgcatcaacggaaaacgagaagtatcaaaggcacattagagtttatggcaccagaactcttcactgggaattacaacgagttggtggatatatattcatttgggatgtgcatgcttgaaatggtgacatgtgaatatccatacagtgaatgcgaaggcaagccatggatatacaagaaaatttctgaaggtataaaaccagctgtgctttccaaggttgaagatgcagaagtaagaggtttcatagaaatctgtttggctccggcagctgaaagactttgtgcaagtgagctcttaaagaactgtttcctccagaaagacaagcctatcccagtccctgcgcctcctatttcagtctctctggtctcgagtgtgactaaagatgggcggcagtctgccagtttcatgctatggaagggtgaattctcactgaaaggcgatatgcatgtcaccgaccatgttaatttatcgctaagatttcctgatcccagtggttgttttaagaatgccgagttcccgttcgatgtggaccaagataccagcctttctgtggctctggaaatggtcgacacttttggacggtggcggcggcggcggcagaggctatggctcgatagcgagacgagtctgctcagcctggcccccgacggggtcccctccgttgctgtcggacgggtggttgtggttcctgagagtgcacacagccactgctccgtctccttacctctcttgtgctgctgcctgcgctgtgtggccgtcctaggttgggcctgccttccccgtccctgtgtatcttcccttggtttggtttagtccggcggttttcgccgtgctcctgcctctggcgcggctctcatttcggcccccactcgatgtgctgccaggcttggcctttttcctggaggatggccagagttcgtgcacatcttcgagcttccgtgctgggcctgttgcttcgctggggggcggttgtgtcccttttttttcttctgacggtggtggtcattcctatctccatggctatgatcgcctggtgccctgcggatagcccgcaagccatgaaaaattacagnttaacacaacatatatattgtcntacacactcatgatctggnganagnnnnaantgccnngancnntgnnntgtagtgaagntcagaacaatggtnngcacgcacttggtcgttagcgaaggntacaaccgngncngcanaatg

SEQ ID NO: 8450 - DNA, 825 bp, Triticum aestivum
  unsure (1)..(825): unsure at all n locations
  Clone ID: PAT_TA_8450
gaagtactacaagcaatgcttccctgcgcaagttactcaccgactagacccaactgtaaatgcaccaaggccgggagaatatgagatcccctctagttgattggcctttgctcttttacctaattgttcctctatgggccccaatgcctatgcactatactcctcagaagccagtatatagaatatttgtcctcagtttcctgttgctctcacagaaatgtgaatggagtacaaggatatacatggacctcgagcctgcctagatcattgagtttgagaacatgaaccctacattgttctcaagtttgagccttgttgaagaaatgcgctacttgcgatggaacatatttgagacatattgttgattgttggcagtgggaacattataaagaagcatccacaccagtatgcttggttaactcatgcttcacactttcacaggatcaatggcaatctaaatagcagcagtactaccaatggccctgcaaggaaatgccctgctgtcatgatggctggatgtatgccgaggaagattttgtttaatgaggtaaaaagctggaaccattttaaagaaaagcatgatggctgttgtgtatgagcactacttgttggaaagaagaatatactgctcaccctatacaccaagtcgtttgtagatactatatgtttcatcgtattatcaccctaagaacaagtacatgttctctattctgttaatctagaaagtccgatcaggtgttgccttatactgcaaacaactctatttgtatcaaaattctacgaatatttcataccattnaataaaagaatagcgaaccaacctgg

SEQ ID NO: 8451 - DNA, 1479 bp, Triticum aestivum
  Clone ID: PAT_TA_8451
catcaacaaccgggtcggcgcaaaactctgtgcaggcgcacgttctagccgaagccgccgccgccgccgacgagcacgacatctcaggtgaggaagggaggcgggaatggcggatcataaggtggctcagttggggcctggagctgcgtgctgcggctggaaccactgcggccggcgcctagccgccggcgccgtcgatgggtccgtttccgtctacgattctcagccgtccccctcctccaagtggcaggcccatgagcatgccatagtggctgtcgtctggcttcctccggactacggggatgctatagcttgtgtctgtgctgacggtacactgtctttgtgggaggagattgctgaagatgatcaacttccaatctggagaaaatgtaaagtctttgagggtggcagttcccacatcctaaatgtacagtttggtgtgctgctgtcaagtctgaaaatggttattgcatactcagatggtcaagtgaaagtctatgaacttttggattcgttggaattggacaagtggcagcttcaggcagagctacagaatattaccgatcctgtttccagaattgggaagccagcatgcatttctgcatcaattgcatggagtccaagaagaggtgaaggccagcaggctagttttgctattggtttcaattcggattctccaaactttaactcttgcaagatttgggagtttgaagaagctcaccagcgctggcttccacttattgaacttggttcaccggaggataagggggagagagtacatgctctagcatgggctcctaacattggcagaccatatgagatgatagcagttgcaacctgcaaaggcattgcagtgtggcatgtaggcttcaaccctgaatctgacggcagactgtcaacagagaatgttgctgtacttcccagccacaatggggaggtatggcaactggaatgggacatgggcggtatgacgctcgcatcgaccggagtggatggcatggttaggctatggcaagccaacttaaatggagtttggcatgagcaggctgtgcttgactgcaatgggtcacaccagtaagggctgttcacaacaaataggatcccaaattgcaggcacaaagcaaacttaaatgccttaatagctctacaacatgaagataggatcccaaattgtggttgctatctgttcacaattctgcaaggtttctttatgttgtcttgtgtggaaggtatagcgcatgcatggttggctttgccctgacaaaactaggctcctcaaccatgaatgcatgatgtacctgttatccttatctggttgatgatgtagctgttctttatggccatgtgatgggaaaaaaatggtccacagttgataatgtatctgttctcttgtaaacaatttagcctgctgactaactttattttattcaactgtcaacaaatcagttcacagtttccttaaaaaaaaaaaaaaaaatt

SEQ ID NO: 8452 - DNA, 518 bp, Triticum aestivum
  unsure (1)..(518): unsure at all n locations
  Clone ID: PAT_TA_8452
aaattcggcncgaggcacagacaggactagggcatcggcggtcagccggcggacctcgccgtgggcgctgcggcggaaaaagttcgccacagtacggatgtactgtcccccgacttccagcggacaactagccccacccctgcccgcccttctccaagtcggcgcaaccccctccacagccacacacagcgcccagctccaccatccgccgacgccggagaagagaacccccagtcttcagggaaggatggagtcaatgaaaagcatgcattgctccaagtgtcaggtcaactacagcgatatgacttgaagatggattaaaaggtcgtggaatgccaatggatgatttcactagttaaaatcttggctagactcttcatttactcttgaacgtttgtttttcaaaatgtgcacttcctgtggaacatatgtttcttttttataccaccttggaaactccatgacactatctgtacaatatttatatgtgatgggcgaaggtgaaagcaaaaaaaaaa

SEQ ID NO: 8453 - DNA, 612 bp, Triticum aestivum
  unsure (1)..(612): unsure at all n locations
  Clone ID: PAT_TA_8453
cagcgcgnaggggcaagagaactcggcggcgacgctcttcagcctgtccatgctcgacgagaacaaggccacgatcgggacccttgggggcatcgcgccgctggtggagctcctgaccaacggcaccgtccggggcaagaaggacgccgccacggctatcttcaacctcatcctcaaccagcagaacaaggtcagggccacccaagccggcatcgtcccagcgctaatgaaggtcatcgacgacaggagccttggaatggtcgacgaggcgctctccatctttctgctgctgtcgtcgcatccaacctgtcttggagagatcgggacaacgccattcgtggagaagctcgtgcagcttatcaaggaaggcacacccaagaacaaggagtgcgcgctgtccgtcctgctggagctgggctccaagaagcagacgctcctggtgcacgcgctcaggttcggcctccacgagcacctctcacagatcgccaagactggcaccagtagagcgcagaggaaggccaactctctcattcagatagcaaaaaagtgctactgaatgtgagacccatttgtacctgcctgtaattcatcccgtttttgatagaaaattta

SEQ ID NO: 8454 - DNA, 563 bp, Triticum aestivum
  Clone ID: PAT_TA_8454
ctagtttcttagagaaggccgcggaaggtcttgtcgaaggtggcaagaaggagatcttcactccgatgtacttctttgtggttcggaagcctctttcagaatgagcaactttcaggcaatgcaaagatgcattttgaagaagcgggctcgaccgaggagtttggctatggcgatcctcggttcttatctgtagaagagatgtagcgaaatgtgttgcgtttctgtttgttttgtatttaattaatgttgagcttctgttttgttgttttgtcgtgcgagcttttgatcctcgtcgattaactgactgtttgacgccattgtgctaagcgattagtggcataaataagctagatgcagttttcttccccgtcaaggtttgcataaggccgttccgatttcttgcccaaacaagtgtgtgtactgtgtaagatccggtggtgctgaagttttgtaacctaggaacgagaatttcgcatgaatgatcgttctcagtactggaattttcaagtatgtttgccttaagaataataatttgaggggtatgtttgccttaattttattgt

SEQ ID NO: 8455 - DNA, 1699 bp, Triticum aestivum
  Clone ID: PAT_TA_8455
gccccccttccccccccgcctccccgagatctccgcccggccgcctcttccagatcctcctcctgctcctccataccccccgaagctccgtcctcctcctcccgagactccgagatctccgccccggacccgtttcttccccaccaaggcccagcgcagccgcccggccggccctccctgctggagccgtcgccgccgccatgttatgagaaatatcatggatactacggagggaaggaggaatcgaggaaatccaactacaccgatatggttaataaatattatgatcttgctactagcttctatgagcatggctggggtaaatccttccacttagctaacctacgcaatggggaatctataaggtacagcatcaaaggtaacaagcactttttggctttacagcttgagttgaaaccagttatgaatgttttggatgtcggctgtggaataggcgggccattaagagaaattagcgagatttagctccacctcagttactggattgaacaacaacgactaccagataactaggggaaaggcgcttaatcggtcggtaggacttggcgctacttgtgattttgtcaaggcagacttcatgaagatgccattctctgataacactttcgatgctgtttatgccattgaggcaacatgccacgcacctgatccggttggctgctacaaggagatctaccgtgtattaaaacccgggcagtgttttgctgtatatgagtggtgcattaccgatcactatgatccaaacaatgcaacccacaagaggattaaggatgaaattgagcttgggaatggcctgccagatatcagaagtactcggcaatgtcttcaagctgttaaagatgctgggtttgaggttatttgggacaaggatcttgctgaagattctccattgccttggtacttgcccttggacccaagtcggttttctttgagtagtttccggttgactaccgtgggacgaataattactcgcaatatggtcaaggtattggaatatgttggtctggctccggaaggcagccagagggtctctagtttcttagagaaggccgcggaaggtcttgtcgaaggtggcaagaaggaaatcttcaccccggtgtacttctttgtggttcggaagcctctttcagaatgagcaactttcaggcaatgcaaagatgcattttgaagaagcgggctataccggggagtttggacttccgatcctcggttcttatctgtagaagaagacgtagtgaaatgtgttgcgtttctgtttgttttgtatttaatgttgagcttctgttttgttgttttgtcgtgcgaccgttttgatgctcgtcgattaactgactgtttgacaccattgtgctaagctattagaggcaaaaataagctagatgcagttttcttctttggccatgcgagcatttgatcctccccaattaactgactgtttgacgccattgtgctaaacgattagtggcataaataagctagatgcagttttcttccccgtcaaggtttgcataaggccgttccgatttcttgcccaagcatgtgtgtgttctgtgtaggatccggtggtgctgaagttttgtaacctagcaacgagaatttcgctcgacgcggccgcctcagtactggaatttcaagtatgtttgccttaagaataataatttgaggggtatgttgcctt

SEQ ID NO: 8456 - DNA, 513 bp, Triticum aestivum
  Clone ID: PAT_TA_8456
cagggtggccaccttctccgtgccctcttccctgccgccgccgttgtcgccattggtttgccttgccggcgacaaccactcggccacccttcaattgtctcgcccgctccgctggccggacacacacgatgcttccaaccgactgtgtcgtcttcattgcgctcctcgtgctgctcggagacgcggcgaccgccgtcgctggcatccgcgtcgaccctgccatgatgatccggcagccgttggattctatccctacgttccgcgaggcgcccgccttccgaaacggcgccgagtgcgctggcggtgacaaggtgaacgtcgccatgacgctggacgctaactacctccgtggcaccatggccggcgtgctctccatcctgcagcacacagcgtgcccggagaacgtggtgtttcacttcctcgccgcccggatggacggtgacctcgtcgccatgctgcgcgcgaccttcccttacctggacctccgcgtgtaccgattcgacccgtcgcgcg

SEQ ID NO: 8457 - DNA, 693 bp, Triticum aestivum
  unsure (1)..(693): unsure at all n locations
  Clone ID: PAT_TA_8457
gcacgaggcgaacaatggagacggctcgccggagacatgctggagccgccggccctgccttcgcttcggccatccttgtgatcttcgccttctcatgtgtggaatctaaaccggcgcgggcgcgaacgccagagcatgcgtctggaccggcgtcggcacctgcccatgcgcctgcgtcggcgccggcgccggcccttgggcctcatcaggcggtaccctctcacgctctgttcaactacaaggacaaagacccaactggccccgacaaatgggccaagctgaataagggctgggctgcctgtggcgacggcaagaagcagtccccgatccacatccgcaacgtggagatcaacaaggacatgggccctctagagcagacctacaagtcaagcgcctgcacactggaaaaccgcgggcacgacttcatcctgcaatggaaaggtgggaatggcaagttgacgatcgagaagtaggtttacgtgctccagcaggtgcactggcacgtaccctcggagcacaccgccaatggcaccaggttcgacatggagttgcacatggttcacgaggactccagcaaggcgcgcgccgtcgtctccgtgctctactccaccaaagaggcnggcgaccccgacaagacgctgactgatctggcgccatatttcaagaggctcgccggcaagtacctcggcgcga

SEQ ID NO: 8458 - DNA, 1071 bp, Triticum aestivum
  Clone ID: PAT_TA_8458
agaggcggctgccccccctcacgttgctcgatccccttactccgacgccgaccgcactctatctcaaatccgtctccacctccaactctgatcgccctcccctccataaattcaacccacacaccggagacgaacctagatctgggatccatggaccttacaggaggagaggaatcctcgacacacaacatgcaaatcagttggccgtccttgaacccccctgctcacggctacatcgacgacggcggcgagcggccacccttcgtcctcatcgagccctacgcctgcttcgccaacctcatcaacggcaccaccgccagcaccccaattatgttcgacaccgagctcgagggctgtagcatccaggtcaccttctgcgccgtccacccgccggacgtctcttacctgtgcgtccacgccgtaggcttgggcgaccccctgttcaccaacccgcctcgcatcctcgccaccgagacggacggtagcctcctcctgctatgcgtccccatccccatccccggccatcctttcccactcggtgcctacgtcaacagcacccgagaagagtacttcgtctacaacccccgcgtccctgtgcttgagcaccttcggcacccggaacccggcagcatcccctgcttggttgacggcacggttgccatcgtgcgcaagtgcagccaacaccaacacaccagcaacccaggccgcaaacaacaaccccatcgagccggcgtccacaacttagccctacatccccatggagccggcgtccacaacttcgccctacaatcccacggagccggcggccacaagttcggcctacaaccccatggagccggccgccacgactgcagcaactgcagctacgtcattgcggcgcaatctgaaaggttcggatctgactatccttgtcaactctacctctatcactccaatacctcctcctggaccactccgtccgtggtattcgagacgcccctcgacaacgaataccaaacacacaagacaatcttcatcggaggagaaaagggtactctggcctgggtcgatctctctggaactattgtcttg

SEQ ID NO: 8459 - DNA, 611 bp, Triticum aestivum
  Clone ID: PAT_TA_8459
ccacgagccagtgagcgggcggcgtcagccctggccgcccggccccgccagcgctcagcgtcaaccatggccggtctggctcgcttcatcctcctcctgctcctcgtcctcgccgtccccgtcgctcagcctaccccctacagcgacaacctccaggacgcgtgcaacaagacgttgttccccaaactgtgcatccaggcgctgacgggcaacccggagacccggacagcggacgcgcgcctgctggccgagttgtccgtgaacttcgccaaccaggcgggcaccaagctggcagcgaccgctcacaacgagctcaacggtgtcaaggcggacgacgccctgttcaagtgcctcgacagctgctccgacgacatcgaagaggcggtggcgcacctcagcggcctcagccgcgaggtcaccgacaccaagttcctcgaggtcaagtcgtggctgtccgcgacgctgggcggctcctccacctgtgacgacagctgcaaggacgcgcccgccagtgatgccaagctgttcgtcgtagccgagagcatcgaattcgagaagctgctccgcgtcacgctcgacctcatcaccgaggcctccggcccccatgtccg

SEQ ID NO: 8460 - DNA, 651 bp, Triticum aestivum
  Clone ID: PAT_TA_8460
tataccaccctcccggagtagatttcaatggttcaccacgtcttccacctccaaacttataggcagttcctgcgaaaaaaagaccgtcagctcgattggttcgagtcagtcctgaagtagaaagaatgtttcagtttgtcccttattactaattgaagtgacatgtgatgttttgttgttgtgatatgaccaagataacaagtgaaactgaactcgaattgccgacatgtttgtttggataccagaggcgggagaaatgcagttgtccggcaccctgtggtccacgaaggagaggcgcctgacaactgatgcccgagggctgccttgtacctgcactcgacttttcagtgcaaactatccactgtaggggttcctttcctctgtgaggaacgagttggttagatgttggattagtgctgccatgttggccgatctgtgcccctgtcaaatgtttctgattatccatgtgttggatgcaaaggttgactgattctgctaccatgcctgagtatttttgctgccatgttgaaacattaagctgctggttcagtccaagggtctgcattgtttcatcatgttaacacaactgattaattgtatcttgccaattggggcatatatgatatgcatgaaaaggaaaagaaaattggt

SEQ ID NO: 8461 - DNA, 1045 bp, Triticum aestivum
  Clone ID: PAT_TA_8461
gcggccccccgggctggttttctccctggggggtgggtgccatcagcttttgtgcatgtttcatggagaggagaagccgctccaattccatctcctgaaggaggatgcccaccatccaaggtgctcaacatcacatccatctattgcctgccaagggcctagatagagaaccttatgcttactggaaagggaatccagagatcgcaactataaggcaagagcttatcaagtgtgatgtttccagtaaacaagaatgaaatacacggatctacaaacaggattggatcaaagagagcaaggcaggatacaagaaatcatatttggccagtctatgcacccataggtacaagatctacattgaaggatcaacatggcctggttgtgtgttgttgagcatggcccgtgttcaacccaaaatactgcgatttcttttcaagggtgttgatgcccactcagctttatcgccctgtcccagtcgcggcgggatagcaggttccgttcccctgtgagctttccccgctgggttcctgttgccagtccgcgatggccgtcgagccgggggcctcctgcggataaggtgcgtgctgcgagaattgtctggcctggcgatctactgtgtgagcgaccattaagaaaagctcgatttgtggtcgaaggctgcaaaaaattattacaatgagcagtctagccaattaattacagttagtcctttaagttagatttagtattagctgaattacttgcttctattgacagtgaaaaagtaccataattttagtaaacattgaaggtcaaaagaaagcaaattattgtatcaaaacttatgcttgccggtatggctaccctgcgatcgcccctgtgaggctggagcccagccagtgcgatggttccagtgggcatgattcaaatgcacgcagcctccatctcgactgcaccaaagagagcaaggcaggatacaagaaatcatatttggccagtctatgcacccataggtacaagatctacattgaaagatcaacatggccagttagtgagaagtatatca

SEQ ID NO: 8462 - DNA, 956 bp, Triticum aestivum
  unsure (1)..(956): unsure at all n locations
  Clone ID: PAT_TA_8462
ggagcncctcaccggccacttcactccacatccaaagcggtcgaaccaacggcagcggcggcagcggcagcccggtaaccaggcacggccatggatctcgaagggaagatctgcaagctagctgcccgtgcagcggccacctcgccggcgctggtgaggaaggctgtgggggcactggagcgcagcagcgccgcgcgcgcggccgccgaagtcctgatctatcagttcctgtccgctgtcttcatcttctccggcttcttgaacctcgtcgcggtcgaggcctgcggcgggaaaaactgcaccgtcgcctccatcctgttcgagctctcgtaccattctggtatgatcgccctgcttctcttggcgccggcgtgcgtgctcttcttcctgcgcgccgcgggcagcaccagcgacagcgaggtcgaggacgaggatcgctctgagatcttcccgtggcccctgatctggccggtgctagggttcatcaccgtggcggcgtcggcggcacccatcgccttcgttcttcagatgtgtggatttcgagaggcttcttaccaagtctgcgtcgcggctgtgttgtgctcggccctactctccgccctcttctacatcggtgctgcggtagcgctgtggaggatgaatcctcaagagcgcagcatcgccggcatgctcaggatgagtctcaggcccagcaacaaggtggcggagtagcgcagcttcacctacgtactcaggtgcacgggaagaatttgcagcagcaagatgacggagatcagagcttactactatactaccagtgcaggagtgattctgtttcctagctactactatctttgttgctcttgtgaacaattaagagatggacatgtcgatcgtgtgatgcgtagttatctatctagtagtataacttagtactcagtaagcctgattcgatgcgaggtcagagctgtcactag

SEQ ID NO: 8463 - DNA, 905 bp, Triticum aestivum
  unsure (1)..(905): unsure at all n locations
  Clone ID: PAT_TA_8463
ggcacgaggcctccccttctctccctctccccgatctagattgacaacgtcggctccctctctccctcgtcggcaggtccctccaccgtggtccctcctaccctagccccggccattctcccttctgccaccctctcatgtcccagtctctcgcctttgtccacctgcagcctattgagcgcgccgcccaacctcaccagcaacatatgcactgccgcccagcagccacggcgtcgcggctggccggctcgtcggcgtgcgcatgcttcaatgcacgccgctcaatcgagctggtcggaccgcggcggcgcgtgacctagggttttggtcagtttgccccatgccggccacgactctccggcaaccaggacggggacgacatcgacgacatcctctaacggtcgtcgtccaccttgcattgcagggaggggtcggtcctctcctcggacgaggggccggccgtgttcgtcgttccacaccctggcagtcgatcccatccgcactgcttcactagcctcctccgcggcgtctccgcgagggcgcttgacgctaggcaggccatggacgcgctggactcaaggccgtccgtgctgtcctgctccggtgcgcggatgctggaggggtccgtgcctgaggaaaaccgagcttcgccatgctggttncttttcaatggccaacaangggaaagggcccgacgaagganaaaaagggtcccctacacccaaacatggttaagggttttccttggggttggttccgggnaagtttnttnggaacccgggtggccttaaaattttnccttggggcctccaanaagggaaaccnggggggccaanccccctgngaaacctttgaanancgggggggacttgggagggaaangggantccatggaaaaaaccant

SEQ ID NO: 8464 - DNA, 574 bp, Triticum aestivum
  Clone ID: PAT_TA_8464
gcgccacggggcacgcacgggacgcggcgccgcccgcgcggacgccggcgacgacgatgaggacgagcttgcacatcgccatggtcgcggcggttgtcctgctgctcgccgtgacggcgacggcgcatgtccggatggacttgatggacggctaccggccgcagcagaggagggccagcggcggcggtggcagctggtctttcgacttcatgagaggcctatggggaggataatttggcgggcgccaccaccacagtttgctcgagcatggtttcattaaggagattcgattgctggaggaacgtacgtgttcatgatgcatgcgacgtatctggcctagatataagaattttgcattttgcttgagaactgaaggacaatatttcttatgacttatgttacctatcttatatgtatgcttcgttcactctagtgaaggacagggccggtgaatggggcgaccttcctggctcgcccatgtcagggcctcggcccgtatttgcgttcttgtgcaaatatgtgtattgtaaatttttcgtataaacagaatttctttcgtgcattaaaaaaaaaa

SEQ ID NO: 8465 - DNA, 551 bp, Triticum aestivum
  Clone ID: PAT_TA_8465
ggcacgagggtggactacagcagcgtgctggacgtgtcggagaacctgggctacggcgagagctccagcaacagcagcaactggaacagcgctccggaggcgagcaatgcgctggagggcgaggcgctgcattgggcctcggagagcaaggtggagcctttcgccggctacgccggcgacgaggacgacaagttcgcgctgccctgccacggccagcaagagcacagcatggcgcattttgacttcaacctcgagtacttctgaggccttttctgatctagccatcgtcgtatatattgtttttacacacgggcacgggcaagaccaaccaaccgggagattagcgactgtactttgtcatttttttctagtctttattactccttttaacactgtttcttttcttttcaccgtctgtttatggttcttatatatatatggctgaaataagaggtatagaaacgtgaacactctgtaatttaccatgagattctgctctctttttattttttgtaaagataaggaataagattcttactcttttgctcggt

SEQ ID NO: 8466 - DNA, 952 bp, Triticum aestivum
  Clone ID: PAT_TA_8466
accgctcgcccgctgggcattggtcgaaccctgacgaaagaaattccccttctctcgctccccccgtcccgtgatggcagcaacggcgcccggcgccggcgccgtcgaggtttccatggaacgacaaggccaaggcgttggtggccgcgaagatcaaggaaggggagtacaaggtgcagatgataggacagtacgcggtgcggacggaccgcgcaatcgatgcgctggagaaaaaggtgcaggacatcgaggcggtgatggatctcgagctgatgctcggcgagtactgcgccgacctctcggacatgcacaaggcgcgccactactaccgcgccacctcgctctcggaggaggagaagctctacctccaccaaatcgacgacttcgccaccgccaccatcgccgagtacgaggccagcgtcggccccgtccccgccttcgacaaccacctcagcctgttcagccaagaaatcccactggagttccccgaacccttggctccccctcccgcttcttcggctccggcttcggcttcggcttcggcttcggcttctcaccacgagcctgctgtggacaatggaggggatgttgcatgctaagagatgatcgcctggagcaccctgcccctttcatttcttcaccgcattgtcatccaagtcggctatcatggttctaggggctttcaccctattttaagcatgtctgcagtttgactgacgacgactaatttaaacttggagctgtgagattgtcagtacgggtgtaggtatgaacatctcagatgtatgcgaacgtgtgggttctgaagtgtgattcatgcttgcattgctctgtgcctatcatcacatcgtttctattactggatcatggctgttggcgtgttgagaattggttgaatgtcagttcataggaaaaaaattaaagccccctaggtttcaccaatttcaagtct

SEQ ID NO: 8467 - DNA, 567 bp, Triticum aestivum
  unsure (1)..(567): unsure at all n locations
  Clone ID: PAT_TA_8467
ggctcccgcacctttgccctcctcgttcgtctccaaccgnaactcaacccacctcctgtcccaactggccgttgccgtngncatccatcctcgtgatcgaacccatccattcgtgtccaaatctcctacgtacgatactcgtgcccaaattgcgctcccgcgcccccggcccccctgcccgcccgccccccccccgtgtccacccccgcgcccgccgccccccccccccccccccgcgcccccccggcacccgcgccgcgctcgcgccctgccggcgtcccggcctcccccggcccaccctcagcgccctccgcccccgccgcgtcccaggcttccgagagaaatgacaccttgctgggcaatggagtcatcggcattctcgccgagaccgtcaacatgtgggagaggagggcgccgttaactccttcccactgcgctcgcctcgtgctcggaggaggcaagcgcgaatccggcgtgaaccggatcatcgtgcagccaagcaccaagaggatccaccacgacgctcagtacgaggatgctgggtgcgagatctcagaagatctgtca

SEQ ID NO: 8468 - DNA, 530 bp, Triticum aestivum
  Clone ID: PAT_TA_8468
gggcagcccaacaaccaactccatatcccctcgaccccttcatctcggcttctacatccatgcccaggtacgacggcggggcggcaacagtggcggggaggcgcaagatctgagctgcgatgcggagcggctcgacgtacaagagcgctgctgcgcccaggtccaggagcaagattgcacgggtgtgccgggaggcagccgcagaccacggcgaggagcgtggccgtgcagaggaggtgatggccacaccaaacagcggccactcaagttccaaggatgagtttgattcaatcgtaactgaagactagaagatgatgcctagaacactgaggtgaagaatggaagatgatacatggttctacccgtgcgtgcttgatgttgtgctatgccattttgtgggaaactaagactgagaatgatgttgtgttgttgctatgtcatttcgcgatgactgaaaattgtgtacttatgtttattcgatgttatgtcattttgtgagaatgtgagagattatttggtgaaaaaaaaaa

SEQ ID NO: 8469 - DNA, 803 bp, Triticum aestivum
  Clone ID: PAT_TA_8469
aggaattcggcacgagggggaggcggccggagccggagccggagatggaggtggtggcgctggtgagcggcggcaaggacagctgcttctccatgatgcggtgcctcgactacggccacaaggtcgtcgccctggccaacctcatcccgctcgacgacgccgtcgacgagctcgacagctacatgtaccagaccgtcgggctcccgaccgcggcccccttcgccttgtgcgccgggctgcccctcccccgccgccgcagctgcggatccacaagggatcatgctcttaaatacagcgttaccgcgggagacgaggtggaggacatgtttgccctgctgagcgaggtgaagcggcgaattccgtccattggcgccgtgtcttcgggcgccatcgcctccgattaccagaggctccgggtcgagagcgtctgctcgaggctgggcctggtctcgctcgcctacatgtggaggcaggatcagactctgcttcttgaagaaatgataagaaggggcattgtggctataactgtcaaggttgctgcaatggggctgaaaccttctgcccacttgggtaaagaactggctgaacttaagggccatctgctccaaatgaatgagagttttggaatcaatgtctgtggtgaaggtggagagtacgaaacactaactcttgactgccctctatttcgtaatgcaaggattgtccttgatgattttgaagtgatactccactctgctgattccattgcttcagttggaattcttcatccgctggcatttcatgttgagcccaagccaggttca

SEQ ID NO: 8470 - DNA, 703 bp, Triticum aestivum
  unsure (1)..(703): unsure at all n locations
  Clone ID: PAT_TA_8470
gcggggactccagcaggaacgggaattcggcacgaggacgggggtcggggtggcgactacaccacgcacgcggcggctcctcacgctcgggggcaagctctcctcgctgggattcagattccgccgcgtggcctgcgcttcgggcttccacagctttcttacaaagatgagcctaatcagttttttcctggactaatcatggaacaaactgggctgtgctttctctgttttgccttcttgctccttctgacttgtggtgaatctttagaagataaaggttatggtgcaagtgcatatgctgtgcactgggaccccgatcatccacattcagaagagagaggttacggtgcaagtgcatatgctgtgcattgggaccccgatcatccacattccgaagaaaaaggttatggtgcaagtgcatatgctgtgcactgggaccccgatcatccgcattccgaagagaatggttatggtgcaagtgcatatgctgtgcactgggaccccgatcatccacagtccgaagaaaacggttttggtacgagtgcgtatgctgtggactgggaccccgatcatccacattccgcttctgatgttcccgaagcaacggcaaaacaccatcagataaaaggtcaaactggcatgttgttcctgaagaaaatctgcatngtggcactgtacttccgaaaggaccactttntcccga

SEQ ID NO: 8471 - DNA, 271 bp, Triticum aestivum
  Clone ID: PAT_TA_8471
tcggcacgaggcaatgttgcagtcgcaggatgagtagttcattgaatgttcgtctcgaaacttgcattacaaacagaagtgtagattaagttatcagattatgtactttcctctttttttctgcggcaattacaagggacccatatgttttatttctcatttattacagattgtggagttttcttgtacctgggcacttgataacatgggataggcctgtaacttccctttcatacataggtagctaagagtaattgtactaaaaaaaaaa

SEQ ID NO: 8472 - DNA, 537 bp, Triticum aestivum
  Clone ID: PAT_TA_8472
gcgacgtgttctggatcccacgccacctcccgttcgtccaggtggcgtcgcggggcgggccgttcgtgttcttcgggttcaccacgtcggcgcggcggaacaagccgcagttcctgaccggccccacctctgtcctccgcatgatgctcgggccggagctcgcggccgggttgggcgtccctcagaaggaattgagggaggtggtggaggcccagacggtggcggtgatcgagccgccgttgccggagaaggagaaggggcggaaggagagggaaccgtttgttatgaagcaagtggcgagggagtgaccgcacgcgcggcgagccatctgcttaatgctttattgagcggatgatcgatcttacctgtgttcttctggtcgaaacttctgtacatcatgcgcgtgtttgcgccgtgtgtttcagtgtttgtgtcgctagtgtgtgtgtgttgtgttctagtacgtgtttgttcatgtgagttctggcgtcgtcaataaataaagatgcatgtcaaattcagctgtgggctagacat

SEQ ID NO: 8473 - DNA, 1372 bp, Triticum aestivum
  Clone ID: PAT_TA_8473
cccacgcgtccgcccacgcgtccgcaatgtgattgccttcacattgtttgagcttgaaacaatcacaaagagctttcgtgccgattatgttcttggtgaaggaggctttgggactgtttacaagggttatatagacgagaatgtccgggttggcctgaaatcgctgcctgttgctgtcaaggtgctcaacaaagatggacatcaaggacacagagaatggcttactgaggttaatttcctggggcagctaaggcatccaaatctagtaaagttgattggatattgctgtgaagatgatcaccggctgcttgtctacgagttcatgtttcgaggaagtctagaaaatcatttatttcgaaagacagcatcccctttaccctgggctactaggatgtctatagctttgggagctgccaaagggttggcttgcctccacaatgctgaaaggcctgttatctacagagatttcaagacctcgaacattctgctagactctgattatacggccaagctgtctgactttggcctggcaaaagctggaccagaaggtgatgagacccatgtatcgacaagagtgatgggaacatatggctatgctgcccctgaatatgtgatgaccggccacttgaccgccagaagcgatgtctacagcttttggcgtcgtccttctggagctgctcacagggcgcaagtccatcgacaagtcacggtccagcagggagcacagcttggtggactgggcctgccccaagctgaatgacaagaggaggcttctccagatcattgacccgaggctggaggggcagtactcagtcagagcagctcacaaggcttgcagcctggcatactactgcctgagccagaaccccaaggcgaggccgctgatgagcgacgtggtggagacccttgagccactgcagttgcagggcagcgatgcacgcttccggtccatccatgtccctgactacaggattcaccgtaggctaacggggaacaatgtccactacagggccatcccgaacccgaaatgcgccccggctgccgtcccggcgtgcagggtgcggtgagagccgagcctccttcgttcatgctgcctggaggaaaaggaaataggttcagttgtaaatttgcaagccgtggattgcgcgtttcgtgggtgtgtgtgtgcacttgtgtcgtgcgtattttcttgttttgcatggttttccgatttgtaaatctgatccgcgtgctgctgctgcttgtaaggccctctagttttctcactgaggtattatgtggtgctgataagacatattgagcccttgccgataaccagcagggtttattcctagaaatgaactggtgagctcttatgttggtatggtgaaat

SEQ ID NO: 8474 - DNA, 1989 bp, Triticum aestivum
  Clone ID: PAT_TA_8474
gctgtttggtggtggccccgcctcacgagcgggcttgggagtcgcctcttgatgagttgacgacgccggcaactggcaggagcaaacacggacgagtagcacggcacacacggactagcgacaggagcactgcgaacgcagggcgcaaacacgtggatgaggtacgggcggttcggccagcaagaagacgggttagatcgttcagcggctccataaagcattaagcagatgcctcgccgcacggacagtctagcgccccgcacctgcttctgaaccacccggctcaatctcgtgcagcgagtactgcttctccgagcagaggaggctcgatgagatcgaccatctggggctccaaccaccttcttcgctgctttctcgttgtgagggcacgcccaaccgcggccgcgagctccaggcccgggtatcacgcggaagacagaggtgcggcctgtcaggaactgcggctggttccgccgcgccgacggggtgaacccgagagaacaagaaccgcccgccccgtgacgccaccgggacgaacgggaagtggcgtgggatccagaacacctcgccggcacgcaccaccgcgctcatcgcaagagacccgttcgggaagaccacctcggtgacgccttccccggcgagccccacgcggcaccccgtcgcacgcggggtcacgtgtgacgccataaacgtcgccggcgcgagcctccccagacatcgcaagcgacccgttcgggcaaacggctcggatgacgccttctccggcgagcaccacgccgtactccgtcgccctcgggttcacgtgtggcgccatcatcgagccggcggtgaggttgacgagatagacgccgatgtcggagtggtccaagggctggtagtcgtgcttgtcgacggagatgctccacccgtaggtgttccggaagctgggctcgtgatcgaacaggttgtaaggctccggcgcgcgcacagtcttgtccgacttcttgttcagctcctctccgatgaacctgctcatcagtttcctccacgaccaagtccaagtggattgcccgctaccgcgttcgtcgtcgttgcctctccccactggtctccatggctcgctctcccttccattttctcccacatcacgcttgcctccctgtccatgctctttgccaccgctctccgttgtgtaggacacgaaagggcccagaggtttcacgggtaagattctttccaattcgtcgaaagtggtattgagagcggtgacaagaatctttggctcgaagccggccagcactgacgtccgtttccctcccccaccaagatagaaggactgataaggtgcgaagcctgcgctatccgaggcgtcgatactgcatatgatgtgcagcctctggcctttgcctgtgttgaccatgtagaaggtggagccggcgtcgatctggaggacgtcgcccatcttgagctgcttctccacgagaccgcccttgtggatccatccaaccttcacatcccctcgctgcacgaagaggatgaggttggagtctatgtactgcggcacgaacagcgtcttgggctccatggttatgaagccgatgtgcatgagcccctctcggcaagcaccgcaccccgcggaccacccgccgtgctgccacggtgcttccggcacgccggacgctggcagcccgcgcacgacgtgcacactcccaccttccgactccaccaccttctccaccttgtccagcaagaacagccctttcccagtcccgccacctccgccgccgcccttggcctcttcctccggccgccactccccctccccctcctcccatctctcgcgtaagcgcggagtccccatcgccgaccaccccgagaggaggagaagcagcacgagcagcggcgccatggcggcaaccccgcgacgcatcatccgctagcttgcacgatttctttagcgtcttcttcttgcacgccggcttgcagtatgctctctcgcccccctcgtgc

SEQ ID NO: 8475 - DNA, 1136 bp, Triticum aestivum
  unsure (1)..(1136): unsure at all n locations
  Clone ID: PAT_TA_8475
ggctgcaggnaattcggcacgaggtacgcgcgtcgccttcgaagccgcatgcgcgttccttgaggatcgtgaaagcggactcgagggctacgactacgagcccgtggcgtcgcatggcggcttcgtcgccctccgccgccgtccatcgccgtccgcagtcgtcttgcccggccactcgccgccgccttcagacctcgtcgtgtgcaatcctgtcaccgggtaacacgtctctctgccgcacccgtccatctgggacgagtcttttgtgctgttggctcacggcggcacgagcttcagcctacagattctgaatcttgaactggcggacgccgggatgctccagatccaaaccttctcgtcggcgaagggcaagtgggatggcgtcgtggccacgtatgccaacctgcccctgggcgccccgagcaggttcgtccggccttcgccgctcgtcctcgacggcgtcgcgtactggctctgcaagtccgagtccaagtgcctcggttaccacgtcctcgcgctccctctcgacggacagcggcagccgacgccgataaacttcccgatcaaagttccagaaacacgaggtcgcggcgacaacttcaacaccgaggacatcctcctggcatcgatgacggtgaatgggacgcggcggctgaccctagccgtggtggcaaatgtcaccatatctctatggacgctggacgaccatcaggcggagaagccggcaaggtggacgcgccacaagtccttcgacttgtggaacatcacgttggagcgaaagggccggctgccgtcgcgggagaagggagacagggtggcgctggagtgcttctcagagttaggggagagcggcagcttgcttttccacttctaccatcgcatgctctacaggatcgacctgcaaaccgagaaggtctccctcaacctcgccggcatttactgcaagcggagctccagcaacatgtgtgagtaccatgttgacgatgcagcagtgctcaagctcaagagctaaatgagatggtatatatgtcgcgacgcatgcacaccaacttccgcgcaaagctgaaagaatcgtccaaattgtttgttatagttaaagaggctacttctcattttaccggcacgaagnattcaaa

SEQ ID NO: 8476 - DNA, 654 bp, Triticum aestivum
  unsure (1)..(654): unsure at all n locations
  Clone ID: PAT_TA_8476
cccacgcgtccgcccacgcgtccggccagccaaaagcctgcccgcttcctcttcaacgctagcgccgccgtcgccggctacctcgacgccggcctccaatccaatcatcgctctcctaatccagcagagaggcttctctgcctgaccttgcgcttcgctcggtagagagacagagcgcccggctcaccgcgccgaggcaccgctgcactgcccccgcccaccgcctcggccgcgtcgccccgcttacgctgcgcctccgaaactccgagccgccccctcctccgctggactgctgcgccgctgcgtcaggccggaaccccgcccctgtcggctcgcctccgctgcaccgccaagggggcctgctggtcgagctcacccacgcgtcccactctcgtcgcgccgctgctccaagagatggctggtcggtacaatcgcacaaactactcttcctacctgaacgacgaaccaatgcctgacgccacgtcggaaaaggaacagggtaatgagtactccagggaagaatttgctgaagcggttgagtgctactcaggaagtaccatgttgccgacgctgttgctttgcaatcgactatggctatctaaactagaagattgagagnanagaatgatgacgagntctgatctggtgacgttg

SEQ ID NO: 8477 - DNA, 533 bp, Triticum aestivum
  Clone ID: PAT_TA_8477
tctcctcatccctggttatttttggctttgcctttcatgctctcgcctccgtttcactcacgcgcgcctctcgtttctccgtacgcagctcgccaaccgcttgatgccgcatgccccaaccggcgctgccaccgtcggcggcggccaccgctgaccccgagccatccgggaccccggcaagggagatggacgacgaggacctcgtggaggagctcctcgccaccgtcaattcggcccgcgcttactcggaattccgccgcacgcagcgaaaggaatgccacaacctcctccgctggctgcagctcatccttccgctgctcgaggagctccgcgactccgcgccccggctcaccgatgacgcctaccgccgcctcaccctcctcggccgggccttgtccgccgcgcgccgcctcctccgatcctgcaacgacggcagcaaaatctttctggcgctggagagcgaggccgtgctggggaggttccgcgctgtgtacgagaagatgaactctgcgctggatggaatgccctacgcg

SEQ ID NO: 8478 - DNA, 1874 bp, Triticum aestivum
  Clone ID: PAT_TA_8478
gccccccccggttccccacccccgcgccgcaaacgcgacctgccggttcatcactttccccgccgcctgctatcctagcgcggttcgatccgcctctggaagttggattggcgaatggtggcgcaccaggaggcggaggcgacgacgacgacgacggtggacccgatgcgcctggcgtcgcggtggcggtccccggcggagtgggttgccaccgcagcggcactggactcggagcccatgccatccgagctcaacaccgccaacagctcgggcctctttgcagtcgtctccgtcgacaagatgtccgtcaagtacctcggcgtcaaccaccacggccatgacgtcggagtcgtgcaggccgactgccccgctcccatgcaccgagccgtctactactttgagatgaccgtgaggaatgctgggctcaagggccagacctccatcggcttcaccaccgagagcttcaagatgcgccgccaacctggttgggaatctcaaagttgtggataccatggcgatgatggctatctttaccggggtccagggaaaagtgagtcttttggtcccaaattcacatcaggcgacataattggcgctggaattaactacatagaacaacttcttttcttcacaaaaaatggatctctgattggagcctttccaaaagatattaaaggaccactatatcctactattgcggtccatagccaggatgaagagttgacagtaaacttcggaaaagaacagttctgttttgatattgagggttatattcttgagcagaaaatgacgcaacaatctattagcgacaaactgtacttgcaacctgatatcagtcattggattgttcgttcatatctcctacattacggctaccaagatacattgaattcttttgatgcggcaagtgaaactgaccctccagcgaatcatcaaactggttatggggaacctcctgaaatgtatggtcttagccacagaaaaatattgcgtcagctcatcatgaatggggatatcgattctgcattcaaaaggcttgaagagtggtatccacaggtcttaaaggatgacgtatcagttatttgcttcttgcttcattctcaaagattcattgaatacatcagggctgagcaactggagggtgctgtaaaatatgcccgtgctaacctggccaactttttggcacacaaagcttttgaggggttgctgaaggagagtgtggccctgcttgcgtatgagaagccttcagaatcttgcattggatatttgctggagtccccacagcgtgaatttgtagcggacgcggtgaatgctgccatcctgtcgacgaaccccaaaatgaaggatccagagagctgcctttactcgtgtctggagaagttactgaggcagctcacggtatgcagctctgagctacgtgcgttcaacagcgatcaaggggatgtcttcttacttcataaggagatctacgaaagatctaggcgtccctaaggcacgtcgagcatacatacgagcagtcaactcgcaaaataagatcctcattcttcttggaaagaaagaaacatcacctggaattgtggaccatgccatgaggaaacacacacatattctcccctgagtgaggcctcaaggtgaatggaaatttcgcagcttgggcatgggacttcccaggagctccttccctgtaatcagcgaatttagattcacgtttgatctcaacccctttggtgttttcataaacttgttggctatgtgcagttgcacattgtgaactttaagataaagagcttgaacagtactgtaaatgaaatcagaataccattcttgttgacgtgctatgccatcaggtatgttcgttcacgaaaaaaaaaaaa

SEQ ID NO: 8479 - DNA, 1102 bp, Triticum aestivum
  Clone ID: PAT_TA_8479
gcacgaggccacgacgctcccaaccccacgcgcccccgcgcgcccgcgcccccggcccccgccccccccccccccccccccccccccgcctccgccccctcgcctccgcccccgcgcccccgcccgcccgcgcccccggcccccgccccccccccccccccccccccctcgtccccccccccccccccccccgccccccccccgccggctcccccctcccggcccccccccccccgccccgccccccccgcccgccccgacccccccgccgcggccgccccccccatccccgcgcccccctccccgcccccccgccccgcgcccccgggggcgccgcccacgtgaaggtggaggtcccggcggtggagccgttgcggtgggagcggggggcgagggtgatgccgtccagggacgccgtggtaaaggttttctgcgtgcacacggagccgaacttctcaatgccatggcagcgcaagaggcagtacagctccagcagcagcggcttcatcattgggggccgcagggtgctcaccaacgcccattccgtcgagcactacacccaagtcaagctcaagaagcgcggctcaggcaccaagtacctcgccaccgtccttgccatcggcaacgaatgcgactgggcaacgtggacccgtgatgtcgatgaattctggaaaggagttctgccgctggagtttggattgctgccagcacttcaggatgctgtcaccgtcgttggttaccctattgggggagacacaatttctgtgacaagtggtgtagtatctaggatagaaatactctcatatgttcatggttctacagaacttcttggactacagatagatgcagctataaattcaggaaactctgggggccctgcttttaatgatcagggaaaatgtgtcggtatagcttttcaatctcttaaacacgaagatgcagaaaacataggctatgttatacccaccccggttattaagcacttcattcaagactatgagaaatctggagagttcacaggttttcctatacttgggatagaatggcagaaaatggaaaattccgatctccgcaaggcattgggaatgaaatctgaccaaaa

SEQ ID NO: 8480 - DNA, 781 bp, Triticum aestivum
  unsure (1)..(781): unsure at all n locations
  Clone ID: PAT_TA_8480
cgaacccaaacccagtaggatttcgcaggggtgatccggtccgatcggcggcggcgcgaggtcggtccgaattgggcggcaggaggattcgcggcgcgtccgtgggcgcctagatcgggggttccagctggctccccccggcgccatggccgctgactccagcatggggttccaccaggggatcaccgccgccgcctcggtctacaaccaccatcaccaccaccaccacaacaacaacatgctctccttccagtcgtccagcagcgacgtcaccatgggtggcgccgggatggggctcgtgagcatgagcggcgggccgagcagcaccgcaggcctgtaccactcttctccaaacaaccacagcagcagcaacagcaacaacaacggcggtgtgttcggcaacgtgccggtggttgtccagtcaaggagctcgccggggggcgcgtcccgtggcgccggcggcaccaccgcgtccaagtacaagttcgtcaccggctcgccttctgagtggagtgaccgcgagctgaatatactcaacgaagggctcaccagatatgctcgtgaacctaatatcatgaggtacatcaagatagcggctatgctgcccaacagaaccatcagggatgttgcactgcgatgctggtgggctgcangtaaagatagaaggaagaaaccagaaggttttttacagggaaaaagatgagagatatgaagccaatgcaggacaaaatgtttgcatctgccccgatgtcaaatttcacatggcgcctacaacaactta

SEQ ID NO: 8481 - DNA, 1117 bp, Triticum aestivum
  unsure (1)..(1117): unsure at all n locations
  Clone ID: PAT_TA_8481
ggacaacgctcagagctgccgccgcgggttgagagggtcttaccaccatgcatagcgtggtcgcggccgaggtacctgcattgcagttcctccagtcagcactgttggctgcgaacctcaatacccaagtgacactatcatgtccccactcgatggagatgattcccatggcatttcctccctctaccgccactttcaacgcgtcgtggagctccataatgctgccgtatcttcagtttctgaagagtaccaccactcttgctcttctggtgctgggatggtagtatctgttctatcgaaataaggtggcctggctgtgacttgtgatgatttaccagtaagacctaggaactcaaatcctagcgaggtggtccgtcatttgcagcattaccactgtgccagcaatgtttatcaaggtcacatggtactggtacctccccgggcggccgcgcgagtccaagaaaatgaaagaaaaatccaagagcacacggagggtagtccaacacaatgtggagaagatccaagacaaagcagagaaaatccaatgcaagttgaaagaaagttaaaattacacaattattcttgaggccagcttgatgaattattgttggcagtcgatctcaaggacaaagctcatgaagtcatgaggtaccaccaatcttactcttctggtgctgggatggtaatatctgatctatccaaataggacggcctggctgtgttaccagtaagacctaggaattcaaatcctagctaggtcgtccgtcatttgcagcattaccactgtgccagcaatgttatcaaaggtcacatggtactggtactgtggaaactctgaagtctgaacgacaacacagtccaggacgtcgtgagatgatgatacagcgcttgggtgctgttaatgcaatccacactccgtgtaagcaactgatgttcattttgctgcttcaaatcaaatcatgtggagcttcaaaatggacatccgttgaaggcatgcgccttagttgaaatagattgttgttgtagcttttgtgcagcttccttgattctttttcctgtgtctgcatacaagaatcaccaagggcccccatnatttgtatgtaaacaggacaacaga

SEQ ID NO: 8482 - DNA, 733 bp, Triticum aestivum
  Clone ID: PAT_TA_8482
aagggtagggaaggcaagggaagggagagggagcgcccagatccacggcggcatcagcgcgctgtcgtcgacctgatccgcgtccgtcctcgacggaggttggccatggaggtctgacccggcccggcagcagcgatggacggacggagacgccccaaacccgagaacggcacctcaaccttcaaggacgacgcctcaaccttcaagggcgcgtgccggcgaccgaggatcttcggtgacggctatggatggctgccccggatctggacgcacgacctgcagctgctgcagcaggtggacgacccaacgcacgagccctcccccctccctcatggctctgcttcctcctaccctgcccccctcacgtggacgtgctgccttggcagggatcctccatatcaagggaagagcggggtagtgtgggcgagggaagtccttgtgtaccaggcttctaaaagaaacacaaaaggaaacaagatgcagtaaatttttgatgaagaacatttttccatagcttgtgaacatgttggtcctccgattttgttttttcatgatttgtggtccatgcatgctttttatattcaatcactttatttgtttacatcctactattttctaatttcagaattggtattctatctagctgtgagaccttgcctttattttgtatgaagttatggtcacaggatcatagcactctgggttttggattcaggtacaggatcatgtgata

SEQ ID NO: 8483 - DNA, 597 bp, Triticum aestivum
  unsure (1)..(597): unsure at all n locations
  Clone ID: PAT_TA_8483
ttcggcacgagggccggcgccaggcggtggcaaggnacgaagaaaacaaggtgacgctgtcgggtttgctcaatttcatcgacgggctgtggtcagcatgcggcggcgagcggatcatcgtgttcaccaccaaccacaaggagaagcttgacccggcgctgatccgacggggcaggatggacgtgcacatcgagatgtcgtactgctgcttcgagtccttcaaggtgctcgccaagaactacctgcacgtcgccgaccacgagctcttccatgaaatccaacaacttctaggggaggtcaacatgaccccggccgacgtggcggagaacctgatgcccaagtccaaaaagaaggacgtggacacctctctggccaggctggttaaagcgctcaaggaagcaaaggaggaagcgttggccaaagcactggccggggcagaggaaaaagaggaaaccgaagacgacgacgaggaagatgacaccagttcgagcgaagaggaggaaaatgggaagaataaaaaattgtacttacccgcaaaatgggaagagtagagtcatatatacgcaatgatatcatactttttccgtaaaaaaaaaa

SEQ ID NO: 8484 - DNA, 3801 bp, Triticum aestivum
  Clone ID: PAT_TA_8484
ggtggttttgcctctgggttcaaaacgccagaagaggagacgtttgaaacacggttatatatttgcaaaggaaagagagctattagaattaagcaggttccctttgcacggtcatcattaaaccatgatgatgtgtttatcttagatactgaaaataaaatttatcaattcaatggtgcaaactccaatatccaagaaagggctaaatcactggaagtgatccaacatttaaaggagaagtaccatgggtgtgtgtgtgatgttgcaatcgttgatgatggaaaactacaagcggaatcagactctggtgaattctgggtcctttttggaggttttgcacctattgggaaaaaaactgttagtgatgacgatgttgtactggaaactacagcacccaagctctacagtatcaatggcggtgaattaaagtttgaagatatacctcttacaaaagcagtccttgagaacacaagatgtttcttacttgactgtggggctgaaatgtttgtatgggttggtcgggtaacacaactcgaggacagaaaagctgccactaaagcagttgaggaattcatcattaatcagaaaaggccaaagaccacaagagtgtcaacgtgcctctgcactggctgccttgtccaatgcgtttaatccatcctcaaaaccaaaaactccacctccgtcacgttcaggtcaagggtcacaaagagcagctgcagttgctgcgctatcctctgtgctgactgctgagcagtctggatcatctgagaatctcagagctagcaagacgagcacaacatcagaaaagactgaagcggaggtcgtcgtaatatctccagcggaggcatctcctcgctctgaagctggggaatcctctgaatttcagtcagagaaagatgctgcagtgcatgaggtgccacctgaggtagatgtagcacagcctgcggcgccggaggtgccagaggaacaagaaactgagcatgttggtgaagcaacatttagctacgaccgcttgatatctaaatctactgatcctatccgcgggatagactacaaacgcagagaggcgtacttatcggagagcgagttccagactgtcttcggcatcaccaaggacgcgttctacctgcagccagggtggaagcaagagcttcagaagcggaaagccgacctcttttaaataagcggctgcttccggttctcccgcagaatgagatcaatcaatcatgtgcttgtttttatccctcatcatgattgattgattggcacgagccattgctggtcatctttgtgcgaacggctacctgtggcctttggttggttgggttttgtgaatttttatagggcattgctttcgtttgtacagtggactgagttgcttgtgctgtttgccaaggttctaaagtggtggaagactcgaggtgtggtgcatcgatggaaatactaggagtccacttccaaaagaggacaatggaaaattttacagtggagactgttatattgttctttatacatatcattcgggtgacaagaaagaagaatattatctcaattactggatcgggtgggaaagcacagcggatgatctggggatgggagctgaactagccaatacaatgtggaattcactgaaaggaaggcctgttctgggtcgtatttatcaagggaaggaaccaccgcaatttgttgcccggtcccggccccccgggtcctccccgcgtcgcatcagttctggatacaagaagattacagaagaaaagggtgcggccagtggatcttactctcccgatggcatagctctgtttcgggtgtctggaacagctatccataacaataaaacgcttcacgttgacgcgctagctacatctttaagctccacagactgttttgtattgcaaactggaagtgctatgtttacatggcatggcaattctagcacttacgagcaacagcagtgggcagcgaaagttgctgaattcttgaagcctggtgtgacagtgaaacattgcaaggagggaacagagagttctgctttctggtttgctcttgatggaaaacagagctatacaagcaaacccatcatgcaggatactattgtcagagatcctcatttgtatgccttctcaattaggaaagggagactggaggttaccgagatattcaatttttgccaagatgatttgttgactgaagacttgatgattcttgacacacacggagaggtctttatttggattggtcagtgcgtggaaccaaaagagaaacaaaaggcgttcgaagttggccagaaatacatagagcatgcgatgtcgattgaagatctttccccgtatgtaccactttacaaagtctctgaagggaatgagccatgcttcttcaagacatacttctcttgggataacacaaaatctgtgattcatgggaattcgttccaaaagaaactttcacttctttttggattacgctcagagggtgcatctaggagctctggtaatggtggacccactcaaagggcatctgcattagcagctctatcatctgcattcaatccatcttcgcagccgaagcaggctaatgatagtaggcctccaagcagtcgggtgatggacccactcaacgtgcctctgcactggctgccttgtcctcatctgcattcaatccaactccgcagcagaagcaggctactgatagcaggcctccaagctcgggtgatggacccactcaacgtgcctctgcactggctgccttgtccaatgcgtttaatccatcctcaaaaccaaaaactccacctccgtcacgttcaggtcaagggtcacaaagagcagctgcagttgctgcgctatcctctgtgctgactgctgagcagtctggatcatctgacaatctcagagctagcaagacgagcacaacatcagaaaagactgaagcggaggtcgtcgtaatatctccatcggaggcatctcctcgctctgaagctggggaatcctctgaatttcagtcagagaaagatgttgcagtggatgaggtgccatccgaggtagatgtagcagagcctgaggcgctggaggtgccagaggaacaagaaactgagcatgttggtgaagcaacatttagctatgaccgcttgatatctaaatctactgatcctatccgtgggatagactacaaacgcagagaggcgtacttatcagagagcgagttccagaccgtcttcggcatcaccaaggacgcgttctaccagcagccagggtggaagcaagagctgcagaagcggaaagccgacctcttttgaataagtgtctgcttccagttctcccgcagaatgagatcagtcaatcatatgtgcttgtttttatccctctcatcatgattgattgattggcatgatccattgctggtcatctttgtgcgaatggcaacctgtggctttggttggttggttttgcgaattttataggtcattctttcgtttgtacatggactgagtgctgtgctgcttgcaaggtcctaaatatgctctagcttgttttgtgattgtccatatgtgtatggtttttctcggtttgttttatttacatgtgtatgggcagtcccccagggtatgttttggaaggtcatctacactgtcattctgatgtaccacggacaattatgttacctatattgcctagttgtgttgttgaagattgttggaacttggaaagaacccgcccatcaaaattattgtctgtttttgtaaataagcctgcatgttttaccattatgaaagtcatgccggctttttggaaaaaaaaaaaaaaa

SEQ ID NO: 8485 - DNA, 913 bp, Triticum aestivum
  Clone ID: PAT_TA_8485
actcggcacgttggccgccctcccacctctgccgccagcgatatccttagagcgacggacctccagtcttccccatccggccgactcccaagtcccaactcccccagcccccccaggtctcacgccgccggtcgccgccctcccgcctccgccgcccgcgagatccccagagcgacggccttccagcctcccccgtccggccgcctccctgccggaggaccggagccagattgctggtcccgccccgtcccgtccccccactggccagcgccgttctctgctccactcaaccggcgacccctcccgcggacgcggcaggccgaggcgtgatgtgcggatcggagcatggacgtgatcgcctcgcccagtagaagctgcagcagccgtcgcgggagcagggtgtgcgccgtctactgccatgacgatctacctagctcgggaggcttccaaggtatggaggaaggtgtgcgcggagacgacgaccgagctgccgatgcttcgcgagaagtggccgctactcctcgctgggattgtgttccagtatattcatgggctggctgctcgaggagtgcattacttgcatcggcctggaccactgctccaggacctgggatttatggcccttccagagctgggacaagacaaaaattatcttagtgaatgcacatttgttttcatcttcttctccttttttctgtggacctttcatccttttatttatcatagcaaacgcttctacaccatcctaatctggcgcagggtgcttgcttttttagttgcttcacaggttttaaggatcgttacattttattcaacccagctcccaggtccaaactatcactgtcgcgagggctcaagtatggccactcttccaccacccaataatgtgcttgaagtgctcctaattaatttt

SEQ ID NO: 8486 - DNA, 1028 bp, Triticum aestivum
  Clone ID: PAT_TA_8486
aaccaaaccctatccgcatcccacccacgaccggccggcaatccatggcgctgcgcaacctggccaagaagttgcggatccccacctctgctgctgcccggctcccgtccgcccccaaccctgctgatttccggttcccatcggaccctggcgcttggcgggcgtccgtttctcggctcgagagcgctagagactggtatgagtttcagcgagcacgttatgatgatgtgacaacagagttaaaaaacttcaggcgtgaggttgtgtggactgaaagggcggctaacctgtttgatttggtttataaggtgggttgtcctattgtcgttggtactttggtcataaaagtgattgtctatcgggccatgtgatgggttaatggccatctgctgtgcgaacatgaagtttctgcccccgagctcatatgctcccttgtgaacggtaaaatgaaataaaaaaatcagaaaaaatcaaacattgacgaatactcaacatgcgtgcaattttccatgaagaaataacattccaaaatgcttctgtaaaaaataattgatgctccaaaaagtcgtttttagagcaatttggagcatcgattttgtttcttataggagcatcttgggaaaaaaaatctcaatgaactttgcacgcatgtagaaaattcgtcaatgtttgttgacaagaaatttctgatttttttaaattttgtttactattgtcattgaggatgcatataagctcgagagcggaaggctcattggcacagatgcatgtgcgctcgttgtggcaagtggcaagtggcaagagcagataaccatgtagaaataactgattgttgtatatatgtcttgctctgttgtgtcatggaccagtggctatgactttatgtaattgtgtataagcatactttctcataatgtttgttgcacttgttggtttgatgaagaattaatgttgtgtttgctttcaacttttgtttgtgcttgtgaaagtaccgtgtggtgtgaggattctcctgttgcactttgttc

SEQ ID NO: 8487 - DNA, 974 bp, Triticum aestivum
  unsure (1)..(974): unsure at all n locations
  Clone ID: PAT_TA_8487
cccatgcgtacaaggcaagagacgcctaacccaaaccctagcatcgtcctcgacctcgaccccctccctcccccggccggcaatccatggcgctgcgcaacctggccgcgaagttgcggatccccacctctgctgctgcccggctcccgtcgccccccacccctgctgctttccggctcccatcggaccctagcgttccgccgccgtccgtttctcggctcgagagcgccagagactggtaccagttccagcgggcacgttatgatgatgtgacaagagagtttagaaacttcaggcttgaggttgtgtggtctgaaaaggtggctaacctgcttgatttggcttacaaggtgggttgtcctattgtcgttggtggtgtggtcattgaaagggattgccttatcgggtgcttcgcataacaaaagatgtggtggggaaaagccacgtgctgctctgttcattagtgcacgatgcgtgtgcacttgtcgggagcactcctggttgtggtaactgggaactgcctgcaagagcagataaccatgtagaaataaatggtttgttgcgtgcgtgtctttatccggtgtgtgtcatggaccaagtggttttgacttgatgtaattgtgtctaagcgtacttcttcctggtaatggtgttggtgcacttggtttgatggagaatgtgtttttgagccttggtttgatgaagaaagatttaataaaaaaaaaaaaatgcctacgtgcccagtttgaggatgccatgtaagctagagagcatgaaaggctcattggcacaggatggcatgtgcgctcgttgtggcaagtggcaagtggcaagagcagatagccatgtagaaataattgattgttgtatatatgncagtgcnttngttgtctcntggcccngtggatatgacttnatgtaantgtgtatangcanactttnttggtaatgnttgntgctgnntgttgggatgt

SEQ ID NO: 8488 - DNA, 967 bp, Triticum aestivum
  unsure (1)..(967): unsure at all n locations
  Clone ID: PAT_TA_8488
aaagcatcgagactctccaccagagtaccacttcccttggcgtctagccacccccaccccggcgcagggttgcctggaggccgatgaggcccccaaggctttgcgcgcgtggagctgtgcgtcccgggcgcgcggactgctacacaggggccagccaattattcaccgagagacaatgccacgtgaagaaagcaaagattcctgaagattgatgcttgtcggcactctctcacacttttctatattattagaaggacacgcgtgtaccctagtaggacacgtgtgcatgctaccgtgtgtaaaataagtgaaggaaggctcccgaaggccgcccttgcagccacccctcgcggctataaaaggagacgctgggctcaacaacaaggacacactaagagacgggagagcacggagcactcaaagcatcgaggactctccaccagagcaccacttccttcgtagtctagccaccaccactactagtagaatagccaagaaggtgcttagttcgccaagagtttgaaggaatcagcccaagttgttgtgatcccttcgggcgctcccactccggactctgcatgaacagtttaagcatattacaaatgttagtccaactcatggtgccaaatatcagggcgtgaggaggaaatagatgtcgcgcaaaaaaaggaagctattggagcattagcatacatgcaggtcgttgttcttcggcctcatgtgtcttgtgtttatgtaaaaactaaaaagccatagttcgttcttccaagtccttgttgggatcagtacgccttgtccatgttttgaacgcctcgggtcgagggctaggcagagaagtgcttatggtccataagtgatagcaaaggctaggtgttttgccgggtccttgcatttgtcgtaagctttttcgaagcctttaatgtagaaccagcaaaactgaaattgttaccccttgttnaaaaaaaaa

SEQ ID NO: 8489 - DNA, 997 bp, Triticum aestivum
  Clone ID: PAT_TA_8489
gcgcgagagagaaacagaggaggcggcgccgggcgatccgcgaactcgagcgagagagaaacagaggaggcggcgccgagcgatcccccctcctcctccccccgtcgcgtgatccatggccatggccgcctccagatcgctctgggcctcccgcgccgcctcctacctcaagatctccgccttccccagggccttctccaccgtgctgaaggatctgaagtatgctgaaacccatgaatgggtgaaggttgatggtgattccgcaaccgttgggattacagaccatgcccaggaccatttgggtgatgttgtgtatgtggagctgccagaagttggcgcctctgtatcccagggaacgaactttggtgctgttgaaagtgtgaaggcaaccagtgacatcaactcgccggtgtctggagaggtcattgcagtgaatgatgaactactagagaaaccagcattggtcaatggagatccatatgagggcggctggatcatcaaggtcaaggtcagcgatgcaggtgagctcaattcactgatggatgacaagaagtactcaaaattctgcgaggaagaggacagcaagcattaagcatggtggcttctgaaagagaatctgcgcttcgacattcgtaggtgtttgtcatgtgctgttgggcactttgtaccacctgctttctcagcccagaaaggatcaaaacatggaataaatggcatttgcctaccctacaagggcttgtgagatctaaaatatatgtatctctcgagataactttctttcgttatccaaaatctgtatatcactcgagttcctttgtttcgttgccatggtttcgtctctgatttaagctctgttctgattaaatcgtataaaaaaaaaaaaaaaaaaacctaccaataacacacacccgcaaaagcaaaaaaaacctacacattgagagacacaaaaaacggggccgccgttctaaaggacccaaccttacttacccgggcatgc

SEQ ID NO: 8490 - DNA, 404 bp, Triticum aestivum
  Clone ID: PAT_TA_8490
attcggcacgaggaacctacttatttgtaatgagaagaagaagaacaaagaattagttacctcgaggcttgaagggagtgttcccgccaacgccaggagtagcgtggtttttccggcaccaggaggacccaaaagcaaggtcatcctagcaagagcagggatgagagaatttgccattccctgtttgaagtcgattaggccatgtcaatcggccggtgtgcataccacataatagagaaacgaaaatctaaggtcatgtgagcatcctcgacgtctaccgactagctcctgacattgtgttgttccagtggtcgttgggtgtacttgtaatcatcttgatattaatactttttgtgagaaaagatattaacatatatatatatatttttttatcaaaaaaaaaa

SEQ ID NO: 8491 - DNA, 957 bp, Triticum aestivum
  Clone ID: PAT_TA_8491
catggcggaggccgcaccgcctcctctcctcggcggcctccctgacgagatcgccatctgggagatcctcgtccgcctgccccccaaagacctcctccgctgccgtgccgtctgccgtgcctggcgctgcaccacctccacccgcgacttcctcctcacccaccacgcccgccagccctccctccctctctcctacgtcaaaaattacggcggcgaccttttcaccctagacatcatctccttcgaccaccagggaggggccgccaccccccagaccgtcgcgcgacttcgccgccatatcttaattccgagggtctcctgcgacggcttaatcgtcttctggatagaatgcaaagctggtcaacaactattcatctgcaacccggcgactcgtcagtatggttgcctcccgatgctttttggcggtcccctgtccgccgtggggatgccttttggcgctccccgacccgtggccgtggggatgtactcacacagcccaaccggcgagtaccgactactattgctgcagaaagctgaagcaccagatggctcctccctcgtctacacatacgctttaggctccagccagccgccgtggcacctacacatcgaaggccccaatttgaacgaactggactacgagcacgaggtctgggcttttaaataccgggttgaaataccgtatgcggagctcaccttgcagtttggattgttttacccgcgtgattgtgtggtgtttacttcttgggttggcgatgtggcagtgctggtcccgtttggccgctggttacttcagcttgacgtgggtggcaagctggttgccagtttcgaggacagcggtggactcattggtcagccatatcagctcaagcaaactcttgttcagcataccttctttcttacactagagggttatgttgtcaatggttcgcctttcatctgaagagaagattatgt

SEQ ID NO: 8492 - DNA, 1582 bp, Triticum aestivum
  unsure (1)..(1582): unsure at all n locations
  Clone ID: PAT_TA_8492
ggtaatgtaattttggtcgggcaggggtttgtgaagaaaactagcaaggttcatagatgcacccaggtggaatacttactttccaaatgtcaagtatttttaaaaaattagacatataaatgtctgagtcctttgtgtgcttgtcaaatatcatccccgcttggggtggtgcccgtggtggcgcggggacgtgctcgcgcgggagggggcgggactggctcttgcctgggtgggtctcccctcctttgtgctgccacctcgcccgcgggggttctggcctgcttctcctggcgtctgcctgcatggtggggccgtccgctgttgccatgctttggctgtgggccctccggtcccttctatcatccatgggctaaaaattgaattatcaacaagtatggtgatagccagcgttactgtgatctccaaagaacaataactatgcaacatagtgctgaactttgacattttcgttttgctataaatttccttttaatatttcgtaatttgtttaattaatctttctattaatatttggtttcactatagtaaatttatttgaaggtctccatgatggcataattctatgtagactgatgtgtcgattattttgtcatgcatttatttgcccaacattacctagatacttagtgccattacaatgacatcctgttttatttcagaaagtgattgctccatcacatacacattaaaagaaattgcacaactgcaccatggctatccagtatatcaagcaagattaatctaaacataccttacagcatctcattactcccgtcgaagtaatctaaacatgttcttacggcccccggcttcgtccccatggcggccgggcgggcttcatccctcttcttcgtgccttgctgtcgtgttcgggagttcgtgcgccgccagagcgccccggggcccctcctcgctgcttcggcgtcttgttgcggcgccggggggctgcgcctcctggccccggccccacggcggccgggccgccttcatcccgcctcctcgcgcctaggtctcgcgggcaggaggtggagcggcgcctgatctccccatgcctcatccttggtgcttctttgtcatgttgcacctccggtgtgatggtcctactggacagaggttaacgacttcctggtcgcgaagcatccgtccgcactctacaaggtcacgtcggctccatgttggagcgggagcgcgccttgagcccgcatctgagtttgttgtatctgagtttgtggtgggtcgaagccccaaggacccgattgtgatttgtgttttctctagggtgcttataccactggtgttctttaatatatgacctgggtcttctccacaagaaagggtgatatctatcatttgtaatgcattgcacactacagagttatggcgacaaatttgagctnaagatattcttaatggcaacangtnactaattctttcgttcctatggaatatgtaaattcatatgcaggtaagcaggttaatctaaacatgccttacagtatcccattacttttgttgaaattctatactgttagattacaccttttgttggattaaatatctg

SEQ ID NO: 8493 - DNA, 1247 bp, Triticum aestivum
  unsure (1)..(1247): unsure at all n locations
  Clone ID: PAT_TA_8493
accggtccggaatttccgggtcgacccacgcgtccggagcgatgatagcgaaggaggcgaggacggcgatgaaagcgaagatggcagcgaaggaggcaaggacggcgacgcgcacgcaggtgatgtcgaggtatgggacaaatcatatactgcaaaaatcaagagagcgcagagggcagccaaagaggctgccggggatgatggcagcgcggcaggagatgcggcgccgggggatgatccaaagnaactggggcacagggnaagaaaacatactatgatgatcatgagcaagatgctgatgatgttgagtttgatgagcttaggaggttgcaggcagagaataagctgtcgatgaaagatttcggattggaagatgatgaaagtgatgaagagggtaataagccctcaaaggcgtccgaccatcaggtgaagcttgctgatgaggcatcccctcttgaaagctacacgaagctgagggaagactttgctgtcctgtcaagagacgagaagatggatgtagtgtacagctcagctcctgaactggttgggttactggctgatttgaacgaggcccatgaacagctgaaggcaataggaccagtcacccctgagttggcagctgggcaaggcaagaataagggtaaaatgcagccattggaggtgaagcgagcttgtctgttggctcattgtcaagccattaccttctacctccttatgagagcagagggactgtctgtgcaggatcatcctgtaattgctcggctggtagagaccaagaacatggtgcaaaagctggcaaatataaatcttccgagccaagacggggacactgaagaccattttatgcctgatagcagcacccttgatgaggtgaacaaggcagtcgctctagagaatgagggaaaatctagcaatttactagatatggacaaagtaaaacagggtgctgaagtagccgaattgacaaagaataagccttctaaggggcaccatgaaattgcaaaaaggaagggcaaggatgagcatatgggcttgcaaagcattgaaatgttgaaaagaagagcaatccttgaggaggggttgaagcaaaaagggctgtctaagttgaagccaaagttgtcaaaaaccttggcaaccaatagtaggaaaaaactgcagacattggatgactttgatgatgaagtgcagaaaaatagtcaagtggtcaaacctacaaagctcctggttaatgcagctggctcagttag

SEQ ID NO: 8494 - DNA, 1334 bp, Triticum aestivum
  unsure (1)..(1334): unsure at all n locations
  Clone ID: PAT_TA_8494
ggtttgttccttggnggctgcttgcagtactaggaaccttgccttgtacattgttgattcctggcctattcttcatcccggagtctccaagatggctggcaaagatgaacttgatggatgatttcgagacttctctgcaagttttgaggggtttcgagactgacatcacagcggaaatgaatgatataaagagagccgtagcatctgcaaacaaaaaggctacggtccgttttcaggagctgaatcaaaagaagtaccgaactcccttactaataggaactggccttctagtacttcaaaatttatgtgggataaatggcatactgttttacgcaagtagaatcttcagagctgcagggttcacaaacagtgacctggccacatgtgcacttggagctattcaggttctcgccaccggagttacaacctcgctactagataaagctggccgaaggatgctccttattatctctactgctgggacaactctgagccttcttgcagtttctgttgcatttttcctcaaggacaatctaccacatgactctcactcggactacatcttaagcatggtgtccttggtggctcttgtggcttatatcatcaccttctcctttggcatgggtgccattccgtggctcataatgtccgagatcctcccgttgggcatcaagagtttcgcggggagcttcgcgacgctggccaacatgctcacttccttcggggtgacaatgacggcgaacctgctactgagctggagcgctggcgggactttcgcgtcttacatggtcgtgagcgcgttcgccctcgtgttcgttatactttgggtgccggagaccaaggggaggacgctggaggagatacagtggtcgttccggtgagcgatctcgatccgcggtgccacccggtcgtcgcatatggtgtgtagctcttcaagttagggtaaaagccgtatgtcaggcaagaattgttgcacggtcagcgatcttggctcttcgaaccttgcagccagttcccaccaagtggaatcagtagtaccagtcacattattttcttcttctgttatgtatcttttgtaagtcaaatgcagaaaatcatattttcagcgggaacgagcagccccaaaaaggccgtgcgtttcctgccgaggctgtacggctgggccgggctttgaggcccagtcttcattcttggtttctgcgtccaaacggtaatcaagctaatcaaaaagaaaaacctcccggttagattagtcccaaaccgtttgcgcagatcagcatagctgttcagacgtgtataagaggaggtgcaaggcnccgggttcaactcatacc

SEQ ID NO: 8495 - DNA, 785 bp, Triticum aestivum
  unsure (1)..(785): unsure at all n locations
  Clone ID: PAT_TA_8495
tttgtcctttgacgcgtgggcggacgcgtgggcggacgcgtgggcggacgcgtgggcggacgcgtgggcggacgcgtgggcggacgcgtgggcggacgcgtgggcggacgcgtgggctgaagcttttcgtggaaattttagtcaactcagcagcttgattagagtcattgccgataacaatggtatttctgaagagcaagcaccagctgctggtctggtagctgatcttcctctgcaggattcggtgctaaccagacgtcttgttgaagatggggctttcaccacaataatatccaaagtgataatgatcagacaaggggagagtcgtggggggcgtttcgtcaacccttttcttgaaggtctagttaggatagtctcccggatcacatttatcttggaggatgatccagatatcattgctgttgctcgtgaatacaatctcactgcactatttagtgatctgcttcagatgaatggtcttgacactgtccagattgtctctgccaccgcactaggaaatctatctggccagccaaagcatctaacgaagattctgccacctccccaacgcgggattgtgtttttcnaatatttccatgcctcagtcaagagtccgttagaaactggtgtcctgtagagttcatcctggggtttgttccgtccaagggaaactcctgncccttggnaaggaagttgtgggnaaatttggttgcttgcttggtncacaacaatgagaaatttttgaacctcnctaacaacacgtccacattattnacnaggaatgg

SEQ ID NO: 8496 - DNA, 653 bp, Triticum aestivum
  unsure (1)..(653): unsure at all n locations
  Clone ID: PAT_TA_8496
ttttcatccacccgcgcaaggcagattgagaacgacgaccggcgacgacgcaggcgcgtgcgtgttcgtcttccccgatcgagccgtagcgcggatggagatggactttctgggcccacgatcggcgccgcggcatgcgatgccgctcgtggcgcgacgcgatgccgaggacgacggcgagccctggcgtctcgcttcaccggcacacttcgcgtatccggacgtgcgcgcggcggcggctcatcgccaccacccgacggcgccgtcgtaccagctgcacgcgccgccgccgccgcctctgcatccccaagccttcccgtgcgccattcccgcctcgttcctgcaaggcccgcaggtagtccaccgtgcagcgtactcgcccgatcggaggtgctccgccgcgcagctgacgatattctacgcaggttcagtgcatgtgttcgacaacgtgacgaaggaaaaggccgagcagatcacgttcatggccgcgaaggcagctcaagcnnnncgcagccctccccttcgtcgggcgctgcggcaatcggaatctgctccggtccccgacgaaagnnngcagatgccactggcgagagcttgcagcgatcctgtgcacccttcgccacnnnnattnnntnatgctgccgannnnnnnn

SEQ ID NO: 8497 - DNA, 799 bp, Triticum aestivum
  Clone ID: PAT_TA_8497
cgataacaaatgatactcaattttttgttatagcaagtgcaggtgtctgaattaattaaatttgatggttccgtacaatgttgattttctatttggagatgacagattgggatgtcatgacaagtcggcaggtggttaattttgtacaccaatgcttgcaatcggaggagaaagatccgggaaccatctgtgaaaaacttcttgattcatgcctgcgcgagggctcaaaggagaatttgaccattatactggttcaattcaaggccaccgcccatggtggagctgaggccaatgttgctcatggtggagctgaagccaatggtgcccatggtggagctgaagccaatgtcgcccatggtggagctgatcgcgaaacggcaactgatgatatcgagagcaaagggtcaggtagccacagccctaagcccttagagatcgaggcccaggaatctggctccaaaaaagaaagtgcgccgaggatgcttcagctggggttggctaaagcacgaggaatgctaggtgtgcccacagtttgatcaagaaaagagttgatcctgagctgggaaggatttgcaatgctgtttttgctctttgtcggagacagaattatgtgttgacgcactctaggtgtgagcagttgcttcgttgtgtcgttggttttgcttgagcgccacttggattcactctcttgttctgattttagatattgaagatgcttaatggggtatgcaggcttcctgccttcatgataattcttttatgctatgcaatgcagtagcattatgctctaaaaaaaaaa

SEQ ID NO: 8498 - DNA, 675 bp, Triticum aestivum
  Clone ID: PAT_TA_8498
ttcggcacgaggctcaatttccgccagcccgccttctctctccccttcctcgccgcgcatgcgccggcgcggctgctgctaggcggcgcagacgacaaacccagcgaccagcggcccgtccgtccaccctaggaggccccagccatggcgacgctgcaggacctcggggtgtcggccttcatcaacatcctgggggccttcgtcttcctcctgctcttcgccgtgctccgcatccagcccatcaacgaccgcgtctacttccccaagctctacatcgccgggaagcgcgccgccgaccaccgcggcgcccgcagggccatcaacctcaacctctgcacctacttcaagttcctcagctgggtgcccggcgcgctccgcatgacccagaccgagctcatacaccacgccggcctcgactccgccgtctacctccgaatctacacgctcggcctcaagatttttctgcccgtcatggttgtcgccttgctggttctcattccggtcaatgtctctggtgggacactactgaacctgagaaaagatgttatgttcagtgatattgataagctgtccatatcaaatgttagcccgggctccaacaggttctttattcatcttctaatggcatatgtgttcacattttggacgtgctttatgctgtaccaagagtacagt

SEQ ID NO: 8499 - DNA, 579 bp, Triticum aestivum
  Clone ID: PAT_TA_8499
gctgcaatgctcaaggttatgacatctcggttgtgctaatccttgtcgtccagtggcgtgcattcatggatggacggcgtaccactcatgctattggccgagcagcctcgttgaaggttgtttccatcgctacagaccgctcatgcagtccttgccgtcgcccctaccggcaagtttgccatgatggaagaaacctttcaacaggcagctcgtcccatagcttgagtgccacccgttttatgaatcaccatgatgagtgcgatgaaggttttctccatcaaaataatagagaacaatgaatatcttttttttgcggggatagaacaatgaatatcttctccacataaaaagggaaaatgacggatatatatcttacaaagaacatgatcagatgatctacagagatgctccacgtacattgaaagatgcaatgaatttctccctctgtaacgaaatatagtttttagataactattttagtgatctaaacgatcttatatttctttacagagggagtactatatggcaatttgcttcagtatcaatccgtgtacacgcaatccattattaaaaaaaaaa

SEQ ID NO: 8500 - DNA, 662 bp, Triticum aestivum
  Clone ID: PAT_TA_8500
ccgttttcttaatgcaaagcacgagcactgctgcgaacggcgaaagctagcagctccagctacaagagccatccctttctctttccctttctgcgactccactcactcgttccagatctagaggttcttcccgggccgccgtccatgccaaggatggcttctctggcattggcgaggtgggtgctcctggcggcgatggcggcgaggctcgccggcgctgatgacccttaccgctacttcacctggattgtgacgtatggccccatcaatccgctcggcgccatccagcagggcatcctcatcaacgggcagttcccgggccctcgcatcgactgcgtcaccaacgacaacctcatcgtcaacgtcgtcaacaacctcgacgagccgttcctcatcacatggaacgggatcaagcagcggaagaactcatggcaggacggcgtggcgggcaccaactgccccatcccgcccggcgccaactacacctacaagttccaggccaaggaccagatcggcaccttcacctacttcccctccgtcgcgctgcaccgcgccgccggagggttcggcgccctcaacgtctaccagcggcccgctatccccgtcccctacccgccccccgccggcgacttcacactcctcgtcggtgactggtacctcgc

SEQ ID NO: 8501 - DNA, 428 bp, Triticum aestivum
  unsure (1)..(428): unsure at all n locations
  Clone ID: PAT_TA_8501
cacactactgatctccttgcttcaaggtcaaggaaggaaaccgtatcatcattggccagtgtaggttgccgctggaactagatggggtctccagccagccgccatgtggcttgcagtagcggttgatgcaagttatccttacatacgtataagggtcttagtacttacttagtatgacaaagtgaagatagaactgatgtattgaattattaatggggtggtttcgatgagaactgaaaccttttgctttcaaggttggacactgatatgaactgtgagtatttaatagagaaattcagttcatatggatcaaaacgaaggcatgtagtacctcacatggacagtgattatttgcccattgtagtacttcaaatttgatgaagaatttatttcacgactgagacatgggattngagaatctcagttct

SEQ ID NO: 8502 - DNA, 720 bp, Triticum aestivum
  unsure (1)..(720): unsure at all n locations
  Clone ID: PAT_TA_8502
cgcgccagtcagtagcgattcatcgcagctgatgtggcaggtcaaggcgaagcgtcgctgcggaccgccgctgtcgattgaagtctctccggcctccgctgaaattaatggaggttaaagaaattacagaaaaagctttgaaaatcattaacaactaggcttgacgccaaaagggtaggatccttcacaaaatatctcctactggttagtgaggtgaaggatgtgttgtactctgaagaaatcgtcttggggtcaaccacatgccagactctgattgacgttcaaagtggaggacctccagaactaggcccagcaatttgaaagttgaaacctaagacctcacttcaccgaaaatagcttcagcccggaggaaggctgcgggatcatcagaaatccaaacgcagttaacaactaactcgactccagtcgatgatgacaatgtgataaactactacaccctcatgaaggaagtgtgacagaatcataaccagggacatccagttggcatcacaatccattttgcaagccacaaatggcagcttatgtgtgctcaactataatactgagattggtgtgctgttatatgaatgtctactaccttaatagagtttgtgagagtttataacgtcttgacattgtataatccttaatggttgtaaagagttgtgtgtactcagaaatcatcctcgtatgtgtnatcaaagtaaaatctaaaaagtt

SEQ ID NO: 8503 - DNA, 743 bp, Triticum aestivum
  Clone ID: PAT_TA_8503
ccacgcgtccgcccacgcgtccgcccacgcgggcggtcccgctgaacgcacctcaccgggataaaccctctcagccgcgacggagcacgccaccatctcgccgattctacaaagaagggcacccgcaaaagggaaagtgggccggaagaaaatctcgccgccttccctttctttttttcgcgcgcgccataacgctggcggcggagctttgacctcacctcgccggaggataatcccctcaccgcccctcctctcctaaaacgcgccctaatcccgggccgagaggacctcggccggcgcgcctctccatttcttcctctcgttcgctccgcgccggcggtgggcgtgacctcccagtagcaccgcagcgatgtcgtcggcggcgggggcaccatcggacggcggaggggataggccgtggcagtcataccacaccgcctacaccaacgccaaagctggaatggagggagttgacaaagagaaggtgctgaaggtgatctatgaaatgagcaagggttctaagtatttcgaaaatgagcagaagaaggaggcgattaccaaactgaaaattgagcatctgcgcgcgcagtgtgcaaagttaaccgataatgacatatcacattttcagaaggttgctgaaaagaaaattttggagttggaagcttcacgggatctttcaaagatatggctccacactgacatggacgccttctatgctgctgttgagacattggaaaatccat

SEQ ID NO: 8504 - DNA, 612 bp, Triticum aestivum
  unsure (1)..(612): unsure at all n locations
  Clone ID: PAT_TA_8504
gtgcaggtcgagctcgcgccgctgaacgaagttgaaatgtcatagcaacggccggacggattcaacgccattggatattctccgttctagctggatccatcgcttccgctgcgaccattgctggagctgctcgggacgaggcctctggtgtgctgcctcctcttgtcatacctccttcgagctccaccatggtgaagtcctactagagcaagacgtcaggttctactacagcaggccggccgtggtgaagttctaactcgcacgcgaggccgctgcctgcaccgcgcggccggtgcctcaagccccatgccggacattggatccacagcgcagggggttggtgcaccaccatccagctgcattggtgagtaaggtcctccgccgcggccgggagcggcatcccgacttcgaccatcttgttaatgtcttcaaccatgtccaagggagacacaagacgatacaaatgtattgagcagctgatcagcttgtattgtgcaggctcgcatggggcagggggatgcaatggatagatccacgttccagccaaccgcagctgctgtcttgcatgtaataataagttataagatatttgttgtgctatactnaagatat

SEQ ID NO: 8505 - DNA, 751 bp, Triticum aestivum
  unsure (1)..(751): unsure at all n locations
  Clone ID: PAT_TA_8505
ccccttcacccctgcaccacgcacgcagcttcctccagctctccacgtggtctccaccgcctgcggtgggctctgacggcctgacggcgttcgcgcttcgcctggcaaaaaagctgcctgcgggcgacggcgtcgttgccttctcgccgttgtcaatctacacgacggcgagcccgccctggtggtcaccagaagcacgcggcaaaaccctggaagagctcttggccctgcttggcacctcgtcccccgacgaggtcgccgggttcgtgaggggcctcgcctctgatccatccagctccggcgggccgcacatcacctacgcctgcggagggttacacaaggagaagatggaactcacgccaagcctacctgcacaacgccgcagtcctataaggccgagatacgtacaatcgactttgacgaggtctgcactttcatcttgctcttgttgccgccagtgctaggtgatcaaacaatctgtgagttcggatcggcgccacccttgatgacgtggtggccatagcctcaagctgtatgtgtgacatttacggtggtgtggaagtcacaaaggagcatgtggctgtgccatgcccagcgaggagatcgtcggtggataagattagaggctggtgacaaatttcccggagaagagaaaatgtgctagtatagtagtagcatctcgctcaagtttaagaaaaaaaatgatttnctttggatgcaaattatattttctcggaagcagattctacta

SEQ ID NO: 8506 - DNA, 761 bp, Triticum aestivum
  Clone ID: PAT_TA_8506
gggccccgtggcaggccgctcccccccttccggcgtcgacccaccgccgatgcagggccgtcaccgcctcctgggccctccccttgcccccctttacggtccgccgcgccagttccagggacgccggccggacaccggccgggtctgccacggccaccccagccgtccgctccctccctagcaggcgtccccggcagcctcggacgaaggcggcggcgggcacctcaagctgcagatcgacagagcccgctgcgtgctccaaccgttggccgaccatccgacccgcaaccacaagacacctacgaggccaccggcccaacagggtttgaggccaaaggagcaatactccggactatcttccgggaggatgaaaggggagtctagggacacggccccataaagttgcagaaaattggctaaaagtactggcgaaagtgaatgatcacccttccttcgcaatttctaatttacctgtccgccgaatggacatgagacaacgtacactgtaaactctacagttcataagtacgggagattcaggcaatggcacattgacgaatttaacagaaaatcttccgggatgtacatcggatgggcaaccaccacgcgctttcccttcgccccccattgggtgggctccattggtctcttgcccgcggactatttcatcttcgctcggtatggggtcgacacgtgccgttggtcgctcgcttgctttattgttttgcagtttattgtgatggatattggctaagcaaact

SEQ ID NO: 8507 - DNA, 937 bp, Triticum aestivum
  Clone ID: PAT_TA_8507
gcgggaaggtaaaattgaggaacttctgagagaagttggggacgctgatgaaaagtctactctgcttgagactactgtacaaaggcttgaagaaagattaaccgagaatgatgctctatcaactacagaaagacaagaaagtgaagcaactaagaaattactcaatgaagttcagggtaaaaatgaggaattactcaagaaacttgaagatgctggaaaaaatattgttcattatcaagacaccacccaaagactcgaggaagaggtagccgccgcgggggtttccttgaaagatgaaaggcagcaaaatgatgtgatcatgaaacaactagcagatgcccaggtagaaattgtggagctacagaggaaccttgaaggtgctgataagagaaacagtctgcttcaagattctttacagagacttgatcaaggtgcgtccgcaagagaggctgttttgctagctgagcagcaggagaaagaggcgacctctaaggcactagctgaggctctggcgcggatcgagggtctgctggaggaacttgcttctgctaacagcaatgtgcatcttcttctatatacgttgcataggcttgtagagggtgcaacaacaacagatgctctttatttagaagaaaagcacgcacacgatcaaaccaagaaagtgttctcagaagctcaagaagtaaatcaggagttgcttaggaaagttgaagaagctgataaaaacattggtcatcttctagagaatgtggaaagacttgaaaaagatgcaatgacaagagagtctttgcttcttaaaacaaagcaaagttacgatgacaccataactgagctatttgaagctcaggagacaaatcaacagttaacgagcaaaatagaggactcggataacaaaatcggtctgcttgaagtttcggtgaaaagacttgaagaaagt

SEQ ID NO: 8508 - DNA, 1133 bp, Triticum aestivum
  unsure (1)..(1133): unsure at all n locations
  Clone ID: PAT_TA_8508
cccacgcgtccgatcaaaaatgctttctgtgcgggtgcggccccactcccgatcccgatcgggagcaggaaaacggcggcagagatccgggaggcgggaaacggcggggaagtggcggaggtcgggatccatcccggtggtttgtagtagaggctggccgcggcggcgctcccgatccccgatccgatcggtagcaggatgacggcggcagagttcctggaggcggggaacggtggggaagtggcggaggtcgggatccatcccgacggttcgtagtggaggccggcggcggcggtgctccatggctgtggcgactaggtcttctgggaagaagatacaagggagggagacgaggtgagatggagagaatagaagggagaatagggactgcgtgggtacctgctgctggttcgacggcggctccgatcatcggatcaggccaactcttgatggatttccaatgtgttgctgggctcccaattttttccgtcgtgcagttgctccccgtctccctgtgtcgtcccaagatggtccggctgggcgctgtcctgacggctgagcgtgtgctatccacggaacacagctcctccacctaggccctcctccgtaacgccggcgaggacactacttcgtctgaaccgattatcacaaccacgcacaggagctctatggcacatgtagcaggtcttgggcatgatggccggacgcgatgaggaggacatactggatccccatggacgccaaggattcgaggacattggcagatgcagaggaggcaatgaggacggagatgattgcggcacacaatttaaataaactagaatatcctgaaaattatatttggtgtatagaattcagttttagtctttgagtacattttcatcatcgcttattccagtagtgagtaaaaatatgtaaaactacgtgacttgtgttgacttggtaaatttttggtgtcctgtccctngtgtccccaaaccgattcccnacccggcatccggcctcccccctaacccctgggtgccggactggccagtattaagcggcncccctttgggagccccctggaagcaactccaaanggcatccncccttngggngcgcctcccctccaaaggcttttaagcttttcc

SEQ ID NO: 8509 - DNA, 675 bp, Triticum aestivum
  Clone ID: PAT_TA_8509
tcggcacgagggacgcggcgagctgtgcggtgtgcctggaggactacgcgtgcggcgagcgcgcccgggagctgccctgcaggcacaggttccactcccagtgcatcgtgccgtggctggagatgcacagctcctgcccggtctgccggttccagctgcccgccgacgacgacccaaagagctcatgcggcagcggcagtgggagtagcagcaccaccaccacctacgtcacctatgtcagtgctgaggtgaacgacaatgtggatggtcatggcaatgagagtggcgatgaggcagcgggcaatgcggccgtggagcgccaagacggcgatgtggagggtgaaggaaacgcgagccggctgccggcgtccatacagtggctcaacagcctcttctccccgcaggcggcatcaccatcctccacttccacttccggcggcagctcgcggcactttgaggactaaatctgctctgctccgttcggatgccattgtcatacctaccacgaacgcaagggtttgctgctgcgctaaaacttggagcttttctcctgtctcttcgtgtgaatcggtcatttgggtgtaatttaaaaagaaaaaacaagggttgtacagtttaaatttgatacattttgtcaaatatatgactgatgttcatcagttttcaaaaaaaaaa

SEQ ID NO: 8510 - DNA, 1005 bp, Triticum aestivum
  unsure (1)..(1005): unsure at all n locations
  Clone ID: PAT_TA_8510
ggtacgcttctcttagcgactcctactcctacgaccaactccacgctacaaaccaggccacgtacgtacagtgccatccaatcttcactcttgcgtttcccctttgtctctagctgcttcacatggcgtcgttcatggcggccgttctggtcctgctgctcttggcatccagtgcacgggcgagcgaggccgacccggcgcccgctgagactcagcagaatgtcttcatcgtcgacaactacggtgcacgtggcgacgggaagcacgacgacgcgcagccgctcgccaaggcgtggaacgcggcgtgttcctcctcccggccggccgtgctgctcgttcccgagggcaagacctacctgctcagctccgtcaccctctctggcccatgcaagtccagcgtcgtcttcatggtcaaaggcacgctggtcgctccacggagcaggtcggcgtggagccagaacgacacaagtcgctggatcctgatccaaggcgtcaccggtctcaccgtctccggtggcggcacgatcaacggcaacggcgacgtctggtggaccaactcatgcaaggtcaacaaggctctgccgtgcaccaaggcgccgacggccctcacgtttcaccaagtgcaacaatctgcaggtggagaaccttaagctagtaaacagccagcagatccatctctcggtcgaggactgcagcggcgtgcagttggcccgcctgtccatcacggcgcccggcaccagccccaacaccgacgcatccacatcacccgcagcaaagatggcaagccaaagattgtgtcatcaagaccggggacactgcgtctcatcgagaatggaaccacatctttgtaataaantgtttgtgtccgggcatgaatacatccggagctaagaatacaatcagancgaggcncggatacatgatcgtcacataggacacatgtgccgataaaatgaggaggacgttcaagnatagtcaanangctggacngaaacatnatgcaaa

SEQ ID NO: 8511 - DNA, 763 bp, Triticum aestivum
  Clone ID: PAT_TA_8511
ccgcccgccccgtccttcgccccccgcctcccccccccgcgcccccctgcgcccccgcatctcccaaatcccgacccaaatcctccccggagcgagccggagtcggccggtctaccattgcctcggcacgccgatggggatccccaacctgctccgcttcatgaagccgttcatcgagcccgtgcacatcaagaagtacgccggccagcgggtcggcatcgacgcgtactcctggctccacaagggggcctactcctgcagcatggagctgtgcatgagccccaggagcgccggcgccaggcgctacatcagctacttcatgcaccatgtcaacctcctgcggcaccacaaggtcgtgcccgtcgtcgtctttgacggcggcagcatgccctgcaagtcggccacggatgaagaccggcacaagaagagggaactcagtttggtgttggggaaagaaaagctgaagcaaggaaatacagctgctgcaatcgaccttttccggaaagctgtgcaaattactccatcgatggcttatcaactgattcagattttaaagacagaaaacgttgagttcgtggttgctccatacgaagcagatgcacagttggcatatctagctactctagatgctgatcaagggggcatagctgctgttataacagaagacagtgacttaatagcatatggttgcactgctattatatttaagatggaccgctttgggaatggtgaagaattcataatggagaaaaccttggagact

SEQ ID NO: 8512 - DNA, 911 bp, Triticum aestivum
  Clone ID: PAT_TA_8512
cgctatgtatgtagccctagaatggcattcccttggtagagtttagtaaaatcatttcacttttgtaaatgaagtcttcttttttatctaaatcatgctaattgtacacatttccttacatggcagttaagtatgcagaggagctgaatgatgcagagaagaaggtcacggctgttagcatggacgtgctcactcttacggcactgcatcaccctaaatatgtatccggccttggcaagaaaagagggcgtggctgggtttcccagttaaacaaaaaaaactttttgccagtatggaggacaggggtccaaggctgggctccctcataagcttgttccagtccttgtaatctcggaacttaggtgcaataatcaccccggaaagtgcattgtcactccggctactcaagcacccatgctattgaaaatactaaaataggagaaaaaaggaggacctcgccattcacaagcaataaccaacactgaacatgccgtgacactgcttgtatcggtgcattcaggctcttgaaggttctaaagtgtagtagaaaggagtgtaaaggtctattgtgtgatgttccaatttactcccgccttgtactcagacttcatggagtggttttgtaccatcgaggtttatgttttgtggcatcaacttctttgaataaattttaacgtaaatgttgtatgaaattgatgtctcgttccatccgtgatttttaacgttaaggctaatttggcgcgctaatgatgtagctcggctgtgtctagcctacccgaattccctacccaatcacaaaaaggcccaacacgaccaggtgctggccactcgtgaagacaatgctgttgaggaccttatggtctccttcacctaccttcgcttgggccctgacctctttcagcccgtctact

SEQ ID NO: 8513 - DNA, 894 bp, Triticum aestivum
  unsure (1)..(894): unsure at all n locations
  Clone ID: PAT_TA_8513
ggcaaggtcgaatttgatgatgaagggaaagttcgtggagttacatctgaaggggagacagcaaaaggcaagaaagttgtttgtgatccgtcttacgtacctgagaaggttaaaaaggttggaaaggtttttcgtgcaattgctatcatgagccacccgatcccaaatactgctgaatctcactcagtacagatcataataccacaaaagcaacttggccgcagatcagacatgtatgttttctgttgttcctattctcacaatgttgcctcgaagggaaaattcatagcgtttgtgtcagcacaagcagagagtgacaatccagaggcagaactgaagccaggaatcgatcttcttgggccatttgacgagttgtttttcgacacatacgacagatatgaacctactaatgacccttcttcggacaattgttttatatcaacgagttatgatgccacaacacactttgagtctaccgtgatggatgttctttcgctgtatacaaagatcaccggaaagacggttgatctcagtgtggatctaagcgctgcaagtgcccccgaagatgattgacaattctagggcagctatatcttgcaatttggaaacgatttatgctttgttttgcagttcatcgtaggtccacctttgccctccttattttgaaatgtgatagctgagctatagtcagataaagttgtatgatgtatagtctaatttcctaaattttctattgggaggtcgatagtatgtttaggcttccaagacagcttcgcctcggccgctacttttactttaaattctgataagacacaacaagacaatagatnatattttttggtttgtnatttcaatttgtcatctcctttgtctttttttctaggaaaccaaagc

SEQ ID NO: 8514 - DNA, 856 bp, Triticum aestivum
  unsure (1)..(856): unsure at all n locations
  Clone ID: PAT_TA_8514
tctacgagtgccagttcgacgggtaccaggacacgctctacacgcacacgagccggcagtactaccgagactgcaccgtgagcggcaccatcgacttcatcttcggcaacgcgcaggtggtgttccagaactgcatcctccaggtgcgcaagtgcatggagaaccagcagaacatcatcacggcgcaggggcgcaaggagaggcactcggccggcggcatcgtcatccacaactgcaccatcgangccgcacgcggagttcaaagaccacatgggcaggctccggacgttcctggggcggccgtggaaggagcactcccgcaccctctacatccagtcggagatcggcgacctcatcgacccgcaggggtggctgccgtggctcggcgacttcgcgctcaccacctgctactacgccgaggtggacaaccgggggccgggggccgggggccgacatgagcaaccgcgtcacgtggaagggcgtcaagcacgtcacctaccggcaggcgcaagagaagtacaccgtggagaggttcatccaggggaagctctggatctccaagtacggcgtgcccttcatcccggggttgctgccgcaggagcaggccgcccacactgatgacactgagccaagctagcgttcgtccggggtcgacgatgaagatggattgtggacaagggttgttaattttatggatagaggatcggttgtacgtacactgttgttgatgtatatcatctgtgtatcgtcgtacagtatatgtgagatgcatgtcaatgtagaatgtagaatgtatgtgcgtgtacactgctctttcggacacccatgctcacaattggacaacttacgactcaca

SEQ ID NO: 8515 - DNA, 1044 bp, Triticum aestivum
  unsure (1)..(1044): unsure at all n locations
  Clone ID: PAT_TA_8515
attcggcacgagggtttggaagcagacaaaaacaacctgctggctatggattttattttcctgcaaaagatgatcatgcggatgaatacacttcaaattctatgatgaaaaagatttcccgacttgcctgtattctggaggaagagagaagtccttgtgatgaaggtgtggaccagcagtccagcccccgtgatagtgctagttcaaagaaggatgaagttgccgttgctgataatgacataaaaattacttctttgataagtacagcagagttgatgaagaaagaaagatcgactgactggctgcgtgaatttaaggagtggatggatgaaaatacagagaacacagatggtgacagcctttatgttgatttcactaacagaaatggaagtcagaaacaacaaaacagaagagaaaaattgaacatagagagctccaagagtgtcacagacctggcaaaaacatcagaaggtggaagcagctcaaaccttgtggagtctaaattgtcttccacagatgatgcatgcaacggcgctaatggcttcactgcaggatccttgaacgaagtgaatgctgaccaaactcatgtaagggtacacttgaattctgccatacagcttcctccactagaatttgtgggcacttcacatccagattctttttctgatgtggaaggtggtgcaaattttttgcatacgaacggaacaccatctaatgcaacaagcaagttgatagaaccaagtccatcctttgcataccctagtccacagtcacccccacaatacaaggaagatatcctacgtcgaagactttttatggaggaagaatttttgcagagttcaggagatttccaatgtgttggttctcttggtagtggtagcagctgcagtgatgactcttcaggtgatttatgttcgtgcaattcagaagatgattgcgtagcaattcagacaaaaagggaactagccctgaatggtcagattgcttcatttccttatgcagnnnnnnnnnnnnnnnnnnnnnnnnnnnnnnnnnnnnnnnnnn

SEQ ID NO: 8516 - DNA, 1301 bp, Triticum aestivum
  unsure (1)..(1301): unsure at all n locations
  Clone ID: PAT_TA_8516
ggcgccgccctcctggtggcgctggccgtcgacatccagatctcgtctccgctctccgctcaccggccggccggccggccggccgactgccgcgtgaatgctcttatttaaagagcactgcaccatattacgtatctgcaaatggagtacgaaattagtactggacataatgctctggagcgcatgttaattgatggaagtgcggagccaatggatctgccgttatcacttttagaagacatcacaaattgtttctctgacgatcagcaaatcggcagtggcgggtttgcagtggtctataagggaatggtcggaaatgagataattgctgtgaagaggctatccaggaatatgcatgagagtaaattccacaaagaggtcgagtgcttgatgaaggccaagcacaaaaacatagtgcgttttctaggatattgttctgacacgcaagggaaaattatggactatgaggggaagatggtcatggcggatatacgaaattggttgctctgttttgagtatgtacctaacggcagtcttgataagtatattactgatgcatctcatggacttgaatggagggagcgttttgagataattaagggaacatgtgacggtctatgtcatcttcatgagaagcgcattttgcacttagatttgaaacccgctaatattctaatagatgatcacatggtacccaaaattgctgattttggccttacaaggtgcctcgagaaagagcaaacccacgtttttacttcaaacctttgtggatcactcggatatttggcacctgagttctatagtgggcaagtcacatttgcatcggacatatatagtcttggcgttataatcctggagataatgactggacaaaagggttactccgaagataagaatgggctggcgaggccaacaatacgtccgacgatgtgcacagagtcagttccacctgaagggaacacttctctacggccacaaggatgaggcgagagagcagctctgtggatggcttccgggagaatgcacctctttattttatatttggtaggatgcatgcgtgtctttctagggtattgataagagcgagagatagtgccccgacaaacttcaatcttcaggaatctttcaagtcattgcttttttcacgtgcgcattgtctcttggtgaataattggttgactcttcttttcatcttcgcttttcagcgatgcaaatcttcatgccttcagatagattgcttctccttcaggaatnccttgtgccagtgtatgcgtacatacatgccaagnattatttaaata

SEQ ID NO: 8517 - DNA, 865 bp, Triticum aestivum
  Clone ID: PAT_TA_8517
gccgtgctcgcgctcttcgtcgccgggatcttctgcatcttcctcgccgcgccccgccccgcgcgcggccggatcctccgcctcccgcgcagcctcgccgacgtgcgcctcctcaaggacaaccttgctgtgtatgcaagcgagcatcaggcgaatttcgtgctggggtattgctccatatacatcttcatgcaaacatttatgatccccggaacaatatttatgtctttacttgctggagcgctttttggggtgattaaagggggtgttttggtcgtcttcactgccacagctggggcatcatcttgctattttctctccaagttgattggcagacctttggtttgctggttgtggcctgaaagactgagatatttccagtcagagattgcaaagaggaaagacaagctgttgaactacatgctttttctgagaataacaccaaccctgcccaatactttcataaatatggcgtcacctattgtcgacatacctttccatattttctttgctgcaacactaattggactcatcccagcatcttatattactgtaaaggctgggagagctctaggcgatctaagatcagttagggaattgtacgacttcaagacattagttgttctgttcctcattggatctgtcgccgttgtcccaaccatcttgaaaaggaagagaacatacgaatgatgcctcaggcgacattgatatatatacagtccccgatgccccagcgtgtactagccttttttcaggccttctcttttcctttgctatatatgtatacctatttaatttagctgtaaagatgtaagaaacggaatggctcccttcaaagtcggtattacgcaataaaaaaggcgct

SEQ ID NO: 8518 - DNA, 613 bp, Triticum aestivum
  Clone ID: PAT_TA_8518
aggagattcggaccgtcgggaacgatgaggacggcggaggcggcacctcgggcgggtccaacggcaaaggtagcccgggcgagcccaacggcaaagagaccctcgaggaacagcagcagcccaggagggacctgtctcacccgacgctcaaagggctccccgtcagccgtctgcagaatgcggtgagatgcgtcactttcctcatcaggctgcagaaaagaggcctgtggtcatgatgcagccagccagcgtcggacaactaaccgaaccgctaacccaacccgttcatcatgtggccgctcatgcaactgtacagagcgatatatacaggccgtacaagtttttttttcctttttcttttttgaaaaaaaagagcgggttatagatcatacatatacaaagtacacaagacacattagagaagaataggttaagaaataccagtagtccaagtgaagtatacacacaaagcatcatcatggtggttaattgggggttgcaattttggtcctagggcagcgtccggatgtttcgacggacgtgaaagtgatcggtgtcgtggggtgtcatgatcatcatggttacctgtaaagtcctgttatatacctgtaaa

SEQ ID NO: 8519 - DNA, 207 bp, Triticum aestivum
  Clone ID: PAT_TA_8519
ggagagaactagtttcggcccgtattgttttttttcagatctgcgattttagcaattttctagagaaaccagttttacagtttagccctcaaacatcatgcatatcataacttaataatcgtgcatcggtttaaaatgaattatatatgtaacttgactagaattttgtctagtttcataatatccaactttcatgcaaaaaaaaaa

SEQ ID NO: 8520 - DNA, 461 bp, Triticum aestivum
  unsure (1)..(461): unsure at all n locations
  Clone ID: PAT_TA_8520
ggccatgtgggtcgagatactgtgcggcctggtggcctgcaagctcatccgcgccgtcttcttctccgacgacggcctcgaccagctcgccggcctcgactcctcccactccgatctctgcttcgccgtcgcagccaggctcgagaggctctacggcggccgctgcttcgtcggcctccgcatccctgaccccgacgccggcgaagcgccagcatgtcgacgtcgttctcgtcaccaagagggaggtcatggtgggggcaatcaacaaatgtctctgggtttttgttgaaggttgacaaaggatgggtaactgggttcaccgaaaaagaagcgcaaagaaaggagggttattccaaacccccggcttgctgtcaggtcgagtgcggccaatcttccctcatccttcgagcagaggcgggcgaccctgccgggcgggattgtcttccctagacgggaattgn

SEQ ID NO: 8521 - DNA, 735 bp, Triticum aestivum
  unsure (1)..(735): unsure at all n locations
  Clone ID: PAT_TA_8521
ctataggcaggcaacggtaacgggttcattgcggcttgcccgccggccggtacgagcatgccagcagccaccgtggtaggccgggaccacgccctggtccacgggactgttcgactgcgccgaggatcagggcgtctgcttgatggggtggtgctgcccgtgcgtcgcggtggggcggatagcggagatcctggacaagggggcgacgtcgagcggcaccggcgcggcgctctactttgcggtggggctgctgacggggtggcagtgccagtggatctactcctgcgtataccgcaccaagatgcgcgcccagtacgggctccaggagacgccctgtccggactgctgcgtccacttctgctggctcgagtattgcgccatctgccaggagtaccgcgagctccgcaaccggggcttcgtcatggacatcggatggcacgccaatgtggagctacagaagcagcagggccgcagcgacggctccatcgtgccgcccgccacgcagcacatgatatgacagacacgttcatcggagggcggtatatataaattggtggtgctagctagcttagctacgtccctgttggattggatacatacttagtctttgctgatagcagatcgcaacgtatgtacgttgtggttggtttgcttcttccatttagtaggtaggcatccttgttatgaggtttcaggttttcatgctggtaagtngtaaccatgtactatcacagt

SEQ ID NO: 8522 - DNA, 1416 bp, Triticum aestivum
  Clone ID: PAT_TA_8522
cctcccgcagctgagctaccgcagctcccttgccctcctcgacctatctatctacccgctgcatcccaccgagcaaagaggagaagggtagcaaatctattaccggtcggtttgtgtgctcgaggaggacgaagctggtagcatggctttcctcaacatggagcagcacacctgggccttcaccttcggtatcctaggcaacatcatctcacttatggtcttcctttcaccgctcccgacgttctaccgtgtgtaccgcaagaagtcgacggaggggttccagtcgacgccctacctggtgacgctcttcagctgcctgctgtggatgtactacgccttcctcaagtccggctccgagctcctcctcaccatcaacgccgtcggctgcgtcatcgagagcctctacatcgccatgtacctcgtctacgcccccaacagcgccaggctcctcaccgcgaacctcttcagtcgcctcgtcgtccgcctcttccgcctcacccccctcgtcaccctgctgtccgtcgcacggccccccccgcatcccgttcgccggctggacctgggtcgccctcgcgctgggcgtcctggccgctcgcgcgtcctccggcttgtgtgcggtccctaccgcgtgggttgcgttcccgccccgctcgccgtcctcctgcctcgccctccccgccgccggctcgctcgcggcccgcgcgctcaggacatcttcgtggcgatgcccaacgtgctgggcttcttgttcggccgggcgcgcgcagcgcgttacatgccgtaccggaccaagaagcccgccaccgtggtactggtgcacgcggaagtggagcaggctgcccacgtccagcaaggaggtggccggcggcgccaagccggagggcggcgcgcccaccgaggggaggatcagctgcggcgctgaggtgcaccccattgacgtgctcccggccgtggccgacgacgagcaagccgccgcagcggccgacgaagacgtgatccgcgacgaccagaacatgctcaggccggagcagccggcggtcatcaagcctgacgtcgccattgtcgtccaggcgtagattaggtttatcaatcagccccgttattaattcagtaagccggcgataagtgggtacgctcagcacacatgcgggccttccggcgtggtcgcgtacgtggctggccagaagttggagcactgtgtggctgcatcaggtccgcgcatggcatggctgactgtgcatgcagagatccagcttagctagcccgaccgactgcatgccatgtatgaagagagaccaggagtgagagcgagtgtgagtgagtgagtgagtgagagagatgcatgctacagcagctttgtactgtattatcaaacattttatcagcctgtcacatgcattggtttctttttatgtt

SEQ ID NO: 8523 - DNA, 1160 bp, Triticum aestivum
  unsure (1)..(1160): unsure at all n locations
  Clone ID: PAT_TA_8523
cactccctccccctccatcgcagcacccatctctctgcctcgcggtactgataagcgccaatatcgccatcgcggtgaccgcgacgcgccggagtggaagaaggtggcggagctcagggagttcgttgaggcacaggacccctctcccaaggagctgggggactgcgcgccgcgaccacggccatggcggcgacggcgatgcggcagagtggaagaaggtggcggagctcagggaggtcgtcgaggcacaggacccctctgccaaggaggaggatgactttgcgctgcggcggttcctgcgtgcccgggaccaaaacatcaacaaggcatcggcgatgcttctccggtatcttgcctggaagcgtgtcaccaagccccatggcttcatctccgaagacgaggtgcgcggcgagatcgcaaagggaagggaccgccaccaaggttttgaccgtcttggtcgccccatgtcgtatctctatggtgggcgccacttccctgtccggcgtgatcacgaagatctcaagcgctatgtggtctatgttttcgacaaaatctgcaccaggctgccggcagggcaggagaagtttgcggcagtgatagacctgaagggatgggggtatgcgaactgcgacatccgggggtacctggcggggctggacatcatgcagagctattacccagagcggctgggccgcgtgttcctgatccacgtgccctacatattcatggctgcgtggaagattgtgtaccccttaatcgatgacaagaccaagaagaagtttgtgttcgtcgctgatagggaccttgatgccacacttcgagacgccatcgacgagtcccagctccctgaggagtacggtggcaagctcaagctctaggcctacaacagttcaccatcgtccaagtccatctgatgatcaatcgatagcgatgaccatgtgacatatgcaaataaggttgcggcgtccggcgaggcagcccgagagaggcgacgatccttgcaagtgtgggagatcggctcaccgctcaagctacttgttgtgatttttttacgaaaaaaatggcggactcatacgtgcgatgttatatatgtttttttcatgtaagactgttatatatgtttcaaaaaccaagcgccgatatttnctcggtaaacacac

SEQ ID NO: 8524 - DNA, 892 bp, Triticum aestivum
  unsure (1)..(892): unsure at all n locations
  Clone ID: PAT_TA_8524
gggccttctactacgccaagcaggagaagctcctcatctatgactacctccccaacggcaacctccatgatcgcctccacgggcaccagatgacaggggagacgccattggactggacgacgagggtgacgctgctgctcggcgtggcgcgcgggctggcctgcatccaccgggagtaccgcgactccaccataccccacggcaacatcaagtccaccaatgtcctgctcgacaagaacggcgccgcgtgcgtcactgacttcggcctagcgctgctgctcagcccggcgcacgccattgcccgcctcggcgggtacatcgcgccggagcggtcgggcgaccacaagcgcctctcgcaggaggcagacgtgtacagcttcggcgtgctcgtcctagaggcgctgaccggcaaggtgccggcccagcacctgcagccgctgccggacgcagccggcaacagcgcacagaggaaagacaagcaggcggctgtgagcctcccggagtgggtgcggtcggtggtgcgggaggagtggacggcggaggtgttcgacgcggagctgctccggtacaagaacatcgaggaggagatggtggcgctgctgcacatcgcgctggcgtgcgtggcgcagctgccggagcagaggccctccatggccgacgtggtgaggatgatcgagagcgtccccgtggaccagtcgccgctcccggaggaggatgtatcgatgtcgccctccattggcatcaccacggacgatggtctcagctactagttttagttcagcatcagctttcctcgtccatagctagtagtagcattgaactgaggttgcttcagttaagtacctgtgcttggtgatgttctgggttgaaatgcnttctttcctgtttccgc

SEQ ID NO: 8525 - DNA, 557 bp, Triticum aestivum
  unsure (1)..(557): unsure at all n locations
  Clone ID: PAT_TA_8525
gctttccactcaaccacgtaagctaatctagccatgagtccttgcgacaagtgttttctcgagggctttgtgtacggcatggtggccatccccgcgatgctgggcatcgcgcggatcctcgacctcatcgaccactttatcacggacaagatccgggcttgcaggggcggcgatctggagcaaggagcgggaggcgcaggcggcgcggcggtctgaggtcaggatcggccgggtccagggccttccctggatggaggcgtgcaagctaagtactatggagtgttgcgttgcgtgtgtctggtcattcgatgagagcttaattagctgcaggcatggtatgtattggtacggtatgttatgtactagcaggcattgcatggtctctgcgactactacgtactcgatctagagtttctctagcatgtgttgttcactgcatgcacgtacacatatgtaatatgtttgtaataatcggtctccggctccggccggtgtgtttgtttctccgtcgatctacttaatttggcgataacttaatactagcaagcagganctnt

SEQ ID NO: 8526 - DNA, 809 bp, Triticum aestivum
  unsure (1)..(809): unsure at all n locations
  Clone ID: PAT_TA_8526
gccttgtaggtgatgcggatnatatggatatttcagtcaccaaggaggcagcagaagccacagttaatgatagggagaaggtcggttgtggtttcagcagtgaagataaaagtgcatctccagataattctcgaccctcgcctccgcccactggccatcagagagagaatgtgggttgtggtttaagcagtgaagataaaagtgaatctccagataattcagaaggatcttctgaacctaatggtcgtcaaacacacggcgtgcgacgtagcggtcgttcttctaatgcatcaaagagaaaagtggaagaaagctcagaagatgaggtgaatggatccataactcttgagaaaagaaaaaaggaagcaccaaagagaaaaaagggagcgccaaagagaaagaaagaagtgccagagggaaaccaaacagggggtggtgcattgtgggatatattccgacgggaagatgtcagcaaactacaggagtatctaataaagcattcagaggagtttaggcattacaattatgaaccagtgaagcaggttattcatcctatacatgatcagtgcttttacctaacaaatgagcacaagagaaaactcaaggaagaatatggagttgagccttggacatttgaacagaaacttggtgatgcagtctttatccctgcaggatgtccccaccaagtcagaaatttgaagtcatgtataaaggttgcactggactttgtttctccggaaaatgtaaaagagtgcatcaagttgacagaagaattccgtctgcttccaactggcatagggtgaatgaag

SEQ ID NO: 8527 - DNA, 1223 bp, Triticum aestivum
  unsure (1)..(1223): unsure at all n locations
  Clone ID: PAT_TA_8527
tttctcccacgcgtccgnttttttttatttcttttctttttttttttttttttttttttttaaaacagtataaacttttatactggattccatcatcttttgttcaccactgcacagcaagactgggcaaaacatgtgcaacgacactgaagggcccgccgcctctggctttgaccactatacacagagatgcccagttgcctgccttataccccaacaccagtatttacatgctataacaaacaccccctgctcatagggtgcgcagtttttcacgcctaatgcgacctcctgaaaacagcatgctagctcttgaaggctttttattattattttggactgccttcagcatgctagctagctctgtcatggtagaccagccagcaagcacagtaggatcgcaagtgcccattgacaggaatgccttcgggtggcaattgatgtgttgggagcaggggccacagctggcacttgagcaggatgatgcgcatgagcgagagacactgtatgcagcgggggcttcacatttgctggagatggagcaggggaactatggtgcctgttgggaatatttgtagagtgacgagcagaaggtgatggactgacagaagatggtgacactgcatgaggcatggtgggaggggaagcataatgatgattcctaactactggctcagccgctggggccacaggagccttattttttggcttattggtgtatccatatgaataaccagatggggatggagatctatatttgggctgttccacaggaggatgtacaggtgcaggagatggaggcaaatgcctaattacttcatgactacggtggtggctatggtggtggtgatggtggtggtggtggtggtggtgatgatgatggtggtggtgatggcgatgatcttcatgagtcatgggtgcggggcttggtgcatcactatcactcccgctgtgcaaagaatgccgcagatacgacgaaagacttatctgctttactttgccaaatacagtgtgatttagtcccaagtttcctgaagatgaattagcaatcgtttgtgccaactgcttcattcttggaggggaaggctggtgattcccaacttctagaataatggaggaccgaacaactgttggaggagcaaccgttgaaccttccaaatttgtcaatttgatataaaggatctcattggtatcgagaagtagtccctggtgccgaattcctg

SEQ ID NO: 8528 - DNA, 623 bp, Triticum aestivum
  unsure (1)..(623): unsure at all n locations
  Clone ID: PAT_TA_8528
atgtagtcntaatgaaatctctacaaagactaatattcaggaacggacggagtatacaagagaactgagtaccagtggaggattatattgcatttgccatggcgcggaaggtcatctgataaacaggaacccaatctaaaactagctactattagacctaattgctcatctaataagaccaacataagaaagaaaggaactacagctatatatacacgttgccccctacatctgttctgcatcactgcaatattcaacttagccaatcagnaacctagccaacccaccaccatgacaagagcaccggaacttcattagaccgcatcgatcgaccgaccgaggtaacttcctcgaaagtcatattgctcagcgggcaaaccgagcaagccatcagatatagcagctccacttacgtaggctcttcggttagtgagttaagcctagtgtcaactacgagtgcttgagcctcctgtgagttgtctgtactcgctgcccttgtaggctacagtactttgacgtgcattgatgcgagtgcggacagcagttccctggactggtccattagagaacgctcttgcgtggcgattctggcaaggtcagacaccaaaatacttgtcccagat

SEQ ID NO: 8529 - DNA, 1412 bp, Triticum aestivum
  unsure (1)..(1412): unsure at all n locations
  Clone ID: PAT_TA_8529
ccacgtccgaatctcccccgccccctgttagggttcgtgccgcctccatggcaggcgccggcatccacccgtttcaccagcagtggccgccccaagcggcggtgcccgcgcctcccgccgtcccaccgcctccccccgtaccaggcgcacccgatgccgccgcccgccccggctctgacgaggtccgcaccatcttcatcacggggctccccgtggacgtcaaggagcgggagctgcataacctgctgcgctggcttccgggattcgaggcttcccagatcaacttcaagggcgaccagcccatggggttcgcactcttctcctacgcgcaccacgccatcgccgcaaaggccgcgctgcaggatctggtcttcgatgccgagaccaagtcggcgctgcacatcgagatggccaagaagaacctattcatcaaaagaggtgtgggaactgatgcaaatgctatggaccaaagtaaacgcttgcgaactggtggaggcctccatcttcttcccatctcttcaagttcttttgtttaatgtgagtggccgtgcgtcaaatcgtccattttattaacgtgtcgagatcgacagcagcagcaggacacgacagactggacaaacgaaaactaagacggcggcgaagaggcagacatgccgcaacaacggcagaaatgaccaccttcattattagtcactctgtgactcgcatcgtttcttcgttccgcctcaagccgagcagttgacttgtccgatgttgcagcgggaggggaggctgttgatgatgcccatggtgctgcacgcgcagtcgcgcgagatggagctcagcgcgctgcagcagtcggcgctggggtcggccgcgccgggcaccaggtacgcgcggcacgccagcagccggttcagctgcggcacgcacctccccggcggctgtgcctccgccgccggcccgaggccgccgaccaccaggagaacgagggacacggccaggagcgcgcgcgggaaggtgctcggcgccatcgtacgtcggtggactgtttttgttctctcaaacgctagcgtggctcgttgaccttggggccaccgcaggttatatggcagctccgcctccttataatgcgtatgctgacgatcctgtgccggcggtaccaatggcttcaccttctcctgtgcactatactcattctgcgtatgctcctcctccattccacccacccccaccagctgtttccatgtggggaactgcaggttatatggcagctcctcctccttataatccttatgctggctatcctgtgccgacggtaccaatgacttcaccttctcctgtgccaggcccaacagcatatgctcctgtgcagaacatgaaagataaccctccctgcaatacccttttcattggaaatcttngtgaaactg

SEQ ID NO: 8530 - DNA, 734 bp, Triticum aestivum
  unsure (1)..(734): unsure at all n locations
  Clone ID: PAT_TA_8530
gatgttgcatactctgtntttttatgtgtatgttttttgacactacttttgaaactataatacagcacacgaggtacatgtaggctcttttacaagccaaggaaaattaaccgatagtgtcagggaataaagaatggcgtcggctatacaaaattctgttatctccactgtgcaaaacattgctcgctgctgccgcacattttagcactacgcttgtatcttgttgaccctgaaagagtccatgactctcctcaggtctccctcttcctccgagagcaaccgttccggcgtctgcagccgtagcgcgtacagctggttgttctcgacaccgaggactgtcaggtaccgccggtcccactccaagctctgcaccctgtctttcggcatcaccgctagctcattgttgcttgcgtaggacttgatgttcacctcgacttcgtagtagagcttgccatcgtcggcgaccttggacgatgctgacaagacattcgactcgcgtcgaacgcctagtctggtcgacatgaactccgtcaaatacgctcacaaccctccgcagctctaagggggccaagtccccacggtctgtctctgacgaagaagggatgattttcacggcatgtcactcaggagacggttctaagaatttccggcantcttgactgataacctttggtantaagatactaattgcagtccctatnacgcgngccacaagattgctggccnaatanagt

SEQ ID NO: 8531 - DNA, 1119 bp, Triticum aestivum
  Clone ID: PAT_TA_8531
gcacgagggtacggcccagcggcgccatgtcgtcgtcgttcaagcccaaccccctctcgctgagcgtaccggaccccgctctcgaccgctggctccgggactccggctacctcgacctcctcgactcctccacccccgcacccgccgcagccgcccccacacgcgccagccccgcatccacctcctcggggcccggcgccgccgccgacgtcctcgccttcgcgcgcaccctagcctctctcctcgcgctcaacccctttgcgtgcctcaccgccgccgacctcgccgcgcccaccccctcctggtccctcgccttcatcggccccgccggcaccgcctcctactcctggcccccgacccccacccaggcccgactccgcgtccaggagaacgtccgccgctacacccgcaactatgccgcgctatccatcctcgtcttcgcctgctgcctgtaccggatgcctatgtcgctgctggggttgctggccagcctcgccgtgtgggaggctgtgcggtactgccggaaccggtgggagctcgccacacgagcgcccggaattgggcaggctcttctgcactgtgcccagattgccactgctatactactatatgtatgcaacctgcagtttgctcttgtgtatgccattgggttgagttatgcagtcatgatgctacatgcttctcttcggaagttgactccctcaagcctatctgttccagcaaataagaataggagggcacagccaagacgaagctagtcgccattggaggtcggctgcagatggcaggtacattgccatgtcgcagtacggtggaggcactgccctgaaagcaattctacacctaagatcatgtgctccgactatatacgccattcaatccttccacagggttatgtcaaaagatattggctgcatgagttcggagacggggaagacgattgcaagagtgaaactgtaagcacagcggaatgtgggaacaatgtgtgcttacaatcctaggactgtaaaatccagttttggcaccgacgctgattaaagaatttttgggaggaatttcggagttcttaatacagttttgttaaagcacatctagatgtgccataagtattgcacatct

SEQ ID NO: 8532 - DNA, 741 bp, Triticum aestivum
  unsure (1)..(741): unsure at all n locations
  Clone ID: PAT_TA_8532
ccccccctttttgatgattnttgataccatattcatgcagtttcaaccctacaccattacatgcgtaggacacggcagcaagttaaatacatattcccacactttgtgctactttgatatgctttaataagatggttgcatgcatcattatgatgcagagggccgagggtacacctccattttcaaaaagaaaaaacatgcacgcagggcgcagcagcaacacaggcacaccggatgttaaaaaaaaaacaggcacaccggccaaacgtacgtagtacgtatacataacgagccgtatatacgcacaaattcctggctcttattggacgcacgctcgcgcgtatgcgtataggtgtgctagcagctggctgaatcgcggatcgatcagcagcagctggctagcttagccgaagaagtggtgcttcttcttcccctcgccgcggccggactcctcgtcctcgccgtcctctgccgactccttgtactccttcttctcgtggtgctcgtggaacgcgtaaccgccgctgcccacggccgccaccgcggccacctcctcctcgatcttgtgtcggtgcgcgttctccgggtccttcttcacctggtgcttctcgtacatggcgaaggcgccggaggcgagggtgcctatctcgcccgaggtgctccttgtgcttgtgctccttctcctccttcctgtacttctcggtctcgtccctggacgacccgtactctgtgtcgtcgccg

SEQ ID NO: 8533 - DNA, 1320 bp, Triticum aestivum
  Clone ID: PAT_TA_8533
acccaccaaattcgcagaacctacaccgggtcactcacgcggccccacccggcagcgaggggggcaagggcaaaggcggaggcagtttgcaggaaagcccccgtactattccgccccgcctcccgcctccttccctcctgccggggctgcccgcctcctcctccgcccccccctccgcgcctcgccgcccccctcggccggcgacgccggccggcgagcgggcgggcgggcgccgcccccctcctctcctctctccccggcccggtgcgtctgcgcggcccgcccccattgccgccccgtcccgagtgtagctctgattggggaagagtggaagatggttgtcaaggagttcaccgttgatctcaaccagcctcttgttttccaggttggccatctcgaggaacattaccaggaatgggttcaccagcctatcgtcagcaaagaaggtccgcgctttttcgcaaatgataccatggagttcttgacacgcacaaagtggtgggctgtgccagtcatatggctacctgtcgtctgctggctgtttgccaagtcgattcggatgggtcacaccattcaggaagtaatcctgatggccctatttggagtgtttgtttggacgttcattgagtacgctttgcaccgcttccttttccacatcgagacgaaaagctattggtcgaacaccgcacactaccttatccatggatgccaccataagcatcctatggactcactcaggctcgtattccctcctgctggggcagcgatcatatgtgtgccgttctggaatgttgtggcattcttcgccagtccatctaccactcctgcgctgttcgccggtggcctgctggggtacgtgatgtatgactgcacgcactactacctgcaccatggacagccatccaaagatccagcgaagcatctcaagcggtaccacctcagccaccatttcagaatccaggacaagggcttcggcatcacctcgtcgctctgggacgccgtttttgggacgctgccttcgtccaagatcgccgcgaagctcagctgacacgcgcatgaacatgttctttgcatgaggaattttcagtagagtctgtagggcttaggttagggacaaggctcatcttgcctttctgccatgggttcgcatgtctgctccggtggtgtgcgccggtggcgggtgcggcggtcggcctcggttgcctcgacgtttggttgcctcaacttttcatccacagaaataggttattcgtttcgtggtattcgacgctaggaggataaatagtcatattccttggttcaattgcgaaaaaaaaaaaa

SEQ ID NO: 8534 - DNA, 582 bp, Triticum aestivum
  Clone ID: PAT_TA_8534
tttcgcttgttgtttccttaaacaacagaatctttagcttcataaatgctgaatagcataaaaaacagtacattacactgcttcaactaaataaagagagaaccatgccgtttgttggcaaaaaaagcttgacagatagtttcaggaatcaaacactgaaagagggcaaccttattttgctggactactgaagagctagttctttcttctacccagctgttaacatctaccaagacgctttcttaacacccatcagttcacccttgtttgccaaggtgcggaacacgatacgagacatgcggaatttctggtagacaccacgagagcggcccgtgaaaatacagcggtttctaagacgtgtcatgttactatttcttggcagcttggacaacttatagcgaaacttatcccgcatatctgatggaagttcagggtccctacagacagccttataaagctttcctctcagctcatattttgctgcaagaattctacgtttgtgatcccgcaagtttctcttctctgagactgagaccccatggtatcctcgagcttgggacgtgcatgaacatgctgggtttt

SEQ ID NO: 8535 - DNA, 428 bp, Triticum aestivum
  unsure (1)..(428): unsure at all n locations
  Clone ID: PAT_TA_8535
acggcgagctcatagtgcacatccggccgtcctcgcaaagtggctccgagcacagcgccaccgttgacgccgaccaacagctccccttcacctgcggacatccggaggcgggaacgccgtccttttacgacggcggtccttaccgcgcgctgttctggtcgctgcccgagcttgacgaccaaggcccaaaaaacgtcttgccgttaccatggtcgcggttggagatgtggggcaggctgacggcggcggcgctggatgggacttgggccgtaaaccccccgattatacacgaacatgcgttacctgagtccgtgacgctctccaccgacgtggtgatgttctaccggccggacncggaggctgggggaacgaatgtgatgattgctgcaaccgaggatgtggagcatgtgtatagcatggaggaacat

SEQ ID NO: 8536 - DNA, 907 bp, Triticum aestivum
  unsure (1)..(907): unsure at all n locations
  Clone ID: PAT_TA_8536
tactagatttataccagttgtagatgttaatattttcncgataaactctggtcgatgagccttgtaaatacgccaataggggattacatccccatctatacaaatctgattggtttggataaccgatgcaaaaacagagtaccagctgaacttctgaaggtgttcgcagtaacaattcagaacaaaacactaaaacctaacccagcagcgggtgcactgcgcggcgcagtcccctcggcaatccacattgtagcccaaaaccttgggattccgcaaaagaacactccggagagtcttcccgtttatcccccaatcgctgtccagcttgccgacattcagcttcacctcgctctcaagatcgcacccaggaacctctgggaatttctttgagcagcttgtaaaggtcgtcatcagagagccccaaggcccctgacgtagtccagcactccgcttacccacctcggcgctcgggacctccttctttctctcctcggtcccagtaacggcgaatggagcccacccgaacgccttcttcagcatcttctcggcgtcttcggccggagaaattcagcggaggtgagtatctgcttgcactcttcccatgttttgctgtcaccggcgtccacggacagcggcggcttgagctgggtcagacgacagtgtacgccattttccttgaatcccacttgcacctttagcctttccatgctgagtgtttggctggacagttaaccttgttccatgtttcttcttggagaaggtgacacttggagaagtggagagatggcagggttggaagaaggccgaggaggcggcggcagtttcagtggccgtcaggtaggggacgggcagcgccggcgacctggccaacatcgcacgcatggggccgccgccgctcttggctttc

SEQ ID NO: 8537 - DNA, 660 bp, Triticum aestivum
  Clone ID: PAT_TA_8537
gcacgcggctttaaacagcaatatgttacagaacagttcagggtgtgaggaggaggaaacataagaggatatcatgtggtagtacaatgccagtcagcaatagatgatcaatggaagcccgagtacaagaaggcagcaatgccagctgctaccaggaagcaactgccggcactggagctgtgtggagaggagctgctgtcagctactttgggtgccgcctccggagggccgctcaccgacacaggcggcagcggcgggtcgagaacatcggcgggttccagcaagggtgctggcgggagcgctgggggcagcgcgcctggggggaccatgctcaccagagcaccgggtgctgcagccatgattgtgtaggtcaggttcttcgtcggatcactgcatgggctcctgaagtatgtagttgcagtggcagggaactcggtcacaattccatcgacgaccaatgcagcagagtatgtggcgatctcgaccatcggatcagcaaagtagtcgaacccaaagttggtgaactcattcttgagcggaccgacgtgcaccgtcaagtttgcagcgtgcagattctccaccaaattagtgaaccctgtcaggaagaagccattgaccttcacgagcgaagccgcgggtcaccatcactacatccgcaac

SEQ ID NO: 8538 - DNA, 1745 bp, Triticum aestivum
  unsure (1)..(1745): unsure at all n locations
  Clone ID: PAT_TA_8538
cgtccgcggacacgtcggcccacgcgtccgcccgcgcttccgccctgggagacagaggcagctcttcttcgtttcagtagtctttgagcagagccacctccatccagccagagcgcctgcagagcgatgatggcgctgagcgagaggcagccgcagtcggagaagaaggccccgcgggcgaggcccatgtcggcgaaggcggtcttcgtgctctgcgccaccagcttcttcgtggggctgctgctcagcggccggatgacggtactgtctccgccggcgtcgggcagccacggcggctcgaggatcgccctcttctccgacgacgactgcgagcacaggcgtaagctggaagaagagagcaacccgaacgatgtcatgaacgaggtgtcacgaacccaccaagccattcggtctctggacaagtcggtgtcgtcgctggagatggagctggcggtggagcgcgccaagaggaacggcggcctgggcgcggccgggccgtccaagggccgcccgtggttgtggtgttgtgcagggcctcaacacgcactacagcagcaggaacgcgccccgctccctgcgcgccacctggccccgggcggccgacaagctccggcagctggagaaagagaagggggtggtgcggttcgtgatcgggcacagcgccacgcccggcggcgcgctggaccgggccatcgacgtggaggaggcggagaccagggacttcatgcggctggaccacgtggagggctaccacgagctctcctccaagaccaggatctacttcgccgccgccgtcgccacctgggacgccgccttctacgtcaaggtcgacgacgacgtacacgtcaacctagggatgctgacgaacaggctcgccaggtacaggacgacgcccagggtgtacgtggggtgcatgaagtccggccctgtgctgtcgcagaagggcgtcaagtaccacgagcctgagtcttggaagttcggggacgaggggaacaagtacttccgccacgccacggggcagatctacgccatctccagggacctcgcctcctacatctccatcaaccagccgatactgcaccggttcgcgaacgaggacgtgtcgctgggcgcgtggctcatcgggctcgaggtggagcacgtcgacgaccggagcctctgctgcgccacgcccccagactgcgagtggaagaagcaggccgggaacgtgtgcgcggcgtccttcgactggtcctgcagcggcatctgcaagtccgtcgacaggatgagggccatccacagcgcctgcggcgagggcgacggagccgtctccaacttcgccgccgcctgatccgccgccccccccccgccgtgtcgaccaagccttgttacatgctttgtgtttttgtcagacttgaaaactatcatcagagaaaggaaccggctgtggtttccggccggcggcaggtaaaccgtagaaacgtggcggcgttttgggaacagagcatctcgtggtttgngtgatccaaccgaaggccatgtcttcttttattagtttgcaaaaaaaagtcttcttttatcaggacaggagtatctagcgaacgtcagagtataacaagtttagttgacgagcatgacaaatactcctaagttcatttttaccagaatattgccgtgcttgcaactaaatttatcatccttgcatcaatataaattgtcatgaaaagcccaaaaaaaacaaaaacaataagaaaatccaatgcgcg

SEQ ID NO: 8539 - DNA, 694 bp, Triticum aestivum
  Clone ID: PAT_TA_8539
tcggcacgagggtcttcggaaaatcgtcacaggggatcgtggggctggaaacaagtgccggcacgcttcgcgttcaattgctgcctgattgtgcaccccattctgtggattacttcatcgagctgttgcgcctgcacaactgcgccggatgcagattctatcgtgccgaaggccgtgggcacctgtgggacgcaaaaggagaccacgtaaaaaatgctgcatttggtccaccatacgcgctgctgcaagggacactggaagtcgacggcgtggccttcaaggagatgccgaaggaagggtgctcgacagtgagaagggggtccgtggcgtggatcgggtcagggccggagttcctgatcagcctggcggaccacgaggagtggagagacgcctacacggtgttcgggtccgtggtgccggaggacatggccatcgccgaggagatggcgatgctccccaccagcacagacgtctggagcggtgtgaccgtcaggctgctgaaggacccggtgtatatcaaggtgaagaggagaagcaacgtgaccgcctactgagctcgccggcgattttgttgttcctcttcttctttcacttgagatgtcaaaagataagaacacaaattacatgtccaaaggaagaaagaaagaaaaatagaggaggtttggaggggactgttacacctgagattttatct

SEQ ID NO: 8540 - DNA, 857 bp, Triticum aestivum
  Clone ID: PAT_TA_8540
cgtccgggccacgcttgtgaagatgctgaaaatgatgggaggaaggacagcttgcaccagttctttgacatggtagctggtggtctagctggtcaaactccacatgcgattagtgctgctgtgactgggttagctcgcttgacctatgagttctcagatcttattggagtagcttacaagctcctcccctcgacttttctccttatgcagaggaacaaccgagaacttgtcaaagccaatttaggctttatcaaagcattggtggctagatctaaagctgatgtgcttcatgagcacttgaagggagtcgttgagggtttgttgagctggcaaagtgataagaagaattctttaaaagcgaaggtcagttcgcttgttgaaattctcgtgaaaaaatgtggtttagatgcagtgaaagctgtgatgcccgaagaacatatgaaattgctcaccaatatcaggaagattaatgagcgtaaaatgaggaagggcaatttgtctgaagatggggaggctatgtccatggcctcaggagctacaaggcaaagtggatggaatcacacacagatgttttctgattttggaagtgacgatgaagactcgaatggtcccttttccaagcagcatactgtagcttctcgtaatggatcaaaagcttcaacacggtcgaaccgaaagcgtcaagataagaacttgcaggaaaagttcattgatcactcaactggtgagccactagatttacttgaccagaagacaatgcggttggctctcaaatcgacaggaaaaaagagggctgcacctgatgacgacgacgacgatgagatcgagatggaccccgaatgccgtatgatcattcg

SEQ ID NO: 8541 - DNA, 1258 bp, Triticum aestivum
  Clone ID: PAT_TA_8541
gcgtggtcgcggccgaggtactttgctggtgtgatggtgaggttgattcttgttgcagcacctgctgtttgccttattagtgccattgctgtatctgctacaataaagaatctgacgacattgatccggtcaaaaagcaaaagtccacagactacaggaaaaacaacaggctcgaaggcagctgcaaagggagcagttgatcaacccttgcctttccaacataatgtggctgttgctttacttctgggcgctttctacttgctcagtagatatgccatacactgcacttgggtaacctctgaggcttactcttctccttccatcgttctgtccgcaaggggtcacaatggaggaagggttatattcgatgattatcgtgaggcatactactggcttcgtcagaacactcctactgatgccaagattatgtcatggtgggactatgggtaccaaattacagccatgggtaacagaactgttattgttgataataacacgtggaataatacacacatagcaactgttggacgtgcaatgtcatcatatgaagacgaggcatatgaaataatgcagtcattggatgtgaattatgtgcttgtcgtatttggaggtgttacagggtactcctctgacgacatcaataagttcttatggatggtgcgtattggtggaggagtttttcctgtaatcaaagagcctgattaccttgtgaatggggaatatcgtgttgacaagggggcgtcaccaaaaatgttgaactgtctaatgtacaagctctgttattatcgatttggagaactgaccacggaatatggaaaacctccaggatacgatcgagtgcgaggagtggagataggcaacaaagacataaagcttgagtacttggaggaggcattcacaacatcaaactggatagtgcgcatatacaaggtcaaacctccaaagaatagatcctaaggtttcgtcccaggaggggagcggcaagcgagacggtttggggtgattgctttgacatttatctcatcaggagggtgcctagacatgaacttttttgttttcgtaagactaacagtaacccgtactgttgcttgaaagctgaggacatgtagttgtgatagctggtcactcatttttgtttgagcatactgtgatggaattctcggaaacttttgggtggaaacttttgggtagcaagtaattttagatcaatatgccagttgaaattcaccggtgttggggtgtagaagaaaagaatttt

SEQ ID NO: 8542 - DNA, 974 bp, Triticum aestivum
  Clone ID: PAT_TA_8542
tgttgctagttaaaatatattttttggcaagaaccccaagcatttcatcacatgtacacttacaagcttgctcctaatttgagcacccatcagatgatcaaaatacaagagatgtttttctttctcttttctatatcagtgatttgctgtagtggcaacaaaaagaatagcaacgaggtaaaaacaagagatggatatgtttggtcagtgggcgctcccttccagagttagccagattagaatcatagaataacggatgatcttacacaagcttggatgttcccagcactgcaatttataatcaacgccacatcggggactaactggaagcattgtcgttgtcaggctgtaaatctccacacgagaggcactgctggaaaaggcaagatcagagtgtgtaaatgtttcaactatggaactgagaagagttggttgacttctcaactcaagacaaaacatgttctcttcattgagctgcaactcttcgcaacctcatgtaaatggctcattatgtctcgtacacactgaagcccatcgcctttgagggaactgagtacccgcttgagaaactcatgatcatcttcaagggccctcagtcgtgtatccaagagtgaaatttcatcctgaagattgtttaggccactcattttttcgttgtcgaaagaagaacatgaacactcatccttgtccttctgctcaattgattgctgaaaagaacttgattcatcccctatatgatctccaagcaatgtctcttgaatgtttgtggtatcattagaagcaagcttgtatgtagaaatgcgaagcttttcctccaatctgcccagtgattccaaaatgtatgccttttcttcttcgaaacctgacatggtgctcgtcatgaaatctgatgcattcaagacatcaaatgacacattcttgtcatatccgggtgtattgtccactgtatcatcaaaattccccccattaaattg

SEQ ID NO: 8543 - DNA, 460 bp, Triticum aestivum
  unsure (1)..(460): unsure at all n locations
  Clone ID: PAT_TA_8543
ctgttcctttatnctgtnctactggagaaccgtataaggacagcgatgccacagtaggcacaggccaaaactcgttgtacacacatagatagatggatcctcgatttttctggctccggactgcgacgttctaatagtattaaccttacaaacatggcacgcctgggactgtaccttccagagtatatagactggaaggagctctccacctggagctggagccacgcacgcttccgcatctccaactgtttgtactagtcggtggtcccgcgacagagatctgggcaccgtcgcctcgccgctctcaggggcagccgggccagtctagcgagagaataccgggatctcccgtgttcccatgtgcgaacactttcggcactttcaccagggaaagtggtggaaaccggggttgaattctggctctggagaatccctccacgccaaacaagcactcgtagcc

SEQ ID NO: 8544 - DNA, 936 bp, Triticum aestivum
  Clone ID: PAT_TA_8544
cctcgccgagacgccgccgggccaggcaaaacttgttcatcaaatcctcaaagctgccaagtctatcaacgaacaagtcctgcttcagatcactagtcccatggcgcttatggacgcccttccaaagtctggtagatctagcttgggtgaagacctgtaccatgccataaccacggactatattcctatcgaagaaatctttgtttctctgagtctaaaaaccgagcatagcgtgctcgagaccatgaaccggttagaaggtgcactttttgcatggaaccaaaggatctcagaggaaagaagcaggaggtcccctgcacggcattcgtggaagttcatgaaggacagttcgtcggagctggagaagatgtcggcgtgcatcgaaagggtcgagaccctcatccagcttctgaagtccagattccccaacctgcctccaacgttcatcgacgtcgtgaaggtccagtataacgaggacgtggggcacgccattgtggaggcctactcgagggttcttgtaggggtggcgttcagcatcctgtcccgggtggcggagatcatgctggaggacgacctggtgaagaagcccaacacgcccatggccaccctcaagttcgacctctcctccgacgtgtacctggcgggcatcaccgagacgccgccgggccacatacggcggtccctcatggaccagatcagcatggtcgacggccgattcgacgccgtcgtcaagaagagaggggccaagcagctcatgtggtgatgcgggcgggcggggtgttgtacagggtgatggctgcgtgccggctgcgtacacaagttgcatctaccttactactaatggtgcatttgtaatctgtaacagcagcattggccgagtcttgctgaatgctgaatgctgaatgctgatggcaacccagatgctgctgcttttgc

SEQ ID NO: 8545 - DNA, 917 bp, Triticum aestivum
  unsure (1)..(917): unsure at all n locations
  Clone ID: PAT_TA_8545
cacnccttctcaagtactcccaggaggtaacggcataacagactgtccaacattttaaacttatattagtaattattggantacgtttaattgcacttgactatgtaaaatgcaaattacttaatgccagcttaataaatggactccgcggtgtcgtacatggcaaacccaaagatcatacttggtactatctccaggtagcaaccaaataagctaaaagaagggaaattaattatagtgcattgttgtccaacaatgagatgtatacgcacattctattctgatagcacaaaatacttgctaccatgttcgtagagacccatttgaaataatatacatgtacataatacattctccagtgtacatttacataatgtctcacagtttggaagaaaatatatatgtcaatggcggtacataaaactaaaaatgagtgtatttgtcgctagggagtaaaagggcgtatcatgagtaactgtatccagtatacagagaatatttctctgtcaaataactccaatgaatcatagtaaattcaatacattgtttggaagaaaatattgatagaagtccattgagcgctgaggaataaaatcgttggggactgaaaaatatattgattctagcaaaaagcatttctccaagtgagaaacattcagtccaaaaccacatcaagaccagcatacctggcttcttctgctatcttgtatatgcagatgaaagcctccaatgatgaaagaattcctagtttaggggtatgacatccaatttgctagtaatatgtcaaccaaaaatattagttacaaatattgtcattttagtcggcagcagcaatggcccaccaactcaaacagttgcatgtaacaacatattctatatcgaaatatagactacaacatgtacatggacatgttaag

SEQ ID NO: 8546 - DNA, 2442 bp, Triticum aestivum
  Clone ID: PAT_TA_8546
ggcacgccgcggccgccccacccacccgccagccagccctcacatactcctgccccgtccctgcgtccgcctcggcctcctcgcctccccccccccgtccgcgtcccccctccccccgcccccgtccggccggggcccctgctccggcggccccctgctcggctccgctcgcccctccgtccgtccggtcggggctacgtcccggcgccgtcgcggcttctgctctccgcaccacagatcatatactatggaaactctacgtgacatggctctgccaccaggatttggattccatcccaaggacactgaactcgttgctcactatctgaaaaagaaaatactcggtcagaaaattgaatatgacattatacctgaggtggatatatacaagcatgaaccatgggatttacctgcaaagtgcaatgttccaacccaggataacaagtggcatttctttgctgctcgagacagaaagtatcctaatggtgctcggtcaaatagggcaacggttgctgggtattggaagtctactggaaaagaccgggctattaaggtggataagcggaccataggaacaaagaaaactttagtttttcatgaaggtcggcctcccactggaaaacgtactgagtggattatgcatgaatactacatagatgagaatgaatgtcaagcctgccctgatatgaaggatgcctttgttctatgtgaagttactaaaagaattgactggacatcagagaatggtaacgaggtgggcaataataaccctcagccacaacaagcaaatgttgctgctattttagctgtcagtgttgaacaaccagatactgctgcatcatcaattattggtgatgaacttccaagtgatgctgctacggtagctatccctgctcacacaactccagatgggaatgatgaccttaaagaatggctggaagaactgcttgatacctcctttgatccttctgctaacactgcagtggattctatttctgctcaactgtctccggatgaacaaaatgctgaatcatcgaacattggtgctatggctccgggggcgggtcgggactcggcctgtccgctccggtccggggcagtcgttcccgtcttcctggtgcctgctgggtgtctctccatgtggtagcctggctgtgtggtctgcccggcttggctgctggcgttctttacggcggcggatcccttcagtctgtcaaacaacttcatggatgaatttcagatgaaagagctacagttacctctggaaaataatgggcctaatctgtatgaacctgctgatactggaattgtagtgcgaacacgtcatgggggaacatctgcagccagcgctccaccatacaaggctcgacttcagcaaagtcttggcaggatggttacgagcagctctgaatccatcaaccagactatcaagttcgttgacaacaacggtcatcttgatctcatgactaatgtgaaacaccagaagaaacatgtgcgtgatattacttctgccaggcagtctgatgcagagaagtgtggaagtcacaacaaccaaggatttctcaggggcgtccaaagggcatttagaggctgttcagcaacaggactcaatatactcgttgctctttgcatggttggagttgctgcagcaatactgcaccatggacgtcaccgtggtgggatcagtttgtagtagagggggatcagaagcgtgcctagttttagctgtacaaatctgtagcatctacgcactgtgatcttgatcttgacagtaggcactgtgattgaagtggatgagcgattgagcatgtggctgggatccttgccttctggaggtacttggtcgttagtcgttacacgtaatgtgtgctctggtgcaggacattgattcccttatatctggtttcttcatggtgtttgtacatatgaagctcttgctttttgatcagtctggctaggtactatggtgatggatgagtgccaaacagaaaagaacaaaaacatagggaataatagctgtgataagttctctcttactgcatgctagatttgtaactctgaaccatagttaacagcttgtagtagggtcatctttttcattcgagttgaaccaagggtacttatgtaaattagcgagtaataatcatcatctcactttggattacagcattattggattacagtattgctgtcatttgaagcgatgacctgtttgcttgaaaaaaaaaaaaataaaaaacgaaaaaatgatcgcatccccccagccgccgcctcggctgtcgcgctttgacgcatgacagctaaaacaatgaaaattcgcagggcacgcaccagcacatctgtctattgatttgccctgtgattcgggcacttgttttgacggaacttgcttgaaaaggagaaaaaatctcaaccctgtcaatatggctacttgttttgacg

SEQ ID NO: 8547 - DNA, 998 bp, Triticum aestivum
  Clone ID: PAT_TA_8547
gtggcattatgggggactatccgatctagggaaaaatattgcatcagttggtaaagcccgtgcgaaggatctgatggcttctgaagccattgaaggctatgctgtactattggaaaatgttatcaagtttccttccgaaacactgaccccgttaactgctggggagatacctttgcctttgaaacaagagtggaaatggcatctatttgaggatgtgaagcacttatacaatgtgaatgaaagtttggctgactgcaagatgctcaagaaaatggattggcacaggaacagaaagaatgatcctcacagtattacaccaaagattgatgaaacgttctctgctattgcatggaaggaagaaagagcaaatcggattatgagcgccaaaatgaaattggaagaagagtatttgaaggagaggagtgaccaacctcgtggaacatgggaggaagtgtataggaaatgtcaaaagggtggataggatgaaaaatgaagcgtctgaaagagatgaaaaggagcttgaacggacaggtcagccactctgtatatacgaacccttctatggggagggaacttggccctttctgcatcaaagctctctgtatcgtggaattggcctgtcttcaaaaggtcgaagattcggagcagatgacattgatgcttcttctcgtctcccgctgctcaacagtgggtactacagagatatccttggggaatttggagctttctttgctctggctaacagaattgaccggatacacaagaattcttggataggatttcaatcctggagggtgactgcaagaaaggcgaacttgtcaaaaaatgctgaatctgcaatgttggaagctattcaaactcaaaagcatggagatgccttctacttttgggttcgtatggaccaagatccaagaaatcatgccaatcaagatttctggtccctctgggatgcgattaatgctgggaacttgaggttagctgttttggaggctttttaa

SEQ ID NO: 8548 - DNA, 1237 bp, Triticum aestivum
  Clone ID: PAT_TA_8548
gcaccgtccgggacgtgcggcggagacgagcgatggctcgataggcatcctccccaggttcagatcccgacggcatcctccccaggttccagaaccgctgacgtggcgctcctcttcctcctcctcccgcctctcccatcaccgcctcgtctgcctcaccgccggcgaccgtcgctcccgtacccacactccggcgcagggatggctcaatgaggtgtgtgtgagccgcgttgatctggcttctggtggagtgtgaaatggtggatttcccggaagggttgcgacggctcgctgctctcctgctcaagtgctgcgatctcgacataccaaatcgtcccaagggcctcgaggatcctgagcgtctggcaagggaaacagtttttagcgtaaatgagattgaggcattgtatgagctgttcaagaagatcagcagtgctgtggttgatgatggtgtgattaataaggaagaattccaactggcgctgtttaagactaacaggaaagatagcatgtttgctgaccgggtgtttgatttgttcgatactaaacacaaaggaaattctgcgaactcgaagaatttgcgcgagctattcatgaattccatcctaatgcaccatttgatgacaaaattgattttgctttcaaactctatgatctcaaacaacaaggtttcattgaaaagcaagaggtgaagcaaatggtggttgcaacacttgctgaaatgagaatatagagttcagatgagattatagagggtattatcgaacaagacatttgaggaagcagatacaaagcacgatggtaaaatcgacaaggaggaatggcgcaatcttgtcttgaggcatccatctttgttgaagaatatgacactcccatatctaagggatattaccacaacatttccaagctttgtcttcaactctcaggtcgaggatgcttgagaatccagtttctaggttaccactgaagcttgtgaaagaccacggcagactatgtcgtaggtggaccttgtgtatttttatttctttattcctttttggcgatatccttcttgtgcttggaacaattcttgtaattttttcactttaaaatgtgaattcccagcaatctcctcgtgtgagggctcttcttttgtatataccgagtataatctagaattaactgttccttatgtataaacgatctttggatagcagttatattttatcgttctaaaaaaaaaaaaaaaaaaaaaaaa

SEQ ID NO: 8549 - DNA, 528 bp, Triticum aestivum
  unsure (1)..(528): unsure at all n locations
  Clone ID: PAT_TA_8549
gtgttgttgtgatncccgagacgcagtgctctcggtatctataccaccagtttctctcgtgatgagcgccacaggaggtataggtacagttataacttatctattcgattttttattatggcccatggcccactacctagatgctatctcttttaccccgtcagctatccttagcacggatcaaatggagatagactatacgagccgtcccatcgtggattctggactaacgccgctagtgagctcctttatgacatccgctcatgggagctaccaatctcgccccaacactgctcctcctgttcgtagacttgtggatcccccacagattggccttccaatcaatttgagctggtaccaccactccaattcgttcccaaccatgtctgcatcgtctcctgctgaagtacgcattgctgcagccgagctctctcctctagctgcaattgtaattcctgggaagacaattcactgctgcttncacgcacggtcatgcccactggcatcgttgccccccttagcacgctt

SEQ ID NO: 8550 - DNA, 1436 bp, Triticum aestivum
  unsure (1)..(1436): unsure at all n locations
  Clone ID: PAT_TA_8550
cggggcaattcggaaggaggcccatgtctacccgggaagtcccccccccggaagacgaggctccgagtcggctcccactgatcgcttctagaagcttccagaaagctccggcccgccgccatggccgcgcccttcttctccacccccttccagccctacgtctaccagagccaacagggatctgtgacggcgtttcagatatccggtggggatgtgcaggtcctgcaggtgatggtgaagtcgcaggacaagttgactgcgaaaccaggtacaatgtgttacatgtccgggaacattcagatggacaacaattacttgcctgaaaacgatggaggcgtgtggcagtggatatttggaaaaagcataaccagcactgttttcttcaatcctggccctgatgatggatatgtggggatttctgcgccatttcctgggaggatactgcctatagatctagcgaacttttgctggagaactactttgccaggacagattctttcctctgctcggtcaatgatgtgtcagtcacaagtagtacagttgatcagcggccgcgcaacattgaaattggtgcagagatgatcctcaaacagaagcttaggggtcaaggtatggccttccttgtcggcggtggatcagtaatgcagaaaattcttgctccccgggaggtgattactgttgattgtgcttgtattgtggctatgacaaccaccattaactttcagttacagaaccctaccccacatagaagagcagtccttgtattcgggggtgtcaaccagctaaaagcatctctcacaggacctggcgtcgttttcattcagagcctgcccttcaatcggctctcacagcgcatcgcaagtagatcggtgggggccccaaggttgatcgccagccccaggttcttcatccagatcgtcatgttcttcttcctggcctatgtcatgattgtctcgtccataattctgacggatgtttaggcgatgtcgccacgagcaccttcgggtgttccggcgatgctgcggcctgcatgttggtgtagtccttgtaggatgttggaagagtcaaagttgttgcaccttacagaaccccctccctccctctgtagatgccgtgtcgcgggcgtgagtaagcctgagaagaaatcgcacagctgttgttagaaaacatagtggaaagtttgtcagatttcttttgtattatggtttgcgacgagcagcccttgttcgtgtgtagacagcaagctcaagttgcacagcatagggtgaatattaccgttgacattgacttagatcccaatgtgctcttcgggcaaacgtgggatgttcgtgcacgtgggtgatggntgtggtttggggttggggggtgtgtggnggagtgttagaggntggggtnttgtttntttttgagtgggtttgtgttgtgggttttgtgat

SEQ ID NO: 8551 - DNA, 439 bp, Triticum aestivum
  Clone ID: PAT_TA_8551
atatatataactttagaggaaatggaagctccccaagtgatttacactcattattttcacattagaatgctgcaataagcccttacttttcagggagaattgcccagcgtctttctcgctcgtaccatgagatggttgcccaatatgtcatgagtcgagcctcgcttctacatattaaactggtgtgtagttacttcttggagcgagtcaatttaaatttacacttaaggaagtcacccgccatgcacgacatttacggcagctgtcgccagcgtccatgcctcaagccttgacaccttcacgatgccggtcccgttattgaacaggaacacatggctattgttgttctccgcgtgcacagggtacacccgtgctgtgatgcatgtccgccccccgccaccaaagctctccaccaccgaatggtcaatcaatgttctaa

SEQ ID NO: 8552 - DNA, 647 bp, Triticum aestivum
  unsure (1)..(647): unsure at all n locations
  Clone ID: PAT_TA_8552
tttttttttttttttttttgtaatggagtcgtaatttatttctaagtcggtcaagttgcacaatgtgggcaacataaaaacaaagctgaatcatccacttagaaatatgaattcccatcccatncttagaaatagccgctcccgttacataccagcaatcctctcccacttgcgtttcagcccttggacgacgatggttcataaagtttctagtactagcgtactactcgtgcatttcctagtgctgtactatgcatttcactcaagagtctctgtcaaaagaaacagctcctcgtggccgacctgcctgcctgcaggatgcatggctgctgtaactctgtagtacgtatttcccaagctacacctgtgaatccagcttggctctcttctcctcctccagtttcacctcgtcgtcctcttccttgttcatggcgccggtgcgagcattgctaccatcgcatccttgtttcatggtggttgctgatgcaggagctgcactaagcggcggcggcgggggcgcccccccccccctcccccactgctcgcccggcaccccggccccccgcagcgccccgccgggcccgccgccccccgtgggcgccctccccgccgcggcaggtggagcggagcccggtgcccgcgaccct

SEQ ID NO: 8553 - DNA, 735 bp, Triticum aestivum
  Clone ID: PAT_TA_8553
cgcctacccaagggaaattctttttctaattatatagtaggagtacatgacagttcaaatctcccaacatatcaaattacagtctgccgattgttctacgcaggggaggggggcggggatcaatacttaatttcatgatctcgcccttttaaggcccctctcgccgtgatcatagctcctgtggtcatacacatccttcctcttccggtcgtcgagctcagtcacggtggaaaggtactcttgactgtccatggagagctcgccctcctcggcgttctctgccgtccgagtaccgttctggtgcgggggctggggccagctctgccttctgtcgtgtttcttctcatccttgacagccatctccactccatgctccagctccctctcaatcaggtcatcatcatccatgacgtcaacctttctaccggcatcaccttttgatttcctccgtttctcaagcgcagctttcactttatccttgtctatcttcttcattgcatccattgaggatgacatattggggcccttcgttgctgctggcaataccatcctttgcttccaccttgggtatcctctggtttgagttttgcttctcaggggggcctaccatgctcgactgtttaggtgcttgatgatttccatgagcatgacgctcgtcagcagctccaggagccttccccacagcacgtggattaaccacacttgcagaactgccttcggtatcattcccttggg

SEQ ID NO: 8554 - DNA, 526 bp, Triticum aestivum
  Clone ID: PAT_TA_8554
ttttttttttttttttttttttttttttagcgactgaaagcttgccttcctcctcttctccctccgctcctcctctccagttccacgattttgctgaaacaaagattaataacatcgatcgcatgtgaagcactctctatgaacgattaatattacactggagttgcggcaccaagctgttccgttagagccgcaagcagtcttggcatcgggggcatatcaatctcctgcagaccctcgagaacccggaccacttcacccatagtcggccgatcaaactcattatcttggatgcaccagcatgcaactttgcaaaccctttcagcctcttccaaattgaagtcgccatgcaactgtggatccaccaaactcttcacatctcccgccatgaagcttgctgatggcttgcacagggaaatattcaacattctggtacctgggtgcggctgcttccaagtggtgtatgggtgtttctagtgaggaattcctccttcctgatatgatttccagaagtaccatgccgaag

SEQ ID NO: 8555 - DNA, 652 bp, Triticum aestivum
  Clone ID: PAT_TA_8555
ggtactattatacactaacaaggagttaccataaaaaatacactaagaaggaaaaagagcagagagatctataaattcagtcatgccctgcgctttttcagtttataaagtatataaacaccccaatatcctatatgagaacacacggttacatgctaaaactctatacagggggacctgcagcaacgtgaaacggcagcttcgcagacgaatgtggtgctgacacctctgaaatccggtccatgttcgcagagctcccgtacgaccttttcagctgctcgctacctgctcgtcttgccgagccgtgccttgcgcaccgcctcttggatgtgcctctcgtgctccttgagcatgtcctcgatattccctcccagcggcaccaatggccccgagtggtggatcctcctgagcttccttccatggttctgaccacagaaaggcaatggtacgccccttgtgagatgaaagaatataaatcctcaatacttcccttagcagtagcacactgatcatagcgtcctgcacctctagggggttcttgttgtgagatgatgcaggcctatcaggtggctgattctgatatgtaacctcaactgcattcctcagatctgtcgtgcaaaactgtggtatatgtgaatgcgatgatgccttt

SEQ ID NO: 8556 - DNA, 529 bp, Triticum aestivum
  unsure (1)..(529): unsure at all n locations
  Clone ID: PAT_TA_8556
gagagaactagtctcgagtttttttttttgtgtccttgctggcgggtgggtatgcctctgggagcggtacttttgcgttcacctcgcggtcttccgcccacagatgccaggcctatcccgagtgaagtgtccagctcactgctcaagcaccacttccgacatcttggcaccagcccgcgcgcggccccgccccgcccgccccgcttgtgtacttctactatagcagcagtcgttcaaagaggcagctgctctactgacccaggagcttgagcagcacggggagcccgcacttgggctgcagcgtcaggaactcggccggcgcgtgcacgtactccggcgccacctcgaactcgaaccggcgcaggatcacggcgagcgtcgccttggcctccagcatcgcgaagtctgcccgatgcacgaccgcgggccggcggagaaggcaagcatcgcgctcggtgcttcgcgctctgccnaggccgtccgaaancggtccggcttgaactcgccgggtccgcgcccaaaactctcg

SEQ ID NO: 8557 - DNA, 881 bp, Triticum aestivum
  Clone ID: PAT_TA_8557
cgacctcgctcactccccggtccctactctcgcaagtagagaagagagatggctcgcccctaccacctgcccctcctctccgtcttgtccttcctgctcctcaccgcactcggttcttctgtgcaagctcgctcactcctcagtccctagtctggcaagagagaagagagatggctcgcccctaccacctgaccctcctctccgtcttttccttcctgctcctcactggccttgtgactgctgatctgtccggagagaataaggtcgggaagattgtgaccatgaccgtccagtacccggccgcgggctcaccgccgggggagaagaccacgatctcagcgcactacgttgacgagtacggaggcggcggaacgctcacttcaaccctcgactgggacggtggatggtgccccgtccagtttcgccatgaaaggacccttatcacgacccttggaggggatacgagatagcgcgggagtctttgttgcggtatttccatattgctgtaccctcaattaggaagcagtgccagtcggatagttcgctgtgtggtatagtacagtgtgaaactcttctattctatgttgtgttttaaagaatctctttagtatatcttggattgtgtgtgttgcttaacttaaattgaagatcgtgttcatcgcttgtcgatccgagctatagtagtacgcggcccttcacgtatggtgctcagcgtggtggatggttgcatgtccagtgcccagtggagattggagaaggaatagtgtggtagtgtctgcagatcgtactatctgcagatcggtagtagtgtggtagtgtagtatggagcgatctttgatctccttttcatatcacggaaaatattataggcgccttttaac

SEQ ID NO: 8558 - DNA, 1480 bp, Triticum aestivum
  unsure (1)..(1480): unsure at all n locations
  Clone ID: PAT_TA_8558
tttgaaaccgaaccnttttnggtctatgtacagtccactttccggcgctccacatgttcaatctaaaggcacaaccaatggccctcaactatcaaacaccttttcatgtctcaagcaggagagtttgcaaaaaggctaaatacacgtcaagattactccacccaaactgacaccagacaaatgaaaatgcatagctccacatacactgaccaacataactaccaaacagggaaattcttgggtgcgagtgttgcccacatgtcagaattagtcaagaatgttgttacagcttgtctttacaggtcgttttcaagaccaggatggtcaggaatcaaagctgagttacaacccttcactggttcatctgtctgcacaaaccggagaatgcggctttccggatgagagggtgaatactcccaacaaaaacctcctcgtccaacatgccaatgtgagaccaaatctctgttgcatactgtcgagaaaatgactttagataccccaatgtgcacaggcaccattgctcaagctctccaatagtataaccagctttcatattttcaccattcacttgactattgttatctgctccattttcatcgtctatctccatagttgccgcttcaggatcgctggctggaaatgttacattaggatctccagcgcgtaggttaggaacatctccatcagcagaaacaggtggcaggcgttcagtaagcacatcaacaaagctcttgaataataacctaagcaattctttgccttcttcaagcccccgggcaaggagagcctgctttgcctctaacgattcttcaatagttacttcctcttcttttgctttgtcagcaaagccttgaagtcgtctcagcctgcctggtctttcagatgacacaggttggccctctacgatttcaagtattgatttagcctcctccaactctttgatggcttttgcactagcctctttagcaacttgaatacttttcctcagtgtctgaatttccttccggagatcactgattcgattgtatgtcttactaacagtattcctaagaatctcccatggacgatccgacacatgaaattggatgaacattagcaggagaaaaaacccacttgactatagccaagttggaaattaagcgataacccatcattctatcaatagctatagcagtcatctgggtactgttcttccagtaagcactgacttcatccatcaacaataactgcatttcctcatctgggcacagtttggaaattatttgaccatatctctccaaaacagtgataagatgggtgaaactttttgaaccgatgtcaagaagtgtctgactaacaacatcaactgcgaatttggccccatttgcaggaactatttgttcctcaacccacaaaataatatcacgtgtagtcttccttcctctaaccatgctaacaagttccttggatagcctgtggccttcggtgctcggacgcgtgg

SEQ ID NO: 8559 - DNA, 582 bp, Triticum aestivum
  Clone ID: PAT_TA_8559
ttgtgaccaacaggttgttgacaagaagatcaaacaaatatcataaaacttgttggcaccacagagtacagactatcacatgagtgtccccaattccacatgccaaggcgttggttacatggagcttactgcaagttcataaggagatcttgcagcaattccaccagagtatgtatgtatgtgaccatatagcaaggcaaaggaattccatgtccattggtgttttgttggtgaagaaaggcagatgctcagtgctgtccatgatgatcacaagaggccgactgcagaccagaccatgcagatggacatcatgaagtatgtatgcatcctctcgacagcaatggatctcgcatgccggccggccgggcggggatcaggacgccgcattggcgctgttcaggaaagacagcctcctccgcgcgaccttggacctgtagcaccaggcgtcgaacgcctccgacaggtccgggaacgcggcgtgctccgactgaagccactccgacagcacctcggcctgggcgtttcgacggcagcgtcgtcacgatcgaggtgatcgccgactccagcccctgccacaccttc

SEQ ID NO: 8560 - DNA, 748 bp, Triticum aestivum
  unsure (1)..(748): unsure at all n locations
  Clone ID: PAT_TA_8560
ggcatgattgaaatgtggcagggccggcgcctgggcgacatggggcaaggctggcgccagggccacggggcctcctgagaaggccagttccagggttccaacttagtagtacaattctactactactactagtgctactactgcttctactgctgctactactgaactggggttacttactagctatagctaacaagttagggcaacagcaacactgagatggtgttggctaggccgtcccagcagctaaacttcaggcctaacaccgacttaatccaactacctcagctacgacccggtcggatcgcgcatcacgttacaaaaatggcgaccgaccgaccgtctagacgaacgttggagactacgtcgtctccgttgaagctctttgagagccagatggccgtctccctgggggacgccttctcggggccgaacggcttcagcaggatccccagctcgtcgtacctctcctgctgcagcagctgcgcgctgaactccagcaggccctccagcgcctccgcacgctgctggaacgacgacatgtcgaaccgctgcagcctcgagtcgttggagcccccgcccggccccgcccgggcgccccgccccccccgcgcgcccccggggtcccccccgtccgcacggagcacctggatcgtgcacttgtccttagtgatcgaccggttgatgaagggaggggtggagcatgagccatgggctgaagagagncttgtggatggagtggaagggg

SEQ ID NO: 8561 - DNA, 597 bp, Triticum aestivum
  Clone ID: PAT_TA_8561
cactagtaggtggttttatcctacgtcgttgctcggcttttgtgggaaccgcaaactactccaggttgcacgaccgacgtcgaaacaaccagtgctgcaacggtcaccgccttcgcagcgtgtgtacaggacaaactgctcggcaaaaatgggggggaactctggagcagtcaccctccatgcttcccgtgcaacgcgagcatgcccttggcgtaccgcgtccgacccgcccgatacagaacgagcagcgcctcgaactccctgcaggcgtcgtcgtacacggcacgcctacagaaccttgacttgaaatcggcgaaatcggccgaggctccctcacgatcggagctgaacatgtcaagaagctcttccaagggccccaggacgtcgcagaagccgatcctgctgctgcgaccgtgctgctgcggctgctgccggagccaggacatccactggaagggctcatcgtttctctccttgaccacgagctcgactgacctcagcgcatcctcgaagccacagttcctgttgatgttgtggagtatctcagcgaaggttgacctatggctgcttctcagagagttactggatgacgggagc

SEQ ID NO: 8562 - DNA, 925 bp, Triticum aestivum
  unsure (1)..(925): unsure at all n locations
  Clone ID: PAT_TA_8562
gctctttcacctgtgcctgtcaacaatgtaaagaaggaagctacggttccttcagctgggcctgtcaacaatgtaaagaagactaaagccacagctccttcagctgggcctgccaacaatgtaaagaagactgaagccacggccccgtcagctgagatccagtgttcactgaatttttctgtgctaagtttagagaaagcatcgaatgctatcactgaaggctctgctcattctccaaacccaacttatggccatacaaaggatcacgctggcagtaataagaaggaaactgtaacatctaccttaccaaatggtggaccagtgctgttcaatggatttcctgccgaagtttctcctaataatggtattctcaagaatgtgaagtctgaagcttcggtcccttcagctgggcctgtcagcaatttaaaggagaacaaagcaacggttgctttagctggccctgtaaacaatgtaaagaagactgaagctcaagttccttcagctcgtcctgtcaacgatgtaaagaagaatgaagctctggctctttcacctgggccgatcaacaatgtaaagaaggacgctacagttccttcagctgggcctgtcaacaatgtaaagaaggacgctgcagttccttcagctgggcctgtcaacaatgtaaagaaggctaaagccacggctccttcagctgggcctgccaacaatgtgaagaaggctgaagccacgcccccttcagctgtgtctgccaacaatgtgaagaaggctgaacctacagttccttcagctaggcctgtcaacaatgtgaagaaggctgaagctacgattccttcacctgtgcctgtcaacaaatgtgaagaaggctgaagctacggntccttcacccgggcctgtcaacatgtgaagaaagctgaagctacggtccctt

SEQ ID NO: 8563 - DNA, 2550 bp, Triticum aestivum
  unsure (1)..(2550): unsure at all n locations
  Clone ID: PAT_TA_8563
aagaatgaagctctggctctttcacctggngccgatcaacaatgtaaagaaggaagctacggttccttcagctgggcctgtcaacaatgtaaagaagaccaaagccacatctccttcagctgggcctgccaacaatgtaaagaagactgaagccacggccccttcagctgtgtctgccaacaatgtgaagaaggctgaacctacggttccttcagctaggcctgccaacaatgtgaagaaggctgaagctacggttctttcacctgtgcctgtcaacaatgtgaagaaggctgaagctacagttccttcaccagggcctgtcaacaatgtgaagaaggctgaagctacggttccttcacccaggcctgtcaacaatgtgaagaaggctgaagctacggttccttcacccgggcctgtcaacaatgtgaagaaggctgaagctacagttccttcacccggccctgctaacactgtaaagaagactgaatctgtggctacttcagttgcgcctatcaagagcatcagcagttcaacaccaattgaagggccagggccgcaccatgatggtctcagatgtacagaaagcagcagttcagctatgttagtaactgagaatggaagcacaggtgctgatgcacctattattgcagctccagcagatgattccgtcacaagtttaaataaggaagactatcagaataagccgttgcttcctcatggtttgaagaatacaggaaatatatgcttcctgagatgcaactttgcaggctttcctttcatgcttcccttttgttcagcttgtacaaggcctgaggaaccggagtatacctaaggctggctaccctactctgagtgcattcattgagctcgtctctcagtttgatgtacttgacgagtctactatgaaagacgagaggtttgctttagtcgctgcaaaaataatcaatcctaccatgttcgatcaagttctgagaaattttactccagatgtaccggctggaacatctgctcggccaagacaagaagatgcccaagagttcctaagttttgccatggatagaatgcatgatgaactgttgaggcttaatggcaatggttcaaattcaaaggaaggtatggttgtttcttctgatgatgacgatgcctgggagactgtaggtaggaagaacaaatctgcaatcatgaggactcagagttttgttccctccgatctaagtgctatttttgggaggcaatagcttcaaagtgtacgtgaatggctgcatgccaacaaagccttcatgctatccggccagtccttgccttgctgatccagcctagatctatttccaggatgccgttcaaacgcgttgacagatgcatcttcatctgttttccacccctggaatctttggcaaggatacaagaacaactgctgggaaaggccggagtggatgacagctagggaatcattcacgatacactgaactttcaaaagattacgatactgcacttgaagaggtccagttatggaaatcgtgggtgtactaaactgtacaagccacttccacttccctccttgaactggtccttaatcgggatctgctgagctcaccatcatcagagggtagaagatacgagctcgttgcaaccatcactcatcacgggagcggcccgtccaggggccattacaccgctgatgcaaagcgtgacggtgggcagtggctttcggttcgatgacggccatgtcatgcccatcaacgtgaacaagggcttgcataacccagcgtatatcctgttctacaagcaagtttaagtctggtgttaccatgcggttggctgctcccttcctcgcattgctggaacagtgagttatactgtctaactatgggtgtgttaaatggtagccgccgtgtaaccccggagtcgtgacagctaggaactcattcaagatacacgacctttcaaagataatgatactgcacttgaagaggttcagttatggaaatcgtgggtgtactaaactgtacaagccactccacttccctcttgaactggtcctcaatcgggatctgctgagctcaccatcatcagagggtagaagatacgagcttgttgcaaccatcactcatcacgggagcggcccgtccaggggccattacactgctgatgctagcgtggtcgcggccgaggtgcttcggttcgatgacggccatgtcatgcccatcaatgtgaacaaggtgttgcataacccagcgtatatcctgttctacgagcaagtttaagtctggtgttaccatgcggttgattgcccccttcctctcattgctggaacagtgagttatactgtctaactatggttgtgttaaatggtagctgccgtgtaaccgaagaattgagtgtgtcaagtacctgcccgggcggccgctcgaaatatatgcttggtaacgtagtgatgaggggggtgggctttcccgctcagcccatttttgaggtcctgtaaaatgcacctgctcatcttggtaaccatgaggttgctagctattcatcctgtgtgctggtgttatggcg

SEQ ID NO: 8564 - DNA, 1076 bp, Triticum aestivum
  Clone ID: PAT_TA_8564
cgctcgccctcccgtccgcgcccgtgggatccgcacgccgaaatcccccagatctctctccttccctcgcgcggcaatggcatcggtggacgctggcgaggggcaggcggcgccggcgcccagggccaccgtctcacacgtcatcttcgacatggacggcctcctcctcgacacggaggggttctacacggaggtgcaggagaagatcctcgcgaggtacggcaaggtgttcgactggtccctcaaggccaagatgatgggcaagaaggcccccgagtcggcgcgcatcttcgtcgacgagtgcggcctcgccggcctgctcaccccggagcagttcctcgaggagcgcgagggcatgctgcaggagctcttcccctcctgcgccgtcctgcccggggtagtacgattgattcatcatctccatgcaaacgaaatacctatctgtgtcgcgacaggatcccataaacgtcattttgcactgaagacacagaaccaccaggaaatgtttgccttgatgcatcatgttgtcatgggggatgacccagaggtgaaggctggcaagccatctcctgatattttccttgctgccatgagaagatttgagggtaatgtagaaccaagtaagtgcttggtctttgaagatgcgccatcaggtgtaggagcagctaagaatgctggcatgtatgcagtgatggtcccagatccgaggctggatgtttcgtatcagaaagatgctgaccaagtcctcagttccctgttagatttcaacccgaccgaatggggcttgccaccttttaaagagtagtggaaattgaggaggttcaagtgagtaacagaacattggcaggttgatttacatatgcaaaagctggaattgtgattagggttagtgggtaaccattgaacattcttgctgtgtctgatttggtgatagcaagctactgcatatacttcaataaagaccctcccatcaaatttgaagtgtgcataaactattttttttcttgaaactttgttttatgtttattgtatgattcttctagcagtgatataccttaggtatttgaagaccccct

SEQ ID NO: 8565 - DNA, 618 bp, Triticum aestivum
  Clone ID: PAT_TA_8565
agtcctcgtcctttttctgccataccatataactgtatatacaaattattatgttcctgtaagttacctgaccttgaattaactacacaccgcaacgctaataaacacattgggtggggtagacagccaaattaaccactacaaaccgagacatatacatgatgattatcacttttcacacatatcaatctcgaccctacccaagctaaaaaccctagctatgtttctattagctgtgtttcttaccacccctttcttcgtcgttcttcaccttattttctgcatgaagtactagggcaccgcgccatgcccccgtgcctgcccccgcgcccttatgcggtttggcaaccttcgccaatatatcatatttacacacactccacctacattattgtgtgtatgtatatgtatatatatacaagtatatataccatgcacgctatatagctaatacctagctagtgatcttactaacttggatcacttcactactcagtcccaagtcccaaccagacacacattgcattgcaataccagtagtagcattgtcacttttggtgcagagtggtttccaccggaagtctaaccgtagaacggggcgcggtgggggatgccctt

SEQ ID NO: 8566 - DNA, 1126 bp, Triticum aestivum
  Clone ID: PAT_TA_8566
ccacgcgtccgatatacttacgatgatgctcaacccctcgcttcccttcttgcatccgctgatgctccggaggccttctatatatctgtgaagcatggtgttgaaggtgttggggatatgctgacaaaagctatatctgcggcattatcacagtcagcagaatacgagcaattaaacgcgcttctggacaaggttatcaggaaacttgatggaactgtgagcacattttcaaggattgacaatgagtttgcttatatgatccaagtaacaacgtccgcccacgcgtccggcagcattaaagatggatctgaagatggtgacgttgcatctagggcgaggctttgctgggctactttgcactcacttcttcactcacaaatttcatcatacaggcaccatggatatatttggttagttgaattgctcctctcagaaataagtgaagaaacagatggctctgtttggtctaaaatccaaaacctccaggaggaaattaaagatgctggaagccacgacacctcgtgtccagaagtttcgctgcccgtttgtctgctgtgtgggcttctgaaatcaaaacacaactacatcagatggggatttctatatgttttagagaaatttctgatgcgctgcaaattattattggatgacagtgacatgcaggagcattcagttgcttatcatagcaaaaaccgtctggacaaagcttttgcggttatagatgttatgagtactgctttgctactcgtggttcaaaataatgagacagaccatatcaacatcttaaagatgtgtgacatgttgttttcacaattatgtttgaggcttccgtccacaaatgtgatgcaactgggcggccttcaatcccttggtcaactttttggttgcacaactaagaacatcgagtgcactttggaaacccttgcatcacacaaaaccataggaacgaagagcctttccaggaatgagacattgcaagatacagggatgaatcaatctactcaatccgctctgctctgcgaaacatcaatggcagcactacttctaaaaggtcttgcgatagctccgatgcagctcgtagcccttgtgccaacttcattattttatgggccattgatgcaacttg

SEQ ID NO: 8567 - DNA, 586 bp, Triticum aestivum
  Clone ID: PAT_TA_8567
ccagctgcgcaagctcccaccgcggatggttttggggaatgtgttgtcagcagctgtggcagatccccgagcagtcgcggtgccaagccatccacaatgttgttcatgctattatcctgcatcaacaacaacaacaacaacaacaacaacaacaacaacaacaacaacaacaaccgttgagccaggtctgcttccaacagtctcaacaacaatatccatcaggccagggctccttccagccatctcagcaaaacccacaggcccagggctctgtccagcctcaacaactgccccagtttgaggaaataaggaacctagcgctagagacgctacctgcaatgtgcaatgtctatatccctccatattgcacgaccaccattgcgccatctggcatcttcggtactaactgagaagagaagaacttgtactagatatatgaaacaccgtttccttagtccatggtttggtcgttgtagcggtggaaaagtaaagtgacatgcactatcatgtaagaacccgaactatactagttcaaacttgggaataaaagacaaacacatgtcttgtctgcaaaaaaaaggggggg

SEQ ID NO: 8568 - DNA, 606 bp, Triticum aestivum
  Clone ID: PAT_TA_8568
gagagagagagagagagagagagagagagagagagagagagagagagagagagagagagagagagagagagagagagagagagagagagagagagagcagcagagagagagcagccgactcgcggcacgttgcctttcccccccgcgccctaccctcgccgtccgcggatcaggcgatctcgcacgctgtgtcgcggactgttgaactctgggttggtctgtcatgtgagggatgtgttggagctgttgagcgggttcttggcaaaatggcaaggtgttgagtccttcgatgtagacatcgaggagcagagagtctctgtcgaaggggagtgtgactccggatgctgttctgcagactgtttcgaagacaggcaagaagacggcgttctgggaggctgaaccctcagcggcatctgctgtttcgtcctaaaaaggcacctctataatatgtaaactgtgaggtttgatgtagcaatggcccagttgaaatgctttgcaaggacatgattttctggtgggacggtggtatgtgcaccatgaatttactgcaaataatagcaaactggtaatttgtttgtgcaaaaaaaaaaaaaaaaaaggccccta

SEQ ID NO: 8569 - DNA, 852 bp, Triticum aestivum
  unsure (1)..(852): unsure at all n locations
  Clone ID: PAT_TA_8569
ccgcctggcgaagccgacacgccagctgccgtatcgaagacggtgtggaggggcccatgaagacgttctcccaggatcctgcagtgagagatatgtatgtatcagcgccacaagcagaggtcaagcatcaacaaaggtaaccggaagaacttgtttctggcatgcatccttggtaggatttggtcaggtgcaagataactgatatgtctggaacgagaatcaggagcgcgtagatagattaccagagaggaccacgggggaggggggatgtccatggctgtgaatccactgatgcactgggcagcagctccttcgccaaccttcaggatatactgcacaatccaagagaacaaaaattcagccacatggcggctaagctagtaggctagtttgatgtgcaagtgttagaaacatagaagaaaaccagctggttgggtaagcttgttaggtaatctggcggcatctcacaagggaacaaatagaagagggaaatcatggagaagaagtcgcacctcttctggtttcagcgcaaacttcttgccaccaatggtgaactcaatgtcaggcatggatccaaggctggcacagtccacggctgattctcccatgggactcgggagacggttgcacagctgcaaaatttatacagttataagcagagtgccaccacagaagtacagnaacaaacttcaccaaaggtcactgagcttacctggtaancgtaatccagtatgagatcctgggtcttgttctgtgcaagttggttctgatccacacaacagccatctcacaggcactgcactgggatcggtacggaggccattgatttcacagctatcatcaaccacgctc

SEQ ID NO: 8570 - DNA, 617 bp, Triticum aestivum
  Clone ID: PAT_TA_8570
gaattcggcacgagcacatacatactttgctgtgaaacaagacaagagaaacaatgtctcccatgctcaagcggatcgcccaggacgagcccaagaaggcggcgtacgtgaccttcctcgccggctccggcgactactggaagggcgaggcgggcctggccaagggcctccgcgccgacatgtccgcctacccgctagtggaggacgtgctccccgacgtccccgaggaccaccgccagaagctgctcgcccagggctgcctcgtccgcgagatcgtgcccgtctacccgccggagagccagacccagttcgccatggcatactacgtcatcaactactccaagctccgcatctgcgaggtacatcatcacctacttattcctagcttgatccgtcgtctcttcagtttcatccttggcttgacgctgacgacgatgaggtttgtggtgtatgtactatgcagttcgtggagtacgagaggatggtgtacctggacgcggacatccaggtgtacgacaacgtcgaccaccttttcgacctcgagaagggcagcttttacgccgtcaaggactgcttctgcgagaagacgtggagccacaccaagcagtacgagatcg

SEQ ID NO: 8571 - DNA, 713 bp, Triticum aestivum
  unsure (1)..(713): unsure at all n locations
  Clone ID: PAT_TA_8571
taattctagagctaatacgtgcaacaaaccccgacttctgggaggggcgcatttattagataaaaggctgacgcgggctctgctcgctgatccgatgattcatgataactcgacggatcgcacggccttcgtgccggcgacgcatcattcaaatttctgccctatcaactttcgatggtaggataggggcctaccatggtggtgacgggtgacggagaattagggttcgattccggagagggagcctgagaaacggctaccacatccaaggaaggcagcaggcgcgcaaattacccaatcctgacacggggaggtagtgacaataaataacaataccgggcgcattagtgtctggtaattggaatgagtacaatctaaatcccttaacgaggatccattggagggcaagtctggtgccagcagccgcggtaattccagctgctcaggctgacgacgacgatgatgttcctgagcttgtccctggagagacatttgaagaggccgctgaagacaaaaaggcagagtcgtgattttgatgcatgtttactgttgtgaagggttataagttaagcggcgccattagagaccacctcccctttcaagaattctgacctaccttatttgtgccagtggaccggttttgtaatgtacgcgagtttcgtctgatatgttggggaattttgcatcaaattacatgccncttggttgccctc

SEQ ID NO: 8572 - DNA, 377 bp, Triticum aestivum
  Clone ID: PAT_TA_8572
gagcacaagaataaaatccaagtaagtagtacctaacgcaaatccaccatgaagaccttactcatcgtaacaatccttgcgatggcaacaaccatcgccaccgccaatatgcaagtcgaccccggctaccaagtacattggccacaacaacaaccacgtccagcccccgacctattgatgctcaccgtgaattcagtaaagcttaactgaagctaccaatgccagaagaatatagatgaactctaaattattatgccatggatggaacatgtcattcagctggttttggttattcagtctcacaaaagatttggatgtaagtgaaatttgtaccaggaagacaaagataacattacctgtcgttttcaaaaaaaaaa

SEQ ID NO: 8573 - DNA, 453 bp, Triticum aestivum
  unsure (1)..(453): unsure at all n locations
  Clone ID: PAT_TA_8573
gtcgactcggcaatcctcgccgtcgtcgtcgccttcctcctccccctccgcctgctctccctcttcgcccgcctgaaatcctccggtagcgcaggcgatctccgccgatcctgcaccgccctcgccatcgcggccgcgctccttgccaccttcttcgccctaccccgctacgacggcggtcgcacggggcagtgcaccgcccccgttggtttcgtttgggaggagggtaccggccgagaggttcgggttggaaatcgagcaagctgaagctgcagctcaacccgattggaatcattatgggaaaacaattcaaaaagcaccaagatgacaaaggtgatggcttcaaaaggaaagatgcccgaagttttgtgaaaagccgatggggactnggacnatttcaagggctctgaattnaagggaacaaagganaacaatcnanggaatcatttattg

SEQ ID NO: 8574 - DNA, 736 bp, Triticum aestivum
  Clone ID: PAT_TA_8574
ccctaataaaccctcactaaagggaacaaaagctggagctccaccgcggtggcggccgctctagaactagtggatcccccgggctgcaggaattcggcacgagcacataactagagcacaagaatcaaatccaagtaagtagtacctaacgcaaatccaccatgaagaccttactcatcgtaacaatccttgcgatggcaacaaccatcgccaccgccaatatgcaagtcgaccccggctaccaagtacattggccacaacaacaaccatttccccagccccaacaaacattcccccaacaaccccaactaccatttccccaacaaccccaacaaccattcccccagcctcaacaaccccaacaacaatttccccagtcacagcaaccacaacaaccttttccccagccccaacaacaattcctgcagccccaacaaccgcaacaatcattcccccagcaacaacaaccgttgattcagctatctctacaacaacagatgaacccctgcaagaattttctcttgcagcaatgcaaccctgtgtcattggtgtcatccctcatatcaatgatcttgccacgaagtgattgccaggtgatgcagcaacaatgttgccaacaactggcacagattcctcagcagctccagtgtgcagccatccatagtgtcgtgcattccatcatcatgcagcaagaacaacgacaaggcgtgcagatccggcggccactggtttcagc

SEQ ID NO: 8575 - DNA, 822 bp, Triticum aestivum
  Clone ID: PAT_TA_8575
cgagacggcaccccgaaacgagtccattaaaggttctcatgtcatggagtatggcgacaagactttcaaggatgacatgctttttctctaccaaggtttcgatcctgcaaagtcaagcatcagaaacaggccgctgcctatgcccagcctcaagggtgcaatcaagcaaagagatgccgatattctcttcatgtggaagaagtatgagaagttgaatgggggatcagaagagaagcagagggctctcagggaggtcaaagaaaccgtgctgcacaggaagcatctcgacaccagtatcgatttcatcgggaagcttgtctttggattcgacaaggggccatcggtgctcgaggctgctagaggctctggccagccactggtcgacgattgggattgtctgaagacgatggtgcgagtgttcgagtcccagtgcggatcgctcactcagtacggcatgaagcacacgagggcgttcgcaaacatgtgcaacaatggcgcctccgaggccgagatgaaggaggcgagcatcagcgcttgcgacggctacgacatggggaagtggagcccgctggttcgaggctacagcgcctgatccgcttgcagtgcagcactactacatggcagcagcagccagaagctccggaggttcctagagctcgtacggtgtacatagacacatcggtatacatacaagaaagaagaaaccgcccagcaatggcgcccctggggtgttgggttaatcagtagtgtatatggtcgtgcctttgtaaatcgaatttgactgcaatcaattgaaaggcaatgattactattattataccc

SEQ ID NO: 8576 - DNA, 890 bp, Triticum aestivum
  Clone ID: PAT_TA_8576
gtgcataattcaagccaagcaagcagtggtcaatacaaatccaccatgaagacctttctcatccttgccatccttgctatcgtggcgaccaccgccacaactgcagttagagttccagtgccacaattgcaaccacaaaatccatctcagcaacaaccacaagagcaagtcccattggtgcaacaacaacaatttccagggcaacaacaacaatttccaccacaacagccatatccgcagccgcaaccgtttccatcacaacaaatccttcaacaaattttgcaacaacaactgattccatgcagggatgttgtcttgcaacaacacaacatagcgcatgcaagctcacaagttttgcaacaaagtacttaccagctattgcaacaattgtgttgtcaacaactgttgcagatccctgagcagtcgaggtgccaagccatccataatgttgctcatgctattattatgcatcaacaacaacaacaacaacaagaacaacaacaacagttgcaacaacaacaacagcagcaactgcaacaacaacgacaacaaccgtcgagccaggtctccttccaacagcctcagcagcaatatccatcaagccaggtctccttccagccatctcagctaaacccacaggctcagggctccgtccaacctcaacaactgccccagttcgcggaaataaggaacctagcgctacagacgctacctgcaatgtgcaatgtctacatccctccacattgctcgaccaccattgcgccatttggcatctttggtaccaactgagaagagaagaactctagtactagatatatgaaacaccgttttcttagtccatggtttggtcgttgtagcagtgaaaaaataaagtgacatgcactatcatg

SEQ ID NO: 8577 - DNA, 831 bp, Triticum aestivum
  Clone ID: PAT_TA_8577
atggttagagttccagtgccacaattgcagccacaaaatccatctcagcaacagccacaagagcaagttccgttggtacaacaacaacaatttctagggcagcaacaaccatttccaccacaacaaccatatccacagccgcaaccatttccatcacaacaaccatatctgcaactgcaaccatttccgcagccgcaactatcatattcgcagccacaaccatttcgaccacaacaaccatatccacaaccgcaaccacagtattcgcaaccacaacaaccaatttcacagcagcagcagcagcaacaacaacaacaacaacaacaacaacaacaacaacaacaacaacaacaagaacaacaaatccttcaacaaattttgcaacaacaactgattccatgcatggatgttgtattgcagcaacacaacatagcgcatggaagatcacaagttttgcaacaaagtacttaccagctgttgcaagaattgtgttgtcagcacctatggcagatccctgagcagtcgcagtgccaggccatccacaatgttgttcatgctattattctgcatcaacaacaaaaacaacaacaacaaccatcgagccaggtctccttccaacagcctctgcaacaatatccattaggccagggctccttccggccatctcagcaaaacccacaggcccagggctctgtccagcctcaacaactgccccagttcgaggaaataaggaacctagcgctacagacgctacctgcaatgtgcaatgtttacatccctccatattgcaccatggcgccatttggcatcttcggtactaactatcgatga

SEQ ID NO: 8578 - DNA, 635 bp, Triticum aestivum
  unsure (1)..(635): unsure at all n locations
  Clone ID: PAT_TA_8578
cttttccccactcccgggtctccagcattcctatcctctccccgcccgcccgtgccgccgccgccgccgccgccgcggcttcccttcctctcccgagccaagatgaatgttgaaaagctcaagaagatggcaggtgctgtgcgcaccggggggaaaagggttaaccgtgcgcaaggaagaagaaggcagtccacaaagactacaaccacagatgacaaacggcttcaaaagcaccttggaaaagaataggagttgaacagcattcctgggtattgaaagaggcaacatctttaaggatgatgtttgttatcaatttggtaaaccctaaagtgcaagcgtcaatgggtgctaatacatgggtggtcaagttggactcccaacaagacaaagaantgcaagntctgttcccgttcgattacaacaacttgggcctgacaacctggacatctgcggangtcncaaacattccaagaacaagctccgggngttctggggaaaaggtgggcaacntggggcgtcaagagatgagatgacttctaacttgcctgnaanaattgnggngcccgaaaaaaagnncccagatttgaaagcngggtgaacagcattnaggctttaacccnnnacttattgcngga

SEQ ID NO: 8579 - DNA, 491 bp, Triticum aestivum
  Clone ID: PAT_TA_8579
gagccctggtcctgtgggttttgctgagatggccggaaggagccctggcctaatggatattgttgcagaggctgttggaaggagacctggctcgatggttgttgttgttgtttttgttgttgatgcagaataatagcatgaacaacattttggatggcctggcactgcgactgctcagggatctgccataggtgctgacaacacaattcttgcaatagctggtaagtactttgttgcaaaacttgtgatcttccatgcgctatgttgtgttgctgcaatacaacatccatgcatgggaatcagttgttgttgcaaaatttgttgaaggattgttgttgttgttgttgttgttgctgctgctgtgaaatggtctaatccttaaatcaccgttgtttagtcgatggatatgtcgatgttacggtgacaaataaagtgtcacacaaacgtcatgtgtgacccgcaaactagtaattaaattccgggataaataa

SEQ ID NO: 8580 - DNA, 511 bp, Triticum aestivum
  unsure (1)..(511): unsure at all n locations
  Clone ID: PAT_TA_8580
atacaaatccatcatgaagacatttctcatcatttccctccttgctatcgtggcgaccaccgccacaactgcagttagagttccagtgccacaattgcagccacaacaaccaatttcgcagcaacaagcacaacaacaacaacaacaacaacaacaaatccttcaacaaatccttcaacaaattctgcaacaacaacaactgattccatgcagggatgtcatcgtcttgcaactacacaacatagcgcatgaaagctcacaagtattgcagcaaagtagttaccaagtgttgcaacaattatgttgtcagcagttgtggcagatccccgagctgtcgcggtgccaagccatccacaatgtcgttcaatgctattatcctggcatccaacaacaacaacaacaacaacaagaacaacatcaaccgttcgagcaagtctcctacaacagctcaagcaacatnccatcaggcaaggtccttccagcatctcaagcaaatccacaggccaaggtt

SEQ ID NO: 8581 - DNA, 1156 bp, Triticum aestivum
  Clone ID: PAT_TA_8581
agccaagcaagcagtggtcaatacaaatccatcatgaagacctttctcatccttgccctccttgctatcgtggcaaccaccgccacaactgcagtaagagttccagtgccacaattgcagccacaaaatccatctcagcaacagccacaagagcaagttccattggtacaacaacaacaatttccagggcagcaacaacaatttccaccacaacagccatatccgcagccgcaaccttttccatcacaacaaccatatctgcagctgcaaccatttccgcagccgcaaccatttccgccacaactaccatatccgcagccgcaatcatttccaccacaacaaccatatccacaacagcaaccacagtatctacaaccacaacaaccaatttcgcagcaacaagcacaacaacaacaacaacaacaacaacaacaacaacaacaacaacaaattcttcaacaaattttgcaacaacaactgattccatgcagggatgttgtcttgcaacaacacaacatagcgcatgcaagctcacaagttttgcaacaaagtacttaccagctattgcaacaattgtgttgtcaacaactgttgcagatccctgagcagtcgcagtgccaagccatccataatgttgctcatgctattattatgcatcaacaacaacaacaacaacaagaacaaaaacaacagttgcaacaacaacaacaacaacaacagcaactgcaacaacaacaacaacaacaacaacaacaaccgtcgagccaggtctccttccaacagcctcagcagcaatatccatcaagccaggtctccttccagccatctcagctaaacccacaggctcagggctctgtccaacctcaacaactgccccagttcgcggaaataaggaacctagcgctacagacgctacctgcaatgtgcaatgtctacatccctccacattgctcgaccaccattgcgccatttggcatctctggtaccaactgagaagagaagaactctagtactagatatatgaaacaccgttttcctagtccatggtttggtcgttgtagcgatgaaaaaataaagtgacatgcactatcatgtaagaacccgaactatactagttcaaactcgggaataaaagacaaacacatgtcttgtctac

SEQ ID NO: 8582 - DNA, 641 bp, Triticum aestivum
  Clone ID: PAT_TA_8582
ccccccccccccccccccagccaagatgaatgttgaaaagctcaagaagatggcaggtgccgtgcgcaccggagggaagggtagcatgcgcaggaagaagaaggctgtacacaagaccacaactacagatgacaaaaggctccagagtacgctgaaaagagtaggagtgaacaccatccctggtatcgaagaggtcaacatctttaaggatgatgtggttattcagtttctcaatcctaaagtgcaagcttcgattggtgctaatacatgggtggtcagtggaactccacagacaaagaaactgcaagatctgctgccatcaattatcaatcaacttggtcctgacaacttggacaacctgcggaggcttgcagagcaattccaaaagcaggtccccggtggtgctgctggcatcgaggctggtgccagtgcaggtgctgctcaggctgacgacgatgatgatgttcctgagcttgtccctggagagacatttgaagagaccacctcccctttcaagaattctgacctaccttatttgtgccagtggaccggttttgtcatgtacgcgagtttcgtctgatatgttggtggaattttgcatcaaaatacatgcctctttggttgccctcattctcaaatcg

SEQ ID NO: 8583 - DNA, 884 bp, Triticum aestivum
  Clone ID: PAT_TA_8583
tcatttccaccacaacaaccatatccacagccgcaaccatttccatcacaacaaccatatctgcagctgcaaccatttccgcagccgcaactaccatatttgcagccacaaccatttcgaccacaacaaccatatccacaaccgcaaccacaatattcgcaaccacaacaaccaatgtgtttcccaaccccaacagcagtcgcagcagcaactcgggcaacaacctcaacaacaacaattggcacagggtacctttttgcagccacaccagatagctcagcttgaggtgatgacttccattgcgctccgtatcctgccaacgatgtgcagtgttaatgtgccgttgtacagaaccaccactagtgtgccattcgacgttggaccggagttggtgcctactgataaggaaagatctctagtaatatataattgggtcaccgttgtttagtcgatggatatgtcgatgcagcggtgacaaataaagtgtcacacaatgtcgtgtgtgacccgcccatactagttgtttaaattctggaataaaataaaataaagttgtatcaagacaatgttaaaaaaaataaaaaaaaaaaaaaaaaaaaaaaaaaaaaaaaaaaaaaaaaaaaaaaaaaaaaaaaaaaaaaaaaacgatataaaaaaaaaaaagttaacgttccaaaacatgcaaaggcaaagccctaatatatggaaacctaaatttaattaaaaggccgtggttttaaaaatacaggactgggaaaacaaaaacgttacccaaataaaaccccttggagaacatacccttttcgccatgtggagcttacccaaagaggcacagaccgtatcgcccttccaaacagtaacagtatcctgattcccaaatggga

SEQ ID NO: 8584 - DNA, 500 bp, Triticum aestivum
  Clone ID: PAT_TA_8584
tggagctagtaggggccggatccgtgtgcagcagaggctggggaggccgattcggaggcaggcggcgaggcaggggtcgccggtgacgatgaggaaggccgaagcgtggtttccctggcagatccatggcatccgcggttcctgggcagaaagaagagtggagatgagggagagaaggaggaaggaaggaggggaggtgtggtgtgctaggcaggagctcgccggagccgagcgacggaggacgtgcgctgcagacggagggattcagagccggccggtggggcgacagtacaccaaccaggccaggggtggcgtacgaatgaggacttcatcaccatcagcagcaaatgcggaagaaagtagctggggagcatactgccctgggatgtaaacaccacctcctcctgaatatatgacctgcttgggtgacgcatacagtgtttcttggatggaagacagtgaaactcacaatctacagaaggaacccatcaagcagcagt

SEQ ID NO: 8585 - DNA, 664 bp, Triticum aestivum
  Clone ID: PAT_TA_8585
caacaacaacaacaacaacaacaacgacaacaaatccttaacaaattctgcaacaacaactgattccctgcagggatgtcgtcttgcaacaactcaacatagcacatgcaagctcacaagtattgcaacaaagttaccagcagttgcaacaattatgttgtcagcaactgcagcagaccccgagcagtcgcggtgccaagccatccacaatgttgttcatgctattattctgcatcatcatcaacaacaacaacaacaacaacaaccgttgacccaggtctccttccaacagcctcaacaacaatatccatcaggccagggctccttccagccatctcagcaaaacccacaggcccagggctctgtccagcctcaacaactgccccagtttgaggaaataaggaacctagcgctagagacgctacctgcaatgtgcaatgtctatatccctccatattgcaccattgctcaagttggcatcttcggtactaactgagaagagaagaactctagtagtagatatatgatacaccgttttcttagtccatgggtttggtcgttgtagcggtgaaaaaataaagtgacatgcactatcatgcaagaacccgaactatactagttcaaacatgggaataaaagacaaacacatgtctttgactacccc

SEQ ID NO: 8586 - DNA, 774 bp, Triticum aestivum
  Clone ID: PAT_TA_8586
tgcagctgcaaccatttccgcagccgcaactaccatatttgcagccacaaccatttcgaccacaacaaccatatccacaaccgcaaccacaatattcgcaaccacaacaaccaatttcacagcagcagcagcagcagcaacaacaacaacaacaacaacaacaacaacagctggtgcaacaacaaatccctgttgttcagccatccattttgcagcagctaaacccatgcaagctattcctccagcagcagtgcagccctgtggcaatgccacaacgtcttgctaggtcgcaaatgttgcagcagagcagttgccatgtgatgcaacaacaatgttgccagcagttgccgcaaatcccccagcaatcccgctatgaggcaatccgtgctatcatctactccatcatcctgcaagaacaacaacaggttcagggttccatccaatctcagcagcagcaaccccaacagttgggccaatgtgtttcccaaccccaacagcagtcgcagcagcaactcgggcaacaacctcaacaacaacaattggcacagggtacctttttgcagccacaccagatagctcagcttgaggtgatgacttccattgcgctccgtatcctgccaacgatgtgcagtgttaatgtgccgttgtacagaaccaccactagtgtgccattcgacgttggcaccggagttgggtgcctactggataaggaaagttctctaagtaatatatattgggtcaccgttgtttagtcgatggatatgtcgatgcagc

SEQ ID NO: 8587 - DNA, 452 bp, Triticum aestivum
  Clone ID: PAT_TA_8587
gcagaaaactctccggatactacatgagcttctttgtcaacatcaacattagagtgtggagtagccacagacttgcagggtttgagcttcaggtctttgtctgaatcaagaccagatggcttcttgggctttgcatcaacaggttctacaccttcatcattagcagatttcaactgatcagcatcttttgtgtcttcaggctgttcaggcttctcttttggtgatgctggtccttttggtgacgctgatccctttggagacgctggtccttttggagacgctggtccttttggagacactggtccttgattagcctcaccattatcaaccagagttgcaccactactaatagcagtagttggagtaccatcttgctccagttttgaagattcctgaggcagttcatcagaaatagtctttccgaaagtttgcctcatccaccgtgtcttccc

SEQ ID NO: 8588 - DNA, 834 bp, Triticum aestivum
  unsure (1)..(834): unsure at all n locations
  Clone ID: PAT_TA_8588
ccaacagcaaccgatccaacaacaaccacaaccatttccacaacagccaccatgttcacagcaacaacaaccaccatnatcgcagcaacaacaaccaccattttcacagcaacaaccaccattctcgcagcaagaactaccaattctaccgcaacaaccaccattttcgcagcaacaacaaccacaattttcgcagcaacaacaaccattcccgcagcaacaacaaccacttctactgcaacaacccccattttcacaacaacgaccaccattttctcagcagcagcaacaaccagttctaccgcaacaaccacctttttcgcaacaccaacaaccggttcttccgcaacaacaaataccatatgttcagccatctatcttgcagcagctaaacccatgcaaggtattcctccagcagcaatgcagccctgtggcaatgccacaaagtcttgctaggtcgcaaatgttgtggcagagcagttgccatgtgatgcagcaacaatgttgccagcagctgccgcgaatccccgaacagtcacgctatgatgcaatccgtgccatcatctactcgatcgtcctacaagaacaacaacatggtcagggtttcaaccaacctcagcagcaacaaccccaacagtcggtccaaggtgtctcccaaccccaacaacaacagaagcagctcggacagtgttctttncaacgacctcaacaacaacaactgggtcaatggcctcacaacaacaggtaccacagggtaccttgttgcagccacaccaaatagctcaacttgagttgatgacttccattgcactccgtaccctgcaatgatgtgca

SEQ ID NO: 8589 - DNA, 1109 bp, Triticum aestivum
  Clone ID: PAT_TA_8589
caagcaagcactggtcaatacaaatccatcatgaagacatttctcatcctttccctcattgctatcgtggcgaccaccgccacaactgcagttagagttccagtgccacaattgcagctgcaaaatccatctatgcaacaaccacaagagcaagttccattggtgcaacaacaacaatttctagggcagcaacaaacatttccaccacaacaaccatatccacagccgcaaccatttccagcacaacaaccatatccgcagccgcaaccatttccacagccgcaaccttttccgccacaactaccctatccgcagccgcaaccatttcccccacaacaaccatatccacaaccgcaaacacaacatctgcaaccacaacaaccaatttcgcagcaacaagcacaacaagcacaacaacaacaacaacaacaacaacaacaacaacaacaacaacaacaacaacaacaacaacaactacaacaacaaatccttcaacaaattctgcaacaacaactgattccatgcagggatgtcatcgtcttgcaacaacacaacatagtgcgtgaaatctcacaagtattgcagcaaagtagttaccaagtgttgcaacaattatgttgtcagcagctgtggcagatccccgagcagtcgcggtgtcaagccatccacaatgttgttcatgctattattctgcatcatcatcatcaacaacaaccaacagaagaagaacaacaacaccgtcgagccaggtctcctaccagcagcctcaacaacaatatccatcaggctagggctccttccagccatctcagcaaaatccataggcccaaggctttgtccaacctcaacatctgccccacctcgaggaaataaggaacctagcgctgcagacgctaccagcaatgtgcaatgtctacatccctccatattgctcgaccaccattgtgccatttggcatcttcggtactaactgagaagagaagaactctagtactagattatgaaacaccgtgttcttagtccatggtttggtcgttgtaccattgaaaatataaggtgacatgcactatcatgtaagaacccgaaagaataataataaaaaaaaaaaa

SEQ ID NO: 8590 - DNA, 790 bp, Triticum aestivum
  Clone ID: PAT_TA_8590
gctgcgaaagaaccaggtgagaaggcattgcattgcattttgcaggcgcggtagattatttacattgcacatggagaacgcgatcacaacaacttcgtcgcgataataagtgtgttcgtcgtccacaagcgtactacacctactatctctctcggatgtttgttttttcatctacttgccttgcagcaaatggatcacgggaaccccgatgaacctctcccctgtgccgccttgctgctctgccctgagaacttgattgccgccgccaggttgccggcttgcggctgaagctcagctagctctttcactcgtagcaaaatggccggtggtattggaatgatcgaagggttgcttttccgcggacaaacaccatcattttccggcgaaagctgtgtctggctggctcttagcagattgcgccacttatccttgagatccactgaggtgcggtaagaatatgaggcaaaggatagtcttctaatctcagaccatttgccaggcccgaactgagccacgccatcgaccagcttcagaacctcggacaatgtccatgctcgatgatgcttccgcttcaaaccccgctttgttttcgtcttggcatcagttctgcaaatatcctctggctctatggaatgaatctccttgttatcagctgtttctatatgccctcctttcttctcagctgtttctatatgccctcctttcttctcagcatttttcgatagtggaacttccacggcactgcttgcatgattcacatgttcaccatcttttcccaacatcgtctcaa

SEQ ID NO: 8591 - DNA, 762 bp, Triticum aestivum
  Clone ID: PAT_TA_8591
caactattgtattactccagaccacactccattcaggttccagactctgatcttggctacacttcggttctcttttggacagtaatgaaggggttgatgttattcttaatgtgagtggagagaggtttcatgcccaaaagtttggatctaaatacagtagaccgtgcagccaacaacaactcgggcaagaggctcaacaacaacaattggcacaaggtacctttttgcagccacaccagatagctcagcttgaggtgatgacttccattgcgctccgtaccctgccaacgatgtgccgtgtcaatgtgccgttgtatagaaccaccactagtgtgccattcggtgttggcaccggagttggttcctactaataaggaaaggtctctagtaatatatagttggatcaccgttgtttagtcgatggatatgtcgatgcagcggtgacaaataaagtgtcacacaatgtcgtgtgtgacccgcccatactagttgtttaaattctgaaataaaataaaaataaagttgtatcaagacaatgttcatattggcattgtgtggatgtcgatctgattgccatgcttgcaagttcataagtttgtctttcctagtcacaagcgcaacctggtgccttaattaagtatccatgtgttggaataatcactatttgaatataatggtgttactaaaaaaatttttaaaaaaaaaaaaaaaaaaaaaaaaaaaaaaaaaaaaaaaaaaaaaaaaaaaaaaaaaaaaaaaaaa

SEQ ID NO: 8592 - DNA, 999 bp, Triticum aestivum
  unsure (1)..(999): unsure at all n locations
  Clone ID: PAT_TA_8592
ttaaccctactaaagggaacaaaagctggagctccaccgcggtggcggccgctctagaactagtggatcccccgggctgcaggaattcggcacgagactagttaacaccaatccaccatgaagaccttcctcgtctttgccctcctcaccgttgcggcgacaagtgcaattgcgcagatggagactagatgcatccctggtttggagagaccatggcagcagcaaccattaccaccacaacagacattctccacaacaaccactattttcacaacaacaacaacaacaactatttcctacaacaaccatcattttcgcagcaacaaccaccattttggcagcaacaaccaccattttctcagcaacaaccaattctaccacagcaaccaccattttcgcagcaacaacaactagttctaccgcaacaaccaccattttcacagcaacaacaaccaggtttacctgcacaacattcaccttgtccacaacaacaacaacaccaacagctggtgcaacaacaaatccctggtgttcagccatccattgtgcagcagctaaacccatcaaggtattcctccagcagcaagtgcaaccctgtggcaatgccacaacgtcttgctaggtcgcaaatggtgcagcagagcagttgccatgtgatgcaacaacaatgttgccagcagttgccgcaaatcccccagcaatcccgctatgaggcaatccgtgctatcatctactccatcatcctgcaagaacaacaacaggttcagggttccatccaaactcctcagcagcaaccccaacagttgggccaatgtgtttcccaaccccaacagcagtcacaacaacaactcgggcaacaacctcaacaacaacaattggcacaaggtacctttttgcagccacaccagatagctcagcttgaggtgatgacttccattgcgctccgtaccctgccaacgatgtgccgtgtcaatgtgccgttgtatagaaccancacta

SEQ ID NO: 8593 - DNA, 219 bp, Triticum aestivum
  Clone ID: PAT_TA_8593
gattaaatatagcctatataaatagaacatgaataagctggctacaacaacatccgacacaaactaaatgttcccttgaggctctgcagcatcacatcatgcatcccacaacacaaagtcacgactaaacattacagctactgcagatgtttcctgccacagccccctaactacaacagacacagacaatgacgacggacctcggccgcgaccacgcta

SEQ ID NO: 8594 - DNA, 682 bp, Triticum aestivum
  Clone ID: PAT_TA_8594
accaatccaccatgaagaccttcctcgtctttgccctcctcgccgttgcggcgacaagtgcaattgcgcagatggagactagatgcatccctggtttggagagaccatggcagcagcaaccattaccaccacaacagacatttccacaacaaccactattttcacaacaacaacaacaacaactatttcctcaacaaccatcattttcgcagcaacaaccaccattttggcagcaacaacaaccaccattttctcagcaacaaccaattctaccacagcaaccaccattttcgcagcaacaacaactagttctaccgcaacaaccaccaatttcacagcagcaacaaccaccattttcgcagcaacaacaaccaccattttcacagcaacaacaaataccagttattcatccatctgttttgcagcagctaaacccatgcaaggtattcctccagcagcagtgcatccctgtggcaatgcagcgatgtcttgctaggtcacaaatgttgcagcagagcatttgccatgtgatgcagcaacaatgttgccagcagttgcggcaaatccccgagcaatcccgccatgagtcaatccgtgctatcatctactctatcatcctgcagcagcagcagcagcaacaacaacaacaacaacagggtcagagtatcatccaatatcagca

SEQ ID NO: 8595 - DNA, 766 bp, Triticum aestivum
  Clone ID: PAT_TA_8595
acgcagccatggcggttccccttctctgtaggctaacagagcaggccactccatccaagcgggcacgagccggctgcggtggctctgcggtggctctactgaagtgacggcgccaagttggatcgcgatttcggcggcggagcggcgctcggccgcggcgaggtgctccatgagctcgataagtttcttatctctcttcttccatcctcgtatccttgattgatcctcgcctccctgattgatttgggcccattgatctgggttgttttttcattgactaggtatgaatatgattgacatacttttcaagtttggtcactggctccctgcacgcgcccatgagctcaagccccgccccttacctccctctaacttggccgcctccatgccgtggtggtaattgaatcaagcaattcagtatgaactaatagagggcagggggttctacagatggagcagcatcaaggactgtgccgtgaggaagcacgtggagtggagtcatggcagcgccgtgattctcatttaaccaatgagaacaaacacaaccacaaccacgtccagcccccgacctattgatgctcaccgtgaattcagtaaagcttaactgaagctaccaatgccagaagaatatagatgaactctaaattattatgccatggatggaacatgtcattcagctggttttggttattcagtctcacaaaagatttggatgtaagtgaaatttgtaccaggaagacaaagataacattacctgtcgttttca

SEQ ID NO: 8596 - DNA, 471 bp, Triticum aestivum
  Clone ID: PAT_TA_8596
aacactagttaacaccaatccacaatgaagaccttcctcgtctttgccctcctcgctcttgcggcggcaagtgccgttgcgcaaatttcacagcaacaacaagcaccgccattttcgcagcaacaacaaccaccattttcacagcaacaacaaccaccattttcgcagcaacaacaatcaccattttcgcaacaacaacaacaaccaccatttgcgcagcaacagcaaccaccgttttcacaacagccaccaatttcacagcagcaacaaccaccatttttgcagcaacaacgaccaccattttcacggcaacaacaaataccaagttattcatccatctgttttgcaacagctaaacccatgcaaggtattcctccaacagcaagtgcatccctgtggcaatgcagcgatgtcttgctaggtcacaaatgttgcagcaagagcatttgccatgtgatgccacaaacaatt

SEQ ID NO: 8597 - DNA, 800 bp, Triticum aestivum
  unsure (1)..(800): unsure at all n locations
  Clone ID: PAT_TA_8597
aaagacaatgtaccttgaagatagaactgtgagactccaactctgggatactgctggtcaggaaagattcaggagtttaattccaagctatattagagactcttcagttgctgtcattgtattcgatgttgcaagcaggcagtccttcttaaatacatctaagtggatagaggaagttcgcactgagaggggcagtgatgttatcattgtgcttgttgggaacaaaactgaccttgttgacaagaggcaagtctcatagnaggggaaggggagggcaaggcgaaggaccttggagtcatgtttattgaaaccagtgctaaggctgggtttaacattaaggcgctgttccgtaaaattgctgctgcacttcctggaatggagacgctctcatcagcgaaacaggaagacatggttgatgtgaacttgaggtccggcaatgcaaactcgtcccagtctcaagctcaagctgggggatgcagttgttaattgcatctctgacacttgcttgctcatgatctttgggactctgagcatcagaaggcgttatcactgatgcttctctcgggaagaagagttgattgcctctcgccagtgaacacaccatagtctttacccggtgaatggaccgtttgcattggaacgatacgtttatgagttttctgttanttcctcagtggctaagctagcaacagtgtanagttgggttgacacttcaaacttctacaatcgagttgggtattagaactagttatattggtcagttgaacttatatatattccaaccttttgnattagnttgg

SEQ ID NO: 8598 - DNA, 1258 bp, Triticum aestivum
  Clone ID: PAT_TA_8598
cctggtctctctcccgctcctatcctctcctccccccctcgcgccgccgccggcgccgacgccgcggcttccgctcctcccccagccaagatgaatgttgaaaagctcaagaagatggcaggtgccgtgcgcaccggggggaagggtagcatgcgcaggaagaagaaggctgtacacaaggaccacgactacagatgacaaaaggctccagagtaccctgaaaagagtaggagtcaacaccatccctggtatcgaagaggtcaacatctttaaggatgatgtggttattcagtttctgaatcctaaaggtggtaccccttgacaataaactcagttctacaggattagttttccacttccttacatctgtttcttggtttccttgcagtgcaagcttcgattggtgctaatacatgggtggtcagtggaactccacagacaaagaaactgcaagatctgctgccatcaattatcaatcaacttggtcctgacaacttggacaacctgcggaggctcgcagagcaattccaaaagcaggtccctggtggtgctgctggcatcgaggctggtaccagtgcaggagctgctcaggctgacgacgacgatgatgttcctgagcttgtccctggagagacatttgaagaggccgctgaagacaaaaaggcagagtcgtgattttgatgcatgtttactgttgtgaagggttataagttaagcggcgccattagagaccacctcccctttcaagatttgttggcattgccacaaagtcttgctaggtcgcaaatgttgtggcagagcagttgccatgtgatgcagcaacaatgttgccagcagctgccgcgaatccccgaacaatcacgctatgatgcaatccgtgccatcatctactcgatcgtcctacaagaacaacaacatggtcagggtttcaaccaacctcagcagcaacaaccccaacagtcggtccaaggtgtctcccaaccccaacaacaacagaagcagctcggacagtgttctttccaacgacctcaacaacaacaactgggtcaatggcctcaacaacaacaggtaccacagggtaccttgttgcagccacaccaaatagctcaacttgagttgatgacttccattgcactccgtaccctgccaatgatgtgcagtgtcaacgtgccggtgtacggcaccaccactagtgtgccattcggcgttggcacccaagttggtgcctactgataagaaaatatctctagtaatatat

SEQ ID NO: 8599 - DNA, 622 bp, Triticum aestivum
  Clone ID: PAT_TA_8599
acgaattctggcggcagatccagaaagatgaactctgatatttacaatgtgtggtcattggccaacgatacggagaaaacggttgaagctctacattcagatgtccaaaaggctcaaattataatggatgaatcaaggaagatgaactctaatgctcaccagatatggtcattggcaaaggatacagcaaaaaaggtcgaatctctgtatacagatgttgcaaaggttcaaagtgtaattgatatatcaaaaaagatggaatctaatatacacaaagcatggtcttatgcaaagcagacagagaagagggttgaagatatatattcagatgtcaaaaagggcttcaagaagaaggcctggatgagctgattgcgccgtcgacttgacgggctagcattggcctgggcatggagtaatgtagtagagaagccacccggccttgcgtctgcgaacctgtaatgccccttgatattgtatgacacgtttacggttgcgtcgtgcgtgttgtggacatgatcgtactgtgtttcggatctgactcactcgcttcctgtttctgtgccgtcatggtaatgtatatattgatgatgtgcagcggtaatgcaataatatgcgactttca

SEQ ID NO: 8600 - DNA, 614 bp, Triticum aestivum
  unsure (1)..(614): unsure at all n locations
  Clone ID: PAT_TA_8600
gcaacaacaacnaccattttcacaacaacaacnaccattttcgcagcaacaacaacaaccattatcgcagcaaccagttattatactgcaacaaccaccattttcgcagcaacaacaaccagttctaccacaacaaccaccattttcacaacaacaacaacaacaacaacaacaacaaccaccattttcgcagcaacaacaaccagttctaccacaacaaccaccattttcacaacaacaacaaccaccattttcgcagcagcaacaaccatcttcacaacaaccaccttttccacaacaacaccaacagtttccacaacaacaaatccctgttgttcaaccatccgttttgcagcagctaaacccatgcaaggtgttcctccaacagcagtgtagccatgtggcaatgtcgcaacgtcttgctaggtcacaaatgtggcaacagagtagttgccatgtgatgcaacaacaatgttgccaacagctgccgcaaatccccgaacaatcccgctctgaggcaatccgtgccatcgtctactccatcatcctgcaagaacaacaacagggttttgtccaacctcagcagcaacaaccccaacagtcgggccaaggtg

SEQ ID NO: 8601 - DNA, 972 bp, Triticum aestivum
  Clone ID: PAT_TA_8601
gcatttttgcaacaccaacaactagttctaccgcaacaacaattaccatatgttcatccatctatcttgcagcagctaaacccatgcaaggtattcctccagcagcattgcagccctgtggcaatgccacaaagtcttgctaggtcgcaaatgttgtggcagagcagttgccatgtgatgcagcaacaatgttgccagcagctgccgcgaatccccgaacaatcacgctatgatgcaatccgtgccatcatctactcgatcgtcctacaagaacaacaacctggtcagggtttcaaccaaccttagcagcaacaaccccaacagtcggtccaaggtgtctcccaaccccaacaacaacagaagcaactcggacaatgttctttccaacaaccacaacaacaacaactcggtcaatggcctcaacaacaacaggtaccacagggtaccttattgcagccacaccaaatagctcaacttgaggtgatgacttccattgcattccataccctgccaacgttgtgcagtaccaatgtgcccggtgtacggcaccaccactagtgtgccattcggcgttggcacccaaattggtgcctactgataacaaaatatctctagtaatatatagtaggatcgccgttgcttagtcgatggacatgtcgaggaagcggtgaaaaataaagtgtcacacaatgtcatgtgtgacacacccaaactagtagttaaattctggaataaaatacaaataaagttgtatcaaaaaaaaaaaaaaaaaaaaaaaaaaaaaaaaaaaaaaaaaaaaaaaaaaaaaaaaaaaaaaaaaaaaaaaaaaaaagaaaaagaaaaaaaaaaaagtaatatataaagaatacctataattaattgattaatcaaatttcattgcaacgaatttgaatgagaaaagcccttaaattacccaacttaggggagctaccaaatcatcttctggttaga

SEQ ID NO: 8602 - DNA, 858 bp, Triticum aestivum
  Clone ID: PAT_TA_8602
acaacactagttaacgagcaatccacaatgaagaccttactcgtctttgccctcctcgctcttgcggcggcaagtgccgttgcgcaaattttacagcaacaacaacaaccaccatttttacagcaacaacaaccaccattttcacagcaacaacaaataccagttattcatccatctcggggtgcagcagctaaacccatgcaaggtattactacatcagcagtgcatacctgtggcaatgcagcgatgtcttgctaggtcacaaatgttgcagcagagcatttgccatgtgatgcagcaacaatgttgccagcagtagcagcaaatccccgagcaatcccgccatgagtcaatccgcgctatcatctactctatcatcctgcagcagcagcagcagcaacaacaacaacaacaacagggtcagagtatcatccaatatcagcaacaacaaccccaacagttgggccaatgtgtctcccaaccccaacagcagttgcagcagcaactcgggcaacaacctcaacaacaacagttggcacatggtacctttttgcagccacaccagatagctcagcttgaggtgatgacttccattgccctccggaccccgccaaaaatgtgcagggtcaatgtgcccttgtacgaaaccccccccagtgggcccttaggggttggcatcggagttggtgtttactgataagaaaagatctttagtaaaatttagttggatcccccctgtttagtcgaaggataagtcgatgtaccggtgcccaataaagtgtccccccacgtcatgtgtgaccccccccaactagttgttttaattttgaaataaaaaacaaataaaggggtatttag

SEQ ID NO: 8603 - DNA, 832 bp, Triticum aestivum
  Clone ID: PAT_TA_8603
atcattatcgcaccaccaacaacaacaacccgtccaacaacaaccacaaccatttccacaacagcaaccatgttcacagcaacaacaaccaccattatcgcagcaacaacaaccaccattttcacaacaacaaccaccattttcgcagcaacaacaaccatcattttcgcagcaacaacaaccaccgttttcacaacaccaacaaccagttctaccgcaacaacaaataccatctgttcagccatctatcttgcagcagctaaacccatgcaaggtattcctccagcagcaatgcagccctgtggcaatgccacaaagtcttgctaggtcgcaaacgttgtggcagagtagttgccatgtgatgcagcaacaatgttgccggcagctgccgcaaatccccgaacaatcacgctatgatgcaatccgtgccatcatctactcgatcgtcctacaagaacaacaacatggtcagggtttgaaccaacctcagcagcaacaaccccaacagtcggtccaaggtgtctcccaaccccaacaacaacagaagcagctcggacagtgttctttccaacaacctcaacaacaacaactgggtcaatggcctcaacaacaacaggtaccccagggtaccttgttgcagccacaccaaatagctcaacttgaggtgatgacttccattgcacttcgtaccctgccaacgatgtgcagtgtcaacgtgccggtgtacggcaccaccactattgtgccattcggcgttggcacccgagttgggtgcctactggataagaaaatatctctaagtaatatatagtggattcgcaaaaaaaaaaaa

SEQ ID NO: 8604 - DNA, 748 bp, Triticum aestivum
  Clone ID: PAT_TA_8604
tcggcacgagggccaaaaccccactctcgacgagcctcaagagatcaagcccgaacacaaaagctcaagcccgaacccaagaaagcttcctccccgagactagatcaagatggctcccgagctggccggcaagatggccgccaaggctgccgtggcggcggcgaagcccgcgacgaaggcgtacgtgacgttcttggcgggggcaggggactactggatgggcgtggttgggcttgccaagggcctgcgcaaggttggctcggcctacccactggtggtagccgtgctgcccgacgtgcccgagctccaccgcaagatcctcgtctcccagggctgcatcgtccgcgagatcgcccccgtgtacccgcccgagaaccacacccagtttgccatggcctactacgtcatcaactactccaagctccgcatctgggagtttgtggagtacgagaggatggtgtacctcgacgccgacatccaggtgttcgaaaacatcgacgagctgttcgatctgcccaaggggcacttctacgccgtgatggactgcttctgcgagaagacgtggagccacaccccgcagtaccagatcggctactgccagcagtgtcccgacaaggtgacgtggccggccgccgagatgggcccgccgccggcgctctacttcaacgccggcatgttcgtgcacgagcccagcatggccaccgccaaggcgctccttgacaccctccgcgtgacgccgacgacccca

SEQ ID NO: 8605 - DNA, 607 bp, Triticum aestivum
  Clone ID: PAT_TA_8605
tttcatgtccacaacacacaacgaacccatctcatccactctttcaagcaagacaagagagatcgagcgagcaatggctcccatgctcaaggggatcgtggaggacgcgccgaagagggcggcgtacgtgaccttcctcgccggctccggcgactactggaagggcgtggtgggcctggccaagggcctccgcgccgtcaactccgcctacccgctcgtggtggccgtgctccccgacgtccccgaggatcaccgccgcaagctggtcgaacagggctgcctcgtccgcgagatcgtgcccgtgtacccgccggagagccagacccagttcgccatggcctactacgtcatcaactactccaagctccgcatctgggagttcgtggagtacgagaggatggtgtacctggacgcagacatccaggtgttcgacaacatcgaccacctcttcgacctcgacaagggcagcttctacgccgtcatggactgcttctgcgagaagacgtggagccacacgccgcagtacaagatcggctactgccagcagtgcccggaccgggtggcttggccggagcgcgagctcggcgtgcccccgccgccgctctac

SEQ ID NO: 8606 - DNA, 839 bp, Triticum aestivum
  Clone ID: PAT_TA_8606
gcaatactaagttaacaccaatccaccatgaagaccttcctcatctttgctctccttgccattgcggcgacaagtgccattgcacaaatggagactagccgcgtccctggtttggagaaaccatggcagcaacaaccattaccaccacaacaacaaccaccatgttcacagcaacaacaaccatttccacagcaacaacaaccaattattatactgcaacaatcaccattttcgcagcaacaacaaccagttctgccgcaacagcaaccagttattatactgcaacaaccaccattttcgcagcaacaacaaccagttctaccacaacaaccaccattttcacaacaacaacaaccaccattttcgcagcagcaacaaccatcttcacaacaaccaccttttccacaacaacaccaacagtttccacaacaacaaatccctgttgttcaaccatccgttttgcagcagctaaacccatgcaaggtgttcctccaacagcagtgtagccatgtggcaatgtcgcaacgtcttgctaggtggacaaatgtggcaacagagtagttgccatgtgatgcaacaacaatgttgccaacagctgccgcaaatccccgaacaatcccgctctgaggcaatccgtgccatcgtctactccatcatcctgcaagaacaacaacagggttttgtccaacctcagcagcaacaaccccaacagtcgggccaaggtgtctcccaacaccaacagcagtcgcagcagcagcagcaactcggacagtgttctttccaacaacctcaacaactacaacaattgggtcagcagcctcaacaacaacagataccac

SEQ ID NO: 8607 - DNA, 959 bp, Triticum aestivum
  Clone ID: PAT_TA_8607
attcggcacgagggaaagatcaggagtttaattccaagctacatcagagactcttcagttgctgttattgtatttgatgttgcaagcaggcaatctttcttaaacacgtcgaagtggatagaggaagttcgcactgagaggggcagtgatgtcattatcgtgcttgttgggaacaaaactgaccttgtggacaagaggcaagtatccattgaggaaggggaaggcaaggcaaaggacctcggtgtgatgtttattgaaaccagtgctaaagctggttttaacattaaggccctgttccgcaagattgctgctgcactgcctggaatggagaccctttcatcagcaaagcaggaagacatggttgatgtgaacttaaagtccagcaatgctaactcatctcggtctcaggaggattgattgtctcacggcagttgagtccatgatccaagtcaatgaacgagaaccattttcgttggaaagatacgtttttatgtgttcttagtattttgtcagtggcctaagctagcaacagtgtagttgggttggcactgtgaactcctatcgctcggctgagtattagagttagtgattggttttatgtttcaacctatatttacgtcgcccatcttgttgcagtcagcccgagtcctgtgtttttctatggtgtactcttagaaaggatagtatgattaatgagctaaaacgggagctcaatgagcaagaagatattctgctgttcttcaagcgttacgagaccatgctggaagagcatcgctcaaagaaattgcaggctgatgttgatggaaatcaggtgactttgccaatcccgtccttgcgaatgttaaaacaatcttcaaatgcatatacacctgaagctttcaagatgttccagggtgagtttgaggcttacatgaactgcatgtccttcccctgcagtgcggttgggacagtgtcagagt

SEQ ID NO: 8608 - DNA, 917 bp, Triticum aestivum
  Clone ID: PAT_TA_8608
acactagttaacaccaatccacaatgaagaccttcctcgtctttgccctcctcgctcttgcggcggcaagtgccgttgcgcaaatttcacagcaacaacaacaaccaccattttcacagcaacaacaaccaccattttcgcagcaacagcaatcaccattttcgcaacaacaacaacaaccaccattttcacagcaacaacaaataccagttattcatccatctgttttgcagcagctaaacccatgcaaggtattcctccagcagcagtgcatccctgtggcaatgcagcgatgtcttgctaggtcacaaatgttgcagcagaggatttgccatgtgatgcagcaacaatgttgccaacagttgcggcaaatccccgggcaatcccgccatgagtcaatccgtgctatcatctactctatcatcctgcagcaacaacaacaacaacaacaacaagttcagagtatcatccaagctcagcaacaacaaccccaacagttgggccaatgtgtctcccaaccccaacaacaatcgcagcagcaactcgggcaacaacctcaacaacaacaattggcacagggtacctttttgcagccacaccagatagctcaatttgaggtgatgacttccattgcactccgtaccttgccaacgatgtgcaatgtcaacgtgccgttgtacggaaccaccactagtgcgccattcggcgttggcactggagttggtgcctactgataagaaaagatctctattaatatatagttggatcaccgttgtttagtcgatggatatgtcgatgtagcggtgacaaataaagtgtcacacaacaccatgtgtgacccgcccaaactagttgtttaaattctgaaataaaatacaaataaagttgtatcaagacaatgttcatatcagcattgt

SEQ ID NO: 8609 - DNA, 809 bp, Triticum aestivum
  unsure (1)..(809): unsure at all n locations
  Clone ID: PAT_TA_8609
gcacaactagagcacaagcatcaaatccaagtaagtagtatttaacgcaaatccaacatgaagaccttactcatcctaacaatccttgcgatggcaacaacaatcgccactgccaatatgcaggtcgaccctagcagccgagtacaatggccacaagaacaaccacccccccaagtcccaacaaccattctcccagcaaccacaacaaatatttccccaaccccaacaaacattcccccatcaaccacaacaagcatttccccaacctcaacaaacattcccccgtcgaccacaacaacaatttccccaagccccaagcaaccacaacaaccatttccccagccccaacaaccccaactaccatttccccgacaaccacaacaaccattcccctcagcagcaacaaccccaacagtcggtccaaggtgtctcccaaccccaacaacaacagaagcagctcggacagtgttctttccaacaacctcaacaacaacaactgggtcaatggcctcaacaacaacaggtaccccagggtaccttgttgcagccacaccaaatagctcaacttgaggtgatgacttccattgcacttcgtaccctgccaacgatgtgcagtgtcaacgtgccggtgtacggcaccaccactattgtgccattcggcgttggcacccgagttggtgcctactgataagaaaatatctctagtaatatatagttggattgtcgttgcttagtcgatggatatgtcgatgtagcggtnacaaataaagtgtcacacaatgtcatgtggacccgcacaaactagttta

SEQ ID NO: 8610 - DNA, 1130 bp, Triticum aestivum
  unsure (1)..(1130): unsure at all n locations
  Clone ID: PAT_TA_8610
gcagaataatagcatgaacaacattgtggaggcgaacacttgcgccgggaaagagcttagcttttttactctgaatttgaccggtgatgtgtgtgtatatatgctacatgctgcgaaattggttgttgtggttgtagatactgtggttgctgttgtggatatggttgttgtggtggaaatgattgcggctgcggatatggtagttgtggcggaaatggttgcggctgcggaaatggttgcagctgcagantatggttgttgtgatggaaatggttgcggctgcggatatggctgttgtggtggaaattgttgttgctgccctggaaattgttgttgttgtaccaatggaacttgctcttgtggctgttgctgagatggattttgtggctgcccacgcgtccgcaacaatcaccgttttcgcaacaacaacaaatagtactacagcaacaaccaccatttttgcaacaacaacaaccaagtctaccgcaacaaccaccattttcgcagcaacaacaacaactagttctaccgcaacaacaaataccatttgttcatccatctatcttgcagcagctaaacccatgcaaggtattcctccagcagcaatgcagccctgtggcaatgccacaaagtcttgctaggtcgcaaatgttgcagcagagcagttgccatgtgatgcaacaacaatgttgccagcagttgccgcaaatcccccagcaatcccgctatgaggcaatccgtgctatcatctactccatcatcctgcaagaacaacaacaggttcagggttccatccaatctcagcagcagcaaccccaacagttgggccaatgtgtttcccaaccccaacagcagtcgcagcagcaactcgggcaacaacctcaacaacaacaattggcacagggtacctttttgcagccacaccagatagctcagcttgaggtgatgacttccattgcgctccgtaccctgccaacgatgtgccgtgtcaatgtgcccgttgtatagaaccaccactagtgtgccattttcggtgttggcacccggaggttggtgcctactgataaggaaaggtctctagtaatatatagttggatcacccgttgtttagtcgatggatatgtcgatgc

SEQ ID NO: 8611 - DNA, 885 bp, Triticum aestivum
  Clone ID: PAT_TA_8611
gcaacaaccatttccaccacaacaaccatatccacagccgcaaccatttccatcacaacaaccatatctgcaactgcaaccatttctgcagccgcaactaccatattcacagccacaaccatttcgaccacaacaaccatatccacaaccgcaaccacagtattcgcgaccacaacaaccaatttcacagcagcagcagcagcagcagcaacaacaacaacaacaacaacaacaacaacaacaaatcattcaacaaattttgcaacaacaactgattccatgcatggatgttgtattgcagcaaagtagttaccaactgttgcaacaattatgttgtcaacgtttgtggcagatccccgagcagtcgcggtgccaagccatccacaatgtcgttcatgctattattctgcaacaacaacaacaacaacaacaacaacaacaacaacaacaacaacaacaacaacaacaacaacaacaacaacaacaaccgtcgagccaggtctcctaccagcagcctcagcaacaatatccatcgggccagggctccttccagccatctcagcagaacccacaggcccagggctctgtccagtctcaacaacttccctagttcgaggaaataaggaacctagcgctgcagacgctaccggcaatgtgcaatgtctacatccctccatattgctcgaccaccattgcgccatctggcatcttcggtactaactgagaagagaagaacttgtactagatatatgaaacaccatttccttagtccatggtttggtcgttgtagcggtgacaaaataaagtgacatgcactatcatgtaagaacccgaactatactagttcaaacttgggaataaaagacaaacacatgtcttgtctgc

SEQ ID NO: 8612 - DNA, 978 bp, Triticum aestivum
  Clone ID: PAT_TA_8612
acgcaacctgccatttttttttcctggcgacttcatcaaagtgctacggtaaaagcatgcttccaaaagctattccgagatgatcatatatgttgaagcatgtgaaagtggcagtatctttgagggattaatgccacaagaccttaatatttatgttacaacagcagcaaatgcggaagaaagtagctagggagcatactgccctgggatggaaacaccagctcctcctgaatgtatgacctgcttgggtgactcatacagggtttcttggatggaagacagtgaaactcacaatctacacaaggaaaccatcaagcagcagtacgaggtggttaaagcaagaacggcacccccaaatgactccaatatcggttctcatgtcatggagtatgggaacaagacattcaaggatgacaagcttttcctttatcaaggtttctatcctgtgaagtcaagcatcacaaacaggccgctgctttcgcccagcctcaagggtgcaatcaatcaaagagatgttgatattcttttcatgtggaagaagtatgagcagttaaatgttggatcagaggagaagcagagggctctcacctctcagggaggtcaaagaaactgtgttacacaggaagcatctcgacagcagtatcgatttcatcgggaagcttgtctttggatttgagaaggggccttcggtgattgaggctactaaaggccctggccagccattagtagacgattgggattgtctggagacgatggtgcgagtttttgagtcccaatgcggatcactcgaagtcagtatggcatgaacacacgagggcgttcgcaaacatctgcaacaatggcgtctctgagacagagatgaaggaggccaccatcagcggttgcgacggctacaacatggggaagtggaacccgctggttctagggcacagcgcctgatcggcagcactgcagtagtacctcggccgcgaccacgta

SEQ ID NO: 8613 - DNA, 746 bp, Triticum aestivum
  Clone ID: PAT_TA_8613
gttcattgcttaactttcttgctctactatcacaaacccagcaatggacaccacggcgaccactatatacccacaatatgtgattgaaaccaaaatcacctctaagcgaagtatccaggattttgatgacaatggtcattaatggccagcagtccagacaggtgtcagctccagagcagcagtagcgaacatcatcataatcagatatatctatatcaaaaataagttccctttccactggtacgaagacattgttaccagactgggcgtaggcatgtcgctttgcaggatctacgctgtagacaggtccaatatcaatcttgaaagggcacttctccttgatagaagtctccagttcagctgcagtatcaaaggactgaaaccgcagatagatgtcattctccagtgtaaacgaaagctcccgacgcccaatgtatgactgatcacatccaggatgctttgcatcatttccgtatgcaagccacttgaagaaatcaccatatgggaagagctttccgtagtagattcggaggtaatcggcgttgaagccgtccggcacagcggcggcgacttcttgccgctgctgcccatcaatctccatggcctcgaccctctcgtcccccatttcagacgaggactagatcgatcttgcgcgctgaagaagaataacctgcgtcgtcgtcgccttcgccggccgccgagggattcgcctgccactggcaccgagggattctccccgtcgaccc

SEQ ID NO: 8614 - DNA, 825 bp, Triticum aestivum
  unsure (1)..(825): unsure at all n locations
  Clone ID: PAT_TA_8614
gacccctatccgttcccccactcctggtctctctcccgctcctatcctctcctccccccctcgcgccgccgccggcgccgacgccgcggcttccgctcctcccccagccaagatgaatgttgaaaagctcaagaagatggcaggtgccgtgcgcaccggggggaagggtagcatgcgcaggaagaagaaggctgtacacaagaccacgactacagatgacaaaaggctccagagtaccctgaaaagagtaggagtcaacaccatccctggtatcgaagaggtcaacatctttaaggatgatgtggttattcagtttctgaatcctaaagtgcaagcttcgattggtgctaatacatgggtggtcagtggaactccacagacaaagaaactgcaagatctgctgccatcaattatcaatcaacttggtcctgacaacttggacaacctgcggaggctcgcagagcaattccaaaagcaggtccctggtgggtgctgctggcatcgaggctggtaccagtgcangagctgctcaggctgacgacgacnatgatgttcctgagcttgtccctggagagacatttgaagaggccgcttaagacaaaaaggcagaggcgggaatttgatgcatgtttactgttgggaagggttataagttaggcggcgcctttaaagaccaccttccctttttcagaattctgaacctaccttatttgggccaagggacccggttttggaatgtaccccaggtttcgcctgaaaatgttgggggaaatttttgcatcaaaatacatgccctcttttggtgggccctcattctcaaaaacg

SEQ ID NO: 8615 - DNA, 1126 bp, Triticum aestivum
  Clone ID: PAT_TA_8615
tcatccatcattctcataagtagagcacatcatttaagccaagcaagcagtgctcaatacaaatccaccatgaagacctttctcatccttgccctccgtgctattgtagcaaccaccgccacaattgcagttagagttccagtgccacaattgcagccacaaaatccatctcagcaacaaccacaaaagcaagttccattggtacaacaacaacaatttccagggcagcaacaaccatttccaccacaacagccatatccgcagcagcaaccatttccatcacaacaaccatatatgcagctgcaaccatttccgcagccgcaactaccatatccgcagccgcaactaccatatccgcagccgcaaccatttcgaccacaacaatcatatccacaaccgcaaccacagtattcgcaaccacaacaaccaatttcgcagcagcagcagcagcagcagcagcaacaacaacaacaacaacagatccttcaacaaattttgcaacaacaactgattccatgcagggatgttgtattgcaacaacacagcatagcgcatggaagctcacaagttttgcaacaaagtacttaccagctggtgcaacaattttgttgtcagcagctatggcagatccccgagcagtcgcggtgccaagccatccacaatgttgttcatgctattattctgcatcaacaacaacaacaacaacaacaacaacaacaacaacaacaacaaccgttgagccaggtctgcttccaacagtctcaacaacaatatccatcaggccagggctccttccagccatctcagcaaaacccacaggcccagggctctgtccagcctcaacaactgccccagtttgaggaaataaggaacctagcgctagagacgctacctgcaatgtgcaatgtctatatccctccatattgcaccattgctccagttggcatcttcggtactaactgagaatagaagaactctagtagtagatatatgatacaccgttttcttagtccatggtttggtcgttgtagcggtgaaaaaataaagtgacatgcactatcatgtaagaacccgaactatactagttcaaacctgggaataaaagacaaacacatctcttgtctac

SEQ ID NO: 8616 - DNA, 1325 bp, Triticum aestivum
  unsure (1)..(1325): unsure at all n locations
  Clone ID: PAT_TA_8616
ccccaacaaccattccctctacaaccacaacaatcattcctttggcaatcacaacaaccgttcctccaacaaccacaacaaccatctccccaaccccaacaagtagtacaaataatctccccagcaaccccaacaaccattccctctgcaggcaaaccaacctcagccccttttccacaacaacaacaacaacaccaacagctggcgcaacaacaaatccctgttgttcagccatccattttgcagcagctaaacccatgcaaggtattcctccagcagcagtgcagccctgtggcaatgccacaacgtcttgctaggtcgcaaatgttgcagcagagcagttgccatgtgatgcaacaacaatgttgccagcagttgccgcaaatcccccagcaatcccgctatcaggcaatccgtgctatcatctactccatcatcctgcaagaacaacaacaggttcagggttccatccaatctcagcagcagcaaccccaacagttgggccaatgtgtttcccaaccccaacagcagtcgcagcagcaactcgggcaacaacctcaacaacaacaattggcacagggtacctttttgcagccacaccagatagctcagcttgaggtgatgacttccattgcgctccgtatcctgccaacgatgtgcagtgttaatgtgccgttgtacagaaccaccactagtgtgccattcggcgttggcaccggagttggtgcctactgataaggaaagatctctagtaatatataattgggtcaccgttgtttagtcgatggatatgtcgatgcagcggtgacaaataaagtgtcacacaatgtcatgtgtgacccgcccaaactagttgtttaaattctgaaataaaataaaaataaagttgtatcaagacaatgttcatattggcattgtgtggatgtcgatctgattgccatgcttgcaagttcaaaaaaaaaaaaaaaaaaaaaaaaaaaaaaaaaaaaaaaaaaaaaaaaaaaaaaaaaaaaaaaagatgaaaaagaaaaaagaaaacaaaacaaaaaaaaacaaaaaaaagggggcgccaattttaaaaaaacaaaacttaacatcacggcgttgggaacagatatccttttttaaaaaaccccataaattaaacttattggccgtcttttaaaaaacccnctgtttggaaaaaccctggagtaaccaaaattaaaggacctagagacattcccactttttgaaaattgggaaagaccaaagaagccccccctgaagccccttataaaaaatttaaaaacctaaatggtaaaaggaaccccccctttaactgg

SEQ ID NO: 8617 - DNA, 650 bp, Triticum aestivum
  Clone ID: PAT_TA_8617
gaaatccgcgtgctagcttcctacaagatttggggatctttaggcgtctcgtcgcgagctctcgatcgctccgcgctcccgcggttagtgattccggaggccggcggatctggcggcgggggcctgggggaaatttttggtgcccggatttgaagcgatctgttcttgatttcgcgttcgtggctgctgaggagtcgggcttccacataaggaccaacaagagaaaccttaatctgttcggtgccagtcaaacctcaacaacaaagtttcatgtctgatctcgacgttactctgccatctgccttcgatccttttgctgaggcaaatgctgaggatgctggtgcaggccccggcgcaaaagattatgtgcatgtgcgcatccagcagcgcaacggcaggaagagtctgaccactgtccaagggcctgaagaaggagttcagctacaacaagatcctcaaggatctcaagaaggaattctgctgcaatggcacagtagtccaggatccggagctaggccaggtcattcagcttcagggtgatcagcgtaagaatgttgctactttcctagtccaggctgggattgcgaagaaggagctcatcaagatccacggcttctaagccttagccgcctccgataaatgctcgaacc

SEQ ID NO: 8618 - DNA, 1106 bp, Triticum aestivum
  unsure (1)..(1106): unsure at all n locations
  Clone ID: PAT_TA_8618
caacaatcaccattttcacagcaacaacaactaattttaccggcacaacaacaacaacagcttccgcaacaacaaatctctattgttcaaccatccgttttgcagcagctaaacccatgcaaggtattcctccagcagcagtgcagccctgtggcaatgccacaacgtcttgctaggtcgcaaatgtggcagcagagcagttgccatgtgatgcagcaacaatgttgccagcagttgtcgcaaatccccgaacaatcccgctatgatgcaatccgtgccatcacctactccatcatcctacaagaacaacaacagggttttgtccaagctcagcagcaacaaccccaacagtcaggtcaaggtgtctcccaatcccaacagcagtcgcagcagcagctcggacaatgttctttccaacaacctcaacagcaactgggtcaacagcctcaacaacaacaggtacaacagggtacctttttgcagccacaccagatagctcaccttgaggtgatgacttccattgcgctccgtaccctgccaatgatgtgcagtgtcaatgtgccattgtacagctccaccactagtgtgccattcggagttggcaccggagttggtgcctactgataagaaaagatgtctagtaatatatagttggaacaccgtcatctagtcaatggacatgtcgaggaagtggtggacaaataaagtgtcacacaacatcatgtgtgacccgcccaaagtagtagttaaattctggaataaatacaaataaagtgttctctagacaatgttcaaaaaaaaaaaaaaaaaacggtccgcggccgccaccgcggtggagctccagcttttgttccctttagtgagggttaattgcgcgcttggcgtaatnttggtcatagctgtttcctgngtgaaattgttatccgctcacaattccacacaacatacgagccggtaagcataaagtgtaaagnctgggggngcctaatgagtgngctaacttcacattanttgngttgngctnactgncccgctttccagtcgagaaacctgtcgngccagctgcattaatgnaatcgggccaacncgcggggaaganggcgggt

SEQ ID NO: 8619 - DNA, 1020 bp, Triticum aestivum
  unsure (1)..(1020): unsure at all n locations
  Clone ID: PAT_TA_8619
ttcggcacgagggttaacaccaatccaccatgaagaccttcctcatctttgctctccttgccattgcggcgacaagtgccattgcacaaatggagactagccgcgtccctggtttggagaaaccatggcagcaacaaccattaccaccacaacaacaaccaccatgttcacagcaacaacaaccatttccacagcaacaacaaccaattattatactgcaacaatcaccattttcgcagcaacaacaaccagttctgccgcaacagcaaccagttattatactgcaacaaccaccattttcgcagcaacaacaacaacaacaacaaccaccattttcgcagcaacaacaaccagttctaccacaacaaccaccattttcacaacaacaacaaccaccattttcgcagcagcaacaaccatcttcacaacaaccaccttttccacaacaacaccaacagtttccacaacaacaaatccctgttgttcaaccatccgttttgcagcagctaaacccatgcaaggtgttcctccaacagcagtgtagccatgtggcaatgtcgcaacgtcttgctaggtcacaaatgtggcaacagagtagttgccatgtgatgcaacaacaatgttgccaacagctgccgcaaatccccgaacaatcccgctctgaggcaatccgtgccatcgtctactccatcatcctgcaagaacaacaacagggttttgttcaacctnaggctgcaacaaccccaacaaggtgggcccaagggggttttccaaacacccaaacagcaggtcggcaggcagccagccaggcaaaccttcggaacaagtgggttctttttttccaaccaaaccctttaaacaaacctaaccaaaccaaatttgggggttccaggccagagccctttcaaaccaaaccaacccgggaatatccccaccaagggggtaattatatttctttgggcaggcgccaccaaccccaggaatatttctttcaaacccttggaggggtggaattgaacg

SEQ ID NO: 8620 - DNA, 741 bp, Triticum aestivum
  Clone ID: PAT_TA_8620
tcaaaaccaagcaatactagttaacaccaatccaccatgaagaccttcctcatctttgctctccttgccattgcggcgacaagtgccattgcacaaatggagactagccgcgtccctggtttggagaaaccatggcagcaacaaccattaccaccacaacaacaaccaccattttcacagccacaaccaccatttgcgcagcagcaacaaccatcttcacaacaaccaccttttccacaacaacaccaacagtttccacaacaacaaatccctgttgttcaaccatccgttttgcagcagctaaacccatgcaaggtgttcctccaacagcagtgtagccatgtggcaatgtcgcaacgtcttgctaggtcacaaatgtggcaacagagtagttgccatgtgatgcaacaacaatgttgccaacagctgccgcaaatccccgaacaatcccgctctgaggcaatccgtgccatcgtctactccatcatcctgcaagaacaacaacagggttttgtccaacctcagcagcaacaaccccaacagtcgggccaaggtgtctcccaacaccaacagcagtcgcagcagcagcagcaactcggacagtgttctttccaacaacctcaacaactacaacaattgggtcagcagcctcaacaacaacagataccacagggtatattcttgcagccacaccagatatctcaacttgaggtgatgacttccattgcactccgtaccttg

SEQ ID NO: 8621 - DNA, 954 bp, Triticum aestivum
  Clone ID: PAT_TA_8621
ccactctgaagaccttccgatctttgctctcctcgccattgtggcgacaagtgccattgcacaaatggagaatagccacatccctggtttggagagaccatcgcagcaacaaccattaccaccacaacaaacattatcacaccaccaacaacaacaacccatccaacaacaaccacaaccattttgacaacagcaaccatgttcacagcaacaacaacaaccattatcgcagcagcaacaaccaccattttcacaacaacaaccaccattttcgcagtcacaacaacaactcgggcaacaacctcaacaacaacaattggcacaaggtacctttttgcagccacaccagatagctcagcttgaggtgatgacttccattgcgctccgtaccctgccaacgatgtgccgtgtcaatgtgccgttgtatagaaccaccactagtgtgccattcggtgttggcaccggagttggttcctactaataaggaaaggtctctagtaatatatagttggatcaccgttgtttagtcgatggatatgtcgatgcagcggtgacaaataaagtgtcacacaatgtcgtgtgtgacccgcccatactagttgtttaaattctgaaataaaataaaaataaagttgtatcaaaaaaaaaaaaaaaaaaaaaaaaaaaaaaaaaaaaaaaaaaaaaaaaaaaaaaaaaaaaaaaaaaaaaaaaaaaaaagaaaaacaaataaaaaaaaaaaaagggtacgtcccttaaaatgacacaacttaactttctcaatacaggcacctaaataaattttattgggcgccacttaaaaacaattggatgggccaaaatttacaccttccccaactgaaaaaacctggaggaaacccaacttatcccccttggggaaaatccccataggcccagacggaaagcccttaaaacggccgcacaaattgaatttcc

SEQ ID NO: 8622 - DNA, 809 bp, Triticum aestivum
  Clone ID: PAT_TA_8622
tcggcacgaggcataactagagcacaagaatcaaatccaagtaagtagtacctaacgcaaatccaccatgaagaccttactcatcgtaacaatccttgcgatggcaacaaccatcgccaccgccaatatgcaagtcgaccccggctaccaagtacattggccacaacaacaaccattcccccagccccaacaaccattctgccagcaaccacaacaaactattccccaaccccatcaaacgttccaccatcaaccacaacaaacatttccccaaccccaacaaacatacccccatcaaccacaacaacaatttccccagacccagcaaccacaacaaccatttccccagccccaacaaacattcccccaacaaccccaactaccatttccccaacaaccccaacaaccattcccccagcctcaacaaccccaacaacaatttccccagtcacagcaaccacaacaaccttttccccagccccaacaacaattcctgcagccccaacaaccgcaacaatcattcccccagcaacaacaaccgttgattcagctatctctacaacaacagatgaacccctgcaagaattttctcttgcagcaatgcaaccctgtgtcattggtgtcatccctcatatcaatgatcttgccacgaagtgattgccaggtgatgcagcaacaatgttgccaacaactggcacagattcctcagcagctccagtgtgcagccatccatagtgtcgtgcattccatcatcatgcagcaagaacaacgacaaggcgtgcagatccggcggccactgtttcagctcg

SEQ ID NO: 8623 - DNA, 914 bp, Triticum aestivum
  unsure (1)..(914): unsure at all n locations
  Clone ID: PAT_TA_8623
gtttttttttttttttttagtagaaggtaaacgttgtttatcacatactaattcaacaacattgtcggaacaaacatccagaaacagtctcagccatcttaggaaccacccttagtcatgtcagggtcttttgaaaagcagcatgtagcatatatacacacacatcaccggtcaaattcagagtaaaaaagctaagctctttcccggcgcaagtgttcgcctccacgatggggcgctcgctcgatcaccccttcaggccgccttggcgaagccgacccgcagcttgccgtagtcgaagacggtgtggtaggggcccatgaagacgtctccccaggatccagagaggaccacggggagggggggatgtccatggctgtgaatccactgatgcactgggcagcggctccttcaccgaccttcaggatatactcttctggtttcagcgcaaacttcttgccaccaatggtgaactcaatgtcaggattgggtaatttgcgcgcctgctgccttccttggatgtggtagccgtttctcaggctccctctccggaatcgaaccctaattctccgtcacccgtcaccaccatggtaggcccctatcctaccatcgaaagttgatagggcagaaatttgaatgatgcgtcgccggcacgaaggccgtgcgatccgtcgagttatcatgaatcatcggatcagcgagcagagcccgcgtcagccttttatctaataaatgcgcccctcccagaagtcggggtttgttgcacgtattagctctagaattactacggttatccgagtagcacgtaccatcaaacaaactataactgatttaatgagccattcgcagtttcacagttcaaattggttcatacttgcacatgcatggcttaatctttgagacaagcatanactacc

SEQ ID NO: 8624 - DNA, 967 bp, Triticum aestivum
  Clone ID: PAT_TA_8624
ttaattttaattgaaggcttttcaagcgcagcagtacatctgcaccatatgacgctataggcattattaccgtcgctaccacggcaacaacaagaacatgcaaagtttaaaaagctcgcgtacaatagactaataatccaaaaccttttcccagcgactggtcggcccatagataacagtactagaagttgagctgcgcgagcgtcacctcgtctacctctcctccaagatggaagtagattgcactcccagcttcagactactacctgtgggtcgagcgccgctgcgcatcggcggcgccatcagctacctttttttctcacttgtagtcgaacgatgggtatcggagtgctgggcgtgtcaaagctctctaatatctccgacttgccgccgccgccgctgggcttcttctcctcctccttcttgccgaagaggccgccgaaccaactacccccgccgctggagctcccgacctccacggggggcacgagtggctggggcatgcctgggaagccgccgacgcctccccccgccatcgcggcggccaggttgggatcgtcggtggggagcggcgggaggttctgcggcgcggcgaggacgcggttgagcatgaggccggcgccctcgatgagcgcgaggaggcagccgccccatgagcgcggagcggccggcggcgccggggccctggcgcatggagaggaagccgcccgtggcggcgccggcgatgatggagttccaggggtcctccttctggcgcacgaagaccatggtgcagtcgaaggcggagaagaggccgccccagacggcgaagctcccgccgacgcgcggcgcgttgaggcgcacctgctgggccccgccgagcaggcgctcgccgttgggcgagttgtaggtgcccttgaggaaatggaagacggagccgcccaccgcccccatcccgaacgcgccgcccacgtcgtccaggctggtc

SEQ ID NO: 8625 - DNA, 414 bp, Triticum aestivum
  Clone ID: PAT_TA_8625
gcaacagttgggccaatgtgtttcccaaccccaacagcagtcacaacaacaactcgggcaacaacctcaacaacaacaattggcacaaggtacctttttgcagccacaccaaatagctcaacttgaggtgatgacttccattgcacttcgtaccctgccaacgatgtgcagtgtcaacgtgccggtgtacggcaccaccactattgtgccattcggcgttggcacccgagttggtgcctactgataagaaaatatctctagtaatatatagttggattgtcgttgcttagtcgatggatatgtcgatgtagcggtgacaaataaagtgtcacacaatgtcatgtgtgcacccgcacaaactagtttaaattatggaataaaatacaaataaagttttatctgacaaaaaaaaaa

SEQ ID NO: 8626 - DNA, 1401 bp, Triticum aestivum
  unsure (1)..(1401): unsure at all n locations
  Clone ID: PAT_TA_8626
cccaggcggtgtcccggcaactataaataggcatgaagtataaagatcatcacaagcacaagcatcaaagccaaacaacactagttaacaccaatccacaatgaagaccttcctcgtctttgccctcctcgctcttgcggcggcaagtgccgttgcgcaaatttcacagcaacaacaacaaccaccattttcacagcaacaacaaccacaattttcacaacagccaccattttcccagcagcaacaaccaccattttcgcaacaacaacaacaaccaccatttgcgcagcaacaacaaccaccgttttcacaacaaccaccaatttcacagcagcaacaaccaccattttcacagcaacaacaaccacaattttcacagcaacaacaaccaccatattcgcagcaacaacagccaccatattcgcagcaacaacaaccaccattttcgcagcaacaacaaccaccattttcgcagcaacaacaacaaccaccatttacacagcagcagcagcagcaacaacaacaacaaccatttacacagcaacaacaaccaccattttcacaacagccaccaatttcacagcagcaacaaccaccattttcgcagcaacaacaaccacaattttcacagcaacaacaaataccagttattcatccatctgttttgcagcagctaaacccatgcaaggtattcctccagcagcagtgcatccctgtggcaatgcagcgatgtcttgctaggtcacaaatgttgcagcagagcatttgccatgtgatgcagcaacaatgttgccagcagttgcggcaaatccccgagcaatcccgccatgagtcaatccgtgctatcatctactctatcatcctgcagcagcagcagcagcaacaacaacaacaacaacagggtcagagtatcatccaatatcagcaacaacaaccccaacagttgggccaatgtgtctcccaaccccaacagcagttgcagcagcaactcgggcaacaacctcaacaacaacaattggcacatggtacctttttgcagccacaccagatagctcagcttgaggtgatgacttccattgcactccgtaccctgccaacaatgtgcagtgtcaatgtgccgttgtacgaaaccaccactagtgtgccattaggcgttggcatcggagttggtgtctactgataagaaaagatctctagtaatatatagttggatcaccgttgtttagtcgatggatatgtcaatgtagcggtgacaaataaagtgtcacacaacgtcatgtgtgacccgctcaaactagttgtttaaattctgaaataaaatacaaataaagttgtttcaaaaaaaaaaaaaaaaaaaactcgagggggggcccggtacccaattcgccctctagtggntcg

SEQ ID NO: 8627 - DNA, 829 bp, Triticum aestivum
  Clone ID: PAT_TA_8627
ggagagtgcatcattcaagccaagcaagcagtggtcaatacaaatccaccatgaagacctttctcatccttgccctccttgctatcgtggcgaccaccaccacaactgcagttagagttccagtgccacaattgcagccacaaaatccatctcagcaacaaccacaagagcaagttccattggtgcaacaacaacaatttctagggcagcaacaacaacaatttccagggcaacaacaaccatttccaccacaacagccatatccgcagccgcaaccatttctgccacaactaccatatccgcagccgcaaccatttccaccacaacaatcatatccacaaccacaaccacaatatccgcaaccacaacaaccaatttcgcagcaacaagcacaactacaacaacaacaacaacaacaacaacaacaaccgtcgagccaggtctcctaccagcagcctcagcaacaatatccatcaggccagggcttcttccagccatctcagcaaaacccacaggcccagggctttgtccaacctcagcaactgccgcagttcgaggaaataaggaacctagcgctgcagacgctaccagcaatgtgcaatgtctacatccctccatattgctcgaccaccattgcgccatttggcatcatgagtactaactgagaagagaagaactctattactagatatatgaaacaccgttttcttaaaacatggtttggtcgttgtagcggtgaaaaataaagtgacatgcactatcatgtaagaacccgaactagactatttcaaacttggaaataaaagacaaacacaggtcttgtttgccc

SEQ ID NO: 8628 - DNA, 425 bp, Triticum aestivum
  Clone ID: PAT_TA_8628
gcccagcaatcagcacaaataattcctcagcaaccccaacaaccattccctctacaaccacaacaatcattccttcggcaatcacaacaaccgttcctccaacaaccacaacaaccatctccccaaccccaacaagtagtacaaataattccccagcaaccccaacaaccattccctctgctggcaaaccaacctcagcaaccttatccacaacagcaaccatcaggagtaatggtataggcatcgggggccaaggaaatgaagagctatagtactagcccggcggatcatcgttgtttagtcaattgagtgttcaatgtaacgatgataaataaagtgatgtgtaccatcatgtgtaaccccgacctatactagttcaaacatgagaataaaagacaaagaaagttcttgtcaaaaaaaaaaaa

SEQ ID NO: 8629 - DNA, 725 bp, Triticum aestivum
  Clone ID: PAT_TA_8629
agaacagctgcaaccgtggtggctactgcaacttcatgcacgtgaagcagattggtagggagctcaggaggaagctatatggtgggcgttccaggaggagccacgggaggagccgcagcccgagcccacagcacaggagggacaaccgtgaccgtggtggcgacttccgccgtgatggccgggatgaataccgtggtggcggtggcggttacccgtggaggcgatggaggtgatggtgccggttaccgtggaggtggtggtggtggctaccgtggaggtgatgggggtggctatcgtggtggtggtggtggcggttaccgtggtggcggcaggggtggaggtgttggcaggcatgacaggtatgatgatggaccaaggcgcaggtatggtggcagcccgccacgacgtggaaggagccctccagccagggagaacagcgaggagcgcagggccaagatcgagcagtggaaccgtgagcgggaggagaagaagtgatgaaaccgcgagtagtggaaccgcaagcgttatttaccttttcattcttgtgtcgttagtttgctcctatgttgagtctggtggtttactgtcagacattggttgatatagtactattgcttggttgagtgacctgtcaagtgcaggattctattagaggcgtgtaagctgctatttgtgctcaatatttatctgcaggattctaaaaaaaaaaaagtcgacgcggccgc

SEQ ID NO: 8630 - DNA, 911 bp, Triticum aestivum
  Clone ID: PAT_TA_8630
ttttttttttttgaccaaatatagcctatataaatagaacatgaataagctggctacaacaacatccgacacaaactagatgttcccttgaggctctgcagcatcacatcatgcatcccacaacacaaagtcacgactaaacattacagctactgcagatgtttcctgccacagcccccctaactacaacagacacagacaatgacgacggtgcccagtcagcagacagacaaattcaataggtaaggtaaaaacaacgacgaccatggagtttacaatccatacaacggtgccatgatgagagcgaacccatttacaggggaagttcacggttggttggttggttcaagcctaagccttccttctgcgcttctttccagttgaagacgcccccttgccggatgcctcctgctccatttcagatgcctcggcctcttctttctcctccttctccttccgcttctcttgaacagatccagatccgctagccgccactggagtggtagtggcagcgctttttggtttccgcacaggcctacccttcacagatccatcgccagatttgctcccaacctccttcaccttctggttgctgctgtctttagctaaatcatccttcgtcttgttagctgatccagtggctttctccttgccttctttcttaatctcgctggcacttttaggtgtccccttggcatccttgacagcagttttcccctttgatttgcttggagttgttgacggtgtgccaccattgttggggcgccaacctttcggacggccccttttctttggaagctccactccatcacttttaggtgtttctattttttcttccttcactggcagcagcgtgattcctctcccttttctgccacagcgcatctcagatggtacatcagaaatttggc

SEQ ID NO: 8631 - DNA, 1263 bp, Triticum aestivum
  Clone ID: PAT_TA_8631
aaccctactaaagggaacaaaagctggagctccaccgcggtggcggccgctctagaactagtggatcccccgggctgcaggaattcggcacgaggtgaaagagatcattccatggcagctataaatagccccatagcatgacgatcatccttcctcatccatcattctcattagtagagcgcatcatttaagccaagcaagctgtggtcaatacaaatccaccatgaagacctttctcatccttgccctccttgctatcgtggcgaccaccgccacaactgcagttagagttacagtgccacaattgcagccacaaaatccatctcagcaacagccacaagagcaagttccattggtacaacaacaacaatttctagggcagcaacaaccatttccaccacaacaaccatatccacagccgcaaccatttccatcacaacaaccatatctgcagctgcaaccatttccgcagccgcaactaccatattcacagccacaaccatttcgaccacaacaaccatatccacaaccgcaaccacagtattcgcaaccacaacaaccaatttcacagcagcagcagcagcagcagcaacaacaacaacaacaacaacaacaacaacaacaacaacaacaacaaatccttcaacaaattttgcaacaacaactgattccatgcatggatgttgtattgcagcaacacaacatagtgcatgggagatcacaagttttgcaacaaagtacttaccagctgctgcaagaattgtgttgtcagcacctatggcagatccctgagcagtcgcagtgccaggccatccacaatgttgttcatgctattattctgcatcaacaacaaaaacaacaacaacaaccatcgagccaggtctccttccaacagcctctgcaacaatatccattaggccagggctccttccggccatctcaacaaaacccacaggcccagggctctgtccagcctcaacaactgccccagttcgaggaaataaggaacctagccctacagacgctacctgcaatgtgcaatgtctacatccctccatattgcaccatcgcgccatttggcatcttcggtactaactgagaagaaaataactctagtactagatatatgaaacaccgttttctcagtccatggtttggtcgttgtagcggtgaaaaaataatgggacatgcactatcatgtaagaacccgaactatactaggttcaaacttgggaattaaaagacaaacacaggtcttgtctt

SEQ ID NO: 8632 - DNA, 1323 bp, Triticum aestivum
  Clone ID: PAT_TA_8632
gcacgaggcgcaagtccacagcacacagcaaacacatctcaattctcacccatccttcgaagcaagacaagagagaccgagcgagcaatggctcccatgctcaagcggatcgccgaggacgagccgaagaaggcggcgtacgtgaccttcctcgccggctccggcgactactggaagggcgtggtgggcctggccaagggcctccgcgccgtcaagtcggcctacccgctcgtggtggccgtgctccctgacgtccccgaggaccaccgccagaagctgctcgcccagggctgcgtcgtccgcgagatcgtgcccgtgtacccgccggagagccagacccagttcgccatggcctactacgtcatcaactactccaagctccgcatctgggagttcgtggagtacgagcggatggtgtacctggacgcggacatccagttgtacgacaacatagaccacctctttgacctggagatgggcagcttctatgccgtcatggactgcttctgcgagaagacgtggagccacaccccgcagtacgagatcggctactgccagcagtgcccggaccgggtggtctggccggagcgcgacctcggcgtgcccccgccgccgctctacttcaacgccggcatgttcgtgcacgagcccagcatggccaccgccaaggccctgctcgacaagcttgtcgtcaccgaccccacccccttcgccgagcaggactttcttaacatgttcttcagggacgtgtacaagcccatcccgccggtgtacaacctcgtgctcgccatgctctggaggcaccccgagaacatccagctccacaaggtcaaggtcgtccactactgcgcagcgggctcgaagccgtggaggtacaccgggcgaggaggccaacatggacagggacgacatcaagatgcttgtgaagaaatggtgggacatctacaacgacgagggcctagactacaaggccggcgaggataccgccaacctgctacgtggagctctggttgaggccggcgccgtgaagtacttcccggcgccctcggccgcgtaggctcgctgcatgccggcgttagcccggctaggtcgtcacagaatgattaattaagtgctatcagtaggggatttcggattttcggtaaagaactatactatagtatcgaagtatatggatcagcatcgatctacacgtttttttggtattgtagatcaatctaatccgtgtcttgttttcgtttgcacgaaaaatataggcgtgtacaccatgtatatatctagtacttgttacgtagtacgtatattgttaaatatttttcaaat

SEQ ID NO: 8633 - DNA, 1161 bp, Triticum aestivum
  Clone ID: PAT_TA_8633
ggtccccatccagcaaatttgagcccatagcccagtcgcagcagggaattcttcccgtccatggccatgagggtcgactctgcaatcctcgccgtcgtcgtcgccttcctccttcccctccgcctgctctccctctgcgcccgcctgaactcctccggtagcgcaggcgacctccgccgatcctattccgccctcgccatcgcggccgcgctcctagccaccttctttgccctaccccgccacgacggcggtcgcacggggcagtgcgccacctccgttggttccccttgggaggagggtaccggccgagaggttcggttggagatcgagcagctgaagctgcagctctaccgattggaatcattatggcaaaacaaatcaaaagcaccagatgacaaaggtgatgcttcagaggaagatgccgagtttgtgaaagcgatgggactggacattcaggctctgatcaaggaacaagaaaacatcaaggaatcattatggagttctggcgatactatcaaatcagtcgaaaacgaggtacgaattctggcggcagaatccagaaagatgaactctgatatttacaatgtgtggtcattggccaacgatacggagaaaacggttgaagctctacattcagatgtccaaaaggctcaaattataatggatgaatcaaggaagatgaactctaatgctcaccagatatggtcattggcaaaggatacagcaaaaaaggtcgaatctctgtatacagatgttgcaaaggttcaaagtgtaattgatatatcaaaaaagatggaatctaatatacacaaagcgtggtcttatgcaaagcagacagagaagagggttgaagatatatattcagatgtcaaaaagggcttcaagaagaaggcctggatgagctgattgcgccgtcgacttgatgggctagcattggcctgggcatggagtaatggagtagagaagccacccggccttgcgtctgcgaacctgtaatgctccttgatattgtatgacacgtttacggttgtgtcgtgcgtgttgtggacatgatcttgctgtgtttctgatctgactcgcttcctgtttctgtgtcgtcatggtaatgtatatattgatgatgtacggcgttaatgcaataacatgcgactttcaggactc

SEQ ID NO: 8634 - DNA, 882 bp, Triticum aestivum
  Clone ID: PAT_TA_8634
ttcggcacgagggtagagtgcatcattcaagccaagcaagcagtggtcaatacaaatccaccatgaagacctttctcatccttgccctccttgctatcatggcgaccaccaccacaactgcagttagagttccagtgccacaattgcagccacaaaatccatctcagcaacaaccacaagagcaagttccattggtgcaacaacaacaatttctagggcagcaacaacaacaatttccagggcaacaacaaccatttccaccacaacagccatatccgcagccgcaaccatttctgccacaactaccatatccgcagccgcaaccatttccaccacaacaatcatatccacaaccacaaccacaatatccgcaaccacaacaaccaatttcgcagcaacaagcacaactacaacaacaacaacaacaacaacaacaacaacaaatccttcaacaaattctgcaacaacaactgattccatgcagggatgtcgtcttgcaacaacccaatatagcacatgcaagctcacaagtatcgcaacaaagttaccaactgttgcaacaattatgttgtcagcaactgtggcagacccccgagcagtcacggtgccaagccatccacaatgtcattcatgctattattttgcatcatcaacaacaacaacaacaacaacaacaacaacaacaacaacaacaacaacaacaacaacaacaacaacaacaacaaccgtcgagccaggtcttctaccaacagccctaagaacaatatccatcaggcccgggcttcggttccagccttctcagcaaaacccacagggcccagggctttggccaaacttagcaactgccggaattcgaggaaataaggaacctagcgctacaga

SEQ ID NO: 8635 - DNA, 780 bp, Triticum aestivum
  unsure (1)..(780): unsure at all n locations
  Clone ID: PAT_TA_8635
ttttttttttttacggcaaaatgcatgaaacttccttgagactcatccaagcctcgaagcagcatacacaaattaactcttgcatcatcaagaaaaaagcaaaaccaaaaataacatagaaccacatctctgcccctattgagttcaactatcgcagataacagacagacgtaacattaggttccacataatcaagacactgtcctaaaaactcattattttaaatttgatagccagtgctcttcttagtaggactcacggtcaccaccatagccgccgccaccaccaccacggccaccaccgtatccgccgccaccaccaaagccaccgccaccatagccgccgccgccgccaccacccgaaggtcgctcgttggcgaagttcacacggacgttcctccccgcaagctccttgccgtccatgttttctgcagcactctttgcatcctcgccgctggcgaagctcacaaaaccaaaccctctagaccttccagtctctctgtcagtgataacacgagcttcaacgacctcaccaaagcattgaaacgcctccttcagcgaatgatcatcagtagcccaggcgagaccaccgacgaaaagcttggagccatcagcaggctggccggcgcacatgaagcgggcagcgttgaacagggcaggagccgagccggtggaggcactgctagccacagcactctgcctaagaaggcttccgagcttgatgagggccgccatggaggaagactaaaactnctggagggcgagctggacgagacggcgg

SEQ ID NO: 8636 - DNA, 730 bp, Triticum aestivum
  Clone ID: PAT_TA_8636
tctgccttctcttcctttctaggctctagcacacgcacatgatgaactcgagggtggcgatggctgcgtggtgggtttgtggactcctcccgctcctggcggatgcggccaaggggaactcggagcccgctgatccggctgccgacggagaatgggcatgcccctgcccctgcgcctggccctgccgcgtcggcggcgggtgaagaggtgacgaagtgggccgtgctcgttgccggctcctccggctacgagaactaccggcaccaggccgatgtgtgccacgcgtaccagatcctgaagaagggggggctaaaggatgagaacattgtggtgtttatgtacgatgacatcgccaacagccccgacaacccaaggcgtggaaccgtcatcaaccatcccaaaggcaaagatgtttaccatggtgttcccaaggactacactggtgaccaggtcactgctaagaacttttatgcggttctcctggggaacaaaaccgcggttaccggagggagtaggaaggtgataaacagcaaaccagaggatcacatcttcatcttctactcggatcatgggtctcctggttcacttggtatgcccaacgggccagatgtttatgctgacgacttcatcaaagtgttacggcaaaagcatgcttccaaaagctattcgaaaatggtcatatatgttgaagcgtgtgaaagtggcagcatctttgagggtttgatgccac

SEQ ID NO: 8637 - DNA, 1317 bp, Triticum aestivum
  Clone ID: PAT_TA_8637
caacaactgattcctgcagggatgttgtcttgcaacaacacaacatagcgcatgcaagctcacaagttttgcaacaaagtacttaccagctattgaacaattgtgttgtcaacaactgttgcagatccctgagcagtcgaggtgccaagccatccataatgttgctcatgctattattatgcatcaacaacaacaacaacaacaagaacaaaaacaacagttgcaacaacaacaacaacaacaacagcaactgcaacaacaacaacaacaacaacaacaacaaccgtcgagccaggtctccttccaacagcctcagcagcaatatccatctatcttgcagcagctaaacccatgcaaggtattcctccagcagcaatgcagccctgtggcaatgccacaaagtcttgctaggtcgcaaatgttgcagcagagaagttgccatgtgatgcaacaacaatgttgccagcagttgccgcaaatcccccagcaatcccgctatgaggcaatccgtgctatcatctactccatcgtcctgcaagaacaacaacaggttcagggttccatccaaactcagcagcagcaaccgcaatagttgggccaatgcgtttcccaaccccaacagcagtcgcagcagcaactcgggcaacaacctcaacaacaacaattggcacagggtacctttttgcatccacaccagatagctcagcttgaggtgatgacttccattgcgctccgtaccctgccaacgatgtgccgtgtcaatgtgcccttgtatagaaccaccactagtgtgccattcagcgttggcaccggagttggtgcctactgataaggaaaggtctctagtaatatatagttggatcaccgttgtttagtcgatggatatgtcgatgcagcggtgacaaataaagtgtcacacaacgtcgtgtgtgacccgcccaaactagttgtttaaattctgaaataaaatacaaataaagttgtatcaagacaatgttcaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaataaaaaaacaaataaaaaaaaaaaaaaaaattctttaatagaacacacctaaatacaattaactggcagggggtttaacaactttttagataggaaaatccctggccttaccaaacttaatcgttttgcagaaaatccccctttaaaaagctggcgaaatagcgaaaattcccaaaccgttcgcccttaaaaacattggggcaccctgaatgttaaatgg

SEQ ID NO: 8638 - DNA, 863 bp, Triticum aestivum
  Clone ID: PAT_TA_8638
caacaacaacaacaacaacaacaacaacgacaacaaatccttcaacaaattctgcaacaacaactgattccctgcagggatgtcgtcttgcaacaactcaacatagcacatgcaagctcacaagtattgcaacaaagttaccagcagttgcaacaattatgttgtcagcaactgcagcagaccccccatcagtcgcggtgccaagccatccacaatgtcgttcatgctattattctgcatcagcaacaacaacaacaaatccttcaacaaattttgcaacaacaactgattccatgcagggatgttgtcttgcaacaacacaacatagcgcatgcaagatcacaagttttgcaacaaagcacttaccagccattgcaacaattgtgttgtcaacagctgtggcagatccccgagcagtcgcggtgccaagccatccacaatgttgttcatgctattattctgcatcaacaacagcgacaacaacaaccatcgagccaggtctccttgcaacagcctcagcaacaatatccatcaggtcagggcttcttccagccatctcagcaaaacccacaggcccagggctctgtccaacctcaacaattgccccagttcgaggaaataaggaacctagcgctacagacactacctagaatgtgcaatgtctatatccctccatattgctcgaccaccattgcgccatttggcatcttcggtactaactgagaagagaaacaacattttcttagtcccatggtttggtcgttgtagctgtgaaaaaataaagtgacatgcactatcatgtaagaacccgaacaatactagttcaaacttgggaataaaagacaaacccaagtattgtttcc

SEQ ID NO: 8639 - DNA, 540 bp, Triticum aestivum
  Clone ID: PAT_TA_8639
ttttttttttttggcgtaattttaattttaggcttttcaagcgcagcagtacatctgcaccatatgacgctataggcattattaccgtcactaccacggcaacaacatgaacatgcaaagtttaaaaagctcgcgtacaataaactaataatccaaaaccttttcccagcgactggtcagcccatagataacagtactagaagttgagctgcgcaagcgtcacttgtctacccctccgacaagatgaagtagattgcactcccagcttcagactactacttgtggatcgagcgccgctgcgcatcggcgccatcagctaccttttttttcacttgtagtcgaacgaaggtatcggagggctgggcgtatcaaagctctctaatatctccgacttgccgccgctgccgctgggcttcttctcctcctccttcttgccgaagaggccgccgaaccaactacccccgccgccggagctcccgacctccacagggggcacgggtggctggggcatgcctgggaagccgccgaccggacgcgtgg

SEQ ID NO: 8640 - DNA, 1744 bp, Triticum aestivum
  Clone ID: PAT_TA_8640
ttctcttcctctctaggctctagcacacgcacatgaactggggggtggccatggctgcgtggtgggtttgtggattcctcccgctcctgctgctggcggtggccgcggatggggactcggagcagctgatccggctgccgacggagaatgggcatgcccctgcccctgcgcctggtcctgccgcgtcgccggtggaggaagaggtgacgaagtgggccgtgcttgtcgccggctcctccggctacgagaactaccggcaccaggccgatgtgtgccacgcgtaccatatcctgaagaagggaggcctcaaggatgagaacattgtggtgcttatgtacgatgacatcgccaacagtcctgaaaacccaaggcgtggggtcgtcatcaaccatcctaaacgcaaagatgtttaccatggtgttcccaaggactacaccggtgagcaggtcactgctaacaacttgtatgcagttctcctggggaacaaaactgcggttaccggagggagtaggaaggtgataaacagcaaaccgaatgatcacatcttcatctactacacggatcatgggggtgctggtgcacttggtatgcccaacgtgccgtttgtttatgctggcgacttcatcaaggtgttacggcaaaagcatgcttccaaaaagctattcgaaaatgattatatatgttgaagcgtgcgaaagtggcagcatctttgagggtttgatgccacaagatcacaatatctatgttacaacagcagcaaatgcggaagaaagtagctgggcagcatactgccctgggatggaagtaccacctccttctgaatacaagacctgtttaggtgacgcatacagtgtttcttggatggaagacagtgaaacccacaatctgaagaaggaaacaatcaagcagcagtacgaggtggtgaaagcgagaacggcaccccgaaatgagtccagtataggttctcatgtcatggagtatggtgacaggactttcaaggatgagatgcttttcctctatcaaggtttcgatcctgcaaagtcaagcatcacaaacaggccactgcttaggcccagcctcaagggtgcaatcaatcaaagagatgccgacattcttttcatgtgggagaagtatgagcagttaaatgggggatcagaagagaaacagagggctctgagggagatcaaagaaaccgtgctacacaggaagcatctcgacagcagtatcgatttcatcgggaagcttgtctttggattcgaaaagggtccttcagtgcttgacgcttctagaggctctggccagccattggttgatgattgggattgtctgaagacgatggtgcgagttttcgagtcccaatgcggatcactcactcagtatggcatgaaacacatgagggcgttcgccaacatatgcaacaatggcatctccgaggccgagatgaaggaggcaagcatcagcgcttgcgacgattacgacatggggaagtggagcccgctggttcgagggcacagcgcctgatccgctgcactgcagtacatgggagcagtaccaaatgctccagaggttcctagctagacctcatatatggtgtacatacataatacattggtatacgtacaagaaaacaccaacaatgacgccccatgtggtgttgggttaatcagtagtttatgatcgtgctcgtgcctttgtaaatcaaaaataactgcaatcaattgaaaggcaatgattattatgtagc

SEQ ID NO: 8641 - DNA, 1490 bp, Triticum aestivum
  Clone ID: PAT_TA_8641
aataaaaatccaccatgaagacctttctcatcctagccctccttgctatcgtggcgaccaccgccacaagtgcagttagagttccagtgccacaattgcagccgcaaaatccatctcaacaacaattccaccaacaacaattaccacaacaacaatttccccaacaacaattcccccaacagcaattcccccaacaacaacagttcccccaacaacaacaattaacgcaacaacaattcccccggccacaacaatcccctgaacaacaacaattcccccaacaacaattcccccagcaaccaccacaacaattcccccaacaacaatttccaataccatacccaccccagcaatcacaagaaccttccccataccaacaatatccagcaacaacaaccaccattttcgcagcaacagcaaccaccattttcacagcaacaacaaccagttctaccgcaacaacaattcccccggccacaacaatcccctgaacaacaacaattcccccaacaacaattcccccagcaaccaccacaacaattcccccaacaacaatttccaataccatacccaccccagcaatcacaagaaccttccccataccaacaatatccagcaacaacaaccaccattttcgcagcaacagcaaccaccattttcacagcaacaacaaccagttctaccgcaacaatcaccattttcgcagcaacaacaactagttttacctccacaacaacaacaacaacaacttgtgcaacagcaaatccctattgttcagccatccgttttgcagcagctaaacccatgcaaagtattcctccagcagcagtgcagccctgtagcaatgccacaacgtcttgctaggtcacagatgtggcagcagagcagttgccatgtgatgcaacaacaatgttgccagcaattgcagcaaatccccgaacaatcccgctatgaagcaatccgtgccatcatctactccatcatcctgcaagaacaacaacagggctttgtccaacctcagcagcaacaaccccaacagtcaggtcaaggtgtctcccaatcccaacagcagtcgcagcagcagctcggacaatgttctttccaacaacctcaacagcaactgggtcaacagcctcaacaacaacaacaacaacaggtactacagggtacctttttgcagccacaccagatagctcaccttgaggcggtgacttccattgcactccgtaccttgccaacgatgtgcagtgtcaatgtgccgttgtacagcgccaccaccagtgtgccattcggcgttggcaccggagttggtgcctactgataagaaaagttgtctagtaatatatagttggaccaccgtcgtctagtcgatcgacatgtcgaggaagcggtgacaaataaagtgtcacacaacgtcatgtgtgacccgcccaaagtagtagttaaattctggaataaatacaaatgaagtgttctcctcgtccgaatcg

SEQ ID NO: 8642 - DNA, 1891 bp, Triticum aestivum
  unsure (1)..(1891): unsure at all n locations
  Clone ID: PAT_TA_8642
cccacgcgtccgcccacgcgtccggccgaccgagaagggtgatgcccctgcccctgcccctgccgcgccggcggcggaggaaggggtgacgaagtgggccgtcctcgttgccggctcctccggctacgggaactaccggcaccaggccgatgtgtgccatgcctaccagatcctgaggagggggggcctaaaggaggagaacattgtggtgtttatgtacgatgatatcgccaaaaacagcctcaacccaaggcctggagtcatcatcaaccatcctaaaggccaagatgtttacgctggtgttcccaaggactacactggtaaacaggtcaccgctaaaaacttctttgcagttctattggggaacaaaaccgcggttactgaagggagtaggaaggtgataaacagcaaaccaaaagaccacatcttcatctattatgcggatcacgggggtcctggtgttctaggtatgcccaacaggccatatatttatgctggcgacttcatcaaagtgttacgagagaagcatgcttccaaaagctattcgaaaatgattatatatgtagaagcatgtgaaagtggcagtatatttgagggtttactgccagaagatcttaatatttatgttacaacagcatcaaatgcggtcgaaaatagttggggagcatactgccctgggatgaaatcatcacctcctactgaatatgatacctgtttaggagacatctacagtgtttcttggatggaagacagtgaaactcacaatctaaagaaggaaacactcaagcagcagtacgaggtggttaaaacgagaacatcaaaatcaaaggaattcgataagggttctcatgtcatggagtatggtgacaagacattcaaggacgagaagcttttcctttatcaaggttttgatcctgcaaattccaatgtagcaaacaggctgcttttgcccgacctggggggtgcaatcaatcaaagagatgctgatattcttttcatgtggaaaaggtatgagaagttaaatgggggatcgggagaaagcagagggttcttagggagatcaaagaaactgtggtacacaggaagcatctcgacagcagtatcgatttcatcggaaagcttgtctttggatttgaaaatgggccttccatgattgaggctgctagaagctctggccaaccattagtcgacgattgggattgcctgaagaggacggtgcgagttttcgaatcccagtgtggatcacttactcagtatggcatgaaacacatgagggcgtttgcaaacatatgcaacaatggcatctccgggcccgaaatgagggaagcaagcatcagcgcttgtggcggttacgactcggccaagtggagcccactggctgtagggcacagtgcctgatccgctgcactgcagtacatgggagcaaatagcaaatgcttcagaggttcctagacctcatatggtgtacatacatgcactgatttacaagaaaccacccaacgatgagccccatgtggtgttgggttaatcagtagtttatggttgtgcctttgtaagtttcactgcaagcaattgaaaggcaattactaattaacaaaaaatgtgtggattttcctttagctctagtggctctagcttggccacttgcagcaccagttagcaatttggctgcaacctttgcttgagcggctgtgacttcatccatttcttgctctttctcttgagaatccacaatctttagtggtctcttccttggagctcttggcttggaaggaggcttagaagctaagaccttccctttnccttgttggtgcgttttgaacaaccggattcttactatgtggagcattgggagctgtgacttcatcaatattctaagtgacccttgttg

SEQ ID NO: 8643 - DNA, 873 bp, Triticum aestivum
  Clone ID: PAT_TA_8643
aaatcaaaaaatgcctttttaaaagtttatttaaggaggatgtattgaagcgcaaccctcattattttattataattattaggtgcccgatgggggcgggcatcgcacaacctcgacgatagctccgtccgccattaatcaaacgatgggatgctcatcggcgccgttgttgccgcctacatggaggttgaggccatagctcatgcactggtgcacacacagttccatccttgacgggtcatggtagtgatgttggcacttcatctcgcaaaaagctgtgctaggatgatgatgctcccggccgtggcactcgttcacgcaccgtcgtctcccggcggggtctcgccagtgctggcacttgatgtcgcacatgtcgttgcttcggtcgtcggcaccccagccggcctccacctcccaggcgtgggtatggtgatcgacgccgttgttgctgtccgcatggagcttgatgccatagctcatgcactggtgcacgcacagctccatccttgatgggtcgtggtagtgatcttggcacttcatttcgcaaaaagctctgcaagaatgatgaagcttttgtctgtggcactcgttcacccaccgtcgtctccatgggagatgttgcccgtggtgacacttgatgtcgcacatgtcgttgccgtggtcatggacaagcccaccgacctcctcctccacctccgcggctacggtggccgtggccccatcctcctgctccgctcctacggccgcagcagcgagcagcaccgccacgagaaagaggaaccaccaaacaccacccttgtgaacgaacaccattgctgtgtacgcgagcctaggagagacagatgacaacggaatggagaagcgggaggccgg

SEQ ID NO: 8644 - DNA, 575 bp, Triticum aestivum
  unsure (1)..(575): unsure at all n locations
  Clone ID: PAT_TA_8644
atcaaaaccaagcaaaactagttagcaccaatccatcatgaagaccttcctcgtctttgcccttctagccgttgtggcgacatctgccattgcacagatggagactagctgcatccctggtttggagagaccatggcagcaacaaccattacaacaaaaagagacatttccacaacaaccaccatcttcacaacaacaacaaccatttcctcaacaaccaccatttttgcagcaacaaccttcattttcgcagcaaccactattttcacagaaacaacaaccagttctaccacaacaaccaagcattttcgcaagcaacaacaaacaagttctaccacaacaaccaagcattttcgcaagcaacaacaccaacagcttctggcaacaacaaatccctattgttcatccaatccattttgcaagcaagctaaacccgtgcaaggtattcctccaagcagcagtggttagccctgtgggcaatggcacaacatctggctaagtcgcaaantggcagcaagacaattgcaagtgatgcaacaacaagttgccaacaatggcacgatcccgacatcccg

SEQ ID NO: 8645 - DNA, 1248 bp, Triticum aestivum
  Clone ID: PAT_TA_8645
cccacgcgtccggtccacaacacacatcaaacccatcccatccatcctttcaagcgagacaagagaggccgagcgagcaatggcgcccatgctcaagcggatcgcggaggacgagcccaagaaggcggcgtacgtgaccttcctcgccggctccggcgactactggaagggcgtggtgggcctggccaagggcctccgcgctgtcaagtcggcctacccgctcgtggtggccgtgctccccgacgtccccgaggaccaccgccagaagctgctcgcccagggctgcctcgtccgcgagatcgtgcccgtctacccgccggagagccagacccagttcgccatggcatactacgtcatcaactactccaagctccgcatctgggagttcgtggagtacgagaggatggtgtacctggacgcggacatccaggtgtacgacaacgtcgaccacctcttcgacctcgagaagggcagcttctacgccgtcaaggactgcttctggcgagaagacgtggagccacaccaagcagtacgagatcggctactgccagcagtgccccgacagggtcgtctggccggagcgcgacctcggcgtgcccccgccgccgctctacttcaacgccggcatgttcgtgcacgagcccagcatggccaccgccaaggccctgctcgacaagctcgtcgtcaccgaccccacccccttcgccgagcaggacttcctcaacatgttcttcagggacgtgtacacgcccattccgcccgtctacaacctcgtcttggccatgctctggaggcaccccgagaacatccagctccacaaggtcaaggtcgtccactactgtgcagcgggttcgaagccgtggaggtacaccggcgaggaggccaacatggacagggaggacatcaagatgctggtcaagaaatggtgggccatctacgacgacgagagcctcaactacaagcctgccgccgacccgctgcgtgctgccctcgccgaggtcgtcgccgtcaagtccttcccggcgccctcggctgcataggctcgctcgctgcaaaaaggcgtgtaatggtccttaataaataggaatatatccaaaattagggatttcctcagtacgtaatatcgtggtcgattcagtatctgcatgttttggtattgtagatcatcaatggatcatatatatacagtgttcttttcttgattgaggtaaaaaaaaaaaaaaaaaaaaaaaaaaaaaaaaaaaaaaa

SEQ ID NO: 8646 - DNA, 878 bp, Triticum aestivum
  Clone ID: PAT_TA_8646
cccaacaatcattcccccagcaaccagaacaaataattccccagcaaccgcaacaaccattccccctacaaccgcaacaaccattcccccagcaaccagaacaaataatttcccagcaatcccaacaaccattctctctgcagccacaacaaccattttcccagccccaacaaccattatcccagcaaccaggacaaataattccccagcaatcccaacaaccatgccccctccaaccacaacaaccattcccccagcaaccagaacaaataattcgccagcaaccgcaacaaccattcctcctacaatcgcaacaaccattccaccagcaaccagaacaaataatttctcagcaaccccaaaaaccattctctctgcagccccaacaaccattttcccagccccaacaaccatttccccagcaaccaggacaaataattccccagcaaccccaacaaccattctccctgcaacctcaacaaccattcccccagcaactccaacaaccattcgctctgcaaccacaacaatcgttcccccagcaaccacaacaaccatttccccaaccccaacaagcattcccagaacaagcagaacagataattccccagcaaccctaacaaccattccctctgcagccacaccaacctcagcaaccttatccacaacaacaaccatctggagtagcggtataggcatcaggggccaatgaaacgaagagctatagtactagaccggtggatcatcggcgtttagtcaatggagtgttcagtgtaacgatgataaataaaagtgatgtgtaccatcatgtgtaacaccgacctatactagttcaaacatgagaataaaagacaaagaaagttatgtcacaaggacat

SEQ ID NO: 8647 - DNA, 1026 bp, Triticum aestivum
  Clone ID: PAT_TA_8647
tttttttttttcttaatacacctttatttgtattttatttcagaatttaaacaactagtttgagcgggtcacacatgacgttgtgtgacactttatttgtcaccgctacattgacatatccatcgactaaacaacggtgatccaactatatattactagagacctttccttattagtaggaaccaactccggtgccaacaccgaatggcacactagtggtggttctatacaacggcacattgacacggcacatcgttggcagggtacggagcgcaatggaagtcatcacctcaagctgagctatctggtgtggctgcaaaaaggtaccttgtgccaattgttgttgttgaggttgttgcccgagttgttgttgtgactgctgttggggttgggaaacacattggcccaactgttggggttgctgctgaggagtttggatggaaccctgaacctgttgttgttcttgcaggatgatggagtagatgatagcacggattccctcatagcaaacattcaaacaacaacaaccaccattttcgcagcagcaacaaccatcttcacaacaaccaccttttccacaacaacaccaacagtttccacaacaacaaatccctgttgttcaaccatccgttttgcagcagctaaacccatgcaaggtgttcctccaacagcagtgtagccatgtggcaatgtcgcaacgtcttgctaggtcacaaatgtggcaacagagtagttgccatgtgatgcaacaacaatgttgccaacagctgccgcaaatccccgaacaatcccgctctgaggcaatccgtgccatcgtctactccatcatcctgcaagaacaacaacagggttttgtccaacctcagcagcaacaaccccaacagtcgggccaaggtgtctcccaacaccaacagcagtcgcagcagcagcagcaactcggacagtgttctttccacaacctcaacaactacaacaattgggtcagcagcctcaacaacaacagataccacagggtatattcttgca

SEQ ID NO: 8648 - DNA, 1129 bp, Triticum aestivum
  Clone ID: PAT_TA_8648
tttttttttaatattagttgaaggcttttcaagcgcagcagtacatctgcaccatatgacgctataggcattattaccgtcactaccacggcaacaacaagaacatgcaaagtttaaaaagctcgcgtacaataaactaataatccaaaaccttttcccagcgactggtcggcccatagataacagtactagaagttgagctgcgcaagcctcacttcgtctacccctccctcctccaagatgaagtagattgcactcccagcttcagactactacttgtggatcgagcgccgctgcgcatcggcgccatcagctacctttttttcacttcaagtcgaacgatggtatcggagggctgggcgtatcaaagctctctaatatctccgacttgccgccgctgccgctgggcttcttctcctcctccttcttgccgaagaggccgccgaaccaactacccccgccgctggagctcacgacctccacagggggcacgggtggctggggcatgcctgggaagccgccgacgcctccccccgccatcgcggcggccaggttggggtcgtcggtggggagcggcgggaggttctgcggcgcggcgaggacgcggttgagcatgaggccggcgccctcgatgagcgcgaggaggcagccgcccatgagcgcggagcggccggcggcgccggggccctggcgcatggagaggaagccacccgtggcggcgccggcgatgatggagttccaggggtcctccttctggcgcacgaagaccatggtgcagtcgaaggcggagaagaggccgccccagacggcgaagctcccgccgacgcgcggcgcgttgaggcgcacctgctgggccccgcccagcaggcgctcgccgttgggcgagttgtaggtgcccttgaggaaatggaagacggagccgcccaccgcccccatcccgaacgcgccgcccacgtcgtcgaggatgcggtccgggcacggctcccgcgaggtctccggcgtgcccatctcctcctcctgcggcgattcggcggcgggggcggcggcggcgcggggaaaccctaggtcccgggcggcggctggcgtggggaggaagaagaaaggggtgggggagcggacgcgtgaacga

SEQ ID NO: 8649 - DNA, 1505 bp, Triticum aestivum
  Clone ID: PAT_TA_8649
gccggctcttctggctacgggaactaccggcaccaggccgatgtgtgccacgcctaccagatcctgaggaaggggggcctaaaggaggagaacattgtggtgtttatgtacgatgatatcgccaaaaacgacctcaacccaaggcctggagtcatcatcaaccatcctaaaggcgaagatgtttacgctggtgttcccaaggactacactggtaaacaggtcaccgctgaaaacttctttgcagttctattggggaacaaaaccgcggttactggagggagtaggaaggtgataaacagcaaatcaaaggaccacatcttcatctattacgcggatcatgggggtcctggtgttctaggtatgcccaacaggccatatatttatgctggcgacttcatcaaagtgttacgagagaagcatgcttccaaaagctattcaaaaatgattatatatgttgaagcgtgtgaaagtggcagtatatttgagggtttattgccagaagatcttaatatttatgttacaacagcatcaaatgcggtcgaaaatagttggggagcatactgccctgggatgaaatcatcacctcctgctgaatatgatacctgtttaggagacatctacagtgtttcttggatggaagacagtgaaactcacaatctaaagaaggaaacactcaagcagcagtacgaggtggttaaaacgagaacatcaaaatcaatggaattcgataagggttctcatgtcatggagtatggtgacaagacattcaaggacgagaagcttttcctttaccaaggtttcgatcctgcaaattccaatgtagcaaacaggctgcttttgcccgacctggagggtgcaatcaatcaaagagatgctgatgttcttttcatgtggaaaaggtatgagaagttaaatgggggatcggaagagaagcagagggttctcagggagatcaaagaaactgtggtacacaggaagcatctcgacagcagtatcgatttcatcgggaagcttgtctttggatttgaaaatgggccttcaatgattgaggctgctagaagctctggccaaccactagtcgacgattgggattgcctgaagaggacggtccgagttttcgaatcccagtgtggatcacttactcagtatggcatgaaacacatgagggcgtttgcaaacatgtgcaacaatggcatctccgaggccgaaatgagggaagcaagcatcagcgcttgtggcggttacggctcggccaagtggagcccactggctgtagggcacagtgcttgatccgctgcactgcagtacagaggagcaagtagcaaatgctccagaggttcctagacctcatatggtgtacatacatgcactgatttccaagaaaccacccaacgatgcgccccatgtcgtgttgggttaatcagtagtttgtggtcgtgcctttgtaagtttcagtgtttcactacaatcaattgaaaggcaattactaattaacaaaaaaaaaa

SEQ ID NO: 8650 - DNA, 950 bp, Triticum aestivum
  Clone ID: PAT_TA_8650
cgttcccccactcctggtctctctcccgctcctatcctctcctcccctcctcgcgccgccgccggcgcccacgccgcggcttccgctccccccccccccccccagccaagatgaatgttgaaaagctcaagaagatggcaggtgccgtgcgcaccggagggaagggtagcatgcgcaggaagaagaaggctgtacacaagaccacaactacagatgacaaaaggctccagagtacgctgaaaagagtaggagtgaacaccatccctggtatcgaagaggtcaacatctttaaggatgatgtggttattcagtttctcaatcctaaagtgcaagcttcgattggtgctaatacatgggtggtcagtggaactccacagacaaagaaactgcaagatctgctgccatcaattatcaatcaacttggtcctgacaacttggacaacctgcggaggcttgcagagcaattccaaaagcaggtccccggtggtgctgctggcatcgaggctggtgccagtgcaggtgctgctcaggctgacgacgatgatgatgttcctgagcttgtccctggagagacatttgaagaggccgctgaagagaaaaaggcagagtcgtgattttgatgcatgtttactgttgtgaagggttataagttaagcggcgctattagagaccacctcccctttcaagaattctgacctaccttatttgtgccagtggaccggttttgtcatgtacgcgagtttcgtctgatatgttggtggaattttgcatcaaaatacatgcctcttttggttgccctcattctcaaatcgtgtctttaaaatgtttcactcccaaccctatgtaccttcatcataactgtgctattgttttgtccatggatctgtgatttatcactagaggtaatctgagcttatcagcactgtaaaatcggattatgctgtcaccaa

SEQ ID NO: 8651 - DNA, 827 bp, Triticum aestivum
  unsure (1)..(827): unsure at all n locations
  Clone ID: PAT_TA_8651
tcagactaacatacacgacttaactcagagactcaccacaagtacacagtgcaatatacggcaaaatgcatgaacttccattgagactcatccaagcctcgaagcagcatgacttaaactcttgcaccatcaagaaacgaaccaaaaacaaaaatactagaaccacatctctgcccctattgagttcaactatcgcagataacagacagacgtgacataggttccacataatcaagacactgtcctaaaagcgcattattttaaatttgatagtctgcgctctccttagaaagcttcacggtcaccaccatagccaccgccacctcggccaccaccgccgtagccgccgccgccgccaaagccaccacctcctccatagccaccgccgccgcgtgagaagccgccaccacccgaaggtctctcattggcgaagttcacacggacgttcctccctgcaagctcctgaccgtccatgccttttgcagcgctatctgcatcagcttcattcgcaaagctcacaaaaccaaaccctctagaccttccagtctctcgatcagtgatgacacgtgcctcaacgacctctccaaagctttggaacgcctccttcagcgaatgatcgtcagtagcccaggccagaccgccgacgaaaagcttattgccagatttgctcccaacctccttcagcttctggttgctgctgtctttagctaaatcatccttcgtcttgttagctgatccagtggctttctccttgccttctttcttaatctcaacggcagttttaggtgtccccttggcatccttgacagcagttttccccttnccga

SEQ ID NO: 8652 - DNA, 738 bp, Triticum aestivum
  Clone ID: PAT_TA_8652
caacaacaacaacaacaacaacaacaaatccttcaacaaattttgcaacaacaactgattccatgcagggtatgttatcttgcaacaacacaacatagcgcatgcaagctcacaagttttgcaacaaagtacttaccagctattgcaacaattgtgttgtcaacaactgttgcagatccctgagcagtcgaggtgccaagccatacataatgttgttcatgctattattatgcatcaacaagaacaacaacaacagttgcaacaacaacaacaacagcaactgcaacaacaacaacaacaacaacaacaacaacaacaacaaccgtcaagccaggtctccttccaacagcctcagcagcaatatccatcaagccaggtctccttccagccatctcagctaaacccacaagctcagggctccgtccaacctcaacaactgccccagttcgcggaaataaggaacctagcgctacagacgctacctgcaatgtgcaatgtctacatccctccacattgctcgaccaccattgcgccatttggcatctttggtaccaactgagaagagaagaactctagtactagatatatgaaacaccgttttcttagtccatgatttggtcgttgtagcagtgaaaaaataaagtgacatgcactatcatgtaagaacccgaactatactagttcaaacttgggaataaaagacaaacacatgtcttgtctaaaaaaaaaaaaaaaaaa

SEQ ID NO: 8653 - DNA, 820 bp, Triticum aestivum
  Clone ID: PAT_TA_8653
ggggaggatgtattgaagcgcaaccctcattattttcttataattattaggtgcgcgatgggggcgggcatcgcacaacctcgacgatagctccgtccgccattaatcaaacgatgggatgctcatcggcgctgttgttgcctcctacatgaaggttgaggccatagctcatgcactggtgcacgcacagttccatccttgacgggtcatggtagtgatgttgacatttcatctcgcaaaaagctctgctaggataatgatgctcccggctgtgacactcgttcacgcaccgtcgtcttccggcagggtcttgccagtgctggcacttgttgtcgcacatgtcgttgcttcggccatcggcacgccagccgaccaccacctcccaggcatggggatggtggtcgacgccgttgttgctatccgcatggagcttgaggccatagctcatgcactcgtgcacgcacagctccatccttgacgggttgtggtagtgatcttggcacttcatttcgcagaaagctctgctaggatgacgaagctcttgtctgcggcactcgttcacgcaccgtcgtctccaggcgagatgttgcccgtgttgacacttgatgtcgcacatgtcgttgcctggtcatggacacgcccaccgacctcctcctccacctccgcggcgacggtggccgtggccccatcctcctgctccgctcctacagccgcagcagcgagcagcaccgccgcgagaaagaggaaccaccaaacaccaccctccccaacgaacaccattgctgccgacgcgagactaggagagaccctcgtgccgaat

SEQ ID NO: 8654 - DNA, 877 bp, Triticum aestivum
  Clone ID: PAT_TA_8654
ccatatctgcagctgcaaccatttccgcagccgcaactaccatatccgcagccgcaactaccatatccgcagccgcaaccatttcgaccacaacaaccatatccacaaccgcaaccacagtattcgcaaccacaacaaccaatttcgcagcagcagcagcagcagcaacaacaacaacaacaaaaacaacaacaacaacaacaacaacagatccttcaacaaattttgcaacaacaactgattccatgcagggatgttgtattgcaacaacacagcatagcgtatggaagctcacaagttttgcaacaaagtacttaccagctggtgcaacaattgtgttgtcagcagctgtggcagatccccgagcagtcgcggtgccaagccatccacaatgttgttcatgctattattctgcatcaacagcaacaacaacaacaacaacaacaacaaccgttgagccaggtctccttccaacagcctcaacaacaataaccatcaggccagggctccttccagccatctcagcaaaacccacaggcccagggctctgtccagcctcaacaactgccccagtttgaggaaataaggaacctagcgctagagacgctacctgcaatgtgcaatgtctatatccctccatattgcaccattgctccagttggcatcttcggtactaactgagaagagaagaactctagtagtagatatatgatacaccgttttcttagtccatggtttggtcgttgtagcggtgaaaaaataaagtgacatgcactatcatgtaagaacccgaactatactagttcaaacatgggaataaaagacaaacacatgtcttgtctacatatgattgtttgtttgagttccaaaaaaaaaa

SEQ ID NO: 8655 - DNA, 928 bp, Triticum aestivum
  unsure (1)..(928): unsure at all n locations
  Clone ID: PAT_TA_8655
cccacgcgtccgcccacgcgtgcgagaggggggccaaaaaatcttgtacttggaagctgcgaaattctcgaaacagccgggcagggggcgcttggaacactatataaagttttagaatctgccattgcagatagagagaacgggtcatcagctcaggggcaaataatttgggtccactttggggtgaatagtggtgcatcacggtttgctcttgagaatcaagctgtgaatgaagccaccttccgctgcccagatgagcttgggtggaaacctcagagagtcccgattgtcccgtctgatggaagcatctcacggacaagagagactacactgccagtgaaagagttaaccaagtcactccgaaagacaggctacgatgtgatgccttcggatgacgccgggcgattcgtgtgcaactatgtgtactaccactctctcccggttcgcggagcagcacggcatcaagtctctgtttgtgcatgtgccccctcttctcgacggtcgacgaggaggtccagatccatttcgtcgcttccctcgtcgaagctctcggctagcttgaactaggaacgacaactcaaaaggtcagcggtttgacctggaaaatgtaaagttggacgcagactgaataagattgtgtggtgattggcgcctattggtcagatcttgctccaaagaagggtgtatttaaggggagagaaaaaagaaaaacgatgcttagagtgtgtgtgaaatgccggcttgcatgccatcagttacatgtccttaacctgcatgaaaacctggttccaataaaattgacagatcgtcggagtggatgcangcgcgtgcgtgtgatgcgatttgttgatgccgtgtttttctcgttcttgcgtttcgatgctttggtgaatggtggcatcncattntgatcangngccatatttca

SEQ ID NO: 8656 - DNA, 752 bp, Triticum aestivum
  unsure (1)..(752): unsure at all n locations
  Clone ID: PAT_TA_8656
atgtcatcttgcaacaacacaacatagcgcatgcaagctcacaagttttgcaacaaagtacttaccagttgttgcaacaattgtgttgtcagcagctgtggcagatccccgagcagtcgcggtgccaagccatccagaatgttgttcatgctattattctgcatcaacaacaacaacgacaacaacaacaacaacaacaacaacaacaacaacaacaacaacaacaacaacaacaacaacaacaacaacaacaacaacaacaacagcagcaacaaccgtcgagccaggtctccttccaacagcctcagcaacaatatccatcaggccagggctccttccagccatctcagcaaaacccacaggcccagagctctgtccaacatcaacaactaccccaatttgaggaaataaggaacctagcactgcagacgctaccagcagtgtgcaatgtctacatccctccatattgctcgaccaccattgcgccatttggcatcttcggtactaactgagaagagaagaactctagtactagatatatgaaacactgttttcttagtccatggtttggtcattgtagcggtgagaaaataaagtgacatgcactatgcatgtaagaacccgaactatactaagttcaaacttgggaataaaagacaaacacaggtcttgtctacaaaaaaaaaaaaaaaaaactcnagggggggcccggtaccaattcgcccctaatagtgagtcctattacccngcgc

SEQ ID NO: 8657 - DNA, 933 bp, Triticum aestivum
  Clone ID: PAT_TA_8657
tttccagggcagcaacaaccatttccaccacaacagccatatccgcagctgcaaccatttccatcacaacaaccatatatgcagctgcaaccatttccgcagccgcaactaccatatccgcagccgcaactaccatatccgcagccgcaaccatttcgaccacaacaatcatatccacaaccgcaaccacagtattcgcaaccacaacaaccaatttcgcagcagcagcagcagcagcagcaacaacaacaacaacagatccttcaacaaattttgcaacaacaactgattccatgcagggatgttgtattgcaacaacacagcatagcgcatggaagctcacaagttttgcaacaaagtacttaccagctggtgcaacaattgtgttgtcagcagctgtggcagatccccgagcagtcgcggtgccaagccatccacaatgttgttcatgctattattctgcatcaacaacaacaacaacaacaacaacaacaacaacaacaacaacaacaacaaccgttgagccaggtctgcttccaacagtctcaacaacaatatccatcaggccagggctccttccagccatctcagcaaaacccacaggcccagggctctgtccagcctcaacaactgccccagtttgaggaaataaggaacctagcgctagagacgctacctgcaatgtgcaatgtctatatccctccatattgcaccattgctccagttggcatcttcggtactaactgagaatagaagaactctagtagtagatatatgatacaccgttttcttagtccatggtttggtcgttgtagcggtgaaaaaataaagtgacatgcactatcatgtaagaacccgaactatactagttcaaacatgggaataaaagacaaacacatctcttgtttacatatgattgtttgtttgagttcc

SEQ ID NO: 8658 - DNA, 1816 bp, Triticum aestivum
  Clone ID: PAT_TA_8658
cccacgcgtccgaccaccaccaccgcaccctcctccctcctccctcgtttcccccgcgtccgcgtgctgtagcagcttagcgccaacccacgaaatcaatccccaatccctgcctcctccgcccgccaaccctagccccgcgccctcccgcatggacgacgacgacgccgggggcggcggcgacgcgtccccgcagcacgagggcgggggcggggcggtggtgatcgagcgcggggcgggggcgacggcgcccgcgcgggacgccgcggcggcctcgccgacgagctcgcgctccgtgacggagacggtcaacggctcgcaccggttcgtcatccagggctactccctcgccaagggcatgggcgtgggcaagcacatcgccagcgagaccttcgccgtgggggggtaccagtgggcgatctacttctacccggacgggaagaaccccgaggacaactccgcctacgtctccgtcttcatcgcgctcgcctccgagggcaccgacgtccgcgccctcttcgagctcaccctccaggaccagagcggccggggcaagcacaaggtgcactcccacttcgaccgcgccctcgacgccgggccctacaccctcaagtaccgcggatccatgtggggttataaaaggttttttcgacgcactgcccttgagacatcggactttcttaaagatgattgcttgaagataaattgcactgtgggcgttgtaacatcaaccatggagtactctaggccgcattctctagaggttccggattctgacataggccaccattttgggacgcttttggaatctcaagagggtgcagatgttatttttagtgtagcaggagagaagtttcatgctcataagttagtgttggctgcgcgatcttctttttttagatctgaatttcttgatcctgaatcagatgaagaaaacagtgaagtcgacactagtaacgaaatcaaagagattgtcatcgacgacatggagccaaaagtctttcaggctgtgcttcacttcatgtacagggacaatcttgtcggtgatgacgaattgtctgcatcaagctcagattgtcccatctttgatactttagctgggaagttgttggctgcagcagacaaatatgagttgccaaggctaagagtgttatgtgaatcttacttgtgcaaacagatttctgtaaaatctgtggcaactactctagcgctggctgatcggcatcatgctacagagctcaagtccgtctgcctaaaatttgctgctgagaacctttcagctgtaatccggaccgacggattcgattacctcaaagacaactgcccggcgctgcagtcggagatcctccggacggtagccgggtgcgaggaggaatgcagcagcggcggcaagagccagagcgtgtggggccagatctcggacggcggcgacaccagcgggcgcagggtgaggcccagggtctaacgccgccaccgccagcaagcactgacctgtatgtgttagccagctgccgctgctgtataaattcgtaacagccatttgattttgtgacagatcttcttgtaataatagtagcatccgctctgttgtagtactaccttctttgttcataaccgttttgttggataatttaccttcttttttaaaaggagaactttgcttcgcttaacagttaataagcttgcctttatcaagcggagccactacgtcagttgatgaggtgaacaactgagactggccacgttagctcagtctcaaagaatacatttggattgtatgaaaaaaaaaaaaaaaaaaaaaaaaactcgagactag

SEQ ID NO: 8659 - DNA, 1880 bp, Triticum aestivum
  unsure (1)..(1880): unsure at all n locations
  Clone ID: PAT_TA_8659
cctctctaggctctagcacacgcacatgatgaactcgagggtggcgatggccgcgtggtgggtttgtggactcctcccgcttctgctgctggcggtggccgcggatggggactcggagccgctgatccggctgccgacggagaacgggcatgcccctgcccctgcgcctggccctgccgcgtcagcgccggaggaaggggtgacgaagtgggccgtgctcgttgcgggctcctccggctacgagaactaccggcaccaggccgatgtatgtcacgcgtaccagatcctgaagaagggaggactcaaggatgagaacatagtggtttttatgtacgacgatatcgccaacagccctgaaaacccaaggcgtggggtcgtcatcaaccatcctaaaggcaaagatgtttaccatggtgttcccaaggattacaccggtgagcacgtcactgctaaaaacttgtatgcggttctcttggggaacaaaactgcggtcaccggagggagtaggaaggtgataaacagcaaaccgaatgatcacatcttcatctactacacggatcatgggggtgctggttcacttggtatgcccaacgtgccgtttgtttatgctggcgacttcatcaaagtgttacggcaaaagcatgcttccaaaagctattcgaaaatgatcatatatgttgaagcgtgtgagagtggcagcatctttgagggtttaatgccacaagatcacaatatttatgttacaacagcagcaaatgcggaagaaagtagctgggcagcatactgccctgggatggaagtaccacctccttctgaatacaagacctgtttaggtgacgcatacagtgtgtcttggatggaagacagtgaaactcacaatctgaagaaggaaagcatcaagcagcagtacgaggtggttaaagcgagaacggcacccccaaacgagtccagtattggctctcatgtcatggagtatggtgacaagacattcaagggtgacatgcttttcctctatcaaggtttcgatcctgcaaagtcatactccagttatttcaggcagcgtttgcccagcctcaagggtgcaatcaatcaaagagatgccgacattcttttcatgtggaagaagtatgagcagttaaatggtggatcagaggagaagcagagggctctcacggagatcaaagaaactgtgctacacaggaagcatctcgacagcagtatcgatttcatcgggaagcttgtctttggattcgaaaagggtccttcagtgcttgacgctgctagaggctctggccagccattggtcgacgattgggattgtctgaagacgatggtgcgaattttcgagtctcagtgcggatcactcactcagtatggcatgaagcacatgagggcgttcgccaacatatgcaacaatggcgtctccgaggccgagatgaaggaggcaagcatcagcgcttgcgacgattacgacatggggaagtggagcccgctggcttcgagggcagcagcgcctgatccgcctgcactgcagtacatgggagctgtacgcctgtaccaaatgctccagaggttcctagctagacctcatatatggtgtacatacaaacatacataatacattggtatacgtacaagaaaacacccaacaatggcgccccatgtggtgttgggttaatcagtagtttatgatcgtgctcgtgcctttgtaaatcaaattttactgcaatcaattgaaaggcaatgattattatgttaaaaaaaaaaaaaaaaaaactccgangggggggcccgggtaaccaatttccccctaanaagtgaggtccctttttaaccnnccccncaatnggccgtcctttttaaaaaagttcctngactgg

SEQ ID NO: 8660 - DNA, 1411 bp, Triticum aestivum
  Clone ID: PAT_TA_8660
aattcggcacgaggctccgccgcgccgccacagccggtcaggtgcgcctcctccgtcaaccagcggccgcggcagcgaagccgccggatcgatcgagaggatagccgccgtcctcccgctcccgagcttcagcatcatctgaagtgctcccaaaacaatggcggagcacttggcttcaatttttggcacggagaaggatagggtcaactgccccttttacttcaagagcggagcttgccggcatggggaccggggctcccggctgcacaacaggccaaccacatcgccaactattgtgcttgctaacatgtaccaggggcctgatatgattacccctggagttgatgcccaaggtgtggctattgcaccagagaagatgcaggagcactttgaggacttctatgaggatatctatgaggagctgagcaagtttggtgaggttgagaccctgaatgtgtgcgacaaccttgctgaccacatgattgggaatgtctatgtccagttcagggaggaagagcaggcagtggctgctcacaatgccctccaaggccgcttctactctggtcgcccgatcattgtggagtactcccctgtgacagacttccgggaggcgacctgcaggcagtttgaggagaacagctgcaaccgtggcggctactgcaacttcatgcacgtgaagcagattggtagggagctcaggaggaagctatatggtgggcgttccaggaggagccacgggaggagccgcagccccagcccgcagcacaggagggacaaccgtgaccgtggtggtgacttccgccgtgatggccgggatgaataccgtggtggcggtggcggtggtggcggcggttaccgtggaggcgatggaggtgatggtggcggttaccgtggtgggggcggtggtggtggctaccgtggaggtgatgggggtggctatcgcggtggtggtggtggcggttaccgtggtggcgggaggggtggaggtggtggcaggcatgacaggtacgatgatggaccgaggcgcaggtacggtggcagcccaccgcggcgcggaaggagccctccagcaagggagaacagcgaggagcgcagggccaagattgagcagtggaaccgtgagcgggaggagaagaagtgatgaaccgcgggtagttttactgcaagcattatttaccttttcattcatgtgtcgttagtttgctcctatgttggtttgctgtcagacattagtgtgtgggtcgatatagtactattgcttggttgagtggcctgtcaagtgcaggattctattagaggcgtacaagctgctatttgtgctcaatattattgccggacctgttcttgtattatctgaaaagtttaccgtgttctgcttttgttggtttgatctaaaaaaaaaaaaaaaaaa

SEQ ID NO: 8661 - DNA, 1359 bp, Triticum aestivum
  Clone ID: PAT_TA_8661
cgtccgccactctctaaacccgacacaaaaactcaagcccgaacccaagaaagcttccttcccgagacgagatcaagatggctcccgagctggccggcaagatgaccgccaaggccgccgtggcggcggccaagcccgcgacgaaggcgtacgtgacgttcctggcgggggcgggggactactggatgggcgtggtggggcttgccaagggcctgcgcaaggttgggtcggcctacccgctggtggtggccgtgctgcccgacgtgcccgagctccaccgcaagatcctcgtctcccagggctgcatcgtccgcgagatcgctcccgtgtacccgcccgagaaccacacccagtttgccatggcctactacgtcatcaactactccaagctccgcatctgggagtttgtggagtacgagaggatggtgtacctcgacgccgacatccaggtgttcgacaacatcgacgagctgtttgatctgcccaagggccacttctacgccgtcatggactgcttctgcgagaagacgtggagccacaccccgcagtaccagatcggctactgccagcagtgtcccgaaaagggtgacgtggccggccgccgagatgggcccgccgccggcgctctacttcaacgccggcatgttcgtgcacgagcccagcatggccaccgccaaggcgctccttgacaccctccgcgtgacgccgaccaccccattcgcggagcaggatttcctcaacatgttcttcagggagcagtacaagccgatcccgctggtctacaaccttgtgctggcgatgctgtggaggcacccggagaacgtgcagctggagaaggtcaaggtggtgcactactgcgctgcgggatcgaagccatggaggttcacgggcaaagaggagaacatggacagggaggacatcaggatcctcgtcaggaactggtgggatatctacaacgacgagagcctcgatttcaagggcctggccgccgacgccgacgagctcgaggcggcagccaagaagccgctccgcgcggcgcttgcggaagccggcaccgtcaagtacgtcaccgcgccctcggctgcgtaatccccggtcgcatagctccggcccgtgccactgtggtcatcaaagcaggaagccgggcacctataagcatttgcattttggtatttttgcgtctgttcggttccaagttagcagtatatcatttcaagttaaagataggaggtttgatcgaaacagtctacgtatgtgaataccctcagaccctttgtgaagcagagtgctgtctcgtcctgtatgaaagaattatgtgtgaatcaataggaagctgcaaaaattaggcatatttttcac

SEQ ID NO: 8662 - DNA, 792 bp, Triticum aestivum
  Clone ID: PAT_TA_8662
tgctgacgcgtgggtcgtcgtccaacccctccgacctcacacccaactttgcctttccccatccctctgcgccctcgccgtccgcggatcaaccgatttcgcacgcaatgtctcagactgttgaactcagggttggcatgtcatgtgagggatgtgttggagctgttaagcgggttcttggcaaaatggaaggtgttgagtccttcgatgtagacatcaaggagcagaaggtcactgtgaagggtaatgtgacgccggatgctgttctgcagactgtttcgaagacaggcaagaagacatcgttctgggaggctgaaccctcggcatctgctgtttcgtcctaaaaaggcatctctaatatgtaaactgtgaagtttaatgtaacaatggcccagttgaaatgctttgcaaggacatgattttctggtcggatggtatatgcaccatgaatttactgcaaataatagcaaactggtaatttcgtctgtgtgcatcttatggttggcattcctacactgtaaatctgcaatggttcgatcagtttgccacatgtgctgataatgtgttatttgtggttgctgttgatgcacagcatgaataagctcataccaattcttccttcggaagaaaatgaattgcaattatctagattaatgtagaggatcctcctttttttttgataaaatgtggagtatcttccttggaatagaggaagaggggaaaacccatgtctatctctttggttaacaaaattcagaatcagttgcaagggagcatttttttagggtcgat

SEQ ID NO: 8663 - DNA, 1353 bp, Triticum aestivum
  Clone ID: PAT_TA_8663
tccgccgcgccgccacagccaggtcaggtgcgcctcctccgtcaacccccggccgcggcagcgaagccgccggatcgatcgagacgatagccgccgccctcccgctcccgagcttcagcatcctctgaagtgctcccaaaacaatggcggagcacttggcttcaatttttggcacggagaaggatagggtcaactgccccttttacttcaagattggagcttgccgtcatggggatcgttgctcccgtctgcacaacaggccaaccacatcgccaaccattgtgcttgctaacatgtaccagcggcctgatatgattacccctggagttgatgcccaaggtgtggctattgcaccagagaagatgcaggagcactttgaggacttctatgaggatatctatgaggagctgagcaagtttggtgaggttgagaccctgaatgtgtgtgacaacctggctgaccacatgatcgggaatgtctatgtccagttcagggaggaggagcaggcagtggctgctcacaatgccctccaaggccgcttttactctggtcgcccaatcattgtggagtactctcctgtgacggacttccgtgaggcgacctgcaggcagtttgaggagaacagctgcaaccgtggcggctactgcaacttcatgcacgtgaagcagattggcagggagctcaggaggaagctatatggggggcggtccaggaggagccacgggaggagccgcagcccaagcccacagcacaggagggacaaccgtgaccgtggtggtgacttccgccgtgatggccgggatgaataccgtggcggcggcggcggtggcggttaccgtggaggcgatggaggtgatggtggcggttactgtggaggcggtggtggtggctaccgtggaggtgatgggggcggctatcgtggtggtggcggcggcggttaccgtggtggcggcagaggaggtggtggcaggcatgataggtatgatgatggaccgaggcgcaggtatggtggcagcccgccacgacgtggaaggagccctcctgcaagggagaacagtgaggagcgcagggccaagatcgagcagtggaaccgtgagagggaggagaagtgatgaaaccgcgagtagtggaaccgcaagcgtcattttaccttttcattcttgtgtcgttagtttgctcctatgttgagtatctgttggtttgccgtcagacattagtgtgggtcgatatattactattgccttgttgagtgacctgtcaagtgcaggattctagttgaggcgtgtaagctgctatttgtgctcgatatttatctgcaggattctcgtattatctgccaagtttacagtgttc

SEQ ID NO: 8664 - DNA, 1243 bp, Triticum aestivum
  Clone ID: PAT_TA_8664
caacaacaatcaccattttcgcaacaacaacaacaaccagggttttcgcagcaacaacaaccaccattttcacaacaaccactaatttcacagcagcaacaactaccattttcacagcaacaacaaccacaattttcacagcaacagcagccaccatattcgcaacaacaacagccaccatattcgcagcaacaacaaccaccattttcgcagcaacagcaaccaccattttcgcagcaacaacaaccatcattttcgcagcaacaacaacaaccaccatttacacagcaacaacaaccaccgttttcacaacagtcaccaatttcacagcagcagcagcaacaacaacaacaacaacaacaaccatttacacagcaacagcaaccaccgttttcacaacagccaccaatttcacagcagcaacaaccaccattttcgcagcaacaacaaccaccattttcacagcaacaacaaataccagttattcatccatctgttttgcagcagctaaacccatgcaaggtattcctccagcagcagtgcatccctgtggcaatgcagcgatgtcttgctaggtcacaaatgttgcagcagagcatttgccatgtgatgcagcgacaatgttgccagcagttgcggcaaatccccgagcaatcccgccatgagtcaatccgtgctatcatctactctatcatcctgcagcagcagcagcagcaacaacaacaacaacaacaacaacaacagggtcagagtatcatccaatatcagcaacaaccaccccaacagttgggccaatgtgtctcccaaccccaacagcagttgcagcagcaactcgggcaacaacctcaacaacaacagttggcacatggtacctttttgcagccacaccagatagctcagcttgaggtgatgacttccattgcactccgtaccctgccaagaatgtgcagtgtcaatgtgccgttgtacgaaaccaccactagtgtgccattaggcgttggcatcggagttggtgtctactgataagaaaagatctctagtaatatttagttggatcaccgttgtttagtcgatggatatgtcgatgtagcggtgacaaataaagtgtcacacaacgtcatgtgtgacccactcaaactagttgtttaaattctgaaataaaatacaaatccaggtgtattaagaaaatgttcatatcggcattgtgtggatgtcgatttgattgccaagcatgcaagttcat

SEQ ID NO: 8665 - DNA, 742 bp, Triticum aestivum
  Clone ID: PAT_TA_8665
cgcaacccagtattcgcaaccacaacaaccaatttcacagcagcagcagcagcaacaacaacaacaacaacaacaacaacaagaacaacaaatccttcaacaaattttgcaacaacaactgattccatgcatggatgttgtattgcagcaacacaacatagcgcatggaagatcacaagttttgcaacaaagtacttaccagctgttgcaagaattgtgttgtcagcacctatggcagatccctgagcagtcgcagtgccaggccatccacaatgttgttcatgctattattctgcatcaacaacaaaaacaacaacaacaaccatcgagccagttctccttccaacagcctctgcaacaatatccgttaggccagggctccttccggccatctcagcaaaacccacaggcccagggctctgtccagcctcaacaactgccccagttcgaggaaataaggaacctagcgctacagacgctacctgcaatgtgcaatgtctacatccctccatattgcaccatcgcgccatttggcatcttcggtactaactgagaagaaaataactctagtactagatatatgaaacaccgtttttctcagtccatggtttggtcgttgtagcggtgaaaaaataatgtgacatgcactatcatgtaagaacccgaactatactagttcaaacttgggaataaaagacaaacacaggtcttgtctacaaaaaaaaaaaaaaaaactcgtgcc

SEQ ID NO: 8666 - DNA, 793 bp, Triticum aestivum
  Clone ID: PAT_TA_8666
catttccaccacaacagccatatccgcagctgcaaccgtttccatcacaacaaccatatatgcagctgcaaccatttccgcagccgcaactaccatatccgcagccgcaactaccatatccgcagccgcaaccatttcgaccacaacaatcatatccacaaccgcaaccacagtattcgcaaccacaacaaccaatttcgcagcagcagcagcagcagcagcaacaacctcaacaacaacaattggcacaaggtacctttttgcagccacaccagatagctcagcttgaggtgatgacttccattgcgctccgtaccctgccaacgatgtgccgtgtcaatgtgccgttgtatagaaccaccactagtgtgccattcggtgttggcaccggagttggttcctactaataaggaaaggtctctagtaatatatagttggatcaccgttgtttagtcgatggatatgtcgatgcagcggtgacaaataaagtgtcacacaatgtcgtgtgtgacccgcccatactagttgtttaaattctgaaataaaataaaataaagttgtatcaagacaatgttcatattggcattgtgtggatgtcgatctgattgccatgcttgcaagttcataagtttgtctttcctagtcacaagcgcaacctggtgccttaattaattatccatgtgttggaataatcactatttgaatataatggtgttactgtaaaaaaaaaaaaaaaaaaaaaaactaaaaaaacattgatcacctacaaaacaaaaaacaataaacacattat

SEQ ID NO: 8667 - DNA, 700 bp, Triticum aestivum
  Clone ID: PAT_TA_8667
caaatccttcaacaaattctgcaacaacaacaactgattccatgcagggatgtcgtcttgcaacaacacaacatagcgcatgcaagctcacaagtattgcaacaaagtagttaccaactgttgcaacaattatgttgtcaacgtttgtggcagatccccgagcagtcgcggtgccaagccatccacaatgtcgttcatgctattattctgcaacaacaacaacaacaacaacaacaacaacaacaacaacaacaacaacaacaacaacaacaacaacaacaacaacaaccgtcgagccaggtctcctaccagcagcctcagcaacaatatccatcgggccagggatccttccagccatctcagcagaacccacaggcccagggctctgtccagcctcaacaacttccccagttcgaggaaataaggaatctagcgctgcagacgctaccggcaatgtgcaatgtctacatccctccatattgctcgaccaccattgcgccatctggcatcttcggtactaactgagaagagaagaacttgtactagatatatgaaacaccgtttccttagtccatggtttggtcgttgtagcggtggaaaagtaaagtgacatgcactatcatgtaagaacccgaactatactagttcaaacttgggaataaaagacaaacacatgtcttgtctgcataaaaaaaaaaaa

SEQ ID NO: 8668 - DNA, 1249 bp, Triticum aestivum
  Clone ID: PAT_TA_8668
tacggaacatctgatgagatttattagcaaggatcctcagggatatgtgccaatatcagttattgctggcttcaagaaaataaaagctttagtgcataataacccaatgcttgctgcagctctccgtacctcgtcaaaacttgttgtaagtggtgatggaaaaagagtaaaacgccgacatccatttactgaatctgatatgcaggagttccagtcccgaattgtagtggcagaaaatcttcctggtgatccttcttaccagaatcttatgaagatcttttcagctgttggcagtgtgagaacaattcgtacttgctatcctcagactccaaatggtcctggtcctgctactaatagatctgccaagctagatatgctgtttgccaacaagctgcatgcttttgtggagtatgagactcatgaggatgctgagaaggcaattctggagctgaatgatgaaaggaactggagaaatgggcttagatcacggctgctgaatacttgcatgacaaagggtccagtaaaagggaaaacgggagggcatgaaggtgatggaaatggtgaggaggacgtctccacttcaaaccaatcaaacgagagacagcttgaaggatcctttcaactgtctgatgtattgccagagcacctgtttgatgagaacaacagtgacaagcaaggtccaaagcgtggcaaaggtcgtgggcgttgtggtaaaggccgaggccgtggctaccatcaactgaacaacaatcatcattacattcacaatggcagcaaccatcaccaggttatcaacagtcgtggcagccatccagtcgggacaccaccgaacacccagcttatcatggtcgagcagctactacctgtggcaaacaaacagcctcctggtccacgtatgcctgatggcactcgtggtttcgccatgggcagggggaagccatcatcagcttcgtgcgctgttgagctttaaacccattgctatgctttcatgttgatatagatggtttcgaaccaaacctgtttcttgcatggatgtgtgctttggtatttttggactcttcgttgtggaccaatggttgatctcttgtacttgaaaactggaggtgtgctggtgtgtgtcacgcggttattgtagttctaccttttagggatttgctatttcgttagcaaggcggaagaaaatgactgaaaaagaagttgaagagtggaattgtagtgttgttttctcaataatccttgtttagacttt

SEQ ID NO: 8669 - DNA, 1796 bp, Triticum aestivum
  Clone ID: PAT_TA_8669
gccttctcttcctctctagcactctagcacacgcatgcacatgatgaactcgagggtggcgatggctgcgtggtgggtttgtggactcctcccgctcctggcgatggccgcagccgccgcggacggggtgaaggggaactcggagccgctgatccggctgccgacggagaacgggcatgcccctgcccctgcgcctggccctgccgcgtcagcgccgggtgaagaggtgacgaagtgggccgtgcttgttgccggctcctccggctacgagaactaccggcaccaggccgatgtgtgccacgcgtaccagatcctgaagaaggggggactcaaggatgagaacatagtggttttcatgtacgatgatatcgccaacagccctgaaaacccaaggcgtggggtcgtcatcaaccatcccaaaggcaaagatgtttaccatggtgttcccaaggactacaccggtgagcaggtcactgctaagaacttgtatgcggttctcctggggaacaaaaccgcggtcaccggagggagtaggaaggtgataaacagcaagccgaatgatcacatcttcatctactacacggatcatgggggcgctggttcacttggtatgcccaacgtgccatttgtttatgctggcgacttcatcaaagtgttacggcaaaagcatgcttccaaaagctattcgaaaatgatcatatatgttgaagcgtgtgagagtggcagcatctttgagggtttaatgccacaagatcacaatatttatgttacaacagcagcaaatgcccaagaaagtagctgggcagcatactgccctgggatggaaacaccacctccttctgaatataagacctgtttaggtgacgcatacagtgtttcttggatggaagacagtgaaactcacaatctaaagaaggaaagcatcaagcagcagtacgaggtggtgaaagcgagaacggcaccccgaaatgagtccagtataggttcgcatgtcatggagtatggtgacaggactttcaaggatgagatgcttttcctctatcaaggtttcgatcctgcaaagtcaagcatcaccaaaaggcagctgcttatgcccagcctgaagggtgcaatcaatcaaagagacgccgatattcttttcatgtggaataagtatgagcagttagatgggggatcggaagagaagcggagggctctcaggaagatcagagaaaccgtgttccacaggaagcatctcgacagcagtatcgatttcatcgggaagcttgtctttggattcgaaaagggtccttcagtgcttgacgctgctagaggctctggccagccattggtcgacgattgggattgtctgaagacgatggtgcgagttttcgagtcccagtgcggatcactcactcagtacggcatgaagcacatgagggcgttcgccaacatatgcaacaatggcgtctccgaggccgagatgaaggaggcaagcatcagcgcttgcgacgattacgacatggggaagtggagcccgctggttcgagggcacagcgcctgatccgctgcactgcagtacatgggagcagtatcaaatgctccagaggttcctagctggacctcatatatggtgtacatacatacatacataatacattggtatacgtacaagaaaacacccaacaatggcgccccatgtggtgttgggttaatcagtagtttatggtcgtgctcgtgcctttgtaagtcaaatttgactgcaatcaattgaaaggcaatgattattatgtagcaaaagtgtgtgaatgtctttg

SEQ ID NO: 8670 - DNA, 706 bp, Triticum aestivum
  unsure (1)..(706): unsure at all n locations
  Clone ID: PAT_TA_8670
cataactagagcacaagaatcaaatccaagtaagtagtacctaacgcaaatccaccatgaagaccttactcatcgtaacaatccttgcgatggcaacaaccatcgccaccgccaatatgcaagtcgaccccggctaccaagtacaatggccacaacaacaaccattcccccaagccccaacaaccattctgccagcaaccacaacaaactattccccaaccccatcaaacgttccaccatcaagccacagcaaacatacccccatcaaccacaacaacaatttccccagacccaagcaaccacaacaaccatttccccagccccaacaaacattcccccaacaaccccaactaccatttccccaacaaccccaacaaccattcccccaagcctcaacaaccccaacaacaatttccccagtcacagcaaccacaacaaccttttccccagccccaacaacaattcctgcagccccaacaaccgcaacaatcattcccccagcaacaacaaccgttgattcaagctatctctacaacaacagatgaacccctgcaagaaattttctcttgcagcaatgcaaccctgtgtcattggtgncatcccttanaanaatgatcttgccacgaagtgantgccaaggngatgcaacaacaattgttgccaacaaactggcacaaaaattcttcagaggtttccgggnngcagg

SEQ ID NO: 8671 - DNA, 569 bp, Triticum aestivum
  Clone ID: PAT_TA_8671
ggccgggccggggagtcgtcgtcgtcgtccaacccctccgacctcacccccaacgtttcctttcccccctccctcgcgccctcgccgtcacgcggatcaaccgatctcgcacgcaatgtctcagactgttgaactcagggttggcatgtcatgcgagggatgcgttggagctgttaagcgggttcttggcaaaatggaaggtgttgagtccttcgatgtagacatcaaggagcagaaggtcactgtgaagggtaatgtgacgccggatgctgttctgcagactgtttcgaagacaggcaagaagacgtcgttctgggaggctgaaccctcggcatctgctgtttcgtcctaaaaaggcacctctaatatgtaaactgtgaagtttaatgtaccaatggcccagttgaaatgctttgcaaggacatgattttctggtcggatggtatatgcaccatgaatttactgcaaataatagcaaactggtaatcgtttgtgtgcatcttatggttggcaacttgtcattcctacactgtaaatctgcaatggtttgatcagtttgccacatgtgt

SEQ ID NO: 8672 - DNA, 1121 bp, Triticum aestivum
  Clone ID: PAT_TA_8672
gattcaagccaagcacgcactggtcaatacaaatccatcatgaagacatttctcatcatttccctccttgctatcgtggcgaccaccgccacaactgcagttagagttccagtgccacaattgcagccacaaaatccatctctgcaacaaccacaagagcaagttccattggtgcaacaacaacaatttccagggcagcaacaaacatttccaccacaacagccatatccgcagccgcaaccatttccagcgcaacaaccatatccgcagccgcaactatttccacagccgcaaccttttccgccacaacttccatatccgaagccgcaaccatttcccccacaacaaccatatccacaaccgcaaacacagcatctgcaaccacaacaaccaatttcgcagcaacaagcacaacaacaacaacaacaacaacaacaaatccttcaacaaatccttcaacaaattctgcaacaacaacaactgattccatgcagggatgtcatcgtcttgcaactacacaacatagcgcatgaaagctcacaagtattgcagcaaagtagttaccaagtgttgcaacaattatgttgtcagcagttgtggcagatccccgagctgtcgcggtgccaagccatccacaatgtcgttcatgctattattctgcatcaacaacaacaacaacaacaacaagaacaacatcaaccgtcgagccaggtctcctaccagcagcctcagtaacaatatccatcagggcccagggctccttccagcccatctcaggcaaaatccacaggcccagggctttgtccaacctcaacgtctgccccagctcaaggaaataaggaacctagcgctgcagacgcctaccagcaatgtgcaatgtctacatccctccatattgctcgaccaccattgcgccatttggcatcttcggtactaactgagaagagaagaactctagtactagatatatgaaacaccgtgttcttagtccatggtttggtcgttgtaccgttgaaaatataaggtgacatgcactatcatgtaagaacccgaactatactagttcaaacttgggaataaaagacaaacacatgtcttgtctgcaaaaaaaaaaaaaaaaa

SEQ ID NO: 8673 - DNA, 1644 bp, Triticum aestivum
  Clone ID: PAT_TA_8673
caatttctagggcagcaacaaccatttccaccacaacaaccatatccacagccgcaaccatttccatcacaacaaccatatctgcagctgcaaccatttccgcagccgcaactaccatattcgcagccacaaccatttcgaccacaacaaccatatccacaaccgcaaccacagtattcgcaaccacaacaaccaatttcacagcagcagcagcagcagcaacaacaacaacaacaacaacaacaatttccgcagcaacaacaaccacttttaccgcaacaaccaccattttcgcagcaacaaccaccattttctcagcagcagcaacaaccaccattttcgcagcaacaacaacaaccaattctactgcaacaaccaccattttcacaacaccaacaaccagttctaccgcaacaacaaataccatctgttcagccatctatcttgcagcagctaaacccatgcaaggtattcctccagcagcaatgcagccctgtggcaatgccacaaagtcttgctaggtcgcaaacgttgtggcagagtagttgccatgtgatgcagcaacaatgttgccggcagctgccgcaaatccccgaacaatcacgctatgatgcaatccgtgccatcatctactcgatcgtcctacaagaacaacaacatggtcagggtttgaaccaacctcagcagcaacaaccccaacagtcggtccaaggtgtctcccaaccccaacaacaacagaagcagctcggacagtgttctttccaacaacctcaacaacaacaacaacaacaacaacaacaacaacaacaacaacaacaacaacaaatccttcaacaaattttgcaacaacaactgattccatgcatggatgttgtattgcagcaacacaacatagcgcatggaagatcacaagttttgcaacaaagtacttaccagctgttgcaagaattgtgttgtcagcacctatggcagatccctgagcagtcgcagtgccaggccatccacaaagttgttcatgctattattctgcatcaacaacaaaaacaacaacaacaaccatcgagccaggtctccttccaacagcctctgcaacaatatccattaggccagggctccttccggccatctcagcaaaacccacaggcccagggctctgtccagcctcaacaactgccccagttcgaggaaataaggaacctagcgctacagacgctacctgcaatgtgcaatgtctacatccctccatattgcaccatcacgccatttggcatcttcgatactaactgagaagaaaataactctagtactagatatatgaaacaccgttttctcagtccatggtttggtcgttgtagcggtgaaaaaataatgtgacaatgcactatcatgtaagaacccgaactatactagttcaaacttgggaataaaagacaaacacaggtcttgtctaaaaaaaaaaaaaaaaaaaaaaaaaaaaaaaaaaaaaaaaaaaaaaaaaaaaaaaaaaaaaaaaaaaaaaaaaaaaaaaaaaaagggggggggccgttttaaatttcccgtgggggggcccaagtttacccgtcccctgtttttttgaaaaagggggcccctatggggagtcgttttaaaacctgggcccgggcc

SEQ ID NO: 8674 - DNA, 826 bp, Triticum aestivum
  Clone ID: PAT_TA_8674
caaccatatctgcagctgcaaccatttccgcagccgcaactaccatatccgcagccgcaactaccatatccgcagccgcaaccatttcgaccacaacaaccatatccacaaccgcaaccacagtattcgcaaccacaacaaccaatttcgcagcagcaacaacaacaacaacaacaaatccttcaacaaattttgcaacaacaactgattccatgcagggatgttgtattgcaacaacacaacatagcgcatggaaggtcacaagttttgcaacaaagtacttaccagctggtgcaacaattgtgttgtcagcagctgtggcagatccccgagcagtcgcggtgccaagccatccacaatgttgttcatgctattattctgcatcatcatcaacaacaacaacaacaacaacaaccgttgacccaggtctccttccaacagcctcaacaacaatatccatcaggccagggctccttccagccatctcagcaaaacccacaggcccagggctctgtccagcctcaacaactgccccagtttgaggaaataaggaacctagcgctagagacgctacctgcaatgtgcaatgtctatatccctccatattgcaccattgctcaagttggcatcttcggtactaactgagaagagaagaactctagtagtagatatatgatacaccgttttcttagtccatggtttggtcgttgtagcggtgaaaaaataaagtgacatgcactatcatgcaagaacccgaactatactagttcaaacatgggaataaaagacaaacacatgtcttgactacaaaaaaaaaaaaaaaaac

SEQ ID NO: 8675 - DNA, 1773 bp, Triticum aestivum
  Clone ID: PAT_TA_8675
cccacgcgtccgtctgccttctcttgctctctactaggctctagcacacgcacatgatgaactcgagggtggcgatggctgcatggtgggtttgtggactcctccctctcctggcggtggggtactcggagcccctgatccggctgccgacggagaacgggcatgcccctgcccctgcgcctggccctgccgcgtcggcggcggaggaaggggtgaccaagtgggccgtgctcgttgccggctccgccggctacgagaactacaggcaccaggccgatgtgtgccacgcgtaccagatcctgaagaagggaggactcaaggatgagaacattgtggtgttcatgtacgatgacatcgccaacagccctgacaacccaagacgtggaaccgtcatcaaccatcctaaaggcaaagatgtttaccatgggcgttcccaaggactacactggtgaccaggtcactgccaagaacttgtatgcggttctcctggggaacaaaaccgcggttaccggagggagtaggaaggtgataaacagcaaaccagaggatcacatcttcatcttctactcggatcatgggtctcctggttcacttggtatgcccaacgggccagatgtttatgctgacgacttcatcaaagtgttacggcaaaagcatgcttccaaaagctattcgaaaatggtcatatatgttgaagcgtgtgaaagtggcagcatctttgagggtttgatgccacaagattacaatatttatgttacagcggcatcaaatgcggtagaaagtagctggggcagcatactgccctgatgatggaacgccacctcctcctgaatattttacctgtttaggtgacttatacagtgtttcttggatggaagacagtgaaactcaaaatctaaagaacgaaaccatcaagcagcagtacgaggtggttaaagcgagaacggcaccccgaaatgagtccattagaggttctcatgtcatggagtatggcgacaagactttcaaggaggacatgcttttcctctaccaaggtttcgatccggcgaagtcaagcatcagaaacaggccgctgcctatgcccagcctcaagggtgcaatcaagcaaagagatgccgatattctcttcatgtggaagaagtatgggaagttgaatgggggatcagaagagaagcagagggccctcagggaggtcaaagaaaccgtgctgcacaggaagcatctggacagcagtatcgatttcatcgggaagcttgtctttgggttcgacaaggggcctttggtgctcgaggctgctagaggctctggccagccattggtcgacgattgggattgtctgaagacgatggtgcgagtgttcgagtcccagtgcggatcactcactcagtacggcatgaaacacacgagggcgttcgcaaacatgtgcaacaatggcgtctccgaggccgagatgaaggaggcgagcatcagcgcttgcgacggctacgacatggggaggtggagcccgttggttcgaggctacagcgcctgatccgcttgcagtgcagtactactacatggcagcagcagcagccagagctccggaggttcctagctagacctcgtatggtgtacatacacacattggtataccgtatacatacaagaaagaagaaaccgcccaacaatggcgcccctgtggtattgggttaatcagtagtgtatggtcgtgcctttgtaaatcgaatttgactgcaatcaattgaaaggcaattattactatgtagcaaaaaa

SEQ ID NO: 8676 - DNA, 852 bp, Triticum aestivum
  Clone ID: PAT_TA_8676
cgacccctatccgttcccccactcctggtctctcccgctcctatcctctcctcccccccttgcgccgccgccggcgccctcgccgcggcttccgctcctcccccagccaagatgaatgttgaaaagctcaagaagatggcaggtgccgtgcgcaccggggggaagggtagcatgcgcaggaagaagaaggctgtacacaagaccacaactacagatgacaaaaggctccagagtaccctgaaaagagtaggagtgaacaccattcctggtatcgaagaggtcaacatctttaaggatgatgtggttattcagtttctgaatcctaaagtgcaagcttcaattggtgctaatacatgggtagtcagtggaacaccacagacaaagaaactgcaagatctgctgccatcaattatcaatcaacttggtcctgacaacttggacaacctgcggaggcttgcagagcaattccaaaagcaggtccctggtggtgctgctggcatcgaggctggtgccagtgcaggtgcagctcaggctgacgacgatgatgatgttcctgagcttgtccctggagacatttgaagaggccgctgaagagaaaaaggcagagtcgtgattttgatgcatgtttactgttgtgaagggttataagttaagcggcgccattagagacctcccctttcaagaactctgacctaccttatttgtgccagtggaccggttttgtcatgtacgcgagtttcgtctgatatgttggtggaattttgcatcaaattacatgcctcttttggttgtcctcattctcaaatcgtgtctttaaatgttccattcccagccctatgtaccccatcaaac

SEQ ID NO: 8677 - DNA, 780 bp, Triticum aestivum
  Clone ID: PAT_TA_8677
acgagagagagagagagtagagagagagagagagagagagagagagagagagagagagagagagagagagagagagagagagagagagagagagagagagagagagagagagagaggcacgccaccgctctgacctccgtacgcatttattcacccctctcccggcagttccttctcccatcatcctccaacccctccgactcgcggcacgttgcctttcccccccgcgccctaccctcgccgtccgcggatcagccgatctcgcacgcaatgtctcagactgttgaactcagggttggcatgtcatgtgagggatgtgttggagctgttaagcgggttcttggcaaaatggaaggtgttgagtccttcgatgtagacatcaaggagcagaaggtcactgtgaagggtaatgtgacgccggatgctgttctgcagactgtttcgaagacaggcaagaagacggcgttctgggaggctgaaccctcagcggcatctgctgtttcgtcctaaaaaggcacctctataatatgtaaactgtgaggtttgatgtagcaatggcccagttgaaatgctttgcaaggacatgattttctggtgggacggtggtatgtgcaccatgaatttactgcaaataatagcaaactggtaatttgtttgtgcacatcttatggttggcattcctgcgctgtaaatctgtgataattcggggaagaaattgaattgcaattcctctcccggcagggagcgtgtggtggtctcccctcctcgtcaacactcgcc

SEQ ID NO: 8678 - DNA, 685 bp, Triticum aestivum
  unsure (1)..(685): unsure at all n locations
  Clone ID: PAT_TA_8678
ctcgtgccgaattcggcacgagtctctctctctcctcgcaccgcgtcccctccctctcctgtcgcgtgcgctcggccagcaaaaagcttccacataaaggccaacaagagaaaccataatctgttgggtgccagtcaaacctcaacaacaaagtttcatgtctgatctcgacgttactctgccatctgccttcgatccttttgctgaggcaaatgctgaggatgctgggtgcaaggcccccggcgcaaaaagattatgttgcatgtgcgcatccaagcaagcgcaacgggcaggaaagagtctggaccaactgtccaagggcctgaagaagggagttcaagctacaacaaagattctcaagggattctcaaagaagggaattctgctgcaaatggcacagtatccaaggattccgggagctaaggccaaggtcattcaagcttcaaggtgattcaacgtaagaatgttgctacttccctatccaagctgggattgcnaagaaggactcancaaattcacggttcnaanccgaacccctccgataaatcccgaacgcaaccggtctatctatatgaagactaaggatcatattgcgccgctgttgaaccggttctgctgatcaatttgtgtactgntatagctgcgcgtcagcatacataaggttgcaaatntgcacaataaaaac

SEQ ID NO: 8679 - DNA, 1468 bp, Triticum aestivum
  Clone ID: PAT_TA_8679
gcggggagcgcgagggacgaaggaggggcagggcgagaccttcggggagactcccacccataccgcgccaccgagcgagcgagatcccgccctttccccttctccacccacccgccctgccggacccgatcccgatctgatctcgccgccgccgccgcgcgccggacaagatggcccccgtgtcggctctggccaagtacaagctggtcttcctcggcgaccagtccgtcggcaagaccagcatcatcacccgcttcatgtacgacaagttcgacaacacctaccaggctacgattggtattgatttcctgtcgaagacaatgtaccttgaagatagaactgtgagactccaactctgggatacagctggtcaggaaagattcaggagtttaattccaagctacatcagagactcttcagttgctgttattgtattcgatgttgcaagcaggcagtctttcttaaacacgtcgaagtggattgaggaagttcgcactgagaggggcagtgatgtcattattgtgcttgttgggaacaaaactgaccttgtggacaagaggcaagtatccattgaggaaggggaaggcaaggcaaaggacctcggtgtgatgtttattgaaaccagtgctaaagctggttttaacattaaggctctgttccgcaagattgctgctgcactgcctggaatggagaccctttcatcagcaaagcaggaagacatggttgatgtgaacttaaagtccagcaatgctaactcatctcagtcgcaggcacaggctgggggatgcagttgttagctccagtccctaacactcgcagctcatgatgtcaaagatcccatgcccatcaaacagcaaccctaccttactgcttccctctcggtctcaggaggattgattgtctcacggcagttgagtccatgatccaagtcaatgaacgagaaccattttgttggaaagatacgtttttatgtgttcttagtattttgtcagtggcctaagtgggggatgcagttgttagctccagtccctaacactcgcagctcatgatgtcaaagatcccatgcccatcaaacagcaaccctaccttactgcttccctctcggtctcaggaggattgattgtctcacggcagttgagtccatgatccaagtcaatgaacgagaaccattttgttggaaagatacgtttttatgtgttcttagtattttgtcagtggcctaagctagcaacagtgtatagttgggttggcactgtgaactcctatcgctcggctgagtattagagtaagtgattggtttatgtttcaacctatatttacatcgcccatcttgttgtgtttttctatggggtactgaatatatatatatatatatacatatatatatatatatatatatatatatattggaatttttgtaagctaataagtcctgtgttactccaggtcttcgtgccgaattcggcac

SEQ ID NO: 8680 - DNA, 923 bp, Triticum aestivum
  Clone ID: PAT_TA_8680
atcgaattcccggggattttcgcagcaacaacaacaaccaattctactgcaacaaccaccattttcacaacaccaacaaccagtactaccgcaacaaccaccattttcgcaacaacaacaacaaccaattctaccgcaacaaccaccattttcgcaacaacaacagccagttctactgcaacaacaaataccatttgttcatccatctatcttgcagcaactaaacccatgcaaggtattcctccagcagcaatgcagccctgtggctatgcacacaaagtcttgctaggtcgcaaatgttgcagcagagcagttgccatgtgatgcaacaacaatgttgccagcagttgccgcaaatcccccagcaatcccgctatgaggcaatccgtgctatcgtctactccatcatcctgcaagaacaacaacaggttcagggttccatccaaactcagcagcagcaaccccaacagttgggccaatgcgtttcccaaccccaacaacagtcacaacagcaactcgggcaacaacctcaacaacaacaattggcacagggtacctttttgcagccacaccaaatagctcagcttgaggtgatgacttccattgcgctccgtaccctgccaacaatgtgcaatgttaatgtgtcgttgtatagaaccaccactagggtgccatttcggcgttgggcaccggagtttgttggctactaataaggaaagatctctagtaatatatagttggatcacctttgtttagtcgatggatatgtcgatgcagcggtgacaaataaagtgtcacacaacgtcatgtgtgacccgcccaaactagttgtttaaattctgaaataaaatacaaataaagttgtatcaagacaatgttcatattggcaaaaaaaaaaaaaaaaaaaaaaaaaaaaaaaaaaa

SEQ ID NO: 8681 - DNA, 1213 bp, Triticum aestivum
  Clone ID: PAT_TA_8681
cggcacgagggtagagtgcatcattcaagccaagcaagcactgggtcaatacaaatccatcatgaagacatttctcatcatttccctccttgctatcgtggcgaccaccgccacaactgcagttagagttccagtgccacaattgcagccgcaaaatccatctctgcaacaaccacaagagcaagttccattggtgcaacaacaacaatttccagggcagcaacaaacatttccaccacaacaaccatatccgcagccgcaaccatttccaggacaacaaccatatccgcagccgcaactatttccacagccgcaaccttttccgccacaacttccatatccgcagccgcaaccatttcccccacaacaaccatatccacaaccgcaaacacatcatctgcaaccacaacaaccaatttcgcagcaacaagtacaacaacaacaacaacaacaacaacaacaacaacaacaacaacaacaacaacaacaacaacaacaacaactactactacaacaacaaatccttcaacaaattctgcaacaacaacaactgattccatgcagggatgtcatcgtcttgcaacaacacaacatagcgcatgaaagctcacaagtattgcagcaaagtagttaccaagtgttgcaacaattatgttgtcagcagctgcggctgatccccgagcagtcgcggtgccaagccatccacaatgtcgttcatgctattattctacatcaacaacaacaacaacaacaacaacaacaacaacaacaacaaggacaacatcaaccgtcgagccaggtctcctaccagcagcctcagcaacaatatccatcaggccagggctccttccagccatctcagcaaaatccacaggcccagggctttgtccaacctcaacatctgccccaactcgaggaaataagtaacctagcgctgcagacgctaccagcaatgtgcaatgtctacatccctccatattgctcgaccaccattgcgccatttggcatcttcggtactaactgagaagagaagaactctagtactagatatatgaaacaccgtgttcttagtccatggtttggtcgttgtaccgttgaaaatataaggtgacatgcactatcatgtaagaacccgaactatactagttcaaacatgggaataaaagacaaacacatgtcttgtctgcaaaaaaaaaaaaaaaaaaaaaaaaaa

SEQ ID NO: 8682 - DNA, 754 bp, Triticum aestivum
  Clone ID: PAT_TA_8682
tagcgtggtcgcggccgaggtctctctctctctctctctctctcctctcctcgcaccgcgtcccctccctctcctgtcgcgtgcgctcggccagcaaaaagcttccacataaaggccaacaagagaaaccataatctgttgggtgccagtcaaacctcaacaacaaagtttcatgtctgatctcgacgttactctgccatctgccttcgatccttttgctgaggcaaatgctgaggatgctggtgcaggccccggcgcaaaagattatgtgcatgtgcgcatccagcagcgcaacggcaggaagagtctgaccactgtccagggcctgaagaaggagttcagctacaacaagatcctcaaggatctcaagaaggaattctgctgcaatggcacagtagtccaggatccagagctaggccaggtcattcagcttcagggtgatcagcgtaagaatgttgctactttcctagtccaggctgggattgcgaagaaggagctcatcaagatccacggcttctaagccgaagccgcctccgataaatgcccgaaccgccagccggttctactctatattgaagacttaaggcatctatattgccgcccgcttgttgaaccggtttcttgcttgatgcaagttgtgttgtcacctggttattatgctgctgctgtaccagcatatcagtatggtttgtctaagatgttgccgactaaataaaaatccgtatcgtttggctaaaaaaaaaaaaaaaaaaaa

SEQ ID NO: 8683 - DNA, 1173 bp, Triticum aestivum
  Clone ID: PAT_TA_8683
attcggcacgaggattcaagccaagcaagcagtggtcaatacaaatccaccatgaagacctttctcatccttgccctccttgctatcgtggcgaccaccaccacaactgcagttagagttccagtgccacaattgcagccacaaaatccatctcagcaacaaccacaagagcaagttccattggtgcaacaacaacaatttctagggcagcaacaacaacaatttccagggcaacaacaaccatttccaccacaacagccatatccgcagccgcaaccatttctgccacaactaccatatccgcagccgcaaccatttccaccacaacaatcatatccacaaccacaaccacaatatccgcaaccacaacaaccaatttcgcagcaacaagcacaactacaacaacaacaacaacaacaacaacaacaacaacaacaacaacaacaacaacaacaaatccttcaacaaattctgcaacaacaactgattccatgcagggatgtcgtcttgcaacaacccaatatagcacatgcaagctcaaaagtatcgcaacaaagttaccaactgttgcaacaattatgttgtctgcaactgtggcagacccccgagcagtcacggtgccaagccatccacaatgtcattcatgctattattttgcatcatcaacaacaacaacaacaacaacaacaacaacaacaacaacaacaacaacaacaacaaccgtcgagccaggtctcctaccagcagcctcagcaacaatatccatcaggccagggcttcttccagccatctcagcaaaacccacaggcccagggctttgtccaacctcagcaactgccgcagttcgaggaaataaggaacctagcgctgcagacgctaccagcaatgtgcaatgtctacatccctccatattgctcgaccaccattgcgccatttggcatcatgagtactaactgagaagagaagaactctattactagatatatgaaacaccgttttcttaaaacatggtttggtcgttgtagcggtgaaaaataaagtgacatgcactatcatgtaagaacccgaactagactatttcaaacttggaaataaaagacaaacacaggtcttgtctgcataaaaaaaaaaaaaaaaaaaaaaaaaaaaaaaaaaaaaaaaaaaaaaaaaaaa

SEQ ID NO: 8684 - DNA, 2023 bp, Triticum aestivum
  unsure (1)..(2023): unsure at all n locations
  Clone ID: PAT_TA_8684
gcaggaattcggcacgaggcccaaccctaaccctagccaatcgcattcccatggacgacgacgccggcgacgcctcgccgccgccgggacctgccccccctgctgccacaggcgccccgtcgttgcgtgacatggcggcgtcccctaccagctcgcgctccgtgacggagacggtgaacggctcccaccgcttcgtgatccagggctactccctcgccaaggggatgggcgtcgggaagcacatcgcgagcgagaccttcaccgtcgggggataccagtgggctatctacttctacccagacgggaagaaccccgaggacaactcggcctatgtttccgtcttcatcgcgctcgctttcgagggcactgacgtccgcgctctctttgagctcacgctgcaggaccagagcggcaagggcaagcacaaggtccactcccatttcgatcgctcgctcgagtctgggccctacaccctcaagtaccgaggctccatgtggggttacaaacggttctttcggcgaactgctcttgagacatcggactttcttaaagatgattgtttgaggataaactgcactgtgggtgttgtggtttcaactattgattactccagaccacactccattcaggttccagactctgatcttggctaccacttcggttctcttttggacagtaatgaaggggttgatgttattcttaatgtgagtggagagaggtttcatgcccataagttggtgttggctgcacggtctactgtatttagatccaaactttttgacgatgaatcagaaggagacaagaacgaggttaatgagagtgaggatctgaaggagattgttcttgatgatctagagcccaaggttttcaaggcaatgcttcatttcatctacagagataccctcgttgatgattatgagttggatgcatcaggctccatgggctctatttttgatactttggcggcaaagttgttggccgcagcagacaagtatgacttaggaaggttaagattgctatgtgaatcttacttgtgcaaaggcatttctgtggcctcggttgcaagtactcttgcattggctgatagtcaccatgccatggagcttaaagccgtttgcctaaaatttgctgcagaaaatctttcagctgtgatccggactgacgggtttgattacctcaaggataattgcccatcacttcagtcggagatactgagaactgttgctgggtgtgaggagccgtgcagtagtggcgggaaaagccagagtgtatggggacagctctcggagcggtggcgacactagtggccgtagggtgaggccaagaatctgaggccaccctgaactctgccctggttcggaggctcttgtgtaaatcgcgcaagcaatttgttctgtatgttgtgaaaacagtttaactaggtgtgacgacgacaaacggacaatccctccggcttctcttcgaagtagatgtaaccagcatgcagcctgtcgggagccaagtgcaactttcactgcagaaaattcacgcaaaataaataacaagagggctgcttaatattcgatacttgtttaacctgttgaaaatataaccttccctcgtaatactcacgtatactgcatatataaaggcaaaatacaaaccgccatcaaaaagaggacggcgaggcatgcaggcccacctcacgtacatctggaagatatctgaaagacgaacgtgtgttgggctcgtgattcgtgaatgacaggtatggtttccttctgtgacgtcttagacgtggtggggtgttagatatgaagttcgatggcgtgttcggggtattaccccggtatgattcgttcaacgacaaagtctttacttttggtgagtcactttggtgaggaggtgattcgtcattctttttttcgggggctgctgtagtaatgccggaggcagatgacgaacgttgatgtcaagctcagagatgtgctactatattttcagttttgtcatgtcagactttacgnacttgtatttcgatctt

SEQ ID NO: 8685 - DNA, 2979 bp, Triticum aestivum
  Clone ID: PAT_TA_8685
gaaggaaaccagatgagaaggcattgcattgcattttgcaggcgcggtagattatttacattgcacatggagaacgcgattacaacttcgtcgcgataatatgtgtgttcgtcgtccacaagcgtactacacctactatctctctcggatgtttttttcatctacttgccttgcagcacatggatcacaggaaccccgacgaacctttcccctgtgccaccttgctgctctgccctgagaacttgattgccgccgccaggttgccggcttgcggctgaagctcagctagctctttcactcgtagcaaaatggccggtggttttggtatgatcgaagggttgcttttccgcggacaaacaccatctttttccggcgaaagctgtgtctggctggctcttagcagattgcgccacttatccttgagatccactgaggtgcggtaagaatatgaggcaaaggatagtcttctaatctcagaccatttgccaggcccgaactgagccacgccatcgaccagcttcagaacttcggacaatgtccatgctcgatgatgcttccgcttcaaaccccgctttgtttttgttttggcatcagttctgcaaatatcgtctgcttctatggaacgaatctccttgttatcagctgtttctatatgccctcctttcttctcagctgtttctatatgccctcctttcttctcagctgtttctatatgccctcctttcttctcagcatttttcattagcggaacttccacagcactgcttacatgattcacatgttcaccatcttttcccaacatcgtctcaactgccatctgaacctcaggacattccaccggtggatcgtcatccaaaaatgaaatgaagtttctccggggacgccctcttctcatccttgacgcataaggaacatgtacactaaatcctccaaaagtatccttccgggtaggataagttatactcaatgaatcaacttcttgtaaaggagtaacccgttgtctgagtaacacctcaccatgtgcagccctttttcctggtgaagaaagcttcccagtggagtcaagtgtctcggtatctgcgagctcctcaatgtatctttttgttggttttcgaagtctcttagcggcgccttgttcatcctgcaaagttccttctgattcatcgttgtctgttgatactccttttagcctattggaggatcgctgttggtcctcactccgatagtaagagcaagatgatgtgtctctctcatttccagaacccaatacttgaaacctaaccaaagaagtagcttcaacctcagccttaggtattccttcaattgtaggtagctcgtgtttggcatccttgcaaactattttataatctttaactacacagcctgaactttgaacatcgcaggaattggtcaatcccatggtaatccgtcttttgagccataacttgtccttgacagtagtttcgcgcccaaatgtggctctaaatgcttcctggagttctctaattgtaagattatccaaacagacttcccctcttaaaatggagaagtcgggaactgaactagtaactccagagacagatggtcctgtagatgagttatttacagatcttgaacaagcatcggccttttctttttcagcactgcaagagtcatttaatactgttgattttggagtctcagtggaagcattgtcctggtgaacaatgttgttatcgccttgttccgtgttcagtttatctggtttgtgatcatgaacaactgtacacttcgagggaatatcaagcgagtcatccgacggttttagcctgtctacctctaggtcagcatcaaactgttgtgtatgtatttcaccattagtctctaattcggaatacccctcttcaaagtcaggctccttcagaagcatgcagtcattagtaaaaaaatcctccacatttcctacatcatcaatagaaggcagatcaaccttgtcatcaagaaactgttcaatctgcaggacttcgtcctccgtaggaggaacaagcgttccatcaccttcaacccgaactagctggtaaaccacgggatccaaactgccattctcttcaaagtcattccctccattcttagtctcctcagcatcttgtagagtatccacttccatagatcagtacaaacttcatccaatgttcgtactaatcaaatcctcaccgcgatcagcagcggcggcagcggagggcggatccccgcagcattggcccgatcggccgggccgagcagccggcgggcggatcagatcgcgcgagggcggggcggaggcggaggcgggggtcgctcggtggtccgctcctcgtttgcttcgtctgttctgttctcggtatagaggggagctccgttttggtgccgatagggaaggcaatagcgcatgcaagctcacaagtattgcaacaaagtagttaccaacagttgcaacaattatgttgtcagcaactgtttcagatccccgagcagtcgcggtgccaagccatccacaatgtcgttcatgctattattctgcatcatcatcaacaacaacaacaacaaccgtcgagccaggtctcctaccagcagcctcaggaacaatatccatcaggccagggctccttccagtcatctcagcaaaacccacaggcccagggctctgtccagcctcaacaactgccccagttccaggaaataaggaacttagcgctgcagacgctgccagcaatgtgcaatgtctacatccctccatattgctcgaccaccattgcgccatttggcatcttcggtactaactgagaagagaagaactctagtactagatatatgaaacaccgttttcttaatcgacagtttgatcattgcaacggtgcaaaaaataaagtgtcatggcctatcaggtaagaacccgaaataaaagagttcaaagttgggaataaaagaaatacacatgttttgtttgcataaaaaaacccc

SEQ ID NO: 8686 - DNA, 1009 bp, Triticum aestivum
  Clone ID: PAT_TA_8686
ctatcgtggcgaccaccgccacaactgcagttagagttccagtgccacaattgcagccacaaaatccatctcagcaacagccacaagagcaagttccattggtacaacaacaacaatttctagggcagcaacaaccatttccaccacaacaaccatatccacagccgcaaccatttccatcacaacaaccatatctgcagctgcaaccatttctgcagccgcaactaccatattcacagccacaaccatttcgaccacaacaaccatatccacaaccacaaccacagtattcgcaagcacaacaaccaatttcacagcagcagcagcagcagcaacaacaacaacaacaacaacaacaacaacaacaacaacaaatccttcaacaaattttgcaacaacaactgattccatgcatggatgttgtattgcagcaacacaacatagcccatggaagatcacaagttttgcaacaaagtacttaccagctgctgcaagaattgtgttgtcagcacctatggcagatccctgagcagtcgcagtgccaggccatccacaatgttgttcatgctattattctgcatcaacaacaaaaacaacaacaacaaccatcgagccaggtctccttccaacagcctctgcaacaatatccattaggccagggctccttccggccatctcagcaaaacccacaggcccagggctctgtccagcctcaacaactgccccagtacgaggaaataaggaacctagcgctacagacgctacctgcaatgtgcaatgtctacatccctccatattgcaccatcgcgccatttggcatcttcggtactaactgagaagaaaataactctagtactagatatatgaaacaccgttttctcagtccatggtttggtcgttgtagcggtgaaaaaataatgtgacatgcactatcatgtaagaacccgaactatactagttcaaacttgggaataaaagacaaacacaggtcttgtttccaaaaaaaaac

SEQ ID NO: 8687 - DNA, 750 bp, Triticum aestivum
  Clone ID: PAT_TA_8687
ccctactaaagggaacaaaagctggagctccaccgcggtggcggccgctctagaactagtggatcccccgggctgcaggaattcggcaccagcaacaacaacaacaagaacaacaaatccttcaacaaattttgcaacaacaactgattccatgcatggatgttgtattgcagcaacacaacatagcgcatggaagatcacaagttttgcaacaaagtacttaccagctgttgcaagaattgtgttgtcagcacctatggcagatccctgagcagtcgcagtgccaggccatccacaatgttgttcatgctattattctgcatcaacaacaaaaacaacaacaacaaccatcgagccaggtctccttccaacagcctctgcaacaatatccattaggccagggctccttccggccatctcagcaaaacccactggcccagggctctgtccagcctcaacaactgccccagttcgaggaaataaggaacctagcgctacagacgctacctgcaatgtgcaatgtctacatccctccatattgcaccatcgtgccatttggcatcttcagtactaactgagaagaaaataactctagtactagatatatgaaacaccgttttctcagtccatggtttggtcgttgtagcggtgaaaaaataatgtgacatgcactatcatgtaagaacccaaactatactagttcaaacttgagaataaaagacaaacacaggtcttgtttacatatttacc

SEQ ID NO: 8688 - DNA, 1088 bp, Triticum aestivum
  unsure (1)..(1088): unsure at all n locations
  Clone ID: PAT_TA_8688
gttaacaccaatccacaatgaagaccttcctcgtctttgccctcctcgctcttgcggcggcaagtgccgttgcgcaaatttcacagcatcaacangcaccgccattttcgcagcaacaacaaccaccattttcgcagcaacaacaaccaccattttcgcagcaacaacaagcaccgccattttcgcagcaacaacaacaaccaccatttacacagcagcagcagcagcaacaacaacaacaaccatttacacagcaacagcaaccaccgttttcacaacagccaccaatttcacagcagcaacaaccaccatttttgcagcaacaacgaccaccattttcacggcaacaacaaataccagttattcatccatctgttttgcaacaagctaaacccatgcaagggtattcctccaacagcaagtgcatccctgtggcaatgcagcgatgtcttgctaggtcacaaatgttgcagcagagcatttgccatgtgatgcagcaacaatgttgccagcagttgcgggcaaatccccggagcaatcccgccatgagtcaatccgtgctatcatctactctatcatcctgcagcagcaagcaagcagcaacaacaacaacaacaacaacaacagggtcagagtatcatccaatatcagcaacaacaacccccaacaagttgggccaatgtgtctcccaacccctacagcagttgcaagcaagcaactcgggcaacaacctcaacaacaacaattggcacaccagatagctcagcttgaggtgatgacttccattgcactccgtaccctgccaacaatgtgcaatgtcaatgtgccgttgtacggaaaccaccactaagtgtgccattaggcgttggcatcggagttggtgtctactgataagaaaagatctctagtaatatatagttggatcaccgttgtttagtcgatggatatgtcgatgtagcggtgacaaataaagtgtcacacaacgtcatgtgtgacccgctcaaactagttgtttaaattctgaaataaaatacaaataaaggtgtattaagaaaatgttcatatcggcaaaaaaaaaaaaaaaaaaa

SEQ ID NO: 8689 - DNA, 1054 bp, Triticum aestivum
  Clone ID: PAT_TA_8689
atggttagagttccagtgccacaattgcagccacaaaatccatctcagcaacagccacaagagcaagttccgttggtacaacaacaacaatttctagggcagcaacaaccatttccaccacaacaaccatatccgcagctgcaaccatttccatcacaacaaccatatatgcagctgcaaccatttccgcagccgcaactaccatatccgcagccgcaaccatttcgaccacaacaactatatccacaaccgcaaccacagtattcgcaaccacaacaaccaatttcacagcagcagcagcagcagcaacaacaacaacaaccaatttcgcagcagcagcagcagcagcagcaacaacaacaacaacaacaaatccttcaacaaattttgcaacaacaactgattccatgcatggatgttgtattgcaacaacacaacatagcgcgtggaagctcacaagttttgcaacaaagtacttaccagctgttgcaagaattgtgttgtcagcacctatggcagatccctgagaagttgcagtgccaagccatccacaatgttgttcatgctattattctgcatcaacaacaacaacaacaacaacaacaacaaccgttgagccaggtctccttccaacagcctcagcaacaatatccattaggccagggctccttccggccatctcagcaaaacccacaggcccagggctctgtccagcctcaacaactgccccagttcgaggaaataaggaacctagcgctacagacgctacctgcaatgtgcaatgtctacatccctccatattgcaccatcgcgccatttggcatcttcggtactaattgagaagaaaataactctagtactagatatatgaaacaccgttttcttagtccatggtttggtcgttgtagcggtgaaaaaataatgtgacatgcactatcatgtaagaacccgaactatactagttcaaacttgggaataaaagacaaacacaggtcttgtttacaaatggttgtttttttgtgttccattaatgtgcccgttcccaaacaaaaat

SEQ ID NO: 8690 - DNA, 834 bp, Triticum aestivum
  Clone ID: PAT_TA_8690
atcctcccgtcccgacccctatccgttcccccactcctggtctctctcccgctcctatcctctcctccccccctcgcgccgccgccggcgccgacgccgcggcttccgctcctcccccagccaagatgaatgttgaaaagctcaagaagatggcaggtgccgtgcgcaccggggggaagggtagcatgcgcaggaagaagaaggctgtacacaagaccacgactacagatgacaaaaggctccagagtaccctgaaaagagtaggagtcaacaccatccctggtatcgaagaggtcaacatctttaaggatgatgtggttattcagtttctgaatcctaaagtgcaagcttcgattggtgctaatacatgggtggtcagtggaactccacagacaaagaaactgcaagatctgctgccatcaattatcaatcaacttggtcctgacaacttggacaacctgcggaggctcgcagagcaattccaaaagcaggtccctggtggtgctgctggcatcgaggctggtaccagtgcaggagctgctcaggctgacgacgacgatgatgttcctgagcttgtccctggagagacatttgaagaggccgctgaagacaaaaaggcagagtcgtgattttgatgcatgtttactgttgtgaagggttataagttaagcggcgccattagagaccacctcccctttcaagaattctgacctaccttatttgtgccagtggaccggttttgtaatgtacgcgagtttcgtctgatatgttggtggaattttgcatcaaattacatgcctcttttggttgccctcattctcaaatcgtgtcttt

SEQ ID NO: 8691 - DNA, 1505 bp, Triticum aestivum
  Clone ID: PAT_TA_8691
agatcaatcccaaaaagtacgcttgtagctagtgcaacctaacacaatgtaccaaaaatcatttctgatgcatccaaatagaattatttaagttgatgcaaagaaggaaagaggtggtgcccggactactataaataggcatgaagtataatgatcatcacaagcacaagcatcaaaaccaagcaaaagtagttagcaccaatccatcatgaagaccttcctcgtctttgccctcatcgccgttgtggcgacaagtgccattgcacagatggagactagctgcatctctggtttggagagaccatggcagcagcaaccattaccaccacaacagtcattttcacaacaaccaccattttcacaacaacaacaacaaccattacctcaacaaccatcattttcgcagcaacaaccaccattttcgcagcaacaaccaattctatcgcagcaaccaccattttcacagcaacaacaaccagttctaccgcaacaatcaccattttcgcagcaacaacaactagttttacctccacaacaacaacaacaacaacttgtgcaacagcaaatccctattgttcagccatccgttttgcagcagctaaacccatgcaaagtattcctccagcagcagtgcagccctgtagcaatgccacaacgtcttgctaggtcacagatgtggcagcagagcagttgccatgtgatgcaacaacaatgttgccagcaattgcagcaaatccccgaacaatcccgctatgaagcaatccgtgccatcatctactccatcatcctgcaagaacaacaacagggctttgtccaacctcagcagcaacaaccccaacagtcaggtcaaggtgtctcccaatcccaacagcagtcgcagcagcagctcggacaatgttctttccaacaacctcaacagcaactgggtcaacagcctcaacaacaacaacaacaggtactacagggtacctttttgcagccacaccagatagctcaccttgaggcggtgacttccattgcactccgtaccttgccaacgatgtgcagtgtcaatgtgccgttgtacagcgccaccaccagtgtgccattcggcgttggcaccggagttggtgcctactgataagaaaagttgtctagtaatatatagttggaccaccgtcgtctagtcgatcgacatgtcgaggaagcggtgacaaataaagtgtcacacaacgtcatgtgtgacccgcccaaagtagtagttaaattctggaataaatacaaatgaagtgttctctagacaatgttcatatcggcgttgtgtggacgtcgatctgactaccatgcttgcaagttcataagttcgtcttgccaggtcacaacctcaacttggtgtattaattaattaatcacgtatagcaataatctagatttaaatataatagtgttattgtaaaatttgggttgaactgaagaaaggacaaacatacaactctttaatggttggagatttgagatcttgtttt

SEQ ID NO: 8692 - DNA, 1440 bp, Triticum aestivum
  Clone ID: PAT_TA_8692
ttttttttttgctccggaaccaaagatttcatagcacggaggccaaatatgacaagccgctaatcttctggcgtgataaatcacaggttactagtagaaggcaaacgttgtttatcacatactaattcaacattgtcgggacaacatccagaaacagtctcaccatcttaggaacaacccttggtcatgtcagggtctttgaaaagcagcatgtagcatatatacacaacacacatcaccggtcaaattcggagtaaaaagctaagctctctcccggcgcaagtgttcgcctccacgatggggcgctcgctcgaccgccctttcaggccgccttggcgaagccgacccgcagcttgccatagtcgaagacggtgtggtaggggcccatgaagacgtctcccaggatccagagaggaccgcggggaggggggatgtccatggctgtgaatccactgatgcactgggcagcggctccttcaccaaccttcaggatatactcttctggtttcagcgcaaacttcttgccgccaatggtgaactcaatgtcaggcatggatccgaggctggcacagtccacggctgattctcccatggggctcgggagacggttgcacagctggttaacgtaatccagtatgagatcctgggtcttgttctgtgcaagttggttctgcatccacacaacagccatctcacaggcactgcacatgggatcggtacggaggccatttgatttcacaggctcatcatcaaccacgctccgaattccagcactaacaccacgagtcccatcaaaggtgcacagaccaacctgggagcagatctttttgggctgtgtctctgctagcaacaggtcgaggatctgttgtccatactgagaaacaattgttttgcactcttggctgactaccccagccgcaccaatcttctcgttaatttcagtaatgatggccgtggggccagcaagcagtgaagttccagaatcagcaattgcggcacaaccgccagcacagaatcctgtggacttccctccaaccaggacatcacccatgtcaaactgccaatatcccttctgggtgactgggacatatgtgtgctcacccacgtagtgtttgggatccattcctcccaaaaataatttcaccaccctctccttcatcatcagcatgtcggttcaaccagaacgagaaaacaggatcactgatgagaccttgctctaccatattataccacacaggtactgctttgccaacagatatttccttaaacccaagcccaagaataccatcaaactttgcaaccaagaaagtaacacctggctcctttgtagcttcaatgaactcctgatctttctcaacaagatcacccactgtaacactatcctcgctgaaatatccagcaattgaaccagtgccgtactgaatggcagcaggctttccc

SEQ ID NO: 8693 - DNA, 974 bp, Triticum aestivum
  Clone ID: PAT_TA_8693
tagcaaattcctagcaaagatcttcatgtttgaatgtaatacttggagaatttatgataatcagactaacatacacgacttaactcagagactcaccacaagtacacagtgcaatatacggcaaaatgcatgaacttccattgagactcatccaagcctcgaagcagcatgacttaaactcttgcaccatcaagaaacgaaccaaaaacaaaaatactagaaccacatctctgctcctattgagttcaactatcgcagataacagacagacgtgacataggttccacataatcaagacactgtcctaaaagcgcattattttaaatttgatagtctgcgctctccttagaaagcttcacggtcaccaccatagccaccgccacctcgggccaccaccgccatagccgccgccggccaccaccatagccgccgccgccgccaaagccaccacctcctccatagccaccgccgccggcgtgagaagccgccaccacccgaaggcctctcattggcgaagttcacacggacgttcctccctgcaagctcctgaccgtccatgccttttgcagcgctatctgcatcagcttcattcgcaaagctcacaaaaccaaaccctctagaccttccagtctctcgatcagtgatgacacgtgcctcaacgacctctccaaagctttggaacgcctccttcagcgaatgatcgtcagtagcccaggccagaccgccgacgaaaagcttattgccaccagcgggctggccggcgcacatgaagcgggcagcgttgaacagggcaggagccgagccggtcgaggcactgctcgccaaagcactctgcctaagaaggcttccgagcttgatgagggccgccatggaggaagactaaaacctctggagggcgagctgggacgagacggcgtgggaggggggaatgcagaatggggagtgggggctgggggctgggggctggggtttaa

SEQ ID NO: 8694 - DNA, 919 bp, Triticum aestivum
  Clone ID: PAT_TA_8694
gatcacactaacatacgcaatcattctctacaagtacacagcgcaacatacggcaaaatgcatgaaacttccttgagactcatccaagcctcgaagcagcatacacaaattaactcttgcatcatcaagaaaaaaagcaaaaccaaaaataacatagaaccacatctctgcccctattgagttcaactatcgcagataacagacagacgtaacattaggttccacataatcaagacactgtcctaaaaactcattattttaaatttgatagccagtgctcttcttagtaggactcacggtcaccaccatagccgccgccaccaccaccacggccaccaccgtatccgccgccaccaccaaagccaccgccaccatagccgccgccaccacctccatagccaccgccgccacgagagaagccgccgccgccgccaccacccgaaggtcgctcgttggcgaagttcacacggacgctcctccccgcaagctccttgccgtccatgttttctgcagcactctttgcatcctcgccgctggcgaagctcacaaaaccaaaccctctagaccttccagtctctctgtcagtgataacacgagcttcaacgacctcaccaaagcattgaaacgcctccttcagcgaatgatcatcagtagcccaggcgagaccaccgacgaaaagcttggagccatcagcaggctggccggcgcacatgaagcgggcagcgttgaacagggcaggagccgagccggtggaggcactgctagccacagcactctgcctaagaaggcttccgagcttgatgagggccgccatggaggaagactaaaacctctggagggcgagctgggacgagacggcgggggaggggggaatggggaatggggagtgggggctggggtttaagagcggcagcgaggg

SEQ ID NO: 8695 - DNA, 939 bp, Triticum aestivum
  Clone ID: PAT_TA_8695
agtctggtaccattaccaaatttctagcgaagatctcaatatatttgaatgtaattcgaagagaatttatgatcacactaacatacgcgatcattctctacaagtacagtgcaatatacggcaaaatgcatgaacttccttgagactcatccgagcctcgaagcagcatacacaaattaactcttgcactatcaagaaacaaaccaaaaccaaaaagaacatagaacgacgtaacattaggttccacataatcaagacactgtcctaaaaacttcattattttaaatttgatagccagtgctcttcttagtaggactcatggtcaccaccatagccacctccaccaccaccacggccgccgccgtatccaccgccaccaccgtagccaccgccgccgtagccgccgccaccacctccatagccaccgccgccacgagagaagccaccgccgccaccacccgaaggtcgctcgttggcaaagttcacacggacgttcctcccagcaagctccttgccgtccatgttttctgcagcactctttgcatcctcgccactggcgaagctcacaaaaccaaaccctctagaccttccagtctccctgtcagtgataacacgtgcttcaacgacctcaccaaagctttgaaacgcctccttcagcgaatgatcatcagtagcccaggcaagaccgccaacgaaaagcttggagccatcagcaggctggccggcgcacatgaagcgggcagcgttgaacagggcaggagccgagccggtcgaggcactgctcgccacagcactctgcctaagaaggcttccgagcttgatgagggccgccatgaaggaagactaaaacctctggagggcgagctgggacgagacggcgggggaggggggaatgagaatggggagtgggggttggggtttagcctcgtccgaattcct

SEQ ID NO: 8696 - DNA, 3026 bp, Triticum aestivum
  Clone ID: PAT_TA_8696
aagcttatctagtttacacgtaacaacttgtagaacattacaaaatttatgcttgctaataacttctagaacactacaacacttgacatgtaaaaggaatttgacgagtcatggcctactaaagcaagttatattactagtcttatctatcttaatagaccacacaagattacgaactaagtaccgtgacagccatgcttatctagtttatgtgtagcaatttgcagaaaattacaaacttagttttagaaaaataggcaatctagattagtgtttgagctgtaaagtgaataagatgagtcatgcatgttatcacacctttttggtggtggaatgatagtgcaacaacaaggaactttaatgaccagtccaagaatacacttgtaagtagtgccaccaaacagaacataccaaatgatgatttttagaagcatccaagcactttccacacaaacaaatgccaattgtgaaagagatcattccatggcaactataaatagccccatagcatgacgatcatccttcctcatccatcattctcattagtagagcgcatcatttaagccaagcaagctgtggtcaatacaaatccaccatgaagacctttctcatccttgtcctccttgctattgtggcgaccaccgccacaactgcagttagatttccagtgccacaattgcagccacaaaatccatctcagcaacagccacaagagcaagttccattggtacaacaacaacaatttctagggcagcaacaaccatttccaccacaacaaccatatccacagccgcaaccatttccatcacaactaccatatctgcagctgcaaccatttccgcagccgcaactaccatattcacagccacaaccatttcgaccacaacaaccatatccacaaccgcaaccacagtattcgcaaccacaacaaccaatttcacagcagcagcagcagcagcagcagcagcagcaacaacaacaacaacaacaacaacaaatccttcaacaaattttgcaacaacaactgattccatgcatggatgttgtattgcagcaacacaacatagcgcatggaagatcacaagttttgcaacaaagtacttaccagctgttgcaagaattgtgttgtcaacacctatggcagatccctgagcagtcgcagtgccaggccatccacaatgttgttcatgctattattctgcatcaacaacaaaaacaacaacaacaaccatcgagccaggtctccttccaacagcctctgcaacaatatccattaggccagggctccttccggccatctcagcaaaacccacaggcccagggctctgtccagcctcaacaactgccccagttcgaggaaataaggaacctagcgctacagacgctacctgcaatgtgcaatgtctacatccctccatattgcaccatcgcgccatttggcatcttcggtactaactgagaagaaaatagctctagtactagatatatgaaacaccgttttctcagtccatggtttggtcgttgtagcggtgaaaaaaataatgtgacatgcactatcatgtaagaacccgaactatactagttcaaacttgggaataaaagacaaacacaggtcttgtctacatatttatgttgcatctatttatatattaaaagtaatataaggtgaaccaggagcaaggtaaatatgctagaaaattgcacgttaattagaaattactagccctcgatctggtaaatcttaacaaatagaattatcttgaccgttagatttatgtaacatatataatgctctgggcctccaacgactgtacgtgacacatctgaacgaacatatgttgaagaaaatatatttggtaaatggtgggcctctttaaaaagagaactcacgtacatgcaccaactaagaaaaacacaacttaaaaaaaaactaagaaaaactcatacatgtaaaggcaaaaggctgagattttctcacgtacgtgctccctggctccaccccgttgaaaaaatatacatctggaggccactttgtttccacatcgaaaaaaacttacgttaaaaaaattgcatgcatcccagggaaaatagtcaagaagaagtcggacttttccttacaaaaacaaggaacgtgttaagttgacttcaaagaaataaggaacatgttaagtttaaaaaaaacaagaaacctgttaagttagaaaaaaacaaggaacgtgttgtcctaggaaagatatgtgtcaaatcttacaaaaaaaagaatacacacacgtacgttcatgcacttggaaaatagaaaaaaaaaaggaaacatcacgtatgtatacacttcggaaactcattacatgaccatgtctgatatactcctccaatgcttaatattagtgcctaataatttatatttaaaatttaatttactgatcaaatatccccactgtttaaattttaatttggcacattatttggctatagtatgaacctaaatttcctcttattattatatatcatggtaataatccaaaggcgactaatcgctggcgcaccggcgcaatcaattcggctggacacagcgcggccgtttgattagattgcatttaaccgtcagatctggaatcattttctttccaattaaacggattcaaccaaacagcagaggggaaaacaaagcagcaccgccgccaacactagccatggacgaccgatgtagcaaaaccttgaagaaccgccgccggtcgccaccctcgccgctggtcgccgccctcaccgtcggttaccgccggtcgccgcactcgccgcctgcgtttctcatcggcttcatgcatgcaacaacatgcactcgtggttgcaggcttgcatctccggctccgggggacatggccgcatctccggtagcgcgccgccggccgcagcacctgtcgttgaggtcgcgctgtacctcaccgtgtgccctctcgaggctcttgctagttccaacaaaaaacgatacctattgtagcaaaaaagtatcgcttccagcaaaaaagctt

SEQ ID NO: 8697 - DNA, 721 bp, Triticum aestivum
  Clone ID: PAT_TA_8697
taacgtggtcgcggccgaggtctctcaccgcaccgcgtcccctccctctcctgtcgcgtgcgctcggccatcaaaagcttccacataaaggccaacaagagaaaccttaatctgttgggtgccagtcaaacctcaacaacaaagtttcatgtctgatctcgacgttactctgccatctgccttcgatccttttgctgaggcaaatgctgaggatgctggtgcaggctccggcgcaaaagattatgtgcatgtgcgcatccagcagcgcaacggcaggaagagtctgaccactgtccagggcctgaagaaggagttcagctacaacaagatcctcaaggatctcaagaaggaattctgctgcaatggcacagtagtccaggatccggagctaggccaggtcattcagcttcagggtgatcagcgtaagaatgttgctactttcctagtccaggctgggattgcgaagaaggagctcatcaagatccacggcttctaagccgaagccgcctccgataaatgctcgaaccgccagccggctcttctctatattgaaggcataaggcatatatatattgccgcccgcttgtcgaactgtgtcttgcttgatgcaagttgtgttgtcgcctgattattatgctgctgctgtaccggcatatcagtatggtttgtctaagatgttgccgactgaataaaaatccgtatcgtttggctaaaaaaaaaa

SEQ ID NO: 8698 - DNA, 1014 bp, Triticum aestivum
  Clone ID: PAT_TA_8698
attcggcacgaggagtccagtgccacaattgcagccacaaaatccatctcagcaacagccacaagagcaagttccattggtacaacaacaacaatttccagggcagcaacaacaatttccaccacaacagccatatccgcagccgcaaccatttccatcacaacaatcatatccacaaccacaaccacaatatccgcaaccacaacaaccaatttcgcagcaacaagcacaactacaacaacaacaacaacaacaacaacaacaacaaatccttcaacaaattctgcaacaacaactgattccatgcagggatgtcgtcttgcaacaacccaatatagcacatgcaagctcacaagtatcgcaacaaagttaccaactgttgcaacaattatgttgtcagcaactgtggcagacccccgagcagtcacggtgccaagccatccacaatgtcattcatgctattattttgcatcatcaacaacaacaacaacaacaacaacaacaacaacaacaacaacaacaacaacaacaacaacaacaacaacaacaacaacaacaacaaccgtcgagccaggtctcctacctgcagcctcaacaacaatatccatcaggccagggctcgttccagccatctcagcaaaacccacaggcccagggctttgtccaacctcagcaactgccgcagttcgaggaaataaggaacctagcgctacagacgctaccagcaatgtgcaatgtctacatccctccatattgctcgaccaccattgcgccatttggcatcatgagtactaactgagaagagaagaactctattactagatatatgaaacaccgttttcttaaaacatggtttggtcgttgtagcggtgaaaaataaagtgacatgcactatcatgtaagaacccgaactagactatttcaaacttggaaataaaagacaaacacaggtcttgtctgcaaatgattgtttgtttgagttccattcatgggcccgttcccaagttcccccct

SEQ ID NO: 8699 - DNA, 1090 bp, Triticum aestivum
  Clone ID: PAT_TA_8699
acggagaccaatatgacaagccgctaagcttctggcgtgataaaccacaggttactagtagaaggtaaacgttgtttatcacatactaattcaacaacattgtcggaacaaacatccagaaacagtctcagccatcttaggaaccacccttagtcatgtcagggtcttttgaaaagcagcatgtagcatatatacacacacatcaccggtcaaattcagagtaaaaaagctaagctctttcccggcgcaagtgttcgcctccacgatggggcgctcgctcgatcaccccttcaggccgccttggcgaagccgacccgcagcttgccgtagtcgaagacggtgtggtaggggcccatgaagacgtctcccaggatccagagaggaccacggggaggggggatgtccatggctgtgaatccactgatgcactgggcagcggctccttcaccgaccttcaggatatactcttctggtttcagcgcaaacttcttgccaccaatggtgaactcaatgtcaggcatggatccaaggctcgcacagtccacggctgactctcccatgggacttgggagacggttgcacagctggttaacgtaatctagtatgagatcctgggtcttgttctgtgcaagttggttctgcatccacacaacagccatctcacaggcactgcacatgggatcggtacggaggccattcgatttcacaggctcatcatcgaccacgctccgaattccagcactaacaccacgagtcccatcaaaggtgcacagaccaacctgggagcagacctttttgggctgtgtctctgctagcaacaggtcgaggatctgttgtccatactgagaaacaattgttttgcactcttggctgactaccccagcagcaccaatcttctcgttaatttcagtaatgatggccgtggggccagcaagcagtgaagttccagaatcagcaattgcagcacaaccgccagcacagaatcctgtggacttccctccaaccaggacatcacccatgtcaaactgccaatatcccttctgggtgactgggacatatgtgtgttcacccacgtagtgtttcctcgtgc

SEQ ID NO: 8700 - DNA, 1388 bp, Triticum aestivum
  Clone ID: PAT_TA_8700
atcattctcataagtagagcgcatcatttaagccaagcaagcagtgctcaatacaaatccaccatgaagacctttcccatccttgccctccttgctattgtggcgaccaccgccacaactgcagttagagttccagtgccacaattgcagctacaaaatccatctcagcaacagccacaagagcaagttccattggtacaagaacaacaatttccagggcagcaacaaccatttccaccacaacagccatatccgcagccgcaaccatttccatcacaacaaccatatctgcagctgcaaccatttccacagccgcaactaccatatccgcagccgcaaccatttcgaccacaacaaccatatccacagccgcaaccacagtattcgcaaccacaacaaccaatttcgcagcagcagcagcagcagcagcaacaacaacaacaacaacaacaaatcctacaacaaattttgcaacaacaactgattccatgcagggatgttgtattgcaacaacacaacatagcgcatggaagctcacaagttttgcaagaaagtacttaccagctggtgcaacaattgtgttgtcagcagctgtggcagatccccgagcagtcgcggtgccaagccatccacaatgttgttcatgctattattctgcatcaacaacaccaccaccaccaacaacaacaacaacaacaacaacaacaaccgttgagccaagtctccttccaacagcctcagcaacaatatccatcaggccagggcttcttccaaccatctcagcaaaacccacaggcccagggctctttccagcctcaacaactgccccagtttgaggcaataaggaacctagcgctacagacgctacctgcaatgtgcaatgtgtatatccctccatattgcaccattgctccatttggcatcttcggtactaactgagaagagaagaactctagtagtagatatatgatacactgttttcttagtccatggtttggtcgttgtagcggtgaaaaaataaagtgacatgcactatcatgtaagaacctgaactatactagttcaaacttgggaataaaagacaaacacaggtcttgtctacaaaaaaaagccaagaagccgctccgcgcggcgcttgcggaagccggcaccgtcaagtacgtcaccgcgccctcggctgcgtaatccccggtcgcatagctccggcccgtgccactgtggtcatcaaagcaggaagccgggcacctataagcatttgcattttggtatttttgcgtctgttcggttccaagttagcagtatatcatttcaagtttaagataggaggtttgatcgaaacagtctacgtatgtgaataccctcagaccctttgtgaagcagagtgctgt

SEQ ID NO: 8701 - DNA, 1177 bp, Triticum aestivum
  Clone ID: PAT_TA_8701
gaattcggcacgagggcgactccccccaccctctccctccccagcccaaaaaatttccccgaagaatcccaccaccaccactgccacgaagaaccaatccgccccctcgcctcccccagggccaccgattctcccccctcgccaccgccccccgagaagggtaaatgggatcggaagggccttcaatcgtgactgtccatgttaccggatttaagaagttccatggtgttgctgagaacccgacagagaaacttgtgaccaacattaaatccttcattgaaaagagagggttgccaaaaaatcttgtacttggaagctgcgaaattctcgaaacagccggacagggggcgcttggaacactatataaagttttagagtctgccattgcagatagagagaacgggtcatcggctcaggggcaaataatttgggtccactttggggtcaatagtggtgcatcacggtttgctcttgagaatcaagctgtgaatgaagccaccttccgctgcccagatgagcttgggtggaaacctcaggttgcgttgttgtcagattacaaacccttcatttgttctgcatttgaatagatcttctggttgcatttcattttaccagcttccttgttcccatgcagagagtgcctattgtgccatctgatggaagcatctcacggacaagagagactacactgccagtgaaggagttaaccaagtcactccgaaagacaggctacgatgtgatgccttcggatgacgcggggagattcgtgtgcaactatgtgtactaccactccctccggtttgcagagcagcacggcatcaagtctctgtttgtgcatgtgcccctcttctcgacagtcgacgaggaggtccagatccatttcgtcgcttccctcgtcgaagctcttgctagcttgaactaggaacggcaacttaaaaggtcagcggtttgacctggacgatgtaaagttggacgcagactgaataagattgtgtggtgattggcgcctattggtcagatcttgctccaaaaagggtgtatttaaggggagagaaaaagaaaaacgatgcttagagtgtgtgtgaaatgccggcttgcatgccatcagttacatgtccttaacttgcatgaaaacctggttccaataaaattgacagatcattggagtaaaaaaaaa

SEQ ID NO: 8702 - DNA, 1222 bp, Triticum aestivum
  Clone ID: PAT_TA_8702
acaacaaccaccattttcacaacaacaaccaccatttttgcagcaacaacaacccgttctaccgcaacaaccaccattttcgcagcaacaacaacaatttccgcagcaacaacaaccacttttaccgcaacaaccaccattttcgcagcaacaaccaccattttctcagcagcagcaacaaccaccattttcgcagcaacaacaacaaccaattctaccgcaacaaccaccattttcacaacaccaacaaccagttctaccgcaacaacaaataccatctgttcagccatctatcttgcagcagctaaacccatgcaaggtattcctccagcagcaatgcagccctgtggcaatgccacaaagtcttgctaggtcgcaaatgttgtggcagagtagttgccatgtgatgcagcaacaatgttgccggcagctgccgcaaatccccgaacaatcacgctacgatgcaatccgtgccatcatctactcgatcgtcctacaaggaacaacaacaacaacaacaacaacaacaagaacaacaaatacttcaacaaattttgcaacaacaactgattccatgcatggatgttgtattgcaggaacacaacatagcgcatggaagatcacaagttttgcaacaaagtacttaccagctgttgcaagaattgtgttgtcagcacctatggcaaatccctgagcagtcgcagtgccaggccatccacaatgttgttcatgctattattctgcatcaacaacaaaaacaacaacaacaactatcgagccaggtctccttccaacagcctcagcaacaatatccattaggccagggctccttccggccatctcagcaaaacccacaggcccagggctctgtccagcctcaacaactgccccagttcgaggaaataaggaacctagcgctacagacgctacctgcaatgtgcaatgtctacatccctccatattgcaccatcgcgccatttggcatcttcggtactaaatgagaagaaaataactctagtactagatatatgaaacaccgttttcttagtccatggtttggtcgttgtagcggtgaaaaaataatgtgacatgcactatcatgtaagaacccgaactatactagttcaaacttgggaataaaagacaaacacaggtcttgtctacatatttatgctgcatctatttatatattaaaagtaataaaaaaaaaaaaaaaaaaaaa

SEQ ID NO: 8703 - DNA, 1078 bp, Triticum aestivum
  Clone ID: PAT_TA_8703
cacaagttgaataaaatggtggtagttctaccgcaacagccatcattttcgcagcaacaactaccaccattttcacaacaacaaccaccgttttcacaacaacaacaaccagtactaccgcaacaaccaccattttcgcaacaacaacaacaacaaccaattctaccacaacaaccatcattttcgcaacaacaacaacaactagttctaccgcaacaacaaataccatttgttcatccatctatcttgcagcagctgaacccatgcaaggtattcctccagcagcaatgcagccctgtggcaatgccacaaagtcttgctaggtcgcaaatgttgcagcagagtagttgccatgtgatgcaacaacaatgttgccagcagttgccgcaaatcccccagcaatcccgctatgaggcaatccgtgctatcatctactccatcgtcctgcaagaacaacaacaggttcggggttccatccaaactcagcagcagcaaccgcaacagttgggccaatgtgtttcccaaccccaacagcagtcacagcagcaactcgggcaacaacctcaacaacaacaattggcacagggtacctttttgcagccacaccagatagctcagcttgaggtgatgacttccattgcgctccgtaccctaccaatgatgtgccgtgtcaatgtgccgttgtatagaaccaccactagtgtgccattcggcgttggcactggagttggtgcctactgataaggaaaggtctctagtaatatatagttggatcaccgttgtttagtcgatggatatgtcgatgcagcggtgacaaataaagtgtcacacaacgtcgtgtgtgacccgcccaaactagttgtttaaattctgaaataaaatacaaataaagttgtatcaagacaaaaaaaaaaaaaaaaaaactcgagggggggcccggtacccaattcgccctatagtgagtcgtattacaattcactggccgtcgttttacaacgtcgtgactgggaaaaccctggcgttacccaacttaatcgccttgcagcacatccccctttcgccagctggcgtaatagcg

SEQ ID NO: 8704 - DNA, 1216 bp, Triticum aestivum
  Clone ID: PAT_TA_8704
caacccatccaacaacaaccacaaccatttccacaacagccaccatgttcacagcaacaacaaccaccattatcgcagcaacaacaaccaccattttcacaacaacaaccaccattttcgcagcaacaacaacccgttctaccgcaacaaccaccattttcgcagcaacaacaacaatttccgcagcaacaacaaccacttttaccgcaacaaccaccattttcgcagcaacaaccaccattttctcagcagcagcaacaaccaccattttcgcagcaacaacaacaaccaattctactgcaacaaccaccattttcacaacaccaacaaccagttctaccgcaacaacaaataccatctgttcagccatctatcttgcagcagctaaacccatgcaaggtattcctccagcagcaatgcagccctgtggcaatgccacaaagtcttgctaggtcgcaaacgttgtggcagagtagttgccatgtgatgcagcaacaatgttgccggcagctgccgcaaatccccgaacaatcacgctatgatgcaatccgtgccatcatctactcgatcgtcctacaagaacaacaacatggtcagggtttgaaccaacctcagcagcaacaaccccaacagtcggtccaaggtgtctcccaaccccaacaacaacagaagcagctcggacagtgttctttccaacaacctcaacaacaacaactgggtcaatggcctcaacaacaacaggtaccccagggtaccttgttgcagccacaccaaatagctcaacttgaggtgatgacttccattgcacttcgtaccctgccaacgatgtgcagtgtcaacgtgccggtgtacggcaccaccactattgtgccattcggcgttggcacccgagttggtgcctactgataagaaaatatctctagtaatatatagttggattgtcgttgcttagtcgatggatatgtcgatgtagcggtgacaaataaagtgtcacacaatgtcatgtgtgacccgcacaaactagtttaaattatggaataaaatacaaataaagttttatctagacaatgttcataccggtgttgtgtggatgtcgatctgattgccatgcttgcaagttcataggttcatcttgcctggttacaaccgcaagctggtgcattaattacttatttatgtattgcaataataaagatttaagtataatagtgttatt

SEQ ID NO: 8705 - DNA, 913 bp, Triticum aestivum
  Clone ID: PAT_TA_8705
tcggcacgaggcgcagccgcaaccatattccgccacaactaccatatccgcagccgcaatcatttccaccacaacaaccatatccacaacagcaaccacagtatctacaaccacaacaaccaatttcgcagcagcagcagcagcaacaagcacaacaacaacaacaacaacaacaacaacaacaacaacaacaacaaatccttcaacaaattttgcaacaacaactgattccatgcagggatgttgtcttgcaacaacacaacatagcgcatgcaaggctcacaagttttgcaacaaagtacttaccagctattgcaacaattgtgttgtcaacaactgttgcagatccctgagcagtcgaggtgccaagccatccataatgttgctcatgctattattatgcatcaacaacaacaacaacaacaagaacaacaacaacagttgcaacaacaacaacagcagcaactgcaacaacaacgacaacaaccgtcgagccaggtctccttccaacagcctcagcagcaatatccatcaagccaggtctccttccagccatctcagctaaacccacaggctcagggctccgtccaacctcaacaactgccccagttcgcggaaataaggaacctagcgctacagacgctacctgcaatgtgcaatgtctacatccctccacattgctcgaccaccattgcgccatttggcatctttggtaccaactgagaagagaagaactctagtactagatatatgaaacaccgttttcttagtccatggtttggtcgttgtagcagtgaaaaaataaagtgacatgcactatcatgtaagaacccgaactatactagttcaaacttgggaataaaagacaaacacatgtcttgtctacatatgaaaaattaaaaaaaaaaaaaaa

SEQ ID NO: 8706 - DNA, 1433 bp, Triticum aestivum
  Clone ID: PAT_TA_8706
aaaagtacgcttgtagctagtgcaaacctaacccaatgtaacaaaataattcatttcagatggagccaaacagaattattaaagctgatgcaaagaaggaaaagaggtggttcctgggctactataaataggcatgaagtataaagatcatcacaagcacaagcatcagaaccaagcaacactagttaacaccaatccaccatgaagaccttcctcgtctttgccctcctcaccgttgcggcgacaagtgcaattgcgcagatggagactagatgcatccctggtttggagagaccatggcagcagcaaccattaccaccacaacagacatttccacaacaaccactattttcacaacaacaacaacaacaactatttcctcaacaaccatcattttcgcagcaacaaccaccattttggcagcaacaaccaccattttctcagcaacaaccaattctaccacagcaaccaccattttcgcagcaacaacaactagttctaccgcaacaaccaccattttcacagcaacaacaaccagttttacctccacaacaatcaccttttccacaacaacaacaacaacaccaacagctggtgcaacaacaaatccctgttgttcagccatccattttgcagcagctaaacccatgcaaggtattcctccagcagcagtgcagccctgtggcaatgccacaacgtcttgctaggtcgcaaatgttgcagcagagcagttgccatgtgatgcaacaacaatgttgccagcagttgccgcaaatcccccagcaatcccgctatgaggcaatccgtgctatcatctactccatcatcctgcaagaacaacaacaggttcagggttccatccaatctcagcagcagcaaccccaacagttgggccaatgtgtttcccaaccccaacagcagtcgcagcagcaactcgggcaacaacctcaacaacaacaattggcacagggtacctttttgcagccacaccagatagctcagcttgaggtgatgacttccattgcgctccgtatcctgccaacgatgtgcagtgttaatgtgccgttgtacagaaccaccactagtgtgccattcggcgttggcaccggagttggtgcctactgataaggaaagatctctagtaatatataattgggtcaccgttgtttagtcgatggatatgtcgatgcagcggtgacaaataaagtgtcacacaatgtcatgtgtgacccgcccaaactagttgtttaaattctgaaataaaataaaaataaagttgtatcaagacaatgttcatattggcattgtgtggatgtcaatctgattgccatgcttgcaagttcataagtttgtctttccttgtcacaagcgcaacctggtgccttaattaattatcaatgtactggaataatcactatttaaatatatagtgt

SEQ ID NO: 8707 - DNA, 751 bp, Triticum aestivum
  Clone ID: PAT_TA_8707
gccggccgggttgggaacatccgcctctctctctctctctcctcgcaccgcgtcccctccctctcctgtcgcgtgcgctcggccagcaaaaagcttccacataaaggccaacaagagaaaccataatctgttgggtgccagtcaaacctcaacaacaaagtttcatgtctgatctcgacgttactctgccatctgccttcgatccttttgctgaggcaaatgctgaggatgctggtgcaggcccgggcgcaaaagattatgtgcatgtgcgcatccagcagcgcaacggcaggaagagtctgaccactgtccagggcctgaagaaggagttcagctacaacaagatcctcaaggatctcaagaaggaattctgctgcaatggcacagtagtccaggatccagagctaggccaggtcattcagcttcagggtgatcagcgtaagaatgttgctactttcctagtccaggctggaattgcgaagaaggagctcatcaagatccacggcttctaagctgaagccgcctccgataaatgcccgaaccgccagccggttctactctatattgaagacttaaggcatctatattgccgcccgcttgttgaaccggtttcttgcttgatgcaagttgtgttgtcacctggttattatgctgctgctgtaccagcatatcagtatggtttgtctaagatgttgccgactaaataaaaatccgtatcgtttggcgaaaaaaaaaaaaaaaaaggccccta

SEQ ID NO: 8708 - DNA, 1888 bp, Triticum aestivum
  Clone ID: PAT_TA_8708
agtagaaggcaaacgttgtttatcacatactaattcaacattgtcgggacaacatccagaaacagtctcaccatcttaggaacaacccttagtcatgtcagggtctttgaaaagcagcatgtagcatatatacacacacacatcgccggtcaaattcggagtaaaaaagctaagcactctcccggcgcaagtgttcgcctccacgatggggcgctcgattcaaccaccctttcaggccgccttggcgaagccgacacgcagcttgccgtagtcgaagacggtgtggtaggggcccatgaagacgtctcccaggatccagagaggaccacggggaggggggatgtccatggctgtgaatccactgatgcactgggcagcagctccttcgccaaccttcaggatatactcttctggtttcagcgcaaacttcttgccaccaatggtgaactcaatgtcaggcatggatccaaggctggcacagtccacggctgattctcccatgggactcgggagacggttgcacagctggttaacgtaatccagtatgagatcctgggtcttgttctgtgcaagttggttctgcatccacacaacagccatctcacaggcactgcacatgggatcggtacggaggccattcgatttcacaggctcatcatcaaccaccctccgaattccagcactgacaccacgagtcccatcaaaggtgcacagaccaacctgagagcagatcttcttgggctgggtctctgctagcaacaggtcgaggatctgttgtccatactgagaaacaattgttttgcactcttggctgactaccccagccgcaccaatcttctcattaatttcagtaatgatggccgtggggccagcaagcagtgaagttccagaatcagcaattgcggcacaaccgccagcacagaatcctgtggacttccctccaaccaggacatcacccatgtcaaactgccaatatcccttctgggtgactgggacatatgtgtgctcacccacgtagtgtttgggatccattcctccaaaaataatctcaccaccctctccttcatcatcagcatgtcggttcaaccagaacgagaaaacaggatcactgatgagaccttgctctaccatattataccacacaggaactgctttgccaacagatatttccttaaacccaagcccaagaataccatcgaactttgcaaccaagaaagtaacacctggctcctttgtagcctcaatgaactcctgatctttcacaacaagatcacccactgtaacactatcctcgctgaaatatccagcaattgaaccagtgccgtactgaatggcagcaggctttccattcttcttgtaggtgctggacgccccggccttgtagcgtgcgtggaggtagcacgcaatcgagaagtagcacttggcggagggcacccagaggttggagctgccggtgtcgaagatgacggtgaacttctgcggcggcgtgccgacgccgatctccccgaagtactgcgcgttcatgtagttcttgagggacacgatgtcgccctcctcctcggaggggagggtgttggaggcgccgccgaggaggtgcacctcctcgcggtcggagaggctcttggcgacgcggctgttccggtcgatggcgcgcttcttcagcgcgatccgcaccaggccctccgcctccgaggccgggaggaggccctgcagcagcaccgccgcgaggagcagcacggcgagcccgcgggttcccatggtcgcgatcagaaaccggaggaggatggaggagagagaggaggggagcggagccgagccaagtgacgtgtgcggcaccttttttttttttttttttttttttattccccgggcccggccggcccctcga

SEQ ID NO: 8709 - DNA, 1405 bp, Triticum aestivum
  Clone ID: PAT_TA_8709
gcaaactttgatgatcaatccaaaagtaccgttgtagctagtgcaacctaccacaatgtaccaaaaaatcatttctgatgcatgcaaacagaattattaaagttgatgcatagaaggaaagaggtggtgcccggactactataaataggcatgaagtataagatcatcacaagcacaagcatcaaaaccaagcaaaactagttagcaccaatccatcatgaagaccttcctcgtctttgcccttctagccgttgtggcgacatctgccattgcacagatggagactagctgcatccctggtttggagagaccatggcagcaacaaccattacaacaaaaagagacatttccacaacaaccaccatcttcacaacaacaacaaccatttcctcaacaaccaccatttttgcagcaacaaccttcattttcgcagcaaccactattttcacagaaacaacaaccagttctaccacaacaaccagcattttcgcagcaacaacaaacagttctaccacaacaaccagcattttcgcagcaacaacaccaacagcttctgcaacaacaaatccctattgttcatccatccattttgcagcagctaaacccgtgcaaggtattcctccagcagcagtgtagccctgtggcaatgccacaacatcttgctaggtcgcagatgtggcagcagagcagttgcaatgtgatgcagcaacaatgttgccaacaattgccacgaatccccgaacaatcccgctatgaggcaatccgtgctatcatcttctccatcatcctacaagaacaacaacagggttttgtccaacctcagcagcaacaaccccaacagtcggttcaaggtgtctaccaaccccaacagcagtcgcagcagcagctcggacaatgttctttccaacaacctcaacaacaactgggtcaacaacctcaatcaacaacaacaggtacaaaagggtacctttttgcagccacaccagatagctcgccttgaggtgatgacttccattgcactccgtaccctgccaacgatgtgcagtgtcaatgtgccgttgtacagctccatcactagtgcgccattaggcgttggcagccgagttggtgcctactgataagaaaagatctctagtaatatatagttggaccaccgtcattttctcgatggacatgtcgaggaagcggtgaaaaataaagtgtcacacaatgtcatgtgtgacacacccaaactagtagttaaattctggaataaaataaaaataaagttttctctagacaatgttcataccagcgtcgtgtggacatcgatctgactaccatgcttgcaagttcataacttcgtcttgcctgatcacaacctcaacctggtgtattaccatgctgcaaaatctagatttaaata

SEQ ID NO: 8710 - DNA, 1061 bp, Triticum aestivum
  Clone ID: PAT_TA_8710
gcgagatgcatgggtcatgaataaatgtgaactttgtttcctgttggtacaacaacaacaatttctagggcagcaacaaccatttccaccacaacaaccatatccacagccgcaaccatttccatcacaacaaccatatctgcaactgcaaccatttccgcagccgcaactatcatattcgcagccacaaccatttcgaccacaacaaccatatccacaaccgcaaccacagtattcgcaaccacaacaaccaatttcacagcagcagcagcagcaacaacaacaacaacaacaacaacaacaacaacaacaacaacaacaagaacaacaaatccttcaacaaattttgcaacaacaactgattccatgcatggatgttgtattgcagcaacacaacatagcgcatggaagatcacaagttttgcaacaaagtacttaccagctgttgcaagaattgtgttgtcagcacctatggcagatccctgagcagtcgcagtgccaggccatccacaatgttgttcatgctattattctgcatcaacaacaaaaacaacaacaacaaccatcgagccaggtctccttccaacagcctctgcaacaatatccattaggccggggctccttccggccatctcagcaaaacccacaggcccagggctctgtccagcctcaacaactgccccagttcgaggaaataaggaacctagcgctacagacgctacctgcaatgtgcaatgtttacatccctccatattgcaccatggcgccatttggcatcttcggtactaactgagaagaaaataactctagtactagatatatgaaacaccgttttctcagtccatggtttggtcgttgtagcggtgaaaaaataatgtgacatgcactatcatgtaagaacccgaactatactagttcaaacttgggaataaaagacaaacacaggtcttgtctaaaaaaaaaaaaaaaaaaaaaaaaaaaaaaaaaaaaaaaaaaaaaaaaaaaaaaaaaaaaaaaaaaaaaaaaaaaaaaaaaaaaaagggggggcccgtttaaaagaa

SEQ ID NO: 8711 - DNA, 967 bp, Triticum aestivum
  Clone ID: PAT_TA_8711
cacaagagcaagttccattggtacaacaacaacaatttccagggcagcaacaaccatttccaccacaacagccatatccgcagccgcaaccatttccatcacaacaaccatatctgcagctgcagccatttccgcagccgcaactaccatatccgcagccgcatctaccatatccgcagccgcaaccatttcgaccacaacaaccatatccacaaccgcaaccacagtattcgcaaccacaacaaccaatttcgcagcagcagcaacaacaacaacaacaacaacaacaacagatccttcaacaaattttgcaacaacaactgattccatgcagggatgttgtattgcaacaacacagcatagcgtatggaagctcacaagttttgcaacaaagtacttaccagctggtgcaacaattgtgttgtcagcagctgtggcagatccccgagcagtcgcggtgccaagccatccacaatgttgttcatgctattattctgcatcaacagcaacaacaacaacaacaacaacaacaacaacaaccgttgagccaggtctccttccaacagcctcaacaacaatatccatcaggccagggctccttccagccatctcagcaaaacccacaggcccagggctctgtccagcctcaacaactgccccagtttgaggaaataaggaacctagcgctagagacgctacctgcaatgtgcaatgtctatatccctccatattgcaccattgctccagttggcttcttcggtactaactgagaagagaagaactctagtagtagacatatgatacaccgttttcttagtccatggtttggtccgttgtagcggtgaaaaaataaagtgacatgcagtatcatgtaagaacccgaactatactagttcaaacatgggaataaaagacaaacacatgtcttgtctacatatgattgtttgtttgagttccaaaaaaaaaa

SEQ ID NO: 8712 - DNA, 1233 bp, Triticum aestivum
  unsure (1)..(1233): unsure at all n locations
  Clone ID: PAT_TA_8712
ccgcccgggaaggtctctctctctctctctctctctctctctctctctctctctctcctctcaccgcaccgcgtcccctccctctcctgtcgcgtgcgctccgccagcaaaagcttccacataaggaccaacaagagaaaccttaatctgttcggtgccagtcaaacctcaacaacaaagtttcatgtctgatctcgacgttactctgccatctgccttcgatccttttgctgaggcaaatgcctgaggatgctggtgcaggccccggcgcaaaagattatgtgcatgtgcgcatccagcagcgcaacggcaggaagagtctgaccactgtccagggcctgaagaaggagttcagctacaacaagatcctcaaggatctcaagaaggaattctgctgcaatggcacagtagtccaggatccggagctaggccaggtcattcagcttcagggtgatcagcgtaagaatgttgctactttcctagtccaggctgggattgcgaagaaggagctcatcaagatccacggcttctaagccttagccgcctccgataaatgctcgaaccgccagccagttcttctctatattgaagacataaggcatatatatactgccgcccgcttgttgaaccgtgtcttgcttgatgcaagttgtgttgtcacctgattactatgctgcaacagcaaccaccattttcgcagcaacaacaaccaccattttcgcagcaacaacaacaaccaccatttacacagcaacaacaaccatcgttttcacaacagccaccaatttcacagcagcagcagcagcaacaacaacaacaacaaccatttacacagcaacaacaaccaccattttcacaacagccaccaatttcacagcagcaacaaccaccattttcgcagcaacaacaaccaccattttcacagcaacaacaaataccagttattcatccatctgttttgcagcagctaaacccatgcaaggtattcctccagcagcagtgcatccctgtggcaatgcagcgatgtcttgctaggtcacaaatgttgcagcagagcatttgccatgtgatgcagcaancatgttgccagcagttgcggcaaatccccgagcaatcccgccatgagtcaatccgtgctatcatctactctatcatcctgcagcagcagcagcagcaacaaacaacaacacacagggtcagagtatcatccaatatcagcaacaacacccccac

SEQ ID NO: 8713 - DNA, 1080 bp, Triticum aestivum
  Clone ID: PAT_TA_8713
cattttcacagcaacaaccaccattttcgcagcaacaacaaccagttataccgcaacaaccatcattttcgcagcaacaactaccaccattttcacagcaacaaccaccgttttcgcaacaacaacaaccagtactaccgcaacaaccaccattttcgcaacaacaacaaccaattctaccgcaacaaccaccattttcgcaacaacaacaacaaccagttctaccgcaacaacaaataccatttgttcatccatctatcttgcagcagctaaacccatgcaaggtattcctccagcagcaatgcagccctgtggcaatgccacaaagtcttgctaggtcgcaaatgttgcagcagagcagttgccatgtgatgcaacaacaatgttgccagcagttgccgcaaatcccccagcaatcccgctatgaggcaatccgtgctatcatctactccatcatcctgcaagaacaacaacaggttcagggttccatccaatctcagcagcagcaaccccaacagttgggccaatgtgtttcccaaccccaacagcagtcgcagcagcaactcgggcaacaacctcaacaacaacaattggcacagggtacctttttgcagccacaccagatagctcagcttgaggtgatgacttccattgcgctccgtaccctaccaacgatgtgccgtgtcaatgtgccgttgtatagaaccaccactagtgtgccattcggcgttggcgccggagttggtgcctactgataaggaaaggtctctagtaatatatagttggatcaccgttgtttagtcgatggatatgtcgatgcagcggtgacaaataaagtgtcacacaacgtcgtgtgtgacccgcccaaactagttgtttaaattctgaaataaaatacaaataaagttgtatcaagacaatgttcatattggcattgtgtggatgtccatctgattgccatgcttgcaagttcataagtttgtctttcctggtcacaagcgcaacctggtgccttaattaattatgcatgtattggaataattactatttaaatataatagtgttactgtaaaaaaaaaa

SEQ ID NO: 8714 - DNA, 1698 bp, Triticum aestivum
  unsure (1)..(1698): unsure at all n locations
  Clone ID: PAT_TA_8714
tttaccgaattttccagattttgagacaatggtcaattaatggcccaacagtccanacaggtttcaagntccagacatcantacgaacatcatcataatcagatatatctatatcaaaaataagttccctttccactggtacgaagacattgttaccagactgggcgtaggcatgtcgctttgcaggattacgctgtggacaggtccaatatcaatcttgaaagggcacttctccttgatagaagtctccagttcagctgcagtatcaaaggactgaaaccgcagatagatgtcattctccagtgtaaacgaaagctcccgacgcccaatgtatgactgatcacatccaggatgctttgcatcatctccggagagaactagtctccagtttttttttttttttttttatcacataataattcaacatcttcggggcaaacgtccacaaacagtcttgccatcttaggaacaacccttggtcatgtcagggtctttgaaaagcagcatgtagcatatatatacacacacagcaccggtcaaattcggagtaaaaaaagctaagctctctcccggcgcaagtgttcgcctccgcggtggggcgctcgctcgaccaccctttcaggccgccttggcgaatccgacacgcagcttgccgtagtcgaagacggtgtggtaggggcccatgaaaacgtctcccaggatccagagaggaccgcgaggaggcgggatgtccatggctgtgaatccactgatgcactgggcagcagctccttcgccaaccttcaggatatactcttctggtttcagcgcaaacttcttgccactaatggtgaactcaatgtcaggcatggatccaaggctggcacagtccacagctgattctcccatggggcttggcagacggttgcacagctggttaacgtaatctagtatgagatcctgggtcttgttctgtgcaagttggttctgcatccacacaacagccatctcacaggcactgcacatgggatcggtatggaggccattcgatttcacaggctcatcatcgaccacgctccgaattccagcactaacaccacgagtcccatcaaaggtgcacagaccaacctgggagcagacctttttgggctgtgtctctgctagcaacaggtcgaggatctgttgtccatactgagaaacaattgttttgcactcttggctgactaccccagccgcaccaatcttctcgttaatttcagtaatgatggccgtgggaccagcaagcagtgaagttccagaatcagcaattgcagcacaaccgccagcacagaatcctgtggacttccctccaaccaggacatcacccatgtcaaactgccaatatcccttctgggtgactgggacatatgtgtgttcacccacgtagtgtttaggatccattcctccaaaaataatttcaccaccctctccttcatcatcagcatgtcggttcaaccagaatgagaaaacaggatcactgatcagaccttgctctaccatattataccacacaggtactgctttgccaacagatatttccttaaacccaagcccaagaataccatcgaactttgcaaccaagaaagtaacacctggctcctttgtagcttcaatgaactcctgatctttcacaactagatcacccactgtaacactatcctcactgaaatatccagcaat

SEQ ID NO: 8715 - DNA, 2423 bp, Triticum aestivum
  unsure (1)..(2423): unsure at all n locations
  Clone ID: PAT_TA_8715
cccgggttttccccggccccccggttgaaaaatacggggccggggatttaattttggtggccccataaaaaaagttatccccttggccagcccacgggaagttaaatttgatcctttaaagcggggcgccccttttttgtttttttttttttttttttgtttttttttttttttttttttttttttttttttttttttttttttttttttttttttttttttttttttttttttttttttttttttttaaggaggagatgctgaagcgcaacccttattattttattataattattaggtgcgcgatgcggcgagcgtcacacgacctcaacgatagctccgcccaccgttaatcagccggtgggatgctcatcgacgccgttgttgccgcctacatgaaggtcgttgaggccatagctcatgcactggtgcacgcacaattccatccttgacgggtcatggtagtgatgttgacatttcatctcgcagaaagctctgctaggatgatgatgctcccggctgtggcactcgttcacgcaccgtcgtctcccggcggggtcttgccagtgctggcacttgatgtcgcacatgtcgttgcttcggtcgtcggcaccccagccgacctccagctcccaggcgtggggatggtgatcgacgtcgttgttgctgtccgcatggagcttgatgccatagctcatgcactggtgcacgcacagctccatccttgacgggtcatggtagtgatcttggcacttcatttcgcagaaagctcttctagaatgatgaagcttttgtctgtggcactcgttcacgcaccgtcgtctccatgcgagatgttgcccgtgttgacacttgatgtcacacatgtcgttgccctggtcatggacacgcccaccgaccacctcctccacctccgcgacgacggtgaccatggccacatcctcctgctccgctcctacggccgcagcagcgagcagcaccgccgcgagaaagaggaaccaccanatccaccatgaagaccttcctcgtctttgccctcctcgccgttgcggcgacaagtgcaattgcgcagatggagactagatgcatccctggtttggagagaccatggcagcagcaaccattaccaccacaacagacatttccacaacaaccacttttcacaacaacaacaactatttcctcaacaaccatcattttcgcagcaacaaccaccattttggcagcaacaaccaccattttctcagcaacaaccaattctaccacagcaaccaccattttcgcagcaacaacaactagttctaccgcaacaaccaccattttcacagcaacaacaaccagttttacctccacaacaatcaccttttccacaacaacaacaacaccaacagctggtgcaacaacaaatccctgttgttcagccatccattttgcagcagctaaacccatgcaagctattcctccagcagcagtgcagccctgtggcaatgccacaacgtcttgctaggtcgcaaatgttgcagcagagcagttgccatgtgatgcaacaacaatgttgccagcagttgccgcaaatcccccagcaatcccgctatgaggcaatccgtgctatcatctactccatcatcctgcaagaacaacaacaggttcagggttccatccaatctcagcagcagcaaccccaacagttgggccaatgtgtttcccaaccccaacagcagtcgcagcagcaactcgggcaacaacctcaacaacaacaattggcacagggtacctttttgcagccacaccagatagctcagcttgaggtgatgacttccattgcgctccgtatcctgccaacgatgtgcagtgttaatgtgccgttgtacagaaccaccactagtgtgccattcgacgttggcaggatacggagcgcaatggaagtcatcacctcaagctgagctatctggtgtggctgcaaaaaggtaccctgtgccaattgttgttgttgaggttgttgcccgagttgctgctgcgactgctgttggggttgggaaacacattggcccaactgttggggttgctgctgctgagattggatggaaccctgaacctgttgttgttcttgcaggatgatggagtagatgatagcacggattgcctcatagcgggattgctgggggatttgcggcaactgctggcaacattgttgttgcatcacatggcaactgctctgctgcaacatttgcgacctagcaagacgttgtggcattgccacagggctgcactgctgctggaggaatagcttgcatgggtttagctgctgcaaaatggatggctgaacaacagggatttgttgttgcaccagctgttggtgttgttgttgttgtggaaaaggtgattgttgtggaggtaaaactggttgttgttgctgtgaaaat

SEQ ID NO: 8716 - DNA, 1404 bp, Triticum aestivum
  Clone ID: PAT_TA_8716
atcaaaaccaagcaatactagttaacaccaatccaccatgaagaccttcctcatctttgctctccttgccattgcggcgacaagtgccattgcacaaatggagactagccgcgtccctggtttggagaaaccatggcagcaacaaccattaccaccacaacaacaaccaccatgttcacagcaacaacaaccatttccacagcaacaacaaccaattattatactgcaacaatcaccattttcgcagcaacaacaaccagttctgccgcaacagcaaccagttattatactgcaacaaccaccattttcgcagcaacaacaaccagttctaccacaacaaccaccattttcacaacaacaacaacaacaacaacaacaacaaccaccattttcgcagcaacaacaaccagttctaccacaacaaccaccattttcacaacaacaacaaccaccattttcgcagcagcaacaaccatcttcacaacaaccaccttttccacaacaacaccaacagtttccacaacaacaaatccctgttgttcaaccatccgttttgcagcagctaaacccatgcaaggtgttcctccaacagcagtgtagccatgtggcaatgtcgcaacgtcttgctaggtcacaaatgtggcaacagagtagttgccatgtgatgcaacaacaatgttgccaacagctgccgcaaatccccgaacaatcccgctctgaggcaatccgtgccatcgtctactccatcatcctgcaagaacaacaacagggttttgtccaacctcagcagcaacaaccccaacagtcgggccaaggtgtctcccaacaccaacagcagtcgcagcagcagcagcaactcggacagtgttctttccaacaacctcaacaactacaacaattgggtcagcagcctcaacaacaacagataccacagggtatattcttgcagccacaccagatatctcaacttgaggtgatgacttccattgcactccgtaccttgccaacgatgtgcggtgtcaacgtgccgttgtacagctcgaccactattatgccattcagcattggcactggagttggtggctactgataagaaaagatttctagtaatatatagtcgttagatcaccgttgtttagtcgatggatatgtcgatgtagcggtgacaaataaagtgtcacacaaacgtcatgtgtgacccgcaaactagtagttaaattctggaataaaatacaaataaagttttctctagacaatgttcataccggcgttctgtggacgtcgatgtgactaccatgcttgcaagttcataagttcgtcttgtctggtcacaaacctggtgcgttaatttattattcatgtatagaaataatcaaaatttaaatataatagtgttattgtaat

SEQ ID NO: 8717 - DNA, 1722 bp, Triticum aestivum
  Clone ID: PAT_TA_8717
tatatattaatagagacctttcgttatcagtaggcactaactccggcgccaacgccgaatggcacactagtggtggttgtagacagcggcacattgacacggcacatcgttggtagggtacggagcgcaatggaagtcatcacctcaagctgagctatctggtgtggctgcaaaaaggtaccctgtgccaattgttgttgttgaggttgttgcccgagttgctgctgcgactgctgttggggttgggaaacacattggcccaactgttggggttgctgctgctgagattgaatggaaccctgaacctgttgttgttcttgcaggatgatggagtagatgatagcacggattgcctcatagcgggattgctgggggatttgcggcaactgctggcaacattgttgttgcatcacatggcaactgctctgctgcaacatttgcgacctagcaagactttgtggcattgccacagggctgcattgctgctggaggaataccttgcatgggtttagctgctgcaagatagatgaatgaacaaatggtatttgttgttgcaacaacaacaaccaagtctaccgcaacaatcaccgttttcgcaacaacaacaaatagtactacagcaacaaccaccattttcgcagcaacaacaaccaagtctaccgcaacaaccaccattttcgcagcaacaacaaccagttctaccgcaacaaccatcattttcacagcaacaactaccaccattttcacagcaacaatcaccgttttcgcaacaacaacaaatagtactacagcaacaaccaccatttttgcaacaacaacaaccaagtctaccgcaacaaccaccattttcgcagcaacaacaacaactagttctaccgcaacaacaaataccatttgttcatccatctatcttgcagcagctaaacccatgcaaggtattcctccagcagcaatgcagccctgtggcaatgccacaaagtcttgctaggtcgcaaatgttgcagcagagcagttgccatgtgatgcaacaacaatgttgccagcagttgccgcaaatcccccagcaatcccgctatgaggcaatccgtgctatcatctactccatcatcctgcaagaacaacaacaggttcagggttccatccaaactcctcagcagcaaccccaacagttgggccaatgtgttttcccaaccccaacagcagtcacaacaacaactcgggcaacaacctcaacaacaacaattggcacaaggtacctttttgcagccacaccagatagctcagcttgaggtgatgacttccattgcgctccgtaccctgccaacgatgtgccgtgtcaatgtgccgttgtatagaaccaccactagtgtgccattcggtgttggcaccggagttggttcctactaataaggaaaggtctctagtaatatatagttggatcaccgttgtttagtcgatggatatgtcgatgcagcggtgacaaataaagtgtcacacaatgtcgtgtgtgacccgcccatactagttgtttaaattctgaaataaaataaaaataaagttgtatcaagacaatgttcatattggcattgtgtggatgtcgatctgattgccatgcttgcaagttcataagtttgtctttcctagtcacaagcgcaacctggtgccttaattaagtatccatgtgttggaataatcactatttgaatataatggtgttcctgt

SEQ ID NO: 8718 - DNA, 1824 bp, Triticum aestivum
  Clone ID: PAT_TA_8718
caaacaaacaatcatatgtagacaagacatgtgtttgtcttttattcccaagtttgaactagtatagttcgggttcttacatgatagtgcatgtcactttattttttcactgctacaacgaccaaaccatggactaagaaaacggtgtttcatatatctagtactagagttcttctcttctcagttggtaccagagatgccaaatggcgcaatggtggtcgagcaatgtggagggatgtagacattgcacattgcaggtagcgtctgtagcgctaggttccttatttccgcgaactggggcagttgttgaggttggacagagccctgagcctgtgggtttagctgagatggctggaaggagacctggcttgatggatattgctgctgaggctgttggaaggagacctggctcgacggttgttgttgttgttgttgttgttgttgttgcagttgctgttgttgttgttgttgttgttgcaactgttgtttttgttcttgttgttgttgttgttgttgatgcataataatagcatgagcaacattatggatggcttggcacctcgactgctcagggatctgcaacagttgttgacaacacaattgttgcaatagctggtaagtactttgttgcaaaacttgtgagcttgcatgcgctatgttgtgttgttgcaagacaacatagcgcatcatttaagccaagcaagcagtggtcaatacaaatccaccatgaagacctttctcatccttgccatccttgctatcgtggcgaccaccgccacaactgcagttagagttccagtgccacaattgcaaccacaaaatccatctcagcaacaaccacaagagcaagtcccattggtgcaacaacaacaatttccagggcaacaacaacaatttccaccacaacagccatatccgcagccgcaaccgtttccatcacaacaaccatatccgcagccgcaatcatttccacagccacaaccatttccgccacaactaccatatccgcagccgcaaccatttccaccacaacaaccatatccacaaccgcaaccacagtatccacaaccacaacaaccaatttcgcagcaacaagcacagcaacaacaacaacaacaacaacaacaacaacaacaacaacgacaacaaatccttcaacaaattctgcaacaacaactgattccctgcagggatgtcgtcttgcaacaactcaacatagcacatgcaagctcacaagtattgcaacaaagttaccagcagttgcaacaattatgttgtcagcaactgcagcagaccccccatcagtcgcggtgccaagccatccacaatgtcgttcatgctattattctgcatcagcaacaacaacaacgacaacaacaacaaccgtcgagccagttcccctaccagcaacctcagcaacaatatccattaggccagggctccttccagccatctcagcaaaacccagaggcccaaggttctgtccagcctcaacaactgccccagttcgaggaaataaggaacctagcgctgcagacgctaccagcaatgtgcaatgtctacatccctccatattgctagaccaccattgcgccatttggcatcatcggtagtaactgagaagggaagaactctagtactagatatatgaaacaccgttttcttagaccatggtttggtcgttgtaatggtgaaaaaataaagtgacatgcacaggtcatgtaagaacccgaactatactagttcaaacttgggaataaaagacaaacataggtcttgtttgcaaaaaaaaaaaaaaaaaaaaaaaaaaaaaaaaagggcggc

SEQ ID NO: 8719 - DNA, 2150 bp, Triticum aestivum
  Clone ID: PAT_TA_8719
gaattcactagtgattagcgtggtcgcggcgaggttttttttttttttttttgaccaaatatagcctatataaatagaacatgaataagctggctacaacaacatccgacacaaactagatgttcccttgaggctctgcagcatcacatcatgcatcccacaacacaaagtcacgactaaacattacagctactgcagatgtttcctgccacagccacagccccctaactacaacagacacggacaatgacaatggtgcccagtcagcagacagacaaattcaataggtaaggtaaaaaacaaagacgaccaaggagtttacaatccatacaacggtgccatgatgagagcgaacccatttacaggggaagttcacggttggttggttggttggttcaagcctaagccttccttctgcgcttctttccagttgaagacgcccccttgccagatgcctcctgctccatttcagatgcctcagcctcttccttctcctccttctccttccgcttctcttgaacagatccagatccactacccgccactggagtactagtggcagcgctttttggtttccgcccaggcctacccttcacagatccatcgccagatttgctcccaacctccttcagcttctggttgctgctgtctttagctaaatcatccttcgtcttgttagctgatccagtggctttctccttgccttctttcttaatctcaacagcagttttaggtgtccccttggcatctttgacagcagttttcccctttgatttgctgggagttgtagacggtgtgccaccattgttggggcgccaacctttcggacggccccttttctttggaagctccactccgtcacttttaggtgtttctattttttcttccttcactggcagcagcgtgattcctctcccttttcggccacggcgctcagatggaaaatcacaagttttgccttcttcctcactgatgaaatcccatttttcatccctgagcagcagtacctctacatctccatcatcatatgcaaccttgtgccttttggaatgggtatcaaatgagtcaacaacgcccttgtaaaacatctcatcgtctggccaccatactttgatccttgcaccaactagacttccatccagacctttgtccttccttgagcgaggagtctcttcagtatcttgttcacgcttcctcttcatcacattattctgcccactttgacccttggttctacctgaccccttggtcagagactttggagagaccatttcctttagagtcatatccttggtggtgtcctcctcagagaggatttcttccttgtgctgtttcaaactgggtttttgctgcttctttgatgattctccttcaccagtcttttttgtggaagctttggtatcatccttagctgatcgctttgttaacttcccagttgaatccatagcctcctcagtcttcttcaaatctaaatctgaagatcggttatttctagcagcctttttctctgatgactttggtccaggaggtcggcctcgttttggcttaactacatcgggtgtggtatcagcacactttggtacattatcagccactccatttactaccttcttgtctgcagataactctccagatactacatgagcctctttgtcaacatcaacattagagtgtggagtagccacagacttgcagggtttgagcttcaggtctttgtctgaatcaagatagatggcttcttgggctttgcatcaacaggttctacaccttcattagcagatttcaactgatcagcatcttttgtgtcttcaggctgttcaggcttctcttttggtgacgctggtccttttggtgacgctggtccttttggagacactggtccctttggagacactggtctctttggagacgctgatccctttggagacgctggtccttttggagacgctagtccttgattagcctcaccattatcaaccagagttgcaccactactaatagcagtagtcggagtaccatcttgctccagttttgaagattcctgaggcagttcatcagaaatagtcctttccgaaagtttgccatcatccaccgtgtccttcccagaagatcaacaattgttgtcttccctgacaaccttatcaccttac

SEQ ID NO: 8720 - DNA, 593 bp, Triticum aestivum
  Clone ID: PAT_TA_8720
cgtccggtcttcctcctcgaccgcggccccttggccgagcgattcggggtggacgacgacgggacgctgccccctctgcggctgggaggagagcggggtcaccgtcgccctcatcttcgagcacgcgtcgcgctgccgggagaggcgattcgagatgctgcagcgccaggcggaggagcggattgccggtgagcaagcaaagaaaggtcgccgccatgcgcatatcaagcttcggaagaactagtgtgctggcgcgtcaacgaggaggatcgacccaacaccggagtggaagagttccagaggaccgactgcatgagtagtttaggttttatattagccctgtcccgtaggactttgttgaactcacgtagagttttagcaaaattggcttaggaagccatatactagaacaaaaaatgcagattttactgcacatatgccactatactgtaatcattgatgcccataaaagatggcattttctgttagatgttcctttaatttccttttcttccaatccggggcttatttctgcaataggggaacctctctgcgttctttttgcgaatggaattgagctagtaaaaaaaaaa

SEQ ID NO: 8721 - DNA, 829 bp, Triticum aestivum
  Clone ID: PAT_TA_8721
acccggggcccccccacttgtcggtcaggcacctgtgcccgccgccatgggggcccacagcgaaccagtaaaagccgatgctgacgaacctcctccaactgaggtatggcttgggcaccttgtgtgaagggattgccctcggagtacgccaccgagaaattgaatcgtaagcaagcatatgagggtctcattatgccttttagtgcaaatgacttgtcaaaagtaagcactgtggctgggctatctacttcttggataatgattggcttaaccctggctgtcggtttatggttcacgcttcaacctatggcaccggtcgcctgccgaacttcggcttgtgggccccgacaataaggttacttcttaccattatgtccttgtttagcacctggtccaccatgctgtaggagcaggcaccgagaaactcgttcgacgcagcttatcagggtcccatgaagccttttggcccaatgactgtcctaagtaagcaccgagttaagagatctacatccgcatgataattggcttaaccggggctcgcactttatggtgttcgattgaatgtactgagccggatacctgctaaacttaaacttgtggtgcctgactgttacttcactaatgcccattatgtgatcgtggcatcactagtagcatttaggattgaatgtacggactcggataccctgctaaacttatacttgtggtgcctgactgtaaggttactaatgcggttggttaatcactagtagcatatgcagaagggacagtaaactcgtaactcgtattttgcgtatgcatttgtagtactttaagtatgcgtttgact

SEQ ID NO: 8722 - DNA, 694 bp, Triticum aestivum
  Clone ID: PAT_TA_8722
aagatccaccctgttttattgaaaccaattcaatcaatatttatactggtttactgaacaaacatgtaaatgtaaatgtaaatgaaacaatcctgaactaacagacaaaaaaagtgaaacctttcttctatccaagaattgtacaccaccaataatgtaattccaacaccccctagtcaccacctccgactcacagcataatgaatcaatccgaattgtatcgtgaatgaacaagaatttgcttcccctatgcactgttcttcctcttctcgtcgcagccgctgcaatgtaccgcccctcctcctctcgctgtacagccgaaggcggcagccggcttgcgacggcagctgcgatggcagtggatatgcatcgcaaggcaattgcattaccacaaccaaatgaaaaaattatatcgtgtgtcccatttctgcctaccaagaaaacaccgccgcgggcaacgccgatgatgacaatgaggcccaggacggcgccgatgcttgcgatgcatcaccgtcgccaatgtagaggtcgtatgatttccaagtatggtcgagcgggcaaggcctgccggcgtcgaggcgatcccatggcttgcccttgcctgaccagtgcatcaggctgacagggcccttgtggagagggcggcagctaccaagaatgttgtcgccgcccaagccgtgctggttccaccgat

SEQ ID NO: 8723 - DNA, 1719 bp, Triticum aestivum
  unsure (1)..(1719): unsure at all n locations
  Clone ID: PAT_TA_8723
ccgatctagcgatggagtgccttgccgagatgccgcacgcgccgctcgaccgccgcccgcgcaagcgccagcgccttggctgggatgtcggccccgagatccctcagctaaaaaaactgtgtggggaagaagtcgcaaatgtgattagtgctatgacaatggggctatcttccggtggtattgttttctcccaggagacccaagggctttttcgttttgcgacccctcctctgagagaagatgacaaggatggacattatgtttttgctgtgggagacaacctcacatcacgctataggattaatgcaaaaatgggtgaaggtacctttggtcaggtgttggaatgttgggacagggaacggaaagaaatggttgctattaagatcatcagaggaattaagaagtacagggatgctgcaatgatagaaattggcatgctcgagcagctttgtaaatatgaaaaaagcagatcccagttgtgttcaaattcggaactggtttgactatcgtaaccatatctgtattgtctgtgagaagcttgggccaagcttatatgattttctgcggaaaaacagttaccgctcattcccagttgccatagttcggggaaggttgccaaacaactgtttggaatgtctagcatttatgcatgatttgcgcctcattcacactgatttaaagcccgagacattctntcttgtttctctggagacaagtatactagctgattacagcacttcatcccgttcaccgcaaacccatgaatactaggagcgtcttgctatgatggagagggtgcttgggccgttgccatatcacatgctcaagaaggccgatcgaacatggtgagaaatatgtgaggaagggccgtttaaactggcctgaaggatgtgcttcacgggaaagcatgaaagctgtcatgaagctgcctcggcttcagaatctggtgatgcaaaacgtagaacattctgctggggacttcatcaatcttttgcaagggctgctgagttatgatccagcaagccgcctaacggcccaagaggcccttgagcatccattcttgacggagctgagtgagcgaagaagatgatgtgcccaagatcctagcatctgccatgtcgctaacttataacttgtatgtttgagccgtgacttccatttgtcgtgttcatggaatgtcagagattccattctctcttccatggaatggaagaaataattaaattacgtccgatttaacagtagctttctcattgcattacgtgcttgtgtaacctgctcgttatctggacatatgttgacttgtgtgtatgtaatcaagatgagattctctctctaaatatattctgtcagagatcgacgtctctgatggttgttttaacctgcagtgtactagtgcatgtcataatactccctccgttccacaaaacacttaatactaagttaaactataaaaagtttgaccaagtttatagagaaaaatatctacatctagaatatcaaatattccctctatcctgaaatataatatcagttttgacactattagatacatcgagacgcatattcatattgtatatatttgatactgtaaatataaatagttctttcgattaacttggttgatctttgtaaagcttgagttttaaaaatatctgtatgcactacattatggaacttgaggagcatgatttagctttattgtgtattttctaaaaa

SEQ ID NO: 8724 - DNA, 671 bp, Triticum aestivum
  Clone ID: PAT_TA_8724
gaccaaaccaattggcaccgccgccttcgtcttgagagcttcgttcggtagcgatggagtgccttgccgagatgccgcatgcgccgctcgaccgccgcccgcgcaagcggcagcgccttggctgggatgtcggccccgagatccctcagctaaaaaaactgtgtggggaagaagtcgcaaatgtaattagtgctatgacaatggggctatcttctggtggtattgtttcctctcaggagacccaagggctttttcgttttgtgacgcctcctctgagagaagatgacaaggatggacattatgtttttgctgtgggagacaacctgacatcacgctataggattaatgcaaaaatgggtgaaggtacctttggtcaggtgttggaatgttgggacagggaacggaaagaaatggttgctattaagatcatcagaggaattaagaagtacagggatgctgcaatgatagaaattggcatgctcgagcagctttgtaaatatgaaaaaagcagatccaggtttcagtcatcctttcacaattcctactacaagcgtgtgcccaagtccagttcaataaaggttattgattttggcagcacaacatatgaccagcaggaccagacctatgtcgtttctactaggcattatcgtgctccggaagttatactggga

SEQ ID NO: 8725 - DNA, 1396 bp, Triticum aestivum
  Clone ID: PAT_TA_8725
ggggcgtcaacctggcgccgccgccttcgtcttgggagctttgttgtgccttgccggggtgcctagcccagcgctcgactgccgcgcccaaatgcagcacgcgctagccgggggtcctgggcgcgcatgtcagcgccaaggaaactatgctgaacaaacagtcgctaaaagaaatagcttttgtatattggaggtcgctacaggggctattgccttgtcccagggcctccccgctggtggtcgactggcgtgcccagtatgttgaggctatccgaatgatgcgcacactgctctagacgttggatacaactatggacggtgcttcctttttcaggcagaagggctgataggaaccggagcggctcttgatgatgtatagtagaaggagcggagggagtggagaggacagcggtgctggcatcgtagaaactgcgatgggcgaaacactacctgaatactgatgaagcagtgactgcctgtgttcatattctttgtatggatgaaaatccgttctctatttctcagaagtggagaaagatttcaactagttcgccgaaggtgggaccgtatcacggtcgactgcgtatatcaagttcgatatatctgtatagttttggaagcacgtgttatgagtcgcgaggccataccattgttgtgcctagtatgcactctggggcactggaagagatcctgcgtgttggatgcggtggcttcctgttatatttggtgagttcggtgtgtgatagttgaactctgcaccggatgaaaacttggagcatcttgctatgattgagagggtgcttgggccgttgacatatcacatgctcaagaaggccgatacatgctcaagaaggctgatcgacatggtgagaaatatgtgaggaagggccgtttaaactggcctgaaggatgtgcctcacgggaaagcatgaaagctgtcatgaagctgcctcggcttcagaatctggtgatgcaaaacgttgagcattctgctggggacttcatcaatcttttgcaagggctgctgagttatgatccagcaagccgcctaacggcccaggaggcccttgagcatccattcttgacggagcggagtgagcgaagaagatgatgtgcccaagatcctagcaaacttgtaacctgtatgtttgagccgtgacttccatttgtcgtgttcatggaatggcagagattccattctctcttccatggaatggaagaaataattaaatagataggattttagcagtagcttttctcgttgcattgcttgtgtaacgtgctcattatctgtacatatgttgacttatgtgtatgtaaccgggatgagattctctcaatgaatatattttgatggcaaaacaaaaaaaaaaatcagcagcgcccacgccacggt

SEQ ID NO: 8726 - DNA, 1604 bp, Triticum aestivum
  Clone ID: PAT_TA_8726
cgtccggagaccgagatcggcggcgccgtgctccgcctcaagactgcttctgctcaaagctggacgtgcatggatctttatgtgtttgcaacaccatataggataacatgggattactattttgcggctcgagaacacactttggagataacgtcatgggaggaagaagcagagctggaatatgttaagcagcatggtgtgtctgtttttctcatgccatctgggatgcttggaactttgttatctttgattgatgtcctgcccttgttttcgaatactggatggggtcaaaattccaacttggcctttttagagaagcacatgggagctacatttgagaaacgttctcaaccttgggttgctaatattatgaaggaggacatacaatctggtgactttttggctctgtcaaagattcgagggcgatggggtgggtttgagacattagagaaatgggtaactggtgcatttgctgggcatactgctgtgtgcttgaaagatgagaagggtgacctctgggttgcagaatcaggctttgaaaatgaaaagggagaggaaattattgctatagttccttgggatgaatggtgggaaatggcactgaaggatggatcaaatcctcagatagcccttttgccattacaccctgatatacgctctagattcaatgaaagtgccgcatgggactttgcacggagcatggtcggaaagccgtatggctatcataatatgatatttagctggattgatacaataggagataattatccacctcctcttgatgctaatctggtaatggctgttatgtcaatgtggactagattacaaccactttatgctgcgaacatgtggaatgaagcccttaacaaacggcttgggactgagggtttggaccttcagggtgtcattcttgagactgaaaagcgtggcatgtctttcgatcagttgctcaccatccctgaacaagatgaatgggtatacagtgatggtaaatcaactacttgtgtttctttcattcttgcgatgtacaaggaagctggggtgtttgctcctttcacagaatcaattcaggtcaccgagttcactatacgggacgcatatatgctcaagatatttgaagacgaccggaccaggctcccaaactggtgtcataccgaggcagacaagcctcccttctgccagatacttggggagtacagaatggagctaccagagtacaacacgatagagccgtacgcaaaaatgaatgagaactgcccatccttacccccgacgtacaagcgaccatctcgctgctgacatgagacggcgtacattggcagactgcctatgtttccggtgcttaaattatgtacagtataaacaaactacgctgtatatagatgtttggtacagatagcagtatccacgggttagcaaaaaggcagtgcatagttttctgccagttagcgtagcagtttctgaacccaggcttccaatgtgaacctggatagaggatttgctcgcatagatagaactttcaaaccatagcttgaaaagttgttgatgatgatcttggcttcatgaaatgtatgcccctgaaataaaatcctccatgtattctc

SEQ ID NO: 8727 - DNA, 1092 bp, Triticum aestivum
  Clone ID: PAT_TA_8727
tctgttttcgtgtattaaatgcttatgcaaggttccttgatgacacacctgagctagtgaagattgttagagtatcatgtggagagtaccatgcagcagctatatcagaaaacggggaggtgtatacatggggacttggaagcctggggcagcttgggcatcgctcgcttcagtctggagataaggagctaatcccaaggcgagttgttgcccttgaaggaatagtaattagggatgtgtcttgtggtggggttcactcttgtgctgtgacggaaggtggagccctctactgttggggaggaggacatgtgggccaactggggcttggacctcagaatggtttcttttcatgcgctcttaatggatccgacatgctacttcgtaacattccagtcctggtcataccatcaggtgtccggcttgttacttgtggtcactcacacacacttatatcgatgaaagatggccgtatatatggatggggctataatagttatggtcaggcagcttatgagaaatctacttatgcttggtacccttctccggttgattggtgtgttggagaggtgagaagacttgccgcaggtggcgggcattcagctgtgttaactgatgcatcgtccttaaaagaactatgtgagtttaagctagcagagactgtaaataggtcgaacgctcggctaatagaagacgttgcatcacgaaccggggctgatgcattggcacgcctgtgtgagaaattaagggaacatttggttgagcaaggagactccgagcttatggaaatgcacatggttgaagagatcgaggccaaagccgggtagactagtagtgaatcgatgcggtcttggttccatttcgccatacacattgatccaagcattggcggtgttgtattatttcacgggaagtagcaattgttctctacttgcctgaaacctcatttgtggtctcccaagtgtgtaccaaaggagtggaggctctgtgtgtatcatggacttccatgtctaaacatgtatacgttgggaactgcatgaaactatacctgcaaactagaaggtcggtaaattcgataagccgcacaacttcgtg

SEQ ID NO: 8728 - DNA, 767 bp, Triticum aestivum
  Clone ID: PAT_TA_8728
ttttgattgcagcgtacttgtaagatattacgactggaccctactgaaccactaccaagatcccaaaacacacataccatatatatagttagcaaatccattcagagtagcattgttacgtatgcaaatcataatactaattagaagagcacaccctgcggcctgcgcctcctcggtcattacatcgagccagtcttcgtggcagccacctcagccttggcagcatgcagcccctgcccctggtgtgtccatgatggttgggacgattcttcagtccgtggtgccaatccttgtgaacatttgctcctgtgcagatgagtgctgaccggcgacgctcgagcgaggttggccctcgggttttagacgtcctcatgcgagatcaaggcgccggcacagcgatgtgattcagaggtcaagacaccggcctggtcaatcttgtagccttttgttgtggttgtagagatcgggtggccagcgacaccatgatgcgctctagtttgcgcacttccatgattcgagtatggtaggcttggagatgattcccttgagccgagggcgctccacctccccgctacgaccaccggcaagccaccacaaatgcgcagtagatctgaatgaactactaacgccaactacgagcaccagctgcaaatactccaggaataaaggggcaagcatggcaccgtacatgatttatctactcagatgatagacttccaagaaggggatagacggagaggaaccttcgaaatccaatctatggcgtc

SEQ ID NO: 8729 - DNA, 1407 bp, Triticum aestivum
  Clone ID: PAT_TA_8729
cgtccgacgcgccaaaacgcgcccctgcgccccttccccacctcccctggtccctcgcgagagcaggtccgggtcgcgtctccggcggcggagaagcaagacaagggcggcggagatgtcggtcagcaacatagggatgatggacggcgcctacttcgtggggcggaacgagatcctcgcctggatcaacaccacgctgcagctcggcctcgccaaggtcgaggaggcggcgtcgggcgcggtggcgtgccagctcatggacgcggcgcaccccggggcggtgcccatgcacaaggcagcagaaccagatgcagcagcagccaatgctgagcccgatcctggaggcgtctgaggccccaagcatcacccccaaggattcttccgaggagagcttgaggcaggaagcagcggcagcacacaagaggaagagcatctcggacctggaggagttcgagatggggtcgagctccaggatgaggctctcagacgtctcggatgtgcagctgtgcggctcaccgttgatgagcgtcacccgccagcaaggagggaccgaattgcaggggctaagttgttgtcattgccggttgtttcgtttgttgtttggttccgtcgcacgcaggctaagcgggccaacgggcatgcttcaaatgctccacagcggtgcgcaaagccgcctccagcttagcctcctctgatgaccgagctgaaactccttgttgatagcgccgagaaagagagagatttctatttctctaagctgcgggacgttgagatcttgtgccagagccccgaggttgagcatttaccgattgtgaaggctatccagaagatactctatgcttcggaggacgacccctcgacggtggcggaagcccaggcagagatggtggcgcagcagaaccagatgcagcagcagccaatgctgagccccatcctggaggcgtccgaggccccaagcatcacccccaaggattcttccgaggagagcttgaggcaggaagcagcggcagcacacaagaggaagagcatctcggacctggaggagttcgagatggggtcgagctccaggatgaggctctcagacgtctcggacgtgcagctgtgcggctcaccgttgatgagcttcacctgaaagaaaggagggaccgaattgcaggggctgagttgatgtcattgccggttatgacttgtgggtttatcttgtgttgtttcgtttgttgtttggtgtcataatgtgtgtgctcttgtggagctggagttgaacctgcctttgactgtgatcgatctgccacagcatttgggccttctgcaacatgttattattgaatagcctcttttatgtagtcactggtgttccttgctctgcctctcttattgcaagacggtctgttttcgattaaaaaaaaa

SEQ ID NO: 8730 - DNA, 691 bp, Triticum aestivum
  Clone ID: PAT_TA_8730
cccgtgccggattcgggccgcggcccgagccgggacggcccgggagcccacgacagatctccctattgtcgccatctctctcacggtcctcttcccctccggcgactccagcgcgcggcacggccggcaaggcggcaagcaagatggattggcaggggcagaagagcgcggagatgctgatgcaggtgctgctggtggcgtcggcggtggcggcgttcctggtcgggtacgcgatggccgacttccagctgatgctgctcgtctacgccggcggggttgtcctcacggcgctcgtcaccgtccccaactggccgttcttcaaccggcacccgctcaagtggctcgacgccgccgaggctgatcgccacccccgcccgcagatcagcagcgcaccagcgacgaccgggggtaagaagaagaccgggaagaacaagtagtcatgttacttattggtccatgtgtcgcagacatgttttatgatatatcagttgcagaacttctgagtatgacatgctagatgttgtgttacctgaatgttttatatgacaaaaaattagcttccttcttggtgtctggatgtctgctttcatggtgctgaaaagcctggtcacctatatatgctcaatacgggcagtgcctatcaaaagaaaggaaattatagcaaaaaaaaaattctatcaaaaaaaaaaaa

SEQ ID NO: 8731 - DNA, 680 bp, Triticum aestivum
  unsure (1)..(680): unsure at all n locations
  Clone ID: PAT_TA_8731
gtccacaacgccaacgccaacgctaacgcatcgcctcagctacttcgggagctgccgcgtcgtccgtgcgtggggggaccggccgcgcacatcggagccccgccgcctcggcgagccggtccgccagacgccatggctgccggcgacgagccctccgtcacccgctggtccttccaggacttcgagcgctactacgacgcgggcctcggcatctgccgccagccccagggcgacggcgacgacgcgccgcccggatcgggctccgccgacaccgcccacgccaatggcggcgccgacctgtccgtcttcgagcaattcgagcggctggatagaaatgtcgagttgcgcaatggttcaatggatgccggaccaccgcagaaatccctgcttccttcttttgaatctgcagaaacacgcaacttagctgagacattgttgagggatatcattcgtgggagtccagatgtcaaatgggaaagcattaaaggtttggaaactgcgaagcgacttcttaaggaggcagtcgtcatgcctataaagtatcccaagtacttcacagggtctgttatcaccctgnnnnngtatattgctnnnttggtccaccaggaacaggaaagacaatgctggcaaaagctgtggctaccgagtgcaaaacaactttnnnnaacatttcagcntnn

SEQ ID NO: 8732 - DNA, 736 bp, Triticum aestivum
  Clone ID: PAT_TA_8732
tccctacggccgaccccccgtcagttctatttccgttctgtccattagccttctcatcctttttcttgacaactaagcagaacaatcggaactctgaccacgacgggtggtcgtgtgcacgagccctccccaactctttataaagttcaccctatctaactaaataccaatgtggaaacgaagtggccaaaactgatatactgccatgtccgagccctaactaaagctcgctactgttctccaacttgctgtcggagcatcgctcacatatggagcttattgagttctgaactcgccgtcgaagcgtcgcccacgtgtctcgtgttcctgtgggcttcagggtcctccctggagaggatctgaacagcaggccgcgctcgcgctgctgctccagggctagagttcaccaccgcagcatttggcctagctgagcacacagggatagaagttcggaccgtaacaggggccgccaaccaagggggccgctgctggtataacaaacctgatgaactcataggagtcgcagctccatatctcgctggagcttgcatgtccaaaggccataactgctggtgatgtcgccctgctgaacggaagattacttctgtgggtaggctcgccgtgctgaacaggactaggataacccttgtcgttggacaggtctttgtacaacagatgatccagcacgagacaatgatggcttttggtgggctgttccgctggcttctttgactct

SEQ ID NO: 8733 - DNA, 660 bp, Triticum aestivum
  unsure (1)..(660): unsure at all n locations
  Clone ID: PAT_TA_8733
atggcttatttatcttttatataactntacagtaccttatttattgtgatatacgtgttatgctaataccttctctttatttatttatttattgttatatatatgcgatcagcatgcgcctgcgttgaaccccagggcgccgccaccaacgtcgtagagcacctcgaacgtccgctgctgcacgttgccgataatgccgagggagctgtcatcgcggttggccgcgaaggcgaggcagctctccagaatgatcccctcgggggcgaggttgacgatggcgcccccggagaacaccagtgcaacgctcggtattctgatgctggactggccactgaagtcgaagcacgtgtccaagatgcccatgggctgcgccggcgggtactgcttcatgccggccttgaacgccgacgacagcgccgagtacgcggtccgcggcaggcgcgtgatgattgtgccggagtccatgagcgacccggcggaaaagaccgtggtgggtatgttgagctgcctgcctcccaccctgatggcctgaagagacacgatgtagtacgccgggacctgcctgctcctcagcaacggtgtcttgacgacgaaacccgaggttgctgcacccagagtgaggaagccggacgagcccggagtcggcgggaggcagtacga

SEQ ID NO: 8734 - DNA, 1793 bp, Triticum aestivum
  unsure (1)..(1793): unsure at all n locations
  Clone ID: PAT_TA_8734
atcaaggtaagatttttcatgtatcaccgttttttattcattatgaaaatacgctgtattggacttacacccctagttacgcagaagtgcaagcaaagcggatgacccgattcagtatgcgctgatgtggatcggttcgggatctctgtagtttcaatggtaagtaataaaggtcttatacaagttgcatcaggccaaatttcgtctgcttcactacacgacgacgtaaggtaaacagaagtaaactgcggctacttccgttaaactcaggtggaagttgagttgcttcgacatgggcagggaccccatcgcaagtgctggttgggaagctcagagctttgacagcgctatgtccatcacatcgacgaagaaatcagcgtcttccttggtgaagcacagagggggagtgattctgaacacgttgccgtaaaagcccccctttccgaccaaaacgcccatatctttcatgtgctccatggcctggcaaatctcgtctttggccggggtcttgagctgccggtcggtcacaagctccacgccaagcatgaagcctgttcccctcacgtcgccgatgatttggtgcttctcctggaggccgcggaggcggtctttgaggtaggcgccgacgatgaaggcgttctcctggagcctctccctgtcgagcaccttgaggacggcgagcccaccggccgtgcacaacgggttgccgccgaacgtgttgaagtaggaccgcctggtcaggacctgcgcgatctccggcgtagtcaccacggcgcccagagggatgccgttgccgatgccctttgccatggtgactatgtcagggatcacgccatgggtctcgaacccccagaagtggctgccgacgcgcgcgaagcccgcctggacctcgtcggcgatgcagaggccgccggccttcctcacggcgtcgtacgccaggggcaggtagccaggcgccacctccacgatcccaccaacaccctggatagcttcggatatgaagccggcgacgtggcccgtggtgccgaactcgatgatctccttgacgtcccgcgcgtacttctcgccgtccgagccgaaggcgcctctgtaggggtccgggttgacggcatggtgcacgccactctgaacaacattgaacttccagttcttctgtgcggtggcacccatggtgccggaggcgttgccgtggtaggagttccggagagatatgatatcgtgggagccggtgtacagccgcgccatcatgatggccagctcgttggcctccgtgccggagttggtgaagaagacgaccttgagatcgccgggcatcttggcggccagcgcctcggcgaagtctgcgatggcgtggttgaggtagagcacggtggagtgctgcaggcggttggcctgcgcggtgatggcgtcgatgatgtcggggtgggtgtggccgcagcacacggtggcgatgccggcgaacgcgtccaggtagcgccgcccgtgctcgtcgtagaggtactgtttcttcccctccacaatgttgaggggcttggagtagaaatggaacagggaggggctgaggaactcggcgcgcttcctggcgatctcgacggcgctcggcccgtcgtagggcagcggcacgtggtcgaacgccggcattctcggcacgtccaccggcgtcctaaccgccgcggcgagcctagagaacgatctcctagcccccagcatctctactgcccacctgaatggaacgtgttatcctctccgttgcgatcacccgatgtgattcacttcccttganccnagtgtan

SEQ ID NO: 8735 - DNA, 990 bp, Triticum aestivum
  unsure (1)..(990): unsure at all n locations
  Clone ID: PAT_TA_8735
tttccccnagtcacnggacgtttgtaaaaaggaccggnccagtgnaantgttaactaccggncccacttattagggnggaattggngcccngaccgntngcattgntgcccgacccngccaattggcggcccngcgggaaattcgnattttcgngccggcccgccccccgcccgggcgggtgagagagagagcgagcctgcctcgtgtttttttttttttcaagaacttttggataaccatgttcacctttgtatttttgcttgggacctttcgtcttttacaacaacaaaaaaaacagagccaattcttggtttgttaatatatcctctgctgtaattacaatcttgtgtacatgttcttatctggcacacaaggacctcacttcttatagagaaataaggcatccaccttggttttcgcatagcaaggagaactgaaaagaagctacattgaaatcttacgaaacaggatgttcaatccctgtgcaacgaaatagtgttccggtcttcacaaagataaagggcatgaagaagaaaactacacccgtatacacgtctttttcatcgttcaagtttgctgagcaaatcttcaagacgtggcaattccttcaaaatgtcgttccagtttggcatgcctcttccagatcttctcacacgaccatcaagacggagaattatgtagacatcttcaccaggagtgacaccttcaagattcttgccggtcacgtatccaactttcccattggttcctggagagacaatatcagctttaaatcgaacctcagctctgagtcgtgattttgccgcaatagattcagtacgtttttcaaagtcacccccaatggagggggcgggtgcaccacatcttctgggtccgttgccctgtgggttgccttggacttttggtgcagccccaaagatcacaggaattagaagaacgcctcgtttgagcagatcagttcggtacctctcagctctttgcattgcttg

SEQ ID NO: 8736 - DNA, 601 bp, Triticum aestivum
  Clone ID: PAT_TA_8736
cgtccgcccacgcgtccgcccacgcgtccgcccacgcgtccgctcccttttccctcgctcgccatccgccgccacacagatccaccgcgtgctcccgtcctcgagcccgaggccgcttccccttcgcgccaccgtcgtggcttaggccaaggcaacgaccgggtcttggtggaggcagaagcacgtggagagcccggcggctgcaggtagaagcaggggttgtgcagtggtggatgcggtcggcgtcggtgattgaggaaggctcgccggtcagagcggccggagaagatggaaagaatagcacgaccctgcacaatacgcacccccggccaccgcctgctcgtccttcatgtggtgtcatcgcagcttttgaaaaaggagtaggaggagccacagatgaggaggaaggagaccagcaaggggacgagatattcttgttcaatttggttctcatggtggcatctttaggttccatctttgatgcttggatttgttgtctagccagcaggagtaggagacagtgagtatcaggaaggagacaagcagggggaagagagactcttgggtgtgggtgtattgttatttattgagtcaattgaga

SEQ ID NO: 8737 - DNA, 693 bp, Triticum aestivum
  Clone ID: PAT_TA_8737
gcttagcattttctgaggcatcgtgcttggtttccgaagatatcaaccaatagaaagtttccggaagctatcaatctgtatcactaaggtaccactaaactaggagactgggataaaaagatgtgctaaaccacacggcactcgctcagtatcattacaaaaaaaatactagctaacaaagaacttgatcacttatcatgggcagcaaaagccttctcccagctagcccacctccttctcccagctcagtatcatcacaaaaaatactagctaacaaagaacttgatcagttatcctgggcagcgatctccttctcccagctagtccacctccatgactttttcacctccagagctggcattgtcttcctcgagttcttcgaggaatctctcaggaatcatatcataaggtacataccccacaatgggaatacctctatcataagagttccaaatttcccgaagacactcttgtttatccttctctttgtacaagaggtcaacaaatgcaggcataaattctctgaaataataatgggccagcatgtctctctccggcatcatcaacaacaccttgggcttagggtggggacctgcggaggagctgctgggggttgtcttcttcgcttcagcttgagacataattgcaggaaggagagcgtcctttcttgtgggctgaggagggaagcggggg

SEQ ID NO: 8738 - DNA, 2497 bp, Triticum aestivum
  Clone ID: PAT_TA_8738
cccacgcgtccgtgacttctcgaatggagacggaaatggtggagaaagtatatacggtgaacaatttgaagatgaaaattttgtgctacgccatgatgaccggggtctcttgtcaatggcaaatgctggacgtaataccaatggctcccagttcttcattacgttcaagcctaattctcatcttgacaggaagaacactgtttttggcaagcttattcttggaaatgatgtgctgaagaggattgagcatgttgatgtggatggttctactaataagcctattgttccagtaagaatagtggattgtggggagcttgttgatggtaaaggccggggatctttctcaactgaaaatgataaaaagaaagataagtcaacgttgtccattgattcatctgaagacgaaggtaatgaagaaaaacacaagggccgtcgcaagaaatctttgaagaggagaaagaagaagagaagatactcttcttcagaatcagaaacctcatctgagtctgagtcgtcagattccgagagtgaatcagattactccagcgagtcatctgacatcagcagctcaagtgatgacaagcggagacgaaggaagagacactccaagaaggataaacgcaagcatgggaaaagaaggcgagatcgcaggcgcgagaaaagacgtcgaaagcgtgacaggaaatcaaagcagaagtcaaaaaggatggtagagagtgacagtgaaactggaaatgcgagtgatagcagctctgaggatgccagaagaaagcggcaacgtcatggaaggaaatctaaggccacatctcaaatttctgctgaagatcacacagcagtagctgctctgaaggatgccacttcaactcaggaaaagattggaacaccaaggagtctggcacaagaagacaaatctcaactggagaatggcgagatgcgcacaaatggtgttactgactccaaatctgaaaggaagtccggtatcatgcctgttctaactggcaaccgaagcaaatctaggagccagagcacgagtgctaatcactccatgagcaagagcatgagtgtaagtcccagaagcccaatcaaaaggtcaaacgtcagcctggagagattggtaagcccgagtcctgttcatcagcgtagtagaagtcctgtccatgcttccaaacaaaaagaaagcaggagcccaccccgacagaggaatatgagcatgagtcctcatcgaagaagccccagcaagagcccacctggaagggcaagcagaagccctgttgtccgcaggaacaggagtcctgttgaagttcggacaagaagcattagcaggagcccagctaggtccttgcagcgaagaagtccaagtaggagcccggaaagaacccatgtgcgaaaaagtgtcagtccaagccccacacctatggagaagggaaaaagcattagccgaacttctgcaagatctccactgcacaagggttttagccggagccctgatatgcctcctagaaagactacaagcagaagccctcaaaggaatgctcatagaaactttagcaggagccctgtgggatcttctagaagaagcttgacccctgtacgaggtggtcgatctcgcaggaacgccagcagaagtcctagcccacctcgcagggcagtatcaccacccaatcacggtaggagcccatctaggagtgtctctcccgatggatcaaaacgcataagaagagggaggggctttactcaacgttactcatttgcaagacagtatcgttcaccttctgttgatcgttctcaccgctatggtggaagaggtgatcgtgacaggtatatcagtcacaggggctctcgttatcgatcacctccaagacgatacagaagccctccaagaagagcatcaccaaggtacagaaggaggagccgaagcgtgtcacgcagcccaccagcttatcgagaccgcacaaggggaggtggctacagcaggagtccagtacgtagtcgttcgcctcctggtgggaaaccaagttcccgcggtgatcgtgcacggtcgctctccaggagcaggagcctgtctgggtcaagatcaaggtccccaccacctgtgcaggatcgctcccccattgcctccccatctccaaaacgtgcaagtaacgacaggtcccggtctatgtcggtgagtcctgaagggaagaagggtttggtttcctatggagatggctcccctgattctgctgggaagtaggggaaaaagaaagaaggcattcactagctgtttcccctgctgttgttcagctctgttaaaatgttacatatgtgattcgagatgattttgaatttggttgaattatctctggacaaccataatctgaggttagtctatggttttgttaattgcatgccaacattttcttgtatcaatccttgttaatggtgcgaatcatggtttttatcaaagctgctacatgtagtaatcctatagtacttttgacaaatcccccacacaccc

SEQ ID NO: 8739 - DNA, 975 bp, Triticum aestivum
  Clone ID: PAT_TA_8739
cgtacgcccacgcgtccgcccacgcgtccggttaccccctcaccactgcgccatgcccacatccaaggcatttctcatcttggtgctcgccgtgctcactcccatggcggcgacctcccaggacacggcgacgaaccttaccctccacaacctgtgcgcgtaccccgtgtggccgctcatcactccgaacatcggcctccccgccatccccgacctggacgacgccgccagccgcctcgacgggggcggagaggggctcgtcaccctgtcgttcccttccggcgcgtggtccggccgcgtcgtggcgcgcaccggctgcagcagcagcgatgactacgactcctcctccccctcctcctcctcgccggcggcggtgaccaggtgcgacacgggcatgccgccggcgccggtgacggtggcgcaggtgagcgtgcacgggtccggcgggctggcggagtacagcgtgagcctggtggacgggttcaacctggccggtgatggtgacgccgcacgggttcgagcagggccggcagtgcccgtccctcggctgcgcggtggacctggacgtggactgcccccgcgacgccagggcccccgccggcgggtgcagggcccagggccaggggcacttcttcaaggagaggtgcccggacactcggacgacgccgacggacgtggaggccacgccgcagcgctgcatccagcccggcgagctcaagatcgtcttctgccccgattcttcctactagtcactcgctaccacaccacacactaggctagctagaccggctgtgtgtcactcacgatgccggttatataataagcttagcgattgattgctgattcgctaagccagattcaaccgaataatatgttaactattcaaaaaaaaacccacgcgtccgcggacgtttagcaacaaaaaaacaaagaaaataaacagtagcaggcttagtttgtgttgttaaaaaaaaa

SEQ ID NO: 8740 - DNA, 1510 bp, Triticum aestivum
  Clone ID: PAT_TA_8740
atctgtcctttcaaccatcatcgacccgaaggacggctcgatggcatcaacacaagcgctgaaacagatggctttggagcatgatgtcccgattgtttcgatcgctgatctcatccgcagggagggaaaaagggagaagctggtggaattgatcgctgtatctcgtttgcctactaaatggggcctattccgtgcttactgctaccaatccaagctggatggaactgagcacatcgctgttgcaaagggtgatattggcgatggagaagacgtgctggtgagggtgcattcaagagtgcctgaccggcgacatcctcggctccgcccgctgcgactgtgggcgagcagctggacctggcgatgcagctgatccagaaggccggctgcggcgtcctcgtgtacctacgcggacatgaaggccgaggcatccggctccgccagaagctccgcgcctacaacctgcaggaccaaggcagcgacacggtggaggccaacgtcgagctcggcctcgccatcgactcccgcgagtacggcatcggcgcccagattctcagggacattggcgtgcgcacgatgcggctgatgacgaacaacccggccaaattcgtggggctcaaggggtacgggctcgcggtggtgggccgggtcccggtgatctcgccgatcacaaaggagaaccagaaatacctcgagaccaagaggaccaagatggggcacctctacggctccgacctccccggcggcctcctcaaggaattcctcaaccctacggaagacaacgccacgaactaattatacacccaccacacgatccacggatcatttggtttcttttaacttcatttctttctgatatacaacgatcgaacgagaattgagacgaaatattgcaaccaatctgtagcgattccattcatccattgttcattgtaacaaacgaaaacaattacaaactacgagcctcgatcactgggcccaggacgatcatcaaacacgacgagccgagagaaggcgggggacgaagcgcctaggaggaggtgaacttggtgacggccttggtgccctcggagacggcgtgcttggcgagttcgccggggaggacgaggcgcacggaggtctggatctcgcgggaggtgatggtgggcttcttgttgtacctggcgagcttggcggcctcctgcgcgagcttctcgaagatgtcgttgatgaaggagttcatgatggacatggccttggaggagatgccgatgtcggggtgcacctgcttgagcaccttgaagatgtagatcttgtacgtctccacgctcttcttggccttcttcttggccttcttgtccgagccgccgccgccgccctccttggccgccggcagccgcttctccgccttgggcttcttctcccccttgggggccttctccgccttctcctccgccggcttcttctccgccggcttcttctccgccttgggcgccatcacggacggatcgagaggtggctggttgcggcgggg

SEQ ID NO: 8741 - DNA, 1009 bp, Triticum aestivum
  unsure (1)..(1009): unsure at all n locations
  Clone ID: PAT_TA_8741
gnctagttctagatcgctagcgatctagaactagtctctcgcttcttcccccggcccatgcgacggcactgacatctttgcccgcctgacctttcgatggccgccgccgccaccgccgccgccgcaaccggcacacttcttccccacgcactattaaatcaccgctcgcctccgccgccacagctcctcgcgctgtcctcctccttccgccgcctctccttatccacctcccatcgccggaacacccatttagtcgcccatgcagacgccggtgccgcagagccggagcccgcgacggagtctgctcctgagggcgagcctgtcgctgcctctgctgactccgaggagggggaggcggagggggctgtcgcattggcggaggaagaggaggagccggcgccgaggcccaagccgattaagttcggcgagatcatcgggattctgaacaagcagttcatcgaggaggctgagaaggtgaaagtgcttccggatttgaagcccggtgacatcatcgagcttagaatgcaacgtcccaacaagaggagattgtctctctttaagggtataatcattgcaaagcacaaatctggtgttcacaccacgatccgcgtcaggaggattattgccggtgttggagttgaaattacattccccatatactcaccaaggatcaaggagatcaaagtaatcagacacaagaaggtgaggagggcaaagttgtactacctgaagtacaagcttccccgtttctcaaccttcaagtgagattagactcgcagcttctcacactagcatgtcgatttctccttgacaaacgagttttcacaatcatgttcagatctgtgcatccactgtaatgatctctgaacctcgagccgcataatcttacatctttttttcgattggcatatatttcgtcttgtgggggaggagtgtacttgtgagtgtataaaattcctgccagcgctccggtatgaatatgatgatgtttattgcgcccttcnccagc

SEQ ID NO: 8742 - DNA, 1184 bp, Triticum aestivum
  unsure (1)..(1184): unsure at all n locations
  Clone ID: PAT_TA_8742
ttccgcgttcggcacctccctcgcctctctcgcttcttcctccggcccctgcgacggcgctgacagctttgccctcctgaccctgccgtcgccgccgccgccgccgccgccgcccgcgacctgcccaccgcttcactacgcacccttgaatcatcgctcgcaccccccgccgcagctcccgccgctcccctcgccgtccctccgcctccccttcccctcctcccatcaccaggaccaccccttaagcacgcacactcgcgacgccggcgccgtcggagccgggggcccctgtctgagcctgctcctgatgggcgagccggtcagctgcctctgctgactgcgaaggagggggaggcggaggggggctgtggcagtggcaggggggaagaggaggagccggcgccgaggcccaagccgattaagatcggcgagttcatagggattctgaaaaagtaattcatcgaggaggctgagaaggcggagatgctgacggttttgaagcgtggtgacatcacaggtcataattttcaacgtttcaacaagagaagattgtctctctttaaggttgtaattcttgcaaagcacatattcagtgttcacaacacgatccgcttcaggaggaatattgccggtcttggagttgaaatcacattccccatgtactcaccaaagtccaaagagatcaaagtaaggagacaaaagaaggagaggagggcaaagttatactacctgaagtacaagcttccccgtttctcaactttcaagtgagactcgatacgcggcttctcacactagcttatcgatttctccttggcaaacgagtttttacgatcatgctcagatcagtgcatccactctatcattttcagatccgtgcatccaatgtatttatctcttttcctcgagccgcataatcttacatctttttttcgagtggcaaaaaaaaaaaatagtcctggcgctgtggacttggcagaaaatggtatccctgccaccgcgccgccctgcctaggatggtgtttattgcgccctttcccagctacccaccggagtcccaactgttggttaacagtacgtaacgctgctgttatgaaagaacagtggttatgaaatagtaggtctgggctcttatgtactcctatataatgaagaanggttgaagtttccgcaaaaaaagggggccc

SEQ ID NO: 8743 - DNA, 867 bp, Triticum aestivum
  Clone ID: PAT_TA_8743
actggagcacggctcaaagtaacaggaattcaactactctagcacaggccatgtatttgatgagttgccagctgcttgagcaagttgaccactttccaatgatattgcgggtttaacccccgcctcaagatgagttgggtacagcgtgtcaacaaatgaacgcaccattcatgttacaagcaccaggggatcaacccttttctccgttctagcctagattgctactaaactagcaccaaaacaacttctatgtcgaatgggtggcaagttgtggtcttttctatatcatacacaatggtcaaccttgtttaaggttctcagatgtcaaggtgatctaggttgaccatgcttgcggccttctggattagttccttcctgtattcaacccgagcacccataagagatgagaacacaacattggcctctgcagcatcttcgaccgttagctgcttcaacagcctcctttcaggatccattgttgtttcccacaattgtaagggcatcatctcgcccaaacctttgaacctctgggtattataagaagcatttgtagggaaggtgttgactagctctttaagatcagcctcatcatagcagtagtgcacttgtttcccacgctcaaccttgtaaagaggaggcacaccaacatagatgcaaccttcatcgaaaagtgctctctgatatctaaagaagaaagtgaggagaagagtccggatatgtgcaccatctacatcagcatctgtcagtataactatcttatgataccgaagagcttccttcttaaaatcctcacccttcactcctaatccaagaccaagaataagattttggatctcttcatttttgtacatggctgcctcgtgccga

SEQ ID NO: 8744 - DNA, 775 bp, Triticum aestivum
  Clone ID: PAT_TA_8744
acggatcagtggtcaagttaatgcacgagaggaccaagtttcggctgcattcccacgacgtgccgtatggatctggtagcggccagcaatcggtcaccagcttcccaaatgtggatgacgctaacagctactggattgtgagacctcaaccggatacttcagcaaaacaaggtcatgctataacacctggaacaatcgtcaggcttcaacatatgaggactagaaagtggttgcacagccatctgcatgcttctcccattacggggaatctggaggttagttgctttggtggtgagggtgagtcagatacaggagactattggatgcttgagattgagggcggtgggaaaacatggcgtcaaaaccaacgaattcggttgcgccatgttgacactggtggctatctgcacagccatgacagaaagtatacccgcattgcaggcggacagcaagaggtatgcggtgttggcgacaagcgacccgacaatgtctggcttgcagctgaaggtgtctacttccccgtgagccaggccaaatagctgccttgctgggtgagaagtgtcttcactgaaatagcaattgtgtatgattcggaatactggagttgtaatcattagaaatgtttggctacgtccgagttcagttaatttgagctattagtgtaatgtaagcttgttgtatatgaactgaagagcgcatgatgctgctgagtaccacttcgttcatgctccgtttcttccaatgcaaataaattgcattagcaggtgtgcgttgc

SEQ ID NO: 8745 - DNA, 1208 bp, Triticum aestivum
  unsure (1)..(1208): unsure at all n locations
  Clone ID: PAT_TA_8745
cagttgttgtgctcccccgcctggcagtacccgttcaccgcggcgcagcagcggccgctgcacccacgtgcccgaagctccccttcgccgtccgcggacgcgtgggcggaagtcggcgcggcgcgcaattcgcgtgctccttcgacctgagttccccgcggcgtagtggcgtacgagcgaaccttctagagcttccttctctgccccgtcgacaccgccgcggtggcgccgcccacgccccaggggccggtcctctcccgccgcaagcccgcctccgccgaggcgaagccgtcggaggcagcgaccaccagcctcgccggcgccctcgcgcgcgagcggataaggcgccgcggtgagcgggaggaggagcaggaggccgcgccgttctggcagaggacctggttcctggctctgctgctcgcgatggccgccgcgtcgttcgcgctcgcgcttgtgctctacctcggcctcgacctccccgaggcgtcgccgtcgcagtcctacgccgccgactcggacagcgctgtggagatttcctacggatcagtggtcaagttaatgcacgagaggaccaagtttcggctgcattcccacgacgtgccgtatggatctggtagcggccagcaatcggtcaccagcttcccaaatgtggatgacgccaacagctactggattgtgagacctcaaccggatacttcagcaaaacaaggtcatgctataacacctggaacaatcgtcaggcttcaacatatgaggactagaaagtggttgcacagccatctgcatgcttctcccattacggggaatctggaggttagttgctttggtggtgaggggtgagtcagatacaggaggactattggatgcgagtgacaaagtctgggttgcagctgaaggtgtctacttccctgtgagccaggccaaatagctgtcttgctgggtgagaagtgtcatcactgaaatagcaattgtgtatgattcggaatactggagttgtaatcattagaaatgtttggctacgtccgagttcagttaatttgagctattagtgtaatgtaagcttgttgtatatgaactgaagagcacatgctgctgctgagtaccacttcgttgatgctccggcgctgggaaaacatggcgtcannnnaacgaattcggttgcgccatgttgacactggtgactatctacacagccatgacannnngtn

SEQ ID NO: 8746 - DNA, 580 bp, Triticum aestivum
  Clone ID: PAT_TA_8746
taacactactaggaaaaacactaccagtagcatggtttttttgcataccagtagcatgggttctcgcgctactgctatggcgctacagctaatttttagcagtagcacgttttttaccccacgctacagctcccacgctagtactaacctaactactagtagccctcacttttgacccacgctactactaacaatttaggaattaaaaaaaataaaaattagatgtagtactcatgaatggtaatacgtccatcattttaaggtgggtaccttccctagtggccaccaacctaaacagaccacctctctagatgtatctacaaggctaggagttcagacgccgctggacacgaatcctcccttttgcggacggtggcgtcgaggtcctccacatcagcgacttccggggttgaaatcacctggacgatcatctgtgcgacgtggccaccgggcttcacggcgaagtccgcctttgagtggttgaagagcacagcgccaccgggccacgcttgtcagcgtcgatcacctttgcgcccacgtcgggaaagtgaaaaaaaaaaaaaaaagaaaaaaaaaaaaa

SEQ ID NO: 8747 - DNA, 767 bp, Triticum aestivum
  Clone ID: PAT_TA_8747
attcaatcgcaggtggaatctgaagctagaagagctcttcaagcagacttggatgaggccactgtttcactaaatgaggtgaatgagagtacattatttctgtctaataagcttgatagcactgtttccaggatttctgctattaaagaagagaaagaggttctttcagcggctcttttggagcaaaagaaaagtacagccgaagctcagaaaaatatggtggatgctcagcatcttattaaaaggcttgggatggagagagagaatagtgaaatcaggagtacaaagcttgaagaggaattggccacagcaaaaggtgagatgttatatctgaggaggcagattactgcaagtgggtcacagaatgcagatgttttggaagcaagcccaacaccaattttcaaccaatctccggaagatcgtgttccaaataccagtagtactgatgctgtacctcctcgttctgctaagaagatttataggagaagaaaagacagaccataaacatgagcattaccagaacatgtgatctaggaccatcaatctttaatttgctctcattttagcactttatgataaatgttcttatttaacttccaacatttgaaagctagcatgttagactaccctatagtagctccaactctttttgttgtagctctaaaagaagacccttctggtttccatgatccatatgctagattgtgagggagttgcaaatgtatgttaatctgtgtgcagatgtgttgacctgcccgggcggccgc

SEQ ID NO: 8748 - DNA, 875 bp, Triticum aestivum
  Clone ID: PAT_TA_8748
ggtcgcacaggtgtataggcataggtactccaacatatgcatgatgacggtcaagaacagcacaaaaggcacccgctggtagcaaaagagctagaacagccatatggattgttcagttctactagtactataaagtaagaactaggaccttgtgctcataaaggatggatactccaaaggcatacatggcaactagaattacaaaccagcttatagccctatgaagaatggaggctccttatccacaccaccttcttcttgcatctcacagaacggaagtggaatcatgctctcttgaaagtactgatttgtgaagtatgttgaatatgttccctctttcatctcgtaatatcccaaaaactttccgtcagtgtcacaatgcaacagataatcaggacccaccgatggagtgtgacaacagatcagcagctcacgctggttaagcagtgccatcttagaaatatacttgaactgtggtgatgtattcatcgctaacaagttaatccggtacttcaaggcccagacctcagcctcatagtcttgcatcacccaaatctctatgctggcatcattgtcgatgcatgaagcaagcttgttgtccatctccaacaacgacacccgacggcccggccgcccaggcccccgcgtcccagaattccggcaaacgcgatgacacagatggccgactgatgattctcggcttgtcggatccaaacctgagaacgtagccacgaaggcagccacgtgagaaccagagcacccggtattccccagatggttggtgctggtagaatccggctatgtagatgcggggaacccttgctgatgatgatggaactcgaggttgcggtagtatagcacatttgcgagtggcc

SEQ ID NO: 8749 - DNA, 2810 bp, Triticum aestivum
  Clone ID: PAT_TA_8749
tttctgtgaggggcgaggcctcccgcgccggctttctgatgcggggcgtcactgagcttttccaatctctctctccctcgcggactggctgccgtagcggctggactggggccgaaccctcgatcggcgcgggcggacggcggcgaccaccggaggcgagagatggtggtgatcgagctcgagccggagcacgagggcgaggagacgaaacgcccctcctcgccgccggagttcgtggaagccccggacccgaggagcgcggagcaggacgaggaggccttcgaggacgcgctcaccgacgagcagctgcgggagaaagctagaagccaagcaaacgatgcaaaagcagaaggaaataagcattttgcagctggacagtacgaggatgcattatcacaatatgaaattgcactggaaattgctgctgaactggaatcttctgaagatatatcctctgcatgccattcaaatcgtgctgtatgtttcttgaaattggggaaatatgatgaaacaattaaggagtgcaccaaagcgcttgagctgaatccttcatatttgaaagctctgcttcggaggggagaagcacatgaaaagcttgaaaactatgatgatgctattgctgatatgaaaaaaatcattgagctagatccttcaaatcaacaggctaagaaatcattgttccgacttgagccactggcagcagagaaaaaggaaaagatgaaggaggaaatgcttgcaaagctgaaagatctgggcaactcggtgctggggcggtttgggatgagcgtggacaatttccaagctgtcacggatccaaactctggctcgtactccgtttctttccagaagtagtagcatatagcataatgaactatacagacgaacctggcttgggtgtccattgaggccttgagggggagcatccagtatatcctttgaatcatggtggctgttgacgataagttatgtaatgctcttgcactcttgctgtcatgaacgctggttctgaagatgagcctgaccgttcttggcactttatgctccttgggtgccttcacgtattgatacacatgtacatttgccgcctaggcactaagttgtttttgtaaacgacccctcatttcccctttgtagtacggatgcacgatctgttgtcgaattgctgcttgggcagggcagggatcatgtactttctggagtacgagccagacaccatggctccattccttagaggcctgatccggcgtttcctggcgagcaagataaccaacccaagcccgcctccgaatcgcaacgcctcctactcctaccttcagacgctgaacgtgttggagcagtcaaaaacgcatcctaccccggagaatggcctccctacgtcagagacgtatacccttgaatcaattcctggactttaagagttaacagttactcgtactagtagatatcacactcatggtagtctttagtctgcgattgtaataaacaaattatgggtgcgtttcaggaggggtaggtgactaggtgttggcgccccttgcacaaataaaaggggcaacgtgtatctgtcgtgagtggagcattctaaagcgattcttgttcatacccttttcgttataggctatccatgttcaagaattatctatgtaagagtcttgcagcttgagactggactgggggcgaaccctcgatcggcgcgggcggacggcggcgaccaccggaggcgagagatggtggtgatcgagctcgagccggagcacgagggcgaggagacgacacgcccctcctcgccgccggagttcgtggaagccccggacccgaggagggcggaggtggacgaggaggccttcgaggacgcgctcaccgacgagcagctgcgggagaaagctagaagccaagcaaacgatgcaaaagcagaaggaaacaagcattttgcagctggacagtacgaggatgcattatcacaatatgaaattgcactgcaaattgctgctgaactggaatcttctgaagacatatcctctgcatgccattcaaatcgtgctgtatgtttcttgaaattggggaaatatgatgaaacaattaaggagtgcaccaaagcgcttgagctgaatccttcatatttgaaagctctgcttcggaggggagaagcacatgaaaagcttgaaaactatgatgacgctattgctgatatgaaaaaaatcattgagctagatccttcaaatcaacaggctaagaaatcattgttccgacttgagccactggcagcagagaaaaaggaaaagatgaaggaggaaatgattgcaaagctgaaagatctgggcaactcggtgctggggcggtttgggatgagcgtggacaatttcaaagctgtcaaggatccaaacactggctcgtactccgtttctttccagaagtagtagcatagcataatgaattatacagacgaacatggcttggtgtccattgagggggagcctctagtatatcctttgaatcctggaggcgattgttgatgataagttatgtaatggtcttgcactcttgaagtcagaacgctcgatctgaagatgagcctgaccgttcttggactttattctccttcggtgctttcacgtatgatacacatgtgcatttgctgcctaggcactaagttgttttttgtaaacgactcttcattttcttctgtagtatggatgcactatctgttgtcgaattgcttttatggcggcagatccttagcttctcaaccggttgatccaatttcaatgattttaatttgtcctacaaggaacaaagaaattggcttggcc

SEQ ID NO: 8750 - DNA, 1065 bp, Triticum aestivum
  unsure (1)..(1065): unsure at all n locations
  Clone ID: PAT_TA_8750
acgagagcgcaagcggacgagctgcggaggaaggaatagagcagcttacgagttccccgtccctccctgcgcccatccccgctcccgctcgcccagatcccaaaccacaaccctaggccccacctccgcccccgttcgccccgcccgccctacgcacgccggcgaccccgccgccgatgtgatcaggccaggcgccgccgtcgttgacgctctagcgccgcgcttctgttgcctgagggggaggcgccgcaccgctggcgcagatcggggaggcgcgcgacatgccgggggacgtcgcgacctcgtcggcgacggcgtcggggccgccggccgccgcgtcctcttcgcaccaccaccaccatcccgccacctccgcccgcagcgccctctccaacgccgtcgcgggcgcctccgccggtgtgatagcggcgaccttcgtgtgcccgctcgatgtgatcaagacgaggttccaggtgcacggctggcccaagctagcccctggcacagctggaggtagtgtcatcattgggagcttataacagattgctagacgggaaggctttcggggattgtatcgtggtctttccccgactatgctggcgcttttgcctaactgggcagtctactctactgtatacgagcagcttaaaagcatgcttgcttccggcgaagggagccatcaactctctctaggggcaaatgttatggctgcatcatgtgctggagctgcaactacaatagcaacaaatccactttgggttgtcaagacaagatttcagacccaaggagtaagagctggtgcgatggtcccatacaaaggcacggttgctgcattgacgagaatagcacatgaggaaggcatccgtggactatacagtggacttgtccctgccttggctggtatcactcatgttgccattcagttccctgtatacgagaagataaaagcttacctggctgagcgagataacactaccgttgaagcattaagctttggtgacgtcgctgttgcttcatctctggcaaaactagctgcgtcaaccttaacatatcctcatgaggttn

SEQ ID NO: 8751 - DNA, 842 bp, Triticum aestivum
  unsure (1)..(842): unsure at all n locations
  Clone ID: PAT_TA_8751
cagttcggcgacttgccgctgccgtatgcgctggcccagagtgggctactgcggtcgccccaaacaagccaaaccacactatgctagtaaaaaaactgaagtcaactgcaacagaaataaacaagactatgtacagcagccaaggacacttttttcacaggacgacgcagcatccttgccatggcggcgctatgccctcaccataccggcgatatgctcaaaccaaaccgcagttccaagtttacaacctttgcacttctgcagtgtagcgagatgtctagcagtagcaagacgcacaacggaaagcttgggttgaaaagaggagctaattaaactctgtcatagtcacccatctgaaatgtccacaatttcaccaattgcggactccacagtttcacggtctgtttgacctggagcacctacacgattatgcacaagatgatctggcaacgaccgttcttcgacttgagaagcaggcgcactttcagatatgttcttgtcccctgagccttgagaacaagaatcaaaacacacatcctttctaccatcgtttaattctgttgcctgagaatttttcagtaacctttgtcgttttctcatttcggttcttttattgatcaagggcacctcatcttcatctgaatcatcgaaacagtaataattcaactgttcgactattattgaataggatccatcccacttgctggttttccttttcttttgtctgctgcactcttggttcctttttgctgtaactgttcttggtcgctttggtgcttgctgaacagttgcgccggtcaggttgccaaagcgaacgtcctggaaattnattttcttcctcg

SEQ ID NO: 8752 - DNA, 698 bp, Triticum aestivum
  unsure (1)..(698): unsure at all n locations
  Clone ID: PAT_TA_8752
gaatctgatcttgcataaccgatacacaaagtgtctccaactgcaatggaattcttgtctagagacatcagcttacctagagtggctttgattacacacacacagtatatgcacaaaaagatgtgcttggctcggtctaggtgacttcaaatttcgtctggtttgttccttttcctttcactatcatctattatcccttctgaagacacaacactagctcacagcaccgtcggttccacggttcggcctgagggcgagaatatgtccaccggtgcattggtgaacctgaaactgtccaggccaccgaactttgtttgcgcgtcttgtttgtgactatcaaggtagagcaccacaaccgtgatatcgtcgtggaaatgccgcttgatccctctttcgatgtgttgcatgtcggcgtacctcatctctcttttcctcgcggcttcagagatcgccgctctcaccagtcgcctcgctattcccgctctcgggttctaaagacgatctccacgccgcttcgtcggtcaacgctccacagacgtccgatcaaatatacaaagaggctgcgcctatcggcgtacttgatgangaaactgttagacggccgctnaacggtacagaaaaatatgcnggaataangtcctggaaataggtctagtagnaccaatgttgaatcgaagagcctaangcaagcccgcgta

SEQ ID NO: 8753 - DNA, 753 bp, Triticum aestivum
  Clone ID: PAT_TA_8753
cgcctccggaatccccacccccgtccaaatccgggcaaaccatataccccagccgtccgccgagggccagattccccgccatccgccgacgacacgccacgccacgccacccccgtgccgctccgattcgagcttgccggagcccggttcggccggaagcctcgccctctcatgctggcctcgcggctgggggcttgagcgtgcttacttagggcgggatttgggcggcggggaagcaaggatgtcggtgctggaggatctgatccgggcgatcgagctgtggctgcggatcgccaaggagcaggtgccgctggtcgaccccagcctcgacccggtgctgctcgtgcccggcatcggcggctctattctcgaggccgtggacgaggccgggaacaaggagagggtctgggtgcgcatcctcgccgccgaccacgagtgccgcgagaagctctgggcgcagttcgatgcctccacgggcaaaactgtttccgtggatgagaaaatacgcatcactgtcccggaggataggtatggattgtacgccatcgacacattggacccagacctgattattggtgatgacagtgtttactactatcatgacatgatagtgcaaatgattaaatggggatatcaagaaggcaaaactctgtttggatttggttatgatttccgccaaagtaacaggctttcggaaacacttgacaaattttctaaaaagctagagtcagtatacacagcttcaggagagaa

SEQ ID NO: 8754 - DNA, 619 bp, Triticum aestivum
  Clone ID: PAT_TA_8754
gcggccgcccgcccaggtaccactgccacattggcatatttcacgtgatcaatactacaagttcttcctttgttcagaacagttatagtgcgccgacacaaaggatagcatggctctgtcaaggttgtagacgactcgcatgttctgttgtttgtagttgccgatgacagtctggtgcccgaccatcacgtctagcatcagacacatgccccgcacaccgtggtcctcaatacacgtatttcccgcagctcccagcccagcgccatccaggtggagcgtcaagcgatgcaccggcacaggcacaacccaccgcccttgccgcttccagaaatggcgcgatcgctcattgtagagctagaagcattttgtagccattgattataggaattaaaatagtgaccttcaggtgccgattttctaagagaacagagagggtcttctcattgccgcaccatcaacatttgcttgaaccacatctcgccggattcgccaactcaatactgttcgatgccccgacctcctcccatggttgccgtcaaccattgccttctcgttcacccccttctattttgtgcttcaacactgagctcctgcacctcattcagccagtgatactcta

SEQ ID NO: 8755 - DNA, 856 bp, Triticum aestivum
  Clone ID: PAT_TA_8755
aaagtgatgatcaaacgggaagtgcagaactaatggaagtgatgcatgaacaacaggagaatcaactgttgaaaatgacgagcctttagaggaggaagctaatgcatcatttgatttgtttcgggttgcaggcggtctcccggacggcttcaggtaggcctatgtggtgtttgtctatcgttccccgtcggctgccgaggcttcggtacaacttcagcgtgggggccacggccatcttgtgtgcctagaggctcccatctgggccaccccagcctttccagctctggacactgacggtgttcatgtcagggctctccccgggtccctctgcttggtccgcgagtatttggagtgtgctcagcgtttttgagtccggcgtgcgattggcagaggaatgtgtttcccaagccggatacttgttgttctccttgcctcagtgcgagcctgagcgccagctggcctcgatttgagtaccgaaggcgggaacttccgtgcccatgcatattcgtctccaactgtggttgatttggatggtgatggaaattcggacatccttgtcggaacttcctatggcttgctttgtgctcctgttcaccaattagatgaccagaacaggtgttttacttgcagttgctatctcctagtgatacaacaggacaggttcaaaaatgagaccaaccaatatcagcaagagagcaagataaggatcatccaatcccaagcatcctatccagcacagagcacagctgtgtcatatctgtgcactcccctggaccctttctgcagaatgccttgatcacattggcgaaaaccatagcatctaaagcgactcctttcactagcatgtcatcaaaca

SEQ ID NO: 8756 - DNA, 662 bp, Triticum aestivum
  unsure (1)..(662): unsure at all n locations
  Clone ID: PAT_TA_8756
ttttttttttgcaacaaagatcaggtatgcatccatgcgttcaccaaagagttggattcggttcggttcggttcacaaatgtatacccatctctttatgtacatcaccaaccaccacacaaaggagagctagcagtacatacaacaatactggagtatacccccctaacaccaagtaaccaacacagcacaacacaacaccctctccccccctaccttgcccattttcccccagcacacttataccagcccctgcccccctctaacgaactacagccccgtgccgcctcaccttaactccctccatatacccccacccccaccaccaccaccagcccccaaaacaaatttacatctccttataccaaaccatttgtaccacccccaacccaatcccatcacccccacaccccaacaaaaaccaagaatccaactgacaccactactgctgcttccacagaatctaaattcagctaaagatccttattttggcgccggtcgacggcgacgccgggaaacgtttttttttacctacctaggctgcgggcgcgccggaaacgacttggcgtgcctcatctgcggggtctgcttcggggtcgacgagcgggtcagcgtctgggagcgcagcaccatgtccaccatcgacgtcgtctggtaggnctg

SEQ ID NO: 8757 - DNA, 704 bp, Triticum aestivum
  unsure (1)..(704): unsure at all n locations
  Clone ID: PAT_TA_8757
ttccttgtgttcttgtgtgtgttgtgtgaaacaaccagnagagaagagggctgagagagtcggctccgacaattctccagtaacttagagaacgaactggctgtctcttggggaaaaagtttcagccatgggccaggtagggggtaccagctggtgatcaccaccttcctccagacgtgcttggttgaaggacaaacatctcagattaggagccctacataacagtagcctcaccaagcctatctcattatctcttcccatgaagttatacatctctacattcttcaaactgacgtgctggaagtcgacatcattccataccaccccattatgagattcaagatatgataaatagcgtacagtagttctcagtgtagccaaatatggtgcagcaattaggaacatgaacatccaaagaagatcatcggaaggttttgtagcgatgttcaaagttaggactttgaggtttaaaaaggtggcaggagttcttggtttgaccagcttggggatctcgtaccacaagcaaaggctcttgatatggggaaaacaagtagagatatcatccaacctgtccgcatcatattctggaaaaatatcatcagtaaattgcagggaagcatgctcaagacatggaatggattgaaacgtagatgttgggagcatctctccgcagtactccaatctttgcaggtctggtgtgtcta

SEQ ID NO: 8758 - DNA, 447 bp, Triticum aestivum
  Clone ID: PAT_TA_8758
ggcgagcacgatttagctctgcagctagacagtaccctggaggccgcactcgagcccgctccaatcttcaatttggagacggctgcgcagatcgaggacggatggctagacaccgcctcgggggctgcaacctctacggagatagagccgaacactgaccttgtccctcatgaagcttgtgacttcgaggtaccggactccgaatctcccacgccccctccaatcgaatccgattgggtgccggtcatggagttcaccgcagcggacatctttcaacactcacctttcggcgacatcttgagttcgctaaagtatctctcgttatcaggagagccctggccggactgcggccaggacagttggaatgcagacgacaaagaaattcaaagcccacccaccactccattaatagccactaccttccggcgaaccaccgcaactcccccg

SEQ ID NO: 8759 - DNA, 1456 bp, Triticum aestivum
  Clone ID: PAT_TA_8759
cgtccgccatgaactcgctccaatccttcctcgccgtcgcgcccgtcatggcggacgaggccaagtacatcgtgggcacctacaagcgcgcccaggtcgtcttcgtggcggggcgcggctgcaagctctacgacatcgatgggcgtgagtaccttgacatggccgccggcatcgccgtcaacgccctcggccacggcgaccccgacgtggacgccgccgccgcggaccagcgcggacgcctggtccacgccagcaacgtcggctacaccgtgccccaggtggagctcgccaagcggctcgtggaggcctcctttgctgaccgcgccttctttgccaactccggcactgaggccaatgaggcggccatcaaattcgccaggaagtaccagagggtcgcgcaccccaacggtgacgcgcctacggagttcatgtccttcaccaactgcttccatggccggaccattggctcgctcgcgctgaccagcaaggtgcagtacagggagccctttgaacctgtcatgcccggctcaacatttgtcgagtatggcaatttggaggaggccaagaaggtgatacagtcggggaagattgctgctgtgtttgtcgagcccgtgcagggtgagggtgggattcacagtgctaccaaggagttcttgcagggactgcgggatgcttgtgatgaggcaggggctctcttggtctttgacgaggtgcaatgtggtctggggcgcacaggttacctctgggctcatgaggtttatggtgtagtacctgacataatgaccttggcgaagccactggccaatggccttcccattggcgtcgccttggtcacggaaaaggttgctgcagccataaattacggtgaccatggaaccacattcggcggaggcccttttgtgtgccatgctgcattagccacattggacaagatccagaaacctggctttctagcagaggtgaccaggaaaggagaatacttcaagcagctgctcaaagctaagctgagtggaaaccctcatgtcaaagagatccgtggggccggtctcatcgttggcatcgagcttgacgtaccggctggggaggcggtcgcctgcgctcatcgtgtcggtagaaggagctggagcaagctgcagaggtgataagggaatgtcgtacctgctcttgaagcctctacctcgtagtgtaaacaagatctcgaggcatctacataatgtatacttctttctaatgcctgtaggtaataaagtaaacagtttgtcttaccaatatgatgagatctactacatgttgaagtttctttcaaaatttggaagggaataaaatgtcatgttgaactattgtgatgttgaagtccttttcgaagtttggatggaaacaatttctgtgttgttgtcggtatgaaatattttattgactaagttatatctgcctaaaaaaaaaaaaaaaaaactcg

SEQ ID NO: 8760 - DNA, 1095 bp, Triticum aestivum
  unsure (1)..(1095): unsure at all n locations
  Clone ID: PAT_TA_8760
aaatagaacaaatgttnaatctgaataataaatggtccggaattattacaataacgaatgttccagaattaaaacaattgttcaaatcacacatgaaaacaaatatatcgaattaataaaatgggagtctatttcccatagaattgccactgatactcaatgagatcattgcagagctgctggtgtgtgtcatggtcttaaatctgtcggtaggtttcatgaaatgcagttatctcatctgggtttctggtaggcttgacacaactgccaatattatcacagaaaaaacgtttaaatccctctcatcctcgttgatcatgttgtgtagaattatacatgtagtcatgatatttgagtatccctgaagcgagcaggacctcgatcgatggcaagctgaggttccaacacaccaaatgctctctcaatatctttttcgacatgctctcttgtgctcgggcggaaataatttgtattttgcttgcactaaatcctaccaaactggcggcatttctcaacgagtgaagaaacgataattttgcttgcaagcttccacaatgcgaacaaaaagagacctatgcattcgataacgcctacgtgtaagagatgacccagataggttggtacctcggcaaaatagtcttttatgagcaatttgtggccgcaagctcggttgcgcggaattgcaaaggaggtcaaccatcgatctgtggcacttcttcttcttcttgcgggcttcagatttgtcgacgagatgcaacaagaggacgtgcttggcatatcgtcaaaaaacatctcatctatgtccaatcatccgactctgacgacgaggaccaactccaaatatcatccatctttcactggaatcaaatcctgcccaagcaaagacgaagcagccgcaacccccttcccccccatcgccgaccgaaattcgcgaccctgcaactcccttcttctccactgcagccgccgcttcccctacttcctctcgcctccctgcagctcgtgcggacggcggccgctcaatcgtggccagagcaactggatctgcccgcaacgtggcagcactgaagctaccggacggatccctcgtgccga

SEQ ID NO: 8761 - DNA, 812 bp, Triticum aestivum
  unsure (1)..(812): unsure at all n locations
  Clone ID: PAT_TA_8761
aaaaaaaaaaaaaaaaaaaaaaccgaacgcaaacgagccagccaaatcgaccccccgtaccccgaaaaccagcggcagccaccaccacccgaacgcgagcgagccagccagccaaatcgagccccgttccccgaaaccaggcggcaccaccaccacccacccatggcctccctggcggcgagatccggcctccgctccctggcggcgcgcgccagggcccccgccccggccacgggcggacgccgcatgtcctcctccgcccacgacgacgcctatgagacggccaagtgggagaagatcaccatcattggggccgtcacctgcaccctcctggcggcgtggaacctctccaagggccacccccacttcgacgagccgccggcctacccctacctgcacatccgcaacaaggagttcccctggggacccaatggcctgtttgaggtcaagcacgaccattgagtactgaatagtgcatcataagaagtcggtgaatgcttcagtaaaattctctgtttgttccagtggtttttttattttcattgcgatctatttgtggcaagaaataagaaagacaaactcttgtgttgacaatccggaattgactgaattgtgtctaccctttttttcacatcaatgatctatgtgagacgattgtcttgtcttgcccagtttgacacaccggtcattataatactccagtgtaatgctcagctatctggatgaacttctgtcccaatacataagtcacaacgaacaaaattccctcaacccagggggccggtancantctctntanggcgataccgccn

SEQ ID NO: 8762 - DNA, 2028 bp, Triticum aestivum
  Clone ID: PAT_TA_8762
cgtaggcgccgccgtggccggacgcttgtgttcaactcctccctcccttcctcggttccccggttccccgtcccgttcaccagccgccgcttccctccgctaggctctacgcgacgcaaaaacttacgagagggcccggagatggcgatggttctgcggcgcctcgccggcgcatcaggctcgccttcggcggctgcactgctgctccggccggcgctgacccgcccgatctccaccggcttccgcgaggagcgcgacacgttcggccccatccgcgtgcccaacgacaagttgtggggcgcgcagacacagagatcgctgcaaaatttcgacattggcggcgagcgcgagcggatgcctgtgcctatcatccgcgcctttggcgtgctaaaaaagtgcgccgctaaggtgaatatggagtatggccttgatccaacaattgggaaggcaataatgcaggcggccgaggaggttgcagagggaaagttggatgatcactttccgcttgttatctggcaaactggcagtggcacacaaagcaacatgaatgccaatgaggtaattgcaaatagggcggctgagatacttggacataagcgtggtgacaagtttgtacaccctaatgaccatgtgaacaggtcacagtcctcgaatgatacatttcccactgttatgcacatagcagcagctgtagagatcaattcaaggtttatcccaagtctggagcagttgcataagtcacttcattcaaagtctgatgagtttaaagacatcattaaaattgggcgtacacatacccaagatgccaccccactgactcttggtcaagagttcagtggttatgctacacaggtgaaatatggaattgaccgaattgcatgtaccttaccaaggatgtatcagcttgctcaaggtgggactgcagttggtactggcttgaacacgaagaaaggatttgatggcaaaattgcagctgctgtggctgaggaaacagaactacctttcgtgacagcagagaacaagtttgaagctttggcagcacatgatgcttttgttgagagcagtggtgctgtgaacacaatttctgcatctcttatgaagatagcaaatgacatacgcttgctgggaagtggccctcgttgtggacttggtgaacttatcctaccagaaaatgagcctgggagcagcattatgcctggaaaggttaatcctacccagtgtgaggctctgaccatggtttgtgctcaggttatgggcaatcatgtcggtgttacaataggtggttcaaatgggcattttgaactgaacgtttataagccaatgattgctgctggattgcttcgatcattgagattattaggggatgcatctgtatcctttgagaaaaactgtgtcaggggaatagaagcaaaccataagagaatttcacaattgttgcacgagtctttgatgttggtgacatcgttgaaccccaaaattggctatgacaatgctgcagccgttgctaagaaagctcacaaagaaggaacaacactgaaggaagctgctttaagccttggagttttgacggaaaaggaattccatgaactcgttgttccagagaaaatgattggcccttctgattaaaagcatcctgttagttatacttctcatcgaagcgttgaggttaccacttcgtggttcctaagcccttccgtaaataaggcaagccagatttaacatcttcatttccttgcccactgggagagttaattttgcgcacctaatggtgccagagaaaaacatttttttcctgttaatcgtacaggaagtgtgttttgatttattggaaccttattggaaatagttttttttctccttgggtattattatcagcacgccaacttttacccaacgtggcgaatgttcatgtggtgagtgctacgtatattgtaatcatgttcttgaaaaataattaacattcatcttgaggacaaatgaaaggaaaaaaaaaaaaaaaaaaaaaaaaaaacaaaaaaaaaaaaaaaa

SEQ ID NO: 8763 - DNA, 353 bp, Triticum aestivum
  unsure (1)..(353): unsure at all n locations
  Clone ID: PAT_TA_8763
ttttttaggagtnccgccccagcattagtaaaagtgactgcccaatcccggtgtggttaaacaaactgaattacatcaaccggcagactcaacgggacaatggtgaactgcaaacagaagtggggtgctgctcgaacattgaaacgagtaaacataattttgtgagctgtgcacaaatctaaaacttagcactactaccaaatttctgagaatgtgctgagatgtacaggcgtaatgggttccgacggtcagggctctatggtgagcaggagcttcagccagatacacacgagtaggaaggatagtccctttttgtgatgaagaaaagctagacgttgtatcctttataataa

SEQ ID NO: 8764 - DNA, 268 bp, Triticum aestivum
  unsure (1)..(268): unsure at all n locations
  Clone ID: PAT_TA_8764
ctaccttgccagctacgtaaactactactccctccatttccgaaataattgtcgttgggagttctctccgaccaggtgaaaacgtacaaaagtacataaatacccctagtttgaaaacagatcgtcttcctcctccatccgcgaggcagcgctgcaacaggcccctccgtcgggctcctccaggccagcgcccctccgccgggctcctccaggccagcgctcctctttgncctccgncgggctccttcaggccagngctnntctttgg

SEQ ID NO: 8765 - DNA, 611 bp, Triticum aestivum
  unsure (1)..(611): unsure at all n locations
  Clone ID: PAT_TA_8765
aaacgaggcgtgngcgnatagatctcgtggggtttggttcggcccccctcacgaagtccttttttttcataggaaaagctatcataagttttagaacaagaaaatatacaccaatgcttagacatatcaagtcgcaaaatttagttctcgcttatctttgaaagaaacaaaatctaactcttcatcatccatttcctcgtaatcgtcatcatcgtcgtcgtcgtcttcttcatcctcacaaccactgcttcccgccttgtttctaccatttagatcacttgtggacgcgccatttaaggagtggtgatgtgcagtactatcagttagcccaccttcgtccacatcagcaccattggtgcctaaaccggcgggcacgccgttgggttttacttcaagctgaaccgcaccattccccgtcaactcattcgcctcttcctgttcctcaggtgttttagcaagagaaagcaggatgttcttcgctttcttgtctggtgggtacccacgtgtttccatttcgttgaaccaaatgacagcatttccgaaatctgagttcctgccatgtgcatccatgatggtggtaaagatggtttgggtcggttccacaccccgca

SEQ ID NO: 8766 - DNA, 2744 bp, Triticum aestivum
  unsure (1)..(2744): unsure at all n locations
  Clone ID: PAT_TA_8766
ttaacagcttttgttcatatgtgttgacatgtgttcattttcaagaccatcgcctaattgtcaattgaagataaatgtgtcagtctttttaagaacgtgataagctgatgttgtcaaaaccattccattaaatgaaatcattgcatcggcacatctaacatcagatcgaatctctgcaggatttctttacttcactatatccatcagccactccagcaatgcctggctggcagagagctccccggtctggaatgggatttggcatgcggtctcctgctgcagtgttgcagggaatgcagtcatatcctctggcatctttttctctacctacatatcaacaacctatgtatcagcaacctacataccaacaacctacgtatcaacagcctgtatatcagcaaaatgcgtatccccaacctgcgaaagcttcaaacccttttgacctcggaaatgaggcagccccaattcaagctcacatgtcccgaccactgggagcatcagcaggcgctactaacccaacattagttggtaactctagttttggagttccacctcagcagcgtttatagcagtgtcagcgggatggacatcaaaaccattacatgatgcagcatgtctctgacaaccggcctgagcggcgacctaatggcatgcttccaaggcaacaaggaggtgctggttccctcggcatcggctatgatcaacaagctgctcctaggtattcccaccctgacgccccccctgcctgtgctgcggtggctgctcctcctcttgggttcgaggcccgccggttgtcggcaccccgtttgcccggttctgggtctcctgtgtacctgcgggccgccggcgggtcgtgccctccgcccggtcggcccgggaggcacatagcccgggaggatgctcctctccttcggctggttgtgcctccgtcgccgtagctccacggaccgtgtgcccctccgtggccgcgtcgtgccgcgtccgctgcgcctccacctctgccgcggtgctcctcgcccccctgctgtattggttcttccgaggggatttcggaacaggcggcggccgctgctcctgccgggtcccttggccttggtgcggttccggtacccaccgctcctgccccgccatctcagactgcccctccgccccgaccgcgcccagttagtgcacagcctattaacgcaacaacgccgcaacatgttcttgaacaaggcaaaagtgctccatcagcaagcggcggtgattgggcatcttttgatgcttttggccagcagcaacaaacaccacaagcaggcagcaccgtaaatccgcttgagtctgtgcttgcacaactatcattctccgaaacaccctctgcctccaatacgtcagccttttcaacttctgttgatccgcaagcaaatggaggacagctgtccatgatagatacatcacattcttcattatttggtccacccgttggaatctcaggcaatcaggtctcaacaggaatgcctgtccaaggatctgcagttcatcaatctgctgtggctgcctctatgggtggtcttccatctcaattgccttcaaattctcaaggaaccagtggtattcaagaagcaacgtcttctcatgacagcaaatccagtgggcggacagcactgccagtggatttctttacttcactatatccatcagcaactccagcaatgcctggctggcagagagctccccagtctggaatgggatttggcatgcagtatcctgctgcaatgttgcagggaatgcagtcatatcctcaggcaacattttctcaacctacatatcaacaacctatgtatcagcaacctacataccaacaacctacgtatcaacagcctgtatatcagcaaaatgcgtatccccaacctgcgaaagcttcaaacccttttgacctcggaaatgaggcagccccaattcaagctcacatgtcccgaccactgggagcatcagcaggcgctactaacccaacattagttggtaactctagttttggagttccacctcagcagcctcagcagatgtatcagccatctgtacatcaaaaccattacatgatgcagcatgtttcaaacaacatgcctgagcagctacctaatggcatgcttccaaggcaacaaggaggtgctggttccctcggcgtaggctatgatcaacaagctgctcctaggtattcccagccaaacaccccaccgtcctatggtgctgtgggtggaaatcctttcgggtaaaaggcttatcaaatgtggacgtaccatgttacctgtttatggtatcttgtgtatcttcagaccactggtttgtggtgcccactgcccagtgagataagaatgcacaaagccctggagaaaatttgtttcatattactgggttatgtgtttgtcactgtagctccatgtaacttgatctggaaggtggaagcgatgtggggcataagcttcaggaagcaggagttctgcggttcttctagcccctattttcttgtatatttgtgtttggtgttctgtgtgcgttgcatccgatgtatattcacagagaccctatgccttgtatggtttttgattgggatctttcgagcggccatatctgatagtgtacttagttcagaatgttatttttagtccagctggctattcaattttaatgtttattgcaaaacaaaaaaaaaaaaaaaaaaaaaananaaaaaaaaaaaaaaaaaaaaaaaaaaaaaaaaaaaaanc

SEQ ID NO: 8767 - DNA, 743 bp, Triticum aestivum
  unsure (1)..(743): unsure at all n locations
  Clone ID: PAT_TA_8767
agcgtctaatgnatnnattcttcttttgaaataaaatgtgtgccatatatctgaagggacaaatacatagatttagcttgacagttaaagctaaggcaccatttctgggtgttgcaatgaaaagctcggtcagacacaccaggttgggaagttagccaatgcatacaaagtaggacggtgagcatgttgccacatacccaaaacatgaatttctcgagcatgtcttgcttttgcatttcatcacttgttggcagacccatctagttctgacgttggtcaagctacaacaagaaaaaaaaagtgagctagctatcgtttaagggctgaagaaattgtaagacgtgtagtccaacaacaaggttgtgaacaaagcttatcatcatcatcttctccacagtttatctagtctcaggatccagatcagaaagtttgctaatgcatcttctaattacccggtaccctttgttctgacaaactgaagactgtcaaacaattccatctctaacacaccaaaccaaatcagagaatggatgggcaacagagccgaacctccaaacgcccacttgtggaaggtttcgctagtgtccaggaactttggggtgcacgcgggcatggtccaagttccctgtctccactctccagcgcatctgagactgggccaaaaaaaaaatgtgcagctcatgcaaacagagtgttggatgatggactccaacggtagcatataaggacttccctcgtgccga

SEQ ID NO: 8768 - DNA, 816 bp, Triticum aestivum
  unsure (1)..(816): unsure at all n locations
  Clone ID: PAT_TA_8768
ggctttngccctcgcagatagttctgtgtgcaatatgctgcaatgagatgatncgtccagcactgtatgtcgattatgtcagggttcttcatagtatgagaagaaaaggtcgtgcggagaaagcagcactgaaagcagtgaatcaggtctgccaacttgagcccaatagaatatcggattcagtacatagtgttcaatctggtctgagacaattgaagcagctccttgatgatgaagaatctcttgcagaatttccacatgcaagctttttacatacggtagaaactgctgatgactctgctccactgttttcattgctggcaccacttggtagtggagtgcacaagtcctactggaaagctcgtccgggcaacacatctgtggagttcccgattgttcttggcggtatatcagatgtttcaggagttgcaataattgtcagttcctgtggttactcaacatctgattgcccaattgtggagatatgggctagtaataaaatacagcgagatgaccgcacattcataggaaagtgggacgtgcaaagtatgatagtgtcatctccacagctttatggaccagaaaattcgggtagcttggatgaggcaccaagacactttaaactacacttcccaaatcctattcgctgtcgcataatttcaataaaaatgacacttccccaaattggttctagctcaaccaagtttaatgaagactttagtgatcttttatcattggatgaaagctcatttattgattccaaggcaaacaattcacataactcatttatccatgcaaaaaggattgttgttttcg

SEQ ID NO: 8769 - DNA, 618 bp, Triticum aestivum
  Clone ID: PAT_TA_8769
ccgcagcagaattattacaataaaatgtctgacataaaacagaactgagtctcaggcccctacagggaaaagcaaagcagcaacgagctatataatccctcaagggccatctacacgccacgcaatcctaagcaactccccgcgatgatggtcgagcagcttcaagcattggaggagtagcacaacttggctcgcctctctctggtttttcctttcgtggtctgccctccccgccgcgcccaccccacctttgttacgtagtcgcgttcttaccgtggagagttatagccagttaattaaaggcgataaactatgaatccaggcacagggaataatagtgaaatcaatttcacgccctcatatcatctaggttcgagctccgtgagtgacacctcgttcactgacaccccctcgggcttgctaccctcggtagagtacatgcccgagaaaccctccatctcgtcgatgcagaatgttggcctggacggcgcctgaagagatactgtgttgctgctgagcatgacgttgactgtcgacatggtcggcctgtccgccgggttgtcttggacacacagcagcccaatattaatcagcttcagcaaaatggtctcccggaga

SEQ ID NO: 8770 - DNA, 967 bp, Triticum aestivum
  Clone ID: PAT_TA_8770
cgcccccgcacgccgccccggccagctcccctgccctccaggcgcggcggcgccggggccccccgcggcacgcggcgtcccggccgccctcccctcacgggcggaggcggagctcctgcgccgtgcccccgtcgtcgtagccgtcgtcgggattgttctggccgggctcggcgtggcggcccgtgagctccgggccggcggcgcggcagcccgccgcgctgagcggcacacacatgcaatacagagaaatcctcaaatgacatgcaaataaggagcgggggcacacgcgtcaggccgtcagctaacatgcagctagcgtgcgggagggatcgggggtgactggtcactacaccttgttgctgtgcgggtagtcgtagaggaacgccgacggcgagaagacggcgtagtcgttgtccaccagcctccgattcgaagatgtcctcctcatcgcggtcgccgaacgcggccgcggcgagctccggctgcccgccagcggcggcggagcccggggcgcccgcgtcaggcgtcgacccagccgcgctcccctccgggctcagctcttgcgccgcgcggccgtcgtcggtattgtacttggaggggtcggcatggcggcccgtgagctcctggacgagggcgcggaagccggcctcgctggtcttgaccctcatggggttggagatgtacaccaccttgatcggcttcttgcccccgctgccgcccgccttgctggccccccttgccgccccccttgcccgagctgccgccgctccggggactggggctccgctgctgcttccggtgctccatcagctcagctcgcctcgcgagcggccggccgggaaggggagcagcgaggcgatctggttcgtctcagaaggaagagaggggagtgagggcttctgctgcggctggtcctggccatgctcgtgccgaattcggcacgagctcgtgccgaattcggcacgag

SEQ ID NO: 8771 - DNA, 433 bp, Triticum aestivum
  Clone ID: PAT_TA_8771
cgtccgcggacgcgtgggctgcggcaaagcgacggcggttcgaggcggcacagcccgtcgccggcggcaatggagtgcgcagactttagagttgcgctcggcttcgagagagccattcgacgcgaccgtccgtacggcgggtacccacgcctcccgagcgagggctcgccgcagatggccttcttcgacgcggccttccagggcgaccttccccgcctcagggagctggcgagcggcagggacgccaaggggatggcctggcttgccgatgtgtgtctcgtcggcgcgggcccttttcagaccgcggcacgcttggggaaactggacgccgtcaggtgcatggtggaggagctgggctttgatgtcaatgctggcagccaagccggtgtaactgctttggctggtgctgcagcggatgggagaatgcatgtta

SEQ ID NO: 8772 - DNA, 567 bp, Triticum aestivum
  Clone ID: PAT_TA_8772
ttgaataaatccaactgctaatctctgaaaaaaactaataatattaaaaccaaaccaaatacctgaaatacaccacttaaactaaataatctagaccctattaaaaccagcaatagatgtctagctgtgatattagctatcaaccgtacacctaaagccaaaggtcgacaaagccaacttaaaatctcaatttgaattaatgccacacacaaaacaacaggtgctcttacaggcacaaaatgagcaatgcaccttaaagtatttttactaaaacagtaaatatagctccctccccacataataaaagccaatcctatagttatactaggtaaactagtataagaaatacctattggcaccaaaccaaacaaattcaaaaatacaagtataattaataaaaaaacaataaacctaataccaggaaaaacatatctcattctaaaatgactaattaaaccataaaaagtcctaccaaaagacttacttcacatatctccaccaaaactaattaaataaaacagaaaaaccaaaaaaaatacacaaaacggaaccctacaaaatctcgtg

SEQ ID NO: 8773 - DNA, 1016 bp, Triticum aestivum
  unsure (1)..(1016): unsure at all n locations
  Clone ID: PAT_TA_8773
tttttttttttttttgtgagaacaacgatgactaaaacttggccggaatccaagcgatttagagttatacatgtacagacagtctggtatcgataacgaaaaaacgggttagcctattgtacatgaaaaataatttgtacaatgctcatacacaacaggtgatggtccaagcggttacttctttgaaacctgcttgaactttctccagaagacatgccactatataaagaccggaaaagaaacgcccactagctgttttctcagttagcaagattaattgacattgatgtcctctccccatcaaaactgctaagtggccaacactgtcatcttgtaacagctcaaaggaaaaccgacagatactcttcaaccataattcagctcagtggggaccacataatttacagcatgtaggcgattccgggtaatattgtgcatttgcctattaagcgcaatctgagagttaccacccaaaatgtccaaagtatcacaagcgtcgagcaatgaaatccatcatcggctgccttacttgctagactgttcagtgttcacatcatccaagtagatgctagcaactgtatgagaatggaacgccactaaagaaacaaaataagtagaatctcaaaacacttcctgtacaaaccagcacgcctaaacgataagacctatgtgttctgcgctattgaacttttccactaaatactaccagcacgttggggacagtgaaatggtataaccgtataagtatcacacatccaacagcacctactcaaaggatgtcatggttctggtgttcctgggatctcagcagctgtatagactccattngaaatcccgcacaagtctgagttagatcattcacgcttcctgaagttaaaccccagcgctgtggctggaagaaagacatccatcccttttcaanggtgccaacaacagaacattgcaactgtgatttccgattgcctcaaaggcagaatnacacattgtntaactataactgtcanggtgggtgattg

SEQ ID NO: 8774 - DNA, 690 bp, Triticum aestivum
  Clone ID: PAT_TA_8774
tcctccggcggattgcattatgacctgcctccttggtttattagtattcttccggactggcaaaaaacagtcttcaacaccgctagggttggcagccatatttcacaaatgaaaatggaatgggctggaggactcacatggcagtcatataatgaggagattaattcctacagtgaggaggaagcatttacagcggtaggattactggaacaaataaatatgacgagggataacacagactacttgtggtatacaacatatgttgatgttgcgaagaatgagcagttcctcaccagtgggaagtctccaaaactcgctgtgatgtcggctggtcatgctttgcatgttttcgttaatggacaattaacaggaactgtttacggcagtgtagaagacccaaaactaacgtatactgggagtgtgaaactatgggcaggaagcaacactatttcatgcttaagtatagcagttggtctccctaacgttggagaacattttgagacttggaatgctggaattcttggtccggtgatactttatggcctgaatgagggaagaagagatctcacatggcagaaatggacctatcaggttggtttgaaaggtgaggctatgagtcttcattcacttagtggaagctcatcggtagaatggggagaacctgtacagaagcagcctctgacatggtac

SEQ ID NO: 8775 - DNA, 454 bp, Triticum aestivum
  Clone ID: PAT_TA_8775
cgtccgcccacgcgtccgtgttgaagcgaatgaatacttgggaatatctttgcatgcagatgatccagaggacttttggaagttggatgacacaatcgtgaaaagcatcgaaactgctcccaatgatgaactgaagaaagcaaaggaaatcattcaacgtatccgccggagggagctctacaagttctgcaatcaatattctgttccaaaggataaactggaccatttcaagaatataactgcacaggacatagtttgctcacagatagcttcaaaggtgctgcttaaggaggaagacgtggcggtcagcaatgtgaagattgacttgacgcgtgggaaggacaacccgctcgaaagcatcaagttcttcaaggatttcggatgcgaagagaagttcccgataacggatgaacgcgtgagccacctgctgcctgtgtgcaaccaggacaggatc

SEQ ID NO: 8776 - DNA, 1451 bp, Triticum aestivum
  unsure (1)..(1451): unsure at all n locations
  Clone ID: PAT_TA_8776
ccgcccgcccgcccccccccgcacgcacgcctcgaaccttcccctgccgcggaggttcggtgcggtgcaccgttgggccagccctccgccccggcgccgccggcgcagccggacggcgcccggccgggcgcggtggccggcctgccgctgcccccggcggcggcgccgggcagggccctgcacggcctccacgcccgctgctcctccaagcgggtctccggccccctccacggctacatctcccccggcccctgggcccgcgcagttgtcgtcacaggggctgctcagaggttgcggcgtcgcggtcagcttggccttgcttgtctggtctcgcccggggctctccccgcacgttttgaacattccttgggtgtttatagacttgctggggaggctatgaacaatcttcagaagtaccagggaaacgagcttggcattgaccgcattgatgttcaaactgtgaaacttgcaggtctcttacatgacattggacatggccccttcagtcatctgtttgagcatgagtttcttcctcgtgttcatccaggatcaacatgggcccacgaacatatgtctgcactgcttctggacagcattgtcgataaacacgcaatagatattgaacctgattatctgaaagttatcaaggaaatgatagttgcaagctctgacgtctccacagcagaaggtgtgaaggagaagcgtttcctttacgacattgttgctaatgggcgcaacggtatagatgttgacaagttcgactacattgaccgtgagggcagcccgcgtggtagcggcagcttcttccagcactgcgggcgcgtagaggggttcccggtcacgggcgatcgcgtctgccacccgcccccagtgtgcctccgcgtccggatcgtgtgcgcgtcccccgcggagccgcatcgggcggtcgcggccccggccgcggttgagaacctgcagctgaggatgtacggggagaagacgcaggtgcacgacacgcccaccaagaagaagcgcaggttcaactagctctagctgcggcataccacaggcaggcaggcagagtaggaaaccaaacaaacgacatggagggtggacatatacatatatacttctactactacttccgagagtcagttggttttagctaggaatgtctgtccgtcggtctgcgtaggcaagggaaggacgacacactcactggtgaagggttttgtacagttttgatgcccgcaaacgggggggaattttactcggggcggctgacggacgcgctggcccccttggctgccgggtgcatgcatggtgccttgtgatttggccatgcactccctcccccgtatccgtgtgcttaccttaccacctactctatatgcatgatgatgatgatgatgatgatgatgacactgctaccagttacggaangtaatatatatcacacacatagaatccct

SEQ ID NO: 8777 - DNA, 521 bp, Triticum aestivum
  unsure (1)..(521): unsure at all n locations
  Clone ID: PAT_TA_8777
gactcactatagggcgaattgggtancgggcccccccttttttttttggagatgaatgcgcgatgccctccagatctgtttaatcaccataacagaacagatgaccaatgtcttacaggnaaattcccggtgccatattgtcctgaacagttctcccaaacacaactacctgtttcccttttcttgttcccatccccatcacttcgtacagcacccaacagttttaggcgcacatgcttctatcgatctggtaatctggttgcagacattgacatggctgcccaacccgaaattcggaacaaaccaatacagttctcagctcttctctgcttgatgtatcctcggcttcttggaaggcggtgtcatgaaaagctttctaacagatgtaaccggatcctcctcctcatcgagaaggctgagcttagcctcccaattgcgaatctccatcaactcttttatcaaggcgcaagtaacggccaaaagaagtcagccctccatccaaggcaagggaatcactggtt

SEQ ID NO: 8778 - DNA, 740 bp, Triticum aestivum
  Clone ID: PAT_TA_8778
ttgttcgccttgcggcgcttgtagagttacgaattttcatatttttggaaaactcacaagcaagtattggacacgcaatagtgttgtcctattatttgattatctagtagtagaccaaattactcatatgtatttaaccattcttggagacgtccaccgggtaatgatggatgcagctaacccagggtccatccatacctgaagatggttgtatacacacccacccaacagtgttgcactcgtaccctgcaccaaatccgatcatccacaccctgtttccctttttcatccagcctttggcctcgatgtatgataactcataccacaccgatgaggtcgactggtttccaaaacgatgccgtgtcttctttcatggctcagcgtgctcctctggttgattatggccacggtgtacccaggggccatccgctcggccacctgcttggatgcagacccgctcagatgcgtcgcactcgttaccggcgcctggcccgatcgtcctcccccggtcccctttcttcgccacgcctttagcgtcgatgtatgccaactcataccacactgatgcggccgactggtttccaaagcgatacactgtcattcgtgacggttcaacgtgcttgtctgatagattgaggccacgctgtattgagctgataaccgccgctccacctacgtggatgcatatatgttcaatggctgcccctgtgttcggccgcgtgggacgcccaagccgaaac

SEQ ID NO: 8779 - DNA, 528 bp, Triticum aestivum
  Clone ID: PAT_TA_8779
ctgcgaacggagcttcaatgagttaaaaaccagactgacatcggcagccgtattaactcttccagatatctaccgcagtttcgatgtttactgcgacgcctccagaaaaggactggggtgtgtactcatgcaagatggcaaagtggtggcctatgcatctcgccaactgcgacaacatgaaggaaactatcctactcatgatttggaattggccgcagtggtgcacgctttgaaaatctggagacattatctgattggaaagaagtgccagatattcaccgaccataaaagtctcaagtatatattcactcagcccgacttgaacctttgacagcgaagatggctcgagttggttaaggactacgacctcggaataaattatcacctaggcaaagctaatgtggtggctgacgccctcagccgcaaaccagccaaccttaatgctctaatggattccttacctccggagctttatgaagaaatcatgcagctaaacttggtgatcaccgacgcccgtcttaacaatat

SEQ ID NO: 8780 - DNA, 735 bp, Triticum aestivum
  Clone ID: PAT_TA_8780
gaaaaccttgataacaattaaccaacctttttcagagtgacagcgtctcaaagtgggcatttcctctagacaagttcactgtaatatgtacaaatcctggtggtatatgtgcgattcgcacaaaaaaaactgaacactgctacatctatgaacccccctaacattggagctgctgttagacttacacaatgtaggtcttcttcagggctttcctgccacgcttcctgttcgggttgcatgaatcagccatgagattaaaagcattagcaaattcctcgtcttcgttgttacagagtattctagacttttcagggttttcgagcagcagcttggccacaaggaagcccgcaatggaccacgtttggaatagtcgagcttgtttgccgatgaaccgcccacgcttagtatcgtagtattcaggccatttatccacggaaatacgcctctcagccacctccacggctctggctgcaatctcaggccggttcatcttgatacatgccaccgtgagctgccacaacaatgttggccaggaacctgcattatggtatgaccaaggcgtgtttttagggtcgctccctgtaatgtatttccactcttgatcctcgagagcaggataacatatcttcaatggcatttctgccactagatcagaccatttggcttcaactagatccagaatagcatgggattgacgggttgttgccaaactgcttactatagaccacaagttcc

SEQ ID NO: 8781 - DNA, 606 bp, Triticum aestivum
  Clone ID: PAT_TA_8781
atggtcatatatgtacacagctgcaatcacatcgatgaggcgtggtgcacatagcagcggcgaggattcggtgccacctccgctcgatcgggggccgtcgtcggatcacaatcactcctgcttgccgcgaaggctgcgctgcctggtgtgcaccatccagcagacgatggagaccatgacggaggcggatacaaggatgaggccgtggtagacggtcctgctgaaataccggaggccggggcagttgttgacgctgatggaggtgaaggtctcccggacgaaggtgcagtcctggaggttcatcaggaacggcccgtactcgtacagccccatgctgatgctcgccgccgccgtcatctggttgtaggccgccggcgtcactcgccccaccgtcgtgcacacctccttcccggcggggcccttggcctggcactggaacttcttccactcccccggcgccgtcttgaagtcgacctcgccggaggcgcactcgcgggggctcatgtccggcttcaaggggttgcagagcaccggcatcttgggccccgactggttgaagtagagcggctgcagccccggcgggaagtcccggttggagatgttgac

SEQ ID NO: 8782 - DNA, 868 bp, Triticum aestivum
  Clone ID: PAT_TA_8782
tgcagaacatcttaaaatgtaagatgcacaaatagtactgttgttttctgttgctgccgagaccaagattctttggatatcatttgcatcagaatctaccaaccaaaatgccaatagctctaagaatctccaaaacatcaacgtaaccaccatttgtgcagaattatgatagtgtactacgcactacaggtcaggtttaacctagtaaaggctgaagtgcattcatattttacatgtcgccaaaactgagacctgtatacgtaattttattgtaacgacgcgaaaactgacggtaactccattcttgcctcacaactctgtcttctgaacggcggcacttccccctgtggtcagcctcttttcagtgttgggcagaagactaagcagccccgccagcctgtcccaaaccattgcccaccacattagcagcccggccgcggcggcgtggacgaacatcaatccaagtgtttgtattttcatgctttggatatgcgacgggggcatgggctcgtgcactgttgagcgagataggggggccacggtattggacatgctgaaacccctgaatgattggacgcagattcgggcttaggtgctcatcaaagatgacccatatgtatggatcacagacgtgaacaaacctcccatctggtaggtgcaacctggaatctgactggggatgggaatcgtgcgcgagacgattacctttgggatcaacaaaggaagcgacccgcgggaccatcccagcagggtaggcaatgacatcataattacgaagggcagggtggatgtgggtcctgctgcgcgcaaaaatgttgtcatgaatggctggatcaaagaactggtcaaaaacagcccagagctccgg

SEQ ID NO: 8783 - DNA, 1336 bp, Triticum aestivum
  unsure (1)..(1336): unsure at all n locations
  Clone ID: PAT_TA_8783
nattgtggtgccccgaagtnnaacngaagtactnttttgtgttgttaaacttccttgcatttgcggtaatttaattgttttttggttcgtatataagcagaggaggagaggtgccacnatcaaacgtccgacngaaggcacgcggttgtcggnggcgttcgtttgttggaccagacgtccaaagattcccgcttgggtcgggcaaatggcgtccaccatcttgggcaacgacgcgtcccagaagtgttcgtggagcggttcaaacgcggcggtgttcggaggacgactcnaagtggtactcgacggaccggcgtcgggctgcgccggttcgacgtgccggaccagatgctggcgttcgtgcggtcgcaccgggtgatggtgcgcgggcacaacatcttctgggagaaccaggacgccacgccccggtgggtcaagggcctgtcgccggacgacctccgctccgccgtgaacacgcgcatccagagcctcatgacccgctaccgcggcgagttcgcgcactgggacgtcaacaacgagatgctgcacttcaacttctacgagcagcggctgggccccaacgccaccatggagttcttcagcgtggcgcaggacgccgacccgctcgccacgctcttcatgaacgagtacaacgtggtggagacctgcgacgacgtgtcctcgaccgtggacgcgtacgtggcgcggctcaaggacctccgcgccggcggcgccgtgctggaggggatcggcctcgagggccacttctccaggcccaacatcccctacatgagggccgtgctcgacaagctggccacgctcaacctgcccatctggttcaccgagatcgacatcaacaacaagttcgacgcgcagacgcaggccgtgtacctggagcaggtgctgcgggaggcgtacgcgcacccggcggtgagcggcgtcatgctctggacggcgctgcacgagggcgggtgctaccagatgtgcctcacggactggaacctcaagaacctgccggtgggggacgtcgtcgaccgcctgctgcaggagtggcagacggggcaggtcgccgggccgacggacgcgcacggcgcatacagcttcagcggctacctcggcgagtacgtggtcaccgtgaacgccggcaacacctcgaagcaggccaccttctcgctgtccccgggggacgagaccaggcacatcaccgttcagatatgacactggtggtgtctgtatgtgagtggccggtggcacgctgtactgcctgcccgcacttgtttcgggcttctacctccgctgacacatatcgtcgncatgtgggtagtgggttactaaatta

SEQ ID NO: 8784 - DNA, 2060 bp, Triticum aestivum
  Clone ID: PAT_TA_8784
ccacgcccccgcgccccccgccccacctgaacggccctatcggcgaagaggggaacggcgcggcgggaagctgctggatcgcgcgcgcggccatgtccgccgacgaggccgcactgaagacctgtcatgagagaataaaccttagtgtagctgcctcacatcaagctgagaatggacccgtcaccacagttagttccaagaaatcagaggaggcgacctatgcataccttcctcctatcgagtcaactgacgcgcaccttcatgagtttgcagaggccatgagaactgttggaaaagcactgcaacaagtcgcggaagggaaagctgctgcccaagcagaggcagctgagtggaagcgcaagtatgaatctgagaaggcagccaaggcacacacgcatcacagtgtaattaaaggctgcagcaactgtgtcaaggacaagctagagcatttggctagtaaactgacactggagactgcctcggctgatgaaacaggctgttgcggaaaccatgggatctgctcacgtcaaattctccaggatcagtgtcctggacctaaccgtaaatcagatggcaggattgttggaagaaaggtaccatttagactttcgtggggtagcaatggggataagaacggtcagcacaagcatgattttgtgtccttcgaaaaaatagatattacaacagcagaacgcagcaatagactgttctttctggggattcccctccataaacagacccttctgtgactaaacctacctaatactccgtgcgtgcatgctgttccgaaagaaatggatagcttactgaacataataacaaacataaacatcttggtacacgagttagcaagcaaggaccgactgaatgaagattcttacttcaactttattcagacatgggataatgatcaggaaatgaagacattacacacgaaggtcgccctcattgtaactctcggtggggatggaactgttcggctgcatcattcattaatcaaagggccagttcccccagtggttgcattctctcttggatcattgggcttcatgattcccttagcaagcgaacagtatcgtgcttgcgcaatcaattggctgaaaagaccactcaccatcacactgaggagccgtctgcagtgtcatgtaattcgtgatgcagctaaagatgaagttgagaccggggaaccgatgcgcgtgctgaaggtacttacgaccgaccgaggtctgccttccttccctacctactttgcttgcgtgtgtgttgttttttttgttgcgtgcgagcaggggggtggataatatatacctacactggaagggaagcacatcctcttcacggtgaactggaggtggtacggccccaccacaggtcccagggatccttttcacactgcccccattcattgtcattccggcctctgatactgccggaatacgtcactctgcgcgtgcaagtaccgttcaacagcacaggagagggctggccttcctgtcatttcaagggcagaatacagttcagctagggccgggcgacgccctcatctggtctctccatggcccttgcccacggcgtgcatggtggactcgctcgacaacggacttcctgcggagcatccacgagggcctccactggaacctcaggaagagccaggcactggacggccctgcctgaccgatgaagtttgcgtgtcactggaactcgagatggctgacgagtcgttagatgtgatatttcagagcatctcctcacagcccagcgaaaatggagtggatatgtatctatatatatgtgctcccgtgttggtccggttctttatgaatccttgaatattcttctactatatatgctgcgcataaaagggtttatcaatatgtttaggtttaggtttgtggaattcgaacatggtcggtctgtcgccatgtgaatatctatagctttgtggagtagaggtgatgtaattatgtaagagttgcagctgaaactctgatgtgaataatgggtggatttcttgcctgcagcttgcctaaaaagagaggtacactaataagctttaaaaa

SEQ ID NO: 8785 - DNA, 872 bp, Triticum aestivum
  Clone ID: PAT_TA_8785
cagatcttttctatgtgtgcgaaggcacttgttattaaagttcacttacacatacaaactccaagaatcatggatgtataactcgatcctactattccaagttcattcatctcagcttaatctaactgtagtttcgcggcacggccgacagaaacataacagacagggtatacggtcaagatagtatttgctaacagacaacaaaattgcatttgtgactttcactggtccataagacgaaagctaagcttctcatgctgcttggaatgatcacaacccaataactgacggttggactccacagctaccttaacatcttgtaacgaagcttggtagaactggcctgattctgaaggaaaaccatggttctgtccaccattccatgaaggacgtgctcttccattcgcttgaggtatccttgttccatttccccttgctttagcgacatccaaagaagacttgagcaagcgagttaaatgtgagttcaacccagaattcagtacatgagcaaactccatggatacattcaggccttgtgcttgcaatctgtgctgaagtacattccacaatgaccgagtatctggcaactccgcattattagaacatgtttcataagtgtaagaggtagaaggctgaggagtgtgagcctttggagtccccaacggaatccccaacggagctctgatgggactccgactttgaacacacgctgggctactgcgcacttgctcaacctcctccccgtcttctacagagacaacttccagcaaaaccttgctccctgatgaaacaaactccagggtactctgttgctccctagatctcggtatgtcgcaggagttgctgacctcgcctccatgaccatgaggcgc

SEQ ID NO: 8786 - DNA, 608 bp, Triticum aestivum
  Clone ID: PAT_TA_8786
gcacgaggctcgcatccaccccgtcttcacctcgctccttcataaaaactcgccaccccaagcgcgtacacagagacccagaggcagtcacagagagagagagacgtccggagcgagtgagagagagagagagcagagcagcctacagttgcagcttggacacgccgcccaagaaacgccattcttctcccacgccggcctagcttgtacggccagctagcttcctcccataagtagctgcgccgaggagaaggagccgtgcgtgcgtttccaccacttgttgccaagaaggacccccggcttgccctcgtctgctctgctctcacggcgtcgcaaggtggtggtgtctggccggcgaggcgatgaagaagggaggggcggggacggcgaaggaggcggcggcggcggtggggcaggtgaaggcggagctggaggacgcggggaaggcggccgggcgggcggtggcggtggcggccgcgccggcgctgagcccgctgagcgagacgctgtggcgggagaaggcggcggtggagttcctcggggacgtgtcggcgcggctggcgtggagggacctcacggtcaccgtcgcgctcggcagtggcgacacg

SEQ ID NO: 8787 - DNA, 751 bp, Triticum aestivum
  Clone ID: PAT_TA_8787
ttgctggagaactaataatgcacaaattccttcgtgtatacatacaatcacaaacgtcgatgaatttgatctctagaaactatacacacatcaaagagcacacataatcgccaaacaagtagccttgtagacagatgaatggcagacaactaagtgtgcccacacattcattagaatgcttaccactagagtctacagcaatacctatcactctttatcatcattccaaaaactcaccctgcacgtatactttctcctaaactcgccaatcctgagaaacgaagttaaattacctatggcccgagcttgagagcttccagtccatgaatccctttcttgaacatcccttggaatggcaagcccatcctgctctcttttgcttttggtcccttcactgcaccatgtttagcatctgaaccgtcagtcatgcaagcgccttcccccttcacgtcatgctgttcttgaattaggcgttccgtctgctgtaaactctcattagagatcaggagaatgccgcatcagttcactcgctgaagagtaacccatcaaccgatgaagcttagactcctccccaccccttgcagctttggcgccttgccacttcttccttcactcgtgctgggagatgagttccttgacacatgcaggggccgttcgtcctcggtagaatagctcacaccagccgagatgccgtattcttccgagtacgagtacgagtatggttcagcttgatggacaccagtgttatggt

SEQ ID NO: 8788 - DNA, 1175 bp, Triticum aestivum
  Clone ID: PAT_TA_8788
tcgcattcgcttcgtgcgttcgtgtcgcactcgcacgcagccttcgttcctacctccaccccgcagtagtagcagcagctccatcaccatctcccccctgcttccttcctcggatcggagggggagagcgaccggccgaccaggaggaagcggcggcaggatgagtctcttcggcctcggacggaatcagaagacgttccgccccaagaaaagtgctccatcaggcagcaagggggcacagctccgaaagcacatagatgcaaccctcggcagtggaaaccttagggaagctgtgaggctgcctcctggagaggatatcaatgaatggcttgctgttaacactgtggacttctttaatcaagttaacctgctgtatggcacactcacagagttctgcacatccgaaagctgcccaacaatgactgcaggcccaaagtatgagtaccgatgggctgatggtgtacagataaagaagcccatagaagtgtcagcaccaaaatacgtggagtacctaatggactggattgaaggccagcttgacaatgaatccttatttcctcagaagcttggcacaccatttccacccaacttcaaggatgttgtaaacacaattttcaagcgcttgtttcgtgtttatgcccacatataccactcccattttcagaagattgtcagcctcaaggaggaggctcatcttaacacctgcttcaagcacttcattctgtttacgaacgaatttgggctgattgacaagaaagaactggctcccctccaggagctcatcgaatcaatcatcgttccctactgagaaggaaacactgaggctgaaccgaactaaacatggctgctaccgagtcctctacaggaatggtcgagcgattgggctatctgcgccaataatttactggcacaaatcttcttgttccatttctttgacataaaaaaacaaaaacatgtacattaccagtgatgtatttgtgtgtacatgttcagcagttctcctgtgcaaacgcgattgtactgctataacatgcatgtttgggttcggttgtgatagtaataacattgaaaagagcagttttaagatgacaatgcagttgttggaaaaaaaaaaatgaaacataaaaaaacaaaaaaatgacagatgagctagatgacacgagggcctagcttgg

SEQ ID NO: 8789 - DNA, 641 bp, Triticum aestivum
  unsure (1)..(641): unsure at all n locations
  Clone ID: PAT_TA_8789
ctggaatgcaccaagaactcnttttattacgagcgcgaggacctcacttcatcctcccttagcgcttcgtccccgcgccgacgcccgaccccttctctatcttttaccgcgatgtatctccatgcaagctttactcagagacgcgaagcaggatgaggcctggtgcactctggttggtgaacccatcccagcctaccatcctgattgtcgtatatcacaagcatatcccgcattgtagcgtctccaatcaagatccgtcggtctccaccagcgatctgcgttccgttgaggatggccaggcaccaattattgcttctcgtgtggatgaggtagttcatagcagggatatgcatggcaattttgttgtcaaactgcaatgacagtggcttgaacaacctctgaaccttcgtcgatagatttgaatttccagcaatgtggcaggtcatgatcatgcacctcgcggtgtgaactgccgatcatatgtctcaccgtatgaacaaagggattgtatatccgggcaggtatgtaggtgtaggtggaaccactgtcaaagacagcattcactccatgcttgtatataggctctggctgtccgtctaggtgtagttttgcttgaccaggtgagtagaaaagttcgtatt

SEQ ID NO: 8790 - DNA, 574 bp, Triticum aestivum
  Clone ID: PAT_TA_8790
cttgtggtctctggatgttaaattacatggactacttcactggagatagtttgtccgacactcccgaacaggagtgaatgggtgaaaagctctcaaccttatcctattagtttaaacttgggcgtgacaggcgtttagatgttcaggagatacaacagaagtggaagggctccctgaaggatcgtctcgcatgtaaggtagtcattgccggagcccttgaatggcctcgactgaggcctctggcttcagcaagatcgccttggcactgtttcatggcagtcagaaaatagagatgaacacatgcattaaatatcattcttacctaaaggaaggttatggcgccaatatggatgatgaggattggaacacagatctccctttgtgcagttccaccaaaatgaaccaactgttccattctgacattccagttaaacaacacaaaagtcacttcttttaagaagagttttgtgcagtgcaccaaaaggtcacaacagcaggtgaattggatatccctgtttgcacaaaaaggcacaaaggaaacagtcagagtctcaaacaattataggcaaaaaca

SEQ ID NO: 8791 - DNA, 1330 bp, Triticum aestivum
  Clone ID: PAT_TA_8791
cgtccggcagctcctccccctcctctccaacggttcctcctctcaggcagctcctccttatacgcgcgtcctaatcgtggcgatctagaggttttccttcagcagattctcaggtctctagggtcaggttttctccgcagatatgatatctcaaaagaactcggatggattacctgatttacgttgctgatggggattcttcggagtacgttgaggatgatgatgatgtgagcaatgactttcgtccgccaactcatattgcgccagaggttgaagttaacaccaatccaaatactttacatgagcccgaattatgattgcgacttagagagtagagagacaagagagagctgagtggctcggtcttatcccttttgctatgggcgagttatctgttggtctgtttgtgttatgagttttattggacatggggtggttgaattactcgttctgtatctgcgataccatacagtgcactctgcagtcgcattctttcttgctagctttcttttctctaatggtcgctggatcaattttctgtttaattttggtgtactttattctgtttagtgatacataaatctaacatgtttgtacgcacctacacgttgatgcggaattttgccgcgtaaaaaggcatgtgcaaagatgatgtgggctctacaacaatcagttgcaagctatctaacatcttagaaatctcaaaatggcatccaagtatcctatgtttactgctgaccatacaggagctgcatcatcatcgttggtttacgaaaagtatgagagcactgaaggcaatgttttcaaggatgatgcaattgacgtgaagagttacatacagataaggcttgctgttgctatggcgcctaacagtgcctaggcggagggtaaaatggagattccaggtgaaattgttaacagtaagacctacaggactgctacagaaactgggaagaaaattggtagaacaattctcaaaggaatgcggaagagtgagcttgctggtctgtgttacactgatttcagcattgcagacgtttttgtcagtacgtctggaaaggccaagctgaaaggagtccggcgcatcaagttttgtatgacgcagcaatttaaccaactatggcgcagtgtgtgcaatcatgacggagctatttacactgaatgggcagatcccagcggaaattcaacgtctgattaatctcatgcgaacaaggtttgacttgagattcatgtatcatcttcacggatctttagtgcccattgctcgttctactcttttgtacaaaacattatatgagcagctagagatatccactatggacaaagcaag

SEQ ID NO: 8792 - DNA, 502 bp, Triticum aestivum
  Clone ID: PAT_TA_8792
cgtccgcccacgcgtccgcggacgcgtggggctgaacctctgtccaccgttattcggggagaggcaggaagcgagagagtccgagagagcccaccccacccatggagagttcccaccgcctgctcctcgtggccggcctcctcgccgcggtgctcccggcggtggccgccgtgttcgggccgcagttgggggctccatgcgagcccaccctgctggcgacgcagatcgcgctctcctgcgtgctcgacatgcccaccgcgcactgctgtgagccggtcgtcgccgccgtcgacctcgggggcggcgtcccctgcctctgccgcgtcgccgcggagccgcagcttgtcatggccggcctcaacgccagccacctcctcacgatctacatcatctgcggtggtctccgtcccggagtcgcccatcttgcagcagcctgcgaaggacccgctcccccggccaccgtcgtcagcagccccccatcccgacgcccctctcctgcacc

SEQ ID NO: 8793 - DNA, 1789 bp, Triticum aestivum
  Clone ID: PAT_TA_8793
cgtacaccatgcgtccggcaaggcaactggtgcgttgaaaaagagcaagggaaaccagatctgtgaaaatagtgaacttgattcaggcaaatggatggaggtccccaaagagagccgtatagcacttctcgacatttttgctggctggggcaggtttatccgtaagggttgcaagcaagcttgtgctgtcatttgactaaaatggggccaattgaaaagtgagggaaccgagcctggtgaaagcaatttagggcaatcaatcatcccggaaagctggcttgtcgtttgttggataacctcgcaatggttgattttaaaggtcaatgcatggacaaagtgatggggaattctggatgactcgtgtctcaatcttctgaaggctgctagaacaagcaggctaaacttgctagaagagaatattaaaaaccttcctgtccctggtgaagtagaattcataaatggcggtcctccctgtcagggcttttctggcatgaacagattcaaccaaagcccatggagtaaagttcagtgtgagatgattttagcattcctctcttttgcggagtattttcgtcccagattctttcttttagaaaatgtcaggaattttgtttcgttcaacaaagggcagaccttccgactggcagttgcatctcttttggaaatgggataccaggttcgttttggaatcttagaagcaggtacttttggtgttgctcagtccaggaaaagggcattcatttgggctgctgctcctggagagattcttcctgattggccagaaccgatgcacgtgtttgctagccctgaactgaaaataacactgcctgatggcaaatactatgcagctgccaaaagcactgctggtggggcacctttccgtgcaataactgttagagatacaattggggatttgccaaaagtggaaaatggtgcaagtaaactcatacttgagtatggaggtgagcctacctcttggtttcagaagaagatcagaggtagcactattgcattgaacgatcacatatctaaggagatgaatgaattaaatctcataagatgcaaacatattcccaaacgacctggctgtgactggcatgacttgccagatgagaaggtgaagctatcttctggtcaaatggtggacctgataccttggtgcttgcctaacaccgctaaaaggcacaatcagtggaagggtctgtatgggaggttagattgggagggcaatttccccacgtctgtgactgatcctcagccgatgggcaaggttggcatgtgcttccaccctgaccaggataggattatcacggtccgtgaatgtgcgcgatctcagggctttcctgacagctaccagttttcgggcaccattcagagcaagcacaggcagattggcaacgctgtgccaccccctcttgcctttgcgcttgggaggaagctgaaggaagccgtcgatgcgaagcgccagcaggcctgacaccgtccgtagaactcccaagggacagaagcaccagcattcaagtttcttctttattgtgcgtggctggtatgaactgtctcgaaccagcattcaagccacatactgatgtgacgatgtgaactatcatgcatgaacttgtgattttattggtctcttgtatattcttagtttattgttgattgacgcccaaattcagagttgtgattgtatccaaacattgcacgagcgtacatcaactagtggctgctgcatgtgctgtcacatgttctggagctaagatataacaacgtttcctcgtactcgatgttt

SEQ ID NO: 8794 - DNA, 849 bp, Triticum aestivum
  Clone ID: PAT_TA_8794
tagcatttcctgtgcttttcgcatcacgctgaacttgcaaagcctgtgccttacttgtggcatgacctctgcaattgctttcaccataccttcatcctggtctattatgattgtttttggcagtttccctctcatcacatgcaagaaggtttggaacatccatttgaaggtttcagctttctgatcttgtagcaaggcacatccaaacacaaggattcgcccatgattattcactccaatgataggggtgaaaggcatattatgcctattagtgctataggtagtgctaaatgatatgaaatctccaaaaatctcataatctactctcgaccttgcatcagtccagaaaagactcctaactatgttatcttcatctttttgcatggtgtaggaaaatccttggttccgcagctccagttctttgaagcgcttcagtgcggtttcaacatctgagttttcttttctccattggtcgacacactgtgagttgctcatatctttctcgtttgatgatgatacatttccaaagttgcttctcattctctggaaaatattcatagctttccttggatttaccctactttgttgcagaactcttagaaataacttttcttcacttgacaagtatttatgatccggacgcgtgctcgtgagcgatggggatggacatagtggatggttgtgctcgtgcttaactcctgtgaactcccattgctcgttatggagcttcactatcacctttgcttggcactgtgagcccaaaacattaaccttcctcttcctctgcaggtcctgagtttggctttaatttaccacttctgttgcatagtaggtgaaacttctttctct

SEQ ID NO: 8795 - DNA, 1062 bp, Triticum aestivum
  unsure (1)..(1062): unsure at all n locations
  Clone ID: PAT_TA_8795
tggcaatcactcccctttcctcatcgcattcccaaacccctccgagctctcttttccaccgccgcttctgctcgtcgccggattacgattagcccgaaccctctgctgccgctgcttgcgtgatggcgtcggcagcggaggagaagcataagaatcaggaggcggagacggggtcggtgattgggggcagaggtctggacgtgaggaaggacggggtggcgagggaggtggtgcggatggagagggaggcggtgatccccatcatcaagcccaaactagtaatgaagctcgccgacctcatcgagcatgaggtggatcgcaatgagttcctaaagctgtgcaagaaggtggagtacaccatcagggcttggtatctcctccagttcgatgatttaatgccaactgtactcactatttgaccctgttaatggtgagaagaggctggaacagcagaatctgacacccgaggagatcgatactcttgaattcaatttcatgacatatcttttccagataatggaaaagagcaacttcaagttgttatctgatgaagagtatgatgttgcacagtctggaaaatatcttttgaacctccccatcaaagttgatgaatctaagctggacaagaagttgttgacaacatactttaaagaacacccacatgataatctgcctacatttgctgataaggtaatcttgatgtctttctaactgacttaccactttcccttgcagtcaagaattatggttttaatttaaggaagttatgattactagtgtgtgataagggtgtgttctcatttcacgatttatattctttccttacttttgcatatctaatgagggtaataagttactcctttttgctaatgttggggtctcatactgtaataggaatattctaaggattttctactccatatctgactgacatgtgggtagaggtgctacatgccagtgacgcatggagtggaaaatccttggataccaatctcttggggtgccaaactcttaatttttcttctcattattgaattgtatgcatcaatcagttcacccann

SEQ ID NO: 8796 - DNA, 473 bp, Triticum aestivum
  unsure (1)..(473): unsure at all n locations
  Clone ID: PAT_TA_8796
cgtccggtcactcccagtctcactcaagttcctgctcaccacccaaattatctagcgcgcaccaaaaaatcgcagggcgtcatcaaacatctcgtcaccatacagcggggctggggcgccatgtcgcatcattttcacctgcgcacctcggttcttcccctgtcctccttccccggcgagctcggcgcccggttctcgcccgctaataagcccaggcatccggcgagcagcgtcggcgtcgctgctgcgtcgccgtcgagaaccctgcggcaccacatggcgaaggcggtggcgaaagaggtgggggcgcaagaggcgggcaagcaacgcgggtcggttgggcggcaagacactccgcgtctctcccctcgcctttcaactaaggtcaaagaactctaatgacataaaatgtgatactgcggattttgcanatgactctaaacatnaaaacaatggggnacgcatttcccgtt

SEQ ID NO: 8797 - DNA, 530 bp, Triticum aestivum
  Clone ID: PAT_TA_8797
gtcgacccacgcgtccgtttcaatcagccaagaccgatggagactttaaatgattacaacgaggattttcaactagaatttgggcgtgatgttacctttgccaccacagctgaagctgtttcctctgctccagaggttatgaatcaggagaagcttgctctcgttgataccacacaaagggaactaattgggccttttgatgattcaatcaatgcatatgatggttcggagatcataatagatcctccccaggaacttaccagtaaccccactatgttctgggatgacattattaaaggtgttggtcaagaatttgataacgtgaaggatttccgagctcagttgtgcaagtattccatcgcgaaaggatttgcgtaccggttcataaaaaatgaaaccaccagagtcactgtgaagtgtgttggggatggctgcacctggcgattgcatgcatctgagtcatctcgtagcaagaagtttgttatcaagaaaatgactgatgtgcacacatgtggaggaagatggggaga

SEQ ID NO: 8798 - DNA, 660 bp, Triticum aestivum
  Clone ID: PAT_TA_8798
cgtccgcggacgcgtgggcacacgcttcccaacgcgcacacacagcacggcatgtcttaccattccgttttccttgtgctcctgctctgcctttccctccccctccacctcactgccgctgatgaccctgaaaacgttttggatgtctattgcaatctcaccagggaccccttttctggcttgtccgacgttgtgctgagccatttttttctcctacgccgataacccgccacaggttctgtcccgcccgttccttcgtccaaaaaggccggatttctatggtccacccgagatgtggatcatgatccactttgtggaaaacaatcctggcgagacagccacactggctctgtgcgccgacgacgcgtacgcacacggctttaagagtaccaattcatggaaccatttgagcgagttccaacccatagtcccagggtcatacatgcttcccgtttcccatgtttaccctgacctactgccactgttaccaaatctgagacgaagttcacaccgagacttgtacaaagttcgggtgggcatagcctcgccatcgatgcattccgcattctggccaactacaatccacaaaccacaagcgtgtccaaacttagatcggcacttgtcagtttgatcgttatggtttgcgaggggaatcgggtc

SEQ ID NO: 8799 - DNA, 704 bp, Triticum aestivum
  Clone ID: PAT_TA_8799
taacttgaatttacacatttggtttgtttttttctggtatctaccgcacatgttcagctcttcttcccctacatgcttctcaattcctttacatgctacttcacaaaaaggattccttcctttctgttcgaaatgaacatgcacctggaagttgagacaaaagaactttcacatctgagatgacgaaagaaacccataacaccagattctcaaaactgaaagtatagggctgtgtcaacatgatacagttttacaacctgaaacaagacctatcaaacatttcagtgagcagctcttccacactgactgaaggtcatacaaaatccgcaacccctcttccgggcagcatatccatttgcagagccctgccatttctggaggcgaccacaccgacagacggcagcgaggggtccgtaactggctcaatctcgataaacctcatctccaaagaccccgtgcgcttcaagctcaagacgaagaccagcacgatccacccgagcattgtgatcgcccagtagttattcatcccatgaatcaaaccccaggcaatggagtagccaacgatgatccccgacaggtggccgatgaagctggcctggggaaccatgatggatgtgaatatgagcgactcgaagggcgcgaagctgatgggcagcgagaggaccccgaagaggttgagcttggacgacggctgcttggcggcc

SEQ ID NO: 8800 - DNA, 388 bp, Triticum aestivum
  Clone ID: PAT_TA_8800
cgtccgcggacgcgtgggctcctcccagatccgcgcgtgcgttcctgttcacgttctcatccggcggggtcgtcttcccccagactcgactacgccttccgactcgaatctcggcgatttcccaagcgataatggcggaggaggggcaccaggtggtgctcaacgtgcacgacctcagcaacggcctgcgcgcgccagctctccacctccttcctcgggtagcccatcgaggccatatgggcacacggtcgtggtggtgttcggcaacgagtcacttcctcgggggcggtatccatgtggcgccggcgggggccatccagtacggtcgccccgcgcgtcccggcgacctgctggtcatccagctgcccggcgaggtcttccaggaata

SEQ ID NO: 8801 - DNA, 1322 bp, Triticum aestivum
  Clone ID: PAT_TA_8801
gggccgggccagtgggacactgccgcgcacgtccgccgcggcgcctctgtctctccctgctctctgtttctccgctcctcccagatccgcgcgtgcgttcctgttcacgttcctttccggcggcgtcgtcgtcttcctccagattcgactcgacgatttcccaagcgataatggcggaggaggggcacaaggtggtgctcaacgtgtacgacctcagcaacggcctggcgcgccagctctccacctccttcctcggcaagcccatcgaggccatatggcacacgggcgtggtggtgtacggcaacgagtacttcttcgggggcgggatccaggcggcgccggcgggggccacgcagtacggccgccccgtgcgggtcgtcgacctgggcgtcacccacctcccccgcgaggtcttcgaggactacctccgcgacatcgcgccgcgctacaccgccgccacctacagcctgctcacccacaactgcaacaactttagcaacgaggtcgcgcagttcctcgtcggcgccgggatccccgactacatcctcaacctgcccaacgaggtcatgtccagccccatgggcgccatgatcatgcccatgatccagaacctcgaggccacgctcaggaacaacgccgcgccccagaccacccagttcgtgcccacgccggcctccgtctcggtgccgcagccggcggcttcggccggcaaaacccctactgccaatgctagttctacagccgccgctgccgctgctagtgcggcgcccgctggctcttcttccgagaaagaagaagagaagaaggtcgagaagcagactccggagaaagccgccgcgccggcaccgctgactgtggctgaccctctcggcagcgcgagggggaaggtgcaggaggaggtgatgagggagtttgcggcgctcatggcgagtggcacgctgcgggcgagcgaggcggcggccctggccatgcgccgggtcatggagcgccacggcgacggcgccagtatgcaggcctagtggcctgaaagtattttacacaccttcgatctttgatgcaactgcaaactgatagtaattggaacgcttgcttacttgtattgcagcatggaactcaattttatttgtctgatttactcataataattgggaacggttgcttacttgtattgcagcatggaactcactcaattttatttgtccgatttgttttgatggtatggaattatatgcctatatggtttcttcaatgctagatttcttggttcactgctaaaaaaaaaaaaaaaaaaaaaaaaaaaaaaaaaaaaaaaaaaaaaaaaa

SEQ ID NO: 8802 - DNA, 682 bp, Triticum aestivum
  unsure (1)..(682): unsure at all n locations
  Clone ID: PAT_TA_8802
tcgattaatnagcgaagagaattgcccagttaattaatggaaaaccgggcgaaaaccaatacagaccaacaacacgtgaactactcacaaagtatgcaacccctgagcacaagatcgcctcacaaccaaacccaacacctaacgtccaccaaccccacactgctacatcacaaagacaccccaatgagggtaactcggccgaagaccacaggcgccaccaaatccacgaagacaagccagaccataaggacaacctaagagactgataaccatccatcaagctgctgcggacgcctttcctgtggcctcactcttctttcctttgctcctgagagcctcctccacaatcgccttgccagatccagggctcaccctctccaaacgtttgagcaagctgtgaagctctaaatcgaagagaatgtcattgactttgtcacgcacagaaacctgcccaacggtcacgtgcgagtgggtgactacaacatcggaacctccatgctccacaaagatgagcggctggttgcgcaccgaaggatcaggcgccaacataccaaccacctcaacatcatcagtcacaggtaccactgacacgatggactcgagcgtctccagttgctcacatgatagagcctcggagttaggcgccaacacacctaactcatcaacctcgccactcaaagcc

SEQ ID NO: 8803 - DNA, 1055 bp, Triticum aestivum
  Clone ID: PAT_TA_8803
gcacgaggctcactcccgctcccgccgttcctgcgacgcccgaggcggaggcgaacacagatgcggtggccgtgagcgaccgaccgagggccgatcgacatgggaggaggaggcgggaccaaccccgcggccgtcgccttcgcgttgctcgcggcggtggtggtcggcgccgttgcggcggccgcggagggggactcgctcgccggcctcgccgcgggcatcgacggcgccgcgccagaggtgaaggaattggggccatgggcgaaggggctgctcaacgggatgccggtcggcccacccggcccggcggccatggggcccgtcgccaagtacccgctggtactggccgaggacaggacgcggcggccggacgttctccgccatctcaggatgtatggaggtggttggaacatcaccagcaagcactactgggcgtctgtatcattcacaggagttgctggatttctccttgctgccctgtggttcatttcatttgggattgctgcagcttcattctgcttttgtaaatcaagagtgggcaaagcaaaggtttcccatgcagatgtagcacgacctgtgttgcttgtggttgctgtgctcgtccgcggacgcgtgggcggacgcgtgggctatgggcagaatgaattccgtgaagaagctaccgatactttggattatgttgtcaaccaatctgatttcactatccagacactgaggaatgttacagattacttgtcatttgcaatgacgatcaatgtggcagcactgtatcttccatcagatgtgcaggctcagattaacaatttgaaagtggacctaaataaagcagctgataccatatctttgaagacaacagaaagctacaaaaggatcagaaaagttctccataatgtgtacgtttcgaagctgtccttgcttacttgtcgtttttcctccagaatttcactgagaaatagtgtggatgtgactatgcttgccagtgggcttaaatctaactagaaaatgacaccactatgttggtgaaatacacaatcacatgacatattgacttatgg

SEQ ID NO: 8804 - DNA, 755 bp, Triticum aestivum
  Clone ID: PAT_TA_8804
aatagaagttaacattttcataaaaattggaacactatttgggcttgtcccaaacaaacacttgcagcctgagtctacagagaacatctgcagcattagtttcagaagactaacctcaacatatacacacgctcttcctatgccatcactctagagaaatagtacaaccagaaggggataaaccatgctgctagctgttatagttgtacgtacaggtcattgtactctagaagctaaatgggcagaggcaatgctccatcgacaaaatttcagtgtcacagtctcacagatgatcattgatgtgttcttgcacatccggctgcagtgagacctgggaccatcttttctggtcctgccatttcatttccccgtgtgggggatccattgaaatccccctcgggaactggctttgactccgacctgcttatctgggatgccatgatcttcggcccccttccccccgcggtggagggcttcggtgcggctggcgggctccgatctgcggcctggcacgtggtcaccatctgtcctaccaagagccgctcagtacgtctcccgtacccccccccgaagtacccttccgccattcccgcgccgctgtcggccccccccgacacactctccgccagcggccgccctttagctgcttcttttactcatgtttccattgtccattcaaattgctctcctgttctatggccattgatgacccattcgtattttcaacaactcttgttactttttctttcgttttt

SEQ ID NO: 8805 - DNA, 454 bp, Triticum aestivum
  unsure (1)..(454): unsure at all n locations
  Clone ID: PAT_TA_8805
cgtccgcctcgcctccgccccgtccattccatcctctccgtctccggtcagctcgccagatcctacctccacgcgctagggtttgcgcggccgtccgtccgtccgtcgtcgccaccagccatggcgtccgggaagcacttcaagtacatcgtcctcggcggcggcgtctcgggggggtacgcggcgcgggagttcgccaagcagggcgtgcagccgggggagctcgccatcatctccaaggaggccgtggctccttacgagcgccctgccctcagcaaggcatacctgttccctcagaatcctgcaagattgccaggattccatgtgtgtgtgggaagtggaggcgagaggctcttgcctgaatggtgctctaagaaaggcatcgagcttatcctgagcgctggtattgtcaaagctgatcttgcttccgngactctgactagcgcatctgggg

SEQ ID NO: 8806 - DNA, 1062 bp, Triticum aestivum
  Clone ID: PAT_TA_8806
tgggaaaatgacgacgcggccaatctgtatgcagctatccaagcaaagaaggtggaaaggcagtggttgttggaggaggttacattggccttgaactaagcgcagtattgaagatgaacgatcttgatgtgactatggtgttccctgaaccttggtgcatgcctcgtctcttcactgccgagattgcagctttctacgagagttactataccaacaaaggagtcaagatcttgaagggtacagttgctattggttttgatgctgacgccaatggtgatgtgaccgcagttaagctaaaggacggcagtgtgctcgaagctgatattgttgtcgtcggtgttgggggcagaccattgactaatctcttcaaaggccaagttgccgaggagaaaggtggaatcaagaccgatgcttttttcgaaacaagtgtccctggagtgtatgccgttggcgacgtggcgaccttcccgatgaagatctacaacgacgagaggagagtggagcatgtcgaccattccaggaagtccgcggagcaggccgtgaaggcgatcaaggggaaagaggcgggctctgccgtggaggagtacgactacctgccctacttctactcgcggtcgttcgacctgtcgtggcagttctacggggacaacgtcggcgacgccatcctgttcggcgacgccgaccccagctccgccaaacccaagttcgggtcgtactgggtcaaggacggcaagtgcgtgggcgcgttcctggagggcgggtcgccggacgagaacgccgccatcgccaagctcgcgagggcccagccgcccgccgccagccccgacgagctcaaggccgccggcctccagttcgccagcaagatctgatgtggccgtgccgctgaagtgtcacgttgggcattagatttgcaaatacatacatacatacataaacacatagctcactgcacagtacaatttggtcgatgctattgtgatgtctgtatgccacatactctctcagtttctccgcgcctttgaggtttcaataaagcccgcacccctacggtcagttcaatac

SEQ ID NO: 8807 - DNA, 1653 bp, Triticum aestivum
  Clone ID: PAT_TA_8807
gatggccgcgtgccctcgcgtccgctccgccgctccatccattctctccctctccgtctccggtcagctcgccagcttcctacctctccgtccgaccgtccgtcgtcgccgctcacgagccggcccggccatggcgtccgggaagcacttcaagtacatcgtcctcggcggcggcgtctccggggggtacgcggcgcgggagttcgccaaacagggggtgcaggccgggggagctcgccatcatctccaaggaggcagtggctccttacgagcgccctgccctcagcaaggcatacctgttccctcagagtcctgcaagattgccaaggattccatgtgtgcgtgggaaagtggaggcgaggaggctcctgcctgaatggtactcaagaggaaaggcatcgagcttatcctgagcactgaaattgtcaaagctgatcttcccttccaagactctgactagtgccagctggagcaacctttacatacgagatcttgctaattgcttcctggtctcctcgagtcattaagctcttctgcattttggcgctcaaggagctgattctaacaacattctgtacctgagggaaattgacgacgcagacaatctgtatgcagctatccaagcaaagaagggtgtgaaggcagtggttgtttggttggagattacattggccttgaactaagcgtagtattgaagatgaacgatcttgatgtgactatggtgttccctgaaccttggttgcatgcctcgtctcttcaccgccgagattgcagctttctacgagagatattatactaacaatggagtcaagatcttggagggtatacgagctgttgggtcagttgctgggggacaacgtgaggtcacgccatcttagttcggcgaacgccgagtcctagactccgccattcccaaggtcgggtcttgctggatcaaggacggcacgtgcttgggcgcgttactggagggcgggtcgccggacgtgaacgccgacatcgtctacctcgcgagtgtcccgccgcccgccgccagccccgacgagctcaagtccgccaggatgaagttcgactgcaagatgtgatgtggccgtgccgctcaagtgagaaggtgggcatggcattcgcagaaagagatataggggcaacagtcgagttctacctcggaggactatacctatctgccctagttgttctggcggtcgttcgacctgtactggcacaatgtcgcgggcgccatcttcggcgacgcataccggcccgggcgccgccgggcccaggttcgggccaaactggaacaacggacgcctactgcgtggacgggttggtcaagtgcctgggcgccggacgaggagggggggccgccgccaagcgcgcgacgccatcgccgaccgcccccagcgcccaagaggcctgccgccagccccgacgagctcaaggccgccggcctccagttcgccagcaagatctgacgcagccccgccgctgaggtgtcacatttggacattagatttgcaaatacatacatgcataaatagtattattggtcgatgctattgtgatgtctgtataccacatactctctcagtttctccgcgcctttgaggtttcaatcaataaagcccgcgcccttgcggtcggttcaaaaaaaagggg

SEQ ID NO: 8808 - DNA, 797 bp, Triticum aestivum
  Clone ID: PAT_TA_8808
tgtagaccgtccgcacttgatgagcagccccatggaggaagctcaccatggcatgccgtcgacgacgacggcgttcttcccgctggcagggctccacaagttcatggccatcttcctcgtgttcctctcgtggatcttggtccactggtggagcctgaggaagcagaaggggccgaggtcatggccggtcatcggcgcgacgctggagcagctgaggaactactaccggatgcacgactggctcgtggagtacctgtccaagcaccggacggtcaccgtcgacatgcccttcacctcctacacctacatcgccgacccggtgaacgtcgagcatgtgctcaagaccaacttcaacaattaccccaagggggaggtgtacaggtcctacatggacgtgctgctcggcgacggcatattcaacgccgacggcgagctctggaggaagcagaggaagacggcgagcttcgagttcgcttccaagaacctgagagactttagcacgatcgtgttcagggagtactccctgaagctgtgcagcatcctgagccaggcttgcaaggccggcaaagtcgtggacatgcaggagctgtacatgaggatgacgctggactcgatctgcaaggtggggttcggggtcgagatcggcacactgtcgccggagctgccggagaacagcttcgcgcaggcgttcgacgccgccaacatcatcgtgacgctgcggttcatcgacccgctggggcgcgtgaagaagttcctgcacgtcggctcggaggcgctgttggacagagcatcaagct

SEQ ID NO: 8809 - DNA, 794 bp, Triticum aestivum
  Clone ID: PAT_TA_8809
ccgaggttttttttttttttttttttttttttttttttttttttttaccagtgccacatattttcattaatataaacaaggtgggccagggtggtctgctcggtttctccgttattcttcgtttcgtgacttactgctgggatagttgagtttctacattctggcataaacacgtgctacatcacaggaaatcccatactgggatggtgtactggccttgatccgtggtctggtggcccagttgaggattgctgctaagaaactgcaatgactggatatctggagggggagcctggtgcatttgaggaccgctatgaaagggtggttgttgtagatgaggttgctgaagatgaacaggtgattgttcctgcatctgcccaaatggcgacatcccagaaaatccttgaagagaattaagaccaaactgctgtgtaacatatggtgcctgcatcagatgacttggagcaaggaccggggtggttgccggtctccggtggcttgggttggcgggccatgtcctgggagcaagaaccctaagtggcagttcagcctcctcaggctccactagaccttgtctaccttttttctttttacttgattcaagaggactttgctgctggcgacgattctccacatttttattttttttactacttgctctgcgaggttcactgttgctggtatcattctgaggcaaatttggctgttgacttctcatgatagtgcttaaggaaggcttgtcatgcaactttgcttgcaaaagaagctcaacttgctccaggagctgatcatat

SEQ ID NO: 8810 - DNA, 1695 bp, Triticum aestivum
  Clone ID: PAT_TA_8810
gcccggccgggttttacggagtcgcccacgggtccgaccaaataaatccccacctgtcgccgcggccggccaccgcgattcaccgccgccgtccgccggagatcggacggctgcccctgccccgacgccgtctctcgcgagccagtgccgccgcctcgtcctcatcgccgtcgtcgccttcctcttcttccacccctagcttctccgggaggcggccgagtcgccgagtcgccatggaggcctacaaggtctgggtgcggaagaaccgggacctcgtccgctccctcgagtccctcgccaacggggtgacatggatacttcctgagcgcttcgctaactccgagattgccccggaagcagtatatgcacttctgggcattgtaagttctgtcaaccagcatataattgagacaccaaatgatggtcactcactggcctccaaggaacaatctatcccatgggctcttgttgtatctatactcaaggatgtggaagcagttgttgaagttgccgcccagcactttgttggagatgatcgcaaatggggcttccttgctgttacagaagcagtgaaagcatgtgtcaggttagccgctttcagggagagtggctacaggatgctcttacagggaggggaggtggaaaacgaagaggaggatgttcttgaagacaatcagggagtcaagactaatggagtgccagtaatctatccggtcaatggacattcccaaaatggccattggatcacgtctgatggtccggatggaaaacctggaattatatctaagactctggagggaagagcagtagctgctttaaacaggtttggtcagaatgcaaagatgttgtcagatcccacgtggatgagcaggctccaaccttctcctgttcctcctgcagtgatggagattgagaagccaactctcgcaaccatttggtcttctaaaggggtttctgggcgcttattcatgttaggggaggccgtccacatattcagaccacttgtatacgtactcttgattagaaagtttggcatcaaatcttggaccccgtggttggtctcactagctgtggagctcgcaagccttggcattcattcgcatgcaacagatctgaatcatagagctgggaaagttcatcagctctcgtctgctgagagggatgagttgaaaaggcgaaaaatgatgtgggcactttatgtcatgagagatccgttctttgccagctacaccaggcgtcatcttgagaaggctgagaaagcactgaatccggtgccgcttatcggtttcatcacaggtaaactcgtggaactattggagggggctcagtcgcggtatacatatacatcaggctcgtagatgagggttgggatagatttacctgcttctgctggagagcttccttgctgatctgccatactggacttttgctggttcctggagtttgttttcagtagatgaggatttgagcgaaaccctgtctgtgctttgccatttcgtagccagatctggcatcgctgtctcgagaccttggctgataagttgcagccacataacctcacccctggtggcagctgggaatgtaattatacagtacatcggtctaatgtcatgaataggcacgcaagcattaccgtcgtatttaccagaaatgaaaatcataataagtttgttccttaaaaaaaaaaaaaaaaaa

SEQ ID NO: 8811 - DNA, 874 bp, Triticum aestivum
  Clone ID: PAT_TA_8811
cgtccggccaattgggactcttgctgcaatagacaagtctcaggcagaactcaactatgaccaggttttcatgagggatttcgttcctagtgccttggctttcttgatgaaaggggaaccaacgatagtgaagaatttcctggtagagactgctcgccttcaatcaagagagaagatggttgatctttttaagcttgcgcagggtgtgatgccagcaagcttcaaggtgcaccattcccaccctacgaagaagactgaaactctgcttgctgattttggtgaaattgctatcgggcgagttgctcctgtggattctggcctatggtggatttttcttcttcgtgcttacaccaaatatactagggacagttctctggctgaaagtcctcactgccaaagggccatgcgccttattctcaagctatggctctgtgaaggctttgatacatctccagcattactttgcgctgatggttgctccatgatagaccgcagaatgggtatatacggctatccgcttgaaatccaggcactcttcttcatggctctgagatgcgccttgagtttgctgaaagactctgatgacgactttgtgtaccaaataacaaagaggatcaaagctttgagctaccatctgcacagttactactggctcgacttccaaagactcaacgacatctatcgctacaagaccgaagagtactcgcagacagctctgaacaagttcaatgtgatccctgaatcgatccctgactgattatttgacttcatgcctagccgtggtggctacttcattggtaacgtcagtcctgcaaggatggacttccggtggttctgcttgtgcaactttattgcgatcctgtcttgtttggca

SEQ ID NO: 8812 - DNA, 2917 bp, Triticum aestivum
  Clone ID: PAT_TA_8812
gccccccccccgttctggcgattcccctccccccctcccgccccaaaaccctagaggcgggcgcatggccgacgaccactacagctcctccgccgcctccgcgccgtcgccggccgcggcggcggcggccgaggccgcggcggtggtgggctcctcggtgatcccgatcgtcaacaagctgcaggacatcttctcgcagctggggagcagctccaccatcgacctgccgcaggtggccgtcgtcggcagccagagcagcggcaagtcgagcgtcctcgaggcgctcgtcggccgcgacttcctcccgcgcggctccgacatctgcacgcgccgcccgctcgtgctgcagctcgtgcaccagccgcgccgccccgccgacgccgagagggacgagaggggcgagttcctgcaccaccccggccgccgcttctacgagtttcccgacatccgccgcgagatccaggctgagtcgggctgggagcctgcgggtgtcctgggcgcctcacatcgtcccgcccgggggttgtccgttccgccccatgttctcatctgctctttcgccggcctgcccggttttacttaggggcctgcgcccgaccaacccactggcgtcgtgcccagtttaaggactatgatctgttcatatatccatcacaagacatgcatcatattggctgtttctccagcaaatgcagatttagctaactctgatgctcttcaaatggctcggccagctgatcctgatggttctcgaacaattggtgttatcacaaagttggacataatggacaggggcactgatgcccggaattttttgctgggaaatgtcatcccattacgacttggttatgttggcgtcgtaaaccgcagccagcaggatatcaattcagatgtcagtgtcaagcaggctctggcccgagaagaaagtttcttccgttctcatccggcatacaacggtcttgctaagcactgtgggataccacagttagcaaagaagctaaaccagatcttggtccaacatataagaactattctgcctggactgaaggcacgcataagttctcaattgacagctattgctaaggagcatgccttttatggtgacccagtcgagtccaaggctgggcaaggcgctaagcttttgaacattctagctaaatactgtgatgctttctcgtctatggtagaaggaaaaaacgaagatatatcaacaatcgagctttctggtggagcaagaattcactatatttttcaatctatctttgtcaaaagcttagagggtgttgacccttgcgaggatgtcactgatgaagatatccgcatggctatacaaaatgcaactggtcctaggagtgctttgtttgtacctgaggtgccatttgaagtccttgtacgcaggcaaatcagcagattgcttgatccaagtcttcagtgtgcagatttcatatatgaggaactggttaagatgagccaccgttgcctttgcaatgagctgcagcagtttcctatactcagaaggagcatggatgaagtaattgggaagtttctacgggatgggcttaagccagcacaagatatgatagcgcacatcattgagatggaggccgattacataaacacatctcacccaagtttcatcggtggcagcaaggctgtagaacaagcacagcaacaagttagagccgctagattgcctgcaacagtggttagaagggatggagtagatgcagataggccacaggcttctgaaaaaacccaaaaagcacgtgcattattgggtagaactactggtgtaaatggagttatcaccgaccagatccagcagggggtacgatctgctgctgaggcagagagaccaggatcttcaggtagtggaagcacttctttttggggctcaatattcacctcaagcgaagaccgtgcacattcttcagcaagaggtggctcaacgaacaaatcttatgcttcagctactcccaacctggaacattcattctcttcaatacagttaaaagagccaccgctagtcctcaagccttcagaaagtcattctgagcaggaggaccttgaaatagcaatcacaaaattgctgctgcagtcatactacaatatagtcaggaaaaatgtcgaggatttcgtaccaaaagcaattatgcattttctggttaatcacacgaaaagggagctgcataatttccttataactaccctttatagagaagagctctttggggacattctcagagaacctgacgaaataaccacaaagaggaggcagatacgcgatactcttaaggtccttcagcaagcctacaaaactttggacgagataccgcttgaagcggagacagtcgagaggggctattccctggattctgatgcgacgggtctaccacgggtccatggggtttacgatggaagctcaccatattcgactccgaagcaaacaaggcctaggaaatcaagccactccggggagcagcaacaacctttcagtggcaatgggttttgatattgcctttcacgatcatcccccggattagtagtgattgagccagcggatgtgctggtagcaacacatcattccgccttgggtttgtcagttcggtacccaatagatatatgttttttttctctagccattgctattctttttagtgttgcgcccaacgaaagcattggcgtggtgccaaatttttgccatgtgccctcttgtacagtatatcactgcccaatcatttcgacttaaaatgaaaccggtgatgggtatagatttttttgttaaaaacccatggaagaagctatgggaacctttagttttagtgccgagtacttgtatctaaacacggttcgtggtcccgtgatcagtcggacctcgttcttcttaagatgcgaagaggttgtgctacatgaatat

SEQ ID NO: 8813 - DNA, 1697 bp, Triticum aestivum
  Clone ID: PAT_TA_8813
ccacctctgactacagtccactcccctccccccgccgccctccccccccccccctctcccgctcgccccccccccctccccccccccgcccccccgcccgcccccgccccccaccccccccaccccgccggcccccccccccccctctccccggtgaaagtctagatggctcctttggtgctgggtatgtgaattgcagaaaagaataactgttgacatcttggtactgcatgatgaacggttcaactggttccctaggggatcatgtgaacggaaagcaagtgcaaagtgttgaccctcctggtctttcaagttttaacaatggacccagacactgtccgttgaatgcattgagacgctgccgtggtgtattgtgcttggtgattatgccggtgaccgcatgcatgatgatggtttacctagcccctgcgacaaccttcgttgtacggtttttcagtgtgcattacagcagaaagtggacgtgctttctgttcgggatgtggttagccatgtttccctttttgtttgagaagatcaacaggacaaggtttgttttctctggtgaaaaggtgcccccaaaagagtgtgtcttgctgtttgctaaccacagaactgaggtagactggatgtacctgtgggatcttgcattgaggaaaggccgtttgcagtctatcaagtacattctcaagaaaagtttgatgaagttgcctatatttcaactgggcatttcacacctattgagtttatccccgtataccggaattgggaggttgacgaaccactaatccgaagaaggctttctgaactgaagtaccccaaggatcccctttggctcgcagtttttccagaaggcactgattatactgagaagaaatgcatcaaaagtcaagagtatgcggcagagcatggtttgcctattctgaaaaatgtcctccttcccaagataaaaggtttcaattgctgcctgcaagagctgaggagtaacttggatgctgtttacgacatcacgatcgcatacaagcatcggctcccaacgttcatggacaacgtgtacggcgtcgacccttccgaggtccacatccacaccaagatcatccaggtctctgacataccgacagcagaggacgaagtatccagctggctgacggagaggttcagactgaaggacgagctcctgtctgattttttgacacaaggccacttccccaatgaaggaaccgaagaagacctgtccacgctcaagtgcgtcgcgaatttcgttgcggtgatcggcatgacggccttcttcatctacctgaccctgttctcgtccgtgtggttcagggtgttcgcggcgtgcagcgcctctttcctcacgtatgcgaccctgtactctgtacacgcgccccagatcgtgtgtttgccggaggccggcgcccacgccaagaaagcttgagcttggcgttgtaagctggagctggaagctgtgtatgtgtgtccgcatgcagtagaaacatgtttactgcgtatacgcagcgtgtggtgtcattcttttgtatgtgtgtatgctgagtggcatctacagttgggggtagaatttttaactccactcttgactcttttttggagcaaaatacgaagactgcattgcgaaagtggacggagccaaaatcggtcgccactatcttttgtctaaaaaaaaaaaaaaaaaaaaaaaa

SEQ ID NO: 8814 - DNA, 602 bp, Triticum aestivum
  Clone ID: PAT_TA_8814
gcacgcacccactcacaactttcgcattggccccagcctatgggcagaacattagcacgtagcgtctggacaatcgtctcttcgctgctacgtgtcgatatttgcaacaaggcttcttcttgcaaggaactcgctgctagacgcgtgggcaaaagtaccgtatgtgtgtaaaatggaaaaaggcacctttctaatatcgagcccataggcctatgggagattagaaactccacgtccatggacgaaagagttctaattaaagaagaaacacgaaaggcaaatagttaaatggcttggattctgtcttcacatttggagaacacaaatgactttctgaagttttctaacatgagcgtacgctccaaacaaaacatagatgtatgatatgaccgcacatggaaaaggattagacatcttcaataaattcacattcttgatcaatcaatcagacaaagcacagtaagtgcgtagtactactatatatttcccgatgctttttttcctgccacgagatgccaaggcatcactttcctgaccacaccttctgctgattaattgttcaaaaatatgcgtaaaaaatgatacagaaagagttctaaaga

SEQ ID NO: 8815 - DNA, 1177 bp, Triticum aestivum
  Clone ID: PAT_TA_8815
cgtccgctcgacccaaatcctcacccttcccctccccctcccccgtgctctttcgctcccgtcaaaaccctcgcccccacctctccggcggcggcggcggccgtgcttcctctccggcgagggctgcctccacgtccgtacaagagaatatggatgggcctgctgaggctcctgctgttacggagcatgagatgagcgagatccctaatcctacctgcggtgagcaagccgatgctagcattgaggagcaagccaatcctgagagtgatgtggcagagcagatcaaggaagaagcagaaaatacatctgatgaggaacccaaaggcacaaacaacgaagaatctggtaacccgagcgatgaagcgcaggtgactgtgaaagatgacgatatgggggatcagaatagcgaggaccaggctatccgttcacttgaagagccagctgaggcagagcaactggccaatgtggagacggaggacacgaaatggcctgggtggcctggagaaagtgtgttccgtgtactggtttctgcccaaaaggtgggtgctctcattggccgcaaaggggagtttatcaaaagaatgtgtgatgaatccaaagcccgcataaagattcttgatggcccaccaggtgttccagaaagagctgtaatgatttcagcaaaggatgagccagatgcactcgttccgccagccattgatggtctgctcagagtacataatagaataacagatggtttagacagtgaaaccgaccaggctcagcgaggtgctggtcctgcagggccaacacggctacttgtgccagcttcccaagctggcagcctgattggcaagcaaggagcaaccattaaatcaatacaggatgcttcaatgtgtcccctccccattcttgagaatgtgccacctgtagcactaaatgatgacagagttgtcgagatacaaggtgaacctcatgatgttcacaaagcagtggaactgattgcaagccatttgagaaaatttcttgttgaccgtagtgttctccctttattcgaaatgcagatgaaagtgcacagtgcgcccagagagcaacctatgcctgctcctcagcagtggggtcctcctccgccctggagtcatccaccaaacattcctcccagtggcccaggttatggtgggaatccacattttatgcc

SEQ ID NO: 8816 - DNA, 755 bp, Triticum aestivum
  unsure (1)..(755): unsure at all n locations
  Clone ID: PAT_TA_8816
tatttggatagcttatactattgtgaagatctacagagttacaaaatnaaaatgttgtataattagattatcttgccactatatttggctgtgacatttgccagaaaagtaaagtcaatttcatttcgctcaggtactctcctttagctatggctacaaaacggaaacgtcgaaaaagtgtatgaatgaagagaataaatcggattgccgcaacttgatgctcaatagcgctgctagccctgctattagttcaacaaccctgtatttctaatctcagtcctcagactttcagatcaagctcagactgcgatgacagtatgccgtgcttctgtgttttctcgctgattggtatgtaaacctgccgctctttgcctcctggtttggacgacgcattcccgtaccaaatcatgccaataacagctatggtcatgccgagtgcgacatggaaattaaggccctcttttccgaagaggaaaaaaacccagggtcagcacgagaatagtcttcatgtggcctagaacttgaaacgagacagctgtgaatcgtccgatgcatatgaactggcttagattggtaccaacagcaattatgcacgacaatacaatgaagaacgtaactaccatggtataaccaaaagtatcaactcttttgtcagtcaaccataaatccacaaaaggaccaaatattaacaacgacgctgcctgagcaggagcagtatgacccaagaggtggaatagccaagcgagtcttccctc

SEQ ID NO: 8817 - DNA, 828 bp, Triticum aestivum
  Clone ID: PAT_TA_8817
cgtccgcccacgcgtccgcccacgcgtccgcccacgcgtccgcgcaaagatgacggaggcattcccaagttctcccgcagctcgccgtcctcctcctcagctctctcgtctcatccagcgccgcttccactctagacgacacctgcaagtccgtcagcgcgagcaacagggacctcgcctacgactactgcgtcaagttcttccaggcgtgcaagggcagcgccaccgcggacaagcgcggcctggccgtcatccgccacgaagatcatccgagcggcggccgtcgagcaccggcaggcgcatcggccaccatcaaggcatccgcaaaggggacgacaggaggatccagggcccgctcgccggactgcgacgagctgtacgccagcgccgtggaccagctcgacgcggcggcgaggggcatctcgtccgggaagttccaggacgcccttgacgaacctcagcgccgcctgcggacgcgccgcagacctgcgaggaagggttcccccagctgggcgtgagttcgccgctggccgacgaggactccaagttcaggaaggagtgctccatcgctctcgctgtaacgaacacgttgtaagcgacaaaggtctattatcatttggatcaatataaacctgcctggtattcctgtttggaccggggtgaccccgcattcccgtctggccgcactcgcctctcttgttcggtcgatcgtgccccccctggcgactgcttcagcggccttcattgttcttaagtagtgatctaaacgctcttatattaatttatgaaaagtgtgaaagtaagtaacaaggtcagtggattttggcc

SEQ ID NO: 8818 - DNA, 705 bp, Triticum aestivum
  Clone ID: PAT_TA_8818
ctcccattatgatgactccggaaccccttggttcctgtgatccctgtcgaagatgatgatgcttcagatcagtcggaaggaccattgcttgatcaaccaaacgattaccatcagttcgataactatggccctgcagaaatcaatgggctgcaagtgtcaaatactccaattactcctgcacaacagcagcctggtggatccactggcgttgaagctgatgtgttggctgcagcctctgctgcatacactgcaataatgcagagcaaccaaaagggaagtatgcgtccgcccacgcgtccggttaaaatactaagtgatcctgtacaagttgagaggttaatgaaagaatacaaccaaattagaaatgaacaatctactagtagttctgttgttgccccaatgccaccgtgtccacccccccaaatgacaatgactgcccctgcctcatattccaatcatatgacaactttccagaacacaaattccaccctgccaccttcaatggccccacgggcaatgatgaatcgaccgcctcaaggatattctccagtttccatgaatcatccacccggttctagtccagctttgaatcttccaccgggttcaaatccagtatgagtcatcgaccaggttcaaatccacctatgggtcatccaccaggttcaaatccaccttagggtcggccaccgggttcaaatccaccta

SEQ ID NO: 8819 - DNA, 442 bp, Triticum aestivum
  unsure (1)..(442): unsure at all n locations
  Clone ID: PAT_TA_8819
ctcgtgccgaattcggcacgagtggcgtagaaaagagaccatagccaatcatcgccggtgagacgtgccgtcccatggcgctggtggtactcgtcccgtggtcgcctcgcgagcgcacacatttttggtgaatgtgacggtacagtaccaccacacattctacagggttacagtttacacttgtcgccgccgccgccgcctggcggtcgtccacttcttgatgaggcaggtgatggccctggacaagccgcttggacttggacctgctcagccgcgccgggcgggcttcttgccctcgctgccctgctcnggacgcccgtcttccccnccggcctcctccctggggtttgctgcttgctgctnccctcctccctccttgttcctngntggcgccggcgggccttggctgggcaaacctcccaaggaagctcccaaccccggt

SEQ ID NO: 8820 - DNA, 1561 bp, Triticum aestivum
  Clone ID: PAT_TA_8820
gaattcggcacgagcaaacaaacgccgtccgcttccccacctctcccgtccccggtccggtccaccaaccgcctccaggccgcaaccatgcacggccgccgccatctggcggcctccctggcgagaaccctgtcccaggccccctcccgctccatctcctccaccccgtccctcctccaaaccctcgacccgaccccgcagtcccctcccctcgccgcgcccgcggcggggcggctcgcggagatgcggaggcggctgcaggcggagacgccgtcactgggggacttcgcgtactcggtggaggtggggacgcggaagaagccgctgcccaagcccaagtggatgaaggagacgatccccggcggggccaagtacgcggccatcaaggccaagctgcgggagctgaagctgcacaccgtctgcgaggaggcgcgctgccccaacctcggcgagtgctggtcgggcggcgagaccggcaccgccactgccaccatcatgatcctcggtgacacctgcacacgcggatgcagattttgcaatgtcaagacatcacgaacccctcctccaccagatcctaatgagcctgccaatgttgcgcaagctattgcatcgtggggccttgaatatatagtcatcacaagtgtggaccgggatgatttacctgatcaggggagcggccattttgctgaaacagtacagaggttgaagactttaaagccagatatgcttattgaagcgcttgtgcctgatttccaaggagatcgaagttgtgtagaaaaggtagcaacttccgggttgcatgtttttgcacacaatattgaaacggtggaagagcttcaaagaagtgtgcgggaccaccgtgcaaattttaagcaatcaatggatgttctgaaaatggcgaaggagtatgcccctcctggcaccctcacaaagacatcagtcatgctgggttgtggggagactcccgatcaggttatcagcacaatggaaaaggtgcgagctgctggtgttgatgtcattacatttggtcagtacatgaggccgtcaaagcgacatatgccagtgtctgagtatattacacctgaagccttcgagaactaccgcgcccttggtgttgaaatgggattccgttatgttgcatctggtccgatggttcggtcctcctacaaagcaggcgaattctacatcaaagccatgatcgaagatgaccgagcaaaatcaggtgctgttgcagaatcaagttcctagttgacacacctccagtcattgacatggctacgctgcaaataagatgttctaattggagaaacatgtttgtctttttacatcttggtaaaactgatattctttttgagagaataaattcttctgcttcttcacttcaatttattatttacatctcttcatactatctcctcctttgtactcctttatgtggcgataatcatccatcctcagttgtaacagtagcagggatagagtccgtcaatgtaccccaccgaaaataatgaggggccattaatgtgccccaaaaaaaaaaaaaaaaaaaaaaaaaaaaaaa

SEQ ID NO: 8821 - DNA, 907 bp, Triticum aestivum
  unsure (1)..(907): unsure at all n locations
  Clone ID: PAT_TA_8821
acccggcccgcgacctgtttggccgccacaatcagggcgtctgtgcgggcctcctccctccctcgccccgccccccttgggcctgggcggacccccttcattcgcggcccccccctcgaggggtcattccccgtcctcccccctggcctggaccactcctagccggtgctgggcccccgccgggtcctcccggcgcgcccgggtctcccactccccccctgccgccgtgttctgtctgtcacctcatcatttccccccggtcctccgcgaccttctgcgagctgcttggcctcggtttcgacgtctccgcctggtctcgagtccgcgtctcgcccgcccaccaaaagcctcactatctaggcaaacaccatattgtccaatggctggtgacaacaaacgcggagtagcgcattgagcagaacatttcacattttcacaacaagtctgaaacacaacaagcctgaaccagaattcaacaatgttatgacggcactcccaggagtcgacacccctcctacttctttgttttgtcataaacctcaatatatctcttcggaacaccgtgatggtcaacgaggtgctttgcaaggttttcaatgactccgccttgaatcaagacctcatgttgcccccttttacctggaagctcagctcccggggggctccaaggccatcacgcacctgttcctgccgccaactcccctcccctaaacggcgagcgtccctctccgaagcctccggccgtcggctggctcccctgccctcgttcgctcgcggtgggctcggtccgtatcgggcccttccggacgaatccctcctcccccctagctccgncatgcaccaccacccatagaatnaanaaagagctctcantctgtcaatncttgctatgtntggacctgnnaag

SEQ ID NO: 8822 - DNA, 546 bp, Triticum aestivum
  Clone ID: PAT_TA_8822
ctacgtgttccgggggagcaaggagatctccaaagagcagattttggatcagcttgggttatcaggcggggggcggccagggttcccaaagatgacacagcagccaggcgtgcaacaggtcaatgggatgcatccattagtcacgacaggggttaacaggttcttgctcccggtatcagagtgcgagtgcacgctcagcacgctgctggacgagttgcagcctgaccagtggccggttgaggctggcaaccgtgccatcaggtgcacgggtgttgcgctaaatgtggcggctgggttgcttggggcatgcgtgcctgggactggtgcaaggattattgcgctacttggcgggccatgtaccgaaggtcctggagtgattgtatcaaaagatttgtctgagccagttagatcacacaaggatcttgataaggatgcggcgcctcatttccagaaagccgtcaaattttacgatggccttgccaaacaactggtcagtcaagggcatgttctagatgtgtttgcatctgctcttgatcaggttggact

SEQ ID NO: 8823 - DNA, 2730 bp, Triticum aestivum
  unsure (1)..(2730): unsure at all n locations
  Clone ID: PAT_TA_8823
ccaagcgcccatagaacagaacaggaaacagcccgcaggcgcagctctccacctgcctcccctcctctctcccctccgatccacccgctcccctcccctctccgatagctgctcgccgcgctcaatcatggcggccgacccctccgcggctgcggcgcccgccgaccccgatggcccggacgcggtccgcttcacatggaacgcctggccccggtccaaggttgaagccagccgctgcgtcgtcccgctcgccgtcgccatctccccggtccgctcccccgagtccctcgcgtcaccgccccttccctacccgccactccgctgcgtgccgcctccgtcggcccccatttgttcaggttttcaataacagtccagatgaaacagcctatttccgaatgttactcaaccgagagagtctcactaattcagttgcaatgattcagccgtcattaatttcattttctttcgattcacctccttctcctgtattcctcgatgtggcatcaatagcagtagatcgtatactgctgcttgatgcatacttcagtgttgtcatcttccatggaatgacaatcgctcagtggagaaacatgtgttatcagaatcagccggagcatcagcaattcgcacaattattacaagctcctcaggaggaggcccaggtgataataaatggtcgatttccagttcctcgactagttgtctgtgaccaacatggctcccaggcaaggttcttgttagcaaaactgaatccatcggccacatataattcagcacatgatgttccaccaggttctgacatcatattcaccgatgatgtcagcttccaggtcttctgtgagcatctacaaaggctggctgttcagtcgtaaggaaatgcatgcagagttgtactcccaaattgattgttactagctattcgacgtttgtttacctatctggctcgctcatagttttgactgtctttttggccatgtgtcttttcatcatgaattctacttccttctggaaataaacgtaaaaaaaatcattagtgcgctacttggcgggccatgtaccgaaggtcctggagtgattgtatcaaaagatttgtctgagccagttagatcacacaaggatcttgataaggatgcggcgcctcatttccagaaagccgtcaaattttacgatggccttgccaaacaattggtcagtcaaggtcatgttctagatgtgtttgcatctgctcttgatcaggttggactagctgagatgaagcttgctattgagagaacaggcggccttgttgtcttatctgagagttttgggcattctgtgtttaaggattcttttaaacgtattttcgagggaggtgaacattcattgggcctgtcattcaatggcacatttgaaataaactgttcaaaggacattaaagttcagggtgttattggaccgtgtacatctttggagaagaaaggagctttatgtgcagacacaattgtcggtcagggaaacacaacagcatggaaaatgtgtgggcttgataggaatacttcacttacagttttttttgatgtctcaccgagtgaacgctctggccaaccaggtcatcaaaatcccgatttgtacatacagtttgtaaccagttaccaacacccggaaggtcaaatgagaataagagctactactgtatccagaaaatgggtggatggttctaccaataccgaggaactagtcgaaggatttgaccaggaaactgcagctgttgtgttggcaagatacatctccttgaaaatggaaatagaggaagagtttgatgcaacacggtggctcgatagatctctcatacgactatgttcaagatttggggattatcggaaggatgacccctcttcatttagcctacattctaatttctcactgtttcctcagtttatgtttaatctccggcgttcgcaatttgttcaggtttcaataacatccagatgaaacagcctattccgaatgttactcaaccgagagagtatcactaactcagttgcaatgatccagcctccttttatatcatttccttctactccctccctctctcctgcatctcgagatgcggcaacgagcggagcagatcgtatactgctacttgatgcgtactttagtgttgttattttccacgggatgacaattgctcagtggagaaacatgggttatcagaaccaacctgagcatgagcaatttgcacaactattacaagcaccacatgaggaggcacagatgataataaagggtcgatttccagttccaagactagttgtctgcgaccaacatggctcgcaggcaaggtttttgttggctaagctgaatccatcggccacatataactcagctcatgatgttgctccaggttctgacatcattttcaccgatgatgttagcttccaggtcttctgtgagcacctacaaaggctggctgttcagtcgtaaggaaatttatgcaaaagttgtacaccctaattgataggtgctcgcaatgcgccgtgtgcttacctgcctggcgcgctctccctttccgctccccttggcccagttccctgttcatcctgttttcggcttctcctaaggaactgtaattccaagtcgcttgcccacataaaagaaaaactattagttgcaaaaaaaaanaanaaaaaaaaccnggggccggacaattnccaanggncnttacccccaggcgtnttaanccgnggaaac

SEQ ID NO: 8824 - DNA, 795 bp, Triticum aestivum
  unsure (1)..(795): unsure at all n locations
  Clone ID: PAT_TA_8824
cggggtttttttttttttnntttttaaaaagggaaccagaactnctttcngacagcacnagcatcaacaacatgattatttcccaaaattttncaaattccggggagacagcggaaaaattacccagctttgcttttacatacaacacctaatgcctcagacttgcgttgcgctctcacaggtaacaacagctactacttcccaacccacgtaacgtaaactttctcccaacaaggcaataatttacaactgtaatctgagcatacagatttgcatttgttgtttgcgccctgtcggtgacccaaagacgccgtttctcgtccagctcctagccttgccttgcctccttcgcctcctgaatccccacacgacgccctcgccaccgcgatgcgaccatgcgtagaaagaaaagagaatcatcatctgctctcacatgagccacccttcatcctcaccgctgctgaaggactcaatcatgtcaccactctcatcaccatccccgccacccatcatctccagcaagccccctcccacatcaaagtcaccttcctcatcgtcgtcatcgttttcatccccgctgtccatatcctcctcgtcttcatcgtcaccgccatcatcaccgctgctgttacttggatcatcctcagaatccgtgtccccaagccctaaatcggtcccgaggaggacatccacgtccgagtcgtcgtcgtcatcatcctcatcctccgtgtcccctccatcctccgggtccgagtcatcatcagttggtcgtttcctgccaactcggacgcgtgg

SEQ ID NO: 8825 - DNA, 957 bp, Triticum aestivum
  unsure (1)..(957): unsure at all n locations
  Clone ID: PAT_TA_8825
ttgttctgttggcttttcttctggggtgcagccttgggcatctcgtgctgagcttcttccgggcacccaacccggtgccaggaggttcagcaccagggaagtatgatgagctggagcagccctttctcctctgttgtcctcatcgtgaatctccaccgtccggtcttcgaagcacttgcggccacgcggcgctgtggagctcttcgtgctgatgtagtgagctccacccgtccccaacgtggctgctctgttccctcggatacggaccacctgttgccgcgttgcgtcactgctgacgtctaaatgatttaactgacaaacacataattgaagaaagactaaggcttgtgtctggtcatatatgatacctagactgaaacgctgttctgatggcaaaacatcctgtgtgaagccttgggcaactagtgctgactatctacagggcatcgaaatcgatgccaagagtttcatcatcatgaaaatcagatgagcatgagcaaccctatctccagattagtctacatcctgaatttcaaccatccagacttggaagtacattcggccatgcttcgcagtggagtacttcgtgctgatgcagtgatctccactcatccccaacgtggctggactgttcccacggatagggaccacaaatagcagctttgcatcaggactgacatagaaaccaccctgtacatcccagccttgtcctccatttgttgtgaactctctagattagcgccttgcccattttttgatttgctgttctgtttccgccaagagatggttcttacactttagtaagttacaacagaaagatcttcnttggataactaaaatttttgatacctttctcctctattgacttggcatttcatttgcatttgtttggtacctgctgcttctttgctctcaatattttgaccacttgattcactttcgattcctttctctttg

SEQ ID NO: 8826 - DNA, 709 bp, Triticum aestivum
  Clone ID: PAT_TA_8826
tttttttttttttttttttttttttttgaacttgaagctttgacgtgacaaaaaaatactgtcgcatctaatagcatagttttatgctttttactaacacactgacgtgaaaagtaatggccaatggcaaatctccaggtgtcaattctaaaatggcatcaatttacgaaagtgagattagcatttttcgacgaccatattgtcctgtgaattctgaaccattgaagtctgcaactcttcatgtcatactcctcctatctcttctgtgaacattccatcacagacacaaaactgcggagaaaggatagtgtgtgcaagttctaatggaagaggcagagaactaccatataatacagctacgagttgggaaacgacagttaataagatcagaacaagagcagttttgcgcttgcttgctaggaagccgcctgcgctgcctgatcccatagcttcttcctaacgatcaagactctttcatcatctgacgaaagtgcgtctctctttggtttcaccctcagatgaccagtcgtcccatctcagcgcgggtagaagcttcttgatgtagtctatgacagcagctttgtccctgatgatggcgtacccatgaggcctcatgatgcggtccatctcgatcagcagatcttccaggccacagccttgattctccatctcagagaacaggagccacgcgtgaaggaggtcgtaggta

SEQ ID NO: 8827 - DNA, 1490 bp, Triticum aestivum
  Clone ID: PAT_TA_8827
cgtccgcggacgcgtccgcggacgcgtggtgggagaacttgtaaacctgaagcggaagcaagcaaggagcgcctgtgaggcagcgatgtctggccttggtggactcgggagcatcggcgggggcggcaacggcagaagccacggctcggggggcaaggccaagctgctcgcgctcggcaagggtctccctgaacaagttctaccccaggagaagctcgtcgagacctacctccaggacaccagctgcgacgatcccgccaccagggccaagctcgaacgcctctgcaagaccacaacagtgaggacaaggtacactgtcatgtcgaaggagctcctggatgaacacccagaattgaagacagaaggcactccaacattgacgccacggcttgacatctgcaatgccgcggtgcttgaacttggtgctgctgcagctcgtgccgcccttggtgagtgggggctgtccggcagctgatattacccacctggtctacatctcctccagcgagcttcgcctcccggggggtgatcttttcctggcaacccgtcttggcctctctccaaacacagtgcgcacatcccttctcttccttggctgctcaggtggtgctgccgccctccgcactgccaaggacattgcagagaacaacccagggagccgtgtccttgtaatagcggcggagacaactgtgttgggcttccggccgccaagccctgatcgtccttatgaccttgttggtgctgctctgtttggtgatggtgcatcagctgcaattattggagcaagccctatcaaagcagaagaggatcctttcttggagcttgagttctcaacccaggagttcctaccagggacagacaaggtaattgatggcaagatctcagaggaagggattaacttcaaactggggcgtgatttgcctgaaaagattgaaagccgcatagaaggcttctgcaggatactcatggacaaggttgggataaaggagttcaatgatgtattttgggctgtgcatcccggtggaccagcaatattgaacaggctggaggtttgtcttgaacttgagccagataaactcaagatcagtagaaaggccctgatgaactatgggaatgtgagcagtaacacagtcttctatgtgctggagtatttgagggatgaattgaagaaaggggcaataagggaagagtggggattgatcttggcttttggcccaggcatcacatttgaaggactgctagttcggggcattaactgaaattgaaggagatccaagtaggttactaccagatatatggaaaggtcacaaacaagctttacatggcacggtagcatttcacaattataattatacagtgtaaggatagcaattcgcgactataattatatactgtaagaatatcataagcatagcgtcttgatgatttctgttcactacatactcagtactttgtaattttatgctttatgctatcaattatcaaacaat

SEQ ID NO: 8828 - DNA, 761 bp, Triticum aestivum
  unsure (1)..(761): unsure at all n locations
  Clone ID: PAT_TA_8828
aaatttatnccaaaatgggcatatatgctaagtnaagaagaacagtacaatgatacattgagcttatatagcatacaaaaggcaggctatgtagacttttttcttcttcgttttaattattcatagattcagatatagaccggacatgttctacatacatagtacatgacttagttggttcatcctgatctactctcatacgatatggtagacaaaagatagcactcggcgtacataaggaccttgatcgccgtcgtgccttcctgttgcctcttgacttaatcaattgcctacggcaaggagcataaaaattattaggagctcttcctttcccgtagtatgaacatgacgccgctgccttgcaccttgatgcgccgccattgcgaccagccaattaaaaggaggtacctatttgtatctaagcccttatgatgtgcagcaagatgaccagccacgacctagaggtcgataaatttagtcaagggacatataccctttcgattacttcctatgttatcaaaggggacatggatgcggaggtgattgacatgctgaagatgcataatggattgactgatgtaaaataacgcccctctcgccacaaacccccattactttgagcatgagggattttcttaggcctgaaatgaaaaaccacacatggcatgctctatttctcgcctctggcttacctnctccaatgcaacaaatagataggcaatctgtaggtcatcggcaattagtacgacgacatccttgat

SEQ ID NO: 8829 - DNA, 775 bp, Triticum aestivum
  Clone ID: PAT_TA_8829
tataacatgtccttatgaaattaaggagttgatccctcttcttcttgtttttgctctttcgtctgacataaaatcattaccacacaattcattcccagctgtctagttaaacaattaagagaattttgtaaagttctgcatcgaaactcaggtaaataaacctgactggcacaacatggtaaattccggcaaccatgcggcaatttaatcttaataagtccgatgtagaaaagttacagaatatatcacctatctacccagatgatctatgctttatgtcgcctctataacttgtcccagcaattcattcactgcagagcggcgatctatgatttcggtcagtttgatttgttctctaaggagcctcgccacctgctgggtccagctccttccttgggtactctacccagtgtacatgtatttgcaacgcgtttgttgtatggcaatatcagttatatatctggggtaaatccacttgccccggatatataagtatcatgtgtgtttgtcgtggcccttcaacgatttgacgatgctcatcaagaactgcttttcgccacggtatatctcaagcaatgagaagcccaggcacatgatgcctatcgccatgtgaatgggaagggtctgcttgaacctatttctattcagaaacaccctctcggagaaagctgtggtcgcaccagaaatgagcagaacgccccagcccgctggcaagcagtggcgaaaggagaatgagcccttaaaatactcttcgatgaatattgcagaatatgag

SEQ ID NO: 8830 - DNA, 703 bp, Triticum aestivum
  unsure (1)..(703): unsure at all n locations
  Clone ID: PAT_TA_8830
tgtgttctttaaacctcagggcctcctcctcatacaaacttcatcaccgttaacttgtttaaacttaggatacaaaataaagctggcactgaagtatgatgataattactacagtagttggccatactcagcgaaatggtcccatccccaccgtttccacttccaaatcacaaaagcatcaacgagcccatggaatatacaaaatgccagcacagagagccgagacatgtctgttccgtcaatgccatcaaacaaacaattctcagcaaatgatgtagaccatcatcttcagtccccccttgtttttcatcagctcgaagaggcagatgtccccctcccgcaggccgttctcgctcgcaaaagaagtccagcctccgcttatcctcagggcacctttcttgtcgcgcatcttgccatgccatctttggctcttcccctccagctgaagctccaaattatggcctccttgtcgaaggtacttggcagtgtactctgtcccaaaggttagtgagacgcggacattggtctttgtcatgactgccacgtaaatgggcagatctgacgcaatggctccaactttctccaaaactatcttgtcctgcacttccgttagtccggcacccattgccatcatgtanggggttctgtaccatcatgatcagggtacttctcactttatccgatgttcgtcatggcccgaaga

SEQ ID NO: 8831 - DNA, 781 bp, Triticum aestivum
  Clone ID: PAT_TA_8831
tttttttttttttttttttttttgacgggaaattgggcggggggcatgtcatctaaagtagttttcaaaatccccaaacaaaagactgagttgcaaacaaattacgggtattcaaattttcatattgggacaacgacttgagtaaacaagagctatgcaaaggacaagttttgacccttattgctagcagtataaccggaagaccccgtactaatacttctttgcttcaggcttgcaattcaccaggtttcttcaattgtacgtgatactgactttcaccccaccgttgtttgtgctgattgtccgaattctagggccccttaattgtaagaaatggctgtggattgattggcaccgtaacaatgaaccgctgcattggctttaggatcacactaccattgccagcagagggggtgagctgcaccttctcccccccctcacagaagaagagcaacacacaatcatcctcgaagacccggttatgcgcagtgatttgaccatgcacgttgatggtctgaaatgtatcgtcaccaaagaggcggaggctgacctgcacatggacccccaagccttcctccatcaacacatatgacacaacaaggcggcggccatactttgttgtgataagagcatcttcatgcttgacatccacacatgggtaatctccaaaaactagagtagcagtgtcaataacaccacgtctgcttatctcagggatttcaattgtcatgcgactaaaaccgaatcctgagatagtttcgaatggccctgtgagcaccaa

SEQ ID NO: 8832 - DNA, 682 bp, Triticum aestivum
  Clone ID: PAT_TA_8832
gttacagcggctgcgatgcaaacagcagttccacctgcacaagcaccagcatctcagattgaagcaccgcatgcgacttggccagcaccttcatctcaccttcaaacaaggcaattctgtttaacacagcccaccgagatttagacagtgtattcactcgtgcaaggccgcttcacgcttccattgcccaggggtaccaacctgctactacctcccatccgagcgcggacatggaacgtggggttttgcgtgcacccagagcttggacttccttctcaccgtgatgccgaaggtctccgtcatgtccatgtcttcggccccgacgccacagggcagctcccagtcgaagtggaaaaggaggctagcgagcgccagctccatgttggccatcccgagcgccgtgccggggcacatcctccgcccggctccggaggggggcaacgcggagtcggcgcccttgaaacccacggtgctctgcgccgcccccccaccctctcctcccccccctccgcccccgcgtgctcatcctcccccggggcccctgcgctcgccgccgcccgcccccccggcagctcccgcggctctccccgtggctccggcagcgcccccgccgggggcggcctcggtgcctccctcctcactggctggagatagcccagcctcaccttggacgatgtcctct

SEQ ID NO: 8833 - DNA, 2709 bp, Triticum aestivum
  unsure (1)..(2709): unsure at all n locations
  Clone ID: PAT_TA_8833
gacgagcaatcctaagcggcatctccgaaagcgtttttccccctaagttttcggtgccccctcgtgcaaaagaatagatgcctcctctccatagagaagggaatcgcagaactgacacttaccccatatcctgcatgttttttttctaccctctggggtactcaggaatacggacatggtttcttttgaccctgtattttcagcccatcggttaacggcgcgtgtttcgctaactcacgtcggctccgtcgttatgtatgtaccgcaggagcaaattctgctacggttggtccgtttgtataagctcatcgcacacccggttaccagcttgttatctgtaaattagtaagtgtaattccctcttacactataaaatatgttgacatggggaggaacatatttacttagttatatcatctgctattgccagagactctagacgtgcctcaaaccaaatcatatacttccttgagattggtaactaaccagaatcccccaccaacagccgtatatgaaaatttcatctcgtacggttcaagctgaaccacaaaaattttcaacgaatattagaaaaaggttcaaaacttcatcagcaactaaattgggtcgatttgccttgaagagatcaattaagaaaactaaagaatcccctctatgtgatgatgatgccaaaacatcttaacttcccggccctttctttcttcctttcccttatgttggtcgtttgaggcttcttgacctttctcttccctatacaggatttgttttttttgcataacatagaaattatcttgttgagatcctatgaatcagttcaattaaaaccttagcttcatactagacccacgttgattcagtctcaagcttaacaccagccaagggttcttcgaataagacccgctggattatccttggtcgcggccgaggtatgactcgacaaaatcgagagaaaaaaagttgtcttttgggcaaacaaaattggaaggaagaaaatttcttttttatttttatttaagaactacttgaatttttcagtctggttgcgaggtcttaatagtgagtatgaatcatagttccatttttttttgatccactctatctatttcgtgttccagatactagaataaataatatctgacgaattagaatcatcttgatagagataacaggccctttctatgtattatcaataggatcaattctaacaagtcacacactcatattccagagataccgaaacaaaaaaattccgcggtcgaactaccataatatctagaaatgtagatcttaaactagaaaggcttttttggatggaaaaactctgacttcctagttttagttagtagaaacctaattggttaaaattccgtccagtaaaacggaagaattataaatttctaaaatgatagataggaatatagcgaataaagccattgcgacccccataaaaggagtagtcccccaacccggggcgactttcccatattccgaattcaagggtttcagtaaactacctgcaccagttcgttttggcctaggtttagaactatcttcaacggtttgtgtagccataaattctatttaatcattggtgttgactttgtatactattccggttgtagttgtaagtacacgatcttttcgccgatccattgtaatccttgaaattctttaaaaatggaaacagcaactttagtcgccatctccatatctggtttacttgtaagctttactgggtatgccttatataccgcgtttgggcaaccctctcaacaattaagagatccctccggccgactccgagacttaatttaagtaagaagtccccctatctgggagacttcgtccgcggacgcgtgggttttattcttttagttggagttggtggaaccttaggtggttctcggaagaagatagcgaaaaaaattatccctaaagtcgaaactaaaaggaacgtataaaccaatgcttccatagattcgatcctggtttatttacaattataacttccacacctattcatttgtcatttgggataatttcccatataaagaaagaaaaagagtcaaagaaaggatgggagatgtttcccatgtcaaatcaaaaaagagaggtgaaagatactataacaatgtgtatcaggctgcctgtttccttgtagttggatctcccactttttggaatgttccaaattccacttgagcatccaaatctggatcaataccagcaaaaacatctcggaacaatgttctagcgccatgccaaatgtgtccgaaaaagaagagcaaagcaaaggtagcatgaccaaaagtgaaccaaccccttggactgctgcgaaaaacaccatcagatttcaaagtagcccggtctaattcaaaaatttcccctaattgagaacgcctcgcatatttttttacagtagcaggatcagaataacttactccattaagttcgccaccatagaactccaccgttacgcctacttgttcaacactatatttggattctgctcttctaaaaggaacgtctgctctaacaattccctcctcatctaccaaaacaaccgggaaatgtttcaaaaaaagtaggcatacggcgtacaaaaagctcacgtccttctttatctctaaagacgggatgtcctaaccatccaacagctattccatccccattgtccattgagcctgctcnaataatcctcgtgccgaa

SEQ ID NO: 8834 - DNA, 700 bp, Triticum aestivum
  unsure (1)..(700): unsure at all n locations
  Clone ID: PAT_TA_8834
tatttaaagtatgagtaacatacatncaagtaaaatgagnaacaattcattcatgcacagtcatcattagcatacggatgtccctttcagaaaaacgataatgttgagccttcatgtattggctctatctagcacacaatttttgcggtactttaaggtaacaacgctgactatttattctcgtacatgttgtgcaagacttgttgcctcatatgacttgtagttggaggttagggcatccaactttatacttgtgcttgttgaacaactcctgcagagccatcacaaatttttcgtgcacttcatttatctcatccattgtaggttggttatttttcgttacttcaataggtcttccaacaaacacatgcataggcaaccgaaatggtatgaaggttccgaatttaccccagaagacaattgcgggagctttgagtaatccagcaatcttaacaagtaaattacttccgggtctccaccaattgtaaacacgatcttgtccaaagcagaacactgggactaaagggcaaccagtttgaatggctattcttacgaatccttttcttgatctaatgaaagcaacttctgagtcagattcatgatccatatatcgcatctcacgcaggcctcctggcacaacggcacaactatagccggctccgagatagtagggagaagttctttctcgatgccggaacta

SEQ ID NO: 8835 - DNA, 1455 bp, Triticum aestivum
  Clone ID: PAT_TA_8835
ggtctaaataccgggcccccccctcccatcccccctctcccccgactccctctccccctctccccccgtccgtccgccccctccgcctctccgtcctcgcgggcggagggcatgccggccaagggcgagcgggtggtccaacccgggggcaggctgataccctccgccccggcggggggctctctgtccctcgctgcgtggccgctctgcgtccaggcggccgggagctcctcggccaactccgccaggcccctcccgagcccgcgagcgccgtcccgcctcttgggcaggctggggcacggcaggttcggccgcatgctcgcgaacatccgccgggaacccggcgtgcacgccgacggcatcgttttcgaaccgcggtcgcggccactgtccgcccctgcgaggcaccgcgcctggctgccgccgctcgttgctgtgccagcctcgacgccagcgcggtcgtgttcttcgccgacgcccgagccccatttcgacgtcatcaaagggggctgcagtcttccactatggatcaataagcttgatcgccgagccttgccggacagcgcatctgcacgccatgaaggttgccaaagaggccggcgcgcttctctcgtaatgacccgaacctgagggaggcattgtggccctcccttgaggaggctcgcaccaagatcttgagcatctgggaccaggcagacattgtcaaggtcagcgaggtcgagcttgagtttttgactggcatcaactcggtggaggatgatgttgccatgaagctgtggcgccctaccatttaagctcatgcttgtcactcttggagatcaaggatgcaagtactatttccaaaggatttccgtgggtactgtcccatcctacaaggtacagcaagttgatactgacaggtgctggatgatgcatttataggttcttctgctgccgttaaagtgtccatgatccatcggcattgcaagaaaaaacagagattgcaggggcgatcaaatttgccaatgcatgtggagcaatcacagccacgaaggaaaggggcaatcccgtaaatgccggaaaaacacgaggtgtcgaaggaagatggagaaggcgggaggacgcggattacgattacgaagtagcttattactctacaaatcgtattgtaagaggttttggatcaggagcaaggtgtcctagttgcatgatgcacttgccctagtgtttgcttccctttatggtatggttctcgttatggaattcttttcgttttagtaagcagattcttcaacctagccataaatggaatcttgatccataaattcggcagtgtgcttttttccttgttctgtcatcttatttgggttccaactgtattgggaatttgtggtttagcccctgaggtggtttctgttctcaattttcgacaagcgaaacgcatgtacaacgctgatatttgaacgtgccaaaaaa

SEQ ID NO: 8836 - DNA, 650 bp, Triticum aestivum
  Clone ID: PAT_TA_8836
tttttgtgcgaattaataatggcgatggatacaggtatgtaggcataaattagcagctgggggtagtgctatcaaataacctctgacaggcttaaggaacagtttttatccaaaccaggcagtgtaaattataaagtacatgtattctgaaccatggaatacaccctgagacaaatagtattaagaaagcgcaaacccacaacgatgtgactcgatgctggggtgcagcgaggccgaagatgcagacaccgtgcgtgcagctccttccgctaggcctccagcacgcgcacgccgtggttatccagtccagctggttgcttctgccaagtcggctgttatatcacacgtgtgtagtaggcagagactggatgaatttgtcttagcaatccaaacgaaaagcgcacgattggtgagtttacttgctgctctccagcagcagggtcctttctaattgctacatggagtccatgactttctttctctcacaacaagaagaatcgtggttaatgccttgctctttttgtctatcttctcaaactggccaaaggacagctatactctgtcttgttagaaacatcttcaactttctctagagcttccatcatcatagcttcaacaccatatcatttttttcctcattgtactaatgg

SEQ ID NO: 8837 - DNA, 690 bp, Triticum aestivum
  unsure (1)..(690): unsure at all n locations
  Clone ID: PAT_TA_8837
ggttgggaaacaaanaacttgcccaatgtggaaagggcagaactaaaccatgtaaacttgaagatggacacatctgccggagtgacggcggccatgggagccggaagatcacaagagatcgaccttttgggtggtctaatacttcctatatgggcacantagaaaagccactacctgatatttattgtacctcaccttcgctcctggttggcggggaacccctcctggtcgagcccctagcccccaccttggtagctgcctggagaggaggatagctcgaggacaactcccaatgtgccgaggagatgggaacatgataagccgacacctaataaggatcaggagaacaacagatatgctaagagacaaccttttggggttaaggatataaacaacaacatggcttatgaggccgaagagagctcgagtggcgtcttttggttcttgaagacctgcacgttcgtggtggagtagagcaaaataatttggaggctttaaagctactgcacttcatgtagttaggatcaattctttgttttagtttgaaatattccccaattcctcctatttgattgattcatctgatggtcatttgtcaggcaaataaacanaaggcatatgtattgttttgagtgaagccatccatacaagtcgatatattaattatcccatatgtggaattcaagatat

SEQ ID NO: 8838 - DNA, 951 bp, Triticum aestivum
  unsure (1)..(951): unsure at all n locations
  Clone ID: PAT_TA_8838
attggctcatcggcccatcagaggctgtcaatgctgagaagcgaacttggaaatcagctcgctaacaagagtcggaatttgaatctgagaagcacaaccctcttgatccaactaggaacatcaaaaccaaatgggaaatcattgagtggacttcagatggccatgcttacgacaaggaggcggggtggggggagggggtcggtcgtggagggaggctcgcctgccggagcagcaggaacaaggaggcggggtcggccgtggaatatttagctggatgtgcgatctcttctgccgctacgtcttcgttcgactcgccaagaaatggtcttctatgttacgaaccccaatatggcatctcgccattccccacgatccacatgttaagtatggatttatttaatgataatttgatatcaactgccttttcttcaggataatctgacacctaataaggaccaagagaacaacaaagattctaaggggcaaccttttgggtttaaggatataaacaacatgtcttatgaggatttgaactgctgttcttttagttccactcttaaatgttttggttcttgaaggcctgcactttcctggtggagtaggagcaaaataatttagaggctttaaagctgctgcactttagtagttaggatcaattctttgttttggtttgaaatgctcctcaattcctcctatttgattgtatccaaaggacatgaaatatattcagaaagcgtcagttttgtattctgtgtgtgctttcactatctccttcaaaatttcatgatattntcgggtttataaagggctatctcacaagcacttgatagcaagagaattactccatgacattgcctcaattgcatgtaatggctattctccaaaataagattgntgcttactttgcttaccaccatctcatnccaggccctctagctatagtcatggaaa

SEQ ID NO: 8839 - DNA, 681 bp, Triticum aestivum
  Clone ID: PAT_TA_8839
gggggacatgctccctccacatctcacatctcgcagcttgaactgagagcaagagtagaaacccataagatgagacgcaagcaaaatatgcatgaaaatggcacaatcatgattcagtttggtcagcaagtgcctaactgcgagtcctcagctagcgattctcctcaagaagtgtccgggatgagtgaaggaagctttaatgagcagaatgatcaatctggtaatcgcgatggctacaccaagagtgatgaaggcaagatgatgttaacttctaattgggggactaggttgatgccctgtctgatgagaatcttttgggatgcacgggcatatgcttccaccactatatacaatgagtacaacatttaacatgggcatgatgttaaattagagtgaatctaagggcctactgggtgcataatctgtggctaaattattttagattttttgtgtgtgtgcgaggagcagttctactacctcttcatggttcgtcatttacatattagttggatgatatctctttattctgttgttgtgactgaccagctgcttacttatatggataacttgaactgaaagcaagagtagaagcccatgagatgagacacaaggaaaatatgcatgttattttcaattctaatgtttcagttccatattctcctacttgactggatatgtgat

SEQ ID NO: 8840 - DNA, 910 bp, Triticum aestivum
  Clone ID: PAT_TA_8840
cgtccggaaaggggagaggagaggagagggaggtccggcatcggacgagagagggtgaccggccggcgtcggcctacaccggcgaggcgtcggcctgcgcccctcctcgcgcacgaaccctagcttgagagacaaaatgagggggagagagagaagggaggagagaaggtagaaaaagagaggaaagaggaaagggaggtgtggcggctgacaggagagagggtcatcggccggcgccggagaggacgggcccgacgattacgaatggtactggagtttgcctatcttttttgattttttagttctgcttagttgatggcctcacgtaatgtgcctccatggatggagctttccgggtctgccttgttgaatgttctaccatggatggagcttttgctgataccctttctgaataactgatatttattgtacctcatcttcgctcctggttggcggggaacccctcctggtcgagcccctagccccccaccttggcagctgcctggagaggaggatagctcgaggacaactcccaatgtgccgaggagatgggaacatgataagccgacacctaataaggattaggagaacaacagatatgctaagagacaaccttttggggttaaggatataaacaacaacagggcttatgaggccgaagagagctcgagtggcgtcttttggttcttgaagagctgcacgttcttggtggagtagagcaaaataatttggaggctttaaagctactgcacttcatgtagttaggatcaattctttgttttagtttgaaatattccccatttcctcctatttgattgattcatctgatggacattttgtcaggcaaataaacaaaaggcatatgtattattacgagtgaagccatccatactcccatgtggaattcaag

SEQ ID NO: 8841 - DNA, 679 bp, Triticum aestivum
  Clone ID: PAT_TA_8841
gagagagagagagagaaacggaaacagagacagagggagaggagacttgcagaggagaggagagaagaggcggaacaagggaggagggaggggtcgccggaagggggacatgctccctccgcatctcacatctcgcagcttgaactgagagcaagagcagaagcccatgagatgagacgcaagcaaaatatgcaagaaaatggcacaatcatgattcagtttggtcagcaagtgcctaactgcgagtcctcagctagcgattctcctcaagaagtgtccggaatgagcgaagggagctttaatgagcagaatgatcaatctggtaatcgcgatggctatacgaagagtagtgatgaaggcaagatgatgtcggctttgtctctgggcaattcagaaatggcatacacaccgccaaaacctgaccgcactcatccctttgccatatcatacccatatgctgatccttactatggtggtgcagtggcagcctatggcgcacatgctattatgcacccccagatggtgggcatggtaccatcctctcgagtgccgctaccgattgaaccagctgccgccgaagagcccatttatgtgaatgcgaagcaataccatgccattctccgaaggagacagctccgcgcaaaattagaggctgaaaataagctggtcaaaagccgta

SEQ ID NO: 8842 - DNA, 2688 bp, Triticum aestivum
  Clone ID: PAT_TA_8842
tgttatttgaagtatgcactacagatattgcaagtctacttcagtaatgctgtggcatgccgcaaaacaaccacattttgctgctgtgatttggtccatcctgtgcatttcagttcctggtgatctccaatgtttgtcagctaatgccaccaggagggctgcccacccaagacttgtaatgtgggcatcggtactgtcctttgacatatttggaagtcactgtcgtttcaactccgtcaggtgccaggccaaggatgttactcatcgctgctgtgaagaccttgcggatctctggacaaacaaccacaatgggagcattgtttggtgcagcactaacaatagccactacaatgaccagtgaagctacaaattaacagctggagcaaggaaaaggaccttcgagagtatggaactgcgctcctgggtaggagggggaccccgagtgggcgaacgcgtagcggccaacgggagcaggtagcaagggaggcaggaggcagcggcaagggggcagcggtcgccggaaggggcgcatgctccctccacatctcacatcgcgcagcttgaactaagagcaagagtagaagccaaagagatggggcgcaagcaaaaaacaaagaaaaattggacaatgatgattcaggctggtcaggaatctgctagctgtgagtgcgctgctcgtgattctcctcatggggtgacaggattgagcgattgtaacgttaatgagcagaatgttgattccgataactctaggttgctgcatgaagagtgaaggatgcaagctgatttgagttttgtctctggggaacttcctaaaaaagcacaaacacatgcaaaaacgtgtccgcactcatcactttctccatatcctaaccatatcctgaatcttaatatggtggtgcagtggcagcctacggctcacatgctattatacaccacgacatggtggtcatggtaacatcctcttatgttgcgctccaaatggcaccggcaagatctaaagagctgacatatatggaagcacagatttccattccgataatctgaaatctaaacagcaccgcaacatcaagagatgtacaaagaggcctcctggtgggtttagagttacaccaaacttggcgtcaggagaataagaatgcggttggtttagttccagtcctgaatcttttgattgttaaagtgctgcactttcctgcgggagtgggcccgcaatcactgagaggattttacgccgctcgattttgggaatgggggcaagttctcggaagcgctttcaaaccttaccgtcccgttacttccagatcggggccggctggggggcgtttgtcgggcctattccccctagcaatatgtccttgtgttagtggcgccttgcatgcacgtcaattcagtcatattctaatgtgcaacttactagatattcagcaatgttacttcggggttttgtagatagcccgtggtctatgggaatggatgcggctgcagcagattacgagatttataggtttgttattgacgagaatggtgacgcctaataaggatcagggagaacaacagatatgctaagcaggcaacattttggggttaaggatataaacaacaacatggcttatgaggccgaagagagctcgtagtggcgtcttttggttcttgaaggcctgcacgttcctggtggagtaggagcaaaataatttggaggctttaaagctactgcactttatgtagttaggatcaattctttgttttagtttgaaatactccccatttcctcctatttgattgattcatctgatggacattttgtcaggcaaataaacagaaggcatatgtattgttttgagtgaagccatccatactcccatgtggaattcaagaaatagagaaatgttattgttaaaagctaatgcacttcacgtagttaggatcaattctttgtttcggtttgaaatactccccagttcctcctatttgattgagtcatctgatggacattttgtcaggcaaatattaggcaaaggatatgtaccttttttttaatatagaagggtctaattcttatcgtgtgtacttgctcgaacaaaagattattgaaaatatgtatattccaaaccaaaaaaaaaaaacaaaaaaaaaaaaaaaaaatggttgcttgacccacatgtcctataaatgatgttattattggaaacatgtgactccatgtaaacctattactactagcaccatgattgctcgccgatatagagaaatgttattaccacactacaggactttctaggataagtatgtcattgcatctaaaggttctgcgatctcctgtgttactgcatcttgatcttgtgctttgctataactctgttctgatgcttgagggacaaccaagatcaagaatccggaatccggctcgattccggcttctatggtatttctgtgtgccttgaccccagctccatgcttattaatcaatttagcgagctttaggacttagaaagttttcatttagaggagcatgagtttttggccaagatggcatccaaatacgaactacattatgtctgattcttaaatttaatgctctcaattcttgcatgaacattttggtgccctctttttggggttgaagattggaaatgcatgtgaactacattttttaaagcaacaccattatggaagaagttttgctcc

SEQ ID NO: 8843 - DNA, 748 bp, Triticum aestivum
  unsure (1)..(748): unsure at all n locations
  Clone ID: PAT_TA_8843
ctcactgtgattccctgagatgcattgtccataggcaatgcactttctaataaaatatggcggtaaccttgaaaagactaatttatctaagctacaaaaacatgttgtttatgttccttgcttttgcaaatactccctccgtccggaaatacttgtcctaggaatggttgtatctagacttagtttagttatagatacatccattttatccatttttaggacaagtatttccggaaggagggagtagtagtttatggtgtgcactttagtctatatctgtcatgcacccatctggactataaataggaccctccaccaccacttgctagcaagtactacatcatacagcaacagacaccatggatctacttctgctactcatctcgcttcttatggtgagtgcaacaatcattttttaattggatagtttctttctgtgcagcgcatccgcatacaaagtgcttacatatgtagttagttagttaattagttagcttgggtgttcatgtgtgtttgccacgaatagcttatctatgttgctcgttctgatgcatgcaggtcactacaggatagtgaatctggcttgcgagttttgtcgatgcggccatgactgcgatgccaaactctgaggagataccaaaggtgtactgggataatcttggtgtgctttgtttctgtatgatctaaaactacaaggatctngttcagttcagatgttctggaatgagtacgaatcttactatatctg

SEQ ID NO: 8844 - DNA, 1390 bp, Triticum aestivum
  unsure (1)..(1390): unsure at all n locations
  Clone ID: PAT_TA_8844
gccttctgcgtcgtcttacgccttgtagcacgctgcagcctgcagccggagtggcagctagggttgaggcggagggtggagctctgccaaagatccgaccccctcgcacgcggcacagccaaaccctaaccacctgatcccaatgcgcaggggcctcagcagcgagacgtcgctgcgccggcaccgcgcacgggcgcggntgtgggtcgccgtcgcggcgctggttaccggcaccatctggctctggtcctcctcctccgttgtcctcttcggcacccacagggtccaggattttgttgtagatgagttgtggagaactgcagattcaaatggttggagagcatcttctgcaccacgcacctattggcctcccccaccaactgaatccgagagcaatgggtacttgcgtgtccggtgcaatggcggcttgtcccaacaacgaagtgcaatatgtaatgctgttgttgcagcacgaatcatgaatgctacactagtgctgccagagttagatgcaaattcattctggcatgatgagagtggttttgtagatatgtatgatgttccccacttcatcaagacattgaaatatgatgttcgaattgttatgagtgttccaaaaatcactgcacatggaaagtccaagaagctcagatcttataagattgaaccacctaaagatgcaccagttacttgttacaggacaactgcgctggagaagttgaggatgaatgatcgttatatttaaccccggaaggtcgccccacgcgtggcacgcgtccgcccacgcgtgacgcgtgggtgcctctgttcacagctccgcgcaaaattagaggctgaaaataagctggtcaaaagccgtaagccgtacctgcatgagtcccggcaccagcacgcgatgaagcgggctcggggaacaggcgggcggttcctcaacgcaaaggagaagtctgaagcttcaggcggcggcaatgcatcagcgaggtctggccacgccggcgttcccccggatggcggcatgttctcgaagcacgaccacaccttaccatccggtgacttccattaccgcgcgagagggggcgcctagggtgggcacgcagttgccccctggcaaatcatccttggcttatgtgtgtggcgaatgaccgtcaactcggtccagtgatattgtaaaactgaatttagagtctgtgcaattgtgttacttgggggtttggtagacagcccttgtgtttggggaggggacgatgcagctgcagctgcagccggttctcttgttgtggtaggtttgtgtggcatggcaggtgctgctaagctggagcctgcttgaactgttttcctgtcactttgttgtttggggtaataatgaccatcttgtatgatattagtactg

SEQ ID NO: 8845 - DNA, 942 bp, Triticum aestivum
  unsure (1)..(942): unsure at all n locations
  Clone ID: PAT_TA_8845
gaattcggcacgagctagtgcgtccatcctctgcggaattcggcacgtgcctactcccccccaccttttcagcattaactcatctgttggctcaggcgtggccatggccgtcgtcgtctgcgtcaccggcgccggcggcttcatcggctcctggatcgtcaagctcctcctcgcccgcggctacgccgtccgcggcacctcccgccgcgccgatgaccccaagaacgcgcacctgtgggcgctcgacggcgcggcggagcggctgacgatggtgcaggtcgacctgctcgaccgggccagcctccgcgccgccttccacggctgcgacggcgttatccacaccgcatcaccgatgcacgacacccccgaggagatcatcgagccggtgatcaccgggacgctcaacgtggtggagatggccgcggacgccggcgtccggcgcgtggtgctgtcctccaccatcggcaccatgtacatgaacccccaccgcgacccggacgcgccgctcgacgagtcgtgctggagcgacctcgactactgcaaacaaaccaagaactggtactgctacgccaagacgatcgcggagcggggcgcgtgggaggcggcgcgggcgctggggctggacctggcggtggtgatcccggtggtgacgctcggcgaagctgctgcaagccgaccatgaacaccaagcaccaaggcacatactcaagtacctcaccggcgaagccaaggcgtacgtcaacgagtcgcacgcctacgtgcatggtcaaggacgccgcccaaggcgcaagtcaagggtgccccgaggcgcccgcccccggccgacggccccctcgttctgcgccgtattccccccttgcaaccgccggcgaagctctgcccggattctccgcccggcttctttcccgggagtaacccgattcccacaaagatgttaaggan

SEQ ID NO: 8846 - DNA, 565 bp, Triticum aestivum
  unsure (1)..(565): unsure at all n locations
  Clone ID: PAT_TA_8846
ccggccctgcttttttattaattnaagatacaagaatcttggaataccagtttttgcaaatccataagcaaaagataaaccatacggctaagtacaaagtactccccaacaagtaaatgtacagatagactgccaatagatagaagaaaccatcagctcctcatatattcactgcacgcatcaacgtaacaattcggtggaggactggttcttaggggaggctcctagaggaggaggtgctgctgacgggaggagctcctggatgagtcggtgctgcttgaggaagcgagcaagtagacgatggcgggggagctggtcgtggtgctgcccggagagaaagtttcgggaggcagcattgaggcgcggcggaggttgtctgggagcggcgacttgggtcggggaaggaagccgacgcttgatgtggcagaggttaaggaggaagcggcgaagggtgctcgccggtggatgaggaggttgctagggcactccggtcaggtggctgggcggcggcggcgccggggaagaggaagggggcctcgggatgagattcgatctgtgccgattc

SEQ ID NO: 8847 - DNA, 682 bp, Triticum aestivum
  Clone ID: PAT_TA_8847
cgtccgcccacgcgtccgacacccggggtctccccatcatcttctccgtcacacctaccagcagaggagaggagagggatctctccctccgcctccccatccccatccatggcggcgccgagctggatccggctgccgcgcgccaccataatcctgctcctgctcgccatccacctctccctctccctcgccgcccagttcgaggggttcgactccgacgaactgccctccgccgccgccgccgacgtcgcgtcctccgacgatgacgacgagggcctcgacatcgacctcccgccccctccgcccatcaccgtctccgtctccgctccttcccctcccgtgaccaccaccactgccgcaaaccctaacctcacccccaaccccacggtcacgcccccgaatcccactccctcgctcgacttctgggacgaggacgagttcgagggcatccccgttccagaagcggcagcctccggcgactcctccgcgccggccgagtccgccccgtcagatccctccgccgaggaagcggccgaggcggcgccggccacgccaaggggccccgcggagctcatccgcgcgttcgccggcgagatcgcgtgcgtcagcttcctgatctgcttcgtgctcaactacttcaccgggaagcggcagaacgaggcgatcgcgcttgcctgggcca

SEQ ID NO: 8848 - DNA, 927 bp, Triticum aestivum
  Clone ID: PAT_TA_8848
cgtccgccaaaccaaaccaaaccgcaggcaggcaggcgcacgcccaccaaccaaataacaccacacgcctccttcccaccccaccccgcccccctcgccgacgtcactcgccaccgtcgtcggagcggccctcgctccctccctcctcgccgcccccccgcctccccgctcgctccgccccccaaagttatatgctggccattggactactcggtggaggaatacctaaaaaggagttacttgtaaattttctgctgcatccaattcctcccatatattttttctggcattggcaagaatgtcagaaagtgagttatcagtaataaaaccagagtcgttgaagacttatatttggcttcagtgctttgatggatccatacagcaagtggaggaagaggttgccatgttctgccctatgatatgtcgagaaattgtcaaaaatggaacaggatcatccaaaaatcatgctattgctctcccagaaagagttaatccatcaagtttgagtttgattcttgactattgtcggtttcatcaagtcccagggcgctccaacaaggagcggaagtcatttgatgagaagtttgttaggatagacaccgaaaaactttgtgagctgacatctgcagctgacagtcttcaattaaagccattggttgatcttactagtcgagcacttgctcgaatcattgaagggaagacacctgaggaaatccgcgatatttttcatttaccagatgacttaacggaggaagaaaaattggagccactgaaaaatataaacgatgatcccaggattcgcttattgaatcgattgtatgcaaagaaacggaaagaactacaggagcgccagaaactaaaggatattcaggtacagcaagagcaaaaggatgagcggtctttggacgagttactttgttttataaa

SEQ ID NO: 8849 - DNA, 762 bp, Triticum aestivum
  Clone ID: PAT_TA_8849
cgtccgcggacgcgtccgcggacgcgtgggcgactagccagtgtagctccatcttccgctcctgtctctcatcggtacttggcggtcgagaaggcgatcgatggcgccatcgttcgtgtggtcgaggcgcgcgctggtcgtgatggtggtggtggcggcgcagtcgtcggaggcggcggcgaggagcggcggggccgacgaagacgagcttcggttcccggggttcccgggcggcaggccgcgcaaccctggcttcccgggggtgcccgggggcagggtagcgtctcccccagcgtctcgcttcaagccgtcctcgccgccgccgtcgccgccgccgccgcagccgtcacccgctgttagtgctccagcgtgcgtcagcagcggggcgccttcgcagccggcgctgcagccgctgcccgggttcccaggcctgcagcagccgggcaacggcggcgggtcggcgtcgtcgccggcggactgcgtgacgccgctggcggggctgatgacgtgcgcgtcgttcctgacggggagcgagccggacaccccgacgccgcagagcgagtgctgcagcgggctgggcatgttcctcaacagcacggcggcggtggacgaccgctcgctgcggtgcctgtgcccggtcatcctcggcgacgtgaaccgcatgctgcccaagcccatcgaccccgttcgcatgatgtacctccccatctcctgcggcgtcgtcctcccccctcaagtccttttcatctgcttcactggaca

SEQ ID NO: 8850 - DNA, 1133 bp, Triticum aestivum
  Clone ID: PAT_TA_8850
cgtccgcggacgcgtggcgtccgcccacgcgtcggccgccccgtcggcgactagccagtgtagctcgatcttccgctcctgtccctcatcggtacttggcggtcgagaaggcgatcgatggcgtcatcgttggtgtggtcgaggcgcgcgctggtcgtgatggtggtggcggctgcgatggtggtggcgacgcagtcgtcggaggcagcggcgaggagcggcggggccgacgaagacgagcttcggttcccggggttcccgggcggcaggccgcgcaaccctggcttcccgggggtgcccggaggcagggtagcgtcgccgccagcgtctcgcttcaagccgtccacgccgccgccgtcgccgccgtcgccgccgctgcagccgtcacccgctgctagtgctagcccaccgtgcagcagcggggcgccttcgcagccggcgctgcagccgctgcccgggttcccgggcctacagcagccgggcaacggcggcgggtcgccgtcgtcgccggcggactgcgtgacgccgctggcggggctgatgacgtgcgcgtcgttcctgacggggagcgagccggacaccccgacgccgcagagcgagtgctgcagcgggctgggcatgttcctcaacagcacggcggcggtggacgaccgctcgctgcggtgcctgtgcccggtcatcctcggcgacgtcaaccgcatgctgcccaagcccatcgaccccgtccgcatgatgtacctccccatctcctgcggcgtcgtcctcccccctcaagtcctcttcatctgcttcactggacagccaacgccacccgtggtctcgcgcatccccgactcctggatgacgccagcttcatcagcattgacaccttgattgatgccaaccggaccagggattcagatacaattaactatctcaagttaatttatgcctattggcaaatgatgctatatgtcttgaattcagatgcagtcatgaagaaaaaaaataggctgcatcacctgtgccggaaactagtaaccaacttaccatacagctgacctagattggtcagtgcatcatgtgccttgtaagagatgtacttttccattgaaaactatacatatataaaagaccagattgtatttaaaaac
